United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 21

SEQ ID NO: 859616 - DNA, 17 bp, Homo sapiens
atcccaactgtcttttt

SEQ ID NO: 859617 - DNA, 23 bp, Homo sapiens
atcccaactgtctttttttccct

SEQ ID NO: 859618 - DNA, 15 bp, Homo sapiens
atcccacagtggcac

SEQ ID NO: 859619 - DNA, 23 bp, Homo sapiens
atcccacagtggcacggagagaa

SEQ ID NO: 859620 - DNA, 13 bp, Homo sapiens
atcccacatccaa

SEQ ID NO: 859621 - DNA, 22 bp, Homo sapiens
atcccacatccaactccagcaa

SEQ ID NO: 859622 - DNA, 14 bp, Homo sapiens
atcccaccagcccc

SEQ ID NO: 859623 - DNA, 15 bp, Homo sapiens
atcccaccccctcct

SEQ ID NO: 859624 - DNA, 16 bp, Homo sapiens
atcccacgcactccat

SEQ ID NO: 859625 - DNA, 14 bp, Homo sapiens
atcccactgactgt

SEQ ID NO: 859626 - DNA, 14 bp, Homo sapiens
atcccactggaaga

SEQ ID NO: 859627 - DNA, 18 bp, Homo sapiens
atcccactggatctggct

SEQ ID NO: 859628 - DNA, 12 bp, Homo sapiens
atcccacttcac

SEQ ID NO: 859629 - DNA, 13 bp, Homo sapiens
atcccagaaatta

SEQ ID NO: 859630 - DNA, 23 bp, Homo sapiens
atcccagaggtgggatcctccct

SEQ ID NO: 859631 - DNA, 17 bp, Homo sapiens
atcccagcactttggga

SEQ ID NO: 859632 - DNA, 19 bp, Homo sapiens
atcccagcactttgggagg

SEQ ID NO: 859633 - DNA, 17 bp, Homo sapiens
atcccagcagcccaagc

SEQ ID NO: 859634 - DNA, 23 bp, Homo sapiens
atcccagccctttgggaggctga

SEQ ID NO: 859635 - DNA, 24 bp, Homo sapiens
atcccagccggccaatggaaacct

SEQ ID NO: 859636 - DNA, 14 bp, Homo sapiens
atcccagcttgccc

SEQ ID NO: 859637 - DNA, 18 bp, Homo sapiens
atcccagcttgcccccgc

SEQ ID NO: 859638 - DNA, 19 bp, Homo sapiens
atcccaggcttcaccctga

SEQ ID NO: 859639 - DNA, 12 bp, Homo sapiens
atcccaggggac

SEQ ID NO: 859640 - DNA, 20 bp, Homo sapiens
atcccaggggaccacacctc

SEQ ID NO: 859641 - DNA, 23 bp, Homo sapiens
atcccaggggaccacacctccct

SEQ ID NO: 859642 - DNA, 18 bp, Homo sapiens
atcccagtcactcctctc

SEQ ID NO: 859643 - DNA, 23 bp, Homo sapiens
atcccagtttaatattccaatac

SEQ ID NO: 859644 - DNA, 17 bp, Homo sapiens
atcccatcattttccat

SEQ ID NO: 859645 - DNA, 21 bp, Homo sapiens
atcccatcgtctcggccttca

SEQ ID NO: 859646 - DNA, 15 bp, Homo sapiens
atcccatctctacaa

SEQ ID NO: 859647 - DNA, 13 bp, Homo sapiens
atcccatctctcc

SEQ ID NO: 859648 - DNA, 16 bp, Homo sapiens
atcccatctctcccac

SEQ ID NO: 859649 - DNA, 22 bp, Homo sapiens
atcccatctctcccacttcctc

SEQ ID NO: 859650 - DNA, 16 bp, Homo sapiens
atcccatgaacacact

SEQ ID NO: 859651 - DNA, 18 bp, Homo sapiens
atcccatgaacacactgt

SEQ ID NO: 859652 - DNA, 15 bp, Homo sapiens
atcccatgtatttat

SEQ ID NO: 859653 - DNA, 16 bp, Homo sapiens
atcccatgtcacctca

SEQ ID NO: 859654 - DNA, 17 bp, Homo sapiens
atcccatgtcacctcag

SEQ ID NO: 859655 - DNA, 19 bp, Homo sapiens
atcccatgtcacctcagct

SEQ ID NO: 859656 - DNA, 13 bp, Homo sapiens
atcccattcttta

SEQ ID NO: 859657 - DNA, 14 bp, Homo sapiens
atcccattgccctg

SEQ ID NO: 859658 - DNA, 16 bp, Homo sapiens
atcccattgccctggt

SEQ ID NO: 859659 - DNA, 13 bp, Homo sapiens
atcccatttcttg

SEQ ID NO: 859660 - DNA, 15 bp, Homo sapiens
atcccattttcatcc

SEQ ID NO: 859661 - DNA, 20 bp, Homo sapiens
atccccaacatgcactgatg

SEQ ID NO: 859662 - DNA, 12 bp, Homo sapiens
atccccaactcc

SEQ ID NO: 859663 - DNA, 14 bp, Homo sapiens
atccccaagtgtga

SEQ ID NO: 859664 - DNA, 13 bp, Homo sapiens
atccccaccccac

SEQ ID NO: 859665 - DNA, 15 bp, Homo sapiens
atccccaccccaccc

SEQ ID NO: 859666 - DNA, 13 bp, Homo sapiens
atccccagagccc

SEQ ID NO: 859667 - DNA, 23 bp, Homo sapiens
atccccagccagggagcttgcca

SEQ ID NO: 859668 - DNA, 12 bp, Homo sapiens
atccccagccta

SEQ ID NO: 859669 - DNA, 17 bp, Homo sapiens
atccccagctttctcct

SEQ ID NO: 859670 - DNA, 13 bp, Homo sapiens
atccccagggaca

SEQ ID NO: 859671 - DNA, 12 bp, Homo sapiens
atccccagggca

SEQ ID NO: 859672 - DNA, 14 bp, Homo sapiens
atccccagggcagc

SEQ ID NO: 859673 - DNA, 23 bp, Homo sapiens
atccccaggggtcccagccaccc

SEQ ID NO: 859674 - DNA, 22 bp, Homo sapiens
atccccagttttccatggtgta

SEQ ID NO: 859675 - DNA, 16 bp, Homo sapiens
atccccatcggccctg

SEQ ID NO: 859676 - DNA, 15 bp, Homo sapiens
atccccccatcttgc

SEQ ID NO: 859677 - DNA, 15 bp, Homo sapiens
atcccccccagcctg

SEQ ID NO: 859678 - DNA, 16 bp, Homo sapiens
atcccccccagcctgg

SEQ ID NO: 859679 - DNA, 17 bp, Homo sapiens
atcccccccagcctggc

SEQ ID NO: 859680 - DNA, 13 bp, Homo sapiens
atcccccctgctc

SEQ ID NO: 859681 - DNA, 15 bp, Homo sapiens
atcccccctgctcag

SEQ ID NO: 859682 - DNA, 17 bp, Homo sapiens
atcccccctgctgccca

SEQ ID NO: 859683 - DNA, 18 bp, Homo sapiens
atccccctcctctccctg

SEQ ID NO: 859684 - DNA, 19 bp, Homo sapiens
atccccctcctctccctgt

SEQ ID NO: 859685 - DNA, 21 bp, Homo sapiens
atccccctctcacgccacccc

SEQ ID NO: 859686 - DNA, 13 bp, Homo sapiens
atccccctgtgga

SEQ ID NO: 859687 - DNA, 15 bp, Homo sapiens
atcccccttaaagaa

SEQ ID NO: 859688 - DNA, 17 bp, Homo sapiens
atcccccttaaagaaaa

SEQ ID NO: 859689 - DNA, 24 bp, Homo sapiens
atcccccttaaagaaaattgcatg

SEQ ID NO: 859690 - DNA, 16 bp, Homo sapiens
atccccgacagtggct

SEQ ID NO: 859691 - DNA, 19 bp, Homo sapiens
atccccgacagtggctctc

SEQ ID NO: 859692 - DNA, 14 bp, Homo sapiens
atccccgcctggcc

SEQ ID NO: 859693 - DNA, 17 bp, Homo sapiens
atccccgcctggccagg

SEQ ID NO: 859694 - DNA, 21 bp, Homo sapiens
atccccgcctggccaggagca

SEQ ID NO: 859695 - DNA, 22 bp, Homo sapiens
atccccgcttccccttgccacg

SEQ ID NO: 859696 - DNA, 15 bp, Homo sapiens
atcccctctcaggag

SEQ ID NO: 859697 - DNA, 23 bp, Homo sapiens
atcccctctcaggagagtgtgca

SEQ ID NO: 859698 - DNA, 18 bp, Homo sapiens
atcccctttcctccccac

SEQ ID NO: 859699 - DNA, 20 bp, Homo sapiens
atcccctttcctccccacct

SEQ ID NO: 859700 - DNA, 19 bp, Homo sapiens
atcccgagcacctccacat

SEQ ID NO: 859701 - DNA, 17 bp, Homo sapiens
atcccgagtctgggaca

SEQ ID NO: 859702 - DNA, 13 bp, Homo sapiens
atcccgcttagcc

SEQ ID NO: 859703 - DNA, 14 bp, Homo sapiens
atcccgcttagcct

SEQ ID NO: 859704 - DNA, 16 bp, Homo sapiens
atcccgcttagcctgc

SEQ ID NO: 859705 - DNA, 16 bp, Homo sapiens
atcccggaggaaatct

SEQ ID NO: 859706 - DNA, 16 bp, Homo sapiens
atcccggcctcttcca

SEQ ID NO: 859707 - DNA, 17 bp, Homo sapiens
atcccgtatcacagtgt

SEQ ID NO: 859708 - DNA, 18 bp, Homo sapiens
atcccgtgcccctttcct

SEQ ID NO: 859709 - DNA, 13 bp, Homo sapiens
atcccgtgttctc

SEQ ID NO: 859710 - DNA, 12 bp, Homo sapiens
atccctacatgt

SEQ ID NO: 859711 - DNA, 15 bp, Homo sapiens
atccctacatgtatt

SEQ ID NO: 859712 - DNA, 14 bp, Homo sapiens
atccctacccccta

SEQ ID NO: 859713 - DNA, 15 bp, Homo sapiens
atccctactgtaatt

SEQ ID NO: 859714 - DNA, 13 bp, Homo sapiens
atccctcacctgt

SEQ ID NO: 859715 - DNA, 13 bp, Homo sapiens
atccctcatctgt

SEQ ID NO: 859716 - DNA, 22 bp, Homo sapiens
atccctcccctctctccctggt

SEQ ID NO: 859717 - DNA, 18 bp, Homo sapiens
atccctcggaagccgtct

SEQ ID NO: 859718 - DNA, 23 bp, Homo sapiens
atccctctaatgagactgaccat

SEQ ID NO: 859719 - DNA, 18 bp, Homo sapiens
atccctgaggactgattt

SEQ ID NO: 859720 - DNA, 20 bp, Homo sapiens
atccctgatcccattttcct

SEQ ID NO: 859721 - DNA, 17 bp, Homo sapiens
atccctgccactgggct

SEQ ID NO: 859722 - DNA, 20 bp, Homo sapiens
atccctgccactgggctctg

SEQ ID NO: 859723 - DNA, 16 bp, Homo sapiens
atccctgcccagcctg

SEQ ID NO: 859724 - DNA, 12 bp, Homo sapiens
atccctgctctg

SEQ ID NO: 859725 - DNA, 17 bp, Homo sapiens
atccctggagcaggagc

SEQ ID NO: 859726 - DNA, 18 bp, Homo sapiens
atccctgggcattgcttt

SEQ ID NO: 859727 - DNA, 13 bp, Homo sapiens
atccctgggcccc

SEQ ID NO: 859728 - DNA, 15 bp, Homo sapiens
atccctgggcccctc

SEQ ID NO: 859729 - DNA, 17 bp, Homo sapiens
atccctgggcccctcca

SEQ ID NO: 859730 - DNA, 21 bp, Homo sapiens
atccctgggcccctccacgcc

SEQ ID NO: 859731 - DNA, 13 bp, Homo sapiens
atccctgttcatt

SEQ ID NO: 859732 - DNA, 17 bp, Homo sapiens
atccctgttcattgtaa

SEQ ID NO: 859733 - DNA, 22 bp, Homo sapiens
atccctgtttaatatttaaaca

SEQ ID NO: 859734 - DNA, 18 bp, Homo sapiens
atccaatgtcttttgaca

SEQ ID NO: 859735 - DNA, 20 bp, Homo sapiens
atccacaatgagatgcatga

SEQ ID NO: 859736 - DNA, 16 bp, Homo sapiens
atccacacacagagga

SEQ ID NO: 859737 - DNA, 23 bp, Homo sapiens
atccacacacagaggaagagcag

SEQ ID NO: 859738 - DNA, 12 bp, Homo sapiens
atccacataaat

SEQ ID NO: 859739 - DNA, 20 bp, Homo sapiens
atccacatctttactcaggc

SEQ ID NO: 859740 - DNA, 18 bp, Homo sapiens
atccacatgtttcagagc

SEQ ID NO: 859741 - DNA, 18 bp, Homo sapiens
atcctaagatgtgttctt

SEQ ID NO: 859742 - DNA, 12 bp, Homo sapiens
atcctaagctat

SEQ ID NO: 859743 - DNA, 14 bp, Homo sapiens
atcctacaagacac

SEQ ID NO: 859744 - DNA, 19 bp, Homo sapiens
atcctacaagacacagtga

SEQ ID NO: 859745 - DNA, 13 bp, Homo sapiens
atcctacccagcg

SEQ ID NO: 859746 - DNA, 16 bp, Homo sapiens
atcctactgagcattt

SEQ ID NO: 859747 - DNA, 16 bp, Homo sapiens
atcctagagtcttaaa

SEQ ID NO: 859748 - DNA, 19 bp, Homo sapiens
atcctagccttatcctctg

SEQ ID NO: 859749 - DNA, 20 bp, Homo sapiens
atcctagccttatcctctga

SEQ ID NO: 859750 - DNA, 21 bp, Homo sapiens
atcctataagatgacaatgtt

SEQ ID NO: 859751 - DNA, 17 bp, Homo sapiens
atcctatatctgtttgt

SEQ ID NO: 859752 - DNA, 19 bp, Homo sapiens
atcctatatctgtttgtat

SEQ ID NO: 859753 - DNA, 19 bp, Homo sapiens
atcctatcaacaacaaggt

SEQ ID NO: 859754 - DNA, 16 bp, Homo sapiens
atcctcaaagaaagtg

SEQ ID NO: 859755 - DNA, 18 bp, Homo sapiens
atcctcaaagaaagtgta

SEQ ID NO: 859756 - DNA, 21 bp, Homo sapiens
atcctcaaatcagtcttcctt

SEQ ID NO: 859757 - DNA, 18 bp, Homo sapiens
atcctcacgccttggcct

SEQ ID NO: 859758 - DNA, 21 bp, Homo sapiens
atcctcagaggctgagccctg

SEQ ID NO: 859759 - DNA, 22 bp, Homo sapiens
atcctcaggtagtactgggaat

SEQ ID NO: 859760 - DNA, 15 bp, Homo sapiens
atcctcatccctgac

SEQ ID NO: 859761 - DNA, 14 bp, Homo sapiens
atcctcatcttgga

SEQ ID NO: 859762 - DNA, 15 bp, Homo sapiens
atcctcattgcctcc

SEQ ID NO: 859763 - DNA, 16 bp, Homo sapiens
atcctcattgcctcct

SEQ ID NO: 859764 - DNA, 12 bp, Homo sapiens
atcctccacaga

SEQ ID NO: 859765 - DNA, 15 bp, Homo sapiens
atcctccacagagag

SEQ ID NO: 859766 - DNA, 19 bp, Homo sapiens
atcctccacgttctgctca

SEQ ID NO: 859767 - DNA, 20 bp, Homo sapiens
atcctccagtaccttgcttc

SEQ ID NO: 859768 - DNA, 13 bp, Homo sapiens
atcctccccttcc

SEQ ID NO: 859769 - DNA, 19 bp, Homo sapiens
atcctccccttccctgcaa

SEQ ID NO: 859770 - DNA, 16 bp, Homo sapiens
atcctcccgcctcggc

SEQ ID NO: 859771 - DNA, 22 bp, Homo sapiens
atcctccctacttccaagaaaa

SEQ ID NO: 859772 - DNA, 17 bp, Homo sapiens
atcctccctccacctca

SEQ ID NO: 859773 - DNA, 18 bp, Homo sapiens
atcctccctccacctcaa

SEQ ID NO: 859774 - DNA, 14 bp, Homo sapiens
atcctccctccccc

SEQ ID NO: 859775 - DNA, 14 bp, Homo sapiens
atcctccctgccca

SEQ ID NO: 859776 - DNA, 23 bp, Homo sapiens
atcctcccttgccccaggccagg

SEQ ID NO: 859777 - DNA, 15 bp, Homo sapiens
atcctccgtccagcc

SEQ ID NO: 859778 - DNA, 16 bp, Homo sapiens
atcctcctcagccccc

SEQ ID NO: 859779 - DNA, 17 bp, Homo sapiens
atcctcctcagccccca

SEQ ID NO: 859780 - DNA, 22 bp, Homo sapiens
atcctcctcagcccccaggcca

SEQ ID NO: 859781 - DNA, 17 bp, Homo sapiens
atcctcctgcccagctc

SEQ ID NO: 859782 - DNA, 15 bp, Homo sapiens
atcctcctgcctcag

SEQ ID NO: 859783 - DNA, 20 bp, Homo sapiens
atcctcctgcctcagccttc

SEQ ID NO: 859784 - DNA, 21 bp, Homo sapiens
atcctcctggaaccttgctgt

SEQ ID NO: 859785 - DNA, 14 bp, Homo sapiens
atcctcctgttctg

SEQ ID NO: 859786 - DNA, 16 bp, Homo sapiens
atcctcctgttctgaa

SEQ ID NO: 859787 - DNA, 12 bp, Homo sapiens
atcctcctttca

SEQ ID NO: 859788 - DNA, 16 bp, Homo sapiens
atcctctattttgtga

SEQ ID NO: 859789 - DNA, 12 bp, Homo sapiens
atcctctctctc

SEQ ID NO: 859790 - DNA, 15 bp, Homo sapiens
atcctctcttcctct

SEQ ID NO: 859791 - DNA, 12 bp, Homo sapiens
atcctctgatct

SEQ ID NO: 859792 - DNA, 14 bp, Homo sapiens
atcctcttcctctg

SEQ ID NO: 859793 - DNA, 14 bp, Homo sapiens
atcctgaaatttca

SEQ ID NO: 859794 - DNA, 20 bp, Homo sapiens
atcctgaactttctccctca

SEQ ID NO: 859795 - DNA, 15 bp, Homo sapiens
atcctgacatattca

SEQ ID NO: 859796 - DNA, 24 bp, Homo sapiens
atcctgaccagctgctccgaggac

SEQ ID NO: 859797 - DNA, 12 bp, Homo sapiens
atcctgagccat

SEQ ID NO: 859798 - DNA, 24 bp, Homo sapiens
atcctgagccatcggtgaaactaa

SEQ ID NO: 859799 - DNA, 14 bp, Homo sapiens
atcctgagcccaac

SEQ ID NO: 859800 - DNA, 22 bp, Homo sapiens
atcctgagcccaaccaggccct

SEQ ID NO: 859801 - DNA, 12 bp, Homo sapiens
atcctgagcccc

SEQ ID NO: 859802 - DNA, 22 bp, Homo sapiens
atcctgagccccgccctcttcc

SEQ ID NO: 859803 - DNA, 13 bp, Homo sapiens
atcctgaggccag

SEQ ID NO: 859804 - DNA, 12 bp, Homo sapiens
atcctgataaac

SEQ ID NO: 859805 - DNA, 18 bp, Homo sapiens
atcctgatggacctgccc

SEQ ID NO: 859806 - DNA, 13 bp, Homo sapiens
atcctgattccaa

SEQ ID NO: 859807 - DNA, 17 bp, Homo sapiens
atcctgcagcctcctcc

SEQ ID NO: 859808 - DNA, 19 bp, Homo sapiens
atcctgcaggaacgagcac

SEQ ID NO: 859809 - DNA, 23 bp, Homo sapiens
atcctgcaggaacgagcactggc

SEQ ID NO: 859810 - DNA, 19 bp, Homo sapiens
atcctgcagggcttctcct

SEQ ID NO: 859811 - DNA, 11 bp, Homo sapiens
atcctgccccc

SEQ ID NO: 859812 - DNA, 16 bp, Homo sapiens
atcctgcccccaagtc

SEQ ID NO: 859813 - DNA, 15 bp, Homo sapiens
atcctgcccccgccc

SEQ ID NO: 859814 - DNA, 13 bp, Homo sapiens
atcctgccctgca

SEQ ID NO: 859815 - DNA, 14 bp, Homo sapiens
atcctgcctctccc

SEQ ID NO: 859816 - DNA, 12 bp, Homo sapiens
atcctgcctgcc

SEQ ID NO: 859817 - DNA, 16 bp, Homo sapiens
atcctgcgggtggggc

SEQ ID NO: 859818 - DNA, 15 bp, Homo sapiens
atcctgctagcaggc

SEQ ID NO: 859819 - DNA, 16 bp, Homo sapiens
atcctgctagctgtag

SEQ ID NO: 859820 - DNA, 19 bp, Homo sapiens
atcctgctcttttgtgatg

SEQ ID NO: 859821 - DNA, 22 bp, Homo sapiens
atcctgctgaaagtcctgcttt

SEQ ID NO: 859822 - DNA, 14 bp, Homo sapiens
atcctgcttcagtg

SEQ ID NO: 859823 - DNA, 19 bp, Homo sapiens
atcctgcttctcttttcct

SEQ ID NO: 859824 - DNA, 18 bp, Homo sapiens
atcctggaaggacacagt

SEQ ID NO: 859825 - DNA, 20 bp, Homo sapiens
atcctggaaggacacagtga

SEQ ID NO: 859826 - DNA, 19 bp, Homo sapiens
atcctggaggtcttttcta

SEQ ID NO: 859827 - DNA, 16 bp, Homo sapiens
atcctggattcactca

SEQ ID NO: 859828 - DNA, 19 bp, Homo sapiens
atctcaaattctcaaccta

SEQ ID NO: 859829 - DNA, 14 bp, Homo sapiens
atctcaaatttcta

SEQ ID NO: 859830 - DNA, 14 bp, Homo sapiens
atctcaagccagcc

SEQ ID NO: 859831 - DNA, 15 bp, Homo sapiens
atctcaagccagccc

SEQ ID NO: 859832 - DNA, 21 bp, Homo sapiens
atctcaaggggcccagcctcc

SEQ ID NO: 859833 - DNA, 14 bp, Homo sapiens
atctcaatctgcag

SEQ ID NO: 859834 - DNA, 14 bp, Homo sapiens
atctcacttccaga

SEQ ID NO: 859835 - DNA, 15 bp, Homo sapiens
atctcagaaagtgcc

SEQ ID NO: 859836 - DNA, 20 bp, Homo sapiens
atctcagaaagtgcctgaca

SEQ ID NO: 859837 - DNA, 20 bp, Homo sapiens
atctcagaattccttttcta

SEQ ID NO: 859838 - DNA, 18 bp, Homo sapiens
atctcagatacttatgaa

SEQ ID NO: 859839 - DNA, 20 bp, Homo sapiens
atctcagatcagtgtaccat

SEQ ID NO: 859840 - DNA, 19 bp, Homo sapiens
atctcagcaaagctacagg

SEQ ID NO: 859841 - DNA, 15 bp, Homo sapiens
atctcagccatccgc

SEQ ID NO: 859842 - DNA, 16 bp, Homo sapiens
atctcagcctcctgag

SEQ ID NO: 859843 - DNA, 19 bp, Homo sapiens
atctcaggaagtccagcca

SEQ ID NO: 859844 - DNA, 18 bp, Homo sapiens
atctcaggagatttcatg

SEQ ID NO: 859845 - DNA, 12 bp, Homo sapiens
atctcagggagg

SEQ ID NO: 859846 - DNA, 14 bp, Homo sapiens
atctcagggcctgg

SEQ ID NO: 859847 - DNA, 17 bp, Homo sapiens
atctcaggggccagagg

SEQ ID NO: 859848 - DNA, 20 bp, Homo sapiens
atctcaggggctgtttgagg

SEQ ID NO: 859849 - DNA, 21 bp, Homo sapiens
atctcaggggctgtttgagga

SEQ ID NO: 859850 - DNA, 17 bp, Homo sapiens
atctcaggtgccactcc

SEQ ID NO: 859851 - DNA, 22 bp, Homo sapiens
atctcagtatgaattattcaat

SEQ ID NO: 859852 - DNA, 14 bp, Homo sapiens
atctcagtgctttc

SEQ ID NO: 859853 - DNA, 19 bp, Homo sapiens
atctcagttgtttgcttct

SEQ ID NO: 859854 - DNA, 20 bp, Homo sapiens
atctcagttgtttgcttctt

SEQ ID NO: 859855 - DNA, 23 bp, Homo sapiens
atctcataggttgccaataatac

SEQ ID NO: 859856 - DNA, 19 bp, Homo sapiens
atctcatcatgtctattgt

SEQ ID NO: 859857 - DNA, 15 bp, Homo sapiens
atctcatccccccac

SEQ ID NO: 859858 - DNA, 15 bp, Homo sapiens
atctcatcctggcac

SEQ ID NO: 859859 - DNA, 15 bp, Homo sapiens
atctcatctatctca

SEQ ID NO: 859860 - DNA, 18 bp, Homo sapiens
atctcatgaggggagagg

SEQ ID NO: 859861 - DNA, 23 bp, Homo sapiens
atctcatgcccctggctgggacg

SEQ ID NO: 859862 - DNA, 15 bp, Homo sapiens
atctcattggaccct

SEQ ID NO: 859863 - DNA, 20 bp, Homo sapiens
atctcattggacccttccat

SEQ ID NO: 859864 - DNA, 21 bp, Homo sapiens
atctcatttttccgtaaaaat

SEQ ID NO: 859865 - DNA, 14 bp, Homo sapiens
atctccaaaataaa

SEQ ID NO: 859866 - DNA, 20 bp, Homo sapiens
atctccaaaataaaactttt

SEQ ID NO: 859867 - DNA, 21 bp, Homo sapiens
atctccaaaataaaacttttt

SEQ ID NO: 859868 - DNA, 18 bp, Homo sapiens
atctccaaggatcctctc

SEQ ID NO: 859869 - DNA, 15 bp, Homo sapiens
atctccagggaagcg

SEQ ID NO: 859870 - DNA, 14 bp, Homo sapiens
atctccagggagca

SEQ ID NO: 859871 - DNA, 16 bp, Homo sapiens
atctccagggagcaag

SEQ ID NO: 859872 - DNA, 22 bp, Homo sapiens
atctccagggagcaagacagag

SEQ ID NO: 859873 - DNA, 19 bp, Homo sapiens
atctccagggagtcccctc

SEQ ID NO: 859874 - DNA, 21 bp, Homo sapiens
atctccagggagtcccctccc

SEQ ID NO: 859875 - DNA, 16 bp, Homo sapiens
atctccagggctccaa

SEQ ID NO: 859876 - DNA, 16 bp, Homo sapiens
atctccagtgtgccag

SEQ ID NO: 859877 - DNA, 20 bp, Homo sapiens
atctccatcatatgcctgac

SEQ ID NO: 859878 - DNA, 22 bp, Homo sapiens
atctccatggccctgtcccagg

SEQ ID NO: 859879 - DNA, 18 bp, Homo sapiens
atctccatggcttcctcc

SEQ ID NO: 859880 - DNA, 19 bp, Homo sapiens
atctcccacctagcagcac

SEQ ID NO: 859881 - DNA, 17 bp, Homo sapiens
atctcccactgcgggga

SEQ ID NO: 859882 - DNA, 20 bp, Homo sapiens
atctcccagataatgtgaaa

SEQ ID NO: 859883 - DNA, 17 bp, Homo sapiens
atctccccaggcctcca

SEQ ID NO: 859884 - DNA, 19 bp, Homo sapiens
atctcccccatagcaccct

SEQ ID NO: 859885 - DNA, 23 bp, Homo sapiens
atctcccctcctcacagttgcca

SEQ ID NO: 859886 - DNA, 20 bp, Homo sapiens
atctccctccccagaaacag

SEQ ID NO: 859887 - DNA, 13 bp, Homo sapiens
atctccctgccat

SEQ ID NO: 859888 - DNA, 15 bp, Homo sapiens
atctccctgccatcc

SEQ ID NO: 859889 - DNA, 17 bp, Homo sapiens
atctccctgccatcccc

SEQ ID NO: 859890 - DNA, 14 bp, Homo sapiens
atctccctgcctgg

SEQ ID NO: 859891 - DNA, 22 bp, Homo sapiens
atctccctggagaagcaccagc

SEQ ID NO: 859892 - DNA, 21 bp, Homo sapiens
atctcccttttccatgactgt

SEQ ID NO: 859893 - DNA, 13 bp, Homo sapiens
atctgatttaatg

SEQ ID NO: 859894 - DNA, 14 bp, Homo sapiens
atctgatttaatgt

SEQ ID NO: 859895 - DNA, 19 bp, Homo sapiens
atctgatttaatgttttct

SEQ ID NO: 859896 - DNA, 22 bp, Homo sapiens
atctgatttcattacatttctg

SEQ ID NO: 859897 - DNA, 16 bp, Homo sapiens
atctgcaaacaatgaa

SEQ ID NO: 859898 - DNA, 20 bp, Homo sapiens
atctgcaaacaatgaagaat

SEQ ID NO: 859899 - DNA, 17 bp, Homo sapiens
atctgcaagaacactgg

SEQ ID NO: 859900 - DNA, 18 bp, Homo sapiens
atctgcaccaccatgccc

SEQ ID NO: 859901 - DNA, 10 bp, Homo sapiens
atctgcaccc

SEQ ID NO: 859902 - DNA, 21 bp, Homo sapiens
atctgcaccccttctctcctc

SEQ ID NO: 859903 - DNA, 22 bp, Homo sapiens
atctgcaccccttctctcctcc

SEQ ID NO: 859904 - DNA, 21 bp, Homo sapiens
atctgcaccctcgatgaagcc

SEQ ID NO: 859905 - DNA, 16 bp, Homo sapiens
atctgcacccttcttt

SEQ ID NO: 859906 - DNA, 20 bp, Homo sapiens
atctgcactctaaactgcaa

SEQ ID NO: 859907 - DNA, 22 bp, Homo sapiens
atctgcagaacatcgatatgta

SEQ ID NO: 859908 - DNA, 11 bp, Homo sapiens
atctgcagaag

SEQ ID NO: 859909 - DNA, 15 bp, Homo sapiens
atctgcaggcagaca

SEQ ID NO: 859910 - DNA, 14 bp, Homo sapiens
atctgcagggagca

SEQ ID NO: 859911 - DNA, 17 bp, Homo sapiens
atctgcatatttctgta

SEQ ID NO: 859912 - DNA, 18 bp, Homo sapiens
atctgcatatttctgtat

SEQ ID NO: 859913 - DNA, 19 bp, Homo sapiens
atctgcatatttctgtata

SEQ ID NO: 859914 - DNA, 20 bp, Homo sapiens
atctgcatatttctgtatat

SEQ ID NO: 859915 - DNA, 21 bp, Homo sapiens
atctgcatatttctgtatatt

SEQ ID NO: 859916 - DNA, 16 bp, Homo sapiens
atctgcatcttaacat

SEQ ID NO: 859917 - DNA, 15 bp, Homo sapiens
atctgcatgtctact

SEQ ID NO: 859918 - DNA, 11 bp, Homo sapiens
atctgcatgtg

SEQ ID NO: 859919 - DNA, 19 bp, Homo sapiens
atctgcattttcaccccac

SEQ ID NO: 859920 - DNA, 16 bp, Homo sapiens
atctgccagaccttaa

SEQ ID NO: 859921 - DNA, 13 bp, Homo sapiens
atctgcccagggg

SEQ ID NO: 859922 - DNA, 15 bp, Homo sapiens
atctgcccaggggtg

SEQ ID NO: 859923 - DNA, 21 bp, Homo sapiens
atctgcccaggggtgccccct

SEQ ID NO: 859924 - DNA, 16 bp, Homo sapiens
atctgcccctccccca

SEQ ID NO: 859925 - DNA, 17 bp, Homo sapiens
atctgcccctcccccaa

SEQ ID NO: 859926 - DNA, 13 bp, Homo sapiens
atctgcccgcctc

SEQ ID NO: 859927 - DNA, 23 bp, Homo sapiens
atctgccctttgcagtgtgcagg

SEQ ID NO: 859928 - DNA, 15 bp, Homo sapiens
atctgcctagaaaac

SEQ ID NO: 859929 - DNA, 22 bp, Homo sapiens
atctgcctcctctcctcctcag

SEQ ID NO: 859930 - DNA, 23 bp, Homo sapiens
atctgcctcctgtgcctcccttt

SEQ ID NO: 859931 - DNA, 11 bp, Homo sapiens
atctgcctggc

SEQ ID NO: 859932 - DNA, 12 bp, Homo sapiens
atctgcctggcc

SEQ ID NO: 859933 - DNA, 15 bp, Homo sapiens
atctgcctggcctgg

SEQ ID NO: 859934 - DNA, 16 bp, Homo sapiens
atctgcctggcctggc

SEQ ID NO: 859935 - DNA, 17 bp, Homo sapiens
atctgcctggcctggct

SEQ ID NO: 859936 - DNA, 18 bp, Homo sapiens
atctgcctggcctggctc

SEQ ID NO: 859937 - DNA, 19 bp, Homo sapiens
atctgcctggcctggctcc

SEQ ID NO: 859938 - DNA, 12 bp, Homo sapiens
atctgcctgggc

SEQ ID NO: 859939 - DNA, 17 bp, Homo sapiens
atctgcctgggcctgtg

SEQ ID NO: 859940 - DNA, 20 bp, Homo sapiens
atctgcctgggcctgtgcag

SEQ ID NO: 859941 - DNA, 21 bp, Homo sapiens
atctgcctgggcctgtgcagc

SEQ ID NO: 859942 - DNA, 23 bp, Homo sapiens
atctgcctgggcctgtgcagcag

SEQ ID NO: 859943 - DNA, 20 bp, Homo sapiens
atctgcctgtaattaaacta

SEQ ID NO: 859944 - DNA, 18 bp, Homo sapiens
atctgccttaaaaccaaa

SEQ ID NO: 859945 - DNA, 20 bp, Homo sapiens
atctgccttccagcccagac

SEQ ID NO: 859946 - DNA, 21 bp, Homo sapiens
atctgccttccagcccagacc

SEQ ID NO: 859947 - DNA, 22 bp, Homo sapiens
atctgcgtgacaataaaacatt

SEQ ID NO: 859948 - DNA, 16 bp, Homo sapiens
atctgctaagtaattt

SEQ ID NO: 859949 - DNA, 14 bp, Homo sapiens
atctgctagtgctg

SEQ ID NO: 859950 - DNA, 21 bp, Homo sapiens
atctgctgaggcccagtgcat

SEQ ID NO: 859951 - DNA, 12 bp, Homo sapiens
atctgctgcagt

SEQ ID NO: 859952 - DNA, 13 bp, Homo sapiens
atctgctgcagtt

SEQ ID NO: 859953 - DNA, 17 bp, Homo sapiens
atctgctgcatagctct

SEQ ID NO: 859954 - DNA, 14 bp, Homo sapiens
atctgctggagttt

SEQ ID NO: 859955 - DNA, 15 bp, Homo sapiens
atctgctgtatatgg

SEQ ID NO: 859956 - DNA, 14 bp, Homo sapiens
atctgctgttgcca

SEQ ID NO: 859957 - DNA, 22 bp, Homo sapiens
atctgctttttaaagaatgctc

SEQ ID NO: 859958 - DNA, 17 bp, Homo sapiens
atctggaaatctgtttt

SEQ ID NO: 859959 - DNA, 20 bp, Homo sapiens
atctggaaggggatcccacc

SEQ ID NO: 859960 - DNA, 15 bp, Homo sapiens
atctggactcctctg

SEQ ID NO: 859961 - DNA, 16 bp, Homo sapiens
atctggactcctctgt

SEQ ID NO: 859962 - DNA, 15 bp, Homo sapiens
atcttaatttattat

SEQ ID NO: 859963 - DNA, 14 bp, Homo sapiens
atcttacaaaatcc

SEQ ID NO: 859964 - DNA, 21 bp, Homo sapiens
atcttacaacaggcttatgaa

SEQ ID NO: 859965 - DNA, 15 bp, Homo sapiens
atcttacaagatatt

SEQ ID NO: 859966 - DNA, 21 bp, Homo sapiens
atcttacaagatattgatgat

SEQ ID NO: 859967 - DNA, 16 bp, Homo sapiens
atcttacctgtaaagt

SEQ ID NO: 859968 - DNA, 18 bp, Homo sapiens
atcttagatgtttcacac

SEQ ID NO: 859969 - DNA, 16 bp, Homo sapiens
atcttagtgtatgatt

SEQ ID NO: 859970 - DNA, 16 bp, Homo sapiens
atcttataactgtttt

SEQ ID NO: 859971 - DNA, 14 bp, Homo sapiens
atcttatacaacag

SEQ ID NO: 859972 - DNA, 17 bp, Homo sapiens
atcttatactgtacaat

SEQ ID NO: 859973 - DNA, 20 bp, Homo sapiens
atcttatgaaaaccaaattt

SEQ ID NO: 859974 - DNA, 21 bp, Homo sapiens
atcttattagggagaaaattc

SEQ ID NO: 859975 - DNA, 22 bp, Homo sapiens
atcttattagggagaaaattca

SEQ ID NO: 859976 - DNA, 20 bp, Homo sapiens
atcttattcattttctctaa

SEQ ID NO: 859977 - DNA, 18 bp, Homo sapiens
atcttattccgagcattc

SEQ ID NO: 859978 - DNA, 14 bp, Homo sapiens
atcttcaatatgaa

SEQ ID NO: 859979 - DNA, 18 bp, Homo sapiens
atcttcaatttggatatt

SEQ ID NO: 859980 - DNA, 18 bp, Homo sapiens
atcttcaccctcatcctt

SEQ ID NO: 859981 - DNA, 18 bp, Homo sapiens
atcttcacctctattctt

SEQ ID NO: 859982 - DNA, 15 bp, Homo sapiens
atcttcacgacaatg

SEQ ID NO: 859983 - DNA, 23 bp, Homo sapiens
atcttcacgacaatgttgagaag

SEQ ID NO: 859984 - DNA, 19 bp, Homo sapiens
atcttcagaactgcccttg

SEQ ID NO: 859985 - DNA, 21 bp, Homo sapiens
atcttcagaactgcccttgct

SEQ ID NO: 859986 - DNA, 14 bp, Homo sapiens
atcttcagagcagg

SEQ ID NO: 859987 - DNA, 18 bp, Homo sapiens
atcttcagagcaggggtc

SEQ ID NO: 859988 - DNA, 13 bp, Homo sapiens
atcttcagcccag

SEQ ID NO: 859989 - DNA, 14 bp, Homo sapiens
atcttcagttgtct

SEQ ID NO: 859990 - DNA, 17 bp, Homo sapiens
atcttcagttgtctctg

SEQ ID NO: 859991 - DNA, 18 bp, Homo sapiens
atcttcagttgtctctga

SEQ ID NO: 859992 - DNA, 19 bp, Homo sapiens
atcttcagttgtctctgat

SEQ ID NO: 859993 - DNA, 22 bp, Homo sapiens
atcttcatggaattcacaaagt

SEQ ID NO: 859994 - DNA, 14 bp, Homo sapiens
atcttcatgtaaat

SEQ ID NO: 859995 - DNA, 18 bp, Homo sapiens
atcttcatgtaaattgac

SEQ ID NO: 859996 - DNA, 22 bp, Homo sapiens
atcttccatctgcatcttaaca

SEQ ID NO: 859997 - DNA, 12 bp, Homo sapiens
atcttccccaag

SEQ ID NO: 859998 - DNA, 23 bp, Homo sapiens
atcttccccaagggccaaaccca

SEQ ID NO: 859999 - DNA, 21 bp, Homo sapiens
atcttccctagagggttcctg

SEQ ID NO: 860000 - DNA, 22 bp, Homo sapiens
atcttccctagagggttcctgt

SEQ ID NO: 860001 - DNA, 15 bp, Homo sapiens
atcttcctgctgctg

SEQ ID NO: 860002 - DNA, 17 bp, Homo sapiens
atcttcctttcttgtct

SEQ ID NO: 860003 - DNA, 19 bp, Homo sapiens
atgcaaagcactctctgca

SEQ ID NO: 860004 - DNA, 18 bp, Homo sapiens
atgcaaatgaatcattgt

SEQ ID NO: 860005 - DNA, 14 bp, Homo sapiens
atgcaaatgtcttc

SEQ ID NO: 860006 - DNA, 15 bp, Homo sapiens
atgcaaattaaaaca

SEQ ID NO: 860007 - DNA, 22 bp, Homo sapiens
atgcaacagaaaagccttttaa

SEQ ID NO: 860008 - DNA, 17 bp, Homo sapiens
atgcaagacgccctcta

SEQ ID NO: 860009 - DNA, 21 bp, Homo sapiens
atgcaagcttggtcaaacttt

SEQ ID NO: 860010 - DNA, 23 bp, Homo sapiens
atgcaagcttggtcaaacttttt

SEQ ID NO: 860011 - DNA, 13 bp, Homo sapiens
atgcaaggaagga

SEQ ID NO: 860012 - DNA, 14 bp, Homo sapiens
atgcaaggaaggaa

SEQ ID NO: 860013 - DNA, 17 bp, Homo sapiens
atgcaaggggctgcatg

SEQ ID NO: 860014 - DNA, 21 bp, Homo sapiens
atgcaaggtagcatgggtcca

SEQ ID NO: 860015 - DNA, 20 bp, Homo sapiens
atgcaaggtatttctccagt

SEQ ID NO: 860016 - DNA, 14 bp, Homo sapiens
atgcaaggtgctgg

SEQ ID NO: 860017 - DNA, 23 bp, Homo sapiens
atgcaaggtgctggtgggtctga

SEQ ID NO: 860018 - DNA, 15 bp, Homo sapiens
atgcaagtaaaaaaa

SEQ ID NO: 860019 - DNA, 13 bp, Homo sapiens
atgcaataactct

SEQ ID NO: 860020 - DNA, 16 bp, Homo sapiens
atgcaataatgtgcaa

SEQ ID NO: 860021 - DNA, 22 bp, Homo sapiens
atgcaatcagacaagtgttttg

SEQ ID NO: 860022 - DNA, 17 bp, Homo sapiens
atgcaatccttccctgc

SEQ ID NO: 860023 - DNA, 24 bp, Homo sapiens
atgcaatgtaagcatactttgtaa

SEQ ID NO: 860024 - DNA, 13 bp, Homo sapiens
atgcaatgtgcta

SEQ ID NO: 860025 - DNA, 18 bp, Homo sapiens
atgcaatgtgctactgat

SEQ ID NO: 860026 - DNA, 15 bp, Homo sapiens
atgcaattaaaacta

SEQ ID NO: 860027 - DNA, 21 bp, Homo sapiens
atgcaattaggtttttcctta

SEQ ID NO: 860028 - DNA, 19 bp, Homo sapiens
atgcaatttattaaaatga

SEQ ID NO: 860029 - DNA, 14 bp, Homo sapiens
atgcacacattttt

SEQ ID NO: 860030 - DNA, 21 bp, Homo sapiens
atgcacacgggcgagctttct

SEQ ID NO: 860031 - DNA, 11 bp, Homo sapiens
atgcacagaga

SEQ ID NO: 860032 - DNA, 19 bp, Homo sapiens
atgcacagagttgttacat

SEQ ID NO: 860033 - DNA, 22 bp, Homo sapiens
atgcacagagttgttacatttt

SEQ ID NO: 860034 - DNA, 23 bp, Homo sapiens
atgcacagagttgttacattttt

SEQ ID NO: 860035 - DNA, 13 bp, Homo sapiens
atgcacagctgct

SEQ ID NO: 860036 - DNA, 14 bp, Homo sapiens
atgcacagctgctt

SEQ ID NO: 860037 - DNA, 15 bp, Homo sapiens
atgcacagctgcttg

SEQ ID NO: 860038 - DNA, 17 bp, Homo sapiens
atgcacagctgcttgtc

SEQ ID NO: 860039 - DNA, 15 bp, Homo sapiens
atgcacagtatcttt

SEQ ID NO: 860040 - DNA, 14 bp, Homo sapiens
atgcacagtatttg

SEQ ID NO: 860041 - DNA, 23 bp, Homo sapiens
atgcacatgctgtctggccctgg

SEQ ID NO: 860042 - DNA, 16 bp, Homo sapiens
atgcacatttatatat

SEQ ID NO: 860043 - DNA, 22 bp, Homo sapiens
atgcacatttatatatatatgt

SEQ ID NO: 860044 - DNA, 18 bp, Homo sapiens
atgcacatttcaaaacaa

SEQ ID NO: 860045 - DNA, 14 bp, Homo sapiens
atgcaccaccaagc

SEQ ID NO: 860046 - DNA, 18 bp, Homo sapiens
atgcaccaccaagccaag

SEQ ID NO: 860047 - DNA, 15 bp, Homo sapiens
atgcacccctggaac

SEQ ID NO: 860048 - DNA, 20 bp, Homo sapiens
atgcacctagctgtgcaaga

SEQ ID NO: 860049 - DNA, 17 bp, Homo sapiens
atgcacgtggggcccac

SEQ ID NO: 860050 - DNA, 18 bp, Homo sapiens
atgcacgtggggcccact

SEQ ID NO: 860051 - DNA, 22 bp, Homo sapiens
atgcacgtgtgcacacacacca

SEQ ID NO: 860052 - DNA, 17 bp, Homo sapiens
atgcactatatttgtat

SEQ ID NO: 860053 - DNA, 22 bp, Homo sapiens
atgcactatatttgtatatatt

SEQ ID NO: 860054 - DNA, 16 bp, Homo sapiens
atgcactatgaggaat

SEQ ID NO: 860055 - DNA, 14 bp, Homo sapiens
atgcactcagctct

SEQ ID NO: 860056 - DNA, 20 bp, Homo sapiens
atgcactgaaaacttagcca

SEQ ID NO: 860057 - DNA, 13 bp, Homo sapiens
atgcactgtaaat

SEQ ID NO: 860058 - DNA, 16 bp, Homo sapiens
atgcactgtaaatatc

SEQ ID NO: 860059 - DNA, 21 bp, Homo sapiens
atgcactgtaaatatccctcc

SEQ ID NO: 860060 - DNA, 21 bp, Homo sapiens
atgcactgtggtttcagatgt

SEQ ID NO: 860061 - DNA, 15 bp, Homo sapiens
atgcacttaaagaag

SEQ ID NO: 860062 - DNA, 19 bp, Homo sapiens
atgcacttaaagaagtatt

SEQ ID NO: 860063 - DNA, 20 bp, Homo sapiens
atgcacttcaaattcaaata

SEQ ID NO: 860064 - DNA, 16 bp, Homo sapiens
atgcactttaattgaa

SEQ ID NO: 860065 - DNA, 21 bp, Homo sapiens
atgcactttaattgaagaact

SEQ ID NO: 860066 - DNA, 18 bp, Homo sapiens
atgcacttttagaaatgc

SEQ ID NO: 860067 - DNA, 21 bp, Homo sapiens
atgcacttttagaaatgcata

SEQ ID NO: 860068 - DNA, 19 bp, Homo sapiens
atgcacttttgggcctttt

SEQ ID NO: 860069 - DNA, 20 bp, Homo sapiens
atgcagaaatagacaaaaag

SEQ ID NO: 860070 - DNA, 18 bp, Homo sapiens
atgcagaaccacaaacaa

SEQ ID NO: 860071 - DNA, 19 bp, Homo sapiens
atgcagaaccacaaacaat

SEQ ID NO: 860072 - DNA, 22 bp, Homo sapiens
atgcagaacgtatttagccatt

SEQ ID NO: 860073 - DNA, 17 bp, Homo sapiens
atgcagaatggcatttg

SEQ ID NO: 860074 - DNA, 15 bp, Homo sapiens
atgcagaatttgatt

SEQ ID NO: 860075 - DNA, 21 bp, Homo sapiens
atgcagacaacaccttcctcc

SEQ ID NO: 860076 - DNA, 22 bp, Homo sapiens
atgcagacaacaccttcctcct

SEQ ID NO: 860077 - DNA, 21 bp, Homo sapiens
atgcagacagtctgttatgca

SEQ ID NO: 860078 - DNA, 16 bp, Homo sapiens
atgcagacatctctgg

SEQ ID NO: 860079 - DNA, 18 bp, Homo sapiens
atgcagacatctctggag

SEQ ID NO: 860080 - DNA, 19 bp, Homo sapiens
atgcagacatctctggagc

SEQ ID NO: 860081 - DNA, 20 bp, Homo sapiens
atgcagacatctctggagcc

SEQ ID NO: 860082 - DNA, 21 bp, Homo sapiens
atgcagacatctctggagcca

SEQ ID NO: 860083 - DNA, 19 bp, Homo sapiens
atgcagattcctgggcctg

SEQ ID NO: 860084 - DNA, 20 bp, Homo sapiens
atgcagattcctgggcctgt

SEQ ID NO: 860085 - DNA, 22 bp, Homo sapiens
atgcagcaggaaggaacaaaga

SEQ ID NO: 860086 - DNA, 17 bp, Homo sapiens
atgcagcccaccaggag

SEQ ID NO: 860087 - DNA, 21 bp, Homo sapiens
atgcagcccatgcccacctgc

SEQ ID NO: 860088 - DNA, 22 bp, Homo sapiens
atgcagcccatgcccacctgcc

SEQ ID NO: 860089 - DNA, 16 bp, Homo sapiens
atgcagcccctgggcc

SEQ ID NO: 860090 - DNA, 13 bp, Homo sapiens
atgcagcctgtgg

SEQ ID NO: 860091 - DNA, 21 bp, Homo sapiens
atgcagctactggaatggtgt

SEQ ID NO: 860092 - DNA, 20 bp, Homo sapiens
atgcagctcttcaacatgac

SEQ ID NO: 860093 - DNA, 21 bp, Homo sapiens
atgcagctcttcaacatgaca

SEQ ID NO: 860094 - DNA, 22 bp, Homo sapiens
atgcagctcttcaacatgacat

SEQ ID NO: 860095 - DNA, 11 bp, Homo sapiens
atgcagctgcc

SEQ ID NO: 860096 - DNA, 17 bp, Homo sapiens
atgcagctgcctggggc

SEQ ID NO: 860097 - DNA, 22 bp, Homo sapiens
atgcagctgcctggggcccaag

SEQ ID NO: 860098 - DNA, 16 bp, Homo sapiens
atgcagctgttgagaa

SEQ ID NO: 860099 - DNA, 17 bp, Homo sapiens
atgcagctgttgagaaa

SEQ ID NO: 860100 - DNA, 18 bp, Homo sapiens
atgcagctgttgagaaaa

SEQ ID NO: 860101 - DNA, 22 bp, Homo sapiens
atgcagctgttgagaaaacgaa

SEQ ID NO: 860102 - DNA, 15 bp, Homo sapiens
atgcagcttatacga

SEQ ID NO: 860103 - DNA, 16 bp, Homo sapiens
atgcagcttatacgaa

SEQ ID NO: 860104 - DNA, 17 bp, Homo sapiens
atgcaggaagaggccca

SEQ ID NO: 860105 - DNA, 18 bp, Homo sapiens
atgcaggaagaggcccac

SEQ ID NO: 860106 - DNA, 22 bp, Homo sapiens
atgcaggagcttctgggagatt

SEQ ID NO: 860107 - DNA, 16 bp, Homo sapiens
atgcaggaggtggaga

SEQ ID NO: 860108 - DNA, 19 bp, Homo sapiens
atgcaggaggtggagaaaa

SEQ ID NO: 860109 - DNA, 20 bp, Homo sapiens
atgcagggaatgcaatcctt

SEQ ID NO: 860110 - DNA, 13 bp, Homo sapiens
atgcagggaggcc

SEQ ID NO: 860111 - DNA, 14 bp, Homo sapiens
atgcagggaggcca

SEQ ID NO: 860112 - DNA, 17 bp, Homo sapiens
atgcagggaggggaggc

SEQ ID NO: 860113 - DNA, 19 bp, Homo sapiens
atgcagggaggggaggcag

SEQ ID NO: 860114 - DNA, 13 bp, Homo sapiens
atgcagggcagtc

SEQ ID NO: 860115 - DNA, 16 bp, Homo sapiens
atgcagtaaattatct

SEQ ID NO: 860116 - DNA, 14 bp, Homo sapiens
atgcagtcctgagg

SEQ ID NO: 860117 - DNA, 19 bp, Homo sapiens
atgcagtgtagattttata

SEQ ID NO: 860118 - DNA, 23 bp, Homo sapiens
atgcatggaaacctgaaaaaaag

SEQ ID NO: 860119 - DNA, 23 bp, Homo sapiens
atgcatggtgcagttgacagcag

SEQ ID NO: 860120 - DNA, 13 bp, Homo sapiens
atgcatgtcttaa

SEQ ID NO: 860121 - DNA, 22 bp, Homo sapiens
atgcatgtcttaaatgctcata

SEQ ID NO: 860122 - DNA, 18 bp, Homo sapiens
atgcatgtcttttaaaat

SEQ ID NO: 860123 - DNA, 13 bp, Homo sapiens
atgcatgtgaaga

SEQ ID NO: 860124 - DNA, 17 bp, Homo sapiens
atgcatgtgaagaaagg

SEQ ID NO: 860125 - DNA, 15 bp, Homo sapiens
atgcattaaacctgt

SEQ ID NO: 860126 - DNA, 17 bp, Homo sapiens
atgcattaaacctgtct

SEQ ID NO: 860127 - DNA, 19 bp, Homo sapiens
atgcattaataaaaatcaa

SEQ ID NO: 860128 - DNA, 13 bp, Homo sapiens
atgcattattaaa

SEQ ID NO: 860129 - DNA, 22 bp, Homo sapiens
atgcattcacatttagaaaagt

SEQ ID NO: 860130 - DNA, 13 bp, Homo sapiens
atgcattccctga

SEQ ID NO: 860131 - DNA, 13 bp, Homo sapiens
atgcattctgata

SEQ ID NO: 860132 - DNA, 22 bp, Homo sapiens
atgcattctgataggagggggc

SEQ ID NO: 860133 - DNA, 21 bp, Homo sapiens
atgcattgctctggatctgtt

SEQ ID NO: 860134 - DNA, 22 bp, Homo sapiens
atgcatttaaagtattctccat

SEQ ID NO: 860135 - DNA, 22 bp, Homo sapiens
atgcatttaataaagatgagtt

SEQ ID NO: 860136 - DNA, 13 bp, Homo sapiens
atgcatttcaagc

SEQ ID NO: 860137 - DNA, 15 bp, Homo sapiens
atgcatttcattcaa

SEQ ID NO: 860138 - DNA, 16 bp, Homo sapiens
atgcatttcattcaaa

SEQ ID NO: 860139 - DNA, 12 bp, Homo sapiens
atgcatttgaaa

SEQ ID NO: 860140 - DNA, 17 bp, Homo sapiens
atgcatttgaggtcaag

SEQ ID NO: 860141 - DNA, 18 bp, Homo sapiens
atgcatttggaaccaaag

SEQ ID NO: 860142 - DNA, 23 bp, Homo sapiens
atgcattttattttagacacaaa

SEQ ID NO: 860143 - DNA, 15 bp, Homo sapiens
atgcattttcttcac

SEQ ID NO: 860144 - DNA, 17 bp, Homo sapiens
atgcattttcttcacag

SEQ ID NO: 860145 - DNA, 20 bp, Homo sapiens
atgcattttcttcacagtgc

SEQ ID NO: 860146 - DNA, 19 bp, Homo sapiens
atgcattttcttcagaatt

SEQ ID NO: 860147 - DNA, 14 bp, Homo sapiens
atgcattttgctgc

SEQ ID NO: 860148 - DNA, 17 bp, Homo sapiens
atgccaaaaaaaaatac

SEQ ID NO: 860149 - DNA, 16 bp, Homo sapiens
atgccaaaatgacttt

SEQ ID NO: 860150 - DNA, 16 bp, Homo sapiens
atgccaaagatcactt

SEQ ID NO: 860151 - DNA, 18 bp, Homo sapiens
atgccaaagatcacttgt

SEQ ID NO: 860152 - DNA, 23 bp, Homo sapiens
atgccaaagatgtttgaaaatgc

SEQ ID NO: 860153 - DNA, 18 bp, Homo sapiens
atgccaaagctagggtgg

SEQ ID NO: 860154 - DNA, 20 bp, Homo sapiens
atgccaaatgttaactgcca

SEQ ID NO: 860155 - DNA, 15 bp, Homo sapiens
atgccaacaccttct

SEQ ID NO: 860156 - DNA, 15 bp, Homo sapiens
atgccaacttcccac

SEQ ID NO: 860157 - DNA, 22 bp, Homo sapiens
atgccaagaaaagggctgacat

SEQ ID NO: 860158 - DNA, 22 bp, Homo sapiens
atgccaaggaccttttgctgcc

SEQ ID NO: 860159 - DNA, 18 bp, Homo sapiens
atgccaataaagtgatct

SEQ ID NO: 860160 - DNA, 18 bp, Homo sapiens
atgccaatttcctctcca

SEQ ID NO: 860161 - DNA, 20 bp, Homo sapiens
atgccacccccgctggagga

SEQ ID NO: 860162 - DNA, 21 bp, Homo sapiens
atgccacccccgctggaggat

SEQ ID NO: 860163 - DNA, 14 bp, Homo sapiens
atgccaccctagcc

SEQ ID NO: 860164 - DNA, 22 bp, Homo sapiens
atgccaccctcacacacacagc

SEQ ID NO: 860165 - DNA, 20 bp, Homo sapiens
atgccaccctgttttcagct

SEQ ID NO: 860166 - DNA, 14 bp, Homo sapiens
atgccactcctccc

SEQ ID NO: 860167 - DNA, 14 bp, Homo sapiens
atgccactgccagg

SEQ ID NO: 860168 - DNA, 21 bp, Homo sapiens
atgccactgccaggcacctgg

SEQ ID NO: 860169 - DNA, 20 bp, Homo sapiens
atgccacttccttttaactg

SEQ ID NO: 860170 - DNA, 22 bp, Homo sapiens
atgccagaaggaatcttctcat

SEQ ID NO: 860171 - DNA, 23 bp, Homo sapiens
atgccagaccgcagagaggctca

SEQ ID NO: 860172 - DNA, 16 bp, Homo sapiens
atgccagagggccagc

SEQ ID NO: 860173 - DNA, 18 bp, Homo sapiens
atgccagagggccagcag

SEQ ID NO: 860174 - DNA, 21 bp, Homo sapiens
atgccagattctgcctctctg

SEQ ID NO: 860175 - DNA, 17 bp, Homo sapiens
atgccagcttctctctc

SEQ ID NO: 860176 - DNA, 23 bp, Homo sapiens
atgccagcttctctctccagggt

SEQ ID NO: 860177 - DNA, 15 bp, Homo sapiens
atgccaggacccgcc

SEQ ID NO: 860178 - DNA, 22 bp, Homo sapiens
atgccaggccagagggcagtgg

SEQ ID NO: 860179 - DNA, 22 bp, Homo sapiens
atgccagtaacgcgtcttcctg

SEQ ID NO: 860180 - DNA, 23 bp, Homo sapiens
atgccagtaacgcgtcttcctga

SEQ ID NO: 860181 - DNA, 21 bp, Homo sapiens
atgccagtttttaaaatgctg

SEQ ID NO: 860182 - DNA, 23 bp, Homo sapiens
atgccataaaattgcagtttcat

SEQ ID NO: 860183 - DNA, 14 bp, Homo sapiens
atgccatagcataa

SEQ ID NO: 860184 - DNA, 23 bp, Homo sapiens
atgccatgtttagattccaggat

SEQ ID NO: 860185 - DNA, 17 bp, Homo sapiens
atgccatttcttctctc

SEQ ID NO: 860186 - DNA, 22 bp, Homo sapiens
atgcccacaacttgtcacccaa

SEQ ID NO: 860187 - DNA, 16 bp, Homo sapiens
atgcccaccccctgcc

SEQ ID NO: 860188 - DNA, 17 bp, Homo sapiens
atgcccaccccctgccc

SEQ ID NO: 860189 - DNA, 15 bp, Homo sapiens
atgcccacctgccca

SEQ ID NO: 860190 - DNA, 20 bp, Homo sapiens
atgcccacctgcccatcaca

SEQ ID NO: 860191 - DNA, 11 bp, Homo sapiens
atgcccagaag

SEQ ID NO: 860192 - DNA, 15 bp, Homo sapiens
atgcccagctctctg

SEQ ID NO: 860193 - DNA, 16 bp, Homo sapiens
atgcccagctctctga

SEQ ID NO: 860194 - DNA, 17 bp, Homo sapiens
atgcccagctctctgac

SEQ ID NO: 860195 - DNA, 13 bp, Homo sapiens
atgcccaggtacc

SEQ ID NO: 860196 - DNA, 16 bp, Homo sapiens
atgcccaggtcaccgg

SEQ ID NO: 860197 - DNA, 17 bp, Homo sapiens
atgcccatttttgctaa

SEQ ID NO: 860198 - DNA, 21 bp, Homo sapiens
atgccccacccccctcctccc

SEQ ID NO: 860199 - DNA, 23 bp, Homo sapiens
atgccccacccccctcctccccc

SEQ ID NO: 860200 - DNA, 15 bp, Homo sapiens
atgcccccagctggc

SEQ ID NO: 860201 - DNA, 16 bp, Homo sapiens
atgcccccagctggcc

SEQ ID NO: 860202 - DNA, 15 bp, Homo sapiens
atgcccccaggcagc

SEQ ID NO: 860203 - DNA, 16 bp, Homo sapiens
atgcccccaggcagcc

SEQ ID NO: 860204 - DNA, 22 bp, Homo sapiens
atgcccccctcaaacctcctct

SEQ ID NO: 860205 - DNA, 20 bp, Homo sapiens
atgccccctcccttcacagg

SEQ ID NO: 860206 - DNA, 10 bp, Homo sapiens
atgccccctg

SEQ ID NO: 860207 - DNA, 13 bp, Homo sapiens
atgcccccttcgc

SEQ ID NO: 860208 - DNA, 22 bp, Homo sapiens
atgcccccttcgctcctcctct

SEQ ID NO: 860209 - DNA, 21 bp, Homo sapiens
atgcccctgcagtttggccct

SEQ ID NO: 860210 - DNA, 14 bp, Homo sapiens
atgcccctgctccc

SEQ ID NO: 860211 - DNA, 20 bp, Homo sapiens
atgcccctgtactccagcct

SEQ ID NO: 860212 - DNA, 16 bp, Homo sapiens
atgccccttctcccct

SEQ ID NO: 860213 - DNA, 13 bp, Homo sapiens
atgatcaataaag

SEQ ID NO: 860214 - DNA, 15 bp, Homo sapiens
atgatcacatctaaa

SEQ ID NO: 860215 - DNA, 21 bp, Homo sapiens
atgatcagcatctgtgatggg

SEQ ID NO: 860216 - DNA, 18 bp, Homo sapiens
atgatcagctgtttgtca

SEQ ID NO: 860217 - DNA, 21 bp, Homo sapiens
atgcgtgggaggcagaaacct

SEQ ID NO: 860218 - DNA, 17 bp, Homo sapiens
atgcgtgtttctgactc

SEQ ID NO: 860219 - DNA, 17 bp, Homo sapiens
atgctaaagatgatgat

SEQ ID NO: 860220 - DNA, 20 bp, Homo sapiens
atgctaaagatgatgatgtt

SEQ ID NO: 860221 - DNA, 14 bp, Homo sapiens
atgctaacatctaa

SEQ ID NO: 860222 - DNA, 16 bp, Homo sapiens
atgctaacctctctga

SEQ ID NO: 860223 - DNA, 17 bp, Homo sapiens
atgctaagagaagtaga

SEQ ID NO: 860224 - DNA, 18 bp, Homo sapiens
atgctaagagaagtagaa

SEQ ID NO: 860225 - DNA, 13 bp, Homo sapiens
atgctaagctgat

SEQ ID NO: 860226 - DNA, 14 bp, Homo sapiens
atgctaatggaatt

SEQ ID NO: 860227 - DNA, 21 bp, Homo sapiens
atgctaattaaataatacaac

SEQ ID NO: 860228 - DNA, 22 bp, Homo sapiens
atgctaattaaataatacaact

SEQ ID NO: 860229 - DNA, 18 bp, Homo sapiens
atgctaatttaaagagac

SEQ ID NO: 860230 - DNA, 13 bp, Homo sapiens
atgctaatttatt

SEQ ID NO: 860231 - DNA, 17 bp, Homo sapiens
atgctacacagacatta

SEQ ID NO: 860232 - DNA, 12 bp, Homo sapiens
atgctacagtta

SEQ ID NO: 860233 - DNA, 14 bp, Homo sapiens
atgctactgtctca

SEQ ID NO: 860234 - DNA, 20 bp, Homo sapiens
atgctactgtctcactgaaa

SEQ ID NO: 860235 - DNA, 19 bp, Homo sapiens
atgctagaaaaatgttctt

SEQ ID NO: 860236 - DNA, 15 bp, Homo sapiens
atgctatgcaaaaaa

SEQ ID NO: 860237 - DNA, 18 bp, Homo sapiens
atgctatgttctgtcttc

SEQ ID NO: 860238 - DNA, 14 bp, Homo sapiens
atgctattgacaat

SEQ ID NO: 860239 - DNA, 15 bp, Homo sapiens
atgctattgacaata

SEQ ID NO: 860240 - DNA, 18 bp, Homo sapiens
atgctattgacaataaaa

SEQ ID NO: 860241 - DNA, 21 bp, Homo sapiens
atgctattgacaataaaatat

SEQ ID NO: 860242 - DNA, 18 bp, Homo sapiens
atgctattgttgtgggct

SEQ ID NO: 860243 - DNA, 19 bp, Homo sapiens
atgctattgttgtgggctt

SEQ ID NO: 860244 - DNA, 12 bp, Homo sapiens
atgctatttctg

SEQ ID NO: 860245 - DNA, 19 bp, Homo sapiens
atgctcaacccccctccca

SEQ ID NO: 860246 - DNA, 21 bp, Homo sapiens
atgctcaacccccctcccaga

SEQ ID NO: 860247 - DNA, 14 bp, Homo sapiens
atgctcaagaatgt

SEQ ID NO: 860248 - DNA, 12 bp, Homo sapiens
atgctcacctct

SEQ ID NO: 860249 - DNA, 17 bp, Homo sapiens
atgctcactttattatc

SEQ ID NO: 860250 - DNA, 14 bp, Homo sapiens
atgctcagaccagc

SEQ ID NO: 860251 - DNA, 17 bp, Homo sapiens
atgctcagaccagctct

SEQ ID NO: 860252 - DNA, 17 bp, Homo sapiens
atgctcagggtcactga

SEQ ID NO: 860253 - DNA, 18 bp, Homo sapiens
atgctcagggtcactgaa

SEQ ID NO: 860254 - DNA, 20 bp, Homo sapiens
atgcttctcactgccatgcc

SEQ ID NO: 860255 - DNA, 11 bp, Homo sapiens
atgcttctctc

SEQ ID NO: 860256 - DNA, 13 bp, Homo sapiens
atgcttctctcct

SEQ ID NO: 860257 - DNA, 14 bp, Homo sapiens
atgcttctctcctt

SEQ ID NO: 860258 - DNA, 14 bp, Homo sapiens
atgcttctgggaga

SEQ ID NO: 860259 - DNA, 17 bp, Homo sapiens
atgcttgcataagagct

SEQ ID NO: 860260 - DNA, 18 bp, Homo sapiens
atgcttgcataagagctt

SEQ ID NO: 860261 - DNA, 16 bp, Homo sapiens
atgcttgcctagggcc

SEQ ID NO: 860262 - DNA, 18 bp, Homo sapiens
atgcttgcggcaaaagga

SEQ ID NO: 860263 - DNA, 22 bp, Homo sapiens
atgcttgcggcaaaaggaaagc

SEQ ID NO: 860264 - DNA, 23 bp, Homo sapiens
atgcttgcggcaaaaggaaagct

SEQ ID NO: 860265 - DNA, 16 bp, Homo sapiens
atgcttgcttggggaa

SEQ ID NO: 860266 - DNA, 21 bp, Homo sapiens
atgcttgggaccagaagtgtt

SEQ ID NO: 860267 - DNA, 21 bp, Homo sapiens
atgcttgtaacaagaaaacat

SEQ ID NO: 860268 - DNA, 12 bp, Homo sapiens
atgcttgtaatt

SEQ ID NO: 860269 - DNA, 22 bp, Homo sapiens
atgcttgtaatttaaacatttg

SEQ ID NO: 860270 - DNA, 18 bp, Homo sapiens
atgcttgtgtatatgtat

SEQ ID NO: 860271 - DNA, 17 bp, Homo sapiens
atgcttgtttatgatat

SEQ ID NO: 860272 - DNA, 22 bp, Homo sapiens
atgcttgtttatgatatttctt

SEQ ID NO: 860273 - DNA, 17 bp, Homo sapiens
atgctttatttgtaaat

SEQ ID NO: 860274 - DNA, 21 bp, Homo sapiens
atgctttatttgtaaatttag

SEQ ID NO: 860275 - DNA, 16 bp, Homo sapiens
atgctttccctgagga

SEQ ID NO: 860276 - DNA, 12 bp, Homo sapiens
atgctttccttc

SEQ ID NO: 860277 - DNA, 22 bp, Homo sapiens
atgctttctgaagctttaccag

SEQ ID NO: 860278 - DNA, 14 bp, Homo sapiens
atgctttgaacttt

SEQ ID NO: 860279 - DNA, 15 bp, Homo sapiens
atgctttgaacttta

SEQ ID NO: 860280 - DNA, 21 bp, Homo sapiens
atgctttgaatgcaaaagaaa

SEQ ID NO: 860281 - DNA, 16 bp, Homo sapiens
atgctttgggaggcca

SEQ ID NO: 860282 - DNA, 19 bp, Homo sapiens
atgctttgggaggccaagg

SEQ ID NO: 860283 - DNA, 15 bp, Homo sapiens
atgcttttaaatgct

SEQ ID NO: 860284 - DNA, 22 bp, Homo sapiens
atgcttttatatggcccagcct

SEQ ID NO: 860285 - DNA, 16 bp, Homo sapiens
atgcttttatattcta

SEQ ID NO: 860286 - DNA, 18 bp, Homo sapiens
atgcttttgcttgcaatg

SEQ ID NO: 860287 - DNA, 20 bp, Homo sapiens
atgcttttggaagttaaaat

SEQ ID NO: 860288 - DNA, 22 bp, Homo sapiens
atgcttttggaagttaaaattt

SEQ ID NO: 860289 - DNA, 13 bp, Homo sapiens
atgcttttgtcta

SEQ ID NO: 860290 - DNA, 16 bp, Homo sapiens
atgctttttatttctg

SEQ ID NO: 860291 - DNA, 16 bp, Homo sapiens
atgctttttgaatgtt

SEQ ID NO: 860292 - DNA, 19 bp, Homo sapiens
atgctttttgagtttcatg

SEQ ID NO: 860293 - DNA, 19 bp, Homo sapiens
atggaaaaaaacataaaaa

SEQ ID NO: 860294 - DNA, 21 bp, Homo sapiens
atggaaaaacttgtgctataa

SEQ ID NO: 860295 - DNA, 12 bp, Homo sapiens
atggaaaaataa

SEQ ID NO: 860296 - DNA, 13 bp, Homo sapiens
atggaaaaataaa

SEQ ID NO: 860297 - DNA, 14 bp, Homo sapiens
atggaaaaatagta

SEQ ID NO: 860298 - DNA, 14 bp, Homo sapiens
atggaaaaatgcca

SEQ ID NO: 860299 - DNA, 20 bp, Homo sapiens
atggaaaaattgacaaaaaa

SEQ ID NO: 860300 - DNA, 19 bp, Homo sapiens
atggaaaactgtgttgcca

SEQ ID NO: 860301 - DNA, 22 bp, Homo sapiens
atggaaaagcaacttcatttga

SEQ ID NO: 860302 - DNA, 12 bp, Homo sapiens
atggaaaaggaa

SEQ ID NO: 860303 - DNA, 14 bp, Homo sapiens
atggaaaaggaaga

SEQ ID NO: 860304 - DNA, 12 bp, Homo sapiens
atggaaaataaa

SEQ ID NO: 860305 - DNA, 16 bp, Homo sapiens
atggaaaataaacatc

SEQ ID NO: 860306 - DNA, 13 bp, Homo sapiens
atggaaaatacca

SEQ ID NO: 860307 - DNA, 16 bp, Homo sapiens
atggaaacattacagt

SEQ ID NO: 860308 - DNA, 13 bp, Homo sapiens
atggaaacctcac

SEQ ID NO: 860309 - DNA, 17 bp, Homo sapiens
atggaaacctcacgctg

SEQ ID NO: 860310 - DNA, 11 bp, Homo sapiens
atggaaagaat

SEQ ID NO: 860311 - DNA, 14 bp, Homo sapiens
atggacctaacatt

SEQ ID NO: 860312 - DNA, 15 bp, Homo sapiens
atggacctagcttga

SEQ ID NO: 860313 - DNA, 14 bp, Homo sapiens
atggacgaatatga

SEQ ID NO: 860314 - DNA, 16 bp, Homo sapiens
atggacgaatatgaat

SEQ ID NO: 860315 - DNA, 20 bp, Homo sapiens
atggacgaatatgaatgtca

SEQ ID NO: 860316 - DNA, 20 bp, Homo sapiens
atggacgcaggccctgtcca

SEQ ID NO: 860317 - DNA, 21 bp, Homo sapiens
atggactatctgtctggtggc

SEQ ID NO: 860318 - DNA, 22 bp, Homo sapiens
atggactatctgtctggtggcc

SEQ ID NO: 860319 - DNA, 18 bp, Homo sapiens
atggactctgggtttcat

SEQ ID NO: 860320 - DNA, 14 bp, Homo sapiens
atggagaaagaagt

SEQ ID NO: 860321 - DNA, 14 bp, Homo sapiens
atggagaagctgca

SEQ ID NO: 860322 - DNA, 21 bp, Homo sapiens
atggagaagggttctgccctg

SEQ ID NO: 860323 - DNA, 15 bp, Homo sapiens
atggagaatcacttt

SEQ ID NO: 860324 - DNA, 20 bp, Homo sapiens
atggagactccatgagaagc

SEQ ID NO: 860325 - DNA, 13 bp, Homo sapiens
atggagagagggg

SEQ ID NO: 860326 - DNA, 14 bp, Homo sapiens
atggagagagggga

SEQ ID NO: 860327 - DNA, 13 bp, Homo sapiens
atggagaggctga

SEQ ID NO: 860328 - DNA, 14 bp, Homo sapiens
atggagaggctgag

SEQ ID NO: 860329 - DNA, 18 bp, Homo sapiens
atggagattctgattcag

SEQ ID NO: 860330 - DNA, 11 bp, Homo sapiens
atggagccagc

SEQ ID NO: 860331 - DNA, 22 bp, Homo sapiens
atggagcccccagatagagctg

SEQ ID NO: 860332 - DNA, 24 bp, Homo sapiens
atggagcccccagatagagctggg

SEQ ID NO: 860333 - DNA, 17 bp, Homo sapiens
atggagccccctctgcc

SEQ ID NO: 860334 - DNA, 14 bp, Homo sapiens
atggagcctgctct

SEQ ID NO: 860335 - DNA, 12 bp, Homo sapiens
atggagcctgga

SEQ ID NO: 860336 - DNA, 17 bp, Homo sapiens
atggagcgcacctgccc

SEQ ID NO: 860337 - DNA, 14 bp, Homo sapiens
atggagctcatgtc

SEQ ID NO: 860338 - DNA, 13 bp, Homo sapiens
atggaggaaaaag

SEQ ID NO: 860339 - DNA, 18 bp, Homo sapiens
atggaggactccaggcag

SEQ ID NO: 860340 - DNA, 15 bp, Homo sapiens
atggaggagaagaat

SEQ ID NO: 860341 - DNA, 17 bp, Homo sapiens
atggaggatattctact

SEQ ID NO: 860342 - DNA, 16 bp, Homo sapiens
atggaggatggagaga

SEQ ID NO: 860343 - DNA, 20 bp, Homo sapiens
atggaggcagagacctccaa

SEQ ID NO: 860344 - DNA, 12 bp, Homo sapiens
atggaggcaggg

SEQ ID NO: 860345 - DNA, 13 bp, Homo sapiens
atggaggccagag

SEQ ID NO: 860346 - DNA, 20 bp, Homo sapiens
atggaggccctcctgtgctg

SEQ ID NO: 860347 - DNA, 19 bp, Homo sapiens
atggaggggcagagccagg

SEQ ID NO: 860348 - DNA, 11 bp, Homo sapiens
atggagggtcc

SEQ ID NO: 860349 - DNA, 17 bp, Homo sapiens
atggaggttctcagagc

SEQ ID NO: 860350 - DNA, 18 bp, Homo sapiens
atggagtgagtcacctgc

SEQ ID NO: 860351 - DNA, 20 bp, Homo sapiens
atggagtgagtcacctgctc

SEQ ID NO: 860352 - DNA, 13 bp, Homo sapiens
atggagtgctgtt

SEQ ID NO: 860353 - DNA, 20 bp, Homo sapiens
atggagtgctgttttgttat

SEQ ID NO: 860354 - DNA, 21 bp, Homo sapiens
atggagtgctgttttgttata

SEQ ID NO: 860355 - DNA, 16 bp, Homo sapiens
atggagtgtacaagta

SEQ ID NO: 860356 - DNA, 14 bp, Homo sapiens
atggagtgtgcaga

SEQ ID NO: 860357 - DNA, 18 bp, Homo sapiens
atggagtgtgcagacagc

SEQ ID NO: 860358 - DNA, 21 bp, Homo sapiens
atggagtgtgtattgttccca

SEQ ID NO: 860359 - DNA, 17 bp, Homo sapiens
atggccgcttctagagc

SEQ ID NO: 860360 - DNA, 21 bp, Homo sapiens
atggccgggcgcggtggctca

SEQ ID NO: 860361 - DNA, 19 bp, Homo sapiens
atggcctcagctgcctcac

SEQ ID NO: 860362 - DNA, 13 bp, Homo sapiens
atggcctcatgtg

SEQ ID NO: 860363 - DNA, 17 bp, Homo sapiens
atggcctcatgtggctg

SEQ ID NO: 860364 - DNA, 18 bp, Homo sapiens
atggcctcatgtggctgg

SEQ ID NO: 860365 - DNA, 20 bp, Homo sapiens
atggcctcatgtggctggaa

SEQ ID NO: 860366 - DNA, 23 bp, Homo sapiens
atggcctcgcctccccaccctcc

SEQ ID NO: 860367 - DNA, 19 bp, Homo sapiens
atggcctgccttgaagcca

SEQ ID NO: 860368 - DNA, 16 bp, Homo sapiens
atggcctggctgcctg

SEQ ID NO: 860369 - DNA, 17 bp, Homo sapiens
atggcctggctgcctgg

SEQ ID NO: 860370 - DNA, 20 bp, Homo sapiens
atggcctggctgcctggtgg

SEQ ID NO: 860371 - DNA, 13 bp, Homo sapiens
atggcctttcctt

SEQ ID NO: 860372 - DNA, 20 bp, Homo sapiens
atggcctttggacccagggc

SEQ ID NO: 860373 - DNA, 22 bp, Homo sapiens
atggcctttggacccagggcct

SEQ ID NO: 860374 - DNA, 22 bp, Homo sapiens
atggccttttgctacgtgcctc

SEQ ID NO: 860375 - DNA, 16 bp, Homo sapiens
atggcgatgtgttata

SEQ ID NO: 860376 - DNA, 20 bp, Homo sapiens
atggcgattccctctcaccc

SEQ ID NO: 860377 - DNA, 14 bp, Homo sapiens
atggcgccctgcct

SEQ ID NO: 860378 - DNA, 22 bp, Homo sapiens
atggcgccctgcctcctggagg

SEQ ID NO: 860379 - DNA, 19 bp, Homo sapiens
atggcggcctgcagtggtg

SEQ ID NO: 860380 - DNA, 13 bp, Homo sapiens
atggcgggcactg

SEQ ID NO: 860381 - DNA, 14 bp, Homo sapiens
atggcgggcactgg

SEQ ID NO: 860382 - DNA, 18 bp, Homo sapiens
atggcgtaatgggcctgc

SEQ ID NO: 860383 - DNA, 20 bp, Homo sapiens
atggcgtttttctcgtcccc

SEQ ID NO: 860384 - DNA, 17 bp, Homo sapiens
atggctaattcccagag

SEQ ID NO: 860385 - DNA, 15 bp, Homo sapiens
atggctataaatata

SEQ ID NO: 860386 - DNA, 19 bp, Homo sapiens
atggctatatggcaagaaa

SEQ ID NO: 860387 - DNA, 16 bp, Homo sapiens
atggctatgccttgca

SEQ ID NO: 860388 - DNA, 14 bp, Homo sapiens
atggctattaacaa

SEQ ID NO: 860389 - DNA, 22 bp, Homo sapiens
atggctcagagggggactgctg

SEQ ID NO: 860390 - DNA, 19 bp, Homo sapiens
atggctcaggcaagcccct

SEQ ID NO: 860391 - DNA, 20 bp, Homo sapiens
atggctcaggcaagcccctc

SEQ ID NO: 860392 - DNA, 22 bp, Homo sapiens
atggctcaggcaagcccctcag

SEQ ID NO: 860393 - DNA, 15 bp, Homo sapiens
atggctcctgtctgg

SEQ ID NO: 860394 - DNA, 14 bp, Homo sapiens
atggctctgcaccc

SEQ ID NO: 860395 - DNA, 17 bp, Homo sapiens
atggctctgcacccctc

SEQ ID NO: 860396 - DNA, 22 bp, Homo sapiens
atggctctgcacccctctgccc

SEQ ID NO: 860397 - DNA, 14 bp, Homo sapiens
atggctgaagctgg

SEQ ID NO: 860398 - DNA, 17 bp, Homo sapiens
atggctgaagctggagc

SEQ ID NO: 860399 - DNA, 19 bp, Homo sapiens
atggctgaagctggagcag

SEQ ID NO: 860400 - DNA, 23 bp, Homo sapiens
atggctgaagctggagcagcgga

SEQ ID NO: 860401 - DNA, 21 bp, Homo sapiens
atggctgagcctcgtgtccag

SEQ ID NO: 860402 - DNA, 20 bp, Homo sapiens
atggctgataattttaaatt

SEQ ID NO: 860403 - DNA, 22 bp, Homo sapiens
atggctgctttgacaaggcaga

SEQ ID NO: 860404 - DNA, 19 bp, Homo sapiens
atggctgggtcagggccag

SEQ ID NO: 860405 - DNA, 19 bp, Homo sapiens
atggctgtgcctctgcctg

SEQ ID NO: 860406 - DNA, 16 bp, Homo sapiens
atggcttaatgtttat

SEQ ID NO: 860407 - DNA, 21 bp, Homo sapiens
atggcttaatgtttattcctg

SEQ ID NO: 860408 - DNA, 20 bp, Homo sapiens
atggcttattttttaaaata

SEQ ID NO: 860409 - DNA, 22 bp, Homo sapiens
atggcttattttttaaaatatt

SEQ ID NO: 860410 - DNA, 15 bp, Homo sapiens
atggcttcctcctcc

SEQ ID NO: 860411 - DNA, 16 bp, Homo sapiens
atggcttcctcctccc

SEQ ID NO: 860412 - DNA, 19 bp, Homo sapiens
atggcttcctcctccctcc

SEQ ID NO: 860413 - DNA, 20 bp, Homo sapiens
atggcttcggacaaaatatc

SEQ ID NO: 860414 - DNA, 14 bp, Homo sapiens
atggcttgttcatc

SEQ ID NO: 860415 - DNA, 23 bp, Homo sapiens
atggcttgttcatcatccagatg

SEQ ID NO: 860416 - DNA, 20 bp, Homo sapiens
atggctttaaactaccctcc

SEQ ID NO: 860417 - DNA, 20 bp, Homo sapiens
atggctttatttgttttttt

SEQ ID NO: 860418 - DNA, 23 bp, Homo sapiens
atggctttatttgttttttttgt

SEQ ID NO: 860419 - DNA, 17 bp, Homo sapiens
atggctttgtgattcaa

SEQ ID NO: 860420 - DNA, 16 bp, Homo sapiens
atgggaaaaaaacaaa

SEQ ID NO: 860421 - DNA, 18 bp, Homo sapiens
atgggaaaactgccaata

SEQ ID NO: 860422 - DNA, 14 bp, Homo sapiens
atgggaaactgttg

SEQ ID NO: 860423 - DNA, 17 bp, Homo sapiens
atgggaaagccacctct

SEQ ID NO: 860424 - DNA, 21 bp, Homo sapiens
atgggaacgcagcctccagtt

SEQ ID NO: 860425 - DNA, 13 bp, Homo sapiens
atgggaaggaggg

SEQ ID NO: 860426 - DNA, 18 bp, Homo sapiens
atgggaaggggaggaccc

SEQ ID NO: 860427 - DNA, 16 bp, Homo sapiens
atgggaatcaggcatg

SEQ ID NO: 860428 - DNA, 22 bp, Homo sapiens
atgggacatcaaatttgccacc

SEQ ID NO: 860429 - DNA, 11 bp, Homo sapiens
atgggaccagg

SEQ ID NO: 860430 - DNA, 18 bp, Homo sapiens
atgggacccaagtctgaa

SEQ ID NO: 860431 - DNA, 14 bp, Homo sapiens
atgggaccgtgccc

SEQ ID NO: 860432 - DNA, 15 bp, Homo sapiens
atgggaccgtgcccc

SEQ ID NO: 860433 - DNA, 19 bp, Homo sapiens
atgggaccgtgccccacct

SEQ ID NO: 860434 - DNA, 15 bp, Homo sapiens
atgggacctcctccc

SEQ ID NO: 860435 - DNA, 18 bp, Homo sapiens
atgggactcattgtagaa

SEQ ID NO: 860436 - DNA, 22 bp, Homo sapiens
atgggagaaaacgccagtgtgt

SEQ ID NO: 860437 - DNA, 22 bp, Homo sapiens
atgggagaaatagtgtggaaat

SEQ ID NO: 860438 - DNA, 17 bp, Homo sapiens
atgggagacccttgaca

SEQ ID NO: 860439 - DNA, 16 bp, Homo sapiens
atgggagacctgttgg

SEQ ID NO: 860440 - DNA, 15 bp, Homo sapiens
atgggagatggtcag

SEQ ID NO: 860441 - DNA, 16 bp, Homo sapiens
atgggagatggtcagt

SEQ ID NO: 860442 - DNA, 12 bp, Homo sapiens
atgggagccaga

SEQ ID NO: 860443 - DNA, 12 bp, Homo sapiens
atgggagccagc

SEQ ID NO: 860444 - DNA, 20 bp, Homo sapiens
atgggagccgggtctgcctc

SEQ ID NO: 860445 - DNA, 21 bp, Homo sapiens
atgggagctggttagaaatgc

SEQ ID NO: 860446 - DNA, 22 bp, Homo sapiens
atgggagctggttagaaatgca

SEQ ID NO: 860447 - DNA, 21 bp, Homo sapiens
atgggagctgtcaagcatgta

SEQ ID NO: 860448 - DNA, 22 bp, Homo sapiens
atgggagctgtcaagcatgtat

SEQ ID NO: 860449 - DNA, 18 bp, Homo sapiens
atgggaggagagccactg

SEQ ID NO: 860450 - DNA, 23 bp, Homo sapiens
atgggagggggcttgaagccaaa

SEQ ID NO: 860451 - DNA, 13 bp, Homo sapiens
atgggagtgggca

SEQ ID NO: 860452 - DNA, 16 bp, Homo sapiens
atgggagtgggcacct

SEQ ID NO: 860453 - DNA, 19 bp, Homo sapiens
atgggagtgggcacctcag

SEQ ID NO: 860454 - DNA, 17 bp, Homo sapiens
atgggatcatttttcca

SEQ ID NO: 860455 - DNA, 13 bp, Homo sapiens
agcagcgcccagg

SEQ ID NO: 860456 - DNA, 15 bp, Homo sapiens
agcagcgcctttccc

SEQ ID NO: 860457 - DNA, 20 bp, Homo sapiens
agcagcgctcggcccggagc

SEQ ID NO: 860458 - DNA, 14 bp, Homo sapiens
agcagcggctctgg

SEQ ID NO: 860459 - DNA, 18 bp, Homo sapiens
agcagcggctctggtcct

SEQ ID NO: 860460 - DNA, 17 bp, Homo sapiens
agcagcggtttggggag

SEQ ID NO: 860461 - DNA, 18 bp, Homo sapiens
agcagcgtttctatgaca

SEQ ID NO: 860462 - DNA, 20 bp, Homo sapiens
agcagctaactccgagagca

SEQ ID NO: 860463 - DNA, 14 bp, Homo sapiens
agcagctactgtaa

SEQ ID NO: 860464 - DNA, 16 bp, Homo sapiens
agcagctactgtaact

SEQ ID NO: 860465 - DNA, 21 bp, Homo sapiens
agcagctagctctttggtcta

SEQ ID NO: 860466 - DNA, 13 bp, Homo sapiens
agcagctcaggca

SEQ ID NO: 860467 - DNA, 14 bp, Homo sapiens
agcagctcaggcac

SEQ ID NO: 860468 - DNA, 22 bp, Homo sapiens
agcagctccctttctcaggagc

SEQ ID NO: 860469 - DNA, 12 bp, Homo sapiens
agcagctgcggg

SEQ ID NO: 860470 - DNA, 16 bp, Homo sapiens
agcagctgcgggtctg

SEQ ID NO: 860471 - DNA, 20 bp, Homo sapiens
agcagctggctctccacctt

SEQ ID NO: 860472 - DNA, 22 bp, Homo sapiens
agcagcttataatgggctctcc

SEQ ID NO: 860473 - DNA, 18 bp, Homo sapiens
agcagcttcaccagagca

SEQ ID NO: 860474 - DNA, 16 bp, Homo sapiens
agcagcttccagattg

SEQ ID NO: 860475 - DNA, 14 bp, Homo sapiens
agcagcttccttct

SEQ ID NO: 860476 - DNA, 15 bp, Homo sapiens
agcagcttcttgggc

SEQ ID NO: 860477 - DNA, 18 bp, Homo sapiens
agcagcttcttttgtctc

SEQ ID NO: 860478 - DNA, 17 bp, Homo sapiens
agcagctttaaacaaat

SEQ ID NO: 860479 - DNA, 22 bp, Homo sapiens
agcagctttaaactcagggaca

SEQ ID NO: 860480 - DNA, 20 bp, Homo sapiens
agcagctttttattccctgc

SEQ ID NO: 860481 - DNA, 22 bp, Homo sapiens
agcaggaagcattcagagagca

SEQ ID NO: 860482 - DNA, 14 bp, Homo sapiens
agcaggaaggaccc

SEQ ID NO: 860483 - DNA, 15 bp, Homo sapiens
agcaggaaggcccct

SEQ ID NO: 860484 - DNA, 16 bp, Homo sapiens
agcaggacctcccttc

SEQ ID NO: 860485 - DNA, 21 bp, Homo sapiens
agcaggacctgtgctttgaga

SEQ ID NO: 860486 - DNA, 15 bp, Homo sapiens
agcaggactccaggc

SEQ ID NO: 860487 - DNA, 17 bp, Homo sapiens
agcaggagccccgccac

SEQ ID NO: 860488 - DNA, 15 bp, Homo sapiens
agcaggaggagtgga

SEQ ID NO: 860489 - DNA, 14 bp, Homo sapiens
agcaggaggccaat

SEQ ID NO: 860490 - DNA, 16 bp, Homo sapiens
agcaggaggccaataa

SEQ ID NO: 860491 - DNA, 15 bp, Homo sapiens
agcaggaggcccctg

SEQ ID NO: 860492 - DNA, 16 bp, Homo sapiens
agcaggaggcccctgg

SEQ ID NO: 860493 - DNA, 23 bp, Homo sapiens
agcaggaggcccctggcccagcg

SEQ ID NO: 860494 - DNA, 21 bp, Homo sapiens
agcaggaggcccttgtcgtgg

SEQ ID NO: 860495 - DNA, 23 bp, Homo sapiens
agcaggaggcccttgtcgtggga

SEQ ID NO: 860496 - DNA, 12 bp, Homo sapiens
agcaggaggccg

SEQ ID NO: 860497 - DNA, 19 bp, Homo sapiens
agcaggaggggggctgggt

SEQ ID NO: 860498 - DNA, 14 bp, Homo sapiens
agcaggagtggaag

SEQ ID NO: 860499 - DNA, 20 bp, Homo sapiens
agcaggagtggtgcagacag

SEQ ID NO: 860500 - DNA, 16 bp, Homo sapiens
agcaggcacatggagg

SEQ ID NO: 860501 - DNA, 19 bp, Homo sapiens
agcaggcacatggaggagc

SEQ ID NO: 860502 - DNA, 23 bp, Homo sapiens
agcaggcaccgccacgtcccagc

SEQ ID NO: 860503 - DNA, 21 bp, Homo sapiens
agcaggcagagtggcgtggcc

SEQ ID NO: 860504 - DNA, 13 bp, Homo sapiens
agcaggcaggggc

SEQ ID NO: 860505 - DNA, 21 bp, Homo sapiens
agcaggcaggggcatctgtct

SEQ ID NO: 860506 - DNA, 23 bp, Homo sapiens
agcaggcaggggcatctgtctgt

SEQ ID NO: 860507 - DNA, 15 bp, Homo sapiens
agcaggccactagtg

SEQ ID NO: 860508 - DNA, 17 bp, Homo sapiens
agcaggccactagtgac

SEQ ID NO: 860509 - DNA, 16 bp, Homo sapiens
agcaggcccagcatgc

SEQ ID NO: 860510 - DNA, 17 bp, Homo sapiens
agcaggcccagcatgca

SEQ ID NO: 860511 - DNA, 17 bp, Homo sapiens
agcaggcctctggttgc

SEQ ID NO: 860512 - DNA, 21 bp, Homo sapiens
agcaggcctctggttgcctcc

SEQ ID NO: 860513 - DNA, 16 bp, Homo sapiens
agcaggctcaggcaca

SEQ ID NO: 860514 - DNA, 20 bp, Homo sapiens
agcaggctcctggctgtgcc

SEQ ID NO: 860515 - DNA, 21 bp, Homo sapiens
agcaggctcctggctgtgccc

SEQ ID NO: 860516 - DNA, 14 bp, Homo sapiens
agcaggctgttcca

SEQ ID NO: 860517 - DNA, 17 bp, Homo sapiens
agcagggaaagctccac

SEQ ID NO: 860518 - DNA, 16 bp, Homo sapiens
agcagggaaggcctga

SEQ ID NO: 860519 - DNA, 17 bp, Homo sapiens
agcagggaaggcctgac

SEQ ID NO: 860520 - DNA, 21 bp, Homo sapiens
agcagggagaccatgcctccc

SEQ ID NO: 860521 - DNA, 20 bp, Homo sapiens
agcagggagggcttctgcca

SEQ ID NO: 860522 - DNA, 17 bp, Homo sapiens
agcagggatgccctgga

SEQ ID NO: 860523 - DNA, 20 bp, Homo sapiens
agcagggattaacctctgca

SEQ ID NO: 860524 - DNA, 21 bp, Homo sapiens
agcagggattaacctctgcac

SEQ ID NO: 860525 - DNA, 22 bp, Homo sapiens
agcagggattaacctctgcact

SEQ ID NO: 860526 - DNA, 23 bp, Homo sapiens
agcagggcggctgccgactcccc

SEQ ID NO: 860527 - DNA, 19 bp, Homo sapiens
agcaggggagcttgggact

SEQ ID NO: 860528 - DNA, 15 bp, Homo sapiens
agcaggggcaccttc

SEQ ID NO: 860529 - DNA, 15 bp, Homo sapiens
agcaggggctccagc

SEQ ID NO: 860530 - DNA, 17 bp, Homo sapiens
agcaggggggctgtgcc

SEQ ID NO: 860531 - DNA, 21 bp, Homo sapiens
agcaggggtgtgatgtaccag

SEQ ID NO: 860532 - DNA, 20 bp, Homo sapiens
agcagggtcttttcatctgg

SEQ ID NO: 860533 - DNA, 22 bp, Homo sapiens
agcagggtcttttcatctggga

SEQ ID NO: 860534 - DNA, 20 bp, Homo sapiens
agcagggtggggtctgggag

SEQ ID NO: 860535 - DNA, 20 bp, Homo sapiens
agcaggtgctgggctggact

SEQ ID NO: 860536 - DNA, 13 bp, Homo sapiens
agcaggtggggag

SEQ ID NO: 860537 - DNA, 14 bp, Homo sapiens
agcaggtggggagg

SEQ ID NO: 860538 - DNA, 20 bp, Homo sapiens
agcaggtggtcctgagacct

SEQ ID NO: 860539 - DNA, 16 bp, Homo sapiens
agcaggtgtggtggct

SEQ ID NO: 860540 - DNA, 22 bp, Homo sapiens
agcaggtgtggtggctcatggc

SEQ ID NO: 860541 - DNA, 18 bp, Homo sapiens
agcaggttcccaagctca

SEQ ID NO: 860542 - DNA, 23 bp, Homo sapiens
agcaggttcccaagctcagaggc

SEQ ID NO: 860543 - DNA, 14 bp, Homo sapiens
agcaggttcttgtt

SEQ ID NO: 860544 - DNA, 22 bp, Homo sapiens
agcagtaaaagataaatttgtt

SEQ ID NO: 860545 - DNA, 23 bp, Homo sapiens
agcagtaaaagataaatttgttg

SEQ ID NO: 860546 - DNA, 20 bp, Homo sapiens
agcagtaaatacttgcagtt

SEQ ID NO: 860547 - DNA, 19 bp, Homo sapiens
agcagtcagagtccagtgc

SEQ ID NO: 860548 - DNA, 15 bp, Homo sapiens
agcagtcagccctta

SEQ ID NO: 860549 - DNA, 22 bp, Homo sapiens
agcagtcgtggctttggcagtg

SEQ ID NO: 860550 - DNA, 15 bp, Homo sapiens
agcagtctaatctag

SEQ ID NO: 860551 - DNA, 23 bp, Homo sapiens
agcagtctcactgcagtcttatt

SEQ ID NO: 860552 - DNA, 22 bp, Homo sapiens
agcagtgaatgattcagtgtta

SEQ ID NO: 860553 - DNA, 21 bp, Homo sapiens
agcagtgagaaaaagctcctg

SEQ ID NO: 860554 - DNA, 22 bp, Homo sapiens
agcagtgagccgcatcttctcc

SEQ ID NO: 860555 - DNA, 16 bp, Homo sapiens
agcagtgagtctcttc

SEQ ID NO: 860556 - DNA, 16 bp, Homo sapiens
agcagtgatctcaggg

SEQ ID NO: 860557 - DNA, 19 bp, Homo sapiens
agcagtgatctcagggcag

SEQ ID NO: 860558 - DNA, 23 bp, Homo sapiens
agcagtgccaatcgggcagaagt

SEQ ID NO: 860559 - DNA, 15 bp, Homo sapiens
agcagtgcctcgagg

SEQ ID NO: 860560 - DNA, 16 bp, Homo sapiens
agcagtgcctcgaggc

SEQ ID NO: 860561 - DNA, 21 bp, Homo sapiens
agcagtgcctcgaggcaccgg

SEQ ID NO: 860562 - DNA, 13 bp, Homo sapiens
agcagtgcctgcc

SEQ ID NO: 860563 - DNA, 16 bp, Homo sapiens
agcagtgccttccata

SEQ ID NO: 860564 - DNA, 17 bp, Homo sapiens
agcagtgccttccataa

SEQ ID NO: 860565 - DNA, 23 bp, Homo sapiens
agcagtggcctacaaatcagtaa

SEQ ID NO: 860566 - DNA, 20 bp, Homo sapiens
agcagtggctggtgcccatg

SEQ ID NO: 860567 - DNA, 13 bp, Homo sapiens
agcagtgggcagg

SEQ ID NO: 860568 - DNA, 17 bp, Homo sapiens
agcagtgggcaggtggc

SEQ ID NO: 860569 - DNA, 20 bp, Homo sapiens
agcagtgtcatcagaagata

SEQ ID NO: 860570 - DNA, 17 bp, Homo sapiens
agcagtgtcttccataa

SEQ ID NO: 860571 - DNA, 23 bp, Homo sapiens
agcagtgtgaatagcctggccac

SEQ ID NO: 860572 - DNA, 11 bp, Homo sapiens
agcagtgtgag

SEQ ID NO: 860573 - DNA, 23 bp, Homo sapiens
agcagtgtgctttgcattttctg

SEQ ID NO: 860574 - DNA, 20 bp, Homo sapiens
agcagtgtggagaccctgcc

SEQ ID NO: 860575 - DNA, 20 bp, Homo sapiens
agcagtgttacttgcaggta

SEQ ID NO: 860576 - DNA, 21 bp, Homo sapiens
agcagtgttccccatctgggt

SEQ ID NO: 860577 - DNA, 17 bp, Homo sapiens
agcagttaatttatata

SEQ ID NO: 860578 - DNA, 13 bp, Homo sapiens
agcagttctgcaa

SEQ ID NO: 860579 - DNA, 17 bp, Homo sapiens
agcagttgctcacatgt

SEQ ID NO: 860580 - DNA, 20 bp, Homo sapiens
agcagttggccaagcagaaa

SEQ ID NO: 860581 - DNA, 13 bp, Homo sapiens
agcagttggggcc

SEQ ID NO: 860582 - DNA, 15 bp, Homo sapiens
agcagttggggccct

SEQ ID NO: 860583 - DNA, 14 bp, Homo sapiens
agcagtttgctttg

SEQ ID NO: 860584 - DNA, 13 bp, Homo sapiens
agcagttttcaag

SEQ ID NO: 860585 - DNA, 22 bp, Homo sapiens
agcagttttcaagtcaaattaa

SEQ ID NO: 860586 - DNA, 14 bp, Homo sapiens
agcagttttcccct

SEQ ID NO: 860587 - DNA, 20 bp, Homo sapiens
agcataaaagatcaccttgt

SEQ ID NO: 860588 - DNA, 21 bp, Homo sapiens
agcataaaagatcaccttgta

SEQ ID NO: 860589 - DNA, 13 bp, Homo sapiens
agcataaatgcaa

SEQ ID NO: 860590 - DNA, 14 bp, Homo sapiens
agcataaatgcaaa

SEQ ID NO: 860591 - DNA, 24 bp, Homo sapiens
agcataaggccggacgcatctcaa

SEQ ID NO: 860592 - DNA, 20 bp, Homo sapiens
agcatacatttataatgttt

SEQ ID NO: 860593 - DNA, 15 bp, Homo sapiens
agcatacattttctg

SEQ ID NO: 860594 - DNA, 22 bp, Homo sapiens
agcataccagtactcagtatag

SEQ ID NO: 860595 - DNA, 15 bp, Homo sapiens
agcatacgtacacat

SEQ ID NO: 860596 - DNA, 14 bp, Homo sapiens
agcatactgtgtat

SEQ ID NO: 860597 - DNA, 16 bp, Homo sapiens
agcatactgtgtatgt

SEQ ID NO: 860598 - DNA, 17 bp, Homo sapiens
agcatactttgtaaata

SEQ ID NO: 860599 - DNA, 21 bp, Homo sapiens
agcatagaaggaagtgtgttt

SEQ ID NO: 860600 - DNA, 13 bp, Homo sapiens
agcatagggggga

SEQ ID NO: 860601 - DNA, 16 bp, Homo sapiens
agcataggggggaggg

SEQ ID NO: 860602 - DNA, 14 bp, Homo sapiens
agcatatcccacca

SEQ ID NO: 860603 - DNA, 23 bp, Homo sapiens
agcatatcccaccaacctccagt

SEQ ID NO: 860604 - DNA, 18 bp, Homo sapiens
agcatatttgtatagttg

SEQ ID NO: 860605 - DNA, 16 bp, Homo sapiens
agcatattttcttact

SEQ ID NO: 860606 - DNA, 20 bp, Homo sapiens
agcatattttcttactttta

SEQ ID NO: 860607 - DNA, 21 bp, Homo sapiens
agcatattttcttacttttat

SEQ ID NO: 860608 - DNA, 15 bp, Homo sapiens
agcatcaatcttgtt

SEQ ID NO: 860609 - DNA, 14 bp, Homo sapiens
agcatcacctcagg

SEQ ID NO: 860610 - DNA, 13 bp, Homo sapiens
agcatcactgccc

SEQ ID NO: 860611 - DNA, 13 bp, Homo sapiens
agcatcactgcct

SEQ ID NO: 860612 - DNA, 18 bp, Homo sapiens
agcatcactgccttggcc

SEQ ID NO: 860613 - DNA, 19 bp, Homo sapiens
agcatcattttgcattcaa

SEQ ID NO: 860614 - DNA, 13 bp, Homo sapiens
agcatccagcctg

SEQ ID NO: 860615 - DNA, 16 bp, Homo sapiens
agcatccagcctgtgt

SEQ ID NO: 860616 - DNA, 24 bp, Homo sapiens
agcatccatgtgtggactcaagtc

SEQ ID NO: 860617 - DNA, 15 bp, Homo sapiens
agcatccccctcctc

SEQ ID NO: 860618 - DNA, 19 bp, Homo sapiens
agcatcccggaggaaatct

SEQ ID NO: 860619 - DNA, 20 bp, Homo sapiens
agcatcccggaggaaatctg

SEQ ID NO: 860620 - DNA, 21 bp, Homo sapiens
agcatccctatgggcttggac

SEQ ID NO: 860621 - DNA, 19 bp, Homo sapiens
agcatccctggagcaggag

SEQ ID NO: 860622 - DNA, 15 bp, Homo sapiens
agcatcccttcccac

SEQ ID NO: 860623 - DNA, 15 bp, Homo sapiens
agcatcctcagaagc

SEQ ID NO: 860624 - DNA, 13 bp, Homo sapiens
agcatcctgcaag

SEQ ID NO: 860625 - DNA, 21 bp, Homo sapiens
agcatccttttctgcagaggg

SEQ ID NO: 860626 - DNA, 23 bp, Homo sapiens
agcatcggacaagacccccagca

SEQ ID NO: 860627 - DNA, 13 bp, Homo sapiens
agcatcggaggga

SEQ ID NO: 860628 - DNA, 15 bp, Homo sapiens
agcatcgggggcctg

SEQ ID NO: 860629 - DNA, 17 bp, Homo sapiens
agcatcgggggcctgca

SEQ ID NO: 860630 - DNA, 18 bp, Homo sapiens
agcatcgtgacccttcag

SEQ ID NO: 860631 - DNA, 21 bp, Homo sapiens
agcatctactctaaagaaaaa

SEQ ID NO: 860632 - DNA, 14 bp, Homo sapiens
agcatctcccagca

SEQ ID NO: 860633 - DNA, 19 bp, Homo sapiens
agcatctcttgaggccagg

SEQ ID NO: 860634 - DNA, 22 bp, Homo sapiens
agcatctgatagaatgatgttt

SEQ ID NO: 860635 - DNA, 13 bp, Homo sapiens
agcatctggctct

SEQ ID NO: 860636 - DNA, 16 bp, Homo sapiens
agcatctggctctaat

SEQ ID NO: 860637 - DNA, 12 bp, Homo sapiens
agcatctggctg

SEQ ID NO: 860638 - DNA, 22 bp, Homo sapiens
agcatctggctgtctagaatgt

SEQ ID NO: 860639 - DNA, 19 bp, Homo sapiens
agcatctgtttacctggca

SEQ ID NO: 860640 - DNA, 20 bp, Homo sapiens
agcatctgtttacctggcag

SEQ ID NO: 860641 - DNA, 13 bp, Homo sapiens
agcatcttcctct

SEQ ID NO: 860642 - DNA, 22 bp, Homo sapiens
agcatcttgccagcctcaggct

SEQ ID NO: 860643 - DNA, 19 bp, Homo sapiens
agcatcttgggggggtggc

SEQ ID NO: 860644 - DNA, 21 bp, Homo sapiens
agcatcttgggggggtggccg

SEQ ID NO: 860645 - DNA, 13 bp, Homo sapiens
agcatgaaacatt

SEQ ID NO: 860646 - DNA, 19 bp, Homo sapiens
agcatgaaataaaatatat

SEQ ID NO: 860647 - DNA, 22 bp, Homo sapiens
agcatgaagataaacacagctg

SEQ ID NO: 860648 - DNA, 21 bp, Homo sapiens
agcatgaataaaacactcatc

SEQ ID NO: 860649 - DNA, 18 bp, Homo sapiens
agcatgaataacatttaa

SEQ ID NO: 860650 - DNA, 20 bp, Homo sapiens
agcatgaataacatttaaat

SEQ ID NO: 860651 - DNA, 14 bp, Homo sapiens
agcatgacaaaaat

SEQ ID NO: 860652 - DNA, 17 bp, Homo sapiens
agcatgacaaaaataac

SEQ ID NO: 860653 - DNA, 18 bp, Homo sapiens
agcatgacaaaaataaca

SEQ ID NO: 860654 - DNA, 18 bp, Homo sapiens
agcatgacaagccccagg

SEQ ID NO: 860655 - DNA, 19 bp, Homo sapiens
agcatgacaagccccaggc

SEQ ID NO: 860656 - DNA, 15 bp, Homo sapiens
agcatgacagcctgc

SEQ ID NO: 860657 - DNA, 19 bp, Homo sapiens
agcatgagagaattgtatc

SEQ ID NO: 860658 - DNA, 17 bp, Homo sapiens
agcatgatctgaaaaat

SEQ ID NO: 860659 - DNA, 13 bp, Homo sapiens
agcatgatgggaa

SEQ ID NO: 860660 - DNA, 17 bp, Homo sapiens
agcatgatgggaaaata

SEQ ID NO: 860661 - DNA, 15 bp, Homo sapiens
agcatgatttgaaaa

SEQ ID NO: 860662 - DNA, 16 bp, Homo sapiens
agcatgcacagctgct

SEQ ID NO: 860663 - DNA, 18 bp, Homo sapiens
agcatgcacagctgcttg

SEQ ID NO: 860664 - DNA, 20 bp, Homo sapiens
agcatgcacagctgcttgtc

SEQ ID NO: 860665 - DNA, 15 bp, Homo sapiens
agcatgcaccacggg

SEQ ID NO: 860666 - DNA, 16 bp, Homo sapiens
agcatgcggagccagc

SEQ ID NO: 860667 - DNA, 17 bp, Homo sapiens
agcatgcggagccagca

SEQ ID NO: 860668 - DNA, 17 bp, Homo sapiens
agcatgcttcctttctc

SEQ ID NO: 860669 - DNA, 21 bp, Homo sapiens
agcatgcttgggctgacccag

SEQ ID NO: 860670 - DNA, 23 bp, Homo sapiens
agcatgcttgggctgacccagca

SEQ ID NO: 860671 - DNA, 17 bp, Homo sapiens
agcatgctttgctgcta

SEQ ID NO: 860672 - DNA, 19 bp, Homo sapiens
agcatgctttgctgctatg

SEQ ID NO: 860673 - DNA, 19 bp, Homo sapiens
agcatggaaaaatggttga

SEQ ID NO: 860674 - DNA, 20 bp, Homo sapiens
agcatggaaaaatggttgat

SEQ ID NO: 860675 - DNA, 17 bp, Homo sapiens
agcatggaacacttcga

SEQ ID NO: 860676 - DNA, 17 bp, Homo sapiens
agcatggacatttagaa

SEQ ID NO: 860677 - DNA, 20 bp, Homo sapiens
agcatggacatttagaagaa

SEQ ID NO: 860678 - DNA, 15 bp, Homo sapiens
agcatggactctggg

SEQ ID NO: 860679 - DNA, 15 bp, Homo sapiens
agcatggagagcctc

SEQ ID NO: 860680 - DNA, 19 bp, Homo sapiens
agcatggcatagccccggc

SEQ ID NO: 860681 - DNA, 18 bp, Homo sapiens
agcatggctattttatat

SEQ ID NO: 860682 - DNA, 12 bp, Homo sapiens
agcatggctgtc

SEQ ID NO: 860683 - DNA, 21 bp, Homo sapiens
agcatggggcccctggcccag

SEQ ID NO: 860684 - DNA, 15 bp, Homo sapiens
agcatggggtcagcc

SEQ ID NO: 860685 - DNA, 21 bp, Homo sapiens
agcatggggtcagccccaagg

SEQ ID NO: 860686 - DNA, 22 bp, Homo sapiens
agcatggggtcagccccaaggg

SEQ ID NO: 860687 - DNA, 15 bp, Homo sapiens
agcatggggttttta

SEQ ID NO: 860688 - DNA, 16 bp, Homo sapiens
agcatgggtccaagag

SEQ ID NO: 860689 - DNA, 20 bp, Homo sapiens
agcatgggtccaagagacat

SEQ ID NO: 860690 - DNA, 19 bp, Homo sapiens
agcatgtaacttatattaa

SEQ ID NO: 860691 - DNA, 21 bp, Homo sapiens
agcatgtactgagccttgtaa

SEQ ID NO: 860692 - DNA, 17 bp, Homo sapiens
agcatgtctattcagct

SEQ ID NO: 860693 - DNA, 18 bp, Homo sapiens
agcatgtctctgcttcca

SEQ ID NO: 860694 - DNA, 16 bp, Homo sapiens
agcatgtgtcagagtg

SEQ ID NO: 860695 - DNA, 16 bp, Homo sapiens
agcatgtgttaatctt

SEQ ID NO: 860696 - DNA, 17 bp, Homo sapiens
agcatgtgttaatctta

SEQ ID NO: 860697 - DNA, 16 bp, Homo sapiens
agcatgtgttgaaaaa

SEQ ID NO: 860698 - DNA, 22 bp, Homo sapiens
agcatgttcctccttttcttca

SEQ ID NO: 860699 - DNA, 19 bp, Homo sapiens
agcatgttgagccaggcct

SEQ ID NO: 860700 - DNA, 18 bp, Homo sapiens
agcattaaaattttacct

SEQ ID NO: 860701 - DNA, 15 bp, Homo sapiens
agcattaactaaatg

SEQ ID NO: 860702 - DNA, 17 bp, Homo sapiens
agcattaactaaatgct

SEQ ID NO: 860703 - DNA, 18 bp, Homo sapiens
agcattaactaatctatt

SEQ ID NO: 860704 - DNA, 17 bp, Homo sapiens
agcattaacttctctgg

SEQ ID NO: 860705 - DNA, 17 bp, Homo sapiens
agcattaagaacacttt

SEQ ID NO: 860706 - DNA, 14 bp, Homo sapiens
agcattaagcccaa

SEQ ID NO: 860707 - DNA, 20 bp, Homo sapiens
agcattacgtgagccaggta

SEQ ID NO: 860708 - DNA, 15 bp, Homo sapiens
agcattatgcaatta

SEQ ID NO: 860709 - DNA, 22 bp, Homo sapiens
agcattcaatttattcaagaaa

SEQ ID NO: 860710 - DNA, 15 bp, Homo sapiens
agcattcagagagca

SEQ ID NO: 860711 - DNA, 18 bp, Homo sapiens
agcattcattacctgttt

SEQ ID NO: 860712 - DNA, 16 bp, Homo sapiens
agcattccagcccctc

SEQ ID NO: 860713 - DNA, 19 bp, Homo sapiens
agcattccagcccctctgg

SEQ ID NO: 860714 - DNA, 20 bp, Homo sapiens
agcattccagcccctctggt

SEQ ID NO: 860715 - DNA, 15 bp, Homo sapiens
agcattccagctctg

SEQ ID NO: 860716 - DNA, 16 bp, Homo sapiens
agcattccagtaactt

SEQ ID NO: 860717 - DNA, 22 bp, Homo sapiens
agcattccagtaacttttttgt

SEQ ID NO: 860718 - DNA, 20 bp, Homo sapiens
agcattcccaccaacaaaat

SEQ ID NO: 860719 - DNA, 20 bp, Homo sapiens
agcattcctcaggaaggaca

SEQ ID NO: 860720 - DNA, 21 bp, Homo sapiens
agcattcctcaggaaggacat

SEQ ID NO: 860721 - DNA, 17 bp, Homo sapiens
agcattctggaggggag

SEQ ID NO: 860722 - DNA, 21 bp, Homo sapiens
agcattcttgtcacaataaat

SEQ ID NO: 860723 - DNA, 17 bp, Homo sapiens
agcattgataatcttca

SEQ ID NO: 860724 - DNA, 19 bp, Homo sapiens
agcattgataatcttcagg

SEQ ID NO: 860725 - DNA, 13 bp, Homo sapiens
agcattgcatgga

SEQ ID NO: 860726 - DNA, 16 bp, Homo sapiens
agcattgctggttcta

SEQ ID NO: 860727 - DNA, 23 bp, Homo sapiens
agcattgctggttctatttaatg

SEQ ID NO: 860728 - DNA, 12 bp, Homo sapiens
agcattgctttc

SEQ ID NO: 860729 - DNA, 14 bp, Homo sapiens
agcattgctttctg

SEQ ID NO: 860730 - DNA, 15 bp, Homo sapiens
agcattgctttctga

SEQ ID NO: 860731 - DNA, 16 bp, Homo sapiens
agcattgctttctgaa

SEQ ID NO: 860732 - DNA, 14 bp, Homo sapiens
agcattggcccctg

SEQ ID NO: 860733 - DNA, 15 bp, Homo sapiens
agcattgtaaaataa

SEQ ID NO: 860734 - DNA, 16 bp, Homo sapiens
agcattgtaaaataat

SEQ ID NO: 860735 - DNA, 22 bp, Homo sapiens
agcattgtaaaattatttcatg

SEQ ID NO: 860736 - DNA, 19 bp, Homo sapiens
agcattgtctttgctgtac

SEQ ID NO: 860737 - DNA, 21 bp, Homo sapiens
agcattgtgaactgacaggca

SEQ ID NO: 860738 - DNA, 14 bp, Homo sapiens
agcattgttccaca

SEQ ID NO: 860739 - DNA, 18 bp, Homo sapiens
agcattgtttcaaaatag

SEQ ID NO: 860740 - DNA, 15 bp, Homo sapiens
agcattgtttgctta

SEQ ID NO: 860741 - DNA, 22 bp, Homo sapiens
agcattgtttgcttattgttcc

SEQ ID NO: 860742 - DNA, 22 bp, Homo sapiens
agcatttaatggcagctagtgc

SEQ ID NO: 860743 - DNA, 14 bp, Homo sapiens
agcatttataaatt

SEQ ID NO: 860744 - DNA, 22 bp, Homo sapiens
agcatttatttctctggcaaac

SEQ ID NO: 860745 - DNA, 21 bp, Homo sapiens
agcatttcaaagccctgcctc

SEQ ID NO: 860746 - DNA, 24 bp, Homo sapiens
agcatttcaaagccctgcctctgt

SEQ ID NO: 860747 - DNA, 18 bp, Homo sapiens
agcatttcatgaaaaagc

SEQ ID NO: 860748 - DNA, 19 bp, Homo sapiens
agcatttccaacaccacag

SEQ ID NO: 860749 - DNA, 17 bp, Homo sapiens
agcatttgattaacatt

SEQ ID NO: 860750 - DNA, 23 bp, Homo sapiens
agcatttggaccaatagcccaca

SEQ ID NO: 860751 - DNA, 13 bp, Homo sapiens
agcatttgtattt

SEQ ID NO: 860752 - DNA, 12 bp, Homo sapiens
agcatttgtcct

SEQ ID NO: 860753 - DNA, 17 bp, Homo sapiens
agcatttgtttctactt

SEQ ID NO: 860754 - DNA, 20 bp, Homo sapiens
agcattttaaacaaaataga

SEQ ID NO: 860755 - DNA, 16 bp, Homo sapiens
agcattttagaaacta

SEQ ID NO: 860756 - DNA, 23 bp, Homo sapiens
agcattttagcaatttatacaat

SEQ ID NO: 860757 - DNA, 20 bp, Homo sapiens
agcattttcctgtttactga

SEQ ID NO: 860758 - DNA, 22 bp, Homo sapiens
agcattttgctaaatgtgaatg

SEQ ID NO: 860759 - DNA, 13 bp, Homo sapiens
agcattttgtaat

SEQ ID NO: 860760 - DNA, 23 bp, Homo sapiens
agcatttttaagggagtggcctc

SEQ ID NO: 860761 - DNA, 14 bp, Homo sapiens
agcatttttatgca

SEQ ID NO: 860762 - DNA, 13 bp, Homo sapiens
agcatttttcaat

SEQ ID NO: 860763 - DNA, 22 bp, Homo sapiens
agcatttttcaatatattgaac

SEQ ID NO: 860764 - DNA, 15 bp, Homo sapiens
agccaaaaatagcta

SEQ ID NO: 860765 - DNA, 22 bp, Homo sapiens
agccaaaaatagctaaatacct

SEQ ID NO: 860766 - DNA, 23 bp, Homo sapiens
agccaaaaggattcctctttgtt

SEQ ID NO: 860767 - DNA, 21 bp, Homo sapiens
agccaaaagtccctccctgcc

SEQ ID NO: 860768 - DNA, 19 bp, Homo sapiens
agccaaaatgactttgaac

SEQ ID NO: 860769 - DNA, 20 bp, Homo sapiens
agccaaaatgactttgaact

SEQ ID NO: 860770 - DNA, 22 bp, Homo sapiens
agccaaaatgtaggcttagttt

SEQ ID NO: 860771 - DNA, 13 bp, Homo sapiens
agccaaacaaaac

SEQ ID NO: 860772 - DNA, 12 bp, Homo sapiens
agccaaaccagg

SEQ ID NO: 860773 - DNA, 13 bp, Homo sapiens
agccaaacccttg

SEQ ID NO: 860774 - DNA, 19 bp, Homo sapiens
agccaaacccttgtcagtg

SEQ ID NO: 860775 - DNA, 14 bp, Homo sapiens
agccaaactctgcc

SEQ ID NO: 860776 - DNA, 15 bp, Homo sapiens
agccaaagaaacaag

SEQ ID NO: 860777 - DNA, 16 bp, Homo sapiens
agccaaagaaacaagc

SEQ ID NO: 860778 - DNA, 17 bp, Homo sapiens
agccaaagaaacaagct

SEQ ID NO: 860779 - DNA, 21 bp, Homo sapiens
agccaaagaaacaagctgtgc

SEQ ID NO: 860780 - DNA, 19 bp, Homo sapiens
agccaaagaaatgggcctg

SEQ ID NO: 860781 - DNA, 23 bp, Homo sapiens
agccaaagaaatgggcctgcctg

SEQ ID NO: 860782 - DNA, 20 bp, Homo sapiens
agccaaagaatatttaaata

SEQ ID NO: 860783 - DNA, 15 bp, Homo sapiens
agccaaagataatct

SEQ ID NO: 860784 - DNA, 12 bp, Homo sapiens
agccaaagccag

SEQ ID NO: 860785 - DNA, 19 bp, Homo sapiens
agccaaaggggagccagaa

SEQ ID NO: 860786 - DNA, 20 bp, Homo sapiens
agccaaatgcagggagggga

SEQ ID NO: 860787 - DNA, 20 bp, Homo sapiens
agccaaatgtaattgaataa

SEQ ID NO: 860788 - DNA, 23 bp, Homo sapiens
agccaacaactctgcctttatga

SEQ ID NO: 860789 - DNA, 19 bp, Homo sapiens
agccaacacgcacctgcct

SEQ ID NO: 860790 - DNA, 20 bp, Homo sapiens
agccaacatgtggctcctcc

SEQ ID NO: 860791 - DNA, 13 bp, Homo sapiens
agccaaccagcct

SEQ ID NO: 860792 - DNA, 16 bp, Homo sapiens
agccaacccctgtgga

SEQ ID NO: 860793 - DNA, 15 bp, Homo sapiens
agccaacgagacaca

SEQ ID NO: 860794 - DNA, 16 bp, Homo sapiens
agccaacgagacacat

SEQ ID NO: 860795 - DNA, 21 bp, Homo sapiens
agccaacgagacacattgcct

SEQ ID NO: 860796 - DNA, 22 bp, Homo sapiens
agccaactgattttgtatgtaa

SEQ ID NO: 860797 - DNA, 21 bp, Homo sapiens
agccaactgctaatgcaaatt

SEQ ID NO: 860798 - DNA, 19 bp, Homo sapiens
agccaacttgtaaatacac

SEQ ID NO: 860799 - DNA, 20 bp, Homo sapiens
agccaagaaacactgcctgc

SEQ ID NO: 860800 - DNA, 17 bp, Homo sapiens
agccaagaaagatgtat

SEQ ID NO: 860801 - DNA, 19 bp, Homo sapiens
agccaagacaaggaggtag

SEQ ID NO: 860802 - DNA, 16 bp, Homo sapiens
agccaagctccctgga

SEQ ID NO: 860803 - DNA, 23 bp, Homo sapiens
agccaagctccctggagccctgt

SEQ ID NO: 860804 - DNA, 18 bp, Homo sapiens
agccaagctgcacaattt

SEQ ID NO: 860805 - DNA, 15 bp, Homo sapiens
agccaagctttaaat

SEQ ID NO: 860806 - DNA, 22 bp, Homo sapiens
agccaagctttaaattatgtga

SEQ ID NO: 860807 - DNA, 17 bp, Homo sapiens
agccaaggatagaagct

SEQ ID NO: 860808 - DNA, 20 bp, Homo sapiens
agccaaggccgaagctctgg

SEQ ID NO: 860809 - DNA, 20 bp, Homo sapiens
agccaaggccgccagcgtgt

SEQ ID NO: 860810 - DNA, 16 bp, Homo sapiens
agccaagggaaagggg

SEQ ID NO: 860811 - DNA, 23 bp, Homo sapiens
agccaagggaaaggggtgctttt

SEQ ID NO: 860812 - DNA, 21 bp, Homo sapiens
agccaagggaacctgtgtccg

SEQ ID NO: 860813 - DNA, 13 bp, Homo sapiens
agccaagggaggg

SEQ ID NO: 860814 - DNA, 16 bp, Homo sapiens
agccaagggagggaag

SEQ ID NO: 860815 - DNA, 17 bp, Homo sapiens
agccaaggggatattta

SEQ ID NO: 860816 - DNA, 22 bp, Homo sapiens
agccaaggtgggctgagccctg

SEQ ID NO: 860817 - DNA, 23 bp, Homo sapiens
agccaaggtgggctgagccctgg

SEQ ID NO: 860818 - DNA, 21 bp, Homo sapiens
agccaagtcagctttgccttc

SEQ ID NO: 860819 - DNA, 20 bp, Homo sapiens
agccaagtggggtgctggga

SEQ ID NO: 860820 - DNA, 15 bp, Homo sapiens
agccaagtgtctttt

SEQ ID NO: 860821 - DNA, 19 bp, Homo sapiens
agccaagttatattgaata

SEQ ID NO: 860822 - DNA, 12 bp, Homo sapiens
agccaatataac

SEQ ID NO: 860823 - DNA, 13 bp, Homo sapiens
agccaatcccctc

SEQ ID NO: 860824 - DNA, 17 bp, Homo sapiens
agccaattcagacaggc

SEQ ID NO: 860825 - DNA, 21 bp, Homo sapiens
agccagcctggctctgccccc

SEQ ID NO: 860826 - DNA, 14 bp, Homo sapiens
agccagcgcctccc

SEQ ID NO: 860827 - DNA, 23 bp, Homo sapiens
agccagcgtcctcctctgtgacc

SEQ ID NO: 860828 - DNA, 14 bp, Homo sapiens
agccagctctctct

SEQ ID NO: 860829 - DNA, 15 bp, Homo sapiens
agccagctctctcta

SEQ ID NO: 860830 - DNA, 13 bp, Homo sapiens
agccagctgcagg

SEQ ID NO: 860831 - DNA, 18 bp, Homo sapiens
agccagctgcagggcacg

SEQ ID NO: 860832 - DNA, 14 bp, Homo sapiens
agccagctgcttga

SEQ ID NO: 860833 - DNA, 15 bp, Homo sapiens
agccagctgcttttt

SEQ ID NO: 860834 - DNA, 13 bp, Homo sapiens
agccagcttaaac

SEQ ID NO: 860835 - DNA, 16 bp, Homo sapiens
agccagcttagcaact

SEQ ID NO: 860836 - DNA, 16 bp, Homo sapiens
agccagctttccctgc

SEQ ID NO: 860837 - DNA, 22 bp, Homo sapiens
agccagctttccctgcctctca

SEQ ID NO: 860838 - DNA, 16 bp, Homo sapiens
agccaggaaacatgaa

SEQ ID NO: 860839 - DNA, 21 bp, Homo sapiens
agccaggaagatcccccagaa

SEQ ID NO: 860840 - DNA, 22 bp, Homo sapiens
agccaggaagatcccccagaaa

SEQ ID NO: 860841 - DNA, 12 bp, Homo sapiens
agccaggacccg

SEQ ID NO: 860842 - DNA, 23 bp, Homo sapiens
agccaggacccgcctgctcccat

SEQ ID NO: 860843 - DNA, 14 bp, Homo sapiens
agccaggagaagct

SEQ ID NO: 860844 - DNA, 20 bp, Homo sapiens
agccaggagaagctcagctg

SEQ ID NO: 860845 - DNA, 15 bp, Homo sapiens
agccaggagctgtca

SEQ ID NO: 860846 - DNA, 24 bp, Homo sapiens
agccaggaggctttaagctccagc

SEQ ID NO: 860847 - DNA, 12 bp, Homo sapiens
agccaggaggga

SEQ ID NO: 860848 - DNA, 13 bp, Homo sapiens
agccaggagggac

SEQ ID NO: 860849 - DNA, 16 bp, Homo sapiens
agccaggagggacctg

SEQ ID NO: 860850 - DNA, 14 bp, Homo sapiens
agccaggagtctgt

SEQ ID NO: 860851 - DNA, 16 bp, Homo sapiens
agccaggagtctgtgc

SEQ ID NO: 860852 - DNA, 18 bp, Homo sapiens
agccaggagtctgtgctc

SEQ ID NO: 860853 - DNA, 18 bp, Homo sapiens
agccaggagtgcccccgg

SEQ ID NO: 860854 - DNA, 20 bp, Homo sapiens
agccaggagtgcccccggga

SEQ ID NO: 860855 - DNA, 14 bp, Homo sapiens
agccaggatgccca

SEQ ID NO: 860856 - DNA, 11 bp, Homo sapiens
agccaggcaga

SEQ ID NO: 860857 - DNA, 13 bp, Homo sapiens
agccaggcccagg

SEQ ID NO: 860858 - DNA, 18 bp, Homo sapiens
agccaggcccaggccagc

SEQ ID NO: 860859 - DNA, 19 bp, Homo sapiens
agccaggcccaggccagcc

SEQ ID NO: 860860 - DNA, 14 bp, Homo sapiens
agccaggcctggct

SEQ ID NO: 860861 - DNA, 15 bp, Homo sapiens
agccaggcctggctg

SEQ ID NO: 860862 - DNA, 17 bp, Homo sapiens
agccaggcctggctgga

SEQ ID NO: 860863 - DNA, 21 bp, Homo sapiens
agccaggcctggctggaggag

SEQ ID NO: 860864 - DNA, 22 bp, Homo sapiens
agccaggcctgggtctgtgtct

SEQ ID NO: 860865 - DNA, 19 bp, Homo sapiens
agccaggcgggctcaagga

SEQ ID NO: 860866 - DNA, 20 bp, Homo sapiens
agccaggctgccaaggccag

SEQ ID NO: 860867 - DNA, 21 bp, Homo sapiens
agccaggctgccaaggccaga

SEQ ID NO: 860868 - DNA, 21 bp, Homo sapiens
agccaggctgctaacctggaa

SEQ ID NO: 860869 - DNA, 14 bp, Homo sapiens
agccaggctgggcc

SEQ ID NO: 860870 - DNA, 11 bp, Homo sapiens
agccagggcca

SEQ ID NO: 860871 - DNA, 12 bp, Homo sapiens
agccagggccca

SEQ ID NO: 860872 - DNA, 15 bp, Homo sapiens
agccagggcccagag

SEQ ID NO: 860873 - DNA, 16 bp, Homo sapiens
agccagggcccagagc

SEQ ID NO: 860874 - DNA, 14 bp, Homo sapiens
agccagggctggag

SEQ ID NO: 860875 - DNA, 15 bp, Homo sapiens
agccagggctggaga

SEQ ID NO: 860876 - DNA, 20 bp, Homo sapiens
agccagggggatgccactcc

SEQ ID NO: 860877 - DNA, 22 bp, Homo sapiens
agccagggtgtggccctgccat

SEQ ID NO: 860878 - DNA, 18 bp, Homo sapiens
agccaggtaatgagggac

SEQ ID NO: 860879 - DNA, 18 bp, Homo sapiens
agccaggttccacagagg

SEQ ID NO: 860880 - DNA, 21 bp, Homo sapiens
agccagtaaatgggggtgcat

SEQ ID NO: 860881 - DNA, 16 bp, Homo sapiens
agccagtaatctttat

SEQ ID NO: 860882 - DNA, 18 bp, Homo sapiens
agccagtctcagagacca

SEQ ID NO: 860883 - DNA, 17 bp, Homo sapiens
agccagtcttgcctagg

SEQ ID NO: 860884 - DNA, 18 bp, Homo sapiens
agccagtcttgcctaggc

SEQ ID NO: 860885 - DNA, 13 bp, Homo sapiens
agccagtgacact

SEQ ID NO: 860886 - DNA, 15 bp, Homo sapiens
agccagtgacactaa

SEQ ID NO: 860887 - DNA, 21 bp, Homo sapiens
agccagtgacctttgacctcg

SEQ ID NO: 860888 - DNA, 14 bp, Homo sapiens
agccagtgccattc

SEQ ID NO: 860889 - DNA, 14 bp, Homo sapiens
agccagtggagctg

SEQ ID NO: 860890 - DNA, 21 bp, Homo sapiens
agccagtggagctggtctgcc

SEQ ID NO: 860891 - DNA, 22 bp, Homo sapiens
agccagtggagctggtctgcca

SEQ ID NO: 860892 - DNA, 15 bp, Homo sapiens
agccagtggcacagg

SEQ ID NO: 860893 - DNA, 23 bp, Homo sapiens
agccagtggcgggtgatggccag

SEQ ID NO: 860894 - DNA, 19 bp, Homo sapiens
agccagtgtgcccaaaagc

SEQ ID NO: 860895 - DNA, 18 bp, Homo sapiens
agccagttcaaagtgtat

SEQ ID NO: 860896 - DNA, 20 bp, Homo sapiens
agccagttcaaagtgtatat

SEQ ID NO: 860897 - DNA, 23 bp, Homo sapiens
agccagttgcttcttcagctgac

SEQ ID NO: 860898 - DNA, 21 bp, Homo sapiens
agccagttgtcctatggacaa

SEQ ID NO: 860899 - DNA, 17 bp, Homo sapiens
agccataaaaaggaaca

SEQ ID NO: 860900 - DNA, 20 bp, Homo sapiens
agccataaaagcattgtctc

SEQ ID NO: 860901 - DNA, 22 bp, Homo sapiens
agccataaaagcattgtctctc

SEQ ID NO: 860902 - DNA, 21 bp, Homo sapiens
agccataacgtgcccccagag

SEQ ID NO: 860903 - DNA, 13 bp, Homo sapiens
agccataattttg

SEQ ID NO: 860904 - DNA, 22 bp, Homo sapiens
agccatacataaaagaaataaa

SEQ ID NO: 860905 - DNA, 17 bp, Homo sapiens
agccatagaccctgagg

SEQ ID NO: 860906 - DNA, 14 bp, Homo sapiens
agccataggcccag

SEQ ID NO: 860907 - DNA, 13 bp, Homo sapiens
agccatagggggc

SEQ ID NO: 860908 - DNA, 23 bp, Homo sapiens
agccatagggggctgcacgggat

SEQ ID NO: 860909 - DNA, 16 bp, Homo sapiens
agccataggtgcagtt

SEQ ID NO: 860910 - DNA, 10 bp, Homo sapiens
agccatagtg

SEQ ID NO: 860911 - DNA, 20 bp, Homo sapiens
agccatatatgaccagaagc

SEQ ID NO: 860912 - DNA, 14 bp, Homo sapiens
agccatattccagc

SEQ ID NO: 860913 - DNA, 13 bp, Homo sapiens
agccatcaaaatg

SEQ ID NO: 860914 - DNA, 18 bp, Homo sapiens
agccatcaaaatgctttt

SEQ ID NO: 860915 - DNA, 13 bp, Homo sapiens
agccatcaccctc

SEQ ID NO: 860916 - DNA, 17 bp, Homo sapiens
agccatcaccctcaccc

SEQ ID NO: 860917 - DNA, 19 bp, Homo sapiens
agccatcactagaagaaaa

SEQ ID NO: 860918 - DNA, 21 bp, Homo sapiens
agccatcactagaagaaaagc

SEQ ID NO: 860919 - DNA, 23 bp, Homo sapiens
agccatcactagaagaaaagccc

SEQ ID NO: 860920 - DNA, 16 bp, Homo sapiens
agccatcacttctccc

SEQ ID NO: 860921 - DNA, 18 bp, Homo sapiens
agccatcataggaaggga

SEQ ID NO: 860922 - DNA, 15 bp, Homo sapiens
agccatcatgccttg

SEQ ID NO: 860923 - DNA, 13 bp, Homo sapiens
agccatcatggat

SEQ ID NO: 860924 - DNA, 15 bp, Homo sapiens
agccatccatttgtg

SEQ ID NO: 860925 - DNA, 22 bp, Homo sapiens
agccatcccttcggagccaaca

SEQ ID NO: 860926 - DNA, 21 bp, Homo sapiens
agccatccctttttttacatt

SEQ ID NO: 860927 - DNA, 19 bp, Homo sapiens
agccatcctccctccacct

SEQ ID NO: 860928 - DNA, 23 bp, Homo sapiens
agccatcctccctccacctcaag

SEQ ID NO: 860929 - DNA, 14 bp, Homo sapiens
agccatcctgccct

SEQ ID NO: 860930 - DNA, 14 bp, Homo sapiens
agccatcgtcctgg

SEQ ID NO: 860931 - DNA, 12 bp, Homo sapiens
agccatctcaga

SEQ ID NO: 860932 - DNA, 16 bp, Homo sapiens
agccatctcaggttgg

SEQ ID NO: 860933 - DNA, 22 bp, Homo sapiens
agccatctctctactcctacct

SEQ ID NO: 860934 - DNA, 23 bp, Homo sapiens
agccatctgacagcaggccacta

SEQ ID NO: 860935 - DNA, 18 bp, Homo sapiens
agccatctgcccaggggt

SEQ ID NO: 860936 - DNA, 19 bp, Homo sapiens
agccatctgcccaggggtg

SEQ ID NO: 860937 - DNA, 15 bp, Homo sapiens
agccatgaagcatta

SEQ ID NO: 860938 - DNA, 18 bp, Homo sapiens
agccatgataactgcaat

SEQ ID NO: 860939 - DNA, 22 bp, Homo sapiens
agccatgatttgtcccagcctg

SEQ ID NO: 860940 - DNA, 16 bp, Homo sapiens
agccatgccaataaag

SEQ ID NO: 860941 - DNA, 20 bp, Homo sapiens
agccatgccaataaagtgat

SEQ ID NO: 860942 - DNA, 16 bp, Homo sapiens
agccatgccagctggc

SEQ ID NO: 860943 - DNA, 16 bp, Homo sapiens
agccatgcctcatgcc

SEQ ID NO: 860944 - DNA, 17 bp, Homo sapiens
agccatgcctcatgcca

SEQ ID NO: 860945 - DNA, 23 bp, Homo sapiens
agccatgcctccctgggccacct

SEQ ID NO: 860946 - DNA, 23 bp, Homo sapiens
agccatgcgccccctccgccctg

SEQ ID NO: 860947 - DNA, 20 bp, Homo sapiens
agccatgctacagttagtct

SEQ ID NO: 860948 - DNA, 21 bp, Homo sapiens
agccatgctacagttagtctt

SEQ ID NO: 860949 - DNA, 15 bp, Homo sapiens
agccaatttcccgga

SEQ ID NO: 860950 - DNA, 19 bp, Homo sapiens
agccacaaggctggccagc

SEQ ID NO: 860951 - DNA, 17 bp, Homo sapiens
agccacacaaacgttta

SEQ ID NO: 860952 - DNA, 21 bp, Homo sapiens
agccacacgcaggcggccagg

SEQ ID NO: 860953 - DNA, 21 bp, Homo sapiens
agccacactctgggctccaga

SEQ ID NO: 860954 - DNA, 18 bp, Homo sapiens
agccacactgggcctgga

SEQ ID NO: 860955 - DNA, 15 bp, Homo sapiens
agccacacttccttt

SEQ ID NO: 860956 - DNA, 18 bp, Homo sapiens
agccacagaagccaggag

SEQ ID NO: 860957 - DNA, 23 bp, Homo sapiens
agccacagaagccaggagcaaat

SEQ ID NO: 860958 - DNA, 21 bp, Homo sapiens
agccacagcccccgggacacc

SEQ ID NO: 860959 - DNA, 19 bp, Homo sapiens
agccacagctgctgttctc

SEQ ID NO: 860960 - DNA, 13 bp, Homo sapiens
agccacaggactg

SEQ ID NO: 860961 - DNA, 17 bp, Homo sapiens
agccacagtcactggat

SEQ ID NO: 860962 - DNA, 15 bp, Homo sapiens
agccacatcttgctc

SEQ ID NO: 860963 - DNA, 18 bp, Homo sapiens
agccacatcttgctctgc

SEQ ID NO: 860964 - DNA, 21 bp, Homo sapiens
agccacatttggaatactttt

SEQ ID NO: 860965 - DNA, 12 bp, Homo sapiens
agccaccaccca

SEQ ID NO: 860966 - DNA, 18 bp, Homo sapiens
agccaccaccctcaggtg

SEQ ID NO: 860967 - DNA, 21 bp, Homo sapiens
agccaccagacttggcctcca

SEQ ID NO: 860968 - DNA, 22 bp, Homo sapiens
agccaccagacttggcctccag

SEQ ID NO: 860969 - DNA, 23 bp, Homo sapiens
agccaccagtggacctagcctgg

SEQ ID NO: 860970 - DNA, 14 bp, Homo sapiens
agccacccaagcct

SEQ ID NO: 860971 - DNA, 23 bp, Homo sapiens
agccacccaagcctgctggctgc

SEQ ID NO: 860972 - DNA, 14 bp, Homo sapiens
agccaccccgggct

SEQ ID NO: 860973 - DNA, 20 bp, Homo sapiens
agccaccccgggctctctgc

SEQ ID NO: 860974 - DNA, 23 bp, Homo sapiens
agccaccccgggctctctgctgt

SEQ ID NO: 860975 - DNA, 15 bp, Homo sapiens
agccacccctgccac

SEQ ID NO: 860976 - DNA, 17 bp, Homo sapiens
agccacccctgccactc

SEQ ID NO: 860977 - DNA, 22 bp, Homo sapiens
agccacccctgccactcaccct

SEQ ID NO: 860978 - DNA, 21 bp, Homo sapiens
agccaccgctgccagcacaga

SEQ ID NO: 860979 - DNA, 16 bp, Homo sapiens
agccaccgtgcctggc

SEQ ID NO: 860980 - DNA, 22 bp, Homo sapiens
agccaccgtgcctggccagatt

SEQ ID NO: 860981 - DNA, 16 bp, Homo sapiens
agccacctctccctca

SEQ ID NO: 860982 - DNA, 22 bp, Homo sapiens
agccacctctccctcaacaagg

SEQ ID NO: 860983 - DNA, 11 bp, Homo sapiens
agccacctgca

SEQ ID NO: 860984 - DNA, 12 bp, Homo sapiens
agccacctgcaa

SEQ ID NO: 860985 - DNA, 13 bp, Homo sapiens
agccacctgcaag

SEQ ID NO: 860986 - DNA, 19 bp, Homo sapiens
agccacctgggaacacagt

SEQ ID NO: 860987 - DNA, 23 bp, Homo sapiens
agccaccttttgggaatgtttta

SEQ ID NO: 860988 - DNA, 17 bp, Homo sapiens
agccacgaacagcccgc

SEQ ID NO: 860989 - DNA, 17 bp, Homo sapiens
agccacgcagtgcctgg

SEQ ID NO: 860990 - DNA, 20 bp, Homo sapiens
agccacgctgtcctctcgag

SEQ ID NO: 860991 - DNA, 23 bp, Homo sapiens
agccacgctgtcctctcgagccc

SEQ ID NO: 860992 - DNA, 18 bp, Homo sapiens
agccacggagggaggcac

SEQ ID NO: 860993 - DNA, 20 bp, Homo sapiens
agccacggagggaggcacca

SEQ ID NO: 860994 - DNA, 14 bp, Homo sapiens
agccacgtgaatgg

SEQ ID NO: 860995 - DNA, 22 bp, Homo sapiens
agccacgttccttactgcagaa

SEQ ID NO: 860996 - DNA, 19 bp, Homo sapiens
agccactaagaacccctct

SEQ ID NO: 860997 - DNA, 14 bp, Homo sapiens
agccactccctccc

SEQ ID NO: 860998 - DNA, 21 bp, Homo sapiens
agccactcctctgactcaggg

SEQ ID NO: 860999 - DNA, 16 bp, Homo sapiens
agccactcctgtcccg

SEQ ID NO: 861000 - DNA, 17 bp, Homo sapiens
agccactcctgtcccgc

SEQ ID NO: 861001 - DNA, 22 bp, Homo sapiens
agccactcctgtcccgccttcc

SEQ ID NO: 861002 - DNA, 23 bp, Homo sapiens
agccactcctgtcccgccttcct

SEQ ID NO: 861003 - DNA, 15 bp, Homo sapiens
agccactcgggaggc

SEQ ID NO: 861004 - DNA, 16 bp, Homo sapiens
agccactgaagctggg

SEQ ID NO: 861005 - DNA, 18 bp, Homo sapiens
agccactgatggtgacag

SEQ ID NO: 861006 - DNA, 14 bp, Homo sapiens
agccactgccaagc

SEQ ID NO: 861007 - DNA, 14 bp, Homo sapiens
agccactgcctctc

SEQ ID NO: 861008 - DNA, 15 bp, Homo sapiens
agccactgcctctcc

SEQ ID NO: 861009 - DNA, 16 bp, Homo sapiens
agccactgggcccctg

SEQ ID NO: 861010 - DNA, 14 bp, Homo sapiens
agccactgtgctga

SEQ ID NO: 861011 - DNA, 18 bp, Homo sapiens
agccactgtgctgaattc

SEQ ID NO: 861012 - DNA, 13 bp, Homo sapiens
agccacttctggc

SEQ ID NO: 861013 - DNA, 19 bp, Homo sapiens
agccacttgcctgtgctac

SEQ ID NO: 861014 - DNA, 15 bp, Homo sapiens
agccacttggcccag

SEQ ID NO: 861015 - DNA, 17 bp, Homo sapiens
agccacttggcccagaa

SEQ ID NO: 861016 - DNA, 21 bp, Homo sapiens
agccacttggcccagaaagct

SEQ ID NO: 861017 - DNA, 15 bp, Homo sapiens
agccacttgtgagta

SEQ ID NO: 861018 - DNA, 13 bp, Homo sapiens
agccagaaatggg

SEQ ID NO: 861019 - DNA, 16 bp, Homo sapiens
agccagaaatgggcag

SEQ ID NO: 861020 - DNA, 23 bp, Homo sapiens
agccagaaatgggcagttctccc

SEQ ID NO: 861021 - DNA, 20 bp, Homo sapiens
agccagaacgtggctctgct

SEQ ID NO: 861022 - DNA, 21 bp, Homo sapiens
agccagaacgtggctctgctg

SEQ ID NO: 861023 - DNA, 22 bp, Homo sapiens
agccagaacgtggctctgctgg

SEQ ID NO: 861024 - DNA, 23 bp, Homo sapiens
agccagaattcactaggaggtca

SEQ ID NO: 861025 - DNA, 14 bp, Homo sapiens
agccagacaacttc

SEQ ID NO: 861026 - DNA, 22 bp, Homo sapiens
agccagacactctgctctgccc

SEQ ID NO: 861027 - DNA, 15 bp, Homo sapiens
agccagacagcccca

SEQ ID NO: 861028 - DNA, 20 bp, Homo sapiens
agccagacagccccaagctt

SEQ ID NO: 861029 - DNA, 21 bp, Homo sapiens
agccagaccccacgctgacca

SEQ ID NO: 861030 - DNA, 20 bp, Homo sapiens
agccagagaggagcacctga

SEQ ID NO: 861031 - DNA, 12 bp, Homo sapiens
agccagagcccc

SEQ ID NO: 861032 - DNA, 16 bp, Homo sapiens
agccagagccccaagc

SEQ ID NO: 861033 - DNA, 19 bp, Homo sapiens
agccagagcccttcactgc

SEQ ID NO: 861034 - DNA, 23 bp, Homo sapiens
agccagagcccttcactgccatg

SEQ ID NO: 861035 - DNA, 13 bp, Homo sapiens
agccagagcctgg

SEQ ID NO: 861036 - DNA, 14 bp, Homo sapiens
agccagagctgggt

SEQ ID NO: 861037 - DNA, 17 bp, Homo sapiens
agccagagctgtgcctg

SEQ ID NO: 861038 - DNA, 22 bp, Homo sapiens
agccagagctgtgcctgctcag

SEQ ID NO: 861039 - DNA, 16 bp, Homo sapiens
agccagaggagggcag

SEQ ID NO: 861040 - DNA, 11 bp, Homo sapiens
agccagaggct

SEQ ID NO: 861041 - DNA, 14 bp, Homo sapiens
agccagaggctggg

SEQ ID NO: 861042 - DNA, 15 bp, Homo sapiens
agccagaggctgggt

SEQ ID NO: 861043 - DNA, 15 bp, Homo sapiens
agccagagtgtatta

SEQ ID NO: 861044 - DNA, 14 bp, Homo sapiens
agccagagttaggt

SEQ ID NO: 861045 - DNA, 15 bp, Homo sapiens
agccagagttcctgc

SEQ ID NO: 861046 - DNA, 13 bp, Homo sapiens
agccagatccacc

SEQ ID NO: 861047 - DNA, 18 bp, Homo sapiens
agccagattttttaaaat

SEQ ID NO: 861048 - DNA, 14 bp, Homo sapiens
agccagcacctggc

SEQ ID NO: 861049 - DNA, 15 bp, Homo sapiens
agccagcacctggca

SEQ ID NO: 861050 - DNA, 15 bp, Homo sapiens
agccagcacttgtat

SEQ ID NO: 861051 - DNA, 22 bp, Homo sapiens
agccagcagagggggagtagcc

SEQ ID NO: 861052 - DNA, 14 bp, Homo sapiens
agccagcagaggtc

SEQ ID NO: 861053 - DNA, 14 bp, Homo sapiens
agccagcagcagga

SEQ ID NO: 861054 - DNA, 11 bp, Homo sapiens
agccagcagcc

SEQ ID NO: 861055 - DNA, 14 bp, Homo sapiens
agccagcagccagc

SEQ ID NO: 861056 - DNA, 14 bp, Homo sapiens
agccagcatcggaa

SEQ ID NO: 861057 - DNA, 17 bp, Homo sapiens
agccagcattcagcaca

SEQ ID NO: 861058 - DNA, 18 bp, Homo sapiens
agccagcattcagcacac

SEQ ID NO: 861059 - DNA, 11 bp, Homo sapiens
agccagccacc

SEQ ID NO: 861060 - DNA, 15 bp, Homo sapiens
agccagccaggtgca

SEQ ID NO: 861061 - DNA, 19 bp, Homo sapiens
agccagcccatggccccca

SEQ ID NO: 861062 - DNA, 14 bp, Homo sapiens
agccagccccctcc

SEQ ID NO: 861063 - DNA, 17 bp, Homo sapiens
agccagcccctcttccc

SEQ ID NO: 861064 - DNA, 13 bp, Homo sapiens
agccagccctccc

SEQ ID NO: 861065 - DNA, 16 bp, Homo sapiens
agccagccctccctgt

SEQ ID NO: 861066 - DNA, 22 bp, Homo sapiens
agccagccctccctgtcctcct

SEQ ID NO: 861067 - DNA, 12 bp, Homo sapiens
agccagccctgg

SEQ ID NO: 861068 - DNA, 14 bp, Homo sapiens
agccagcccttccc

SEQ ID NO: 861069 - DNA, 17 bp, Homo sapiens
agccagccgccctgggc

SEQ ID NO: 861070 - DNA, 17 bp, Homo sapiens
agccagccggtgcctgg

SEQ ID NO: 861071 - DNA, 17 bp, Homo sapiens
agccagcctcagaaggc

SEQ ID NO: 861072 - DNA, 14 bp, Homo sapiens
agccagcctgacct

SEQ ID NO: 861073 - DNA, 23 bp, Homo sapiens
agccagcctgaccttccttcctg

SEQ ID NO: 861074 - DNA, 14 bp, Homo sapiens
agccatggaaggtg

SEQ ID NO: 861075 - DNA, 18 bp, Homo sapiens
agccatggaaggtgccag

SEQ ID NO: 861076 - DNA, 22 bp, Homo sapiens
agccatggaaggtgccagaagg

SEQ ID NO: 861077 - DNA, 19 bp, Homo sapiens
agccatggagattctcata

SEQ ID NO: 861078 - DNA, 18 bp, Homo sapiens
agccatggctcaggcaag

SEQ ID NO: 861079 - DNA, 13 bp, Homo sapiens
agccatggctggg

SEQ ID NO: 861080 - DNA, 18 bp, Homo sapiens
agccatgggaacctcata

SEQ ID NO: 861081 - DNA, 18 bp, Homo sapiens
agccatgggacctcctcc

SEQ ID NO: 861082 - DNA, 16 bp, Homo sapiens
agccatgggcctgggc

SEQ ID NO: 861083 - DNA, 17 bp, Homo sapiens
agccatgggcctgggcc

SEQ ID NO: 861084 - DNA, 22 bp, Homo sapiens
agccatgtataaccaagtgtgc

SEQ ID NO: 861085 - DNA, 14 bp, Homo sapiens
agccatgtctgcat

SEQ ID NO: 861086 - DNA, 20 bp, Homo sapiens
agccatgtggggttgctgaa

SEQ ID NO: 861087 - DNA, 14 bp, Homo sapiens
agccatgttaaatg

SEQ ID NO: 861088 - DNA, 15 bp, Homo sapiens
agccatgttaaatga

SEQ ID NO: 861089 - DNA, 17 bp, Homo sapiens
agccatgttaaatgact

SEQ ID NO: 861090 - DNA, 13 bp, Homo sapiens
agccattaaaata

SEQ ID NO: 861091 - DNA, 16 bp, Homo sapiens
agccattaaaataaaa

SEQ ID NO: 861092 - DNA, 17 bp, Homo sapiens
agccattaaaataaaac

SEQ ID NO: 861093 - DNA, 18 bp, Homo sapiens
agccattaaaataaaaca

SEQ ID NO: 861094 - DNA, 12 bp, Homo sapiens
agccattaatga

SEQ ID NO: 861095 - DNA, 17 bp, Homo sapiens
agccattacccacgtga

SEQ ID NO: 861096 - DNA, 17 bp, Homo sapiens
agccattctgactcata

SEQ ID NO: 861097 - DNA, 11 bp, Homo sapiens
agccattcttt

SEQ ID NO: 861098 - DNA, 18 bp, Homo sapiens
agccattgaacagctgtg

SEQ ID NO: 861099 - DNA, 22 bp, Homo sapiens
agccattgaacagctgtgagcc

SEQ ID NO: 861100 - DNA, 15 bp, Homo sapiens
agccattgaccaccc

SEQ ID NO: 861101 - DNA, 17 bp, Homo sapiens
agccatttccccctcct

SEQ ID NO: 861102 - DNA, 14 bp, Homo sapiens
agccatttgccatc

SEQ ID NO: 861103 - DNA, 16 bp, Homo sapiens
agccatttttaatgat

SEQ ID NO: 861104 - DNA, 18 bp, Homo sapiens
agccatttttcaaagcaa

SEQ ID NO: 861105 - DNA, 19 bp, Homo sapiens
agcccaaaccttgggccct

SEQ ID NO: 861106 - DNA, 20 bp, Homo sapiens
agcccaaaggggacaggcct

SEQ ID NO: 861107 - DNA, 23 bp, Homo sapiens
agcccaaagtggtatagaaatgc

SEQ ID NO: 861108 - DNA, 14 bp, Homo sapiens
agcccaagaggact

SEQ ID NO: 861109 - DNA, 20 bp, Homo sapiens
agcccaagaggtctgagccc

SEQ ID NO: 861110 - DNA, 21 bp, Homo sapiens
agcccaagaggtctgagccct

SEQ ID NO: 861111 - DNA, 22 bp, Homo sapiens
agcccaagaggtctgagccctg

SEQ ID NO: 861112 - DNA, 21 bp, Homo sapiens
agcccaagcttaatagccctc

SEQ ID NO: 861113 - DNA, 22 bp, Homo sapiens
agcccaagcttaatagccctcc

SEQ ID NO: 861114 - DNA, 14 bp, Homo sapiens
agcccaagcttccc

SEQ ID NO: 861115 - DNA, 16 bp, Homo sapiens
agcccaagcttccctc

SEQ ID NO: 861116 - DNA, 17 bp, Homo sapiens
agcccaaggtcagggag

SEQ ID NO: 861117 - DNA, 16 bp, Homo sapiens
agcccaataaacctct

SEQ ID NO: 861118 - DNA, 20 bp, Homo sapiens
agcccaatattataattttt

SEQ ID NO: 861119 - DNA, 16 bp, Homo sapiens
agcccacaaagcctta

SEQ ID NO: 861120 - DNA, 16 bp, Homo sapiens
agcccacagagcctga

SEQ ID NO: 861121 - DNA, 13 bp, Homo sapiens
agcccacagcgag

SEQ ID NO: 861122 - DNA, 22 bp, Homo sapiens
agcccacagcgagcctgtgcct

SEQ ID NO: 861123 - DNA, 23 bp, Homo sapiens
agcccacagcgagcctgtgcctt

SEQ ID NO: 861124 - DNA, 24 bp, Homo sapiens
agcccacagcgagcctgtgccttc

SEQ ID NO: 861125 - DNA, 16 bp, Homo sapiens
agcccacaggcctgtt

SEQ ID NO: 861126 - DNA, 17 bp, Homo sapiens
agcccaccaatctgccc

SEQ ID NO: 861127 - DNA, 13 bp, Homo sapiens
agcccaccagcca

SEQ ID NO: 861128 - DNA, 14 bp, Homo sapiens
agcccaccagccag

SEQ ID NO: 861129 - DNA, 22 bp, Homo sapiens
agcccaccagccagccctggcc

SEQ ID NO: 861130 - DNA, 24 bp, Homo sapiens
agcccaccaggagcacctggaccc

SEQ ID NO: 861131 - DNA, 13 bp, Homo sapiens
agcccacccccct

SEQ ID NO: 861132 - DNA, 16 bp, Homo sapiens
agcccacccccctcat

SEQ ID NO: 861133 - DNA, 15 bp, Homo sapiens
agcccacccctcaac

SEQ ID NO: 861134 - DNA, 12 bp, Homo sapiens
agcccacctggg

SEQ ID NO: 861135 - DNA, 23 bp, Homo sapiens
agcccacgcccgactagcaggca

SEQ ID NO: 861136 - DNA, 17 bp, Homo sapiens
agcccacggggatcaca

SEQ ID NO: 861137 - DNA, 23 bp, Homo sapiens
agcccacggggatcacagcgttt

SEQ ID NO: 861138 - DNA, 19 bp, Homo sapiens
agcccactgcccaccccct

SEQ ID NO: 861139 - DNA, 15 bp, Homo sapiens
agcccactgcctcct

SEQ ID NO: 861140 - DNA, 21 bp, Homo sapiens
agcccactgcctcctgcctgg

SEQ ID NO: 861141 - DNA, 19 bp, Homo sapiens
agcccagaacaaaaagaaa

SEQ ID NO: 861142 - DNA, 13 bp, Homo sapiens
agcccagactctg

SEQ ID NO: 861143 - DNA, 12 bp, Homo sapiens
agcccagagact

SEQ ID NO: 861144 - DNA, 13 bp, Homo sapiens
agcccagagccac

SEQ ID NO: 861145 - DNA, 18 bp, Homo sapiens
agcccagagccacctgga

SEQ ID NO: 861146 - DNA, 14 bp, Homo sapiens
agcccagagcctgg

SEQ ID NO: 861147 - DNA, 17 bp, Homo sapiens
agcccagagcctggctg

SEQ ID NO: 861148 - DNA, 21 bp, Homo sapiens
agcccagatacgggggctgtg

SEQ ID NO: 861149 - DNA, 17 bp, Homo sapiens
agcccagattcccctgt

SEQ ID NO: 861150 - DNA, 21 bp, Homo sapiens
agcccagattcccctgtgtca

SEQ ID NO: 861151 - DNA, 23 bp, Homo sapiens
agcccagccattaccatggagac

SEQ ID NO: 861152 - DNA, 16 bp, Homo sapiens
agcccagccccactcc

SEQ ID NO: 861153 - DNA, 20 bp, Homo sapiens
agcccagcccctactgctgt

SEQ ID NO: 861154 - DNA, 13 bp, Homo sapiens
agcccagccctcc

SEQ ID NO: 861155 - DNA, 14 bp, Homo sapiens
agcccagcctgccc

SEQ ID NO: 861156 - DNA, 23 bp, Homo sapiens
agcccagcctgccccctatcttg

SEQ ID NO: 861157 - DNA, 14 bp, Homo sapiens
agcccagcctggga

SEQ ID NO: 861158 - DNA, 16 bp, Homo sapiens
agcccagctacattcc

SEQ ID NO: 861159 - DNA, 22 bp, Homo sapiens
agcccagctacattcctcagct

SEQ ID NO: 861160 - DNA, 12 bp, Homo sapiens
agcccagctctt

SEQ ID NO: 861161 - DNA, 16 bp, Homo sapiens
agcccagctgggtcag

SEQ ID NO: 861162 - DNA, 17 bp, Homo sapiens
agcccagctgggtcagg

SEQ ID NO: 861163 - DNA, 16 bp, Homo sapiens
agcccaggagcaacag

SEQ ID NO: 861164 - DNA, 12 bp, Homo sapiens
agcccaggagct

SEQ ID NO: 861165 - DNA, 13 bp, Homo sapiens
agcccaggccgtt

SEQ ID NO: 861166 - DNA, 23 bp, Homo sapiens
agcccaggccgttccccttggct

SEQ ID NO: 861167 - DNA, 23 bp, Homo sapiens
agcccaggctcggaggaccctgg

SEQ ID NO: 861168 - DNA, 22 bp, Homo sapiens
agcccaggctgatgcttgaagt

SEQ ID NO: 861169 - DNA, 23 bp, Homo sapiens
agcccagggcatcttgctggcta

SEQ ID NO: 861170 - DNA, 13 bp, Homo sapiens
agcccagggcctg

SEQ ID NO: 861171 - DNA, 23 bp, Homo sapiens
agcccagggctcctgcacttact

SEQ ID NO: 861172 - DNA, 22 bp, Homo sapiens
agcccaggggagaatgcagccc

SEQ ID NO: 861173 - DNA, 10 bp, Homo sapiens
agcccagggt

SEQ ID NO: 861174 - DNA, 22 bp, Homo sapiens
agcccagggttcccccagccct

SEQ ID NO: 861175 - DNA, 15 bp, Homo sapiens
agcccagtagacctt

SEQ ID NO: 861176 - DNA, 18 bp, Homo sapiens
agcccagtagaccttgtt

SEQ ID NO: 861177 - DNA, 15 bp, Homo sapiens
agcccagtgaagcct

SEQ ID NO: 861178 - DNA, 16 bp, Homo sapiens
agcccagtgctgctgt

SEQ ID NO: 861179 - DNA, 18 bp, Homo sapiens
agcccagtgctgctgtaa

SEQ ID NO: 861180 - DNA, 21 bp, Homo sapiens
agcccagtgggctgcacgctc

SEQ ID NO: 861181 - DNA, 15 bp, Homo sapiens
agcccagtggtgagg

SEQ ID NO: 861182 - DNA, 14 bp, Homo sapiens
agcccagtgttttc

SEQ ID NO: 861183 - DNA, 19 bp, Homo sapiens
agcccataaagtctgagaa

SEQ ID NO: 861184 - DNA, 16 bp, Homo sapiens
agcccatactcagcct

SEQ ID NO: 861185 - DNA, 18 bp, Homo sapiens
agcccatactcagcctgc

SEQ ID NO: 861186 - DNA, 13 bp, Homo sapiens
agcccatcacctc

SEQ ID NO: 861187 - DNA, 15 bp, Homo sapiens
agcccatcacctcta

SEQ ID NO: 861188 - DNA, 20 bp, Homo sapiens
agcccatccattaggccagc

SEQ ID NO: 861189 - DNA, 14 bp, Homo sapiens
agcccatcctgacc

SEQ ID NO: 861190 - DNA, 16 bp, Homo sapiens
agcccatcctgaccag

SEQ ID NO: 861191 - DNA, 16 bp, Homo sapiens
agcccatgcccacctg

SEQ ID NO: 861192 - DNA, 17 bp, Homo sapiens
agcccatggacttcaca

SEQ ID NO: 861193 - DNA, 16 bp, Homo sapiens
agcccatggcccccaa

SEQ ID NO: 861194 - DNA, 17 bp, Homo sapiens
agcccatggcccccaat

SEQ ID NO: 861195 - DNA, 20 bp, Homo sapiens
agcccatggcccccaataaa

SEQ ID NO: 861196 - DNA, 22 bp, Homo sapiens
agcccatggcccccaataaagg

SEQ ID NO: 861197 - DNA, 23 bp, Homo sapiens
agcccatggtaacgaacccctag

SEQ ID NO: 861198 - DNA, 14 bp, Homo sapiens
agcccatgtcttct

SEQ ID NO: 861199 - DNA, 19 bp, Homo sapiens
agcccatgtggctaaaaaa

SEQ ID NO: 861200 - DNA, 17 bp, Homo sapiens
agcccatgttctgcccc

SEQ ID NO: 861201 - DNA, 19 bp, Homo sapiens
agcccatgttctgccccca

SEQ ID NO: 861202 - DNA, 17 bp, Homo sapiens
agcccattctctctcct

SEQ ID NO: 861203 - DNA, 22 bp, Homo sapiens
agcccattctctctcctgtcca

SEQ ID NO: 861204 - DNA, 15 bp, Homo sapiens
agcccattcttctgg

SEQ ID NO: 861205 - DNA, 15 bp, Homo sapiens
agcccattggccgag

SEQ ID NO: 861206 - DNA, 20 bp, Homo sapiens
agcccattggccgagctcct

SEQ ID NO: 861207 - DNA, 18 bp, Homo sapiens
agccccaactccaggggc

SEQ ID NO: 861208 - DNA, 19 bp, Homo sapiens
agccccaactccaggggca

SEQ ID NO: 861209 - DNA, 21 bp, Homo sapiens
agccccaactccaggggcacc

SEQ ID NO: 861210 - DNA, 14 bp, Homo sapiens
agccccaagctggg

SEQ ID NO: 861211 - DNA, 15 bp, Homo sapiens
agccccaagctgggc

SEQ ID NO: 861212 - DNA, 18 bp, Homo sapiens
agccccaagcttctgagt

SEQ ID NO: 861213 - DNA, 23 bp, Homo sapiens
agccccaagggctggggcggagc

SEQ ID NO: 861214 - DNA, 12 bp, Homo sapiens
agccccacccag

SEQ ID NO: 861215 - DNA, 15 bp, Homo sapiens
agccccacccaggag

SEQ ID NO: 861216 - DNA, 17 bp, Homo sapiens
agccccacccccagcca

SEQ ID NO: 861217 - DNA, 18 bp, Homo sapiens
agccccacccccagccag

SEQ ID NO: 861218 - DNA, 19 bp, Homo sapiens
agccccacccccagccagg

SEQ ID NO: 861219 - DNA, 20 bp, Homo sapiens
agccccacccccagccaggc

SEQ ID NO: 861220 - DNA, 16 bp, Homo sapiens
agccccaccctggcct

SEQ ID NO: 861221 - DNA, 22 bp, Homo sapiens
agccccacctctccaagtctct

SEQ ID NO: 861222 - DNA, 13 bp, Homo sapiens
agccccactcccg

SEQ ID NO: 861223 - DNA, 19 bp, Homo sapiens
agccccactcccggccagg

SEQ ID NO: 861224 - DNA, 12 bp, Homo sapiens
agccccactgcc

SEQ ID NO: 861225 - DNA, 17 bp, Homo sapiens
agccccactgccagcag

SEQ ID NO: 861226 - DNA, 20 bp, Homo sapiens
agccccactgccagcagcag

SEQ ID NO: 861227 - DNA, 18 bp, Homo sapiens
agccccacttcaccccca

SEQ ID NO: 861228 - DNA, 16 bp, Homo sapiens
agccccagccccttcc

SEQ ID NO: 861229 - DNA, 16 bp, Homo sapiens
agccccaggcaggctg

SEQ ID NO: 861230 - DNA, 18 bp, Homo sapiens
agccccaggcctctgtgt

SEQ ID NO: 861231 - DNA, 14 bp, Homo sapiens
agccccaggcctgg

SEQ ID NO: 861232 - DNA, 15 bp, Homo sapiens
agccccaggcctggc

SEQ ID NO: 861233 - DNA, 16 bp, Homo sapiens
agccccaggcctggcc

SEQ ID NO: 861234 - DNA, 23 bp, Homo sapiens
agccccaggcctggcctcgcctg

SEQ ID NO: 861235 - DNA, 10 bp, Homo sapiens
agccccaggg

SEQ ID NO: 861236 - DNA, 13 bp, Homo sapiens
agccccagggcct

SEQ ID NO: 861237 - DNA, 17 bp, Homo sapiens
agccccaggtcttttct

SEQ ID NO: 861238 - DNA, 20 bp, Homo sapiens
agccccagtcttccttgtct

SEQ ID NO: 861239 - DNA, 17 bp, Homo sapiens
agccccagtgacagcta

SEQ ID NO: 861240 - DNA, 13 bp, Homo sapiens
agccccagtgctg

SEQ ID NO: 861241 - DNA, 16 bp, Homo sapiens
agccccatcctgtgtt

SEQ ID NO: 861242 - DNA, 17 bp, Homo sapiens
agccccatcggccaaga

SEQ ID NO: 861243 - DNA, 19 bp, Homo sapiens
agccccatctcatcctggc

SEQ ID NO: 861244 - DNA, 20 bp, Homo sapiens
agccccatctcatcctggca

SEQ ID NO: 861245 - DNA, 21 bp, Homo sapiens
agccccatctcatcctggcac

SEQ ID NO: 861246 - DNA, 23 bp, Homo sapiens
agccccatgtgccttgtccagga

SEQ ID NO: 861247 - DNA, 13 bp, Homo sapiens
agccccattcctg

SEQ ID NO: 861248 - DNA, 13 bp, Homo sapiens
agcccccaacaca

SEQ ID NO: 861249 - DNA, 14 bp, Homo sapiens
agcccccaacacag

SEQ ID NO: 861250 - DNA, 21 bp, Homo sapiens
agcccccaaccccgcggtgct

SEQ ID NO: 861251 - DNA, 11 bp, Homo sapiens
agcccccacca

SEQ ID NO: 861252 - DNA, 17 bp, Homo sapiens
agcccccaccacaaact

SEQ ID NO: 861253 - DNA, 15 bp, Homo sapiens
agcccccaccagcag

SEQ ID NO: 861254 - DNA, 22 bp, Homo sapiens
agcccccaccagcagcacaatt

SEQ ID NO: 861255 - DNA, 13 bp, Homo sapiens
agcccccaccagg

SEQ ID NO: 861256 - DNA, 21 bp, Homo sapiens
agcccccaccggaactgggct

SEQ ID NO: 861257 - DNA, 19 bp, Homo sapiens
agcccccaccttgatccca

SEQ ID NO: 861258 - DNA, 21 bp, Homo sapiens
agcccccagatagagctgggt

SEQ ID NO: 861259 - DNA, 22 bp, Homo sapiens
agcccccagatagagctgggtg

SEQ ID NO: 861260 - DNA, 23 bp, Homo sapiens
agcccccagatagagctgggtgg

SEQ ID NO: 861261 - DNA, 18 bp, Homo sapiens
agcccccagcagaggcag

SEQ ID NO: 861262 - DNA, 19 bp, Homo sapiens
agcccccagcagaggcagg

SEQ ID NO: 861263 - DNA, 15 bp, Homo sapiens
agcccccaggaagac

SEQ ID NO: 861264 - DNA, 13 bp, Homo sapiens
agcccccaggcca

SEQ ID NO: 861265 - DNA, 15 bp, Homo sapiens
agcccccaggccagg

SEQ ID NO: 861266 - DNA, 13 bp, Homo sapiens
agcccccagggcc

SEQ ID NO: 861267 - DNA, 14 bp, Homo sapiens
agcccccagggccc

SEQ ID NO: 861268 - DNA, 18 bp, Homo sapiens
agcccccagggcctccag

SEQ ID NO: 861269 - DNA, 18 bp, Homo sapiens
agcccccccacccacccc

SEQ ID NO: 861270 - DNA, 22 bp, Homo sapiens
agcccccccacccacccccagg

SEQ ID NO: 861271 - DNA, 19 bp, Homo sapiens
agcccccccactccagccc

SEQ ID NO: 861272 - DNA, 16 bp, Homo sapiens
agcccccccctcaagg

SEQ ID NO: 861273 - DNA, 15 bp, Homo sapiens
agcccccccttccac

SEQ ID NO: 861274 - DNA, 13 bp, Homo sapiens
agccccctccaca

SEQ ID NO: 861275 - DNA, 17 bp, Homo sapiens
agccccctggcagctgc

SEQ ID NO: 861276 - DNA, 19 bp, Homo sapiens
agccccctggcctctgtgc

SEQ ID NO: 861277 - DNA, 17 bp, Homo sapiens
agcccccttctccatgg

SEQ ID NO: 861278 - DNA, 16 bp, Homo sapiens
agcccccttgacaccg

SEQ ID NO: 861279 - DNA, 15 bp, Homo sapiens
agccccgactccagc

SEQ ID NO: 861280 - DNA, 17 bp, Homo sapiens
agccccgactccagcca

SEQ ID NO: 861281 - DNA, 22 bp, Homo sapiens
agccccgactccagccagcgcc

SEQ ID NO: 861282 - DNA, 23 bp, Homo sapiens
agccccgactccagccagcgcct

SEQ ID NO: 861283 - DNA, 16 bp, Homo sapiens
agccccgagctgtccc

SEQ ID NO: 861284 - DNA, 16 bp, Homo sapiens
agccccgcacgggctg

SEQ ID NO: 861285 - DNA, 22 bp, Homo sapiens
agccccgccccagccctcagtc

SEQ ID NO: 861286 - DNA, 16 bp, Homo sapiens
agccccgccctcttcc

SEQ ID NO: 861287 - DNA, 17 bp, Homo sapiens
agccccgccctcttcct

SEQ ID NO: 861288 - DNA, 18 bp, Homo sapiens
agccccgccctcttcctg

SEQ ID NO: 861289 - DNA, 20 bp, Homo sapiens
agccccgccctcttcctgac

SEQ ID NO: 861290 - DNA, 22 bp, Homo sapiens
agccccgccctcttcctgacga

SEQ ID NO: 861291 - DNA, 13 bp, Homo sapiens
agccccgcctgtc

SEQ ID NO: 861292 - DNA, 14 bp, Homo sapiens
agccccgcctgtca

SEQ ID NO: 861293 - DNA, 15 bp, Homo sapiens
agccccgcctgtcac

SEQ ID NO: 861294 - DNA, 16 bp, Homo sapiens
agccccgcctgtcaca

SEQ ID NO: 861295 - DNA, 20 bp, Homo sapiens
agccccgcgaccatgtggcc

SEQ ID NO: 861296 - DNA, 14 bp, Homo sapiens
agccccgctcaggc

SEQ ID NO: 861297 - DNA, 13 bp, Homo sapiens
agccccgctccca

SEQ ID NO: 861298 - DNA, 16 bp, Homo sapiens
agccccgctcccacct

SEQ ID NO: 861299 - DNA, 24 bp, Homo sapiens
agccccggggtgagtccattctcc

SEQ ID NO: 861300 - DNA, 18 bp, Homo sapiens
agcccctacccctgccct

SEQ ID NO: 861301 - DNA, 22 bp, Homo sapiens
agcccctacccctgccctgctc

SEQ ID NO: 861302 - DNA, 12 bp, Homo sapiens
agcccctagaaa

SEQ ID NO: 861303 - DNA, 23 bp, Homo sapiens
agcccctagaaacccaagctcct

SEQ ID NO: 861304 - DNA, 14 bp, Homo sapiens
agcccctcagccct

SEQ ID NO: 861305 - DNA, 17 bp, Homo sapiens
agcccctcagcccttgc

SEQ ID NO: 861306 - DNA, 18 bp, Homo sapiens
agcccctcagcccttgcc

SEQ ID NO: 861307 - DNA, 13 bp, Homo sapiens
agcccctccccag

SEQ ID NO: 861308 - DNA, 22 bp, Homo sapiens
agcccctcctccagcccctgtc

SEQ ID NO: 861309 - DNA, 13 bp, Homo sapiens
agcccctcctccc

SEQ ID NO: 861310 - DNA, 15 bp, Homo sapiens
agcccctcctccccc

SEQ ID NO: 861311 - DNA, 19 bp, Homo sapiens
agcccctcctcccccggct

SEQ ID NO: 861312 - DNA, 17 bp, Homo sapiens
agcccctcctctgccac

SEQ ID NO: 861313 - DNA, 23 bp, Homo sapiens
agcccctcctctgccacctcccc

SEQ ID NO: 861314 - DNA, 14 bp, Homo sapiens
agcccctcgaggcc

SEQ ID NO: 861315 - DNA, 18 bp, Homo sapiens
agcccctcgaggcctaca

SEQ ID NO: 861316 - DNA, 18 bp, Homo sapiens
agcccctcggctctggag

SEQ ID NO: 861317 - DNA, 21 bp, Homo sapiens
agcccctctcccctctctgct

SEQ ID NO: 861318 - DNA, 22 bp, Homo sapiens
agcccctctcccctctctgctc

SEQ ID NO: 861319 - DNA, 22 bp, Homo sapiens
agcccctctggtcgctcctgcc

SEQ ID NO: 861320 - DNA, 10 bp, Homo sapiens
agcccctctt

SEQ ID NO: 861321 - DNA, 20 bp, Homo sapiens
agcccctcttggagaagtct

SEQ ID NO: 861322 - DNA, 23 bp, Homo sapiens
agcccctcttggagaagtctcag

SEQ ID NO: 861323 - DNA, 16 bp, Homo sapiens
agcccctgatctctga

SEQ ID NO: 861324 - DNA, 17 bp, Homo sapiens
agcccctgatctctgac

SEQ ID NO: 861325 - DNA, 20 bp, Homo sapiens
agcccctgggaacaggcccc

SEQ ID NO: 861326 - DNA, 20 bp, Homo sapiens
agcccctggggcccagcccc

SEQ ID NO: 861327 - DNA, 21 bp, Homo sapiens
agcccctgtctagagagggag

SEQ ID NO: 861328 - DNA, 23 bp, Homo sapiens
agcccctgtctagagagggaggc

SEQ ID NO: 861329 - DNA, 17 bp, Homo sapiens
agccccttatttttagc

SEQ ID NO: 861330 - DNA, 17 bp, Homo sapiens
agccccttccttgctct

SEQ ID NO: 861331 - DNA, 18 bp, Homo sapiens
agccccttctcccagcac

SEQ ID NO: 861332 - DNA, 23 bp, Homo sapiens
agccccttctcccagcacacggc

SEQ ID NO: 861333 - DNA, 20 bp, Homo sapiens
agccccttgctctcccctgc

SEQ ID NO: 861334 - DNA, 15 bp, Homo sapiens
agccccttgcttcaa

SEQ ID NO: 861335 - DNA, 13 bp, Homo sapiens
agccccttggaga

SEQ ID NO: 861336 - DNA, 17 bp, Homo sapiens
agcccctttgcctctgt

SEQ ID NO: 861337 - DNA, 17 bp, Homo sapiens
agcccgacagtgccatc

SEQ ID NO: 861338 - DNA, 22 bp, Homo sapiens
agcccgatattctccctgacct

SEQ ID NO: 861339 - DNA, 23 bp, Homo sapiens
agcccgatattctccctgacctt

SEQ ID NO: 861340 - DNA, 17 bp, Homo sapiens
agcccgcacccccaccc

SEQ ID NO: 861341 - DNA, 12 bp, Homo sapiens
agcccgcagcac

SEQ ID NO: 861342 - DNA, 14 bp, Homo sapiens
agcccgcagcacat

SEQ ID NO: 861343 - DNA, 13 bp, Homo sapiens
agcccgcagccca

SEQ ID NO: 861344 - DNA, 19 bp, Homo sapiens
agcccgcagggccatgcag

SEQ ID NO: 861345 - DNA, 19 bp, Homo sapiens
agcccgccgcccgcccctc

SEQ ID NO: 861346 - DNA, 20 bp, Homo sapiens
agcccgccgcccgcccctca

SEQ ID NO: 861347 - DNA, 22 bp, Homo sapiens
agcccgccgtctgcaggggcct

SEQ ID NO: 861348 - DNA, 20 bp, Homo sapiens
agcccgcctgccgtgcatgg

SEQ ID NO: 861349 - DNA, 21 bp, Homo sapiens
agcccgcctgccgtgcatggc

SEQ ID NO: 861350 - DNA, 14 bp, Homo sapiens
agcccgcggcctgg

SEQ ID NO: 861351 - DNA, 15 bp, Homo sapiens
agcccgcttcaagct

SEQ ID NO: 861352 - DNA, 17 bp, Homo sapiens
agcccgcttcaagctct

SEQ ID NO: 861353 - DNA, 21 bp, Homo sapiens
agcccggaggggactggtccc

SEQ ID NO: 861354 - DNA, 16 bp, Homo sapiens
agcccggccctccccc

SEQ ID NO: 861355 - DNA, 23 bp, Homo sapiens
agcccggccctcccccagctcct

SEQ ID NO: 861356 - DNA, 11 bp, Homo sapiens
agcccggcctg

SEQ ID NO: 861357 - DNA, 21 bp, Homo sapiens
agcccggcctgctcccagcag

SEQ ID NO: 861358 - DNA, 22 bp, Homo sapiens
agcccggcctgctcccagcagc

SEQ ID NO: 861359 - DNA, 17 bp, Homo sapiens
agcccgggagcctagga

SEQ ID NO: 861360 - DNA, 18 bp, Homo sapiens
agcccgggagcctaggac

SEQ ID NO: 861361 - DNA, 20 bp, Homo sapiens
agcccgggagcctaggacca

SEQ ID NO: 861362 - DNA, 15 bp, Homo sapiens
agcccgggctgcctg

SEQ ID NO: 861363 - DNA, 18 bp, Homo sapiens
agcccgggctgcctgggc

SEQ ID NO: 861364 - DNA, 19 bp, Homo sapiens
agcccgggctgcctgggct

SEQ ID NO: 861365 - DNA, 15 bp, Homo sapiens
agcccgtcctcctct

SEQ ID NO: 861366 - DNA, 17 bp, Homo sapiens
agcccgtgaagcagtgc

SEQ ID NO: 861367 - DNA, 15 bp, Homo sapiens
agcccgtgacagatg

SEQ ID NO: 861368 - DNA, 20 bp, Homo sapiens
agcccgtgcagtacaggcaa

SEQ ID NO: 861369 - DNA, 15 bp, Homo sapiens
agcccgtgtggcccc

SEQ ID NO: 861370 - DNA, 16 bp, Homo sapiens
agcccgtgtggcccct

SEQ ID NO: 861371 - DNA, 16 bp, Homo sapiens
agcccgttagccccag

SEQ ID NO: 861372 - DNA, 15 bp, Homo sapiens
agcccgttttcacac

SEQ ID NO: 861373 - DNA, 17 bp, Homo sapiens
agccctaagcctgtccc

SEQ ID NO: 861374 - DNA, 24 bp, Homo sapiens
agccctactccctgcagatgccac

SEQ ID NO: 861375 - DNA, 15 bp, Homo sapiens
agccctactcctgcg

SEQ ID NO: 861376 - DNA, 14 bp, Homo sapiens
agccctatggatgt

SEQ ID NO: 861377 - DNA, 15 bp, Homo sapiens
agccctatggatgtg

SEQ ID NO: 861378 - DNA, 14 bp, Homo sapiens
agccctcacctctg

SEQ ID NO: 861379 - DNA, 15 bp, Homo sapiens
agccctcacctctga

SEQ ID NO: 861380 - DNA, 17 bp, Homo sapiens
agccctcacctctgagg

SEQ ID NO: 861381 - DNA, 11 bp, Homo sapiens
agccctcaggc

SEQ ID NO: 861382 - DNA, 12 bp, Homo sapiens
agccctcaggct

SEQ ID NO: 861383 - DNA, 18 bp, Homo sapiens
agccctcagtcaccccca

SEQ ID NO: 861384 - DNA, 16 bp, Homo sapiens
agccctcagttccttc

SEQ ID NO: 861385 - DNA, 15 bp, Homo sapiens
agccctccaaaagca

SEQ ID NO: 861386 - DNA, 13 bp, Homo sapiens
agccctccatggt

SEQ ID NO: 861387 - DNA, 20 bp, Homo sapiens
agccctccatggtcctgtct

SEQ ID NO: 861388 - DNA, 21 bp, Homo sapiens
agccctccatggtcctgtctg

SEQ ID NO: 861389 - DNA, 22 bp, Homo sapiens
agccctccccatctcggggctg

SEQ ID NO: 861390 - DNA, 23 bp, Homo sapiens
agccctccccatctcggggctgc

SEQ ID NO: 861391 - DNA, 19 bp, Homo sapiens
agccctccccatggagcca

SEQ ID NO: 861392 - DNA, 21 bp, Homo sapiens
agccctccccatggagccagc

SEQ ID NO: 861393 - DNA, 12 bp, Homo sapiens
agccctccccca

SEQ ID NO: 861394 - DNA, 13 bp, Homo sapiens
agccctcccccaa

SEQ ID NO: 861395 - DNA, 21 bp, Homo sapiens
agccctccccccagctccctg

SEQ ID NO: 861396 - DNA, 23 bp, Homo sapiens
agccctccctgcccctcccttca

SEQ ID NO: 861397 - DNA, 15 bp, Homo sapiens
agccctccctgtcct

SEQ ID NO: 861398 - DNA, 16 bp, Homo sapiens
agccctccctgtcctc

SEQ ID NO: 861399 - DNA, 12 bp, Homo sapiens
agccctcctcac

SEQ ID NO: 861400 - DNA, 17 bp, Homo sapiens
agccctccttccacgga

SEQ ID NO: 861401 - DNA, 19 bp, Homo sapiens
agccctcgaaccaaggcag

SEQ ID NO: 861402 - DNA, 21 bp, Homo sapiens
agccctcgaaccaaggcagcc

SEQ ID NO: 861403 - DNA, 14 bp, Homo sapiens
agccctcggcctcc

SEQ ID NO: 861404 - DNA, 17 bp, Homo sapiens
agccctctcactccagc

SEQ ID NO: 861405 - DNA, 19 bp, Homo sapiens
agccctctcactccagcca

SEQ ID NO: 861406 - DNA, 22 bp, Homo sapiens
agccctctcactccagccaaag

SEQ ID NO: 861407 - DNA, 23 bp, Homo sapiens
agccctcttgcccgcacccctcc

SEQ ID NO: 861408 - DNA, 16 bp, Homo sapiens
agccctgaatttcttc

SEQ ID NO: 861409 - DNA, 19 bp, Homo sapiens
agccctgaatttcttcttt

SEQ ID NO: 861410 - DNA, 17 bp, Homo sapiens
agccctgaccctgtgga

SEQ ID NO: 861411 - DNA, 16 bp, Homo sapiens
agccctgaccttggct

SEQ ID NO: 861412 - DNA, 13 bp, Homo sapiens
agccctgactcct

SEQ ID NO: 861413 - DNA, 17 bp, Homo sapiens
agccctgactcctggac

SEQ ID NO: 861414 - DNA, 17 bp, Homo sapiens
agccctgactggtgcta

SEQ ID NO: 861415 - DNA, 20 bp, Homo sapiens
agccctgagcccggccctcc

SEQ ID NO: 861416 - DNA, 15 bp, Homo sapiens
agccctgagctttct

SEQ ID NO: 861417 - DNA, 15 bp, Homo sapiens
agccctgaggggctg

SEQ ID NO: 861418 - DNA, 17 bp, Homo sapiens
agccctgaggggctggg

SEQ ID NO: 861419 - DNA, 21 bp, Homo sapiens
agccctgaggtgaaagggagc

SEQ ID NO: 861420 - DNA, 18 bp, Homo sapiens
agccctgagtggtcactg

SEQ ID NO: 861421 - DNA, 15 bp, Homo sapiens
agccctgcagcccaa

SEQ ID NO: 861422 - DNA, 16 bp, Homo sapiens
agccctgcattttcat

SEQ ID NO: 861423 - DNA, 15 bp, Homo sapiens
agccctgccctgcac

SEQ ID NO: 861424 - DNA, 12 bp, Homo sapiens
agccctgcctct

SEQ ID NO: 861425 - DNA, 14 bp, Homo sapiens
agccctgcctctgt

SEQ ID NO: 861426 - DNA, 17 bp, Homo sapiens
agccctgctgtgggaga

SEQ ID NO: 861427 - DNA, 17 bp, Homo sapiens
agccctggacacccctg

SEQ ID NO: 861428 - DNA, 21 bp, Homo sapiens
agccctggcaggatgaccctg

SEQ ID NO: 861429 - DNA, 22 bp, Homo sapiens
agccctggcccaccccccagcc

SEQ ID NO: 861430 - DNA, 17 bp, Homo sapiens
agccctggcctggctgg

SEQ ID NO: 861431 - DNA, 13 bp, Homo sapiens
agccctggccttt

SEQ ID NO: 861432 - DNA, 19 bp, Homo sapiens
agccctggcctttttcttt

SEQ ID NO: 861433 - DNA, 18 bp, Homo sapiens
agccctggctcccacctg

SEQ ID NO: 861434 - DNA, 13 bp, Homo sapiens
agccctggctctg

SEQ ID NO: 861435 - DNA, 22 bp, Homo sapiens
agccctggctctgcccctcagg

SEQ ID NO: 861436 - DNA, 16 bp, Homo sapiens
agccctgggaaccact

SEQ ID NO: 861437 - DNA, 19 bp, Homo sapiens
agccctgggaaccactccc

SEQ ID NO: 861438 - DNA, 20 bp, Homo sapiens
agccctgggaaccactccca

SEQ ID NO: 861439 - DNA, 16 bp, Homo sapiens
agccctgggatcactg

SEQ ID NO: 861440 - DNA, 16 bp, Homo sapiens
agccctgggccccacc

SEQ ID NO: 861441 - DNA, 20 bp, Homo sapiens
agccctgggcttggctcttg

SEQ ID NO: 861442 - DNA, 21 bp, Homo sapiens
agccctgggtgacttcaggtg

SEQ ID NO: 861443 - DNA, 22 bp, Homo sapiens
agccctgtacccaccccagcac

SEQ ID NO: 861444 - DNA, 16 bp, Homo sapiens
agccctgtcagtgcag

SEQ ID NO: 861445 - DNA, 14 bp, Homo sapiens
agccctgtcctggt

SEQ ID NO: 861446 - DNA, 23 bp, Homo sapiens
agccctgtcgagacacttgcctt

SEQ ID NO: 861447 - DNA, 22 bp, Homo sapiens
agccctgtctgctaggcgctgg

SEQ ID NO: 861448 - DNA, 15 bp, Homo sapiens
agccctgtggccgcc

SEQ ID NO: 861449 - DNA, 16 bp, Homo sapiens
agccctgtggccgcca

SEQ ID NO: 861450 - DNA, 18 bp, Homo sapiens
agccctgtggccgccacc

SEQ ID NO: 861451 - DNA, 20 bp, Homo sapiens
agccctgttgacacaggtct

SEQ ID NO: 861452 - DNA, 18 bp, Homo sapiens
agcccttcactgccatga

SEQ ID NO: 861453 - DNA, 10 bp, Homo sapiens
agcccttcca

SEQ ID NO: 861454 - DNA, 16 bp, Homo sapiens
agcccttccagcctgg

SEQ ID NO: 861455 - DNA, 18 bp, Homo sapiens
agcccttccagcctggga

SEQ ID NO: 861456 - DNA, 22 bp, Homo sapiens
agcccttccagcctgggacaca

SEQ ID NO: 861457 - DNA, 22 bp, Homo sapiens
agcccttccatgtcgcctctgc

SEQ ID NO: 861458 - DNA, 14 bp, Homo sapiens
agcccttccctgag

SEQ ID NO: 861459 - DNA, 22 bp, Homo sapiens
agcccttcctcctgaagcctct

SEQ ID NO: 861460 - DNA, 15 bp, Homo sapiens
agcccttccttgggc

SEQ ID NO: 861461 - DNA, 17 bp, Homo sapiens
agcccttcggtcacctg

SEQ ID NO: 861462 - DNA, 15 bp, Homo sapiens
agcccttctctttga

SEQ ID NO: 861463 - DNA, 23 bp, Homo sapiens
agcccttctctttgacttaggtt

SEQ ID NO: 861464 - DNA, 14 bp, Homo sapiens
agcccttctgcctt

SEQ ID NO: 861465 - DNA, 15 bp, Homo sapiens
agcccttctgccttt

SEQ ID NO: 861466 - DNA, 22 bp, Homo sapiens
agcccttgactgtacagagact

SEQ ID NO: 861467 - DNA, 23 bp, Homo sapiens
agcccttgactgtacagagactc

SEQ ID NO: 861468 - DNA, 19 bp, Homo sapiens
agcccttgcccccatccct

SEQ ID NO: 861469 - DNA, 13 bp, Homo sapiens
agcccttgcctcc

SEQ ID NO: 861470 - DNA, 14 bp, Homo sapiens
agcccttgcctccc

SEQ ID NO: 861471 - DNA, 23 bp, Homo sapiens
agcccttgcctccccatttccca

SEQ ID NO: 861472 - DNA, 15 bp, Homo sapiens
agcccttggcttctg

SEQ ID NO: 861473 - DNA, 17 bp, Homo sapiens
agcccttggcttctgct

SEQ ID NO: 861474 - DNA, 18 bp, Homo sapiens
agcccttggcttctgctt

SEQ ID NO: 861475 - DNA, 17 bp, Homo sapiens
agccctttctgtgtgca

SEQ ID NO: 861476 - DNA, 18 bp, Homo sapiens
agccctttctgtgtgcac

SEQ ID NO: 861477 - DNA, 23 bp, Homo sapiens
agccctttgctctgatttccttc

SEQ ID NO: 861478 - DNA, 22 bp, Homo sapiens
agccctttgggaggctgaggcg

SEQ ID NO: 861479 - DNA, 21 bp, Homo sapiens
agcccttttacagctcttggc

SEQ ID NO: 861480 - DNA, 16 bp, Homo sapiens
agccgacaatgccctg

SEQ ID NO: 861481 - DNA, 22 bp, Homo sapiens
agccgaccctcctggccttcct

SEQ ID NO: 861482 - DNA, 16 bp, Homo sapiens
agccgacctcagcctt

SEQ ID NO: 861483 - DNA, 18 bp, Homo sapiens
agccgactctggccctgg

SEQ ID NO: 861484 - DNA, 19 bp, Homo sapiens
agccgactctggccctggc

SEQ ID NO: 861485 - DNA, 15 bp, Homo sapiens
agccgagagcctgct

SEQ ID NO: 861486 - DNA, 18 bp, Homo sapiens
agccgagagcctgctccc

SEQ ID NO: 861487 - DNA, 20 bp, Homo sapiens
agccgagattgcaccactgc

SEQ ID NO: 861488 - DNA, 14 bp, Homo sapiens
agccgcaccctgca

SEQ ID NO: 861489 - DNA, 20 bp, Homo sapiens
agccgcaccctgcacctgct

SEQ ID NO: 861490 - DNA, 22 bp, Homo sapiens
agccgcaccctgcacctgctgc

SEQ ID NO: 861491 - DNA, 21 bp, Homo sapiens
agccgcatcttctccatctgg

SEQ ID NO: 861492 - DNA, 22 bp, Homo sapiens
agccgccactcccgggccaaga

SEQ ID NO: 861493 - DNA, 23 bp, Homo sapiens
agccgccactcccgggccaagac

SEQ ID NO: 861494 - DNA, 18 bp, Homo sapiens
agccgccattgccaccag

SEQ ID NO: 861495 - DNA, 15 bp, Homo sapiens
agccgccccagcccc

SEQ ID NO: 861496 - DNA, 14 bp, Homo sapiens
agccgccctgagag

SEQ ID NO: 861497 - DNA, 18 bp, Homo sapiens
agccgccgggcaggcctg

SEQ ID NO: 861498 - DNA, 19 bp, Homo sapiens
agccgccgggcaggcctgc

SEQ ID NO: 861499 - DNA, 21 bp, Homo sapiens
agccgcctgaaagccacaatg

SEQ ID NO: 861500 - DNA, 21 bp, Homo sapiens
agccgcgggcgctcgctcagg

SEQ ID NO: 861501 - DNA, 20 bp, Homo sapiens
agccgcggggaagctggctt

SEQ ID NO: 861502 - DNA, 21 bp, Homo sapiens
agccgcggggaagctggcttt

SEQ ID NO: 861503 - DNA, 18 bp, Homo sapiens
agccgctaggagagactg

SEQ ID NO: 861504 - DNA, 19 bp, Homo sapiens
agccgctcctgtctgccag

SEQ ID NO: 861505 - DNA, 21 bp, Homo sapiens
agccgctcctgtctgccagcc

SEQ ID NO: 861506 - DNA, 19 bp, Homo sapiens
agccgctgcagggctccca

SEQ ID NO: 861507 - DNA, 12 bp, Homo sapiens
agccgctgctgg

SEQ ID NO: 861508 - DNA, 16 bp, Homo sapiens
agccgctgtgagcccc

SEQ ID NO: 861509 - DNA, 22 bp, Homo sapiens
agccgctgtgagcccctggtcc

SEQ ID NO: 861510 - DNA, 16 bp, Homo sapiens
agccggaatagagcct

SEQ ID NO: 861511 - DNA, 20 bp, Homo sapiens
agccggcaagcgagcacagt

SEQ ID NO: 861512 - DNA, 18 bp, Homo sapiens
agccggcatccttgcctg

SEQ ID NO: 861513 - DNA, 21 bp, Homo sapiens
agccggcatccttgcctgtct

SEQ ID NO: 861514 - DNA, 19 bp, Homo sapiens
agccggccccccctctttt

SEQ ID NO: 861515 - DNA, 14 bp, Homo sapiens
agccggcctctctg

SEQ ID NO: 861516 - DNA, 23 bp, Homo sapiens
agccgggaacagacaacagaagt

SEQ ID NO: 861517 - DNA, 13 bp, Homo sapiens
agccgggaccctc

SEQ ID NO: 861518 - DNA, 19 bp, Homo sapiens
agccgggcacccccaacct

SEQ ID NO: 861519 - DNA, 22 bp, Homo sapiens
agccgggcgtggtggcgggcac

SEQ ID NO: 861520 - DNA, 23 bp, Homo sapiens
agccggggccttatcgggctcca

SEQ ID NO: 861521 - DNA, 17 bp, Homo sapiens
agccgggggaggggccc

SEQ ID NO: 861522 - DNA, 21 bp, Homo sapiens
agccggggtgtaacttcctgc

SEQ ID NO: 861523 - DNA, 23 bp, Homo sapiens
agccggggtgtaacttcctgctg

SEQ ID NO: 861524 - DNA, 22 bp, Homo sapiens
agccgggtctgcctcttctggg

SEQ ID NO: 861525 - DNA, 23 bp, Homo sapiens
agccgggtgtggcacgcacctgt

SEQ ID NO: 861526 - DNA, 16 bp, Homo sapiens
agccggtaactgtcct

SEQ ID NO: 861527 - DNA, 13 bp, Homo sapiens
agccggtgcctgg

SEQ ID NO: 861528 - DNA, 14 bp, Homo sapiens
agccggtgcctggc

SEQ ID NO: 861529 - DNA, 14 bp, Homo sapiens
agccggtggtgccc

SEQ ID NO: 861530 - DNA, 19 bp, Homo sapiens
agccgtcagccaaatgtaa

SEQ ID NO: 861531 - DNA, 20 bp, Homo sapiens
agccgtcagccaaatgtaat

SEQ ID NO: 861532 - DNA, 15 bp, Homo sapiens
agccgtccatggcac

SEQ ID NO: 861533 - DNA, 18 bp, Homo sapiens
agccgtccatggcaccag

SEQ ID NO: 861534 - DNA, 14 bp, Homo sapiens
agccgtcccaggcc

SEQ ID NO: 861535 - DNA, 16 bp, Homo sapiens
agccgtcccaggccac

SEQ ID NO: 861536 - DNA, 12 bp, Homo sapiens
agccgtcctggc

SEQ ID NO: 861537 - DNA, 13 bp, Homo sapiens
agccgtcctggcg

SEQ ID NO: 861538 - DNA, 17 bp, Homo sapiens
agccgtctgactccaga

SEQ ID NO: 861539 - DNA, 20 bp, Homo sapiens
agccgtgatgctcaggcttg

SEQ ID NO: 861540 - DNA, 15 bp, Homo sapiens
agccgtgccttcagc

SEQ ID NO: 861541 - DNA, 21 bp, Homo sapiens
agccgtggcttcccgctcagc

SEQ ID NO: 861542 - DNA, 22 bp, Homo sapiens
agccgtggcttcccgctcagcc

SEQ ID NO: 861543 - DNA, 14 bp, Homo sapiens
agccgttttcctca

SEQ ID NO: 861544 - DNA, 14 bp, Homo sapiens
agcctaaagggcag

SEQ ID NO: 861545 - DNA, 15 bp, Homo sapiens
agcctaaagggcagg

SEQ ID NO: 861546 - DNA, 13 bp, Homo sapiens
agcctaaatgatg

SEQ ID NO: 861547 - DNA, 22 bp, Homo sapiens
agcctaaatgccttagaaatgt

SEQ ID NO: 861548 - DNA, 12 bp, Homo sapiens
agcctaatgaaa

SEQ ID NO: 861549 - DNA, 20 bp, Homo sapiens
agcctaatgagagtgcactg

SEQ ID NO: 861550 - DNA, 23 bp, Homo sapiens
agcctacccttcctgcatttctc

SEQ ID NO: 861551 - DNA, 14 bp, Homo sapiens
agcctacctgtatg

SEQ ID NO: 861552 - DNA, 13 bp, Homo sapiens
agcctagccctgg

SEQ ID NO: 861553 - DNA, 17 bp, Homo sapiens
agcctagccgacctcag

SEQ ID NO: 861554 - DNA, 20 bp, Homo sapiens
agcctagccgacctcagcct

SEQ ID NO: 861555 - DNA, 20 bp, Homo sapiens
agcctagcggagcccagcct

SEQ ID NO: 861556 - DNA, 21 bp, Homo sapiens
agcctagcggagcccagcctg

SEQ ID NO: 861557 - DNA, 22 bp, Homo sapiens
agcctagcggagcccagcctgg

SEQ ID NO: 861558 - DNA, 23 bp, Homo sapiens
agcctagcggagcccagcctggg

SEQ ID NO: 861559 - DNA, 21 bp, Homo sapiens
agcctaggaccactcagcccc

SEQ ID NO: 861560 - DNA, 20 bp, Homo sapiens
agcctaggggtcagggacca

SEQ ID NO: 861561 - DNA, 14 bp, Homo sapiens
agcctaggtgttgt

SEQ ID NO: 861562 - DNA, 14 bp, Homo sapiens
agcctagtgaaggc

SEQ ID NO: 861563 - DNA, 23 bp, Homo sapiens
agcctagtgaaggcttctctctg

SEQ ID NO: 861564 - DNA, 17 bp, Homo sapiens
agcctagttcatccaat

SEQ ID NO: 861565 - DNA, 19 bp, Homo sapiens
agcctagtttttaatagct

SEQ ID NO: 861566 - DNA, 22 bp, Homo sapiens
agcctataagaggaatttcttt

SEQ ID NO: 861567 - DNA, 16 bp, Homo sapiens
agcctatatcaaacat

SEQ ID NO: 861568 - DNA, 16 bp, Homo sapiens
agcctatgagcatcct

SEQ ID NO: 861569 - DNA, 18 bp, Homo sapiens
agcctatgagcatcctga

SEQ ID NO: 861570 - DNA, 18 bp, Homo sapiens
agcctcaaaacaaaggcc

SEQ ID NO: 861571 - DNA, 23 bp, Homo sapiens
agcctcaaagtcccttgagactc

SEQ ID NO: 861572 - DNA, 15 bp, Homo sapiens
agcctcaacctcctg

SEQ ID NO: 861573 - DNA, 20 bp, Homo sapiens
agcctcaacctcctgggttc

SEQ ID NO: 861574 - DNA, 15 bp, Homo sapiens
agcctcaaggccctc

SEQ ID NO: 861575 - DNA, 15 bp, Homo sapiens
agcctcacagaagaa

SEQ ID NO: 861576 - DNA, 14 bp, Homo sapiens
agcctcacagcagt

SEQ ID NO: 861577 - DNA, 22 bp, Homo sapiens
agcctcacttttaatgaacaaa

SEQ ID NO: 861578 - DNA, 12 bp, Homo sapiens
agcctcagagtg

SEQ ID NO: 861579 - DNA, 22 bp, Homo sapiens
agcctcagatgatttcccccct

SEQ ID NO: 861580 - DNA, 11 bp, Homo sapiens
agcctcagccc

SEQ ID NO: 861581 - DNA, 19 bp, Homo sapiens
agcctcagcccaacttctt

SEQ ID NO: 861582 - DNA, 13 bp, Homo sapiens
agcctcagtctcc

SEQ ID NO: 861583 - DNA, 20 bp, Homo sapiens
agcctcagtctccctccctt

SEQ ID NO: 861584 - DNA, 17 bp, Homo sapiens
agcctcagtgacccatg

SEQ ID NO: 861585 - DNA, 19 bp, Homo sapiens
agcctcatatttaaagaca

SEQ ID NO: 861586 - DNA, 20 bp, Homo sapiens
agcctcatatttaaagacag

SEQ ID NO: 861587 - DNA, 22 bp, Homo sapiens
agcctcatcctccccaggaccc

SEQ ID NO: 861588 - DNA, 18 bp, Homo sapiens
agcctcatgttctcttcc

SEQ ID NO: 861589 - DNA, 20 bp, Homo sapiens
agcctcattctgaggcctga

SEQ ID NO: 861590 - DNA, 15 bp, Homo sapiens
agcctcattgtgcca

SEQ ID NO: 861591 - DNA, 16 bp, Homo sapiens
agcctcattgtgccaa

SEQ ID NO: 861592 - DNA, 17 bp, Homo sapiens
agcctcattgtgccaag

SEQ ID NO: 861593 - DNA, 21 bp, Homo sapiens
agcctcattgtgccaagcctt

SEQ ID NO: 861594 - DNA, 22 bp, Homo sapiens
agcctcattgtgccaagccttc

SEQ ID NO: 861595 - DNA, 21 bp, Homo sapiens
agcctccaaagtggagctggg

SEQ ID NO: 861596 - DNA, 20 bp, Homo sapiens
agcctccaagcacagagcct

SEQ ID NO: 861597 - DNA, 23 bp, Homo sapiens
agcctccaagcacagagcctggc

SEQ ID NO: 861598 - DNA, 21 bp, Homo sapiens
agcctccaagctccatctcca

SEQ ID NO: 861599 - DNA, 13 bp, Homo sapiens
agcctccaagggt

SEQ ID NO: 861600 - DNA, 14 bp, Homo sapiens
agcctccaattttt

SEQ ID NO: 861601 - DNA, 13 bp, Homo sapiens
agcctccacagcg

SEQ ID NO: 861602 - DNA, 16 bp, Homo sapiens
agcctccagagccagc

SEQ ID NO: 861603 - DNA, 18 bp, Homo sapiens
agcctccagagccagcct

SEQ ID NO: 861604 - DNA, 22 bp, Homo sapiens
agcctcccaagtagctgggatt

SEQ ID NO: 861605 - DNA, 21 bp, Homo sapiens
agcctcccacactgaaaccaa

SEQ ID NO: 861606 - DNA, 21 bp, Homo sapiens
agcctccccaccccagtggga

SEQ ID NO: 861607 - DNA, 18 bp, Homo sapiens
agcctccccatctgtcca

SEQ ID NO: 861608 - DNA, 19 bp, Homo sapiens
agcctccccatctgtccag

SEQ ID NO: 861609 - DNA, 22 bp, Homo sapiens
agcctccccatctgtccagctg

SEQ ID NO: 861610 - DNA, 13 bp, Homo sapiens
agcctccccctca

SEQ ID NO: 861611 - DNA, 10 bp, Homo sapiens
agcctcccct

SEQ ID NO: 861612 - DNA, 16 bp, Homo sapiens
agcctcccctcccctg

SEQ ID NO: 861613 - DNA, 14 bp, Homo sapiens
agcctcccctgcca

SEQ ID NO: 861614 - DNA, 15 bp, Homo sapiens
agcctcccctgccag

SEQ ID NO: 861615 - DNA, 18 bp, Homo sapiens
agcctcccctgccagggc

SEQ ID NO: 861616 - DNA, 20 bp, Homo sapiens
agcctcccctgccagggcag

SEQ ID NO: 861617 - DNA, 18 bp, Homo sapiens
agcctcccgagtagctgg

SEQ ID NO: 861618 - DNA, 22 bp, Homo sapiens
agcctcccgagtagctgggatt

SEQ ID NO: 861619 - DNA, 13 bp, Homo sapiens
agcctccctctga

SEQ ID NO: 861620 - DNA, 14 bp, Homo sapiens
agcctccctctgac

SEQ ID NO: 861621 - DNA, 16 bp, Homo sapiens
agcctccctgagcctg

SEQ ID NO: 861622 - DNA, 19 bp, Homo sapiens
agcctccctgagcctgcat

SEQ ID NO: 861623 - DNA, 15 bp, Homo sapiens
agcctccctgtctcc

SEQ ID NO: 861624 - DNA, 16 bp, Homo sapiens
agcctccctgtctcca

SEQ ID NO: 861625 - DNA, 20 bp, Homo sapiens
agcctccctgtctccagctg

SEQ ID NO: 861626 - DNA, 23 bp, Homo sapiens
agcctccctgtctccagctgcct

SEQ ID NO: 861627 - DNA, 18 bp, Homo sapiens
agcctccgacgctgcctc

SEQ ID NO: 861628 - DNA, 16 bp, Homo sapiens
agcctccgagagggag

SEQ ID NO: 861629 - DNA, 17 bp, Homo sapiens
agcctccgccattccaa

SEQ ID NO: 861630 - DNA, 13 bp, Homo sapiens
agcctccggaagc

SEQ ID NO: 861631 - DNA, 23 bp, Homo sapiens
agcctccggagtagctgggacca

SEQ ID NO: 861632 - DNA, 22 bp, Homo sapiens
agcctccgggcgtgtgaagaac

SEQ ID NO: 861633 - DNA, 16 bp, Homo sapiens
agcctccgtcatccat

SEQ ID NO: 861634 - DNA, 13 bp, Homo sapiens
agcctcctcctga

SEQ ID NO: 861635 - DNA, 16 bp, Homo sapiens
agcctcctcctgacca

SEQ ID NO: 861636 - DNA, 19 bp, Homo sapiens
agcctcctcctgaccacgg

SEQ ID NO: 861637 - DNA, 12 bp, Homo sapiens
agcctcctctgg

SEQ ID NO: 861638 - DNA, 20 bp, Homo sapiens
agcctcctgaagttgctgct

SEQ ID NO: 861639 - DNA, 13 bp, Homo sapiens
agcctcctgagcc

SEQ ID NO: 861640 - DNA, 17 bp, Homo sapiens
agcctcctgccccctgc

SEQ ID NO: 861641 - DNA, 19 bp, Homo sapiens
agcctcctgccccctgcca

SEQ ID NO: 861642 - DNA, 12 bp, Homo sapiens
agcctcctggga

SEQ ID NO: 861643 - DNA, 13 bp, Homo sapiens
agcctcctgggta

SEQ ID NO: 861644 - DNA, 14 bp, Homo sapiens
agcctcctgggtag

SEQ ID NO: 861645 - DNA, 20 bp, Homo sapiens
agcctcctgtacctcagtgg

SEQ ID NO: 861646 - DNA, 22 bp, Homo sapiens
agcctcctgtgcctggccccag

SEQ ID NO: 861647 - DNA, 19 bp, Homo sapiens
agcctccttgctgacccca

SEQ ID NO: 861648 - DNA, 22 bp, Homo sapiens
agcctccttgctgaccccaggt

SEQ ID NO: 861649 - DNA, 14 bp, Homo sapiens
agcctcctttgtgt

SEQ ID NO: 861650 - DNA, 18 bp, Homo sapiens
agcctcgacaccccccca

SEQ ID NO: 861651 - DNA, 22 bp, Homo sapiens
agcctcgacacccccccaaccc

SEQ ID NO: 861652 - DNA, 18 bp, Homo sapiens
agcctcgaggctggtggt

SEQ ID NO: 861653 - DNA, 20 bp, Homo sapiens
agcctcgaggctggtggttt

SEQ ID NO: 861654 - DNA, 13 bp, Homo sapiens
agcctcgagtgcc

SEQ ID NO: 861655 - DNA, 21 bp, Homo sapiens
agcctcgagtgcccctgtccc

SEQ ID NO: 861656 - DNA, 19 bp, Homo sapiens
agcctcgcacaggccctag

SEQ ID NO: 861657 - DNA, 20 bp, Homo sapiens
agcctcgcacaggccctagc

SEQ ID NO: 861658 - DNA, 21 bp, Homo sapiens
agcctcgcacaggccctagct

SEQ ID NO: 861659 - DNA, 19 bp, Homo sapiens
agcctcgcccctccagtgt

SEQ ID NO: 861660 - DNA, 16 bp, Homo sapiens
agcctcgcggtcttgg

SEQ ID NO: 861661 - DNA, 16 bp, Homo sapiens
agcctctaaacagaca

SEQ ID NO: 861662 - DNA, 23 bp, Homo sapiens
agcctctaagcgtgctgacatca

SEQ ID NO: 861663 - DNA, 17 bp, Homo sapiens
agcctctacagccgtcc

SEQ ID NO: 861664 - DNA, 23 bp, Homo sapiens
agcctctacagccgtcccgcgtt

SEQ ID NO: 861665 - DNA, 12 bp, Homo sapiens
agcctctcccac

SEQ ID NO: 861666 - DNA, 15 bp, Homo sapiens
agcctctcccacccg

SEQ ID NO: 861667 - DNA, 17 bp, Homo sapiens
agcctctcccacccggc

SEQ ID NO: 861668 - DNA, 22 bp, Homo sapiens
agcctctcccacccggccacag

SEQ ID NO: 861669 - DNA, 22 bp, Homo sapiens
agcctctccccaggtccagctc

SEQ ID NO: 861670 - DNA, 15 bp, Homo sapiens
agcctctccccgctc

SEQ ID NO: 861671 - DNA, 20 bp, Homo sapiens
agcctctccccgctctggat

SEQ ID NO: 861672 - DNA, 17 bp, Homo sapiens
agcctctcccggctgcc

SEQ ID NO: 861673 - DNA, 18 bp, Homo sapiens
agcctctcccggctgcct

SEQ ID NO: 861674 - DNA, 13 bp, Homo sapiens
agcctctctcctt

SEQ ID NO: 861675 - DNA, 21 bp, Homo sapiens
agcctctctccttggccacag

SEQ ID NO: 861676 - DNA, 12 bp, Homo sapiens
agcctctctctc

SEQ ID NO: 861677 - DNA, 15 bp, Homo sapiens
agcctctctgctata

SEQ ID NO: 861678 - DNA, 18 bp, Homo sapiens
agcctctctggctggtct

SEQ ID NO: 861679 - DNA, 20 bp, Homo sapiens
agcctctctggctggtcttc

SEQ ID NO: 861680 - DNA, 19 bp, Homo sapiens
agcctctgaagttggacag

SEQ ID NO: 861681 - DNA, 21 bp, Homo sapiens
agcctctgacttaagctgcct

SEQ ID NO: 861682 - DNA, 19 bp, Homo sapiens
agcctctgagatgctaatt

SEQ ID NO: 861683 - DNA, 22 bp, Homo sapiens
agcctctgcagcggaatctgtt

SEQ ID NO: 861684 - DNA, 18 bp, Homo sapiens
agcctctgccctgcctcc

SEQ ID NO: 861685 - DNA, 19 bp, Homo sapiens
agcctctgccctgcctccc

SEQ ID NO: 861686 - DNA, 12 bp, Homo sapiens
agcctctgctgc

SEQ ID NO: 861687 - DNA, 13 bp, Homo sapiens
agcctctgctgcc

SEQ ID NO: 861688 - DNA, 14 bp, Homo sapiens
agcctctgctggaa

SEQ ID NO: 861689 - DNA, 19 bp, Homo sapiens
agcctctggacagccagtg

SEQ ID NO: 861690 - DNA, 23 bp, Homo sapiens
agcctctggacagccagtgacct

SEQ ID NO: 861691 - DNA, 12 bp, Homo sapiens
agcctctggcta

SEQ ID NO: 861692 - DNA, 14 bp, Homo sapiens
agcctctggctaga

SEQ ID NO: 861693 - DNA, 20 bp, Homo sapiens
agcctcttaaagctgcctgt

SEQ ID NO: 861694 - DNA, 22 bp, Homo sapiens
agcctcttcaaaaagcagagtg

SEQ ID NO: 861695 - DNA, 13 bp, Homo sapiens
agcctcttctgaa

SEQ ID NO: 861696 - DNA, 18 bp, Homo sapiens
agcctctttgtaataaaa

SEQ ID NO: 861697 - DNA, 16 bp, Homo sapiens
agcctctttttccttc

SEQ ID NO: 861698 - DNA, 18 bp, Homo sapiens
agcctctttttccttctt

SEQ ID NO: 861699 - DNA, 23 bp, Homo sapiens
agcctctttttccttcttcagca

SEQ ID NO: 861700 - DNA, 16 bp, Homo sapiens
agcctgaacagaagct

SEQ ID NO: 861701 - DNA, 15 bp, Homo sapiens
agcctgaactgaggc

SEQ ID NO: 861702 - DNA, 16 bp, Homo sapiens
agcctgaactgaggcc

SEQ ID NO: 861703 - DNA, 14 bp, Homo sapiens
agcctgaagcctgg

SEQ ID NO: 861704 - DNA, 15 bp, Homo sapiens
agcctgaagcctgga

SEQ ID NO: 861705 - DNA, 16 bp, Homo sapiens
agcctgaagctggcct

SEQ ID NO: 861706 - DNA, 17 bp, Homo sapiens
agcctgaagctggcctg

SEQ ID NO: 861707 - DNA, 19 bp, Homo sapiens
agcctgaagctggcctgga

SEQ ID NO: 861708 - DNA, 22 bp, Homo sapiens
agcctgaatttgggatggaagc

SEQ ID NO: 861709 - DNA, 20 bp, Homo sapiens
agcctgaccaacatggagaa

SEQ ID NO: 861710 - DNA, 18 bp, Homo sapiens
agcctgacccggaggaaa

SEQ ID NO: 861711 - DNA, 19 bp, Homo sapiens
agcctgacccggaggaaag

SEQ ID NO: 861712 - DNA, 14 bp, Homo sapiens
agcctgacctgaga

SEQ ID NO: 861713 - DNA, 14 bp, Homo sapiens
agcctgactgccag

SEQ ID NO: 861714 - DNA, 16 bp, Homo sapiens
agcctgactgccagga

SEQ ID NO: 861715 - DNA, 16 bp, Homo sapiens
agcctgagcaactctt

SEQ ID NO: 861716 - DNA, 21 bp, Homo sapiens
agcctgagcaactcttgatta

SEQ ID NO: 861717 - DNA, 16 bp, Homo sapiens
agcctgaggcaggaga

SEQ ID NO: 861718 - DNA, 16 bp, Homo sapiens
agcctgagtctcctgt

SEQ ID NO: 861719 - DNA, 23 bp, Homo sapiens
agcctgatactttagccatcata

SEQ ID NO: 861720 - DNA, 18 bp, Homo sapiens
agcctgatcacctgccct

SEQ ID NO: 861721 - DNA, 19 bp, Homo sapiens
agcctgatcacctgccctg

SEQ ID NO: 861722 - DNA, 17 bp, Homo sapiens
agcctgatccagccttt

SEQ ID NO: 861723 - DNA, 15 bp, Homo sapiens
agcctgatggccaag

SEQ ID NO: 861724 - DNA, 18 bp, Homo sapiens
agcctgcaaactcactgc

SEQ ID NO: 861725 - DNA, 22 bp, Homo sapiens
agcctgcagggtggtgctggga

SEQ ID NO: 861726 - DNA, 17 bp, Homo sapiens
agcctgcccacctctcc

SEQ ID NO: 861727 - DNA, 21 bp, Homo sapiens
agcctgcccacctctccctgc

SEQ ID NO: 861728 - DNA, 20 bp, Homo sapiens
agcctgccccctatcttgtc

SEQ ID NO: 861729 - DNA, 21 bp, Homo sapiens
agcctgcccgctgcaatgcct

SEQ ID NO: 861730 - DNA, 23 bp, Homo sapiens
agcctgccgccgtctctgtcccg

SEQ ID NO: 861731 - DNA, 13 bp, Homo sapiens
agcctgcctcacc

SEQ ID NO: 861732 - DNA, 15 bp, Homo sapiens
agcctgcctcccaag

SEQ ID NO: 861733 - DNA, 16 bp, Homo sapiens
agcctgcctcttctct

SEQ ID NO: 861734 - DNA, 17 bp, Homo sapiens
agcctgcggcgccagcc

SEQ ID NO: 861735 - DNA, 20 bp, Homo sapiens
agcctgcggcgccagcctca

SEQ ID NO: 861736 - DNA, 16 bp, Homo sapiens
agcctgctccagctgt

SEQ ID NO: 861737 - DNA, 22 bp, Homo sapiens
agcctgctccagctgttcagct

SEQ ID NO: 861738 - DNA, 11 bp, Homo sapiens
agcctgctccc

SEQ ID NO: 861739 - DNA, 11 bp, Homo sapiens
agcctgctgca

SEQ ID NO: 861740 - DNA, 10 bp, Homo sapiens
agcctgctgg

SEQ ID NO: 861741 - DNA, 11 bp, Homo sapiens
agcctgctgga

SEQ ID NO: 861742 - DNA, 12 bp, Homo sapiens
agcctgctggca

SEQ ID NO: 861743 - DNA, 18 bp, Homo sapiens
agcctgctggcacccacc

SEQ ID NO: 861744 - DNA, 17 bp, Homo sapiens
agcctgctggcagggcc

SEQ ID NO: 861745 - DNA, 18 bp, Homo sapiens
agcctgctggcagggcca

SEQ ID NO: 861746 - DNA, 22 bp, Homo sapiens
agcctgctggcagggccagggc

SEQ ID NO: 861747 - DNA, 12 bp, Homo sapiens
agcctgctggct

SEQ ID NO: 861748 - DNA, 18 bp, Homo sapiens
agcctgctggctgcggcc

SEQ ID NO: 861749 - DNA, 13 bp, Homo sapiens
agcctgctggggc

SEQ ID NO: 861750 - DNA, 14 bp, Homo sapiens
agcctgctgtgggg

SEQ ID NO: 861751 - DNA, 20 bp, Homo sapiens
agcctgctttggcctttcct

SEQ ID NO: 861752 - DNA, 21 bp, Homo sapiens
agcctggactaaaggcatcct

SEQ ID NO: 861753 - DNA, 13 bp, Homo sapiens
agcctggactctg

SEQ ID NO: 861754 - DNA, 14 bp, Homo sapiens
agcctggagaagct

SEQ ID NO: 861755 - DNA, 16 bp, Homo sapiens
agcctggatggcccct

SEQ ID NO: 861756 - DNA, 17 bp, Homo sapiens
agcctggatggcccctc

SEQ ID NO: 861757 - DNA, 17 bp, Homo sapiens
agcctggattccagcag

SEQ ID NO: 861758 - DNA, 18 bp, Homo sapiens
agcctggattccagcagt

SEQ ID NO: 861759 - DNA, 9 bp, Homo sapiens
agcctggca

SEQ ID NO: 861760 - DNA, 19 bp, Homo sapiens
agcctggcaacagagcgag

SEQ ID NO: 861761 - DNA, 21 bp, Homo sapiens
agcctggcaatttagcaaact

SEQ ID NO: 861762 - DNA, 23 bp, Homo sapiens
agcctggcaatttagcaaactga

SEQ ID NO: 861763 - DNA, 17 bp, Homo sapiens
agcctggcacagggcag

SEQ ID NO: 861764 - DNA, 13 bp, Homo sapiens
agcctggcaccca

SEQ ID NO: 861765 - DNA, 14 bp, Homo sapiens
agcctggccaccag

SEQ ID NO: 861766 - DNA, 16 bp, Homo sapiens
agcctggccaccagcc

SEQ ID NO: 861767 - DNA, 21 bp, Homo sapiens
agcctggccaccagccatcct

SEQ ID NO: 861768 - DNA, 12 bp, Homo sapiens
agcctggcccca

SEQ ID NO: 861769 - DNA, 13 bp, Homo sapiens
agcctggccccag

SEQ ID NO: 861770 - DNA, 21 bp, Homo sapiens
agcctggccccaggccccaga

SEQ ID NO: 861771 - DNA, 22 bp, Homo sapiens
agcctggccccaggccccagac

SEQ ID NO: 861772 - DNA, 12 bp, Homo sapiens
agcctggctctg

SEQ ID NO: 861773 - DNA, 13 bp, Homo sapiens
agcctggctctgc

SEQ ID NO: 861774 - DNA, 17 bp, Homo sapiens
agcctggctctgccccg

SEQ ID NO: 861775 - DNA, 19 bp, Homo sapiens
agcctggctctgccccgca

SEQ ID NO: 861776 - DNA, 21 bp, Homo sapiens
agcctggctggagagctgcta

SEQ ID NO: 861777 - DNA, 21 bp, Homo sapiens
agcctggctgtccaaccagac

SEQ ID NO: 861778 - DNA, 10 bp, Homo sapiens
agcctgggac

SEQ ID NO: 861779 - DNA, 14 bp, Homo sapiens
agcctgggacacac

SEQ ID NO: 861780 - DNA, 18 bp, Homo sapiens
agcctgggactcccagtg

SEQ ID NO: 861781 - DNA, 19 bp, Homo sapiens
agcctgggactcccagtga

SEQ ID NO: 861782 - DNA, 16 bp, Homo sapiens
agcctgggagcccaga

SEQ ID NO: 861783 - DNA, 17 bp, Homo sapiens
agcctgggagcccagag

SEQ ID NO: 861784 - DNA, 20 bp, Homo sapiens
agcctgggaggtcaaggctg

SEQ ID NO: 861785 - DNA, 20 bp, Homo sapiens
agcctgggcaacagagcaag

SEQ ID NO: 861786 - DNA, 23 bp, Homo sapiens
agcctgggcaacgagtgaaactc

SEQ ID NO: 861787 - DNA, 20 bp, Homo sapiens
agcctgggcagcatagcaag

SEQ ID NO: 861788 - DNA, 17 bp, Homo sapiens
agcctgggcagccaggc

SEQ ID NO: 861789 - DNA, 20 bp, Homo sapiens
agcctgggcagccaggctgc

SEQ ID NO: 861790 - DNA, 21 bp, Homo sapiens
agcctgggcagccaggctgcc

SEQ ID NO: 861791 - DNA, 13 bp, Homo sapiens
agcctgggccagg

SEQ ID NO: 861792 - DNA, 14 bp, Homo sapiens
agcctgggccagga

SEQ ID NO: 861793 - DNA, 17 bp, Homo sapiens
agcctgggccatctctt

SEQ ID NO: 861794 - DNA, 20 bp, Homo sapiens
agcctgggcccatctccctg

SEQ ID NO: 861795 - DNA, 18 bp, Homo sapiens
agcctgggctccctcttg

SEQ ID NO: 861796 - DNA, 21 bp, Homo sapiens
agcctgggctccctcttgtgg

SEQ ID NO: 861797 - DNA, 20 bp, Homo sapiens
agcctgggcttgagctgcag

SEQ ID NO: 861798 - DNA, 20 bp, Homo sapiens
agcctggggcggtgtgtgtg

SEQ ID NO: 861799 - DNA, 11 bp, Homo sapiens
agcctggggct

SEQ ID NO: 861800 - DNA, 16 bp, Homo sapiens
agcctggggctctctg

SEQ ID NO: 861801 - DNA, 19 bp, Homo sapiens
agcctggggctctctgacc

SEQ ID NO: 861802 - DNA, 20 bp, Homo sapiens
agcctggggctctctgaccc

SEQ ID NO: 861803 - DNA, 14 bp, Homo sapiens
agcctggggctggc

SEQ ID NO: 861804 - DNA, 16 bp, Homo sapiens
agcctgggtctggatg

SEQ ID NO: 861805 - DNA, 21 bp, Homo sapiens
agcctgggtctggatgggagg

SEQ ID NO: 861806 - DNA, 22 bp, Homo sapiens
agcctgggtctggatgggagga

SEQ ID NO: 861807 - DNA, 11 bp, Homo sapiens
agcctgggtga

SEQ ID NO: 861808 - DNA, 22 bp, Homo sapiens
agcctggtagaattgggaagct

SEQ ID NO: 861809 - DNA, 16 bp, Homo sapiens
agcctggtccttccct

SEQ ID NO: 861810 - DNA, 14 bp, Homo sapiens
agcctggtgctgct

SEQ ID NO: 861811 - DNA, 15 bp, Homo sapiens
agcctggtgctgctg

SEQ ID NO: 861812 - DNA, 18 bp, Homo sapiens
agcctggtgggcctcctc

SEQ ID NO: 861813 - DNA, 17 bp, Homo sapiens
agcctggttcagacaca

SEQ ID NO: 861814 - DNA, 20 bp, Homo sapiens
agcctggttcagacacagct

SEQ ID NO: 861815 - DNA, 23 bp, Homo sapiens
agcctggttcagacacagctctt

SEQ ID NO: 861816 - DNA, 22 bp, Homo sapiens
agcctggtttgcaaagaccacc

SEQ ID NO: 861817 - DNA, 13 bp, Homo sapiens
agcctggtttttc

SEQ ID NO: 861818 - DNA, 16 bp, Homo sapiens
agcctggtttttctca

SEQ ID NO: 861819 - DNA, 23 bp, Homo sapiens
agcctgtaaacggtgctatttct

SEQ ID NO: 861820 - DNA, 18 bp, Homo sapiens
agcctgtaatcccagcta

SEQ ID NO: 861821 - DNA, 18 bp, Homo sapiens
agcctgtatgtggtgtgg

SEQ ID NO: 861822 - DNA, 11 bp, Homo sapiens
agcctgtcacc

SEQ ID NO: 861823 - DNA, 12 bp, Homo sapiens
agcctgtcccag

SEQ ID NO: 861824 - DNA, 18 bp, Homo sapiens
agcctgtcccaggactca

SEQ ID NO: 861825 - DNA, 22 bp, Homo sapiens
agcctgtccccgccttccctca

SEQ ID NO: 861826 - DNA, 18 bp, Homo sapiens
agcctgtcctcaccgtct

SEQ ID NO: 861827 - DNA, 14 bp, Homo sapiens
agcctgtcctggta

SEQ ID NO: 861828 - DNA, 21 bp, Homo sapiens
agcctgtcctggtacagcagg

SEQ ID NO: 861829 - DNA, 22 bp, Homo sapiens
agcctgtctcgggctgaccctt

SEQ ID NO: 861830 - DNA, 17 bp, Homo sapiens
agcctgtctctttccac

SEQ ID NO: 861831 - DNA, 22 bp, Homo sapiens
agcctgtgaataaaaaccctgt

SEQ ID NO: 861832 - DNA, 16 bp, Homo sapiens
agcctgtgcaaaaaaa

SEQ ID NO: 861833 - DNA, 17 bp, Homo sapiens
agcctgtgccttcctcc

SEQ ID NO: 861834 - DNA, 14 bp, Homo sapiens
agcctgtggcatct

SEQ ID NO: 861835 - DNA, 11 bp, Homo sapiens
agcctgtggga

SEQ ID NO: 861836 - DNA, 20 bp, Homo sapiens
agcctgtgggagtagaaaaa

SEQ ID NO: 861837 - DNA, 14 bp, Homo sapiens
agcctgtgggcagc

SEQ ID NO: 861838 - DNA, 19 bp, Homo sapiens
agcctgtggttacagtgca

SEQ ID NO: 861839 - DNA, 14 bp, Homo sapiens
agcctgttcccctc

SEQ ID NO: 861840 - DNA, 14 bp, Homo sapiens
agcctgttggaccc

SEQ ID NO: 861841 - DNA, 16 bp, Homo sapiens
agcctgttgtttaagt

SEQ ID NO: 861842 - DNA, 15 bp, Homo sapiens
agccttaaaatgcat

SEQ ID NO: 861843 - DNA, 19 bp, Homo sapiens
agccttaactaagactccc

SEQ ID NO: 861844 - DNA, 14 bp, Homo sapiens
agccttaagcaaat

SEQ ID NO: 861845 - DNA, 14 bp, Homo sapiens
agccttaatagact

SEQ ID NO: 861846 - DNA, 18 bp, Homo sapiens
agccttaatcaggtcctc

SEQ ID NO: 861847 - DNA, 22 bp, Homo sapiens
agccttagaggtatgtcagaaa

SEQ ID NO: 861848 - DNA, 20 bp, Homo sapiens
agccttagggaagctggcct

SEQ ID NO: 861849 - DNA, 14 bp, Homo sapiens
agccttatcaagtg

SEQ ID NO: 861850 - DNA, 17 bp, Homo sapiens
agccttatcaagtgtct

SEQ ID NO: 861851 - DNA, 15 bp, Homo sapiens
agccttatcctctga

SEQ ID NO: 861852 - DNA, 21 bp, Homo sapiens
agccttatgtgttacattatt

SEQ ID NO: 861853 - DNA, 19 bp, Homo sapiens
agccttatttctagaagca

SEQ ID NO: 861854 - DNA, 18 bp, Homo sapiens
agccttattttgagtaaa

SEQ ID NO: 861855 - DNA, 14 bp, Homo sapiens
agccttcagctcca

SEQ ID NO: 861856 - DNA, 23 bp, Homo sapiens
agccttcagtcttgaatttctaa

SEQ ID NO: 861857 - DNA, 22 bp, Homo sapiens
agccttcataggcggtcatgtg

SEQ ID NO: 861858 - DNA, 17 bp, Homo sapiens
agccttccaactagctg

SEQ ID NO: 861859 - DNA, 13 bp, Homo sapiens
agccttccccagc

SEQ ID NO: 861860 - DNA, 20 bp, Homo sapiens
agccttccccagctccagca

SEQ ID NO: 861861 - DNA, 19 bp, Homo sapiens
agccttccccctcccaggg

SEQ ID NO: 861862 - DNA, 14 bp, Homo sapiens
agccttcccctccc

SEQ ID NO: 861863 - DNA, 19 bp, Homo sapiens
agccttcctccacatcctt

SEQ ID NO: 861864 - DNA, 22 bp, Homo sapiens
agccttcctctgcagctgacct

SEQ ID NO: 861865 - DNA, 17 bp, Homo sapiens
agccttccttctgctcc

SEQ ID NO: 861866 - DNA, 22 bp, Homo sapiens
agccttccttctgctcccaccc

SEQ ID NO: 861867 - DNA, 21 bp, Homo sapiens
agccttcggagcgttctctgt

SEQ ID NO: 861868 - DNA, 22 bp, Homo sapiens
agccttcgtgtggctcctggta

SEQ ID NO: 861869 - DNA, 15 bp, Homo sapiens
agccttctgtaggaa

SEQ ID NO: 861870 - DNA, 21 bp, Homo sapiens
agccttcttctgccacttctg

SEQ ID NO: 861871 - DNA, 20 bp, Homo sapiens
agccttgataatacttgacc

SEQ ID NO: 861872 - DNA, 17 bp, Homo sapiens
agccttgatttgttctt

SEQ ID NO: 861873 - DNA, 14 bp, Homo sapiens
agccttgcacaccc

SEQ ID NO: 861874 - DNA, 16 bp, Homo sapiens
agccttgcacacccac

SEQ ID NO: 861875 - DNA, 23 bp, Homo sapiens
agccttgcagatatctgcatgtg

SEQ ID NO: 861876 - DNA, 17 bp, Homo sapiens
agccttgcatgtacttg

SEQ ID NO: 861877 - DNA, 23 bp, Homo sapiens
agccttgcctaaatttaatgctg

SEQ ID NO: 861878 - DNA, 17 bp, Homo sapiens
agccttgcgctgtccca

SEQ ID NO: 861879 - DNA, 18 bp, Homo sapiens
agccttgcgctgtcccag

SEQ ID NO: 861880 - DNA, 12 bp, Homo sapiens
agccttgctcat

SEQ ID NO: 861881 - DNA, 17 bp, Homo sapiens
agccttgctgggccagg

SEQ ID NO: 861882 - DNA, 19 bp, Homo sapiens
agccttggaaccagcccca

SEQ ID NO: 861883 - DNA, 23 bp, Homo sapiens
agccttggataatgctgttgcct

SEQ ID NO: 861884 - DNA, 17 bp, Homo sapiens
agccttggctcgttctc

SEQ ID NO: 861885 - DNA, 22 bp, Homo sapiens
agccttggctcgttctcttctc

SEQ ID NO: 861886 - DNA, 17 bp, Homo sapiens
agccttgggcctttcag

SEQ ID NO: 861887 - DNA, 19 bp, Homo sapiens
agccttgggggggctgcct

SEQ ID NO: 861888 - DNA, 21 bp, Homo sapiens
agccttgggggggctgccttt

SEQ ID NO: 861889 - DNA, 15 bp, Homo sapiens
agccttggggttgga

SEQ ID NO: 861890 - DNA, 19 bp, Homo sapiens
agccttggggttggacatc

SEQ ID NO: 861891 - DNA, 23 bp, Homo sapiens
agccttgggttccaaccaggcag

SEQ ID NO: 861892 - DNA, 17 bp, Homo sapiens
agccttggtgtccacct

SEQ ID NO: 861893 - DNA, 21 bp, Homo sapiens
agccttggtgtccacctggcc

SEQ ID NO: 861894 - DNA, 16 bp, Homo sapiens
agccttgtaattctaa

SEQ ID NO: 861895 - DNA, 13 bp, Homo sapiens
agccttgtgccct

SEQ ID NO: 861896 - DNA, 21 bp, Homo sapiens
agccttgtgccctgcccccat

SEQ ID NO: 861897 - DNA, 14 bp, Homo sapiens
agccttgtttctga

SEQ ID NO: 861898 - DNA, 14 bp, Homo sapiens
agcctttaaaacca

SEQ ID NO: 861899 - DNA, 19 bp, Homo sapiens
agcctttactgtttgatat

SEQ ID NO: 861900 - DNA, 15 bp, Homo sapiens
agcctttccagcctc

SEQ ID NO: 861901 - DNA, 22 bp, Homo sapiens
agcctttccataaggaatgtag

SEQ ID NO: 861902 - DNA, 15 bp, Homo sapiens
agcctttcctcggtc

SEQ ID NO: 861903 - DNA, 23 bp, Homo sapiens
agcctttctctctttatacagct

SEQ ID NO: 861904 - DNA, 14 bp, Homo sapiens
agcctttgctccct

SEQ ID NO: 861905 - DNA, 18 bp, Homo sapiens
agcctttggatgaccaga

SEQ ID NO: 861906 - DNA, 20 bp, Homo sapiens
agcctttggatgaccagaac

SEQ ID NO: 861907 - DNA, 17 bp, Homo sapiens
agcctttggtgaattcc

SEQ ID NO: 861908 - DNA, 20 bp, Homo sapiens
agcctttggtgaattccttc

SEQ ID NO: 861909 - DNA, 18 bp, Homo sapiens
agcctttggttctggcca

SEQ ID NO: 861910 - DNA, 18 bp, Homo sapiens
agccttttccctctttgg

SEQ ID NO: 861911 - DNA, 23 bp, Homo sapiens
agccttttctggtccctcttctc

SEQ ID NO: 861912 - DNA, 18 bp, Homo sapiens
agccttttgctttatgct

SEQ ID NO: 861913 - DNA, 22 bp, Homo sapiens
agccttttgtttcccttgcttt

SEQ ID NO: 861914 - DNA, 21 bp, Homo sapiens
agcctttttgtataaaataga

SEQ ID NO: 861915 - DNA, 21 bp, Homo sapiens
agcgaacgtatttctccagac

SEQ ID NO: 861916 - DNA, 13 bp, Homo sapiens
agcgaacttcaca

SEQ ID NO: 861917 - DNA, 17 bp, Homo sapiens
agcgacacttgaatgta

SEQ ID NO: 861918 - DNA, 20 bp, Homo sapiens
agcgacatctctgactttct

SEQ ID NO: 861919 - DNA, 12 bp, Homo sapiens
agcgaccccaga

SEQ ID NO: 861920 - DNA, 14 bp, Homo sapiens
agcgaccgccccct

SEQ ID NO: 861921 - DNA, 15 bp, Homo sapiens
agcgaccgccccctc

SEQ ID NO: 861922 - DNA, 18 bp, Homo sapiens
agcgacctctctgcctct

SEQ ID NO: 861923 - DNA, 19 bp, Homo sapiens
agcgacctctctgcctctc

SEQ ID NO: 861924 - DNA, 13 bp, Homo sapiens
agcgactggatgc

SEQ ID NO: 861925 - DNA, 19 bp, Homo sapiens
agcgactggatgctcgcca

SEQ ID NO: 861926 - DNA, 16 bp, Homo sapiens
agcgagcaagccggca

SEQ ID NO: 861927 - DNA, 18 bp, Homo sapiens
agcgagcaagccggcaag

SEQ ID NO: 861928 - DNA, 19 bp, Homo sapiens
agcgagccacaggaacggc

SEQ ID NO: 861929 - DNA, 14 bp, Homo sapiens
agcgagctgctctg

SEQ ID NO: 861930 - DNA, 18 bp, Homo sapiens
agcgagctgctctgctat

SEQ ID NO: 861931 - DNA, 15 bp, Homo sapiens
agcgaggaggctcca

SEQ ID NO: 861932 - DNA, 19 bp, Homo sapiens
agcgaggaggctccagagg

SEQ ID NO: 861933 - DNA, 14 bp, Homo sapiens
agcgagggcagctg

SEQ ID NO: 861934 - DNA, 16 bp, Homo sapiens
agcgagggcagctgct

SEQ ID NO: 861935 - DNA, 21 bp, Homo sapiens
agcgagttgtggaaagcctct

SEQ ID NO: 861936 - DNA, 18 bp, Homo sapiens
agcgatctctcctggcct

SEQ ID NO: 861937 - DNA, 19 bp, Homo sapiens
agcgatctctcctggccta

SEQ ID NO: 861938 - DNA, 21 bp, Homo sapiens
agcgatggcaggcctgaccca

SEQ ID NO: 861939 - DNA, 16 bp, Homo sapiens
agcgatgtatgcagct

SEQ ID NO: 861940 - DNA, 19 bp, Homo sapiens
agcgattattatctaaagt

SEQ ID NO: 861941 - DNA, 21 bp, Homo sapiens
agcgattgattgatgtacaga

SEQ ID NO: 861942 - DNA, 19 bp, Homo sapiens
agcgcacctgccccctggt

SEQ ID NO: 861943 - DNA, 21 bp, Homo sapiens
agcgcagccgccgggcaggcc

SEQ ID NO: 861944 - DNA, 22 bp, Homo sapiens
agcgcagccgccgggcaggcct

SEQ ID NO: 861945 - DNA, 21 bp, Homo sapiens
agcgcaggcagcgcagggctg

SEQ ID NO: 861946 - DNA, 14 bp, Homo sapiens
agcgcaggctgcag

SEQ ID NO: 861947 - DNA, 16 bp, Homo sapiens
agcgcaggctgcagag

SEQ ID NO: 861948 - DNA, 18 bp, Homo sapiens
agcgcaggctgcagagcc

SEQ ID NO: 861949 - DNA, 17 bp, Homo sapiens
agcgcagggctggcacg

SEQ ID NO: 861950 - DNA, 23 bp, Homo sapiens
agcgcagttttttttttcttgtc

SEQ ID NO: 861951 - DNA, 17 bp, Homo sapiens
agcgccaaatgttcatc

SEQ ID NO: 861952 - DNA, 15 bp, Homo sapiens
agcgccaagtgcgtg

SEQ ID NO: 861953 - DNA, 18 bp, Homo sapiens
agcgccaggaagccagag

SEQ ID NO: 861954 - DNA, 20 bp, Homo sapiens
agcgccaggaagccagagcc

SEQ ID NO: 861955 - DNA, 22 bp, Homo sapiens
agcgccaggaagccagagcccc

SEQ ID NO: 861956 - DNA, 12 bp, Homo sapiens
agcgccaggctg

SEQ ID NO: 861957 - DNA, 15 bp, Homo sapiens
agcgccaggctggag

SEQ ID NO: 861958 - DNA, 16 bp, Homo sapiens
agcgccaggctggaga

SEQ ID NO: 861959 - DNA, 13 bp, Homo sapiens
agcgccagggccc

SEQ ID NO: 861960 - DNA, 20 bp, Homo sapiens
agcgcccactagacccactg

SEQ ID NO: 861961 - DNA, 13 bp, Homo sapiens
agcgcccaggcct

SEQ ID NO: 861962 - DNA, 14 bp, Homo sapiens
agcgcccccgagcc

SEQ ID NO: 861963 - DNA, 18 bp, Homo sapiens
agcgcccccgagccctga

SEQ ID NO: 861964 - DNA, 15 bp, Homo sapiens
agcgcccgctgggct

SEQ ID NO: 861965 - DNA, 16 bp, Homo sapiens
agcgcccgctgggctg

SEQ ID NO: 861966 - DNA, 19 bp, Homo sapiens
agcgcccgctgggctgagc

SEQ ID NO: 861967 - DNA, 11 bp, Homo sapiens
agcgccctcac

SEQ ID NO: 861968 - DNA, 23 bp, Homo sapiens
agcgccgactccctgagtctgga

SEQ ID NO: 861969 - DNA, 18 bp, Homo sapiens
agcgccgtgctgtaaata

SEQ ID NO: 861970 - DNA, 20 bp, Homo sapiens
agcgcctccatccaaggcca

SEQ ID NO: 861971 - DNA, 20 bp, Homo sapiens
agcgcctccctccaccccag

SEQ ID NO: 861972 - DNA, 21 bp, Homo sapiens
agcgcctccctccaccccagg

SEQ ID NO: 861973 - DNA, 23 bp, Homo sapiens
agcgcctccctccaccccaggac

SEQ ID NO: 861974 - DNA, 15 bp, Homo sapiens
agcgcctcttcctct

SEQ ID NO: 861975 - DNA, 23 bp, Homo sapiens
agcgcctcttcctctgggcagcg

SEQ ID NO: 861976 - DNA, 21 bp, Homo sapiens
agcgcctggctgctgcttctt

SEQ ID NO: 861977 - DNA, 13 bp, Homo sapiens
agcgcggaggagg

SEQ ID NO: 861978 - DNA, 14 bp, Homo sapiens
agcgctccagggcc

SEQ ID NO: 861979 - DNA, 23 bp, Homo sapiens
agcgctcggcccggagcagcagg

SEQ ID NO: 861980 - DNA, 15 bp, Homo sapiens
agcgctctggacaga

SEQ ID NO: 861981 - DNA, 16 bp, Homo sapiens
agcgctctggacagat

SEQ ID NO: 861982 - DNA, 20 bp, Homo sapiens
agcgctggctccctgggcag

SEQ ID NO: 861983 - DNA, 21 bp, Homo sapiens
agcgcttctgcagcctcggcc

SEQ ID NO: 861984 - DNA, 23 bp, Homo sapiens
agcgcttgggcgccgtgctgggc

SEQ ID NO: 861985 - DNA, 17 bp, Homo sapiens
agcgctttctggaaaag

SEQ ID NO: 861986 - DNA, 21 bp, Homo sapiens
agcgctttctggaaaagagga

SEQ ID NO: 861987 - DNA, 16 bp, Homo sapiens
agcggaaaagttgtct

SEQ ID NO: 861988 - DNA, 15 bp, Homo sapiens
agcggaaacaggtgt

SEQ ID NO: 861989 - DNA, 22 bp, Homo sapiens
agcggagagggctagccctgag

SEQ ID NO: 861990 - DNA, 13 bp, Homo sapiens
agcggagcccagc

SEQ ID NO: 861991 - DNA, 16 bp, Homo sapiens
agcggagcccagcctg

SEQ ID NO: 861992 - DNA, 14 bp, Homo sapiens
agcggaggaggaag

SEQ ID NO: 861993 - DNA, 11 bp, Homo sapiens
agcggaggggt

SEQ ID NO: 861994 - DNA, 22 bp, Homo sapiens
agcggaggggtttgggagtcag

SEQ ID NO: 861995 - DNA, 23 bp, Homo sapiens
agcggaggttgcagggagccgag

SEQ ID NO: 861996 - DNA, 16 bp, Homo sapiens
agcggatcacaaggtc

SEQ ID NO: 861997 - DNA, 16 bp, Homo sapiens
agcggattgctctgga

SEQ ID NO: 861998 - DNA, 22 bp, Homo sapiens
agcggattgctctggagcagcc

SEQ ID NO: 861999 - DNA, 14 bp, Homo sapiens
agcggcaccctggt

SEQ ID NO: 862000 - DNA, 11 bp, Homo sapiens
agcggccctgt

SEQ ID NO: 862001 - DNA, 18 bp, Homo sapiens
agcggccggccagcccct

SEQ ID NO: 862002 - DNA, 14 bp, Homo sapiens
agcggcctcagggt

SEQ ID NO: 862003 - DNA, 20 bp, Homo sapiens
agcggccttgaagacagagc

SEQ ID NO: 862004 - DNA, 17 bp, Homo sapiens
agcggctcaagaataaa

SEQ ID NO: 862005 - DNA, 13 bp, Homo sapiens
agcggctcccctc

SEQ ID NO: 862006 - DNA, 15 bp, Homo sapiens
agcggctcccctctg

SEQ ID NO: 862007 - DNA, 17 bp, Homo sapiens
agcggctcccctctgct

SEQ ID NO: 862008 - DNA, 21 bp, Homo sapiens
agcggctcccctctgcttctc

SEQ ID NO: 862009 - DNA, 14 bp, Homo sapiens
agcggctcctcgcc

SEQ ID NO: 862010 - DNA, 21 bp, Homo sapiens
agcggctcctcgcccccacca

SEQ ID NO: 862011 - DNA, 12 bp, Homo sapiens
agcggctctggt

SEQ ID NO: 862012 - DNA, 13 bp, Homo sapiens
agcggctggcagc

SEQ ID NO: 862013 - DNA, 23 bp, Homo sapiens
agcggctggcagcccacccctca

SEQ ID NO: 862014 - DNA, 14 bp, Homo sapiens
agcggctgtttact

SEQ ID NO: 862015 - DNA, 15 bp, Homo sapiens
agcgggacaaagcct

SEQ ID NO: 862016 - DNA, 14 bp, Homo sapiens
agcgggagcccgtg

SEQ ID NO: 862017 - DNA, 21 bp, Homo sapiens
agcgggaggcagagtttgcct

SEQ ID NO: 862018 - DNA, 22 bp, Homo sapiens
agcgggagggagtctcaggagg

SEQ ID NO: 862019 - DNA, 11 bp, Homo sapiens
agcgggcaggg

SEQ ID NO: 862020 - DNA, 19 bp, Homo sapiens
agcgggcaggttctgcctg

SEQ ID NO: 862021 - DNA, 23 bp, Homo sapiens
agcgggcaggttctgcctgcttt

SEQ ID NO: 862022 - DNA, 15 bp, Homo sapiens
agcgggctgtgcccg

SEQ ID NO: 862023 - DNA, 13 bp, Homo sapiens
agcggggctgctc

SEQ ID NO: 862024 - DNA, 22 bp, Homo sapiens
agcggggcttcatctgcaaagg

SEQ ID NO: 862025 - DNA, 13 bp, Homo sapiens
agcggggggaggg

SEQ ID NO: 862026 - DNA, 16 bp, Homo sapiens
agcggtgaccagcctg

SEQ ID NO: 862027 - DNA, 21 bp, Homo sapiens
agcggtgaccagcctgtcacc

SEQ ID NO: 862028 - DNA, 22 bp, Homo sapiens
agcgtacttgaatttttcttcc

SEQ ID NO: 862029 - DNA, 15 bp, Homo sapiens
agcgtcaagacattt

SEQ ID NO: 862030 - DNA, 21 bp, Homo sapiens
agcgtcactgcccaccaaagg

SEQ ID NO: 862031 - DNA, 23 bp, Homo sapiens
agcgtcagggttggtgtgctgag

SEQ ID NO: 862032 - DNA, 17 bp, Homo sapiens
agcgtcagtttcactcc

SEQ ID NO: 862033 - DNA, 16 bp, Homo sapiens
agcgtcccagtctctg

SEQ ID NO: 862034 - DNA, 19 bp, Homo sapiens
agcgtcccagtctctggca

SEQ ID NO: 862035 - DNA, 13 bp, Homo sapiens
agcgtccctggcg

SEQ ID NO: 862036 - DNA, 14 bp, Homo sapiens
agcgtccctggcgc

SEQ ID NO: 862037 - DNA, 17 bp, Homo sapiens
agcgtcctcctctgtga

SEQ ID NO: 862038 - DNA, 13 bp, Homo sapiens
agcgtcctgccct

SEQ ID NO: 862039 - DNA, 16 bp, Homo sapiens
agcgtcctgccctgcc

SEQ ID NO: 862040 - DNA, 21 bp, Homo sapiens
agcgtcctgccctgccccctc

SEQ ID NO: 862041 - DNA, 14 bp, Homo sapiens
agcgtcgccccagt

SEQ ID NO: 862042 - DNA, 12 bp, Homo sapiens
agcgtctgggaa

SEQ ID NO: 862043 - DNA, 15 bp, Homo sapiens
agcgtgcataagtta

SEQ ID NO: 862044 - DNA, 23 bp, Homo sapiens
agcgtgctggcgacactcagggc

SEQ ID NO: 862045 - DNA, 17 bp, Homo sapiens
agcgtgctttaaaaaat

SEQ ID NO: 862046 - DNA, 22 bp, Homo sapiens
agcgtggcccaggccgggaaga

SEQ ID NO: 862047 - DNA, 18 bp, Homo sapiens
agcgtggccttgggagga

SEQ ID NO: 862048 - DNA, 14 bp, Homo sapiens
agcgtgggctctgc

SEQ ID NO: 862049 - DNA, 23 bp, Homo sapiens
agcgtgtctgtatttatgtgtga

SEQ ID NO: 862050 - DNA, 13 bp, Homo sapiens
agcgtgtggagca

SEQ ID NO: 862051 - DNA, 20 bp, Homo sapiens
agcgtgtggagcagagctct

SEQ ID NO: 862052 - DNA, 14 bp, Homo sapiens
agcgtgtgggtccc

SEQ ID NO: 862053 - DNA, 17 bp, Homo sapiens
agcgttcccttctcccc

SEQ ID NO: 862054 - DNA, 22 bp, Homo sapiens
agcgttcccttctcccccttgt

SEQ ID NO: 862055 - DNA, 18 bp, Homo sapiens
agcgttcctggccttctg

SEQ ID NO: 862056 - DNA, 15 bp, Homo sapiens
agcgttctctgtcct

SEQ ID NO: 862057 - DNA, 21 bp, Homo sapiens
agcgttctggactctgcccca

SEQ ID NO: 862058 - DNA, 12 bp, Homo sapiens
agcgttcttgta

SEQ ID NO: 862059 - DNA, 13 bp, Homo sapiens
agcgttgggtttg

SEQ ID NO: 862060 - DNA, 21 bp, Homo sapiens
agcgttgggtttgctcatgta

SEQ ID NO: 862061 - DNA, 17 bp, Homo sapiens
agcgtttctttacttct

SEQ ID NO: 862062 - DNA, 21 bp, Homo sapiens
agcgtttgaggggctggcctt

SEQ ID NO: 862063 - DNA, 17 bp, Homo sapiens
agcgtttttaacctgtt

SEQ ID NO: 862064 - DNA, 11 bp, Homo sapiens
agcgtttttta

SEQ ID NO: 862065 - DNA, 14 bp, Homo sapiens
agcgttttttaaat

SEQ ID NO: 862066 - DNA, 18 bp, Homo sapiens
agcgttttttaaatgtat

SEQ ID NO: 862067 - DNA, 19 bp, Homo sapiens
agcgttttttaaatgtata

SEQ ID NO: 862068 - DNA, 20 bp, Homo sapiens
agcgttttttaaatgtatac

SEQ ID NO: 862069 - DNA, 14 bp, Homo sapiens
agctaaaaatatta

SEQ ID NO: 862070 - DNA, 15 bp, Homo sapiens
agctaaaaggaaaag

SEQ ID NO: 862071 - DNA, 15 bp, Homo sapiens
agctaaaatggtggt

SEQ ID NO: 862072 - DNA, 18 bp, Homo sapiens
agctaaactccttcctgg

SEQ ID NO: 862073 - DNA, 23 bp, Homo sapiens
agctaaactccttcctggcctga

SEQ ID NO: 862074 - DNA, 13 bp, Homo sapiens
agctaaagaggct

SEQ ID NO: 862075 - DNA, 20 bp, Homo sapiens
agctaaatacctcaatcagt

SEQ ID NO: 862076 - DNA, 20 bp, Homo sapiens
agctaaatgcagggaaactc

SEQ ID NO: 862077 - DNA, 23 bp, Homo sapiens
agctaacatctttacgtactgta

SEQ ID NO: 862078 - DNA, 18 bp, Homo sapiens
agctaacattttaaataa

SEQ ID NO: 862079 - DNA, 22 bp, Homo sapiens
agctaacattttaaataaaaga

SEQ ID NO: 862080 - DNA, 16 bp, Homo sapiens
agctaactgtaaatca

SEQ ID NO: 862081 - DNA, 14 bp, Homo sapiens
agctaagaaaagat

SEQ ID NO: 862082 - DNA, 16 bp, Homo sapiens
agctaaggacatttcc

SEQ ID NO: 862083 - DNA, 20 bp, Homo sapiens
agctaagggtgggtgctcag

SEQ ID NO: 862084 - DNA, 23 bp, Homo sapiens
agctaagggtgggtgctcagaat

SEQ ID NO: 862085 - DNA, 19 bp, Homo sapiens
agctaagtgaaaaggtcat

SEQ ID NO: 862086 - DNA, 19 bp, Homo sapiens
agctaataaaaagcttttg

SEQ ID NO: 862087 - DNA, 23 bp, Homo sapiens
agctaataaaaagcttttgtcta

SEQ ID NO: 862088 - DNA, 14 bp, Homo sapiens
agctaatctgcctg

SEQ ID NO: 862089 - DNA, 23 bp, Homo sapiens
agctaatctgcctggttttattt

SEQ ID NO: 862090 - DNA, 23 bp, Homo sapiens
agctaatctgtagggctggacct

SEQ ID NO: 862091 - DNA, 20 bp, Homo sapiens
agctaatgaactctttcaaa

SEQ ID NO: 862092 - DNA, 24 bp, Homo sapiens
agctaatgtgcagggatattgcct

SEQ ID NO: 862093 - DNA, 19 bp, Homo sapiens
agctaattgggagtccagg

SEQ ID NO: 862094 - DNA, 13 bp, Homo sapiens
agctaatttactg

SEQ ID NO: 862095 - DNA, 13 bp, Homo sapiens
agctacaatttgt

SEQ ID NO: 862096 - DNA, 19 bp, Homo sapiens
agctacaatttgtttttgc

SEQ ID NO: 862097 - DNA, 14 bp, Homo sapiens
agctacaggaagca

SEQ ID NO: 862098 - DNA, 12 bp, Homo sapiens
agctacaggact

SEQ ID NO: 862099 - DNA, 13 bp, Homo sapiens
agctacaggactg

SEQ ID NO: 862100 - DNA, 16 bp, Homo sapiens
agctacattcctcagc

SEQ ID NO: 862101 - DNA, 17 bp, Homo sapiens
agctacattcctcagct

SEQ ID NO: 862102 - DNA, 21 bp, Homo sapiens
agctacattcctcagctgcca

SEQ ID NO: 862103 - DNA, 24 bp, Homo sapiens
agctacattcctcagctgccaagc

SEQ ID NO: 862104 - DNA, 22 bp, Homo sapiens
agctaccacccttaggggtaat

SEQ ID NO: 862105 - DNA, 22 bp, Homo sapiens
agctacccaggaggctgaggtg

SEQ ID NO: 862106 - DNA, 19 bp, Homo sapiens
agctacccctcaaactgca

SEQ ID NO: 862107 - DNA, 20 bp, Homo sapiens
agctaccctttttctccagc

SEQ ID NO: 862108 - DNA, 21 bp, Homo sapiens
agctaccctttttctccagct

SEQ ID NO: 862109 - DNA, 22 bp, Homo sapiens
agctacctacatgctgaaaaat

SEQ ID NO: 862110 - DNA, 23 bp, Homo sapiens
agctacctacatgctgaaaaata

SEQ ID NO: 862111 - DNA, 16 bp, Homo sapiens
agctacctcaaacttc

SEQ ID NO: 862112 - DNA, 23 bp, Homo sapiens
agctacctcaaccaatgccaaaa

SEQ ID NO: 862113 - DNA, 16 bp, Homo sapiens
agctactaatgatgtt

SEQ ID NO: 862114 - DNA, 18 bp, Homo sapiens
agctactaatgatgtttt

SEQ ID NO: 862115 - DNA, 21 bp, Homo sapiens
agctactagagatattcttat

SEQ ID NO: 862116 - DNA, 15 bp, Homo sapiens
agctactagcaaaat

SEQ ID NO: 862117 - DNA, 14 bp, Homo sapiens
agctactcagaaat

SEQ ID NO: 862118 - DNA, 20 bp, Homo sapiens
agctactcagaagcctgagg

SEQ ID NO: 862119 - DNA, 17 bp, Homo sapiens
agctactcaggaggctg

SEQ ID NO: 862120 - DNA, 18 bp, Homo sapiens
agctactcaggaggctga

SEQ ID NO: 862121 - DNA, 19 bp, Homo sapiens
agctactcgatagcctgag

SEQ ID NO: 862122 - DNA, 15 bp, Homo sapiens
agctactcgggaggc

SEQ ID NO: 862123 - DNA, 16 bp, Homo sapiens
agctactctagttctg

SEQ ID NO: 862124 - DNA, 22 bp, Homo sapiens
agctactctccccacgagggct

SEQ ID NO: 862125 - DNA, 14 bp, Homo sapiens
agctactctcttgc

SEQ ID NO: 862126 - DNA, 19 bp, Homo sapiens
agctactctcttgccagca

SEQ ID NO: 862127 - DNA, 16 bp, Homo sapiens
agctactctgtccagg

SEQ ID NO: 862128 - DNA, 20 bp, Homo sapiens
agctactctgtccaggccac

SEQ ID NO: 862129 - DNA, 18 bp, Homo sapiens
agctactgaaccagccac

SEQ ID NO: 862130 - DNA, 16 bp, Homo sapiens
agctactgatttttgt

SEQ ID NO: 862131 - DNA, 18 bp, Homo sapiens
agctactgcggaaaagga

SEQ ID NO: 862132 - DNA, 19 bp, Homo sapiens
agctactgtgtgtgtgaat

SEQ ID NO: 862133 - DNA, 18 bp, Homo sapiens
agctacttgggagcctga

SEQ ID NO: 862134 - DNA, 17 bp, Homo sapiens
agctacttgggaggctg

SEQ ID NO: 862135 - DNA, 15 bp, Homo sapiens
agctagaaatatgat

SEQ ID NO: 862136 - DNA, 14 bp, Homo sapiens
agctagaattgagt

SEQ ID NO: 862137 - DNA, 13 bp, Homo sapiens
agctagaatttct

SEQ ID NO: 862138 - DNA, 15 bp, Homo sapiens
agctagagaaattct

SEQ ID NO: 862139 - DNA, 17 bp, Homo sapiens
agctagatactggaaac

SEQ ID NO: 862140 - DNA, 15 bp, Homo sapiens
agctagatgcccctg

SEQ ID NO: 862141 - DNA, 13 bp, Homo sapiens
agctagcctccag

SEQ ID NO: 862142 - DNA, 14 bp, Homo sapiens
agctagcctccagc

SEQ ID NO: 862143 - DNA, 20 bp, Homo sapiens
agctagcgctgccgcacccc

SEQ ID NO: 862144 - DNA, 18 bp, Homo sapiens
agctagcgtgtgccaggc

SEQ ID NO: 862145 - DNA, 14 bp, Homo sapiens
agctagctgccact

SEQ ID NO: 862146 - DNA, 15 bp, Homo sapiens
agctagcttttagga

SEQ ID NO: 862147 - DNA, 13 bp, Homo sapiens
agctaggactgag

SEQ ID NO: 862148 - DNA, 17 bp, Homo sapiens
agctaggactgaggagt

SEQ ID NO: 862149 - DNA, 23 bp, Homo sapiens
agctaggcttcccaggctgggct

SEQ ID NO: 862150 - DNA, 15 bp, Homo sapiens
agctagggctgctgc

SEQ ID NO: 862151 - DNA, 21 bp, Homo sapiens
agctagggctgctgcttctgc

SEQ ID NO: 862152 - DNA, 22 bp, Homo sapiens
agctagggctgctgcttctgct

SEQ ID NO: 862153 - DNA, 19 bp, Homo sapiens
agctaggtgacatatacat

SEQ ID NO: 862154 - DNA, 19 bp, Homo sapiens
agctagtgccaaataattg

SEQ ID NO: 862155 - DNA, 20 bp, Homo sapiens
agctagtgccaaataattga

SEQ ID NO: 862156 - DNA, 12 bp, Homo sapiens
agctagtgcctt

SEQ ID NO: 862157 - DNA, 17 bp, Homo sapiens
agctagtgcctttagag

SEQ ID NO: 862158 - DNA, 18 bp, Homo sapiens
agctagtgtacctcctct

SEQ ID NO: 862159 - DNA, 16 bp, Homo sapiens
agctagtgtcttatgg

SEQ ID NO: 862160 - DNA, 14 bp, Homo sapiens
agctagtgtttcta

SEQ ID NO: 862161 - DNA, 18 bp, Homo sapiens
agctagttcgtagctttc

SEQ ID NO: 862162 - DNA, 12 bp, Homo sapiens
agctagttttct

SEQ ID NO: 862163 - DNA, 20 bp, Homo sapiens
agctatatccatgtactgta

SEQ ID NO: 862164 - DNA, 16 bp, Homo sapiens
agctatatcctgatgc

SEQ ID NO: 862165 - DNA, 21 bp, Homo sapiens
agctatatcgaatatagttct

SEQ ID NO: 862166 - DNA, 23 bp, Homo sapiens
agctatatcgaatatagttctgt

SEQ ID NO: 862167 - DNA, 23 bp, Homo sapiens
agctatcaagtgtgctttagctt

SEQ ID NO: 862168 - DNA, 21 bp, Homo sapiens
agctatccagtgacttgttct

SEQ ID NO: 862169 - DNA, 18 bp, Homo sapiens
agctatctaaagtttgtt

SEQ ID NO: 862170 - DNA, 15 bp, Homo sapiens
agctatctaggtgga

SEQ ID NO: 862171 - DNA, 18 bp, Homo sapiens
agctatctatatggaatt

SEQ ID NO: 862172 - DNA, 23 bp, Homo sapiens
agctatctgcactctaaactgca

SEQ ID NO: 862173 - DNA, 22 bp, Homo sapiens
agctatctggtcaacctcctgg

SEQ ID NO: 862174 - DNA, 24 bp, Homo sapiens
agctatctggtcaacctcctggac

SEQ ID NO: 862175 - DNA, 16 bp, Homo sapiens
agctatcttcatgtaa

SEQ ID NO: 862176 - DNA, 17 bp, Homo sapiens
agctatcttcatgtaaa

SEQ ID NO: 862177 - DNA, 23 bp, Homo sapiens
agctatgctggtaggctcctgcc

SEQ ID NO: 862178 - DNA, 15 bp, Homo sapiens
agctatgctgtatct

SEQ ID NO: 862179 - DNA, 17 bp, Homo sapiens
agctatgggagccccag

SEQ ID NO: 862180 - DNA, 18 bp, Homo sapiens
agctatgggagccccagg

SEQ ID NO: 862181 - DNA, 19 bp, Homo sapiens
agctatgggagccccaggg

SEQ ID NO: 862182 - DNA, 17 bp, Homo sapiens
agctatggtgagatgca

SEQ ID NO: 862183 - DNA, 20 bp, Homo sapiens
agctatggtgagatgcagct

SEQ ID NO: 862184 - DNA, 20 bp, Homo sapiens
agctattactggatctctta

SEQ ID NO: 862185 - DNA, 21 bp, Homo sapiens
agctattactgtctggtttta

SEQ ID NO: 862186 - DNA, 22 bp, Homo sapiens
agctattcctttcccttcctct

SEQ ID NO: 862187 - DNA, 17 bp, Homo sapiens
agctattgcaaatgagg

SEQ ID NO: 862188 - DNA, 23 bp, Homo sapiens
agctatttaatatctggcactgt

SEQ ID NO: 862189 - DNA, 16 bp, Homo sapiens
agctatttcagcctcc

SEQ ID NO: 862190 - DNA, 13 bp, Homo sapiens
agctatttcatct

SEQ ID NO: 862191 - DNA, 17 bp, Homo sapiens
agctatttgatatgcac

SEQ ID NO: 862192 - DNA, 14 bp, Homo sapiens
agctatttgtggtt

SEQ ID NO: 862193 - DNA, 20 bp, Homo sapiens
agctatttgtggttgttgag

SEQ ID NO: 862194 - DNA, 16 bp, Homo sapiens
agctatttgttaaaat

SEQ ID NO: 862195 - DNA, 14 bp, Homo sapiens
agctattttcctct

SEQ ID NO: 862196 - DNA, 15 bp, Homo sapiens
agctattttcctctg

SEQ ID NO: 862197 - DNA, 18 bp, Homo sapiens
agctcaaagacttccacc

SEQ ID NO: 862198 - DNA, 16 bp, Homo sapiens
agctcaaatgaaatgt

SEQ ID NO: 862199 - DNA, 17 bp, Homo sapiens
agctcaaatgaaatgta

SEQ ID NO: 862200 - DNA, 18 bp, Homo sapiens
agctcaactcacagcttc

SEQ ID NO: 862201 - DNA, 19 bp, Homo sapiens
agctcaactcacagcttct

SEQ ID NO: 862202 - DNA, 21 bp, Homo sapiens
agctcaactcacagcttctcc

SEQ ID NO: 862203 - DNA, 19 bp, Homo sapiens
agctcaagcccttggggag

SEQ ID NO: 862204 - DNA, 13 bp, Homo sapiens
agctcaagtttaa

SEQ ID NO: 862205 - DNA, 17 bp, Homo sapiens
agctcaagtttaaaagc

SEQ ID NO: 862206 - DNA, 19 bp, Homo sapiens
agctcaagtttaaaagcca

SEQ ID NO: 862207 - DNA, 21 bp, Homo sapiens
agctcacactccagtggcaga

SEQ ID NO: 862208 - DNA, 17 bp, Homo sapiens
agctcacactgatgggc

SEQ ID NO: 862209 - DNA, 20 bp, Homo sapiens
agctcacactgatgggctgg

SEQ ID NO: 862210 - DNA, 23 bp, Homo sapiens
agctcacagttcctcgccctggg

SEQ ID NO: 862211 - DNA, 21 bp, Homo sapiens
agctcacccaataaacattaa

SEQ ID NO: 862212 - DNA, 15 bp, Homo sapiens
agctcacccctgggc

SEQ ID NO: 862213 - DNA, 16 bp, Homo sapiens
agctcacccctgggca

SEQ ID NO: 862214 - DNA, 12 bp, Homo sapiens
agctcaccctgc

SEQ ID NO: 862215 - DNA, 15 bp, Homo sapiens
agctcaccctgcccg

SEQ ID NO: 862216 - DNA, 17 bp, Homo sapiens
agctcactgaatcttca

SEQ ID NO: 862217 - DNA, 18 bp, Homo sapiens
agctcagaacccagggct

SEQ ID NO: 862218 - DNA, 19 bp, Homo sapiens
agctcagaacccagggctc

SEQ ID NO: 862219 - DNA, 16 bp, Homo sapiens
agctcagaatccaagt

SEQ ID NO: 862220 - DNA, 15 bp, Homo sapiens
agctcagacccccac

SEQ ID NO: 862221 - DNA, 16 bp, Homo sapiens
agctcagacccccact

SEQ ID NO: 862222 - DNA, 17 bp, Homo sapiens
agctcagacccccactc

SEQ ID NO: 862223 - DNA, 20 bp, Homo sapiens
agctcagacccccactctca

SEQ ID NO: 862224 - DNA, 19 bp, Homo sapiens
agctcagaggcgcactgtg

SEQ ID NO: 862225 - DNA, 16 bp, Homo sapiens
agctcagcatttccac

SEQ ID NO: 862226 - DNA, 20 bp, Homo sapiens
agctcagcccacccccctca

SEQ ID NO: 862227 - DNA, 22 bp, Homo sapiens
agctcagcccacccccctcatt

SEQ ID NO: 862228 - DNA, 22 bp, Homo sapiens
agctcagccccgagctgtcccc

SEQ ID NO: 862229 - DNA, 21 bp, Homo sapiens
agctcagccctggcctggctg

SEQ ID NO: 862230 - DNA, 13 bp, Homo sapiens
agctcagctgcat

SEQ ID NO: 862231 - DNA, 23 bp, Homo sapiens
agctcagctgcattccgcagccc

SEQ ID NO: 862232 - DNA, 21 bp, Homo sapiens
agctcagcttcttcctaggtc

SEQ ID NO: 862233 - DNA, 19 bp, Homo sapiens
agctcagctttctgaggcc

SEQ ID NO: 862234 - DNA, 18 bp, Homo sapiens
agctcaggacctgggacc

SEQ ID NO: 862235 - DNA, 15 bp, Homo sapiens
agctcaggaggcgcc

SEQ ID NO: 862236 - DNA, 15 bp, Homo sapiens
agctcaggcagctcg

SEQ ID NO: 862237 - DNA, 16 bp, Homo sapiens
agctcaggcttttcca

SEQ ID NO: 862238 - DNA, 15 bp, Homo sapiens
agctcaggtgcctta

SEQ ID NO: 862239 - DNA, 22 bp, Homo sapiens
agctcaggtttgtcctggtcat

SEQ ID NO: 862240 - DNA, 22 bp, Homo sapiens
agctcagtaacataactgcttc

SEQ ID NO: 862241 - DNA, 22 bp, Homo sapiens
agctcagttctagtctctctgg

SEQ ID NO: 862242 - DNA, 19 bp, Homo sapiens
agctcagtttatccaaggt

SEQ ID NO: 862243 - DNA, 15 bp, Homo sapiens
agctcatattttgta

SEQ ID NO: 862244 - DNA, 18 bp, Homo sapiens
agctcatattttgtatat

SEQ ID NO: 862245 - DNA, 23 bp, Homo sapiens
agctcatcccccctgctgcccag

SEQ ID NO: 862246 - DNA, 24 bp, Homo sapiens
agctcatcccccctgctgcccagt

SEQ ID NO: 862247 - DNA, 19 bp, Homo sapiens
agctcatgtaggtgagcct

SEQ ID NO: 862248 - DNA, 20 bp, Homo sapiens
agctcatgtaggtgagcctg

SEQ ID NO: 862249 - DNA, 21 bp, Homo sapiens
agctcatgtaggtgagcctgg

SEQ ID NO: 862250 - DNA, 16 bp, Homo sapiens
agctcattaaactttt

SEQ ID NO: 862251 - DNA, 15 bp, Homo sapiens
agctcattatgaaaa

SEQ ID NO: 862252 - DNA, 18 bp, Homo sapiens
agctcattatgaaaaaca

SEQ ID NO: 862253 - DNA, 22 bp, Homo sapiens
agctcattatgaaaaacatccc

SEQ ID NO: 862254 - DNA, 19 bp, Homo sapiens
agctcatttaatcccagga

SEQ ID NO: 862255 - DNA, 20 bp, Homo sapiens
agctcatttaatcccaggaa

SEQ ID NO: 862256 - DNA, 21 bp, Homo sapiens
agctcatttaatcccaggaaa

SEQ ID NO: 862257 - DNA, 22 bp, Homo sapiens
agctccaacactttgagcattt

SEQ ID NO: 862258 - DNA, 14 bp, Homo sapiens
agctccacctctgg

SEQ ID NO: 862259 - DNA, 19 bp, Homo sapiens
agctccacctctggtggct

SEQ ID NO: 862260 - DNA, 13 bp, Homo sapiens
agctccactctgc

SEQ ID NO: 862261 - DNA, 24 bp, Homo sapiens
agctccactctgcttctctgactt

SEQ ID NO: 862262 - DNA, 14 bp, Homo sapiens
agctccagaccccc

SEQ ID NO: 862263 - DNA, 17 bp, Homo sapiens
agctccagacccccagc

SEQ ID NO: 862264 - DNA, 21 bp, Homo sapiens
agctccagcaggaaggacccc

SEQ ID NO: 862265 - DNA, 17 bp, Homo sapiens
agctccagtgccgctcc

SEQ ID NO: 862266 - DNA, 21 bp, Homo sapiens
agctccagtgccgctcctgct

SEQ ID NO: 862267 - DNA, 22 bp, Homo sapiens
agctccagtgccgctcctgctt

SEQ ID NO: 862268 - DNA, 16 bp, Homo sapiens
agctccagtttgcatt

SEQ ID NO: 862269 - DNA, 19 bp, Homo sapiens
agctccatgtgcatataaa

SEQ ID NO: 862270 - DNA, 16 bp, Homo sapiens
agctcccacctccctt

SEQ ID NO: 862271 - DNA, 19 bp, Homo sapiens
agctcccacctcccttccc

SEQ ID NO: 862272 - DNA, 12 bp, Homo sapiens
agctcccaggaa

SEQ ID NO: 862273 - DNA, 16 bp, Homo sapiens
agctcccagggtggac

SEQ ID NO: 862274 - DNA, 18 bp, Homo sapiens
agctccccaactccctgc

SEQ ID NO: 862275 - DNA, 18 bp, Homo sapiens
agctccccagatctccca

SEQ ID NO: 862276 - DNA, 15 bp, Homo sapiens
agctcccctccacag

SEQ ID NO: 862277 - DNA, 17 bp, Homo sapiens
agctcccctccacagct

SEQ ID NO: 862278 - DNA, 19 bp, Homo sapiens
agctcccctccacagctgc

SEQ ID NO: 862279 - DNA, 21 bp, Homo sapiens
agctcccctccacagctgcag

SEQ ID NO: 862280 - DNA, 13 bp, Homo sapiens
agctccctcctgc

SEQ ID NO: 862281 - DNA, 22 bp, Homo sapiens
agctccctcctgcacacagaat

SEQ ID NO: 862282 - DNA, 20 bp, Homo sapiens
agctccctgcaccgccgcag

SEQ ID NO: 862283 - DNA, 21 bp, Homo sapiens
agctccctgcaccgccgcaga

SEQ ID NO: 862284 - DNA, 13 bp, Homo sapiens
agctccctggagc

SEQ ID NO: 862285 - DNA, 15 bp, Homo sapiens
agctccctggagccc

SEQ ID NO: 862286 - DNA, 13 bp, Homo sapiens
agctcccttctct

SEQ ID NO: 862287 - DNA, 14 bp, Homo sapiens
agctcccttctctg

SEQ ID NO: 862288 - DNA, 22 bp, Homo sapiens
agctcccttgggaaggacacag

SEQ ID NO: 862289 - DNA, 16 bp, Homo sapiens
agctccctttctcagg

SEQ ID NO: 862290 - DNA, 18 bp, Homo sapiens
agctccgacctctctcag

SEQ ID NO: 862291 - DNA, 16 bp, Homo sapiens
agctcctcaactcacc

SEQ ID NO: 862292 - DNA, 18 bp, Homo sapiens
agctcctcagcggctcca

SEQ ID NO: 862293 - DNA, 12 bp, Homo sapiens
agctcctcccac

SEQ ID NO: 862294 - DNA, 20 bp, Homo sapiens
agctcctccctgtgccccca

SEQ ID NO: 862295 - DNA, 22 bp, Homo sapiens
agctcctccctgtgcccccagc

SEQ ID NO: 862296 - DNA, 20 bp, Homo sapiens
agctcctcccttgttctcta

SEQ ID NO: 862297 - DNA, 13 bp, Homo sapiens
agctcctcctccc

SEQ ID NO: 862298 - DNA, 23 bp, Homo sapiens
agctcctcctccctgcatctgac

SEQ ID NO: 862299 - DNA, 18 bp, Homo sapiens
agctcctctaggggcagc

SEQ ID NO: 862300 - DNA, 21 bp, Homo sapiens
agctcctctaggggcagcctc

SEQ ID NO: 862301 - DNA, 22 bp, Homo sapiens
agctcctctaggggcagcctcc

SEQ ID NO: 862302 - DNA, 13 bp, Homo sapiens
agctcctctcctt

SEQ ID NO: 862303 - DNA, 18 bp, Homo sapiens
agctcctctccttgggct

SEQ ID NO: 862304 - DNA, 21 bp, Homo sapiens
agctcctctccttgggctcct

SEQ ID NO: 862305 - DNA, 23 bp, Homo sapiens
agctcctctccttgggctcctgg

SEQ ID NO: 862306 - DNA, 13 bp, Homo sapiens
agctcctctctga

SEQ ID NO: 862307 - DNA, 14 bp, Homo sapiens
agctcctctctgaa

SEQ ID NO: 862308 - DNA, 16 bp, Homo sapiens
agctcctctctgaagc

SEQ ID NO: 862309 - DNA, 18 bp, Homo sapiens
agctcctctctgaagcga

SEQ ID NO: 862310 - DNA, 13 bp, Homo sapiens
agctcctctgagc

SEQ ID NO: 862311 - DNA, 12 bp, Homo sapiens
agctcctctggg

SEQ ID NO: 862312 - DNA, 20 bp, Homo sapiens
agctcctctgggcaggacct

SEQ ID NO: 862313 - DNA, 13 bp, Homo sapiens
agctcctcttcca

SEQ ID NO: 862314 - DNA, 14 bp, Homo sapiens
agctcctgagtagc

SEQ ID NO: 862315 - DNA, 19 bp, Homo sapiens
agctgaagaaaaaatcaga

SEQ ID NO: 862316 - DNA, 22 bp, Homo sapiens
agctgaagaaaaaatcagaact

SEQ ID NO: 862317 - DNA, 14 bp, Homo sapiens
agctgaagagcaag

SEQ ID NO: 862318 - DNA, 16 bp, Homo sapiens
agctgaagcccccctt

SEQ ID NO: 862319 - DNA, 13 bp, Homo sapiens
agctgaagttact

SEQ ID NO: 862320 - DNA, 15 bp, Homo sapiens
agctgaatacattct

SEQ ID NO: 862321 - DNA, 20 bp, Homo sapiens
agctgaatattttttatttc

SEQ ID NO: 862322 - DNA, 18 bp, Homo sapiens
agctgaatgcctcctgtg

SEQ ID NO: 862323 - DNA, 20 bp, Homo sapiens
agctgaatgcctcctgtggg

SEQ ID NO: 862324 - DNA, 21 bp, Homo sapiens
agctgaatgcctcctgtgggg

SEQ ID NO: 862325 - DNA, 17 bp, Homo sapiens
agctgacccagagtgga

SEQ ID NO: 862326 - DNA, 16 bp, Homo sapiens
agctgacccagcccct

SEQ ID NO: 862327 - DNA, 17 bp, Homo sapiens
agctgacctctgttgtc

SEQ ID NO: 862328 - DNA, 18 bp, Homo sapiens
agctgacgccaataataa

SEQ ID NO: 862329 - DNA, 11 bp, Homo sapiens
agctgactgtg

SEQ ID NO: 862330 - DNA, 19 bp, Homo sapiens
agctgactgtggccccctc

SEQ ID NO: 862331 - DNA, 21 bp, Homo sapiens
agctgactgttttttttgcag

SEQ ID NO: 862332 - DNA, 20 bp, Homo sapiens
agctgacttgcacagggatt

SEQ ID NO: 862333 - DNA, 20 bp, Homo sapiens
agctgacttggcacttaagt

SEQ ID NO: 862334 - DNA, 21 bp, Homo sapiens
agctgacttttctgtccgagc

SEQ ID NO: 862335 - DNA, 15 bp, Homo sapiens
agctgagaagaatga

SEQ ID NO: 862336 - DNA, 19 bp, Homo sapiens
agctgagactacaagtgtg

SEQ ID NO: 862337 - DNA, 17 bp, Homo sapiens
agctgagagtctgaaag

SEQ ID NO: 862338 - DNA, 17 bp, Homo sapiens
agctgagcagcctctgg

SEQ ID NO: 862339 - DNA, 14 bp, Homo sapiens
agctgagcaggaca

SEQ ID NO: 862340 - DNA, 10 bp, Homo sapiens
agctgagcca

SEQ ID NO: 862341 - DNA, 21 bp, Homo sapiens
agctgagcttcggttctccag

SEQ ID NO: 862342 - DNA, 17 bp, Homo sapiens
agctgaggaacaggttc

SEQ ID NO: 862343 - DNA, 17 bp, Homo sapiens
agctgaggatttcctgg

SEQ ID NO: 862344 - DNA, 23 bp, Homo sapiens
agctgaggatttcctggagtgcc

SEQ ID NO: 862345 - DNA, 15 bp, Homo sapiens
agctgaggcagcagt

SEQ ID NO: 862346 - DNA, 12 bp, Homo sapiens
agctgaggccta

SEQ ID NO: 862347 - DNA, 16 bp, Homo sapiens
agctgaggcctatgca

SEQ ID NO: 862348 - DNA, 17 bp, Homo sapiens
agctgaggcctatgcag

SEQ ID NO: 862349 - DNA, 16 bp, Homo sapiens
agctgagggagggagc

SEQ ID NO: 862350 - DNA, 13 bp, Homo sapiens
agctgagggccct

SEQ ID NO: 862351 - DNA, 21 bp, Homo sapiens
agctgagggccctgtggagtc

SEQ ID NO: 862352 - DNA, 24 bp, Homo sapiens
agctgagggccctgtggagtccag

SEQ ID NO: 862353 - DNA, 14 bp, Homo sapiens
agctgaggggacgg

SEQ ID NO: 862354 - DNA, 18 bp, Homo sapiens
agctgaggtctcttgagg

SEQ ID NO: 862355 - DNA, 16 bp, Homo sapiens
agctgaggtttcaccc

SEQ ID NO: 862356 - DNA, 18 bp, Homo sapiens
agctgaggtttcaccctt

SEQ ID NO: 862357 - DNA, 15 bp, Homo sapiens
agctgagtgaaaaat

SEQ ID NO: 862358 - DNA, 23 bp, Homo sapiens
agctgagtgactgtaggcaggga

SEQ ID NO: 862359 - DNA, 17 bp, Homo sapiens
agctgagtggccagcca

SEQ ID NO: 862360 - DNA, 22 bp, Homo sapiens
agctgagttacttgtctgaggc

SEQ ID NO: 862361 - DNA, 16 bp, Homo sapiens
agctgatacttcattt

SEQ ID NO: 862362 - DNA, 21 bp, Homo sapiens
agctgatattatttcttctct

SEQ ID NO: 862363 - DNA, 13 bp, Homo sapiens
agctgatcagttt

SEQ ID NO: 862364 - DNA, 22 bp, Homo sapiens
agctgatgaaactcctgatttt

SEQ ID NO: 862365 - DNA, 22 bp, Homo sapiens
agctgatgaacttattctgtag

SEQ ID NO: 862366 - DNA, 20 bp, Homo sapiens
agctgatgccccttctcccc

SEQ ID NO: 862367 - DNA, 13 bp, Homo sapiens
agctgatggcagc

SEQ ID NO: 862368 - DNA, 20 bp, Homo sapiens
agctgatgttggaagagaaa

SEQ ID NO: 862369 - DNA, 19 bp, Homo sapiens
agctgattactgtcaataa

SEQ ID NO: 862370 - DNA, 19 bp, Homo sapiens
agctgattccagaacaaat

SEQ ID NO: 862371 - DNA, 14 bp, Homo sapiens
agctgatttccagg

SEQ ID NO: 862372 - DNA, 18 bp, Homo sapiens
agctgcaaaaataatcat

SEQ ID NO: 862373 - DNA, 11 bp, Homo sapiens
agctgcacaca

SEQ ID NO: 862374 - DNA, 20 bp, Homo sapiens
agctgcaccctcaggcaggt

SEQ ID NO: 862375 - DNA, 21 bp, Homo sapiens
agctgcacctgccagcctggc

SEQ ID NO: 862376 - DNA, 12 bp, Homo sapiens
agctgcacggca

SEQ ID NO: 862377 - DNA, 19 bp, Homo sapiens
agctgcactgatcacccaa

SEQ ID NO: 862378 - DNA, 13 bp, Homo sapiens
agctgcactgtga

SEQ ID NO: 862379 - DNA, 16 bp, Homo sapiens
agctgcactgtgaacc

SEQ ID NO: 862380 - DNA, 24 bp, Homo sapiens
agctgcactttaaccctagaaggt

SEQ ID NO: 862381 - DNA, 13 bp, Homo sapiens
agctgcagagcag

SEQ ID NO: 862382 - DNA, 14 bp, Homo sapiens
agctgcagctgggc

SEQ ID NO: 862383 - DNA, 21 bp, Homo sapiens
agctgcaggcgctctcctcct

SEQ ID NO: 862384 - DNA, 23 bp, Homo sapiens
agctgcagggcacggggacctgg

SEQ ID NO: 862385 - DNA, 17 bp, Homo sapiens
agctgcaggtttgtaat

SEQ ID NO: 862386 - DNA, 17 bp, Homo sapiens
agctgcatggagcctgg

SEQ ID NO: 862387 - DNA, 23 bp, Homo sapiens
agctgcatgtggcttttttaaaa

SEQ ID NO: 862388 - DNA, 19 bp, Homo sapiens
agctgcatgttaagtgcca

SEQ ID NO: 862389 - DNA, 15 bp, Homo sapiens
agctgcattccgcag

SEQ ID NO: 862390 - DNA, 18 bp, Homo sapiens
agctgcattccgcagccc

SEQ ID NO: 862391 - DNA, 14 bp, Homo sapiens
agctgccaagagtg

SEQ ID NO: 862392 - DNA, 13 bp, Homo sapiens
agctgccacagag

SEQ ID NO: 862393 - DNA, 17 bp, Homo sapiens
agctgccacattgattt

SEQ ID NO: 862394 - DNA, 17 bp, Homo sapiens
agctgccacccctcttc

SEQ ID NO: 862395 - DNA, 22 bp, Homo sapiens
agctgccacccctcttctgctc

SEQ ID NO: 862396 - DNA, 11 bp, Homo sapiens
agctgccactg

SEQ ID NO: 862397 - DNA, 15 bp, Homo sapiens
agctgccactgggca

SEQ ID NO: 862398 - DNA, 23 bp, Homo sapiens
agctgccactgggcacctgcgca

SEQ ID NO: 862399 - DNA, 13 bp, Homo sapiens
agctgccagagaa

SEQ ID NO: 862400 - DNA, 12 bp, Homo sapiens
agctgccagagc

SEQ ID NO: 862401 - DNA, 18 bp, Homo sapiens
agctgccatccttgctgc

SEQ ID NO: 862402 - DNA, 22 bp, Homo sapiens
agctgccatccttgctgcagct

SEQ ID NO: 862403 - DNA, 14 bp, Homo sapiens
agctgcccagagtt

SEQ ID NO: 862404 - DNA, 14 bp, Homo sapiens
agctgccccagcca

SEQ ID NO: 862405 - DNA, 17 bp, Homo sapiens
agctgccccggcccctc

SEQ ID NO: 862406 - DNA, 12 bp, Homo sapiens
agctgcccctcc

SEQ ID NO: 862407 - DNA, 22 bp, Homo sapiens
agctgcccctcctggagcagaa

SEQ ID NO: 862408 - DNA, 20 bp, Homo sapiens
agctgcccggcgcctgccct

SEQ ID NO: 862409 - DNA, 21 bp, Homo sapiens
agctgcccggcgcctgccctg

SEQ ID NO: 862410 - DNA, 22 bp, Homo sapiens
agctgcccggcgcctgccctgc

SEQ ID NO: 862411 - DNA, 22 bp, Homo sapiens
agctgccctagctgaccccgag

SEQ ID NO: 862412 - DNA, 18 bp, Homo sapiens
agctgccctatgggcctg

SEQ ID NO: 862413 - DNA, 15 bp, Homo sapiens
agctgccctgctgcc

SEQ ID NO: 862414 - DNA, 17 bp, Homo sapiens
agctgccgaccagagcc

SEQ ID NO: 862415 - DNA, 22 bp, Homo sapiens
agctgccgtgcctgtgtcctga

SEQ ID NO: 862416 - DNA, 22 bp, Homo sapiens
agctgcctacctaatgaggact

SEQ ID NO: 862417 - DNA, 13 bp, Homo sapiens
agctgcctcactt

SEQ ID NO: 862418 - DNA, 18 bp, Homo sapiens
agctgcctcctggtctct

SEQ ID NO: 862419 - DNA, 19 bp, Homo sapiens
agctgcctctgacagcagc

SEQ ID NO: 862420 - DNA, 21 bp, Homo sapiens
agctgcctctgacagcagcct

SEQ ID NO: 862421 - DNA, 15 bp, Homo sapiens
agctgcctctgctcc

SEQ ID NO: 862422 - DNA, 17 bp, Homo sapiens
agctgcctctgctccct

SEQ ID NO: 862423 - DNA, 14 bp, Homo sapiens
agctgcctcttctg

SEQ ID NO: 862424 - DNA, 12 bp, Homo sapiens
agctgcctggcc

SEQ ID NO: 862425 - DNA, 16 bp, Homo sapiens
agctgcctggccatgc

SEQ ID NO: 862426 - DNA, 23 bp, Homo sapiens
agctgcctggccatgctgtccct

SEQ ID NO: 862427 - DNA, 15 bp, Homo sapiens
agctgcctgggcccg

SEQ ID NO: 862428 - DNA, 16 bp, Homo sapiens
agctgcctggggccca

SEQ ID NO: 862429 - DNA, 22 bp, Homo sapiens
agctgcctgtagttaggaaata

SEQ ID NO: 862430 - DNA, 12 bp, Homo sapiens
agctgcctgtgc

SEQ ID NO: 862431 - DNA, 22 bp, Homo sapiens
agctgcctgtgccatgcccaag

SEQ ID NO: 862432 - DNA, 17 bp, Homo sapiens
agctgccttccctagct

SEQ ID NO: 862433 - DNA, 18 bp, Homo sapiens
agctgccttcctcatccc

SEQ ID NO: 862434 - DNA, 14 bp, Homo sapiens
agctgccttgagct

SEQ ID NO: 862435 - DNA, 21 bp, Homo sapiens
agctgcgccggacagagtggg

SEQ ID NO: 862436 - DNA, 17 bp, Homo sapiens
agctgcgcttgcttttc

SEQ ID NO: 862437 - DNA, 17 bp, Homo sapiens
agctgcggattggggtg

SEQ ID NO: 862438 - DNA, 14 bp, Homo sapiens
agctgcgggtctga

SEQ ID NO: 862439 - DNA, 18 bp, Homo sapiens
agctcctgagtagctggg

SEQ ID NO: 862440 - DNA, 21 bp, Homo sapiens
agctcctgagtagctgggcct

SEQ ID NO: 862441 - DNA, 23 bp, Homo sapiens
agctcctgagtagctgggcctgt

SEQ ID NO: 862442 - DNA, 13 bp, Homo sapiens
agctcctgggacc

SEQ ID NO: 862443 - DNA, 14 bp, Homo sapiens
agctcctgggaccc

SEQ ID NO: 862444 - DNA, 16 bp, Homo sapiens
agctcctgggaccctt

SEQ ID NO: 862445 - DNA, 19 bp, Homo sapiens
agctcctgggacccttggc

SEQ ID NO: 862446 - DNA, 22 bp, Homo sapiens
agctcctggggagctcctggga

SEQ ID NO: 862447 - DNA, 22 bp, Homo sapiens
agctcctggtcttgagatgtct

SEQ ID NO: 862448 - DNA, 15 bp, Homo sapiens
agctcctgtcctccc

SEQ ID NO: 862449 - DNA, 16 bp, Homo sapiens
agctcctgtcctccca

SEQ ID NO: 862450 - DNA, 17 bp, Homo sapiens
agctcctgtcctcccat

SEQ ID NO: 862451 - DNA, 21 bp, Homo sapiens
agctcctgtcctcccatcccc

SEQ ID NO: 862452 - DNA, 13 bp, Homo sapiens
agctcctgtggcc

SEQ ID NO: 862453 - DNA, 21 bp, Homo sapiens
agctccttattggaaggtatt

SEQ ID NO: 862454 - DNA, 15 bp, Homo sapiens
agctccttcctgttt

SEQ ID NO: 862455 - DNA, 17 bp, Homo sapiens
agctccttcctgtttgt

SEQ ID NO: 862456 - DNA, 15 bp, Homo sapiens
agctccttggagcag

SEQ ID NO: 862457 - DNA, 16 bp, Homo sapiens
agctcctttcatgctc

SEQ ID NO: 862458 - DNA, 17 bp, Homo sapiens
agctcctttctcctgtg

SEQ ID NO: 862459 - DNA, 23 bp, Homo sapiens
agctccttttgtccccagggccc

SEQ ID NO: 862460 - DNA, 17 bp, Homo sapiens
agctcgaattaagaata

SEQ ID NO: 862461 - DNA, 15 bp, Homo sapiens
agctcgcagcccccg

SEQ ID NO: 862462 - DNA, 13 bp, Homo sapiens
agctcgctaaagt

SEQ ID NO: 862463 - DNA, 17 bp, Homo sapiens
agctcggggtccaccag

SEQ ID NO: 862464 - DNA, 19 bp, Homo sapiens
agctcggggtccaccagtg

SEQ ID NO: 862465 - DNA, 15 bp, Homo sapiens
agctcggtggaccca

SEQ ID NO: 862466 - DNA, 16 bp, Homo sapiens
agctcggtggacccag

SEQ ID NO: 862467 - DNA, 18 bp, Homo sapiens
agctcggtggacccaggg

SEQ ID NO: 862468 - DNA, 19 bp, Homo sapiens
agctcggtggacccaggga

SEQ ID NO: 862469 - DNA, 18 bp, Homo sapiens
agctctagcaagggaggc

SEQ ID NO: 862470 - DNA, 17 bp, Homo sapiens
agctctatcaccaagga

SEQ ID NO: 862471 - DNA, 17 bp, Homo sapiens
agctctccaggccaggt

SEQ ID NO: 862472 - DNA, 18 bp, Homo sapiens
agctctccccaggcattt

SEQ ID NO: 862473 - DNA, 15 bp, Homo sapiens
agctctcccctcaga

SEQ ID NO: 862474 - DNA, 14 bp, Homo sapiens
agctctccctctgg

SEQ ID NO: 862475 - DNA, 18 bp, Homo sapiens
agctctccggtctctctc

SEQ ID NO: 862476 - DNA, 12 bp, Homo sapiens
agctctcctggc

SEQ ID NO: 862477 - DNA, 13 bp, Homo sapiens
agctctcctggct

SEQ ID NO: 862478 - DNA, 20 bp, Homo sapiens
agctctcctggctccctccc

SEQ ID NO: 862479 - DNA, 16 bp, Homo sapiens
agctctcgttctcctt

SEQ ID NO: 862480 - DNA, 17 bp, Homo sapiens
agctctctaggcctctc

SEQ ID NO: 862481 - DNA, 19 bp, Homo sapiens
agctctctaggcctctcca

SEQ ID NO: 862482 - DNA, 22 bp, Homo sapiens
agctctctaggcctctccagtt

SEQ ID NO: 862483 - DNA, 16 bp, Homo sapiens
agctctctcctccctt

SEQ ID NO: 862484 - DNA, 23 bp, Homo sapiens
agctctctgacgcttgtgacagt

SEQ ID NO: 862485 - DNA, 16 bp, Homo sapiens
agctctctgccctgtg

SEQ ID NO: 862486 - DNA, 17 bp, Homo sapiens
agctctctgccctgtgt

SEQ ID NO: 862487 - DNA, 18 bp, Homo sapiens
agctctctgccctgtgta

SEQ ID NO: 862488 - DNA, 15 bp, Homo sapiens
agctctctgctgggt

SEQ ID NO: 862489 - DNA, 12 bp, Homo sapiens
agctctctggga

SEQ ID NO: 862490 - DNA, 23 bp, Homo sapiens
agctctgaagtcacatcacagga

SEQ ID NO: 862491 - DNA, 14 bp, Homo sapiens
agctctgacatccc

SEQ ID NO: 862492 - DNA, 20 bp, Homo sapiens
agctctgacattctgattcg

SEQ ID NO: 862493 - DNA, 13 bp, Homo sapiens
agctctgaccctt

SEQ ID NO: 862494 - DNA, 17 bp, Homo sapiens
agctctgagatcctgga

SEQ ID NO: 862495 - DNA, 19 bp, Homo sapiens
agctctgcccccgcgggtt

SEQ ID NO: 862496 - DNA, 14 bp, Homo sapiens
agctctgccgtctc

SEQ ID NO: 862497 - DNA, 18 bp, Homo sapiens
agctctgccgtctctgga

SEQ ID NO: 862498 - DNA, 13 bp, Homo sapiens
agctctgcgccag

SEQ ID NO: 862499 - DNA, 14 bp, Homo sapiens
agctctgcgccagg

SEQ ID NO: 862500 - DNA, 18 bp, Homo sapiens
agctctgcgccaggcaga

SEQ ID NO: 862501 - DNA, 19 bp, Homo sapiens
agctctgcgccaggcagag

SEQ ID NO: 862502 - DNA, 23 bp, Homo sapiens
agctctgcgtcggtcctggtgcc

SEQ ID NO: 862503 - DNA, 12 bp, Homo sapiens
agctctggacca

SEQ ID NO: 862504 - DNA, 16 bp, Homo sapiens
agctctggaggggagg

SEQ ID NO: 862505 - DNA, 22 bp, Homo sapiens
agctctggaggtgctgctctag

SEQ ID NO: 862506 - DNA, 17 bp, Homo sapiens
agctctggatgaaggca

SEQ ID NO: 862507 - DNA, 12 bp, Homo sapiens
agctctggctga

SEQ ID NO: 862508 - DNA, 16 bp, Homo sapiens
agctctggctgaaccc

SEQ ID NO: 862509 - DNA, 19 bp, Homo sapiens
agctctggctgaaccctgt

SEQ ID NO: 862510 - DNA, 23 bp, Homo sapiens
agctctggctgaaccctgtgctg

SEQ ID NO: 862511 - DNA, 23 bp, Homo sapiens
agctctggcttagacaccacctg

SEQ ID NO: 862512 - DNA, 12 bp, Homo sapiens
agctctggcttc

SEQ ID NO: 862513 - DNA, 12 bp, Homo sapiens
agctctgggcct

SEQ ID NO: 862514 - DNA, 14 bp, Homo sapiens
agctctgggcctct

SEQ ID NO: 862515 - DNA, 16 bp, Homo sapiens
agctctgggcctcttt

SEQ ID NO: 862516 - DNA, 23 bp, Homo sapiens
agctctgggcctctttttgccct

SEQ ID NO: 862517 - DNA, 12 bp, Homo sapiens
agctctggggac

SEQ ID NO: 862518 - DNA, 18 bp, Homo sapiens
agctctggggacagcttc

SEQ ID NO: 862519 - DNA, 20 bp, Homo sapiens
agctctggggacagcttcct

SEQ ID NO: 862520 - DNA, 15 bp, Homo sapiens
agctctggggatggg

SEQ ID NO: 862521 - DNA, 18 bp, Homo sapiens
agctctggggatgggtgg

SEQ ID NO: 862522 - DNA, 20 bp, Homo sapiens
agctctggggatgggtgggg

SEQ ID NO: 862523 - DNA, 22 bp, Homo sapiens
agctctggggtgggcagttttt

SEQ ID NO: 862524 - DNA, 22 bp, Homo sapiens
agctctggttatttttctcttg

SEQ ID NO: 862525 - DNA, 13 bp, Homo sapiens
agctctgtaactt

SEQ ID NO: 862526 - DNA, 22 bp, Homo sapiens
agctctgtaacttacacctgga

SEQ ID NO: 862527 - DNA, 12 bp, Homo sapiens
agctctgtggcc

SEQ ID NO: 862528 - DNA, 17 bp, Homo sapiens
agctctgtggcctgtgt

SEQ ID NO: 862529 - DNA, 18 bp, Homo sapiens
agctctgtggcctgtgtc

SEQ ID NO: 862530 - DNA, 20 bp, Homo sapiens
agctctgtgggtctctggaa

SEQ ID NO: 862531 - DNA, 19 bp, Homo sapiens
agctcttaaaaagacactt

SEQ ID NO: 862532 - DNA, 20 bp, Homo sapiens
agctcttaattgttcatttt

SEQ ID NO: 862533 - DNA, 16 bp, Homo sapiens
agctcttagtctcttt

SEQ ID NO: 862534 - DNA, 14 bp, Homo sapiens
agctcttcaagctg

SEQ ID NO: 862535 - DNA, 17 bp, Homo sapiens
agctcttcaggcctccc

SEQ ID NO: 862536 - DNA, 16 bp, Homo sapiens
agctcttccagggcag

SEQ ID NO: 862537 - DNA, 17 bp, Homo sapiens
agctcttcggtttctga

SEQ ID NO: 862538 - DNA, 19 bp, Homo sapiens
agctcttcggtttctgagc

SEQ ID NO: 862539 - DNA, 16 bp, Homo sapiens
agctcttctggagttt

SEQ ID NO: 862540 - DNA, 22 bp, Homo sapiens
agctcttctggagtttctctaa

SEQ ID NO: 862541 - DNA, 13 bp, Homo sapiens
agctcttctgggc

SEQ ID NO: 862542 - DNA, 21 bp, Homo sapiens
agctcttctgggcagagcctg

SEQ ID NO: 862543 - DNA, 16 bp, Homo sapiens
agctcttcttcccagc

SEQ ID NO: 862544 - DNA, 19 bp, Homo sapiens
agctcttgatttgggtgga

SEQ ID NO: 862545 - DNA, 21 bp, Homo sapiens
agctcttgccccactccctgg

SEQ ID NO: 862546 - DNA, 16 bp, Homo sapiens
agctcttgcccttccc

SEQ ID NO: 862547 - DNA, 14 bp, Homo sapiens
agctcttgctctct

SEQ ID NO: 862548 - DNA, 15 bp, Homo sapiens
agctcttgctctctt

SEQ ID NO: 862549 - DNA, 14 bp, Homo sapiens
agctcttgctgtta

SEQ ID NO: 862550 - DNA, 15 bp, Homo sapiens
agctcttggagctgt

SEQ ID NO: 862551 - DNA, 16 bp, Homo sapiens
agctcttggctccact

SEQ ID NO: 862552 - DNA, 14 bp, Homo sapiens
agctctttccaaat

SEQ ID NO: 862553 - DNA, 15 bp, Homo sapiens
agctctttccaaatt

SEQ ID NO: 862554 - DNA, 22 bp, Homo sapiens
agctctttccaaattaaaacaa

SEQ ID NO: 862555 - DNA, 11 bp, Homo sapiens
agctctttctc

SEQ ID NO: 862556 - DNA, 21 bp, Homo sapiens
agctcttttttgtttgtttct

SEQ ID NO: 862557 - DNA, 23 bp, Homo sapiens
agctgaaaaatcacatcctggcc

SEQ ID NO: 862558 - DNA, 17 bp, Homo sapiens
agctgaaaagggcactc

SEQ ID NO: 862559 - DNA, 21 bp, Homo sapiens
agctgaaaagggcactcccaa

SEQ ID NO: 862560 - DNA, 22 bp, Homo sapiens
agctgaaaagggcactcccaac

SEQ ID NO: 862561 - DNA, 14 bp, Homo sapiens
agctgaaattgggt

SEQ ID NO: 862562 - DNA, 21 bp, Homo sapiens
agctgaaccaaagcctcttca

SEQ ID NO: 862563 - DNA, 16 bp, Homo sapiens
agctgaaccacagaaa

SEQ ID NO: 862564 - DNA, 20 bp, Homo sapiens
agctgcgtttttttatagta

SEQ ID NO: 862565 - DNA, 15 bp, Homo sapiens
agctgctatagcctg

SEQ ID NO: 862566 - DNA, 21 bp, Homo sapiens
agctgctatccccatctccct

SEQ ID NO: 862567 - DNA, 22 bp, Homo sapiens
agctgctatccccatctccctg

SEQ ID NO: 862568 - DNA, 23 bp, Homo sapiens
agctgctcattacagttctttcc

SEQ ID NO: 862569 - DNA, 16 bp, Homo sapiens
agctgctccaggcctg

SEQ ID NO: 862570 - DNA, 19 bp, Homo sapiens
agctgctccaggcctgcag

SEQ ID NO: 862571 - DNA, 21 bp, Homo sapiens
agctgctcccacacttgtgcc

SEQ ID NO: 862572 - DNA, 17 bp, Homo sapiens
agctgctcccctgccac

SEQ ID NO: 862573 - DNA, 14 bp, Homo sapiens
agctgctcccctgg

SEQ ID NO: 862574 - DNA, 17 bp, Homo sapiens
agctgctccctggcatt

SEQ ID NO: 862575 - DNA, 18 bp, Homo sapiens
agctgctcctagagggag

SEQ ID NO: 862576 - DNA, 19 bp, Homo sapiens
agctgctcctttaccctct

SEQ ID NO: 862577 - DNA, 21 bp, Homo sapiens
agctgctcctttaccctcttg

SEQ ID NO: 862578 - DNA, 12 bp, Homo sapiens
agctgctctgag

SEQ ID NO: 862579 - DNA, 15 bp, Homo sapiens
agctgctctgagcca

SEQ ID NO: 862580 - DNA, 11 bp, Homo sapiens
agctgctctgc

SEQ ID NO: 862581 - DNA, 13 bp, Homo sapiens
agctgctctgccc

SEQ ID NO: 862582 - DNA, 14 bp, Homo sapiens
agctgctctgcccc

SEQ ID NO: 862583 - DNA, 17 bp, Homo sapiens
agctgctctgccccttg

SEQ ID NO: 862584 - DNA, 12 bp, Homo sapiens
agctgctctgct

SEQ ID NO: 862585 - DNA, 19 bp, Homo sapiens
agctgctgaagttctgagc

SEQ ID NO: 862586 - DNA, 17 bp, Homo sapiens
agctgctgaccaattgt

SEQ ID NO: 862587 - DNA, 14 bp, Homo sapiens
agctgctgaggccc

SEQ ID NO: 862588 - DNA, 16 bp, Homo sapiens
agctgctggctgacct

SEQ ID NO: 862589 - DNA, 21 bp, Homo sapiens
agctgctggctgacctgggcc

SEQ ID NO: 862590 - DNA, 23 bp, Homo sapiens
agctgctggctgacctgggccca

SEQ ID NO: 862591 - DNA, 23 bp, Homo sapiens
agctgctgggacgatcgcccagg

SEQ ID NO: 862592 - DNA, 13 bp, Homo sapiens
agctgctgggcta

SEQ ID NO: 862593 - DNA, 15 bp, Homo sapiens
agctgctgtgcccag

SEQ ID NO: 862594 - DNA, 17 bp, Homo sapiens
agctgctgtgcccagcc

SEQ ID NO: 862595 - DNA, 19 bp, Homo sapiens
agctgctgtgccccaccac

SEQ ID NO: 862596 - DNA, 16 bp, Homo sapiens
agctgctgttctcagg

SEQ ID NO: 862597 - DNA, 20 bp, Homo sapiens
agctgctgttctcaggacag

SEQ ID NO: 862598 - DNA, 13 bp, Homo sapiens
agctgcttctccc

SEQ ID NO: 862599 - DNA, 23 bp, Homo sapiens
agctgcttctccccccatcccag

SEQ ID NO: 862600 - DNA, 18 bp, Homo sapiens
agctgcttctgctgccta

SEQ ID NO: 862601 - DNA, 17 bp, Homo sapiens
agctgcttgacctagct

SEQ ID NO: 862602 - DNA, 12 bp, Homo sapiens
agctgcttgtcc

SEQ ID NO: 862603 - DNA, 24 bp, Homo sapiens
agctgcttgtcctgctctcttcag

SEQ ID NO: 862604 - DNA, 16 bp, Homo sapiens
agcttaattctccttc

SEQ ID NO: 862605 - DNA, 17 bp, Homo sapiens
agcttaattctccttcc

SEQ ID NO: 862606 - DNA, 13 bp, Homo sapiens
agcttacaggaag

SEQ ID NO: 862607 - DNA, 12 bp, Homo sapiens
agcttacccaag

SEQ ID NO: 862608 - DNA, 20 bp, Homo sapiens
agcttacccaagctgtggca

SEQ ID NO: 862609 - DNA, 23 bp, Homo sapiens
agcttactgagttatcaggtgca

SEQ ID NO: 862610 - DNA, 20 bp, Homo sapiens
agcttagagtatacctccta

SEQ ID NO: 862611 - DNA, 16 bp, Homo sapiens
agcttagagttcttct

SEQ ID NO: 862612 - DNA, 21 bp, Homo sapiens
agcttagagttcttctttctt

SEQ ID NO: 862613 - DNA, 21 bp, Homo sapiens
agcttagccttgtgccctgcc

SEQ ID NO: 862614 - DNA, 18 bp, Homo sapiens
agcttagggccctggagg

SEQ ID NO: 862615 - DNA, 19 bp, Homo sapiens
agcttagggccctggaggc

SEQ ID NO: 862616 - DNA, 14 bp, Homo sapiens
agcttatagaataa

SEQ ID NO: 862617 - DNA, 21 bp, Homo sapiens
agcttatagaataaaagctat

SEQ ID NO: 862618 - DNA, 23 bp, Homo sapiens
agcttatctacttccaaactaat

SEQ ID NO: 862619 - DNA, 14 bp, Homo sapiens
agcttatctctttt

SEQ ID NO: 862620 - DNA, 17 bp, Homo sapiens
agcttatctcttttata

SEQ ID NO: 862621 - DNA, 13 bp, Homo sapiens
agcttattggcca

SEQ ID NO: 862622 - DNA, 15 bp, Homo sapiens
agcttcaacttttct

SEQ ID NO: 862623 - DNA, 18 bp, Homo sapiens
agcttcaatataagaagc

SEQ ID NO: 862624 - DNA, 18 bp, Homo sapiens
agcttcacagtacccaaa

SEQ ID NO: 862625 - DNA, 21 bp, Homo sapiens
agcttcagactcaagtaccca

SEQ ID NO: 862626 - DNA, 21 bp, Homo sapiens
agcttcagtaagttatctttg

SEQ ID NO: 862627 - DNA, 22 bp, Homo sapiens
agcttcagtaagttatctttga

SEQ ID NO: 862628 - DNA, 16 bp, Homo sapiens
agcttcatacttcatg

SEQ ID NO: 862629 - DNA, 15 bp, Homo sapiens
agcttcatgcctttg

SEQ ID NO: 862630 - DNA, 20 bp, Homo sapiens
agcttcattatctgagttgc

SEQ ID NO: 862631 - DNA, 13 bp, Homo sapiens
agcttcatttgtg

SEQ ID NO: 862632 - DNA, 19 bp, Homo sapiens
agcttcatttgtgtcaatg

SEQ ID NO: 862633 - DNA, 20 bp, Homo sapiens
agcttcatttgtgtcaatgg

SEQ ID NO: 862634 - DNA, 11 bp, Homo sapiens
agcttccaaag

SEQ ID NO: 862635 - DNA, 12 bp, Homo sapiens
agcttccaaagc

SEQ ID NO: 862636 - DNA, 21 bp, Homo sapiens
agcttccaaatgtgtcagaat

SEQ ID NO: 862637 - DNA, 18 bp, Homo sapiens
agcttccacaaaattaga

SEQ ID NO: 862638 - DNA, 19 bp, Homo sapiens
agcttccacaaaattagaa

SEQ ID NO: 862639 - DNA, 13 bp, Homo sapiens
agcttccacctca

SEQ ID NO: 862640 - DNA, 22 bp, Homo sapiens
agcttccacctcatggattgcc

SEQ ID NO: 862641 - DNA, 22 bp, Homo sapiens
agcttccatgattctatttata

SEQ ID NO: 862642 - DNA, 17 bp, Homo sapiens
agcttcccaagtagctg

SEQ ID NO: 862643 - DNA, 15 bp, Homo sapiens
agcttccctctcagc

SEQ ID NO: 862644 - DNA, 13 bp, Homo sapiens
agcttcctcacac

SEQ ID NO: 862645 - DNA, 15 bp, Homo sapiens
agcttcctcacaccc

SEQ ID NO: 862646 - DNA, 19 bp, Homo sapiens
agcttcctcacacccctgt

SEQ ID NO: 862647 - DNA, 13 bp, Homo sapiens
agcttcctgaggg

SEQ ID NO: 862648 - DNA, 14 bp, Homo sapiens
agcttcctggctct

SEQ ID NO: 862649 - DNA, 14 bp, Homo sapiens
agcttcctgtctgt

SEQ ID NO: 862650 - DNA, 16 bp, Homo sapiens
agcttcctgtctgttt

SEQ ID NO: 862651 - DNA, 14 bp, Homo sapiens
agcttcctgtgccc

SEQ ID NO: 862652 - DNA, 18 bp, Homo sapiens
agcttcctgtgccctcac

SEQ ID NO: 862653 - DNA, 20 bp, Homo sapiens
agcttcctgtgccctcaccc

SEQ ID NO: 862654 - DNA, 13 bp, Homo sapiens
agcttccttctgg

SEQ ID NO: 862655 - DNA, 14 bp, Homo sapiens
agcttcggagggcc

SEQ ID NO: 862656 - DNA, 20 bp, Homo sapiens
agcttcggagggcccctgcg

SEQ ID NO: 862657 - DNA, 16 bp, Homo sapiens
agcttcggggcctcct

SEQ ID NO: 862658 - DNA, 20 bp, Homo sapiens
agcttcggtgtgcagatcat

SEQ ID NO: 862659 - DNA, 22 bp, Homo sapiens
agcttcggttctccagaatgta

SEQ ID NO: 862660 - DNA, 20 bp, Homo sapiens
agcttcgtttattttcaaga

SEQ ID NO: 862661 - DNA, 14 bp, Homo sapiens
agcttctaaagcag

SEQ ID NO: 862662 - DNA, 15 bp, Homo sapiens
agcttctccaagcat

SEQ ID NO: 862663 - DNA, 20 bp, Homo sapiens
agcttctctctccctgtcac

SEQ ID NO: 862664 - DNA, 21 bp, Homo sapiens
agcttctctctccctgtcaca

SEQ ID NO: 862665 - DNA, 12 bp, Homo sapiens
agcttctctgca

SEQ ID NO: 862666 - DNA, 13 bp, Homo sapiens
agcttctgagtct

SEQ ID NO: 862667 - DNA, 20 bp, Homo sapiens
agcttctgcttttctgccct

SEQ ID NO: 862668 - DNA, 21 bp, Homo sapiens
agcttctgcttttctgccctg

SEQ ID NO: 862669 - DNA, 22 bp, Homo sapiens
agcttctgcttttctgccctgg

SEQ ID NO: 862670 - DNA, 23 bp, Homo sapiens
agcttctgcttttctgccctggc

SEQ ID NO: 862671 - DNA, 19 bp, Homo sapiens
agcttctgggagatttttt

SEQ ID NO: 862672 - DNA, 22 bp, Homo sapiens
agcttctgggagatttttttga

SEQ ID NO: 862673 - DNA, 15 bp, Homo sapiens
agcttctggtactct

SEQ ID NO: 862674 - DNA, 16 bp, Homo sapiens
agcttctggtactctc

SEQ ID NO: 862675 - DNA, 13 bp, Homo sapiens
agcttcttcagag

SEQ ID NO: 862676 - DNA, 22 bp, Homo sapiens
agcttcttcctaggtccaagcc

SEQ ID NO: 862677 - DNA, 12 bp, Homo sapiens
agcttcttgggc

SEQ ID NO: 862678 - DNA, 19 bp, Homo sapiens
agcttcttgggctgagtgc

SEQ ID NO: 862679 - DNA, 16 bp, Homo sapiens
agcttcttgtttcctt

SEQ ID NO: 862680 - DNA, 17 bp, Homo sapiens
agcttcttgtttccttg

SEQ ID NO: 862681 - DNA, 19 bp, Homo sapiens
agcttcttgtttccttgtt

SEQ ID NO: 862682 - DNA, 13 bp, Homo sapiens
agcttgaacctgc

SEQ ID NO: 862683 - DNA, 12 bp, Homo sapiens
agcttgaagatt

SEQ ID NO: 862684 - DNA, 23 bp, Homo sapiens
agcttgaagattaggagaaacac

SEQ ID NO: 862685 - DNA, 14 bp, Homo sapiens
agcttgacctgagg

SEQ ID NO: 862686 - DNA, 13 bp, Homo sapiens
agcttgactccca

SEQ ID NO: 862687 - DNA, 24 bp, Homo sapiens
agcttgagccgggcccctgggctt

SEQ ID NO: 862688 - DNA, 21 bp, Homo sapiens
agcttgatctgtgatttcttc

SEQ ID NO: 862689 - DNA, 22 bp, Homo sapiens
agcttgatctgtgatttcttct

SEQ ID NO: 862690 - DNA, 15 bp, Homo sapiens
agcttgatttgatct

SEQ ID NO: 862691 - DNA, 14 bp, Homo sapiens
agcttgcacctttt

SEQ ID NO: 862692 - DNA, 23 bp, Homo sapiens
agcttgccacactcttcttcaag

SEQ ID NO: 862693 - DNA, 12 bp, Homo sapiens
agcttgcccccg

SEQ ID NO: 862694 - DNA, 13 bp, Homo sapiens
agcttgcccccgc

SEQ ID NO: 862695 - DNA, 18 bp, Homo sapiens
agcttgccccggccccgg

SEQ ID NO: 862696 - DNA, 21 bp, Homo sapiens
agcttgctccagattctgatg

SEQ ID NO: 862697 - DNA, 19 bp, Homo sapiens
agcttgctcttcagtggga

SEQ ID NO: 862698 - DNA, 22 bp, Homo sapiens
agcttgctcttcagtgggagaa

SEQ ID NO: 862699 - DNA, 22 bp, Homo sapiens
agcttgctgaggggcagggaga

SEQ ID NO: 862700 - DNA, 23 bp, Homo sapiens
agcttgcttgctttcttttttaa

SEQ ID NO: 862701 - DNA, 12 bp, Homo sapiens
agcttgctttga

SEQ ID NO: 862702 - DNA, 22 bp, Homo sapiens
agcttggagtgacctaaagcat

SEQ ID NO: 862703 - DNA, 16 bp, Homo sapiens
agcttggattaaatac

SEQ ID NO: 862704 - DNA, 17 bp, Homo sapiens
agcttggattaaataca

SEQ ID NO: 862705 - DNA, 21 bp, Homo sapiens
agcttggcagccgagctcgtg

SEQ ID NO: 862706 - DNA, 15 bp, Homo sapiens
agcttggcatgacct

SEQ ID NO: 862707 - DNA, 14 bp, Homo sapiens
agcttggccagaag

SEQ ID NO: 862708 - DNA, 21 bp, Homo sapiens
agcttggctcgatgtttgcca

SEQ ID NO: 862709 - DNA, 15 bp, Homo sapiens
agcttggcttcctct

SEQ ID NO: 862710 - DNA, 23 bp, Homo sapiens
agcttggcttcctcttcttgttg

SEQ ID NO: 862711 - DNA, 12 bp, Homo sapiens
agcttgggaatg

SEQ ID NO: 862712 - DNA, 14 bp, Homo sapiens
agcttgggaatgga

SEQ ID NO: 862713 - DNA, 19 bp, Homo sapiens
agcttgggactcaggtctg

SEQ ID NO: 862714 - DNA, 23 bp, Homo sapiens
agcttgggactcaggtctgtaac

SEQ ID NO: 862715 - DNA, 19 bp, Homo sapiens
agcttgggcagtgccccag

SEQ ID NO: 862716 - DNA, 19 bp, Homo sapiens
agcttgggcccagctgggc

SEQ ID NO: 862717 - DNA, 15 bp, Homo sapiens
agcttgggcttcttc

SEQ ID NO: 862718 - DNA, 18 bp, Homo sapiens
agcttggggaacccatga

SEQ ID NO: 862719 - DNA, 16 bp, Homo sapiens
agcttggggagaggga

SEQ ID NO: 862720 - DNA, 22 bp, Homo sapiens
agcttggggccaccaaagctgc

SEQ ID NO: 862721 - DNA, 23 bp, Homo sapiens
agcttggggccaccaaagctgcc

SEQ ID NO: 862722 - DNA, 15 bp, Homo sapiens
agcttggtattgcag

SEQ ID NO: 862723 - DNA, 17 bp, Homo sapiens
agcttggtcaaactttt

SEQ ID NO: 862724 - DNA, 19 bp, Homo sapiens
agcttggtgacaaaattca

SEQ ID NO: 862725 - DNA, 18 bp, Homo sapiens
agcttgtatagtgtaaaa

SEQ ID NO: 862726 - DNA, 15 bp, Homo sapiens
agcttgtgtcctgtc

SEQ ID NO: 862727 - DNA, 16 bp, Homo sapiens
agcttgttatttataa

SEQ ID NO: 862728 - DNA, 23 bp, Homo sapiens
agcttgttgtcccaatgaaatac

SEQ ID NO: 862729 - DNA, 15 bp, Homo sapiens
agcttgttgtctcca

SEQ ID NO: 862730 - DNA, 22 bp, Homo sapiens
agcttgtttctgtcaagcatat

SEQ ID NO: 862731 - DNA, 19 bp, Homo sapiens
agctttaaaaccacagctg

SEQ ID NO: 862732 - DNA, 23 bp, Homo sapiens
agctttaaaaccacagctgggca

SEQ ID NO: 862733 - DNA, 13 bp, Homo sapiens
agctttaaaagta

SEQ ID NO: 862734 - DNA, 16 bp, Homo sapiens
agctttaaaagtatct

SEQ ID NO: 862735 - DNA, 18 bp, Homo sapiens
agctttaaaagtatcttt

SEQ ID NO: 862736 - DNA, 20 bp, Homo sapiens
agctttaaaagtatctttaa

SEQ ID NO: 862737 - DNA, 20 bp, Homo sapiens
agctttaaactcagggacag

SEQ ID NO: 862738 - DNA, 20 bp, Homo sapiens
agctttaccctcaggcatag

SEQ ID NO: 862739 - DNA, 13 bp, Homo sapiens
agctttactactg

SEQ ID NO: 862740 - DNA, 17 bp, Homo sapiens
agctttactactgtgga

SEQ ID NO: 862741 - DNA, 22 bp, Homo sapiens
agctttactgtttctcaagtgt

SEQ ID NO: 862742 - DNA, 13 bp, Homo sapiens
agctttagaccct

SEQ ID NO: 862743 - DNA, 17 bp, Homo sapiens
agctttagaccctgggt

SEQ ID NO: 862744 - DNA, 17 bp, Homo sapiens
agctttatacagttgaa

SEQ ID NO: 862745 - DNA, 15 bp, Homo sapiens
agctttatactctct

SEQ ID NO: 862746 - DNA, 13 bp, Homo sapiens
agctttatctttg

SEQ ID NO: 862747 - DNA, 16 bp, Homo sapiens
agctttatctttgtgt

SEQ ID NO: 862748 - DNA, 19 bp, Homo sapiens
agctttatctttgtgtaat

SEQ ID NO: 862749 - DNA, 18 bp, Homo sapiens
agctttatgttcatttgt

SEQ ID NO: 862750 - DNA, 16 bp, Homo sapiens
agctttcaagtgcctt

SEQ ID NO: 862751 - DNA, 17 bp, Homo sapiens
agctttccatgttgctg

SEQ ID NO: 862752 - DNA, 12 bp, Homo sapiens
agctttcctgcc

SEQ ID NO: 862753 - DNA, 23 bp, Homo sapiens
agctttcctgccccaggcctgaa

SEQ ID NO: 862754 - DNA, 11 bp, Homo sapiens
agctttctcaa

SEQ ID NO: 862755 - DNA, 21 bp, Homo sapiens
agctttctcaatgtcttccca

SEQ ID NO: 862756 - DNA, 18 bp, Homo sapiens
agctttctcctcatccat

SEQ ID NO: 862757 - DNA, 17 bp, Homo sapiens
agctttctcctctgcta

SEQ ID NO: 862758 - DNA, 14 bp, Homo sapiens
agctttctctcaga

SEQ ID NO: 862759 - DNA, 20 bp, Homo sapiens
agctttctgaggccctgagc

SEQ ID NO: 862760 - DNA, 17 bp, Homo sapiens
agctttctgccttagcc

SEQ ID NO: 862761 - DNA, 14 bp, Homo sapiens
agctttctttcaca

SEQ ID NO: 862762 - DNA, 18 bp, Homo sapiens
agctttgaaaattcagtg

SEQ ID NO: 862763 - DNA, 19 bp, Homo sapiens
agctttgaaaattcagtgg

SEQ ID NO: 862764 - DNA, 20 bp, Homo sapiens
agctttgacgtattatctgt

SEQ ID NO: 862765 - DNA, 11 bp, Homo sapiens
agctttgcagt

SEQ ID NO: 862766 - DNA, 20 bp, Homo sapiens
agctttgctacaaatttatg

SEQ ID NO: 862767 - DNA, 16 bp, Homo sapiens
agctttgctaccaaag

SEQ ID NO: 862768 - DNA, 10 bp, Homo sapiens
agctttgctc

SEQ ID NO: 862769 - DNA, 22 bp, Homo sapiens
agctttgctcagcacactctcc

SEQ ID NO: 862770 - DNA, 18 bp, Homo sapiens
agctttgctctttggtag

SEQ ID NO: 862771 - DNA, 21 bp, Homo sapiens
agctttgctctttggtagaaa

SEQ ID NO: 862772 - DNA, 13 bp, Homo sapiens
agctttgctgcta

SEQ ID NO: 862773 - DNA, 13 bp, Homo sapiens
agctttggctgag

SEQ ID NO: 862774 - DNA, 16 bp, Homo sapiens
agctttgtcacttgcc

SEQ ID NO: 862775 - DNA, 19 bp, Homo sapiens
agctttgtttcaaccaagt

SEQ ID NO: 862776 - DNA, 15 bp, Homo sapiens
agcttttaaaaaata

SEQ ID NO: 862777 - DNA, 16 bp, Homo sapiens
agcttttaaaaaatat

SEQ ID NO: 862778 - DNA, 20 bp, Homo sapiens
agcttttaaaaaatatttta

SEQ ID NO: 862779 - DNA, 21 bp, Homo sapiens
agcttttaaaaaatattttaa

SEQ ID NO: 862780 - DNA, 15 bp, Homo sapiens
agcttttaagaaaaa

SEQ ID NO: 862781 - DNA, 18 bp, Homo sapiens
agcttttaagaaaaacaa

SEQ ID NO: 862782 - DNA, 14 bp, Homo sapiens
agcttttactgttt

SEQ ID NO: 862783 - DNA, 15 bp, Homo sapiens
agcttttattccttt

SEQ ID NO: 862784 - DNA, 19 bp, Homo sapiens
agcttttattcctttgaat

SEQ ID NO: 862785 - DNA, 23 bp, Homo sapiens
agcttttattcctttgaatattt

SEQ ID NO: 862786 - DNA, 14 bp, Homo sapiens
agcttttatttctt

SEQ ID NO: 862787 - DNA, 16 bp, Homo sapiens
agcttttcatggaagt

SEQ ID NO: 862788 - DNA, 19 bp, Homo sapiens
agcttttgattagtataat

SEQ ID NO: 862789 - DNA, 14 bp, Homo sapiens
agcttttgcatttc

SEQ ID NO: 862790 - DNA, 15 bp, Homo sapiens
agcttttgcatttcc

SEQ ID NO: 862791 - DNA, 12 bp, Homo sapiens
agctttttaatt

SEQ ID NO: 862792 - DNA, 14 bp, Homo sapiens
agctttttattaag

SEQ ID NO: 862793 - DNA, 15 bp, Homo sapiens
agctttttattattt

SEQ ID NO: 862794 - DNA, 18 bp, Homo sapiens
agctttttattattttaa

SEQ ID NO: 862795 - DNA, 17 bp, Homo sapiens
agctttttattccctgc

SEQ ID NO: 862796 - DNA, 16 bp, Homo sapiens
agctttttctgtggag

SEQ ID NO: 862797 - DNA, 13 bp, Homo sapiens
agctttttggaat

SEQ ID NO: 862798 - DNA, 14 bp, Homo sapiens
agctttttggaatc

SEQ ID NO: 862799 - DNA, 18 bp, Homo sapiens
agcttttttattttaata

SEQ ID NO: 862800 - DNA, 13 bp, Homo sapiens
aggaaaaaaactt

SEQ ID NO: 862801 - DNA, 16 bp, Homo sapiens
aggaaaaaaactttta

SEQ ID NO: 862802 - DNA, 15 bp, Homo sapiens
aggaaaaaagaacca

SEQ ID NO: 862803 - DNA, 12 bp, Homo sapiens
aggaaaaaataa

SEQ ID NO: 862804 - DNA, 15 bp, Homo sapiens
aggaaaaaattgaaa

SEQ ID NO: 862805 - DNA, 17 bp, Homo sapiens
aggaaaaacacaagcaa

SEQ ID NO: 862806 - DNA, 20 bp, Homo sapiens
aggaaaaatgaggaatccaa

SEQ ID NO: 862807 - DNA, 21 bp, Homo sapiens
aggaaaaatgccactccctac

SEQ ID NO: 862808 - DNA, 16 bp, Homo sapiens
aggaaaacacagcctc

SEQ ID NO: 862809 - DNA, 20 bp, Homo sapiens
aggaaaacacagcctccctg

SEQ ID NO: 862810 - DNA, 20 bp, Homo sapiens
aggaaaacactatttccaaa

SEQ ID NO: 862811 - DNA, 19 bp, Homo sapiens
aggaaaaccaagccgtggc

SEQ ID NO: 862812 - DNA, 16 bp, Homo sapiens
aggaaaacctgcagag

SEQ ID NO: 862813 - DNA, 16 bp, Homo sapiens
aggaaaagcaaattga

SEQ ID NO: 862814 - DNA, 12 bp, Homo sapiens
aggaaaaggaaa

SEQ ID NO: 862815 - DNA, 22 bp, Homo sapiens
aggaaaaggcccctgcaatgtg

SEQ ID NO: 862816 - DNA, 15 bp, Homo sapiens
aggaaaagggagcta

SEQ ID NO: 862817 - DNA, 22 bp, Homo sapiens
aggaaaaggtccttgcctcctg

SEQ ID NO: 862818 - DNA, 17 bp, Homo sapiens
aggaaaaggttgttgtt

SEQ ID NO: 862819 - DNA, 15 bp, Homo sapiens
aggaaaagttaaact

SEQ ID NO: 862820 - DNA, 14 bp, Homo sapiens
aggaaaataatgta

SEQ ID NO: 862821 - DNA, 16 bp, Homo sapiens
aggaaaatagtttagg

SEQ ID NO: 862822 - DNA, 17 bp, Homo sapiens
aggaaaatgtattgatt

SEQ ID NO: 862823 - DNA, 18 bp, Homo sapiens
aggaaaattgaaagtatt

SEQ ID NO: 862824 - DNA, 16 bp, Homo sapiens
aggaaaattgaatgca

SEQ ID NO: 862825 - DNA, 16 bp, Homo sapiens
aggaaacaaatgtgta

SEQ ID NO: 862826 - DNA, 14 bp, Homo sapiens
aggaaacaacagct

SEQ ID NO: 862827 - DNA, 15 bp, Homo sapiens
aggaaacaacagctt

SEQ ID NO: 862828 - DNA, 17 bp, Homo sapiens
aggaaacaagggaaggg

SEQ ID NO: 862829 - DNA, 18 bp, Homo sapiens
aggaaacaggctccaaga

SEQ ID NO: 862830 - DNA, 19 bp, Homo sapiens
aggaaacagttctcactgg

SEQ ID NO: 862831 - DNA, 19 bp, Homo sapiens
aggaaacagttgcatgtag

SEQ ID NO: 862832 - DNA, 21 bp, Homo sapiens
aggaaacagttgcatgtagta

SEQ ID NO: 862833 - DNA, 22 bp, Homo sapiens
aggaaacagttgcatgtagtaa

SEQ ID NO: 862834 - DNA, 13 bp, Homo sapiens
aggaaacatttta

SEQ ID NO: 862835 - DNA, 14 bp, Homo sapiens
aggaaacattttat

SEQ ID NO: 862836 - DNA, 18 bp, Homo sapiens
aggaaacattttatcatt

SEQ ID NO: 862837 - DNA, 16 bp, Homo sapiens
aggaaaccttttcttg

SEQ ID NO: 862838 - DNA, 16 bp, Homo sapiens
aggaaactcacctgct

SEQ ID NO: 862839 - DNA, 21 bp, Homo sapiens
aggaaactcacctgctggccc

SEQ ID NO: 862840 - DNA, 22 bp, Homo sapiens
aggaaactcacctgctggcccc

SEQ ID NO: 862841 - DNA, 20 bp, Homo sapiens
aggaaactccacatctgcct

SEQ ID NO: 862842 - DNA, 21 bp, Homo sapiens
aggaaactccacatctgcctt

SEQ ID NO: 862843 - DNA, 20 bp, Homo sapiens
aggaaactcctgacagtctt

SEQ ID NO: 862844 - DNA, 20 bp, Homo sapiens
aggaaactttatttaaatgc

SEQ ID NO: 862845 - DNA, 13 bp, Homo sapiens
aggaaagaaaaca

SEQ ID NO: 862846 - DNA, 17 bp, Homo sapiens
aggaaagaaagaaggaa

SEQ ID NO: 862847 - DNA, 18 bp, Homo sapiens
aggaaagagagtttgtaa

SEQ ID NO: 862848 - DNA, 16 bp, Homo sapiens
aggaaagccacatctt

SEQ ID NO: 862849 - DNA, 19 bp, Homo sapiens
aggaaagccacatcttgct

SEQ ID NO: 862850 - DNA, 19 bp, Homo sapiens
aggaaagccccagcactaa

SEQ ID NO: 862851 - DNA, 21 bp, Homo sapiens
aggaaagcgtggttccaagaa

SEQ ID NO: 862852 - DNA, 20 bp, Homo sapiens
aggaaaggagagtactttgg

SEQ ID NO: 862853 - DNA, 16 bp, Homo sapiens
aggaaaggctcattta

SEQ ID NO: 862854 - DNA, 17 bp, Homo sapiens
aggaaaggctcatttaa

SEQ ID NO: 862855 - DNA, 18 bp, Homo sapiens
aggaaaggctcatttaaa

SEQ ID NO: 862856 - DNA, 13 bp, Homo sapiens
aggaaagggaaga

SEQ ID NO: 862857 - DNA, 13 bp, Homo sapiens
aggaaagggcctg

SEQ ID NO: 862858 - DNA, 16 bp, Homo sapiens
aggaaagggcctggcc

SEQ ID NO: 862859 - DNA, 19 bp, Homo sapiens
aggaaagggggtcccagtg

SEQ ID NO: 862860 - DNA, 21 bp, Homo sapiens
aggaaagggggtcccagtggg

SEQ ID NO: 862861 - DNA, 18 bp, Homo sapiens
aggaaagtcaagaagaat

SEQ ID NO: 862862 - DNA, 19 bp, Homo sapiens
aggaaagtgcgttctccca

SEQ ID NO: 862863 - DNA, 21 bp, Homo sapiens
aggaaagtgcgttctcccagc

SEQ ID NO: 862864 - DNA, 15 bp, Homo sapiens
aggaaagtgtatgag

SEQ ID NO: 862865 - DNA, 21 bp, Homo sapiens
aggaaagtttacccatgaaga

SEQ ID NO: 862866 - DNA, 20 bp, Homo sapiens
aggaaataaaacctttcaaa

SEQ ID NO: 862867 - DNA, 21 bp, Homo sapiens
aggaaataaaacctttcaaat

SEQ ID NO: 862868 - DNA, 14 bp, Homo sapiens
aggaaataaaggta

SEQ ID NO: 862869 - DNA, 14 bp, Homo sapiens
aggaaataacattg

SEQ ID NO: 862870 - DNA, 16 bp, Homo sapiens
aggaaatctcacccca

SEQ ID NO: 862871 - DNA, 13 bp, Homo sapiens
aggaaatgaacat

SEQ ID NO: 862872 - DNA, 13 bp, Homo sapiens
aggaacaaacagg

SEQ ID NO: 862873 - DNA, 14 bp, Homo sapiens
aggaacaaagacag

SEQ ID NO: 862874 - DNA, 16 bp, Homo sapiens
aggaacaacagcatct

SEQ ID NO: 862875 - DNA, 16 bp, Homo sapiens
aggaacaagcatgtct

SEQ ID NO: 862876 - DNA, 18 bp, Homo sapiens
aggaacaagctggcttct

SEQ ID NO: 862877 - DNA, 16 bp, Homo sapiens
aggaacagtggctggg

SEQ ID NO: 862878 - DNA, 14 bp, Homo sapiens
aggaaccagggcct

SEQ ID NO: 862879 - DNA, 13 bp, Homo sapiens
aggaaccctcagg

SEQ ID NO: 862880 - DNA, 17 bp, Homo sapiens
aggaaccctcaggccac

SEQ ID NO: 862881 - DNA, 22 bp, Homo sapiens
aggaaccctcaggccaccctcc

SEQ ID NO: 862882 - DNA, 20 bp, Homo sapiens
aggaaccgtggtatgtctgc

SEQ ID NO: 862883 - DNA, 22 bp, Homo sapiens
aggaaccgtggtatgtctgcca

SEQ ID NO: 862884 - DNA, 17 bp, Homo sapiens
aggaacctctgatttat

SEQ ID NO: 862885 - DNA, 22 bp, Homo sapiens
aggaacctctgatttattttgt

SEQ ID NO: 862886 - DNA, 12 bp, Homo sapiens
aggaacctggga

SEQ ID NO: 862887 - DNA, 16 bp, Homo sapiens
aggaaccttctccctt

SEQ ID NO: 862888 - DNA, 21 bp, Homo sapiens
aggaaccttctcccttcttgg

SEQ ID NO: 862889 - DNA, 14 bp, Homo sapiens
aggaacgagcactg

SEQ ID NO: 862890 - DNA, 18 bp, Homo sapiens
aggaacgagcactggcca

SEQ ID NO: 862891 - DNA, 21 bp, Homo sapiens
aggaacgagcactggccagag

SEQ ID NO: 862892 - DNA, 21 bp, Homo sapiens
aggaacgctaacaatttctca

SEQ ID NO: 862893 - DNA, 12 bp, Homo sapiens
aggaacggccct

SEQ ID NO: 862894 - DNA, 14 bp, Homo sapiens
aggaacggccctgc

SEQ ID NO: 862895 - DNA, 15 bp, Homo sapiens
aggaacgggcagcca

SEQ ID NO: 862896 - DNA, 16 bp, Homo sapiens
aggaacgggcagccac

SEQ ID NO: 862897 - DNA, 16 bp, Homo sapiens
aggaacggtaaatttc

SEQ ID NO: 862898 - DNA, 16 bp, Homo sapiens
aggaactagaaagaag

SEQ ID NO: 862899 - DNA, 23 bp, Homo sapiens
aggaactagaaagaaggacccag

SEQ ID NO: 862900 - DNA, 19 bp, Homo sapiens
aggaactctggcttccagg

SEQ ID NO: 862901 - DNA, 22 bp, Homo sapiens
aggaactcttaagcaatggtaa

SEQ ID NO: 862902 - DNA, 20 bp, Homo sapiens
aggaactgcaataatatcaa

SEQ ID NO: 862903 - DNA, 18 bp, Homo sapiens
aggaactgggctgggcct

SEQ ID NO: 862904 - DNA, 18 bp, Homo sapiens
aggaactgtccagagagc

SEQ ID NO: 862905 - DNA, 20 bp, Homo sapiens
aggaactgtccagagagcaa

SEQ ID NO: 862906 - DNA, 21 bp, Homo sapiens
aggaacttaaataatgtgaaa

SEQ ID NO: 862907 - DNA, 22 bp, Homo sapiens
aggaacttgctgctgtgcctgc

SEQ ID NO: 862908 - DNA, 23 bp, Homo sapiens
aggaacttgctgctgtgcctgcg

SEQ ID NO: 862909 - DNA, 14 bp, Homo sapiens
aggaagaaaacgga

SEQ ID NO: 862910 - DNA, 20 bp, Homo sapiens
aggaagaaaacggaaatgtg

SEQ ID NO: 862911 - DNA, 15 bp, Homo sapiens
aggaagaaagaatgt

SEQ ID NO: 862912 - DNA, 15 bp, Homo sapiens
aggaagaaatcacag

SEQ ID NO: 862913 - DNA, 17 bp, Homo sapiens
aggaagaaattcaggta

SEQ ID NO: 862914 - DNA, 22 bp, Homo sapiens
aggaagaaattcaggtacagaa

SEQ ID NO: 862915 - DNA, 17 bp, Homo sapiens
aggaagacataaaactt

SEQ ID NO: 862916 - DNA, 22 bp, Homo sapiens
aggaagacataaaactttaaaa

SEQ ID NO: 862917 - DNA, 22 bp, Homo sapiens
aggaagacatctgtagggaatt

SEQ ID NO: 862918 - DNA, 21 bp, Homo sapiens
aggaagagacatgagaaaggg

SEQ ID NO: 862919 - DNA, 23 bp, Homo sapiens
aggaagagacatgagaaagggag

SEQ ID NO: 862920 - DNA, 23 bp, Homo sapiens
aggaagagcaggcacatggagga

SEQ ID NO: 862921 - DNA, 11 bp, Homo sapiens
aggaagagcca

SEQ ID NO: 862922 - DNA, 13 bp, Homo sapiens
aggaagagccacc

SEQ ID NO: 862923 - DNA, 20 bp, Homo sapiens
aggaagagccacctgcaaga

SEQ ID NO: 862924 - DNA, 12 bp, Homo sapiens
aggaagaggccc

SEQ ID NO: 862925 - DNA, 14 bp, Homo sapiens
aggaagaggcccac

SEQ ID NO: 862926 - DNA, 20 bp, Homo sapiens
aggaagagggtagacagggg

SEQ ID NO: 862927 - DNA, 15 bp, Homo sapiens
aggaagagtcttggt

SEQ ID NO: 862928 - DNA, 14 bp, Homo sapiens
aggaagagtttatg

SEQ ID NO: 862929 - DNA, 22 bp, Homo sapiens
aggaagatatacatgaaaattt

SEQ ID NO: 862930 - DNA, 17 bp, Homo sapiens
aggaagatcccccagaa

SEQ ID NO: 862931 - DNA, 17 bp, Homo sapiens
aggaagatgtttacatt

SEQ ID NO: 862932 - DNA, 17 bp, Homo sapiens
aggaagattactcagta

SEQ ID NO: 862933 - DNA, 16 bp, Homo sapiens
aggaagcaaactaagc

SEQ ID NO: 862934 - DNA, 16 bp, Homo sapiens
aggaagcaaagagtga

SEQ ID NO: 862935 - DNA, 17 bp, Homo sapiens
aggaagcaagcttaatg

SEQ ID NO: 862936 - DNA, 22 bp, Homo sapiens
aggaagcagaggtcttcagggc

SEQ ID NO: 862937 - DNA, 17 bp, Homo sapiens
aggaagcagcctcagag

SEQ ID NO: 862938 - DNA, 11 bp, Homo sapiens
aggaagcaggg

SEQ ID NO: 862939 - DNA, 19 bp, Homo sapiens
aggaagcattcagagagca

SEQ ID NO: 862940 - DNA, 19 bp, Homo sapiens
aggaagcattgtaaaataa

SEQ ID NO: 862941 - DNA, 12 bp, Homo sapiens
aggaagccaaag

SEQ ID NO: 862942 - DNA, 12 bp, Homo sapiens
aggaagccagag

SEQ ID NO: 862943 - DNA, 19 bp, Homo sapiens
aggaagccagagccccaag

SEQ ID NO: 862944 - DNA, 19 bp, Homo sapiens
aggaagccggtgcctgggt

SEQ ID NO: 862945 - DNA, 12 bp, Homo sapiens
aggaaggaaaga

SEQ ID NO: 862946 - DNA, 16 bp, Homo sapiens
aggaaggaacaaagac

SEQ ID NO: 862947 - DNA, 15 bp, Homo sapiens
aggaaggacccctca

SEQ ID NO: 862948 - DNA, 18 bp, Homo sapiens
aggaaggacccctcacca

SEQ ID NO: 862949 - DNA, 13 bp, Homo sapiens
aggaaggagagat

SEQ ID NO: 862950 - DNA, 15 bp, Homo sapiens
aggaaggagagcctg

SEQ ID NO: 862951 - DNA, 18 bp, Homo sapiens
aggaaggagagcctgctg

SEQ ID NO: 862952 - DNA, 16 bp, Homo sapiens
aggaaggagcccctga

SEQ ID NO: 862953 - DNA, 14 bp, Homo sapiens
aggaaggaggcaga

SEQ ID NO: 862954 - DNA, 15 bp, Homo sapiens
aggaaggagggcaca

SEQ ID NO: 862955 - DNA, 13 bp, Homo sapiens
aggaaggcaagag

SEQ ID NO: 862956 - DNA, 12 bp, Homo sapiens
aggaaggccttt

SEQ ID NO: 862957 - DNA, 15 bp, Homo sapiens
aggaaggcctttctt

SEQ ID NO: 862958 - DNA, 17 bp, Homo sapiens
aggaaggcctttcttct

SEQ ID NO: 862959 - DNA, 18 bp, Homo sapiens
aggaaggcctttcttctg

SEQ ID NO: 862960 - DNA, 21 bp, Homo sapiens
aggaaggcctttcttctgtgt

SEQ ID NO: 862961 - DNA, 15 bp, Homo sapiens
aggaaggctctgtca

SEQ ID NO: 862962 - DNA, 21 bp, Homo sapiens
aggaaggctgaactcttcaga

SEQ ID NO: 862963 - DNA, 23 bp, Homo sapiens
aggaagggagtgaggggctgtga

SEQ ID NO: 862964 - DNA, 13 bp, Homo sapiens
aggaagggcagag

SEQ ID NO: 862965 - DNA, 16 bp, Homo sapiens
aggaaggggccagagg

SEQ ID NO: 862966 - DNA, 23 bp, Homo sapiens
aggaaggtaaaaacccagcggct

SEQ ID NO: 862967 - DNA, 15 bp, Homo sapiens
aggaaggtgcctggc

SEQ ID NO: 862968 - DNA, 15 bp, Homo sapiens
aggaaggtgctgagc

SEQ ID NO: 862969 - DNA, 14 bp, Homo sapiens
aggaaggtgtgatg

SEQ ID NO: 862970 - DNA, 18 bp, Homo sapiens
aggaaggttttctccact

SEQ ID NO: 862971 - DNA, 14 bp, Homo sapiens
aggaagtaggaagt

SEQ ID NO: 862972 - DNA, 21 bp, Homo sapiens
aggaagtatgagtgctgattc

SEQ ID NO: 862973 - DNA, 12 bp, Homo sapiens
aggaagtggctg

SEQ ID NO: 862974 - DNA, 20 bp, Homo sapiens
aggaagtggctggtctggag

SEQ ID NO: 862975 - DNA, 17 bp, Homo sapiens
aggaagtggctgtccct

SEQ ID NO: 862976 - DNA, 18 bp, Homo sapiens
aggaagtggctgtccctg

SEQ ID NO: 862977 - DNA, 18 bp, Homo sapiens
aggaagtggggacagatt

SEQ ID NO: 862978 - DNA, 21 bp, Homo sapiens
aggaagtggggtctggcctgt

SEQ ID NO: 862979 - DNA, 18 bp, Homo sapiens
aggaagtgtaacagctga

SEQ ID NO: 862980 - DNA, 16 bp, Homo sapiens
aggaagtgtggaaaaa

SEQ ID NO: 862981 - DNA, 19 bp, Homo sapiens
aggaagttctccagcttca

SEQ ID NO: 862982 - DNA, 21 bp, Homo sapiens
aggaagttctccagcttcagc

SEQ ID NO: 862983 - DNA, 22 bp, Homo sapiens
aggaagttgacttatagtacat

SEQ ID NO: 862984 - DNA, 15 bp, Homo sapiens
aggaagttttgtcta

SEQ ID NO: 862985 - DNA, 16 bp, Homo sapiens
aggaagttttttctac

SEQ ID NO: 862986 - DNA, 13 bp, Homo sapiens
aggaataaataaa

SEQ ID NO: 862987 - DNA, 12 bp, Homo sapiens
aggaataataaa

SEQ ID NO: 862988 - DNA, 18 bp, Homo sapiens
aggaataataaattcatc

SEQ ID NO: 862989 - DNA, 16 bp, Homo sapiens
aggaataattatttat

SEQ ID NO: 862990 - DNA, 13 bp, Homo sapiens
aggaatacatttt

SEQ ID NO: 862991 - DNA, 16 bp, Homo sapiens
aggaatacattttatt

SEQ ID NO: 862992 - DNA, 16 bp, Homo sapiens
aggaatagaggaagaa

SEQ ID NO: 862993 - DNA, 19 bp, Homo sapiens
aggaatagcaaaattcctg

SEQ ID NO: 862994 - DNA, 14 bp, Homo sapiens
aggaatagccagag

SEQ ID NO: 862995 - DNA, 17 bp, Homo sapiens
aggaatataagaaaagt

SEQ ID NO: 862996 - DNA, 12 bp, Homo sapiens
aggaatatatgg

SEQ ID NO: 862997 - DNA, 15 bp, Homo sapiens
aggaatatgttcaat

SEQ ID NO: 862998 - DNA, 20 bp, Homo sapiens
aggaatattttccaaagagt

SEQ ID NO: 862999 - DNA, 17 bp, Homo sapiens
aggaatcaaatcttaca

SEQ ID NO: 863000 - DNA, 22 bp, Homo sapiens
aggaatcaaatcttacaaaatc

SEQ ID NO: 863001 - DNA, 15 bp, Homo sapiens
aggaatcaattattt

SEQ ID NO: 863002 - DNA, 19 bp, Homo sapiens
aggaatcaattatttatga

SEQ ID NO: 863003 - DNA, 15 bp, Homo sapiens
aggaatcaccctcct

SEQ ID NO: 863004 - DNA, 22 bp, Homo sapiens
aggaatcactggggatggtggc

SEQ ID NO: 863005 - DNA, 15 bp, Homo sapiens
aggaatcagacttca

SEQ ID NO: 863006 - DNA, 21 bp, Homo sapiens
aggaatcattccagtgctaga

SEQ ID NO: 863007 - DNA, 17 bp, Homo sapiens
aggaatcctggattttg

SEQ ID NO: 863008 - DNA, 13 bp, Homo sapiens
aggaatcctggca

SEQ ID NO: 863009 - DNA, 14 bp, Homo sapiens
aggaatcctggcag

SEQ ID NO: 863010 - DNA, 16 bp, Homo sapiens
aggaatcctggcagcc

SEQ ID NO: 863011 - DNA, 20 bp, Homo sapiens
aggaatcgaggaaccagagc

SEQ ID NO: 863012 - DNA, 15 bp, Homo sapiens
aggaatctgccttcc

SEQ ID NO: 863013 - DNA, 18 bp, Homo sapiens
aggaatctgccttccagc

SEQ ID NO: 863014 - DNA, 22 bp, Homo sapiens
aggaatctgccttccagcccag

SEQ ID NO: 863015 - DNA, 12 bp, Homo sapiens
aggaatctgtgt

SEQ ID NO: 863016 - DNA, 13 bp, Homo sapiens
aggaatctgtgtg

SEQ ID NO: 863017 - DNA, 17 bp, Homo sapiens
aggaatctgtttctctg

SEQ ID NO: 863018 - DNA, 15 bp, Homo sapiens
aggaatgaaagagag

SEQ ID NO: 863019 - DNA, 23 bp, Homo sapiens
aggaatgaaatcctgcttcagtg

SEQ ID NO: 863020 - DNA, 13 bp, Homo sapiens
aggaatgcctgtg

SEQ ID NO: 863021 - DNA, 15 bp, Homo sapiens
aggaatgctctgtgc

SEQ ID NO: 863022 - DNA, 16 bp, Homo sapiens
aggaatgctctgtgcc

SEQ ID NO: 863023 - DNA, 17 bp, Homo sapiens
aggaatgctggactgga

SEQ ID NO: 863024 - DNA, 14 bp, Homo sapiens
aggaatgcttccga

SEQ ID NO: 863025 - DNA, 22 bp, Homo sapiens
aggaatggaggccatatttcca

SEQ ID NO: 863026 - DNA, 21 bp, Homo sapiens
aggaatggggggcgggccagg

SEQ ID NO: 863027 - DNA, 16 bp, Homo sapiens
aggaatgtcagggcca

SEQ ID NO: 863028 - DNA, 17 bp, Homo sapiens
aggaatgtgaaatttaa

SEQ ID NO: 863029 - DNA, 16 bp, Homo sapiens
aggaatgtgtccaaga

SEQ ID NO: 863030 - DNA, 16 bp, Homo sapiens
aggaatgtgtggcctg

SEQ ID NO: 863031 - DNA, 20 bp, Homo sapiens
aggaattcaatttggcaaaa

SEQ ID NO: 863032 - DNA, 22 bp, Homo sapiens
aggaattcccagcccaaagctg

SEQ ID NO: 863033 - DNA, 18 bp, Homo sapiens
aggaattctttgcattcc

SEQ ID NO: 863034 - DNA, 18 bp, Homo sapiens
aggaattggtaaggcctc

SEQ ID NO: 863035 - DNA, 18 bp, Homo sapiens
aggaatttcacctgtaaa

SEQ ID NO: 863036 - DNA, 15 bp, Homo sapiens
aggaatttcctccca

SEQ ID NO: 863037 - DNA, 23 bp, Homo sapiens
aggaatttcttaacttcttgctt

SEQ ID NO: 863038 - DNA, 20 bp, Homo sapiens
aggaatttgagagttcacag

SEQ ID NO: 863039 - DNA, 20 bp, Homo sapiens
aggaatttgatgattttcat

SEQ ID NO: 863040 - DNA, 15 bp, Homo sapiens
aggaatttggctgct

SEQ ID NO: 863041 - DNA, 18 bp, Homo sapiens
aggacaaattagcatgca

SEQ ID NO: 863042 - DNA, 14 bp, Homo sapiens
aggacaaccattcc

SEQ ID NO: 863043 - DNA, 13 bp, Homo sapiens
aggacaagcacga

SEQ ID NO: 863044 - DNA, 17 bp, Homo sapiens
aggacaatcagtcccct

SEQ ID NO: 863045 - DNA, 18 bp, Homo sapiens
aggacaatcagtcccctc

SEQ ID NO: 863046 - DNA, 23 bp, Homo sapiens
aggacaatgaaatactccagcac

SEQ ID NO: 863047 - DNA, 13 bp, Homo sapiens
aggacacactaat

SEQ ID NO: 863048 - DNA, 14 bp, Homo sapiens
aggacacagcacaa

SEQ ID NO: 863049 - DNA, 16 bp, Homo sapiens
aggacacagtgatgaa

SEQ ID NO: 863050 - DNA, 17 bp, Homo sapiens
aggacacagtgatgaat

SEQ ID NO: 863051 - DNA, 21 bp, Homo sapiens
aggacacagttcctgggaaca

SEQ ID NO: 863052 - DNA, 20 bp, Homo sapiens
aggacacatcccggcctctt

SEQ ID NO: 863053 - DNA, 21 bp, Homo sapiens
aggacacatcccggcctcttc

SEQ ID NO: 863054 - DNA, 15 bp, Homo sapiens
aggacacatctattg

SEQ ID NO: 863055 - DNA, 20 bp, Homo sapiens
aggacacgaaggctgcccct

SEQ ID NO: 863056 - DNA, 18 bp, Homo sapiens
aggacactaatgggaaga

SEQ ID NO: 863057 - DNA, 22 bp, Homo sapiens
aggacagaacattgccttcctc

SEQ ID NO: 863058 - DNA, 13 bp, Homo sapiens
aggacagaatgtg

SEQ ID NO: 863059 - DNA, 21 bp, Homo sapiens
aggacagagcaggggctccag

SEQ ID NO: 863060 - DNA, 15 bp, Homo sapiens
aggacagaggccggg

SEQ ID NO: 863061 - DNA, 23 bp, Homo sapiens
aggacagaggccggggtccaggc

SEQ ID NO: 863062 - DNA, 11 bp, Homo sapiens
aggacagcagc

SEQ ID NO: 863063 - DNA, 22 bp, Homo sapiens
aggacagcctgtggcggtgcct

SEQ ID NO: 863064 - DNA, 18 bp, Homo sapiens
aggacaggaagctggcag

SEQ ID NO: 863065 - DNA, 18 bp, Homo sapiens
aggacaggaccagatttt

SEQ ID NO: 863066 - DNA, 14 bp, Homo sapiens
aggacaggatccag

SEQ ID NO: 863067 - DNA, 12 bp, Homo sapiens
aggacaggcccg

SEQ ID NO: 863068 - DNA, 19 bp, Homo sapiens
aggacaggctctagagaga

SEQ ID NO: 863069 - DNA, 19 bp, Homo sapiens
aggacagtgcttcagcctg

SEQ ID NO: 863070 - DNA, 21 bp, Homo sapiens
aggacagtgcttcagcctgag

SEQ ID NO: 863071 - DNA, 21 bp, Homo sapiens
aggacagtttatcctgtctga

SEQ ID NO: 863072 - DNA, 13 bp, Homo sapiens
aggacataatggg

SEQ ID NO: 863073 - DNA, 17 bp, Homo sapiens
aggacatactgcatgta

SEQ ID NO: 863074 - DNA, 13 bp, Homo sapiens
aggacatcagcaa

SEQ ID NO: 863075 - DNA, 14 bp, Homo sapiens
aggacatcagcaaa

SEQ ID NO: 863076 - DNA, 20 bp, Homo sapiens
aggacatcttaaatctaaac

SEQ ID NO: 863077 - DNA, 23 bp, Homo sapiens
aggacatcttaaatctaaacaaa

SEQ ID NO: 863078 - DNA, 14 bp, Homo sapiens
aggacatgaacaga

SEQ ID NO: 863079 - DNA, 20 bp, Homo sapiens
aggacatgcgtgtgtcaggg

SEQ ID NO: 863080 - DNA, 16 bp, Homo sapiens
aggacatgtttttgtt

SEQ ID NO: 863081 - DNA, 23 bp, Homo sapiens
aggacatgtttttgttttctttg

SEQ ID NO: 863082 - DNA, 16 bp, Homo sapiens
aggacattcactgctg

SEQ ID NO: 863083 - DNA, 17 bp, Homo sapiens
aggacattcactgctga

SEQ ID NO: 863084 - DNA, 19 bp, Homo sapiens
aggaccaactggcttctgt

SEQ ID NO: 863085 - DNA, 19 bp, Homo sapiens
aggaccaagggggcgggga

SEQ ID NO: 863086 - DNA, 19 bp, Homo sapiens
aggaccacagtgggtggca

SEQ ID NO: 863087 - DNA, 14 bp, Homo sapiens
aggaccactcagcc

SEQ ID NO: 863088 - DNA, 19 bp, Homo sapiens
aggaccactcagcccctag

SEQ ID NO: 863089 - DNA, 12 bp, Homo sapiens
aggaccactcct

SEQ ID NO: 863090 - DNA, 16 bp, Homo sapiens
aggaccactcctgtac

SEQ ID NO: 863091 - DNA, 22 bp, Homo sapiens
aggaccagaaaatgtaaggcaa

SEQ ID NO: 863092 - DNA, 12 bp, Homo sapiens
aggaccagagcg

SEQ ID NO: 863093 - DNA, 22 bp, Homo sapiens
aggaccagattgctctgcccca

SEQ ID NO: 863094 - DNA, 13 bp, Homo sapiens
aggaccagcctgt

SEQ ID NO: 863095 - DNA, 13 bp, Homo sapiens
aggaccagctggg

SEQ ID NO: 863096 - DNA, 19 bp, Homo sapiens
aggaccagctggggcgtgg

SEQ ID NO: 863097 - DNA, 16 bp, Homo sapiens
aggaccaggactccct

SEQ ID NO: 863098 - DNA, 18 bp, Homo sapiens
aggaccaggactccctcc

SEQ ID NO: 863099 - DNA, 14 bp, Homo sapiens
aggacccaggaaag

SEQ ID NO: 863100 - DNA, 12 bp, Homo sapiens
aggacccaggac

SEQ ID NO: 863101 - DNA, 18 bp, Homo sapiens
aggacccaggacaggatc

SEQ ID NO: 863102 - DNA, 23 bp, Homo sapiens
aggacccaggacaggatccaggc

SEQ ID NO: 863103 - DNA, 12 bp, Homo sapiens
aggacccaggcc

SEQ ID NO: 863104 - DNA, 12 bp, Homo sapiens
aggacccagggt

SEQ ID NO: 863105 - DNA, 15 bp, Homo sapiens
aggaccccacatcct

SEQ ID NO: 863106 - DNA, 14 bp, Homo sapiens
aggaccccagctct

SEQ ID NO: 863107 - DNA, 16 bp, Homo sapiens
aggaccccagctctgc

SEQ ID NO: 863108 - DNA, 17 bp, Homo sapiens
aggaccccagctctgcg

SEQ ID NO: 863109 - DNA, 20 bp, Homo sapiens
aggaccccaggtcaggggct

SEQ ID NO: 863110 - DNA, 15 bp, Homo sapiens
aggacccccttcccc

SEQ ID NO: 863111 - DNA, 15 bp, Homo sapiens
aggaccccgagggct

SEQ ID NO: 863112 - DNA, 20 bp, Homo sapiens
aggaccccgagggctgagga

SEQ ID NO: 863113 - DNA, 15 bp, Homo sapiens
aggacccctcaccac

SEQ ID NO: 863114 - DNA, 20 bp, Homo sapiens
aggacccctcaccaccccca

SEQ ID NO: 863115 - DNA, 17 bp, Homo sapiens
aggacccctcagctccc

SEQ ID NO: 863116 - DNA, 15 bp, Homo sapiens
aggacccctgccttc

SEQ ID NO: 863117 - DNA, 21 bp, Homo sapiens
aggacccctgccttcctctga

SEQ ID NO: 863118 - DNA, 23 bp, Homo sapiens
aggacccctgccttcctctgagg

SEQ ID NO: 863119 - DNA, 20 bp, Homo sapiens
aggaccccttaatcttgctt

SEQ ID NO: 863120 - DNA, 14 bp, Homo sapiens
aggacccgccagcc

SEQ ID NO: 863121 - DNA, 16 bp, Homo sapiens
aggacccgccagcccc

SEQ ID NO: 863122 - DNA, 17 bp, Homo sapiens
aggacccgccagccccg

SEQ ID NO: 863123 - DNA, 18 bp, Homo sapiens
aggacccgccagccccgc

SEQ ID NO: 863124 - DNA, 21 bp, Homo sapiens
aggacccgccagccccgctcc

SEQ ID NO: 863125 - DNA, 18 bp, Homo sapiens
aggacccgcctgctccca

SEQ ID NO: 863126 - DNA, 18 bp, Homo sapiens
aggacccggaggggcctg

SEQ ID NO: 863127 - DNA, 20 bp, Homo sapiens
aggacccggaggggcctggc

SEQ ID NO: 863128 - DNA, 20 bp, Homo sapiens
aggaccctgtttctgtagaa

SEQ ID NO: 863129 - DNA, 20 bp, Homo sapiens
aggacccttacgtgagaaat

SEQ ID NO: 863130 - DNA, 15 bp, Homo sapiens
aggaccgcctgccct

SEQ ID NO: 863131 - DNA, 22 bp, Homo sapiens
aggaccgcctgccctgcctggg

SEQ ID NO: 863132 - DNA, 22 bp, Homo sapiens
aggaccgttctctgtccccagg

SEQ ID NO: 863133 - DNA, 14 bp, Homo sapiens
aggaccgttttgta

SEQ ID NO: 863134 - DNA, 16 bp, Homo sapiens
aggacctaaaacatct

SEQ ID NO: 863135 - DNA, 16 bp, Homo sapiens
aggacctcccttccga

SEQ ID NO: 863136 - DNA, 13 bp, Homo sapiens
aggacctctcagc

SEQ ID NO: 863137 - DNA, 18 bp, Homo sapiens
aggacctctgtaggcagc

SEQ ID NO: 863138 - DNA, 18 bp, Homo sapiens
aggacctgagtttgggag

SEQ ID NO: 863139 - DNA, 20 bp, Homo sapiens
aggacctgcctagcatgggg

SEQ ID NO: 863140 - DNA, 19 bp, Homo sapiens
aggacctggcgtgctcaga

SEQ ID NO: 863141 - DNA, 13 bp, Homo sapiens
aggacctggctgc

SEQ ID NO: 863142 - DNA, 23 bp, Homo sapiens
aggacctggggcacagtccagga

SEQ ID NO: 863143 - DNA, 16 bp, Homo sapiens
aggacctgtgctttga

SEQ ID NO: 863144 - DNA, 21 bp, Homo sapiens
aggacctgtggccaagttctt

SEQ ID NO: 863145 - DNA, 15 bp, Homo sapiens
aggaccttatctgtg

SEQ ID NO: 863146 - DNA, 16 bp, Homo sapiens
aggaccttatctgtgc

SEQ ID NO: 863147 - DNA, 18 bp, Homo sapiens
aggaccttcgggctgtgc

SEQ ID NO: 863148 - DNA, 21 bp, Homo sapiens
aggacctttccaccacagcca

SEQ ID NO: 863149 - DNA, 21 bp, Homo sapiens
aggacctttgggtctacaagt

SEQ ID NO: 863150 - DNA, 20 bp, Homo sapiens
aggacgaacatccaaccttc

SEQ ID NO: 863151 - DNA, 17 bp, Homo sapiens
aggacgccaacttctcc

SEQ ID NO: 863152 - DNA, 20 bp, Homo sapiens
aggacgccaacttctcccac

SEQ ID NO: 863153 - DNA, 21 bp, Homo sapiens
aggacgccaacttctcccacc

SEQ ID NO: 863154 - DNA, 23 bp, Homo sapiens
aggacgccaacttctcccacccc

SEQ ID NO: 863155 - DNA, 17 bp, Homo sapiens
aggacgccactcatttc

SEQ ID NO: 863156 - DNA, 18 bp, Homo sapiens
aggacgccactcatttca

SEQ ID NO: 863157 - DNA, 22 bp, Homo sapiens
aggacgcgacctcagttgtcct

SEQ ID NO: 863158 - DNA, 13 bp, Homo sapiens
aggacgcttctga

SEQ ID NO: 863159 - DNA, 15 bp, Homo sapiens
aggacgcttctgaat

SEQ ID NO: 863160 - DNA, 23 bp, Homo sapiens
aggacggagtggggggacagaga

SEQ ID NO: 863161 - DNA, 18 bp, Homo sapiens
aggacggccctgcctgcc

SEQ ID NO: 863162 - DNA, 20 bp, Homo sapiens
aggacggtgccaagggcccc

SEQ ID NO: 863163 - DNA, 21 bp, Homo sapiens
aggacggtgccaagggcccca

SEQ ID NO: 863164 - DNA, 14 bp, Homo sapiens
aggactaaccatgt

SEQ ID NO: 863165 - DNA, 18 bp, Homo sapiens
aggactaccgcaggcccg

SEQ ID NO: 863166 - DNA, 19 bp, Homo sapiens
aggactaccgcaggcccgg

SEQ ID NO: 863167 - DNA, 22 bp, Homo sapiens
aggactaccgcaggcccggact

SEQ ID NO: 863168 - DNA, 20 bp, Homo sapiens
aggactacgttaagggaagg

SEQ ID NO: 863169 - DNA, 20 bp, Homo sapiens
aggactatagcccaggtcct

SEQ ID NO: 863170 - DNA, 17 bp, Homo sapiens
aggactcaccactgccc

SEQ ID NO: 863171 - DNA, 19 bp, Homo sapiens
aggactccaggcagcagac

SEQ ID NO: 863172 - DNA, 23 bp, Homo sapiens
aggactccaggcagcagacacat

SEQ ID NO: 863173 - DNA, 15 bp, Homo sapiens
aggactccaggccca

SEQ ID NO: 863174 - DNA, 23 bp, Homo sapiens
aggactccaggcccaaggctccc

SEQ ID NO: 863175 - DNA, 21 bp, Homo sapiens
aggactccattggatctgcaa

SEQ ID NO: 863176 - DNA, 13 bp, Homo sapiens
aggactccctcct

SEQ ID NO: 863177 - DNA, 19 bp, Homo sapiens
aggactccctcctcacctc

SEQ ID NO: 863178 - DNA, 23 bp, Homo sapiens
aggactccctcctcacctctgga

SEQ ID NO: 863179 - DNA, 19 bp, Homo sapiens
aggactcctcctttttcca

SEQ ID NO: 863180 - DNA, 13 bp, Homo sapiens
aggactcctggca

SEQ ID NO: 863181 - DNA, 15 bp, Homo sapiens
aggactcggccactg

SEQ ID NO: 863182 - DNA, 19 bp, Homo sapiens
aggactcggccactgtgtc

SEQ ID NO: 863183 - DNA, 23 bp, Homo sapiens
aggactcggccactgtgtctctg

SEQ ID NO: 863184 - DNA, 17 bp, Homo sapiens
aggactctgaggctctt

SEQ ID NO: 863185 - DNA, 15 bp, Homo sapiens
aggactctgcccaga

SEQ ID NO: 863186 - DNA, 13 bp, Homo sapiens
aggactctgcctc

SEQ ID NO: 863187 - DNA, 14 bp, Homo sapiens
aggactctgcctcc

SEQ ID NO: 863188 - DNA, 17 bp, Homo sapiens
aggactctgcctcctct

SEQ ID NO: 863189 - DNA, 14 bp, Homo sapiens
aggactctgccttt

SEQ ID NO: 863190 - DNA, 12 bp, Homo sapiens
aggactctgcgg

SEQ ID NO: 863191 - DNA, 14 bp, Homo sapiens
aggactctgcggga

SEQ ID NO: 863192 - DNA, 15 bp, Homo sapiens
aggactctgcttaaa

SEQ ID NO: 863193 - DNA, 17 bp, Homo sapiens
aggactctgcttaaaca

SEQ ID NO: 863194 - DNA, 14 bp, Homo sapiens
aggactctggacaa

SEQ ID NO: 863195 - DNA, 12 bp, Homo sapiens
aggactctttga

SEQ ID NO: 863196 - DNA, 23 bp, Homo sapiens
aggactgaaagaagaaaacagta

SEQ ID NO: 863197 - DNA, 19 bp, Homo sapiens
aggactgaattgtccccag

SEQ ID NO: 863198 - DNA, 19 bp, Homo sapiens
aggactgagcaccctctgg

SEQ ID NO: 863199 - DNA, 20 bp, Homo sapiens
aggactgagcaccctctgga

SEQ ID NO: 863200 - DNA, 13 bp, Homo sapiens
aggactgagcccc

SEQ ID NO: 863201 - DNA, 13 bp, Homo sapiens
aggactgagccct

SEQ ID NO: 863202 - DNA, 16 bp, Homo sapiens
aggactgagccctctc

SEQ ID NO: 863203 - DNA, 12 bp, Homo sapiens
aggactgagggc

SEQ ID NO: 863204 - DNA, 14 bp, Homo sapiens
aggactgagggcag

SEQ ID NO: 863205 - DNA, 23 bp, Homo sapiens
aggactgcacagcgtcctgtcca

SEQ ID NO: 863206 - DNA, 22 bp, Homo sapiens
aggactgccgaccgaggctgga

SEQ ID NO: 863207 - DNA, 16 bp, Homo sapiens
aggactggagaccgct

SEQ ID NO: 863208 - DNA, 17 bp, Homo sapiens
aggactgtcctcccaca

SEQ ID NO: 863209 - DNA, 22 bp, Homo sapiens
aggactgtcctcccacagacct

SEQ ID NO: 863210 - DNA, 23 bp, Homo sapiens
aggactgtggcgactctgcagag

SEQ ID NO: 863211 - DNA, 20 bp, Homo sapiens
aggactgtgtttccaaaggt

SEQ ID NO: 863212 - DNA, 11 bp, Homo sapiens
aggacttaaaa

SEQ ID NO: 863213 - DNA, 20 bp, Homo sapiens
aggacttaaaattagtcttt

SEQ ID NO: 863214 - DNA, 21 bp, Homo sapiens
aggacttaaaattagtctttt

SEQ ID NO: 863215 - DNA, 20 bp, Homo sapiens
aggacttaacggctccagga

SEQ ID NO: 863216 - DNA, 15 bp, Homo sapiens
aggacttacccagta

SEQ ID NO: 863217 - DNA, 15 bp, Homo sapiens
aggacttccctgtgt

SEQ ID NO: 863218 - DNA, 15 bp, Homo sapiens
aggacttctgcagct

SEQ ID NO: 863219 - DNA, 17 bp, Homo sapiens
aggacttgctaaagcac

SEQ ID NO: 863220 - DNA, 17 bp, Homo sapiens
aggacttggagggtctg

SEQ ID NO: 863221 - DNA, 17 bp, Homo sapiens
aggacttggggtcagga

SEQ ID NO: 863222 - DNA, 22 bp, Homo sapiens
aggacttggtaagatgactctg

SEQ ID NO: 863223 - DNA, 16 bp, Homo sapiens
aggacttggtctgatt

SEQ ID NO: 863224 - DNA, 23 bp, Homo sapiens
aggacttggtctgatttcaggat

SEQ ID NO: 863225 - DNA, 13 bp, Homo sapiens
aggacttgtgtct

SEQ ID NO: 863226 - DNA, 18 bp, Homo sapiens
aggactttgaggcaagtg

SEQ ID NO: 863227 - DNA, 22 bp, Homo sapiens
aggactttgattgcacattgtt

SEQ ID NO: 863228 - DNA, 13 bp, Homo sapiens
aggagaaacacat

SEQ ID NO: 863229 - DNA, 22 bp, Homo sapiens
aggagaaagccgggggaggggc

SEQ ID NO: 863230 - DNA, 18 bp, Homo sapiens
aggagaaagtaccctctt

SEQ ID NO: 863231 - DNA, 12 bp, Homo sapiens
aggagaaatgca

SEQ ID NO: 863232 - DNA, 15 bp, Homo sapiens
aggagaaatgcaata

SEQ ID NO: 863233 - DNA, 19 bp, Homo sapiens
aggagaaatgcaataactc

SEQ ID NO: 863234 - DNA, 20 bp, Homo sapiens
aggagaaattttggtttttc

SEQ ID NO: 863235 - DNA, 22 bp, Homo sapiens
aggagaaccaaatctggaagcc

SEQ ID NO: 863236 - DNA, 14 bp, Homo sapiens
aggagaaccactac

SEQ ID NO: 863237 - DNA, 14 bp, Homo sapiens
aggagaagcaatgg

SEQ ID NO: 863238 - DNA, 22 bp, Homo sapiens
aggagaagcacagctcctgcca

SEQ ID NO: 863239 - DNA, 16 bp, Homo sapiens
aggagaaggaaggaga

SEQ ID NO: 863240 - DNA, 18 bp, Homo sapiens
aggagaagggctggggcc

SEQ ID NO: 863241 - DNA, 22 bp, Homo sapiens
aggagaaggtcagcgagaagga

SEQ ID NO: 863242 - DNA, 20 bp, Homo sapiens
aggagaatcactcgaacccg

SEQ ID NO: 863243 - DNA, 16 bp, Homo sapiens
aggagaatccaagcga

SEQ ID NO: 863244 - DNA, 18 bp, Homo sapiens
aggagaatccaagcgagg

SEQ ID NO: 863245 - DNA, 17 bp, Homo sapiens
aggagaatcgcttgaac

SEQ ID NO: 863246 - DNA, 23 bp, Homo sapiens
aggagaatcgcttgaacctggga

SEQ ID NO: 863247 - DNA, 17 bp, Homo sapiens
aggagaatggggttcct

SEQ ID NO: 863248 - DNA, 24 bp, Homo sapiens
aggagaatggggttcctgctgtgg

SEQ ID NO: 863249 - DNA, 20 bp, Homo sapiens
aggagaattgcttgaacctg

SEQ ID NO: 863250 - DNA, 16 bp, Homo sapiens
aggagacaaaagagca

SEQ ID NO: 863251 - DNA, 15 bp, Homo sapiens
aggagacatatatag

SEQ ID NO: 863252 - DNA, 19 bp, Homo sapiens
aggagacattgctctatgt

SEQ ID NO: 863253 - DNA, 14 bp, Homo sapiens
aggagaccaaggcg

SEQ ID NO: 863254 - DNA, 17 bp, Homo sapiens
aggagaccaaggcggga

SEQ ID NO: 863255 - DNA, 20 bp, Homo sapiens
aggagaccaagtcctggcta

SEQ ID NO: 863256 - DNA, 14 bp, Homo sapiens
aggagaccctggaa

SEQ ID NO: 863257 - DNA, 11 bp, Homo sapiens
aggagactcac

SEQ ID NO: 863258 - DNA, 14 bp, Homo sapiens
aggagactcacctc

SEQ ID NO: 863259 - DNA, 21 bp, Homo sapiens
aggagactcacctctgcctca

SEQ ID NO: 863260 - DNA, 22 bp, Homo sapiens
aggagagaaaatatatgtattt

SEQ ID NO: 863261 - DNA, 13 bp, Homo sapiens
aggagagaagaat

SEQ ID NO: 863262 - DNA, 22 bp, Homo sapiens
aggagagactgaaagcagcagc

SEQ ID NO: 863263 - DNA, 13 bp, Homo sapiens
aggagagagccag

SEQ ID NO: 863264 - DNA, 15 bp, Homo sapiens
aggagagagggcaca

SEQ ID NO: 863265 - DNA, 13 bp, Homo sapiens
aggagagatgacc

SEQ ID NO: 863266 - DNA, 17 bp, Homo sapiens
aggagagattatttaca

SEQ ID NO: 863267 - DNA, 21 bp, Homo sapiens
aggagagattgggagaaatca

SEQ ID NO: 863268 - DNA, 17 bp, Homo sapiens
aggagagccactgggcc

SEQ ID NO: 863269 - DNA, 14 bp, Homo sapiens
aggagagcccccac

SEQ ID NO: 863270 - DNA, 22 bp, Homo sapiens
aggagagcccccaccagcagca

SEQ ID NO: 863271 - DNA, 13 bp, Homo sapiens
aggagagcctgct

SEQ ID NO: 863272 - DNA, 18 bp, Homo sapiens
aggagagcctgctgcatg

SEQ ID NO: 863273 - DNA, 12 bp, Homo sapiens
aggagagcctgg

SEQ ID NO: 863274 - DNA, 13 bp, Homo sapiens
aggagagcctggg

SEQ ID NO: 863275 - DNA, 20 bp, Homo sapiens
aggagaggaaaagtaaggtg

SEQ ID NO: 863276 - DNA, 13 bp, Homo sapiens
aggagaggactgg

SEQ ID NO: 863277 - DNA, 12 bp, Homo sapiens
aggagaggagaa

SEQ ID NO: 863278 - DNA, 13 bp, Homo sapiens
aggagaggagaaa

SEQ ID NO: 863279 - DNA, 20 bp, Homo sapiens
aggagaggcaacatccaaaa

SEQ ID NO: 863280 - DNA, 18 bp, Homo sapiens
aggagaggggaagggcca

SEQ ID NO: 863281 - DNA, 16 bp, Homo sapiens
aggagaggggcacagg

SEQ ID NO: 863282 - DNA, 13 bp, Homo sapiens
aggagagtgtgca

SEQ ID NO: 863283 - DNA, 23 bp, Homo sapiens
aggagatatctgagggaggaggc

SEQ ID NO: 863284 - DNA, 14 bp, Homo sapiens
aggagatcagcagc

SEQ ID NO: 863285 - DNA, 15 bp, Homo sapiens
aggagatcagcagcg

SEQ ID NO: 863286 - DNA, 20 bp, Homo sapiens
aggagatcgagaccatcctg

SEQ ID NO: 863287 - DNA, 16 bp, Homo sapiens
aggagatgaccaggga

SEQ ID NO: 863288 - DNA, 17 bp, Homo sapiens
aggagatgaccagggat

SEQ ID NO: 863289 - DNA, 18 bp, Homo sapiens
aggagatgaccagggatg

SEQ ID NO: 863290 - DNA, 22 bp, Homo sapiens
aggagatgctccttgggccctt

SEQ ID NO: 863291 - DNA, 15 bp, Homo sapiens
aggagatggagggct

SEQ ID NO: 863292 - DNA, 14 bp, Homo sapiens
aggagatggcccca

SEQ ID NO: 863293 - DNA, 14 bp, Homo sapiens
aggagatgggcctt

SEQ ID NO: 863294 - DNA, 16 bp, Homo sapiens
aggagatgggtccagg

SEQ ID NO: 863295 - DNA, 18 bp, Homo sapiens
aggagatgttgaggggag

SEQ ID NO: 863296 - DNA, 21 bp, Homo sapiens
aggagatgttgaggggaggag

SEQ ID NO: 863297 - DNA, 23 bp, Homo sapiens
aggagatgttgaggggaggaggc

SEQ ID NO: 863298 - DNA, 12 bp, Homo sapiens
aggagatttctt

SEQ ID NO: 863299 - DNA, 14 bp, Homo sapiens
aggagatttcttag

SEQ ID NO: 863300 - DNA, 20 bp, Homo sapiens
aggagcaaaacgcctctttt

SEQ ID NO: 863301 - DNA, 17 bp, Homo sapiens
aggagcaaatgtttctg

SEQ ID NO: 863302 - DNA, 23 bp, Homo sapiens
aggagcaagggtggccttgaaga

SEQ ID NO: 863303 - DNA, 16 bp, Homo sapiens
aggagcaatcacagga

SEQ ID NO: 863304 - DNA, 23 bp, Homo sapiens
aggagcacctggaccccctgccc

SEQ ID NO: 863305 - DNA, 13 bp, Homo sapiens
aggagcagagagg

SEQ ID NO: 863306 - DNA, 14 bp, Homo sapiens
aggagcagagaggt

SEQ ID NO: 863307 - DNA, 20 bp, Homo sapiens
aggagcagagaggtggccac

SEQ ID NO: 863308 - DNA, 12 bp, Homo sapiens
aggagcagcagc

SEQ ID NO: 863309 - DNA, 13 bp, Homo sapiens
aggagcagcagcc

SEQ ID NO: 863310 - DNA, 14 bp, Homo sapiens
aggagcagcagcca

SEQ ID NO: 863311 - DNA, 19 bp, Homo sapiens
aggagcagcagccagcacc

SEQ ID NO: 863312 - DNA, 13 bp, Homo sapiens
aggagcagcagct

SEQ ID NO: 863313 - DNA, 14 bp, Homo sapiens
aggagcagcagctt

SEQ ID NO: 863314 - DNA, 17 bp, Homo sapiens
aggagcagccaggaccc

SEQ ID NO: 863315 - DNA, 18 bp, Homo sapiens
aggagcagccaggacccg

SEQ ID NO: 863316 - DNA, 21 bp, Homo sapiens
aggagcagcctcgaggctggt

SEQ ID NO: 863317 - DNA, 14 bp, Homo sapiens
aggagcagctgggg

SEQ ID NO: 863318 - DNA, 19 bp, Homo sapiens
aggagcagcttccttctgg

SEQ ID NO: 863319 - DNA, 18 bp, Homo sapiens
aggagcatagaagccaca

SEQ ID NO: 863320 - DNA, 17 bp, Homo sapiens
aggagccaccagttctc

SEQ ID NO: 863321 - DNA, 20 bp, Homo sapiens
aggagcccagccagaaagca

SEQ ID NO: 863322 - DNA, 19 bp, Homo sapiens
aggagcccagtgggctgca

SEQ ID NO: 863323 - DNA, 20 bp, Homo sapiens
aggagcccatactcagcctg

SEQ ID NO: 863324 - DNA, 14 bp, Homo sapiens
aggagccccagcta

SEQ ID NO: 863325 - DNA, 15 bp, Homo sapiens
aggagccccattcct

SEQ ID NO: 863326 - DNA, 16 bp, Homo sapiens
aggagccccattcctg

SEQ ID NO: 863327 - DNA, 18 bp, Homo sapiens
aggagccccattcctggg

SEQ ID NO: 863328 - DNA, 14 bp, Homo sapiens
aggagcccctgagt

SEQ ID NO: 863329 - DNA, 16 bp, Homo sapiens
aggagccgaagcccag

SEQ ID NO: 863330 - DNA, 18 bp, Homo sapiens
aggagcctagcggagccc

SEQ ID NO: 863331 - DNA, 22 bp, Homo sapiens
aggagcctagcggagcccagcc

SEQ ID NO: 863332 - DNA, 12 bp, Homo sapiens
aggagcctctgg

SEQ ID NO: 863333 - DNA, 13 bp, Homo sapiens
aggagcctctggc

SEQ ID NO: 863334 - DNA, 16 bp, Homo sapiens
aggagcctctggcttc

SEQ ID NO: 863335 - DNA, 20 bp, Homo sapiens
aggagcctggtccttccctg

SEQ ID NO: 863336 - DNA, 13 bp, Homo sapiens
aggagccttgctg

SEQ ID NO: 863337 - DNA, 13 bp, Homo sapiens
aggagcgcaagat

SEQ ID NO: 863338 - DNA, 19 bp, Homo sapiens
aggagcgctagtgccttgc

SEQ ID NO: 863339 - DNA, 21 bp, Homo sapiens
aggagcgctagtgccttgccc

SEQ ID NO: 863340 - DNA, 15 bp, Homo sapiens
aggagcgggcagggc

SEQ ID NO: 863341 - DNA, 15 bp, Homo sapiens
aggagctcaccctgc

SEQ ID NO: 863342 - DNA, 21 bp, Homo sapiens
aggagctcaccctgcccgctc

SEQ ID NO: 863343 - DNA, 17 bp, Homo sapiens
aggagctctcaatttta

SEQ ID NO: 863344 - DNA, 19 bp, Homo sapiens
aggagctcttcaggcctcc

SEQ ID NO: 863345 - DNA, 14 bp, Homo sapiens
aggagctgagggag

SEQ ID NO: 863346 - DNA, 16 bp, Homo sapiens
aggagctgagggaggg

SEQ ID NO: 863347 - DNA, 19 bp, Homo sapiens
aggagctgagggagggagc

SEQ ID NO: 863348 - DNA, 21 bp, Homo sapiens
aggagctgaggtttcaccctt

SEQ ID NO: 863349 - DNA, 15 bp, Homo sapiens
aggagctgatacttt

SEQ ID NO: 863350 - DNA, 12 bp, Homo sapiens
aggagctgatgg

SEQ ID NO: 863351 - DNA, 19 bp, Homo sapiens
aggagctgatggcagctgg

SEQ ID NO: 863352 - DNA, 20 bp, Homo sapiens
aggagctgatttccaggccc

SEQ ID NO: 863353 - DNA, 21 bp, Homo sapiens
aggagctgatttccaggcccc

SEQ ID NO: 863354 - DNA, 21 bp, Homo sapiens
aggagctgcccagagttgctg

SEQ ID NO: 863355 - DNA, 22 bp, Homo sapiens
aggagctgccttggctcagaca

SEQ ID NO: 863356 - DNA, 19 bp, Homo sapiens
aggagctgctatagcctgg

SEQ ID NO: 863357 - DNA, 21 bp, Homo sapiens
aggagctgctatagcctgggg

SEQ ID NO: 863358 - DNA, 17 bp, Homo sapiens
aggagctgctggcttgc

SEQ ID NO: 863359 - DNA, 16 bp, Homo sapiens
aggagctgggaggaaa

SEQ ID NO: 863360 - DNA, 13 bp, Homo sapiens
aggagctgttact

SEQ ID NO: 863361 - DNA, 15 bp, Homo sapiens
aggagcttacccaag

SEQ ID NO: 863362 - DNA, 18 bp, Homo sapiens
aggagcttacccaagctg

SEQ ID NO: 863363 - DNA, 19 bp, Homo sapiens
aggagcttacccaagctgt

SEQ ID NO: 863364 - DNA, 21 bp, Homo sapiens
aggagcttacccaagctgtgg

SEQ ID NO: 863365 - DNA, 15 bp, Homo sapiens
aggagcttttctgga

SEQ ID NO: 863366 - DNA, 17 bp, Homo sapiens
aggagcttttgtgtgcc

SEQ ID NO: 863367 - DNA, 13 bp, Homo sapiens
aggaggaaaagga

SEQ ID NO: 863368 - DNA, 16 bp, Homo sapiens
aggaggaaaaggaaaa

SEQ ID NO: 863369 - DNA, 14 bp, Homo sapiens
aggaggaaagagag

SEQ ID NO: 863370 - DNA, 12 bp, Homo sapiens
aggaggaagccg

SEQ ID NO: 863371 - DNA, 15 bp, Homo sapiens
aggaggaatactgaa

SEQ ID NO: 863372 - DNA, 18 bp, Homo sapiens
aggaggaatactgaacat

SEQ ID NO: 863373 - DNA, 22 bp, Homo sapiens
aggaggaatgctggactggagg

SEQ ID NO: 863374 - DNA, 12 bp, Homo sapiens
aggaggacaaga

SEQ ID NO: 863375 - DNA, 19 bp, Homo sapiens
aggaggacacagcacaagg

SEQ ID NO: 863376 - DNA, 16 bp, Homo sapiens
aggaggacccaggaca

SEQ ID NO: 863377 - DNA, 17 bp, Homo sapiens
aggaggacccaggacag

SEQ ID NO: 863378 - DNA, 19 bp, Homo sapiens
aggaggacccctgccttcc

SEQ ID NO: 863379 - DNA, 23 bp, Homo sapiens
aggaggacccctgccttcctctg

SEQ ID NO: 863380 - DNA, 14 bp, Homo sapiens
aggaggacttggag

SEQ ID NO: 863381 - DNA, 13 bp, Homo sapiens
aggaggagagagt

SEQ ID NO: 863382 - DNA, 23 bp, Homo sapiens
aggaggagatgttgaggggagga

SEQ ID NO: 863383 - DNA, 19 bp, Homo sapiens
aggaggagccttgctgggc

SEQ ID NO: 863384 - DNA, 21 bp, Homo sapiens
aggaggagccttgctgggcca

SEQ ID NO: 863385 - DNA, 21 bp, Homo sapiens
aggaggagctctcaattttat

SEQ ID NO: 863386 - DNA, 14 bp, Homo sapiens
aggaggagggaggc

SEQ ID NO: 863387 - DNA, 17 bp, Homo sapiens
aggaggatgtccctggg

SEQ ID NO: 863388 - DNA, 13 bp, Homo sapiens
aggaggattgcct

SEQ ID NO: 863389 - DNA, 15 bp, Homo sapiens
aggaggattgccttt

SEQ ID NO: 863390 - DNA, 21 bp, Homo sapiens
aggaggattgcctttaatatt

SEQ ID NO: 863391 - DNA, 20 bp, Homo sapiens
aggaggattgcttgagccca

SEQ ID NO: 863392 - DNA, 21 bp, Homo sapiens
aggaggattgcttgagcccag

SEQ ID NO: 863393 - DNA, 17 bp, Homo sapiens
aggaggccaaccagccc

SEQ ID NO: 863394 - DNA, 18 bp, Homo sapiens
aggaggccaaccagcccg

SEQ ID NO: 863395 - DNA, 22 bp, Homo sapiens
aggaggccaataaaaagttcag

SEQ ID NO: 863396 - DNA, 12 bp, Homo sapiens
aggaggccacct

SEQ ID NO: 863397 - DNA, 16 bp, Homo sapiens
aggaggccacctctcc

SEQ ID NO: 863398 - DNA, 19 bp, Homo sapiens
aggaggccacctctccaag

SEQ ID NO: 863399 - DNA, 21 bp, Homo sapiens
aggaggccctggtcctggcct

SEQ ID NO: 863400 - DNA, 20 bp, Homo sapiens
aggaggccctggtgtcaggc

SEQ ID NO: 863401 - DNA, 22 bp, Homo sapiens
aggaggccctggtgtcaggcag

SEQ ID NO: 863402 - DNA, 20 bp, Homo sapiens
aggaggccctgttccctgga

SEQ ID NO: 863403 - DNA, 20 bp, Homo sapiens
aggaggcccttgtcgtggga

SEQ ID NO: 863404 - DNA, 17 bp, Homo sapiens
aggaggcctggaccgag

SEQ ID NO: 863405 - DNA, 19 bp, Homo sapiens
aggaggcctggaccgagat

SEQ ID NO: 863406 - DNA, 20 bp, Homo sapiens
aggaggcggcagctcttctg

SEQ ID NO: 863407 - DNA, 16 bp, Homo sapiens
aggaggctccagaggg

SEQ ID NO: 863408 - DNA, 17 bp, Homo sapiens
aggaggctccagagggc

SEQ ID NO: 863409 - DNA, 21 bp, Homo sapiens
aggaggctccggcccacaggt

SEQ ID NO: 863410 - DNA, 16 bp, Homo sapiens
aggaggctgaggcagg

SEQ ID NO: 863411 - DNA, 20 bp, Homo sapiens
aggaggctgccctgaggggc

SEQ ID NO: 863412 - DNA, 21 bp, Homo sapiens
aggaggctgccctgaggggct

SEQ ID NO: 863413 - DNA, 23 bp, Homo sapiens
aggaggctgccctgaggggctgg

SEQ ID NO: 863414 - DNA, 16 bp, Homo sapiens
aggaggctggaggaag

SEQ ID NO: 863415 - DNA, 16 bp, Homo sapiens
aggaggctggcaggta

SEQ ID NO: 863416 - DNA, 22 bp, Homo sapiens
aggaggctggtgacaggccaaa

SEQ ID NO: 863417 - DNA, 13 bp, Homo sapiens
aggagggacttgg

SEQ ID NO: 863418 - DNA, 14 bp, Homo sapiens
aggagggagaaagg

SEQ ID NO: 863419 - DNA, 16 bp, Homo sapiens
aggagggagaaaggag

SEQ ID NO: 863420 - DNA, 12 bp, Homo sapiens
aggagggagagg

SEQ ID NO: 863421 - DNA, 16 bp, Homo sapiens
aggagggagccttgtg

SEQ ID NO: 863422 - DNA, 15 bp, Homo sapiens
aggagggcacagcag

SEQ ID NO: 863423 - DNA, 15 bp, Homo sapiens
aggagggcagagcca

SEQ ID NO: 863424 - DNA, 12 bp, Homo sapiens
aggagggcaggc

SEQ ID NO: 863425 - DNA, 22 bp, Homo sapiens
aggagggcgtgactcacccaag

SEQ ID NO: 863426 - DNA, 17 bp, Homo sapiens
aggaggggaagctgggc

SEQ ID NO: 863427 - DNA, 19 bp, Homo sapiens
aggaggggaagctgggccc

SEQ ID NO: 863428 - DNA, 19 bp, Homo sapiens
aggaggggagcgtctggga

SEQ ID NO: 863429 - DNA, 22 bp, Homo sapiens
aggaggggcctgggcagcccca

SEQ ID NO: 863430 - DNA, 16 bp, Homo sapiens
aggaggggctgtaaaa

SEQ ID NO: 863431 - DNA, 14 bp, Homo sapiens
aggagggtggagga

SEQ ID NO: 863432 - DNA, 22 bp, Homo sapiens
aggagggtggaggaaggtgctg

SEQ ID NO: 863433 - DNA, 14 bp, Homo sapiens
aggagggtgggaag

SEQ ID NO: 863434 - DNA, 15 bp, Homo sapiens
aggaggtagagaggg

SEQ ID NO: 863435 - DNA, 17 bp, Homo sapiens
aggaggtcatctgacct

SEQ ID NO: 863436 - DNA, 14 bp, Homo sapiens
aggaggtgagggat

SEQ ID NO: 863437 - DNA, 14 bp, Homo sapiens
aggaggtggagaaa

SEQ ID NO: 863438 - DNA, 20 bp, Homo sapiens
aggaggtggaggctgcagtg

SEQ ID NO: 863439 - DNA, 15 bp, Homo sapiens
aggaggtggcttcat

SEQ ID NO: 863440 - DNA, 15 bp, Homo sapiens
aggaggtgggggctg

SEQ ID NO: 863441 - DNA, 22 bp, Homo sapiens
aggaggtgggggctggaggtgc

SEQ ID NO: 863442 - DNA, 13 bp, Homo sapiens
aggaggtgtgagg

SEQ ID NO: 863443 - DNA, 18 bp, Homo sapiens
aggaggttctgggcctct

SEQ ID NO: 863444 - DNA, 14 bp, Homo sapiens
aggaggttgggagg

SEQ ID NO: 863445 - DNA, 11 bp, Homo sapiens
aggagtaacaa

SEQ ID NO: 863446 - DNA, 15 bp, Homo sapiens
aggagtcaactggct

SEQ ID NO: 863447 - DNA, 17 bp, Homo sapiens
aggagtcaactggctgg

SEQ ID NO: 863448 - DNA, 22 bp, Homo sapiens
aggagtcaactggctggccagt

SEQ ID NO: 863449 - DNA, 15 bp, Homo sapiens
aggagtcactgagac

SEQ ID NO: 863450 - DNA, 16 bp, Homo sapiens
aggagtcactgagacc

SEQ ID NO: 863451 - DNA, 19 bp, Homo sapiens
aggagtcaggggctctgtg

SEQ ID NO: 863452 - DNA, 12 bp, Homo sapiens
aggagtccctgg

SEQ ID NO: 863453 - DNA, 15 bp, Homo sapiens
aggagtctattttgt

SEQ ID NO: 863454 - DNA, 20 bp, Homo sapiens
aggagtctcaacatgtgttt

SEQ ID NO: 863455 - DNA, 16 bp, Homo sapiens
aggagtctctgccacc

SEQ ID NO: 863456 - DNA, 19 bp, Homo sapiens
aggagtctctgccacccac

SEQ ID NO: 863457 - DNA, 13 bp, Homo sapiens
aggagtctgagga

SEQ ID NO: 863458 - DNA, 14 bp, Homo sapiens
aggagtctgccact

SEQ ID NO: 863459 - DNA, 16 bp, Homo sapiens
aggagtctgtgctctt

SEQ ID NO: 863460 - DNA, 17 bp, Homo sapiens
aggagtctgtgctcttt

SEQ ID NO: 863461 - DNA, 18 bp, Homo sapiens
aggagtcttcagacccag

SEQ ID NO: 863462 - DNA, 20 bp, Homo sapiens
aggagtcttcagacccagag

SEQ ID NO: 863463 - DNA, 21 bp, Homo sapiens
aggagtcttcagacccagaga

SEQ ID NO: 863464 - DNA, 22 bp, Homo sapiens
aggagtcttcagacccagagaa

SEQ ID NO: 863465 - DNA, 22 bp, Homo sapiens
aggagtgaaacctttagggcag

SEQ ID NO: 863466 - DNA, 23 bp, Homo sapiens
aggagtgaaacctttagggcagc

SEQ ID NO: 863467 - DNA, 14 bp, Homo sapiens
aggagtgacatgaa

SEQ ID NO: 863468 - DNA, 18 bp, Homo sapiens
aggagtgaccgggcactg

SEQ ID NO: 863469 - DNA, 21 bp, Homo sapiens
aggagtgattgaaccagctca

SEQ ID NO: 863470 - DNA, 16 bp, Homo sapiens
aggagtgcagccttct

SEQ ID NO: 863471 - DNA, 13 bp, Homo sapiens
aggagtgccagga

SEQ ID NO: 863472 - DNA, 14 bp, Homo sapiens
aggagtgccaggac

SEQ ID NO: 863473 - DNA, 16 bp, Homo sapiens
aggagtgccaggacca

SEQ ID NO: 863474 - DNA, 19 bp, Homo sapiens
aggagtgccaggaccagcc

SEQ ID NO: 863475 - DNA, 21 bp, Homo sapiens
aggagtgccaggaccagcctg

SEQ ID NO: 863476 - DNA, 21 bp, Homo sapiens
aggagtgggaaaacactgcca

SEQ ID NO: 863477 - DNA, 21 bp, Homo sapiens
aggagtgggtgacaagagcct

SEQ ID NO: 863478 - DNA, 16 bp, Homo sapiens
aggagtgtggccacgt

SEQ ID NO: 863479 - DNA, 15 bp, Homo sapiens
aggagtgttattgca

SEQ ID NO: 863480 - DNA, 16 bp, Homo sapiens
aggagttcgagaccaa

SEQ ID NO: 863481 - DNA, 17 bp, Homo sapiens
aggagttcgagaccagc

SEQ ID NO: 863482 - DNA, 22 bp, Homo sapiens
aggagttcgagaccagcctggc

SEQ ID NO: 863483 - DNA, 16 bp, Homo sapiens
aggagttcgaggctgc

SEQ ID NO: 863484 - DNA, 18 bp, Homo sapiens
aggagttctctgatgcag

SEQ ID NO: 863485 - DNA, 17 bp, Homo sapiens
aggagttctcttccgca

SEQ ID NO: 863486 - DNA, 16 bp, Homo sapiens
aggagttggaatgttg

SEQ ID NO: 863487 - DNA, 21 bp, Homo sapiens
aggagttgtcgtttttagctt

SEQ ID NO: 863488 - DNA, 17 bp, Homo sapiens
aggagttgtgagccctc

SEQ ID NO: 863489 - DNA, 21 bp, Homo sapiens
aggagttgtgagccctctagg

SEQ ID NO: 863490 - DNA, 18 bp, Homo sapiens
aggagttgtttctgaccc

SEQ ID NO: 863491 - DNA, 23 bp, Homo sapiens
aggagtttattacaatgtatctt

SEQ ID NO: 863492 - DNA, 21 bp, Homo sapiens
aggagtttgagacaagccctg

SEQ ID NO: 863493 - DNA, 21 bp, Homo sapiens
aggagtttgagaccaacctgg

SEQ ID NO: 863494 - DNA, 24 bp, Homo sapiens
aggagtttgaggctgcagcgagct

SEQ ID NO: 863495 - DNA, 21 bp, Homo sapiens
aggagttttaagtccagcttg

SEQ ID NO: 863496 - DNA, 17 bp, Homo sapiens
aggagttttactgcctg

SEQ ID NO: 863497 - DNA, 20 bp, Homo sapiens
aggataaaaagccagggctg

SEQ ID NO: 863498 - DNA, 16 bp, Homo sapiens
aggataaaaaggaagg

SEQ ID NO: 863499 - DNA, 19 bp, Homo sapiens
aggataacttgctttcttc

SEQ ID NO: 863500 - DNA, 16 bp, Homo sapiens
aggataaggagactga

SEQ ID NO: 863501 - DNA, 13 bp, Homo sapiens
aggataagtgaaa

SEQ ID NO: 863502 - DNA, 17 bp, Homo sapiens
aggataatgaaataatc

SEQ ID NO: 863503 - DNA, 18 bp, Homo sapiens
aggatactggcacagagg

SEQ ID NO: 863504 - DNA, 16 bp, Homo sapiens
aggatagacactggac

SEQ ID NO: 863505 - DNA, 20 bp, Homo sapiens
aggatagacactggacatgg

SEQ ID NO: 863506 - DNA, 21 bp, Homo sapiens
aggatagacactggacatggc

SEQ ID NO: 863507 - DNA, 15 bp, Homo sapiens
aggatataaaaggat

SEQ ID NO: 863508 - DNA, 17 bp, Homo sapiens
aggatataaaaggatgt

SEQ ID NO: 863509 - DNA, 22 bp, Homo sapiens
aggatataagagggctttttaa

SEQ ID NO: 863510 - DNA, 23 bp, Homo sapiens
aggatataagagggctttttaaa

SEQ ID NO: 863511 - DNA, 18 bp, Homo sapiens
aggatatattttcacttt

SEQ ID NO: 863512 - DNA, 17 bp, Homo sapiens
aggatatccttatcaga

SEQ ID NO: 863513 - DNA, 19 bp, Homo sapiens
aggatatccttatcagagc

SEQ ID NO: 863514 - DNA, 21 bp, Homo sapiens
aggatatccttatcagagcta

SEQ ID NO: 863515 - DNA, 16 bp, Homo sapiens
aggatattaaacgtgt

SEQ ID NO: 863516 - DNA, 21 bp, Homo sapiens
aggatattaaacgtgtaaatt

SEQ ID NO: 863517 - DNA, 21 bp, Homo sapiens
aggatattagttaatgagcca

SEQ ID NO: 863518 - DNA, 18 bp, Homo sapiens
aggatattatctacctgt

SEQ ID NO: 863519 - DNA, 19 bp, Homo sapiens
aggatattcagatgtatgt

SEQ ID NO: 863520 - DNA, 22 bp, Homo sapiens
aggatattctactgtacttttt

SEQ ID NO: 863521 - DNA, 17 bp, Homo sapiens
aggatattggttcttcc

SEQ ID NO: 863522 - DNA, 20 bp, Homo sapiens
aggatcactggagcccagga

SEQ ID NO: 863523 - DNA, 17 bp, Homo sapiens
aggatcagccccgctcc

SEQ ID NO: 863524 - DNA, 15 bp, Homo sapiens
aggatcagggctcct

SEQ ID NO: 863525 - DNA, 15 bp, Homo sapiens
aggatcagttaacta

SEQ ID NO: 863526 - DNA, 20 bp, Homo sapiens
aggatcatttgttggaatga

SEQ ID NO: 863527 - DNA, 13 bp, Homo sapiens
aggatccagagag

SEQ ID NO: 863528 - DNA, 11 bp, Homo sapiens
aggatccaggc

SEQ ID NO: 863529 - DNA, 14 bp, Homo sapiens
aggatccgctgcca

SEQ ID NO: 863530 - DNA, 16 bp, Homo sapiens
aggatccgctgccacc

SEQ ID NO: 863531 - DNA, 21 bp, Homo sapiens
aggatcctattctcaccagga

SEQ ID NO: 863532 - DNA, 18 bp, Homo sapiens
aggatcctctccactcca

SEQ ID NO: 863533 - DNA, 16 bp, Homo sapiens
aggatcctgcaggaac

SEQ ID NO: 863534 - DNA, 12 bp, Homo sapiens
aggatcgaggca

SEQ ID NO: 863535 - DNA, 14 bp, Homo sapiens
aggatcgaggcatg

SEQ ID NO: 863536 - DNA, 21 bp, Homo sapiens
aggatcgaggcatggggcatg

SEQ ID NO: 863537 - DNA, 19 bp, Homo sapiens
aggatcggactctgcccct

SEQ ID NO: 863538 - DNA, 15 bp, Homo sapiens
aggatctcaagccag

SEQ ID NO: 863539 - DNA, 17 bp, Homo sapiens
aggatctcaagccagcc

SEQ ID NO: 863540 - DNA, 18 bp, Homo sapiens
aggatctcaagccagccc

SEQ ID NO: 863541 - DNA, 22 bp, Homo sapiens
aggatctccactgataagactg

SEQ ID NO: 863542 - DNA, 17 bp, Homo sapiens
aggatctctaaagagca

SEQ ID NO: 863543 - DNA, 21 bp, Homo sapiens
aggatctcttgagcctgggag

SEQ ID NO: 863544 - DNA, 12 bp, Homo sapiens
aggatctgctga

SEQ ID NO: 863545 - DNA, 16 bp, Homo sapiens
aggatctgctgaggcc

SEQ ID NO: 863546 - DNA, 16 bp, Homo sapiens
aggatctttgtggcca

SEQ ID NO: 863547 - DNA, 18 bp, Homo sapiens
aggatctttgtggccaag

SEQ ID NO: 863548 - DNA, 14 bp, Homo sapiens
aggatgaaagaaag

SEQ ID NO: 863549 - DNA, 20 bp, Homo sapiens
aggatgaagaacacagcatg

SEQ ID NO: 863550 - DNA, 22 bp, Homo sapiens
aggatgaagagaaggcacacag

SEQ ID NO: 863551 - DNA, 18 bp, Homo sapiens
aggatgaatgtatgtgca

SEQ ID NO: 863552 - DNA, 20 bp, Homo sapiens
aggatgaatgtatgtgcact

SEQ ID NO: 863553 - DNA, 11 bp, Homo sapiens
aggatgacttt

SEQ ID NO: 863554 - DNA, 15 bp, Homo sapiens
aggatgagaatgtga

SEQ ID NO: 863555 - DNA, 13 bp, Homo sapiens
aggatgagggaag

SEQ ID NO: 863556 - DNA, 18 bp, Homo sapiens
aggatgataagttccttt

SEQ ID NO: 863557 - DNA, 15 bp, Homo sapiens
aggatgattgtacag

SEQ ID NO: 863558 - DNA, 22 bp, Homo sapiens
aggatgatttcagaaggagaag

SEQ ID NO: 863559 - DNA, 19 bp, Homo sapiens
aggatgcacatttctggat

SEQ ID NO: 863560 - DNA, 23 bp, Homo sapiens
aggatgcagcgccgtgtcctctc

SEQ ID NO: 863561 - DNA, 17 bp, Homo sapiens
aggatgcattctgatag

SEQ ID NO: 863562 - DNA, 12 bp, Homo sapiens
aggatgcctttt

SEQ ID NO: 863563 - DNA, 18 bp, Homo sapiens
aggatgcggctttctctg

SEQ ID NO: 863564 - DNA, 19 bp, Homo sapiens
aggatgcggctttctctgc

SEQ ID NO: 863565 - DNA, 24 bp, Homo sapiens
aggatgcggctttctctgcctctg

SEQ ID NO: 863566 - DNA, 15 bp, Homo sapiens
aggatgctaaagatg

SEQ ID NO: 863567 - DNA, 22 bp, Homo sapiens
aggatgctaacatctaaaaata

SEQ ID NO: 863568 - DNA, 15 bp, Homo sapiens
aggatgctaatggaa

SEQ ID NO: 863569 - DNA, 23 bp, Homo sapiens
aggatgcttgtacataatgcgtg

SEQ ID NO: 863570 - DNA, 16 bp, Homo sapiens
aggatggagagagggg

SEQ ID NO: 863571 - DNA, 17 bp, Homo sapiens
aggatggagagagggga

SEQ ID NO: 863572 - DNA, 17 bp, Homo sapiens
aggatggagccagctct

SEQ ID NO: 863573 - DNA, 19 bp, Homo sapiens
aggatggaggggtggtcct

SEQ ID NO: 863574 - DNA, 21 bp, Homo sapiens
aggatggatgagtcagacacg

SEQ ID NO: 863575 - DNA, 23 bp, Homo sapiens
aggatggatttagaaaaaaacat

SEQ ID NO: 863576 - DNA, 16 bp, Homo sapiens
aggatggcctttcctt

SEQ ID NO: 863577 - DNA, 20 bp, Homo sapiens
aggatgggatgggttccaga

SEQ ID NO: 863578 - DNA, 13 bp, Homo sapiens
aggatggtcacac

SEQ ID NO: 863579 - DNA, 19 bp, Homo sapiens
aggatggtgggcaggatct

SEQ ID NO: 863580 - DNA, 19 bp, Homo sapiens
aggatggttagacagcaca

SEQ ID NO: 863581 - DNA, 21 bp, Homo sapiens
aggatgtaaacagtgcctgct

SEQ ID NO: 863582 - DNA, 20 bp, Homo sapiens
aggatgtatattttatataa

SEQ ID NO: 863583 - DNA, 16 bp, Homo sapiens
aggatgtcacagggcc

SEQ ID NO: 863584 - DNA, 14 bp, Homo sapiens
aggatgtgggcagc

SEQ ID NO: 863585 - DNA, 15 bp, Homo sapiens
aggatgtgggcagct

SEQ ID NO: 863586 - DNA, 16 bp, Homo sapiens
aggatgtgtgcatgtg

SEQ ID NO: 863587 - DNA, 15 bp, Homo sapiens
aggatgtgtgggcca

SEQ ID NO: 863588 - DNA, 22 bp, Homo sapiens
aggatgttacaagtttgctaaa

SEQ ID NO: 863589 - DNA, 23 bp, Homo sapiens
aggatgttacaagtttgctaaaa

SEQ ID NO: 863590 - DNA, 15 bp, Homo sapiens
aggatgttagaaagt

SEQ ID NO: 863591 - DNA, 22 bp, Homo sapiens
aggatgttgcttctgaatcact

SEQ ID NO: 863592 - DNA, 23 bp, Homo sapiens
aggatgtttttctttatttttgt

SEQ ID NO: 863593 - DNA, 13 bp, Homo sapiens
aggattaaacaca

SEQ ID NO: 863594 - DNA, 16 bp, Homo sapiens
aggattacatgcatgt

SEQ ID NO: 863595 - DNA, 14 bp, Homo sapiens
aggattatcagtat

SEQ ID NO: 863596 - DNA, 20 bp, Homo sapiens
aggattattactaattctat

SEQ ID NO: 863597 - DNA, 12 bp, Homo sapiens
aggattcagatc

SEQ ID NO: 863598 - DNA, 16 bp, Homo sapiens
aggattcccccagcca

SEQ ID NO: 863599 - DNA, 17 bp, Homo sapiens
aggattccccctgccct

SEQ ID NO: 863600 - DNA, 15 bp, Homo sapiens
aggattcctctttgt

SEQ ID NO: 863601 - DNA, 15 bp, Homo sapiens
aggattctaggtgga

SEQ ID NO: 863602 - DNA, 15 bp, Homo sapiens
aggattctttcccca

SEQ ID NO: 863603 - DNA, 16 bp, Homo sapiens
aggattctttccccag

SEQ ID NO: 863604 - DNA, 18 bp, Homo sapiens
aggattctttccccagag

SEQ ID NO: 863605 - DNA, 17 bp, Homo sapiens
aggattgcatcctgctg

SEQ ID NO: 863606 - DNA, 19 bp, Homo sapiens
aggattgcatcctgctggg

SEQ ID NO: 863607 - DNA, 17 bp, Homo sapiens
aggattgcttgagccca

SEQ ID NO: 863608 - DNA, 20 bp, Homo sapiens
aggattgcttgagcccagga

SEQ ID NO: 863609 - DNA, 22 bp, Homo sapiens
aggattgcttgagcccaggagt

SEQ ID NO: 863610 - DNA, 15 bp, Homo sapiens
aggattgtggaaaac

SEQ ID NO: 863611 - DNA, 18 bp, Homo sapiens
aggattgtggaaaaccag

SEQ ID NO: 863612 - DNA, 19 bp, Homo sapiens
aggattgtggaaaaccagg

SEQ ID NO: 863613 - DNA, 16 bp, Homo sapiens
aggatttaaaaactgg

SEQ ID NO: 863614 - DNA, 19 bp, Homo sapiens
aggatttaaaaactggaac

SEQ ID NO: 863615 - DNA, 12 bp, Homo sapiens
aggatttaacag

SEQ ID NO: 863616 - DNA, 20 bp, Homo sapiens
aggatttaacagtcatttaa

SEQ ID NO: 863617 - DNA, 21 bp, Homo sapiens
aggatttaacagtcatttaaa

SEQ ID NO: 863618 - DNA, 12 bp, Homo sapiens
aggatttcaagc

SEQ ID NO: 863619 - DNA, 16 bp, Homo sapiens
aggatttcctggagtg

SEQ ID NO: 863620 - DNA, 21 bp, Homo sapiens
aggatttcctggagtgccctg

SEQ ID NO: 863621 - DNA, 19 bp, Homo sapiens
aggattttaacaaaagcaa

SEQ ID NO: 863622 - DNA, 23 bp, Homo sapiens
aggattttaacaaaagcaagact

SEQ ID NO: 863623 - DNA, 14 bp, Homo sapiens
aggattttaatttc

SEQ ID NO: 863624 - DNA, 16 bp, Homo sapiens
aggattttaatttcag

SEQ ID NO: 863625 - DNA, 17 bp, Homo sapiens
aggattttaatttcagg

SEQ ID NO: 863626 - DNA, 16 bp, Homo sapiens
aggattttaccaaagc

SEQ ID NO: 863627 - DNA, 12 bp, Homo sapiens
aggatttttaga

SEQ ID NO: 863628 - DNA, 16 bp, Homo sapiens
aggcaaaaaactctta

SEQ ID NO: 863629 - DNA, 20 bp, Homo sapiens
aggcaaaaaagggacagcat

SEQ ID NO: 863630 - DNA, 19 bp, Homo sapiens
aggcaaaaactgtactgtg

SEQ ID NO: 863631 - DNA, 15 bp, Homo sapiens
aggcaaaaatgtaaa

SEQ ID NO: 863632 - DNA, 21 bp, Homo sapiens
aggcaaaacacgcaagggcat

SEQ ID NO: 863633 - DNA, 12 bp, Homo sapiens
aggcaaaagact

SEQ ID NO: 863634 - DNA, 17 bp, Homo sapiens
aggcaaaatccttgctt

SEQ ID NO: 863635 - DNA, 13 bp, Homo sapiens
aggcaaaattgca

SEQ ID NO: 863636 - DNA, 20 bp, Homo sapiens
aggcaaaattgcaaatcttg

SEQ ID NO: 863637 - DNA, 17 bp, Homo sapiens
aggcaaagaaaatgaaa

SEQ ID NO: 863638 - DNA, 12 bp, Homo sapiens
aggcaaaggcag

SEQ ID NO: 863639 - DNA, 15 bp, Homo sapiens
aggcaaaggcagagg

SEQ ID NO: 863640 - DNA, 14 bp, Homo sapiens
aggcaaagtacaaa

SEQ ID NO: 863641 - DNA, 15 bp, Homo sapiens
aggcaaagtccagct

SEQ ID NO: 863642 - DNA, 21 bp, Homo sapiens
aggcaaagtttacagatgttt

SEQ ID NO: 863643 - DNA, 17 bp, Homo sapiens
aggcaaataatggaaaa

SEQ ID NO: 863644 - DNA, 19 bp, Homo sapiens
aggcaaatataagctggga

SEQ ID NO: 863645 - DNA, 12 bp, Homo sapiens
aggcaaatattg

SEQ ID NO: 863646 - DNA, 22 bp, Homo sapiens
aggcaacactggaacatggcta

SEQ ID NO: 863647 - DNA, 16 bp, Homo sapiens
aggcaacatccaaaat

SEQ ID NO: 863648 - DNA, 18 bp, Homo sapiens
aggcaactcaaagatgat

SEQ ID NO: 863649 - DNA, 15 bp, Homo sapiens
aggcaactcttgtaa

SEQ ID NO: 863650 - DNA, 19 bp, Homo sapiens
aggcaactgcattggcttt

SEQ ID NO: 863651 - DNA, 15 bp, Homo sapiens
aggcaagaaaaggac

SEQ ID NO: 863652 - DNA, 13 bp, Homo sapiens
aggcaagagggag

SEQ ID NO: 863653 - DNA, 17 bp, Homo sapiens
aggcaagagggggtgga

SEQ ID NO: 863654 - DNA, 21 bp, Homo sapiens
aggcaagagggggtggagggg

SEQ ID NO: 863655 - DNA, 24 bp, Homo sapiens
aggcaagaggggtggagactgctt

SEQ ID NO: 863656 - DNA, 20 bp, Homo sapiens
aggcaagattggaaagacag

SEQ ID NO: 863657 - DNA, 14 bp, Homo sapiens
aggcaagcccctca

SEQ ID NO: 863658 - DNA, 19 bp, Homo sapiens
aggcaagcccctcagccct

SEQ ID NO: 863659 - DNA, 12 bp, Homo sapiens
aggcaagccctg

SEQ ID NO: 863660 - DNA, 22 bp, Homo sapiens
aggcaagcccttcggtcacctg

SEQ ID NO: 863661 - DNA, 13 bp, Homo sapiens
aggcaaggcaggt

SEQ ID NO: 863662 - DNA, 14 bp, Homo sapiens
aggcaaggcaggtg

SEQ ID NO: 863663 - DNA, 19 bp, Homo sapiens
aggcaaggcaggtgcctcc

SEQ ID NO: 863664 - DNA, 14 bp, Homo sapiens
aggcaagtggtagg

SEQ ID NO: 863665 - DNA, 17 bp, Homo sapiens
aggcaatgctgtacttt

SEQ ID NO: 863666 - DNA, 21 bp, Homo sapiens
aggcaattagacactttggaa

SEQ ID NO: 863667 - DNA, 15 bp, Homo sapiens
aggcaattatatcta

SEQ ID NO: 863668 - DNA, 18 bp, Homo sapiens
aggcaattttagtgtatt

SEQ ID NO: 863669 - DNA, 20 bp, Homo sapiens
aggcacaaaattttgtttaa

SEQ ID NO: 863670 - DNA, 19 bp, Homo sapiens
aggcacaaatcttgggtct

SEQ ID NO: 863671 - DNA, 22 bp, Homo sapiens
aggcacaaggttggttgctaag

SEQ ID NO: 863672 - DNA, 19 bp, Homo sapiens
aggcacacaaggggccctt

SEQ ID NO: 863673 - DNA, 14 bp, Homo sapiens
aggcacacacagcc

SEQ ID NO: 863674 - DNA, 21 bp, Homo sapiens
aggcacacaccaccatgctca

SEQ ID NO: 863675 - DNA, 16 bp, Homo sapiens
aggcacacagcagccc

SEQ ID NO: 863676 - DNA, 15 bp, Homo sapiens
aggcacacagctact

SEQ ID NO: 863677 - DNA, 15 bp, Homo sapiens
aggcacacttcttct

SEQ ID NO: 863678 - DNA, 13 bp, Homo sapiens
aggcacagctgag

SEQ ID NO: 863679 - DNA, 15 bp, Homo sapiens
aggcacaggatgctg

SEQ ID NO: 863680 - DNA, 17 bp, Homo sapiens
aggcacagtgggagctg

SEQ ID NO: 863681 - DNA, 20 bp, Homo sapiens
aggcacagtgggagctgagc

SEQ ID NO: 863682 - DNA, 20 bp, Homo sapiens
aggcaccaaaagaagtaaaa

SEQ ID NO: 863683 - DNA, 22 bp, Homo sapiens
aggcaccaacaactcagaatgg

SEQ ID NO: 863684 - DNA, 18 bp, Homo sapiens
aggcaccaccaggagcag

SEQ ID NO: 863685 - DNA, 20 bp, Homo sapiens
aggcaccaccaggagcagca

SEQ ID NO: 863686 - DNA, 21 bp, Homo sapiens
aggcaccaccaggagcagcag

SEQ ID NO: 863687 - DNA, 23 bp, Homo sapiens
aggcaccaccaggagcagcagcc

SEQ ID NO: 863688 - DNA, 13 bp, Homo sapiens
aggcaccagctct

SEQ ID NO: 863689 - DNA, 11 bp, Homo sapiens
aggcaccagga

SEQ ID NO: 863690 - DNA, 15 bp, Homo sapiens
aggcaccaggaagcc

SEQ ID NO: 863691 - DNA, 13 bp, Homo sapiens
aggcaccatgcaa

SEQ ID NO: 863692 - DNA, 14 bp, Homo sapiens
aggcacccatctgt

SEQ ID NO: 863693 - DNA, 15 bp, Homo sapiens
aggcaccccctggag

SEQ ID NO: 863694 - DNA, 16 bp, Homo sapiens
aggcaccccctggaga

SEQ ID NO: 863695 - DNA, 20 bp, Homo sapiens
aggcacccctccgtgtggag

SEQ ID NO: 863696 - DNA, 14 bp, Homo sapiens
aggcaccctcaggg

SEQ ID NO: 863697 - DNA, 17 bp, Homo sapiens
aggcaccctcagggagc

SEQ ID NO: 863698 - DNA, 14 bp, Homo sapiens
aggcaccgccacgt

SEQ ID NO: 863699 - DNA, 21 bp, Homo sapiens
aggcaccgccacgtcccagca

SEQ ID NO: 863700 - DNA, 13 bp, Homo sapiens
aggcaccggcgct

SEQ ID NO: 863701 - DNA, 18 bp, Homo sapiens
aggcaccggcgctgcagg

SEQ ID NO: 863702 - DNA, 15 bp, Homo sapiens
aggcaccgggctggc

SEQ ID NO: 863703 - DNA, 17 bp, Homo sapiens
aggcaccgggctggctg

SEQ ID NO: 863704 - DNA, 18 bp, Homo sapiens
aggcaccgggctggctgc

SEQ ID NO: 863705 - DNA, 20 bp, Homo sapiens
aggcacctcacaggccccag

SEQ ID NO: 863706 - DNA, 17 bp, Homo sapiens
aggcacctccaggcagg

SEQ ID NO: 863707 - DNA, 22 bp, Homo sapiens
aggcacctccaggcaggccagg

SEQ ID NO: 863708 - DNA, 16 bp, Homo sapiens
aggcacctgctggaaa

SEQ ID NO: 863709 - DNA, 13 bp, Homo sapiens
aggcacctggcct

SEQ ID NO: 863710 - DNA, 14 bp, Homo sapiens
aggcacctggcctg

SEQ ID NO: 863711 - DNA, 16 bp, Homo sapiens
aggcacctggcctgct

SEQ ID NO: 863712 - DNA, 17 bp, Homo sapiens
aggcacctggcctgctg

SEQ ID NO: 863713 - DNA, 22 bp, Homo sapiens
aggcacctggcctgctgggaac

SEQ ID NO: 863714 - DNA, 17 bp, Homo sapiens
aggcacgaacccacctg

SEQ ID NO: 863715 - DNA, 18 bp, Homo sapiens
aggcacgaacccacctgc

SEQ ID NO: 863716 - DNA, 19 bp, Homo sapiens
aggcacgaacccacctgct

SEQ ID NO: 863717 - DNA, 20 bp, Homo sapiens
aggcacgaacccacctgctg

SEQ ID NO: 863718 - DNA, 15 bp, Homo sapiens
aggcacgaagcaatt

SEQ ID NO: 863719 - DNA, 15 bp, Homo sapiens
aggcactcagtgagc

SEQ ID NO: 863720 - DNA, 17 bp, Homo sapiens
aggcactcagtgagcct

SEQ ID NO: 863721 - DNA, 16 bp, Homo sapiens
aggcactccaaacctg

SEQ ID NO: 863722 - DNA, 14 bp, Homo sapiens
aggcactcttaaat

SEQ ID NO: 863723 - DNA, 22 bp, Homo sapiens
aggcactgaacaggctggggcc

SEQ ID NO: 863724 - DNA, 17 bp, Homo sapiens
aggcactgaagtgctta

SEQ ID NO: 863725 - DNA, 22 bp, Homo sapiens
aggcactgccttctcctctctg

SEQ ID NO: 863726 - DNA, 14 bp, Homo sapiens
aggcactgggctcc

SEQ ID NO: 863727 - DNA, 15 bp, Homo sapiens
aggcactggtggcat

SEQ ID NO: 863728 - DNA, 20 bp, Homo sapiens
aggcactttagggctgtaaa

SEQ ID NO: 863729 - DNA, 15 bp, Homo sapiens
aggcagaagaattga

SEQ ID NO: 863730 - DNA, 22 bp, Homo sapiens
aggcagaagaattgaacccagg

SEQ ID NO: 863731 - DNA, 14 bp, Homo sapiens
aggcagaatggctg

SEQ ID NO: 863732 - DNA, 16 bp, Homo sapiens
aggcagaatggctgca

SEQ ID NO: 863733 - DNA, 19 bp, Homo sapiens
aggcagacaagagctgctg

SEQ ID NO: 863734 - DNA, 21 bp, Homo sapiens
aggcagacacagggacttgaa

SEQ ID NO: 863735 - DNA, 14 bp, Homo sapiens
aggcagacagcagc

SEQ ID NO: 863736 - DNA, 20 bp, Homo sapiens
aggcagacagcagctcaggc

SEQ ID NO: 863737 - DNA, 22 bp, Homo sapiens
aggcagacagcaggcagcgcca

SEQ ID NO: 863738 - DNA, 22 bp, Homo sapiens
aggcagacttccctgaatgtat

SEQ ID NO: 863739 - DNA, 18 bp, Homo sapiens
aggcagagaaagaagaga

SEQ ID NO: 863740 - DNA, 14 bp, Homo sapiens
aggcagagaatcat

SEQ ID NO: 863741 - DNA, 15 bp, Homo sapiens
aggcagagaggagtg

SEQ ID NO: 863742 - DNA, 19 bp, Homo sapiens
aggcagagagtacagactg

SEQ ID NO: 863743 - DNA, 17 bp, Homo sapiens
aggcagagcgggaggga

SEQ ID NO: 863744 - DNA, 12 bp, Homo sapiens
aggcagagctga

SEQ ID NO: 863745 - DNA, 15 bp, Homo sapiens
aggcagagctgaggg

SEQ ID NO: 863746 - DNA, 20 bp, Homo sapiens
aggcagagctgagggccctg

SEQ ID NO: 863747 - DNA, 15 bp, Homo sapiens
aggcagaggctggca

SEQ ID NO: 863748 - DNA, 17 bp, Homo sapiens
aggcagaggctggcacc

SEQ ID NO: 863749 - DNA, 23 bp, Homo sapiens
aggcagaggttttaatgtctgtt

SEQ ID NO: 863750 - DNA, 19 bp, Homo sapiens
aggcagagtttgccttcct

SEQ ID NO: 863751 - DNA, 19 bp, Homo sapiens
aggcagatcctctggacac

SEQ ID NO: 863752 - DNA, 20 bp, Homo sapiens
aggcagatctgtgccccatg

SEQ ID NO: 863753 - DNA, 23 bp, Homo sapiens
aggcagatgtggggctgagctgg

SEQ ID NO: 863754 - DNA, 15 bp, Homo sapiens
aggcagattgaaaag

SEQ ID NO: 863755 - DNA, 13 bp, Homo sapiens
aggcagcaccaca

SEQ ID NO: 863756 - DNA, 23 bp, Homo sapiens
aggcagcaccacactgggtgcgt

SEQ ID NO: 863757 - DNA, 15 bp, Homo sapiens
aggcagcagacacat

SEQ ID NO: 863758 - DNA, 22 bp, Homo sapiens
aggcagcagagagagaggacag

SEQ ID NO: 863759 - DNA, 23 bp, Homo sapiens
aggcagcagagagagaggacaga

SEQ ID NO: 863760 - DNA, 15 bp, Homo sapiens
aggcagcaggggctg

SEQ ID NO: 863761 - DNA, 22 bp, Homo sapiens
aggcagcagtgtgaggccaggg

SEQ ID NO: 863762 - DNA, 23 bp, Homo sapiens
aggcagcagtgtgaggccagggc

SEQ ID NO: 863763 - DNA, 18 bp, Homo sapiens
aggcagcatgcttgggct

SEQ ID NO: 863764 - DNA, 24 bp, Homo sapiens
aggcagcatgcttgggctgaccca

SEQ ID NO: 863765 - DNA, 21 bp, Homo sapiens
aggcagccccctccacaccag

SEQ ID NO: 863766 - DNA, 14 bp, Homo sapiens
aggcagcctccaga

SEQ ID NO: 863767 - DNA, 15 bp, Homo sapiens
aggcagcctccagag

SEQ ID NO: 863768 - DNA, 18 bp, Homo sapiens
aggcagcctccagagcca

SEQ ID NO: 863769 - DNA, 17 bp, Homo sapiens
aggcagcctgaacactc

SEQ ID NO: 863770 - DNA, 13 bp, Homo sapiens
aggcagcgcaggg

SEQ ID NO: 863771 - DNA, 19 bp, Homo sapiens
aggcagcgccaagtgcgtg

SEQ ID NO: 863772 - DNA, 21 bp, Homo sapiens
aggcagcgccaagtgcgtgcc

SEQ ID NO: 863773 - DNA, 17 bp, Homo sapiens
aggcagcgtgggctctg

SEQ ID NO: 863774 - DNA, 21 bp, Homo sapiens
aggcagcgtgggctctgccaa

SEQ ID NO: 863775 - DNA, 22 bp, Homo sapiens
aggcagcgtgggctctgccaat

SEQ ID NO: 863776 - DNA, 20 bp, Homo sapiens
aggcagctatttcagcctcc

SEQ ID NO: 863777 - DNA, 12 bp, Homo sapiens
aggcagctcacc

SEQ ID NO: 863778 - DNA, 13 bp, Homo sapiens
aggcagctcaccc

SEQ ID NO: 863779 - DNA, 17 bp, Homo sapiens
aggcagctcacccctgg

SEQ ID NO: 863780 - DNA, 14 bp, Homo sapiens
aggcagctccctcc

SEQ ID NO: 863781 - DNA, 16 bp, Homo sapiens
aggcagctccctcctg

SEQ ID NO: 863782 - DNA, 13 bp, Homo sapiens
aggcagctcttct

SEQ ID NO: 863783 - DNA, 11 bp, Homo sapiens
aggcagctgcc

SEQ ID NO: 863784 - DNA, 17 bp, Homo sapiens
aggcagctgcctctgct

SEQ ID NO: 863785 - DNA, 22 bp, Homo sapiens
aggcagctgcctctgctccctc

SEQ ID NO: 863786 - DNA, 23 bp, Homo sapiens
aggcagctgcctctgctccctct

SEQ ID NO: 863787 - DNA, 14 bp, Homo sapiens
aggcagctgctctt

SEQ ID NO: 863788 - DNA, 16 bp, Homo sapiens
aggcaggaacatacag

SEQ ID NO: 863789 - DNA, 16 bp, Homo sapiens
aggcaggaagggaagc

SEQ ID NO: 863790 - DNA, 20 bp, Homo sapiens
aggcaggaagggcaggaagg

SEQ ID NO: 863791 - DNA, 13 bp, Homo sapiens
aggcaggaatggg

SEQ ID NO: 863792 - DNA, 16 bp, Homo sapiens
aggcaggaatgggggt

SEQ ID NO: 863793 - DNA, 23 bp, Homo sapiens
aggcaggaccttcgggctgtgcc

SEQ ID NO: 863794 - DNA, 18 bp, Homo sapiens
aggcaggattgaaaatgt

SEQ ID NO: 863795 - DNA, 22 bp, Homo sapiens
aggcaggattgaaaatgtccag

SEQ ID NO: 863796 - DNA, 17 bp, Homo sapiens
aggcaggcactgtggcc

SEQ ID NO: 863797 - DNA, 13 bp, Homo sapiens
aggcaggcattga

SEQ ID NO: 863798 - DNA, 14 bp, Homo sapiens
aggcaggcattgag

SEQ ID NO: 863799 - DNA, 23 bp, Homo sapiens
aggcaggcattgaggaagagtct

SEQ ID NO: 863800 - DNA, 15 bp, Homo sapiens
aggcaggccagatgg

SEQ ID NO: 863801 - DNA, 12 bp, Homo sapiens
aggcaggcctcc

SEQ ID NO: 863802 - DNA, 15 bp, Homo sapiens
aggcaggcggctcct

SEQ ID NO: 863803 - DNA, 18 bp, Homo sapiens
aggcaggcggctcctcct

SEQ ID NO: 863804 - DNA, 22 bp, Homo sapiens
aggcagggaaaggctctgaaag

SEQ ID NO: 863805 - DNA, 12 bp, Homo sapiens
aggcagggaggg

SEQ ID NO: 863806 - DNA, 15 bp, Homo sapiens
aggcagggagggctt

SEQ ID NO: 863807 - DNA, 16 bp, Homo sapiens
aggcagggaggggact

SEQ ID NO: 863808 - DNA, 16 bp, Homo sapiens
aggcagggcagaggga

SEQ ID NO: 863809 - DNA, 19 bp, Homo sapiens
aggcagggccttgcccaga

SEQ ID NO: 863810 - DNA, 20 bp, Homo sapiens
aggcagggccttgcccagag

SEQ ID NO: 863811 - DNA, 21 bp, Homo sapiens
aggcagggccttgcccagaga

SEQ ID NO: 863812 - DNA, 15 bp, Homo sapiens
aggcagggctctccc

SEQ ID NO: 863813 - DNA, 11 bp, Homo sapiens
aggcagggctg

SEQ ID NO: 863814 - DNA, 12 bp, Homo sapiens
aggcagggctgg

SEQ ID NO: 863815 - DNA, 18 bp, Homo sapiens
aggcaggggacaagggag

SEQ ID NO: 863816 - DNA, 21 bp, Homo sapiens
aggcaggggacaagggaggca

SEQ ID NO: 863817 - DNA, 20 bp, Homo sapiens
aggcaggggcatctgtctgt

SEQ ID NO: 863818 - DNA, 21 bp, Homo sapiens
aggcaggggcccacttggggc

SEQ ID NO: 863819 - DNA, 18 bp, Homo sapiens
aggcaggggctgctgcct

SEQ ID NO: 863820 - DNA, 23 bp, Homo sapiens
aggcagggggaaggtggggtcct

SEQ ID NO: 863821 - DNA, 16 bp, Homo sapiens
aggcagggggccctgc

SEQ ID NO: 863822 - DNA, 18 bp, Homo sapiens
aggcagggggccctgccc

SEQ ID NO: 863823 - DNA, 17 bp, Homo sapiens
aggcaggggtgagagca

SEQ ID NO: 863824 - DNA, 22 bp, Homo sapiens
aggcaggggtgggagagccagc

SEQ ID NO: 863825 - DNA, 17 bp, Homo sapiens
aggcagggtcaggagag

SEQ ID NO: 863826 - DNA, 20 bp, Homo sapiens
aggcagggtcaggagagggg

SEQ ID NO: 863827 - DNA, 23 bp, Homo sapiens
aggcagggtcaggagaggggcag

SEQ ID NO: 863828 - DNA, 14 bp, Homo sapiens
aggcagggtgcagt

SEQ ID NO: 863829 - DNA, 17 bp, Homo sapiens
aggcaggtctgcaaggg

SEQ ID NO: 863830 - DNA, 23 bp, Homo sapiens
aggcaggtctgcaagggcccaga

SEQ ID NO: 863831 - DNA, 17 bp, Homo sapiens
aggcaggtgcctccagg

SEQ ID NO: 863832 - DNA, 13 bp, Homo sapiens
aggcaggtgcctg

SEQ ID NO: 863833 - DNA, 20 bp, Homo sapiens
aggcaggtttcatttcttat

SEQ ID NO: 863834 - DNA, 19 bp, Homo sapiens
aggcagtaataaaaagatt

SEQ ID NO: 863835 - DNA, 15 bp, Homo sapiens
aggcagtagttttca

SEQ ID NO: 863836 - DNA, 19 bp, Homo sapiens
aggcagtattttgtgtcct

SEQ ID NO: 863837 - DNA, 13 bp, Homo sapiens
aggcagtccagag

SEQ ID NO: 863838 - DNA, 14 bp, Homo sapiens
aggcagtcccggga

SEQ ID NO: 863839 - DNA, 18 bp, Homo sapiens
aggcagtcgggggctggc

SEQ ID NO: 863840 - DNA, 20 bp, Homo sapiens
aggcagtcgggggctggcct

SEQ ID NO: 863841 - DNA, 23 bp, Homo sapiens
aggcagtctctatattatgtctt

SEQ ID NO: 863842 - DNA, 13 bp, Homo sapiens
aggcagtgcatgc

SEQ ID NO: 863843 - DNA, 17 bp, Homo sapiens
aggcagtgcatgcatgt

SEQ ID NO: 863844 - DNA, 22 bp, Homo sapiens
aggcagtgcatgtgaagcatgc

SEQ ID NO: 863845 - DNA, 22 bp, Homo sapiens
aggcagtgcctgctctgctgtg

SEQ ID NO: 863846 - DNA, 21 bp, Homo sapiens
aggcagtgtggttatgttccc

SEQ ID NO: 863847 - DNA, 13 bp, Homo sapiens
aggcataaattaa

SEQ ID NO: 863848 - DNA, 22 bp, Homo sapiens
aggcataaattaaaatgtaaaa

SEQ ID NO: 863849 - DNA, 17 bp, Homo sapiens
aggcatacactgtagtt

SEQ ID NO: 863850 - DNA, 18 bp, Homo sapiens
aggcataggcctgggtgc

SEQ ID NO: 863851 - DNA, 22 bp, Homo sapiens
aggcataggtctctttgctttc

SEQ ID NO: 863852 - DNA, 22 bp, Homo sapiens
aggcatattgctttttctaatg

SEQ ID NO: 863853 - DNA, 17 bp, Homo sapiens
aggcatcaaaaaaacaa

SEQ ID NO: 863854 - DNA, 20 bp, Homo sapiens
aggcatcagtccctatgtat

SEQ ID NO: 863855 - DNA, 13 bp, Homo sapiens
aggcatcccaggg

SEQ ID NO: 863856 - DNA, 18 bp, Homo sapiens
aggcatcccaggggacca

SEQ ID NO: 863857 - DNA, 23 bp, Homo sapiens
aggcatcccaggggaccacacct

SEQ ID NO: 863858 - DNA, 20 bp, Homo sapiens
aggcatccttgtcttttgag

SEQ ID NO: 863859 - DNA, 23 bp, Homo sapiens
aggcatcgtcatgcacagtattt

SEQ ID NO: 863860 - DNA, 22 bp, Homo sapiens
aggcatctctgtactttgcttg

SEQ ID NO: 863861 - DNA, 14 bp, Homo sapiens
aggcatctgcaccc

SEQ ID NO: 863862 - DNA, 20 bp, Homo sapiens
aggcatctgttagcagagtc

SEQ ID NO: 863863 - DNA, 23 bp, Homo sapiens
aggcatctgttagcagagtctgt

SEQ ID NO: 863864 - DNA, 22 bp, Homo sapiens
aggcatcttttctagagacaca

SEQ ID NO: 863865 - DNA, 20 bp, Homo sapiens
aggcatgagggatcacaggg

SEQ ID NO: 863866 - DNA, 13 bp, Homo sapiens
aggcatgcctgtg

SEQ ID NO: 863867 - DNA, 13 bp, Homo sapiens
aggcatggccctg

SEQ ID NO: 863868 - DNA, 16 bp, Homo sapiens
aggcatggccctgggg

SEQ ID NO: 863869 - DNA, 21 bp, Homo sapiens
aggcatggccctggggtccca

SEQ ID NO: 863870 - DNA, 17 bp, Homo sapiens
aggcatggctcagagct

SEQ ID NO: 863871 - DNA, 21 bp, Homo sapiens
aggcatggctcagatcggcca

SEQ ID NO: 863872 - DNA, 19 bp, Homo sapiens
aggcatgggtgcaaggaaa

SEQ ID NO: 863873 - DNA, 16 bp, Homo sapiens
aggcatgtcagaggac

SEQ ID NO: 863874 - DNA, 23 bp, Homo sapiens
aggcatgtcagaggaccccaggg

SEQ ID NO: 863875 - DNA, 17 bp, Homo sapiens
aggcatgtcccacccac

SEQ ID NO: 863876 - DNA, 14 bp, Homo sapiens
aggcatgtgctggt

SEQ ID NO: 863877 - DNA, 23 bp, Homo sapiens
aggcatgtgtcaccatgcccagc

SEQ ID NO: 863878 - DNA, 22 bp, Homo sapiens
aggcattacttgctttcaattg

SEQ ID NO: 863879 - DNA, 14 bp, Homo sapiens
aggcattatttaat

SEQ ID NO: 863880 - DNA, 16 bp, Homo sapiens
aggcattatttaatgt

SEQ ID NO: 863881 - DNA, 17 bp, Homo sapiens
aggcattatttaatgtt

SEQ ID NO: 863882 - DNA, 17 bp, Homo sapiens
aggcattcctgaaggga

SEQ ID NO: 863883 - DNA, 14 bp, Homo sapiens
aggcattgccaagg

SEQ ID NO: 863884 - DNA, 21 bp, Homo sapiens
aggcattgccaagggctttgt

SEQ ID NO: 863885 - DNA, 22 bp, Homo sapiens
aggcattgctttgccctggagc

SEQ ID NO: 863886 - DNA, 13 bp, Homo sapiens
aggcattggatat

SEQ ID NO: 863887 - DNA, 16 bp, Homo sapiens
aggcattgtcctgtga

SEQ ID NO: 863888 - DNA, 20 bp, Homo sapiens
aggcattgttagtttagtgt

SEQ ID NO: 863889 - DNA, 17 bp, Homo sapiens
aggcatttaaaatggaa

SEQ ID NO: 863890 - DNA, 19 bp, Homo sapiens
aggcatttcattatgcttt

SEQ ID NO: 863891 - DNA, 12 bp, Homo sapiens
aggcatttcctg

SEQ ID NO: 863892 - DNA, 15 bp, Homo sapiens
aggcatttcctgctg

SEQ ID NO: 863893 - DNA, 20 bp, Homo sapiens
aggcatttctatcacatatt

SEQ ID NO: 863894 - DNA, 16 bp, Homo sapiens
aggcatttgctgaata

SEQ ID NO: 863895 - DNA, 20 bp, Homo sapiens
aggcatttgctgaatacaga

SEQ ID NO: 863896 - DNA, 23 bp, Homo sapiens
aggccaaaattaccaaaaatctt

SEQ ID NO: 863897 - DNA, 21 bp, Homo sapiens
aggccaaactggcaaacttca

SEQ ID NO: 863898 - DNA, 20 bp, Homo sapiens
aggccaaaggccagtggaag

SEQ ID NO: 863899 - DNA, 16 bp, Homo sapiens
aggccaaaggctggtg

SEQ ID NO: 863900 - DNA, 14 bp, Homo sapiens
aggccaaatgcaca

SEQ ID NO: 863901 - DNA, 17 bp, Homo sapiens
aggccaaatgcacaagc

SEQ ID NO: 863902 - DNA, 16 bp, Homo sapiens
aggccaagaatattgc

SEQ ID NO: 863903 - DNA, 19 bp, Homo sapiens
aggccaagaatattgcaaa

SEQ ID NO: 863904 - DNA, 20 bp, Homo sapiens
aggccaagaatattgcaaaa

SEQ ID NO: 863905 - DNA, 17 bp, Homo sapiens
aggccaagagcagaggc

SEQ ID NO: 863906 - DNA, 16 bp, Homo sapiens
aggccaaggcgggtgg

SEQ ID NO: 863907 - DNA, 18 bp, Homo sapiens
aggccaaggcgggtggat

SEQ ID NO: 863908 - DNA, 16 bp, Homo sapiens
aggccaaggtgggcgg

SEQ ID NO: 863909 - DNA, 17 bp, Homo sapiens
aggccaaggtgggcgga

SEQ ID NO: 863910 - DNA, 18 bp, Homo sapiens
aggccaagtcaggccctt

SEQ ID NO: 863911 - DNA, 14 bp, Homo sapiens
aggccaagtgcagg

SEQ ID NO: 863912 - DNA, 14 bp, Homo sapiens
aggccaataaaaag

SEQ ID NO: 863913 - DNA, 17 bp, Homo sapiens
aggccaataaaaagttc

SEQ ID NO: 863914 - DNA, 14 bp, Homo sapiens
aggccacaaaaaca

SEQ ID NO: 863915 - DNA, 18 bp, Homo sapiens
aggccacaggagacatta

SEQ ID NO: 863916 - DNA, 14 bp, Homo sapiens
aggccacaggcagt

SEQ ID NO: 863917 - DNA, 17 bp, Homo sapiens
aggccacagtggggctg

SEQ ID NO: 863918 - DNA, 21 bp, Homo sapiens
aggccacagtggggctgcagg

SEQ ID NO: 863919 - DNA, 12 bp, Homo sapiens
aggccaccagga

SEQ ID NO: 863920 - DNA, 20 bp, Homo sapiens
aggccaccattataatttat

SEQ ID NO: 863921 - DNA, 17 bp, Homo sapiens
aggccacccgggctgcc

SEQ ID NO: 863922 - DNA, 14 bp, Homo sapiens
aggccacctcccca

SEQ ID NO: 863923 - DNA, 17 bp, Homo sapiens
aggccacctccccagca

SEQ ID NO: 863924 - DNA, 14 bp, Homo sapiens
aggccacctgcccc

SEQ ID NO: 863925 - DNA, 22 bp, Homo sapiens
aggccacctgcccccttctccc

SEQ ID NO: 863926 - DNA, 17 bp, Homo sapiens
aggccacgtcccacccc

SEQ ID NO: 863927 - DNA, 17 bp, Homo sapiens
aggccactagtgacagt

SEQ ID NO: 863928 - DNA, 14 bp, Homo sapiens
aggccactcctcca

SEQ ID NO: 863929 - DNA, 17 bp, Homo sapiens
aggccactgtggccaga

SEQ ID NO: 863930 - DNA, 20 bp, Homo sapiens
aggccactgtggccagagct

SEQ ID NO: 863931 - DNA, 15 bp, Homo sapiens
aggccagaaggaggg

SEQ ID NO: 863932 - DNA, 16 bp, Homo sapiens
aggccagaccatggac

SEQ ID NO: 863933 - DNA, 17 bp, Homo sapiens
aggccagaccatggaca

SEQ ID NO: 863934 - DNA, 21 bp, Homo sapiens
aggccagacttggtcctaagc

SEQ ID NO: 863935 - DNA, 15 bp, Homo sapiens
aggccagagggcagt

SEQ ID NO: 863936 - DNA, 18 bp, Homo sapiens
aggccagagggcagtggc

SEQ ID NO: 863937 - DNA, 21 bp, Homo sapiens
aggccagagtcaccttttctg

SEQ ID NO: 863938 - DNA, 17 bp, Homo sapiens
aggccagagtctcccag

SEQ ID NO: 863939 - DNA, 16 bp, Homo sapiens
aggccagatggcccct

SEQ ID NO: 863940 - DNA, 11 bp, Homo sapiens
aggccagccca

SEQ ID NO: 863941 - DNA, 16 bp, Homo sapiens
aggccagcccagccag

SEQ ID NO: 863942 - DNA, 11 bp, Homo sapiens
aggccagcccc

SEQ ID NO: 863943 - DNA, 16 bp, Homo sapiens
aggccagccccaccca

SEQ ID NO: 863944 - DNA, 17 bp, Homo sapiens
aggccagccccacccag

SEQ ID NO: 863945 - DNA, 21 bp, Homo sapiens
aggccagccccacccaggagg

SEQ ID NO: 863946 - DNA, 10 bp, Homo sapiens
aggccagcct

SEQ ID NO: 863947 - DNA, 13 bp, Homo sapiens
aggccagcctccg

SEQ ID NO: 863948 - DNA, 19 bp, Homo sapiens
aggccagctgccccagcca

SEQ ID NO: 863949 - DNA, 17 bp, Homo sapiens
aggccaggccaccagga

SEQ ID NO: 863950 - DNA, 14 bp, Homo sapiens
aggccagggctcac

SEQ ID NO: 863951 - DNA, 21 bp, Homo sapiens
aggccagggctcaccagctgg

SEQ ID NO: 863952 - DNA, 10 bp, Homo sapiens
aggccaggta

SEQ ID NO: 863953 - DNA, 20 bp, Homo sapiens
aggccagtccccatttctgc

SEQ ID NO: 863954 - DNA, 22 bp, Homo sapiens
aggccagtccccatttctgcct

SEQ ID NO: 863955 - DNA, 14 bp, Homo sapiens
aggccagtggcccc

SEQ ID NO: 863956 - DNA, 22 bp, Homo sapiens
aggccagtggcccccgggcctg

SEQ ID NO: 863957 - DNA, 20 bp, Homo sapiens
aggccagtgttgtgggcttc

SEQ ID NO: 863958 - DNA, 20 bp, Homo sapiens
aggccagttgatctgctctg

SEQ ID NO: 863959 - DNA, 15 bp, Homo sapiens
aggccatatttccat

SEQ ID NO: 863960 - DNA, 18 bp, Homo sapiens
aggccatcagggccctgc

SEQ ID NO: 863961 - DNA, 20 bp, Homo sapiens
aggccatcagggccctgccc

SEQ ID NO: 863962 - DNA, 17 bp, Homo sapiens
aggccatctcaggagat

SEQ ID NO: 863963 - DNA, 16 bp, Homo sapiens
aggccatctgtaaata

SEQ ID NO: 863964 - DNA, 13 bp, Homo sapiens
aggccatgaaaaa

SEQ ID NO: 863965 - DNA, 21 bp, Homo sapiens
aggccatgattcgcccaaagc

SEQ ID NO: 863966 - DNA, 19 bp, Homo sapiens
aggccatgtgagccaccgc

SEQ ID NO: 863967 - DNA, 16 bp, Homo sapiens
aggccattctgccgcc

SEQ ID NO: 863968 - DNA, 14 bp, Homo sapiens
aggccattgggttt

SEQ ID NO: 863969 - DNA, 18 bp, Homo sapiens
aggccattgtgaaccaat

SEQ ID NO: 863970 - DNA, 13 bp, Homo sapiens
aggcccaaatgat

SEQ ID NO: 863971 - DNA, 15 bp, Homo sapiens
aggcccaaatgatgg

SEQ ID NO: 863972 - DNA, 14 bp, Homo sapiens
aggcccaacctcct

SEQ ID NO: 863973 - DNA, 22 bp, Homo sapiens
aggcccaagagcagagtctggg

SEQ ID NO: 863974 - DNA, 17 bp, Homo sapiens
aggcccaaggctcccgg

SEQ ID NO: 863975 - DNA, 18 bp, Homo sapiens
aggcccaaggtcccctcc

SEQ ID NO: 863976 - DNA, 17 bp, Homo sapiens
aggcccacgaggagcag

SEQ ID NO: 863977 - DNA, 22 bp, Homo sapiens
aggcccactagagggcccatca

SEQ ID NO: 863978 - DNA, 15 bp, Homo sapiens
aggcccactccccag

SEQ ID NO: 863979 - DNA, 16 bp, Homo sapiens
aggcccactgtgcctc

SEQ ID NO: 863980 - DNA, 10 bp, Homo sapiens
aggcccagca

SEQ ID NO: 863981 - DNA, 13 bp, Homo sapiens
aggcccagcatgc

SEQ ID NO: 863982 - DNA, 15 bp, Homo sapiens
aggcccagcatgcag

SEQ ID NO: 863983 - DNA, 16 bp, Homo sapiens
aggcccagcatgcagg

SEQ ID NO: 863984 - DNA, 19 bp, Homo sapiens
aggcccagcattgctggtt

SEQ ID NO: 863985 - DNA, 20 bp, Homo sapiens
aggcccagcattgctggttc

SEQ ID NO: 863986 - DNA, 14 bp, Homo sapiens
aggcccagccccta

SEQ ID NO: 863987 - DNA, 15 bp, Homo sapiens
aggcccagcccctag

SEQ ID NO: 863988 - DNA, 16 bp, Homo sapiens
aggcccagcccctaga

SEQ ID NO: 863989 - DNA, 19 bp, Homo sapiens
aggcccagcccctagaaac

SEQ ID NO: 863990 - DNA, 21 bp, Homo sapiens
aggcccagccctccttcaggg

SEQ ID NO: 863991 - DNA, 17 bp, Homo sapiens
aggcccagcctgtcctg

SEQ ID NO: 863992 - DNA, 19 bp, Homo sapiens
aggcccaggcaccaccagg

SEQ ID NO: 863993 - DNA, 21 bp, Homo sapiens
aggcccaggcaccaccaggag

SEQ ID NO: 863994 - DNA, 11 bp, Homo sapiens
aggcccaggcc

SEQ ID NO: 863995 - DNA, 15 bp, Homo sapiens
aggcccaggccagcc

SEQ ID NO: 863996 - DNA, 16 bp, Homo sapiens
aggcccaggctgggaa

SEQ ID NO: 863997 - DNA, 17 bp, Homo sapiens
aggcccaggctgggaac

SEQ ID NO: 863998 - DNA, 15 bp, Homo sapiens
aggcccagggaggca

SEQ ID NO: 863999 - DNA, 16 bp, Homo sapiens
aggcccagggaggcag

SEQ ID NO: 864000 - DNA, 18 bp, Homo sapiens
aggcccagggaggcagcg

SEQ ID NO: 864001 - DNA, 22 bp, Homo sapiens
aggcccagtgacaaagactcct

SEQ ID NO: 864002 - DNA, 20 bp, Homo sapiens
aggcccatgcccccttcgct

SEQ ID NO: 864003 - DNA, 12 bp, Homo sapiens
aggcccatgcta

SEQ ID NO: 864004 - DNA, 18 bp, Homo sapiens
aggcccatggttgagaaa

SEQ ID NO: 864005 - DNA, 23 bp, Homo sapiens
aggcccattgtcctccttttcac

SEQ ID NO: 864006 - DNA, 22 bp, Homo sapiens
aggccccaatcttgcccactgg

SEQ ID NO: 864007 - DNA, 21 bp, Homo sapiens
aggccccaccaagagggtgga

SEQ ID NO: 864008 - DNA, 20 bp, Homo sapiens
aggccccacgccctctcctc

SEQ ID NO: 864009 - DNA, 16 bp, Homo sapiens
aggccccactccttcc

SEQ ID NO: 864010 - DNA, 11 bp, Homo sapiens
aggccccagac

SEQ ID NO: 864011 - DNA, 20 bp, Homo sapiens
aggccccagagactcagagg

SEQ ID NO: 864012 - DNA, 22 bp, Homo sapiens
aggccccagagagaccctgcaa

SEQ ID NO: 864013 - DNA, 15 bp, Homo sapiens
aggccccagcctcca

SEQ ID NO: 864014 - DNA, 13 bp, Homo sapiens
aggccccagggac

SEQ ID NO: 864015 - DNA, 14 bp, Homo sapiens
aggccccagggaca

SEQ ID NO: 864016 - DNA, 15 bp, Homo sapiens
aggccccagggacag

SEQ ID NO: 864017 - DNA, 18 bp, Homo sapiens
aggcccccacttgcctct

SEQ ID NO: 864018 - DNA, 20 bp, Homo sapiens
aggcccccacttgcctcttc

SEQ ID NO: 864019 - DNA, 17 bp, Homo sapiens
aggcccccagcccaggg

SEQ ID NO: 864020 - DNA, 23 bp, Homo sapiens
aggcccccagcccagggctcctg

SEQ ID NO: 864021 - DNA, 16 bp, Homo sapiens
aggcccccagtgggga

SEQ ID NO: 864022 - DNA, 22 bp, Homo sapiens
aggccccccagaaagctgccag

SEQ ID NO: 864023 - DNA, 18 bp, Homo sapiens
aggcccccggctttcctc

SEQ ID NO: 864024 - DNA, 21 bp, Homo sapiens
aggcccccggctttcctccgg

SEQ ID NO: 864025 - DNA, 15 bp, Homo sapiens
aggccccgcttgtcc

SEQ ID NO: 864026 - DNA, 21 bp, Homo sapiens
aggcccctatgtagtccgtgc

SEQ ID NO: 864027 - DNA, 21 bp, Homo sapiens
aggcccctctgtggagcgccc

SEQ ID NO: 864028 - DNA, 15 bp, Homo sapiens
aggcccctgaggact

SEQ ID NO: 864029 - DNA, 16 bp, Homo sapiens
aggcccctggcccagc

SEQ ID NO: 864030 - DNA, 20 bp, Homo sapiens
aggcccgctctacatcttct

SEQ ID NO: 864031 - DNA, 19 bp, Homo sapiens
aggcccggcccagcctagg

SEQ ID NO: 864032 - DNA, 14 bp, Homo sapiens
aggcccggggctgg

SEQ ID NO: 864033 - DNA, 22 bp, Homo sapiens
aggccctaggcgggatgggctc

SEQ ID NO: 864034 - DNA, 12 bp, Homo sapiens
aggccctcccac

SEQ ID NO: 864035 - DNA, 13 bp, Homo sapiens
aggccctcccacc

SEQ ID NO: 864036 - DNA, 16 bp, Homo sapiens
aggccctcccaccacc

SEQ ID NO: 864037 - DNA, 17 bp, Homo sapiens
aggccctcccaccaccc

SEQ ID NO: 864038 - DNA, 20 bp, Homo sapiens
aggccctcccaccaccccat

SEQ ID NO: 864039 - DNA, 12 bp, Homo sapiens
aggccctccctc

SEQ ID NO: 864040 - DNA, 22 bp, Homo sapiens
aggccctccctctactcttcct

SEQ ID NO: 864041 - DNA, 14 bp, Homo sapiens
aggccctccctgac

SEQ ID NO: 864042 - DNA, 22 bp, Homo sapiens
aggccctccctgactccctgtg

SEQ ID NO: 864043 - DNA, 23 bp, Homo sapiens
aggccctccctgactccctgtgg

SEQ ID NO: 864044 - DNA, 22 bp, Homo sapiens
aggccctcgctgccagctctgt

SEQ ID NO: 864045 - DNA, 13 bp, Homo sapiens
aggccctcggagc

SEQ ID NO: 864046 - DNA, 19 bp, Homo sapiens
aggccctcggagctggctg

SEQ ID NO: 864047 - DNA, 17 bp, Homo sapiens
aggccctcggtcagcga

SEQ ID NO: 864048 - DNA, 12 bp, Homo sapiens
aggccctctgcc

SEQ ID NO: 864049 - DNA, 13 bp, Homo sapiens
aggccctgaagcc

SEQ ID NO: 864050 - DNA, 15 bp, Homo sapiens
aggccctgaagcctc

SEQ ID NO: 864051 - DNA, 15 bp, Homo sapiens
aggccctgactcctc

SEQ ID NO: 864052 - DNA, 17 bp, Homo sapiens
aggccctgactcctctg

SEQ ID NO: 864053 - DNA, 20 bp, Homo sapiens
aggccctgactcctctggct

SEQ ID NO: 864054 - DNA, 15 bp, Homo sapiens
aggccctgagacagg

SEQ ID NO: 864055 - DNA, 21 bp, Homo sapiens
aggccctgaggcggaggctgt

SEQ ID NO: 864056 - DNA, 13 bp, Homo sapiens
aggccctgccagt

SEQ ID NO: 864057 - DNA, 19 bp, Homo sapiens
aggccctgccattggcctc

SEQ ID NO: 864058 - DNA, 21 bp, Homo sapiens
aggccctgccattggcctctt

SEQ ID NO: 864059 - DNA, 22 bp, Homo sapiens
aggccctgccattggcctcttg

SEQ ID NO: 864060 - DNA, 12 bp, Homo sapiens
aggccctgccca

SEQ ID NO: 864061 - DNA, 12 bp, Homo sapiens
aggccctgctcc

SEQ ID NO: 864062 - DNA, 17 bp, Homo sapiens
aggccctgctcctgcag

SEQ ID NO: 864063 - DNA, 22 bp, Homo sapiens
aggccctgctcctgcagcatgg

SEQ ID NO: 864064 - DNA, 16 bp, Homo sapiens
aggccctgctgagtca

SEQ ID NO: 864065 - DNA, 18 bp, Homo sapiens
aggccctgctttttttct

SEQ ID NO: 864066 - DNA, 20 bp, Homo sapiens
aggccctgctttttttctta

SEQ ID NO: 864067 - DNA, 21 bp, Homo sapiens
aggccctgctttttttcttaa

SEQ ID NO: 864068 - DNA, 21 bp, Homo sapiens
aggccctggcctcccctgcca

SEQ ID NO: 864069 - DNA, 23 bp, Homo sapiens
aggccctggcctcccctgccacc

SEQ ID NO: 864070 - DNA, 20 bp, Homo sapiens
aggccctgggctgggtgctg

SEQ ID NO: 864071 - DNA, 18 bp, Homo sapiens
aggccctggtcctggcct

SEQ ID NO: 864072 - DNA, 13 bp, Homo sapiens
aggccctgtctgt

SEQ ID NO: 864073 - DNA, 19 bp, Homo sapiens
aggccctgtggtctgggga

SEQ ID NO: 864074 - DNA, 16 bp, Homo sapiens
aggccctgttccctgg

SEQ ID NO: 864075 - DNA, 20 bp, Homo sapiens
aggcccttattttcaagaaa

SEQ ID NO: 864076 - DNA, 18 bp, Homo sapiens
aggcccttcctctccact

SEQ ID NO: 864077 - DNA, 19 bp, Homo sapiens
aggcccttcctctccactg

SEQ ID NO: 864078 - DNA, 22 bp, Homo sapiens
aggcccttcctctccactgcct

SEQ ID NO: 864079 - DNA, 18 bp, Homo sapiens
aggcccttggctgcaggc

SEQ ID NO: 864080 - DNA, 18 bp, Homo sapiens
aggcccttgtcattgcct

SEQ ID NO: 864081 - DNA, 13 bp, Homo sapiens
aggcccttgtcct

SEQ ID NO: 864082 - DNA, 19 bp, Homo sapiens
aggcccttgtcctgccagc

SEQ ID NO: 864083 - DNA, 20 bp, Homo sapiens
aggcccttgtcctgccagct

SEQ ID NO: 864084 - DNA, 21 bp, Homo sapiens
aggcccttgtcctgccagctg

SEQ ID NO: 864085 - DNA, 16 bp, Homo sapiens
aggccgaagctctggc

SEQ ID NO: 864086 - DNA, 19 bp, Homo sapiens
aggccgaagctctggctga

SEQ ID NO: 864087 - DNA, 23 bp, Homo sapiens
aggccgaagctctggctgaaccc

SEQ ID NO: 864088 - DNA, 18 bp, Homo sapiens
aggccgacgttttctccg

SEQ ID NO: 864089 - DNA, 20 bp, Homo sapiens
aggccgaggataaagaaaag

SEQ ID NO: 864090 - DNA, 14 bp, Homo sapiens
aggccgaggcaggt

SEQ ID NO: 864091 - DNA, 17 bp, Homo sapiens
aggccgagggccaggca

SEQ ID NO: 864092 - DNA, 16 bp, Homo sapiens
aggccgaggtgggcag

SEQ ID NO: 864093 - DNA, 12 bp, Homo sapiens
aggccgcagctc

SEQ ID NO: 864094 - DNA, 20 bp, Homo sapiens
aggccgcagctccattttct

SEQ ID NO: 864095 - DNA, 13 bp, Homo sapiens
aggccgcagctct

SEQ ID NO: 864096 - DNA, 16 bp, Homo sapiens
aggccgcagctcttgc

SEQ ID NO: 864097 - DNA, 21 bp, Homo sapiens
aggccgccagcgtgtggagca

SEQ ID NO: 864098 - DNA, 22 bp, Homo sapiens
aggccgccagcgtgtggagcag

SEQ ID NO: 864099 - DNA, 18 bp, Homo sapiens
aggccgcgcgtccagctg

SEQ ID NO: 864100 - DNA, 15 bp, Homo sapiens
aggccgcggcccaga

SEQ ID NO: 864101 - DNA, 13 bp, Homo sapiens
aggccgcggcctc

SEQ ID NO: 864102 - DNA, 17 bp, Homo sapiens
aggccgctgttcaccca

SEQ ID NO: 864103 - DNA, 18 bp, Homo sapiens
aggccgcttagtgctgct

SEQ ID NO: 864104 - DNA, 23 bp, Homo sapiens
aggccgcttagtgctgctttgct

SEQ ID NO: 864105 - DNA, 18 bp, Homo sapiens
aggccggagagctggtga

SEQ ID NO: 864106 - DNA, 22 bp, Homo sapiens
aggccggagagctggtgacttt

SEQ ID NO: 864107 - DNA, 14 bp, Homo sapiens
aggccggagcccag

SEQ ID NO: 864108 - DNA, 15 bp, Homo sapiens
aggccggagcccaga

SEQ ID NO: 864109 - DNA, 15 bp, Homo sapiens
aggccggcccagatg

SEQ ID NO: 864110 - DNA, 21 bp, Homo sapiens
aggccgggaagagccacctgg

SEQ ID NO: 864111 - DNA, 16 bp, Homo sapiens
aggccggggtccaggc

SEQ ID NO: 864112 - DNA, 22 bp, Homo sapiens
aggccgtcctcccgggccctcc

SEQ ID NO: 864113 - DNA, 13 bp, Homo sapiens
aggccgtgtctct

SEQ ID NO: 864114 - DNA, 16 bp, Homo sapiens
aggccgtgtctctgag

SEQ ID NO: 864115 - DNA, 13 bp, Homo sapiens
aggcctaagacat

SEQ ID NO: 864116 - DNA, 19 bp, Homo sapiens
aggcctaattctatgcctg

SEQ ID NO: 864117 - DNA, 19 bp, Homo sapiens
aggcctaatttttttttgt

SEQ ID NO: 864118 - DNA, 19 bp, Homo sapiens
aggcctacagaaattgaaa

SEQ ID NO: 864119 - DNA, 21 bp, Homo sapiens
aggcctacagaggaggcctca

SEQ ID NO: 864120 - DNA, 14 bp, Homo sapiens
aggcctacctcaag

SEQ ID NO: 864121 - DNA, 20 bp, Homo sapiens
aggcctacctcaagttcttg

SEQ ID NO: 864122 - DNA, 14 bp, Homo sapiens
aggcctagactctg

SEQ ID NO: 864123 - DNA, 21 bp, Homo sapiens
aggcctagactctgtctacct

SEQ ID NO: 864124 - DNA, 17 bp, Homo sapiens
aggcctaggtgcagctc

SEQ ID NO: 864125 - DNA, 22 bp, Homo sapiens
aggcctatgcagacatctctgg

SEQ ID NO: 864126 - DNA, 21 bp, Homo sapiens
aggcctatttcatcacaagaa

SEQ ID NO: 864127 - DNA, 13 bp, Homo sapiens
aggcctcaagaac

SEQ ID NO: 864128 - DNA, 13 bp, Homo sapiens
aggcctcactggc

SEQ ID NO: 864129 - DNA, 20 bp, Homo sapiens
aggcctcactggctcatgcc

SEQ ID NO: 864130 - DNA, 16 bp, Homo sapiens
aggcctcagccagaga

SEQ ID NO: 864131 - DNA, 15 bp, Homo sapiens
aggcctcaggtgctg

SEQ ID NO: 864132 - DNA, 15 bp, Homo sapiens
aggcctcagtggact

SEQ ID NO: 864133 - DNA, 16 bp, Homo sapiens
aggcctcagtggactt

SEQ ID NO: 864134 - DNA, 16 bp, Homo sapiens
aggcctcatccctcgg

SEQ ID NO: 864135 - DNA, 15 bp, Homo sapiens
aggcctcatttcttt

SEQ ID NO: 864136 - DNA, 21 bp, Homo sapiens
aggcctccaacgcccctgtgg

SEQ ID NO: 864137 - DNA, 14 bp, Homo sapiens
aggcctccagcctc

SEQ ID NO: 864138 - DNA, 22 bp, Homo sapiens
aggcctccagcctctcccggct

SEQ ID NO: 864139 - DNA, 12 bp, Homo sapiens
aggcctccccaa

SEQ ID NO: 864140 - DNA, 18 bp, Homo sapiens
aggcctccctagcacctc

SEQ ID NO: 864141 - DNA, 15 bp, Homo sapiens
aggcctccctctctc

SEQ ID NO: 864142 - DNA, 16 bp, Homo sapiens
aggcctccgtcttccc

SEQ ID NO: 864143 - DNA, 12 bp, Homo sapiens
aggcctcctagg

SEQ ID NO: 864144 - DNA, 16 bp, Homo sapiens
aggcctcgcacttgca

SEQ ID NO: 864145 - DNA, 21 bp, Homo sapiens
aggcctcgcacttgcagagga

SEQ ID NO: 864146 - DNA, 24 bp, Homo sapiens
aggcctcggcagaactctctgtct

SEQ ID NO: 864147 - DNA, 12 bp, Homo sapiens
aggcctctctct

SEQ ID NO: 864148 - DNA, 17 bp, Homo sapiens
aggcctctctctgctcc

SEQ ID NO: 864149 - DNA, 11 bp, Homo sapiens
aggcctctggt

SEQ ID NO: 864150 - DNA, 19 bp, Homo sapiens
aggcctctggttgcctccc

SEQ ID NO: 864151 - DNA, 14 bp, Homo sapiens
aggcctcttcctgt

SEQ ID NO: 864152 - DNA, 22 bp, Homo sapiens
aggcctcttcctgttgtgactg

SEQ ID NO: 864153 - DNA, 22 bp, Homo sapiens
aggcctcttggacctctgctct

SEQ ID NO: 864154 - DNA, 14 bp, Homo sapiens
aggcctcttgtgct

SEQ ID NO: 864155 - DNA, 19 bp, Homo sapiens
aggcctgaatcatgagcct

SEQ ID NO: 864156 - DNA, 21 bp, Homo sapiens
aggcctgacttctgctggcat

SEQ ID NO: 864157 - DNA, 19 bp, Homo sapiens
aggcctgagaatgagtggg

SEQ ID NO: 864158 - DNA, 20 bp, Homo sapiens
aggcctgagaatgagtggga

SEQ ID NO: 864159 - DNA, 17 bp, Homo sapiens
aggcctgaggatgagct

SEQ ID NO: 864160 - DNA, 18 bp, Homo sapiens
aggcctgaggatgagctg

SEQ ID NO: 864161 - DNA, 18 bp, Homo sapiens
aggcctgatcttgcctgt

SEQ ID NO: 864162 - DNA, 16 bp, Homo sapiens
aggcctgatgctgccc

SEQ ID NO: 864163 - DNA, 14 bp, Homo sapiens
aggcctgccccctg

SEQ ID NO: 864164 - DNA, 19 bp, Homo sapiens
aggcctgccccctgggctg

SEQ ID NO: 864165 - DNA, 11 bp, Homo sapiens
aggcctgccct

SEQ ID NO: 864166 - DNA, 16 bp, Homo sapiens
aggcctgccctcaggg

SEQ ID NO: 864167 - DNA, 19 bp, Homo sapiens
aggcctgccctcccatgtt

SEQ ID NO: 864168 - DNA, 20 bp, Homo sapiens
aggcctgctgccagtgcagc

SEQ ID NO: 864169 - DNA, 12 bp, Homo sapiens
aggcctgctggc

SEQ ID NO: 864170 - DNA, 15 bp, Homo sapiens
aggcctgctggcatc

SEQ ID NO: 864171 - DNA, 18 bp, Homo sapiens
aggcctggaaccagggag

SEQ ID NO: 864172 - DNA, 19 bp, Homo sapiens
aggcctggaaccagggagg

SEQ ID NO: 864173 - DNA, 22 bp, Homo sapiens
aggcctggaccgagatgtgagt

SEQ ID NO: 864174 - DNA, 19 bp, Homo sapiens
aggcctggactttcctgca

SEQ ID NO: 864175 - DNA, 15 bp, Homo sapiens
aggcctggagcccac

SEQ ID NO: 864176 - DNA, 15 bp, Homo sapiens
aggcctggagggcac

SEQ ID NO: 864177 - DNA, 16 bp, Homo sapiens
aggcctggccaggcac

SEQ ID NO: 864178 - DNA, 18 bp, Homo sapiens
aggcctggcgtcggccag

SEQ ID NO: 864179 - DNA, 20 bp, Homo sapiens
aggcctggcgtcggccagag

SEQ ID NO: 864180 - DNA, 24 bp, Homo sapiens
aggcctggctccccgagggctcag

SEQ ID NO: 864181 - DNA, 19 bp, Homo sapiens
aggcctgggacccagctac

SEQ ID NO: 864182 - DNA, 18 bp, Homo sapiens
aggcctgggcaggaccct

SEQ ID NO: 864183 - DNA, 19 bp, Homo sapiens
aggcctgggcaggaccctg

SEQ ID NO: 864184 - DNA, 22 bp, Homo sapiens
aggcctgggggacccctggctc

SEQ ID NO: 864185 - DNA, 18 bp, Homo sapiens
aggcctggggtgggacag

SEQ ID NO: 864186 - DNA, 16 bp, Homo sapiens
aggcctgtccaccctg

SEQ ID NO: 864187 - DNA, 16 bp, Homo sapiens
aggcctgtttggcctc

SEQ ID NO: 864188 - DNA, 19 bp, Homo sapiens
aggccttatcattcattct

SEQ ID NO: 864189 - DNA, 17 bp, Homo sapiens
aggccttatctccaaga

SEQ ID NO: 864190 - DNA, 20 bp, Homo sapiens
aggccttcagtttatttcca

SEQ ID NO: 864191 - DNA, 18 bp, Homo sapiens
aggccttccagctgctgt

SEQ ID NO: 864192 - DNA, 15 bp, Homo sapiens
aggccttccctgtca

SEQ ID NO: 864193 - DNA, 15 bp, Homo sapiens
aggccttcctctctc

SEQ ID NO: 864194 - DNA, 22 bp, Homo sapiens
aggccttctcttgaggcctgtg

SEQ ID NO: 864195 - DNA, 20 bp, Homo sapiens
aggccttctgtggggctggg

SEQ ID NO: 864196 - DNA, 21 bp, Homo sapiens
aggccttctgtggggctgggc

SEQ ID NO: 864197 - DNA, 16 bp, Homo sapiens
aggccttgcctggcct

SEQ ID NO: 864198 - DNA, 15 bp, Homo sapiens
aggccttgctcactc

SEQ ID NO: 864199 - DNA, 20 bp, Homo sapiens
aggccttgctggggtccagg

SEQ ID NO: 864200 - DNA, 17 bp, Homo sapiens
aggccttggggtggggg

SEQ ID NO: 864201 - DNA, 22 bp, Homo sapiens
aggccttggggtgggggccagg

SEQ ID NO: 864202 - DNA, 21 bp, Homo sapiens
aggccttgggtggccccctct

SEQ ID NO: 864203 - DNA, 23 bp, Homo sapiens
aggccttggtggagcagccagag

SEQ ID NO: 864204 - DNA, 12 bp, Homo sapiens
aggcctttcttc

SEQ ID NO: 864205 - DNA, 15 bp, Homo sapiens
aggcctttcttctgt

SEQ ID NO: 864206 - DNA, 17 bp, Homo sapiens
aggcctttggaggggaa

SEQ ID NO: 864207 - DNA, 14 bp, Homo sapiens
aggcgagcctgact

SEQ ID NO: 864208 - DNA, 19 bp, Homo sapiens
aggcgagctccttgaagaa

SEQ ID NO: 864209 - DNA, 13 bp, Homo sapiens
aggcgagtccagg

SEQ ID NO: 864210 - DNA, 14 bp, Homo sapiens
aggcgagtgccagg

SEQ ID NO: 864211 - DNA, 17 bp, Homo sapiens
aggcgagtgccaggact

SEQ ID NO: 864212 - DNA, 18 bp, Homo sapiens
aggcgagtgccaggactc

SEQ ID NO: 864213 - DNA, 15 bp, Homo sapiens
aggcgatgccacgct

SEQ ID NO: 864214 - DNA, 22 bp, Homo sapiens
aggcgcactgtgacccccagct

SEQ ID NO: 864215 - DNA, 22 bp, Homo sapiens
aggcgcagggacatggggcaag

SEQ ID NO: 864216 - DNA, 17 bp, Homo sapiens
aggcgcatgtctgcacc

SEQ ID NO: 864217 - DNA, 18 bp, Homo sapiens
aggcgcatgtctgcacct

SEQ ID NO: 864218 - DNA, 11 bp, Homo sapiens
aggcgcccccg

SEQ ID NO: 864219 - DNA, 14 bp, Homo sapiens
aggcgcctggtgtg

SEQ ID NO: 864220 - DNA, 16 bp, Homo sapiens
aggcgcgtctgcccca

SEQ ID NO: 864221 - DNA, 15 bp, Homo sapiens
aggcgctgctggtgt

SEQ ID NO: 864222 - DNA, 14 bp, Homo sapiens
aggcgctgggtgcc

SEQ ID NO: 864223 - DNA, 18 bp, Homo sapiens
aggcgctgggtgcctgca

SEQ ID NO: 864224 - DNA, 16 bp, Homo sapiens
aggcgcttctccaatg

SEQ ID NO: 864225 - DNA, 22 bp, Homo sapiens
aggcgcttctccaatgctctgg

SEQ ID NO: 864226 - DNA, 24 bp, Homo sapiens
aggcggagagtacagtgagccaag

SEQ ID NO: 864227 - DNA, 22 bp, Homo sapiens
aggcggcagctcttctgggcag

SEQ ID NO: 864228 - DNA, 11 bp, Homo sapiens
aggcggccagg

SEQ ID NO: 864229 - DNA, 20 bp, Homo sapiens
aggcggccagggcggccagg

SEQ ID NO: 864230 - DNA, 15 bp, Homo sapiens
aggcggccctgggga

SEQ ID NO: 864231 - DNA, 16 bp, Homo sapiens
aggcggcgatttttgt

SEQ ID NO: 864232 - DNA, 20 bp, Homo sapiens
aggcggctcctcctcaccca

SEQ ID NO: 864233 - DNA, 21 bp, Homo sapiens
aggcgggcatggcgtggagga

SEQ ID NO: 864234 - DNA, 23 bp, Homo sapiens
aggcgggccagccaggcgggctc

SEQ ID NO: 864235 - DNA, 19 bp, Homo sapiens
aggcgggccggggcaggga

SEQ ID NO: 864236 - DNA, 13 bp, Homo sapiens
aggcggggcagta

SEQ ID NO: 864237 - DNA, 20 bp, Homo sapiens
aggcggggtattcccactca

SEQ ID NO: 864238 - DNA, 15 bp, Homo sapiens
aggcggtcatgtgtg

SEQ ID NO: 864239 - DNA, 19 bp, Homo sapiens
aggcggtcatgtgtgcatg

SEQ ID NO: 864240 - DNA, 22 bp, Homo sapiens
aggcggtcatgtgtgcatgtga

SEQ ID NO: 864241 - DNA, 22 bp, Homo sapiens
aggcggtgcggcagggaagagg

SEQ ID NO: 864242 - DNA, 19 bp, Homo sapiens
aggcgtcaccatccacctt

SEQ ID NO: 864243 - DNA, 21 bp, Homo sapiens
aggcgtccgcgcgccagcaca

SEQ ID NO: 864244 - DNA, 21 bp, Homo sapiens
aggcgtctgtatattttggga

SEQ ID NO: 864245 - DNA, 22 bp, Homo sapiens
aggcgtcttcatctccctgcca

SEQ ID NO: 864246 - DNA, 23 bp, Homo sapiens
aggcgtcttcatctccctgccat

SEQ ID NO: 864247 - DNA, 17 bp, Homo sapiens
aggcgtgcccccctcct

SEQ ID NO: 864248 - DNA, 18 bp, Homo sapiens
aggcgtgcccccctcctc

SEQ ID NO: 864249 - DNA, 23 bp, Homo sapiens
aggcgtgcccccctcctccagta

SEQ ID NO: 864250 - DNA, 13 bp, Homo sapiens
aggcgtgtgcagg

SEQ ID NO: 864251 - DNA, 14 bp, Homo sapiens
aggcgtgtggcagc

SEQ ID NO: 864252 - DNA, 14 bp, Homo sapiens
aggcgttctcctgc

SEQ ID NO: 864253 - DNA, 15 bp, Homo sapiens
aggcgttggtgccac

SEQ ID NO: 864254 - DNA, 16 bp, Homo sapiens
aggcgttggtgccact

SEQ ID NO: 864255 - DNA, 15 bp, Homo sapiens
aggctaaaaagcaac

SEQ ID NO: 864256 - DNA, 13 bp, Homo sapiens
aggctaaacatcc

SEQ ID NO: 864257 - DNA, 16 bp, Homo sapiens
aggctaagaatagtgg

SEQ ID NO: 864258 - DNA, 22 bp, Homo sapiens
aggctaagatgagatttgccag

SEQ ID NO: 864259 - DNA, 14 bp, Homo sapiens
aggctaagctgccg

SEQ ID NO: 864260 - DNA, 19 bp, Homo sapiens
aggctaaggcaggaaaatt

SEQ ID NO: 864261 - DNA, 20 bp, Homo sapiens
aggctaattttttatccttt

SEQ ID NO: 864262 - DNA, 22 bp, Homo sapiens
aggctacaattttctcccagga

SEQ ID NO: 864263 - DNA, 15 bp, Homo sapiens
aggctatggttgcca

SEQ ID NO: 864264 - DNA, 14 bp, Homo sapiens
aggctatgtgatta

SEQ ID NO: 864265 - DNA, 17 bp, Homo sapiens
aggctatgtgattacaa

SEQ ID NO: 864266 - DNA, 19 bp, Homo sapiens
aggctattattttcactgt

SEQ ID NO: 864267 - DNA, 21 bp, Homo sapiens
aggctattgtcccctaaacca

SEQ ID NO: 864268 - DNA, 17 bp, Homo sapiens
aggctattttctaaaga

SEQ ID NO: 864269 - DNA, 18 bp, Homo sapiens
aggctcaaggctgtgcag

SEQ ID NO: 864270 - DNA, 23 bp, Homo sapiens
aggctcacctttagaacaggaga

SEQ ID NO: 864271 - DNA, 16 bp, Homo sapiens
aggctcacgaagggca

SEQ ID NO: 864272 - DNA, 17 bp, Homo sapiens
aggctcactgccaggcc

SEQ ID NO: 864273 - DNA, 21 bp, Homo sapiens
aggctcactgccaggccagcc

SEQ ID NO: 864274 - DNA, 22 bp, Homo sapiens
aggctcactgccaggccagcct

SEQ ID NO: 864275 - DNA, 24 bp, Homo sapiens
aggctcactgccaggccagcctcc

SEQ ID NO: 864276 - DNA, 16 bp, Homo sapiens
aggctcaggtccctgg

SEQ ID NO: 864277 - DNA, 17 bp, Homo sapiens
aggctcagtctcaggag

SEQ ID NO: 864278 - DNA, 18 bp, Homo sapiens
aggctcagtctcaggagc

SEQ ID NO: 864279 - DNA, 20 bp, Homo sapiens
aggctcagtggtgggagaga

SEQ ID NO: 864280 - DNA, 16 bp, Homo sapiens
aggctcatttaaaaca

SEQ ID NO: 864281 - DNA, 12 bp, Homo sapiens
aggctcatttta

SEQ ID NO: 864282 - DNA, 22 bp, Homo sapiens
aggctccaccccatccagttca

SEQ ID NO: 864283 - DNA, 14 bp, Homo sapiens
aggctccagagggc

SEQ ID NO: 864284 - DNA, 16 bp, Homo sapiens
aggctccccaccccga

SEQ ID NO: 864285 - DNA, 12 bp, Homo sapiens
aggctccccaga

SEQ ID NO: 864286 - DNA, 16 bp, Homo sapiens
aggctccccgcctcca

SEQ ID NO: 864287 - DNA, 18 bp, Homo sapiens
aggctccccgcctccact

SEQ ID NO: 864288 - DNA, 15 bp, Homo sapiens
aggctccgcccttag

SEQ ID NO: 864289 - DNA, 21 bp, Homo sapiens
aggctcctccttgcccagact

SEQ ID NO: 864290 - DNA, 17 bp, Homo sapiens
aggctcgattttgtatc

SEQ ID NO: 864291 - DNA, 15 bp, Homo sapiens
aggctcgccttccct

SEQ ID NO: 864292 - DNA, 16 bp, Homo sapiens
aggctcgccttccctc

SEQ ID NO: 864293 - DNA, 19 bp, Homo sapiens
aggctcggaggaccctgga

SEQ ID NO: 864294 - DNA, 21 bp, Homo sapiens
aggctcggccgtgggccggga

SEQ ID NO: 864295 - DNA, 20 bp, Homo sapiens
aggctctagagagagggaga

SEQ ID NO: 864296 - DNA, 15 bp, Homo sapiens
aggctctcaccccca

SEQ ID NO: 864297 - DNA, 22 bp, Homo sapiens
aggctctcccctctcgccccat

SEQ ID NO: 864298 - DNA, 16 bp, Homo sapiens
aggctctctcctctct

SEQ ID NO: 864299 - DNA, 17 bp, Homo sapiens
aggctctctcctctctc

SEQ ID NO: 864300 - DNA, 19 bp, Homo sapiens
aggctctgacccagtgaga

SEQ ID NO: 864301 - DNA, 16 bp, Homo sapiens
aggctctgcttctcca

SEQ ID NO: 864302 - DNA, 22 bp, Homo sapiens
aggctctgcttctccaaggaaa

SEQ ID NO: 864303 - DNA, 21 bp, Homo sapiens
aggctctggacagcagaagcc

SEQ ID NO: 864304 - DNA, 19 bp, Homo sapiens
aggctctggagccagagag

SEQ ID NO: 864305 - DNA, 13 bp, Homo sapiens
aggctctgggcac

SEQ ID NO: 864306 - DNA, 15 bp, Homo sapiens
aggctctgggcacag

SEQ ID NO: 864307 - DNA, 19 bp, Homo sapiens
aggctctgggcacagtgct

SEQ ID NO: 864308 - DNA, 22 bp, Homo sapiens
aggctctgggcacagtgctgcc

SEQ ID NO: 864309 - DNA, 13 bp, Homo sapiens
aggctctgggctc

SEQ ID NO: 864310 - DNA, 17 bp, Homo sapiens
aggctctgggctcaggg

SEQ ID NO: 864311 - DNA, 21 bp, Homo sapiens
aggctctgggctcagggctgg

SEQ ID NO: 864312 - DNA, 22 bp, Homo sapiens
aggctctgggctcagggctgga

SEQ ID NO: 864313 - DNA, 19 bp, Homo sapiens
aggctcttaagcagcatgg

SEQ ID NO: 864314 - DNA, 15 bp, Homo sapiens
aggctcttcacatcc

SEQ ID NO: 864315 - DNA, 22 bp, Homo sapiens
aggctcttcctggacctgagtc

SEQ ID NO: 864316 - DNA, 22 bp, Homo sapiens
aggctctttggggtcagccagg

SEQ ID NO: 864317 - DNA, 13 bp, Homo sapiens
aggctgaaagagg

SEQ ID NO: 864318 - DNA, 21 bp, Homo sapiens
aggctgaaatatccacccagc

SEQ ID NO: 864319 - DNA, 20 bp, Homo sapiens
aggctgaactcttcagaaca

SEQ ID NO: 864320 - DNA, 16 bp, Homo sapiens
aggctgaattacagtg

SEQ ID NO: 864321 - DNA, 15 bp, Homo sapiens
aggctgaccaagaga

SEQ ID NO: 864322 - DNA, 21 bp, Homo sapiens
aggctgaccacagcacagcca

SEQ ID NO: 864323 - DNA, 14 bp, Homo sapiens
aggctgacctcaac

SEQ ID NO: 864324 - DNA, 16 bp, Homo sapiens
aggctgacgtgtgagg

SEQ ID NO: 864325 - DNA, 13 bp, Homo sapiens
aggctgagacagg

SEQ ID NO: 864326 - DNA, 17 bp, Homo sapiens
aggctgagactgcggga

SEQ ID NO: 864327 - DNA, 12 bp, Homo sapiens
aggctgagccct

SEQ ID NO: 864328 - DNA, 14 bp, Homo sapiens
aggctgagccctgt

SEQ ID NO: 864329 - DNA, 13 bp, Homo sapiens
aggctgagcctca

SEQ ID NO: 864330 - DNA, 11 bp, Homo sapiens
aggctgaggac

SEQ ID NO: 864331 - DNA, 13 bp, Homo sapiens
aggctgaggactt

SEQ ID NO: 864332 - DNA, 11 bp, Homo sapiens
aggctgaggca

SEQ ID NO: 864333 - DNA, 18 bp, Homo sapiens
aggctgaggcaagagaat

SEQ ID NO: 864334 - DNA, 17 bp, Homo sapiens
aggctgaggcagcagac

SEQ ID NO: 864335 - DNA, 15 bp, Homo sapiens
aggctgaggcaggag

SEQ ID NO: 864336 - DNA, 14 bp, Homo sapiens
aggctgaggcaggc

SEQ ID NO: 864337 - DNA, 13 bp, Homo sapiens
aggctgaggcctg

SEQ ID NO: 864338 - DNA, 21 bp, Homo sapiens
aggctgaggcgggtggatcac

SEQ ID NO: 864339 - DNA, 17 bp, Homo sapiens
aggctgaggctggcaca

SEQ ID NO: 864340 - DNA, 22 bp, Homo sapiens
aggctgaggtggggaaggaggg

SEQ ID NO: 864341 - DNA, 14 bp, Homo sapiens
aggctgaggtgtct

SEQ ID NO: 864342 - DNA, 19 bp, Homo sapiens
aggctgaggttagagagat

SEQ ID NO: 864343 - DNA, 16 bp, Homo sapiens
aggctgatttggagtg

SEQ ID NO: 864344 - DNA, 14 bp, Homo sapiens
aggctgcaaaatta

SEQ ID NO: 864345 - DNA, 11 bp, Homo sapiens
aggctgcactg

SEQ ID NO: 864346 - DNA, 15 bp, Homo sapiens
aggctgcactgcagt

SEQ ID NO: 864347 - DNA, 16 bp, Homo sapiens
aggctgcactggagcc

SEQ ID NO: 864348 - DNA, 19 bp, Homo sapiens
aggctgcactggagccaca

SEQ ID NO: 864349 - DNA, 20 bp, Homo sapiens
aggctgcactggagccacag

SEQ ID NO: 864350 - DNA, 20 bp, Homo sapiens
aggctgcagaaggccaagaa

SEQ ID NO: 864351 - DNA, 15 bp, Homo sapiens
aggctgcagagcccg

SEQ ID NO: 864352 - DNA, 17 bp, Homo sapiens
aggctgcagagcccggc

SEQ ID NO: 864353 - DNA, 13 bp, Homo sapiens
aggctgcaggagg

SEQ ID NO: 864354 - DNA, 19 bp, Homo sapiens
aggctgcagtgagccgaga

SEQ ID NO: 864355 - DNA, 12 bp, Homo sapiens
aggctgccccag

SEQ ID NO: 864356 - DNA, 14 bp, Homo sapiens
aggctgccccaggc

SEQ ID NO: 864357 - DNA, 16 bp, Homo sapiens
aggctgccccaggccg

SEQ ID NO: 864358 - DNA, 20 bp, Homo sapiens
aggctgccccaggccggagc

SEQ ID NO: 864359 - DNA, 16 bp, Homo sapiens
aggctgcccccatcca

SEQ ID NO: 864360 - DNA, 18 bp, Homo sapiens
aggctgcccccatccagc

SEQ ID NO: 864361 - DNA, 20 bp, Homo sapiens
aggctgcccccatccagcca

SEQ ID NO: 864362 - DNA, 13 bp, Homo sapiens
aggctgcccctgt

SEQ ID NO: 864363 - DNA, 18 bp, Homo sapiens
aggctgccctgaggggct

SEQ ID NO: 864364 - DNA, 16 bp, Homo sapiens
aggctgcctcagccag

SEQ ID NO: 864365 - DNA, 17 bp, Homo sapiens
aggctgcctcagccagt

SEQ ID NO: 864366 - DNA, 23 bp, Homo sapiens
aggctgcctcagccagtggcaca

SEQ ID NO: 864367 - DNA, 18 bp, Homo sapiens
aggctgcctctcccatca

SEQ ID NO: 864368 - DNA, 22 bp, Homo sapiens
aggctgcctgctgtgctgggag

SEQ ID NO: 864369 - DNA, 21 bp, Homo sapiens
aggctgcgtccctccgagctt

SEQ ID NO: 864370 - DNA, 12 bp, Homo sapiens
aggctgctgccg

SEQ ID NO: 864371 - DNA, 14 bp, Homo sapiens
aggctgctgccgga

SEQ ID NO: 864372 - DNA, 16 bp, Homo sapiens
aggctgctggagtgca

SEQ ID NO: 864373 - DNA, 23 bp, Homo sapiens
aggctgctggagtgcagtggcac

SEQ ID NO: 864374 - DNA, 12 bp, Homo sapiens
aggctgctggct

SEQ ID NO: 864375 - DNA, 14 bp, Homo sapiens
aggctgctggcttc

SEQ ID NO: 864376 - DNA, 19 bp, Homo sapiens
aggctggaatgagggaggc

SEQ ID NO: 864377 - DNA, 20 bp, Homo sapiens
aggctggaatgagggaggcg

SEQ ID NO: 864378 - DNA, 12 bp, Homo sapiens
aggctggagaag

SEQ ID NO: 864379 - DNA, 20 bp, Homo sapiens
aggctggagaagctcaccca

SEQ ID NO: 864380 - DNA, 21 bp, Homo sapiens
aggctggagataacagcctct

SEQ ID NO: 864381 - DNA, 15 bp, Homo sapiens
aggctggaggaaggg

SEQ ID NO: 864382 - DNA, 14 bp, Homo sapiens
aggctggaggcagg

SEQ ID NO: 864383 - DNA, 20 bp, Homo sapiens
aggctggagtgcagtggcgt

SEQ ID NO: 864384 - DNA, 17 bp, Homo sapiens
aggctggcacaggacat

SEQ ID NO: 864385 - DNA, 18 bp, Homo sapiens
aggctggcacaggacatg

SEQ ID NO: 864386 - DNA, 12 bp, Homo sapiens
aggctggcacca

SEQ ID NO: 864387 - DNA, 15 bp, Homo sapiens
aggctggcagctctc

SEQ ID NO: 864388 - DNA, 19 bp, Homo sapiens
aggctggccaaggtgtcca

SEQ ID NO: 864389 - DNA, 22 bp, Homo sapiens
aggctggccaaggtgtccaggg

SEQ ID NO: 864390 - DNA, 22 bp, Homo sapiens
aggctggccagcaaggcaggtt

SEQ ID NO: 864391 - DNA, 18 bp, Homo sapiens
aggctggccagtccaggc

SEQ ID NO: 864392 - DNA, 21 bp, Homo sapiens
aggctggcctatgtggtctaa

SEQ ID NO: 864393 - DNA, 15 bp, Homo sapiens
aggctggcgcagcca

SEQ ID NO: 864394 - DNA, 19 bp, Homo sapiens
aggctgggacggaccagca

SEQ ID NO: 864395 - DNA, 18 bp, Homo sapiens
aggctgggaggttgggag

SEQ ID NO: 864396 - DNA, 22 bp, Homo sapiens
aggctgggcagcacaaggcctt

SEQ ID NO: 864397 - DNA, 21 bp, Homo sapiens
aggctgggccatgtccaaaga

SEQ ID NO: 864398 - DNA, 22 bp, Homo sapiens
aggctgggccatgtccaaagag

SEQ ID NO: 864399 - DNA, 13 bp, Homo sapiens
aggctgggccgca

SEQ ID NO: 864400 - DNA, 23 bp, Homo sapiens
aggctgggccgcaagggcctgga

SEQ ID NO: 864401 - DNA, 24 bp, Homo sapiens
aggctgggccgcaagggcctggac

SEQ ID NO: 864402 - DNA, 18 bp, Homo sapiens
aggctgggcctcccctgg

SEQ ID NO: 864403 - DNA, 18 bp, Homo sapiens
aggctgggctctgcctgt

SEQ ID NO: 864404 - DNA, 13 bp, Homo sapiens
aggctggggaggt

SEQ ID NO: 864405 - DNA, 20 bp, Homo sapiens
aggctggggaggtgctgggg

SEQ ID NO: 864406 - DNA, 17 bp, Homo sapiens
aggctggggatggtagg

SEQ ID NO: 864407 - DNA, 14 bp, Homo sapiens
aggctggggcatgg

SEQ ID NO: 864408 - DNA, 19 bp, Homo sapiens
aggctggggccccatcttg

SEQ ID NO: 864409 - DNA, 22 bp, Homo sapiens
aggctggggccccatcttgatc

SEQ ID NO: 864410 - DNA, 13 bp, Homo sapiens
aggctggtggccc

SEQ ID NO: 864411 - DNA, 15 bp, Homo sapiens
aggctggtggcccag

SEQ ID NO: 864412 - DNA, 21 bp, Homo sapiens
aggctggtggccttgggcctt

SEQ ID NO: 864413 - DNA, 17 bp, Homo sapiens
aggctggtggttttcag

SEQ ID NO: 864414 - DNA, 20 bp, Homo sapiens
aggctggtgtatgcactgct

SEQ ID NO: 864415 - DNA, 22 bp, Homo sapiens
aggctggtgtatgcactgctca

SEQ ID NO: 864416 - DNA, 15 bp, Homo sapiens
aggctgtaactactt

SEQ ID NO: 864417 - DNA, 15 bp, Homo sapiens
aggctgtcctgtaca

SEQ ID NO: 864418 - DNA, 14 bp, Homo sapiens
aggctgtctggggc

SEQ ID NO: 864419 - DNA, 14 bp, Homo sapiens
aggctgtctgtgcc

SEQ ID NO: 864420 - DNA, 15 bp, Homo sapiens
aggctgtctgtgcca

SEQ ID NO: 864421 - DNA, 16 bp, Homo sapiens
aggctgtctgttgtat

SEQ ID NO: 864422 - DNA, 19 bp, Homo sapiens
aggctgtgctccgccatgg

SEQ ID NO: 864423 - DNA, 22 bp, Homo sapiens
aggctgtgctgccctgaagaat

SEQ ID NO: 864424 - DNA, 10 bp, Homo sapiens
aggctgtggg

SEQ ID NO: 864425 - DNA, 18 bp, Homo sapiens
aggctgtggggtctggct

SEQ ID NO: 864426 - DNA, 19 bp, Homo sapiens
aggctgtggggtctggctg

SEQ ID NO: 864427 - DNA, 20 bp, Homo sapiens
aggctgtggggtgggctgga

SEQ ID NO: 864428 - DNA, 12 bp, Homo sapiens
aggctgtgtctc

SEQ ID NO: 864429 - DNA, 13 bp, Homo sapiens
aggctgtgtggcc

SEQ ID NO: 864430 - DNA, 20 bp, Homo sapiens
aggctgttaaatacaggaaa

SEQ ID NO: 864431 - DNA, 14 bp, Homo sapiens
aggctgttattatg

SEQ ID NO: 864432 - DNA, 20 bp, Homo sapiens
aggctgttcccatgtagccc

SEQ ID NO: 864433 - DNA, 14 bp, Homo sapiens
aggcttaagaactg

SEQ ID NO: 864434 - DNA, 16 bp, Homo sapiens
aggcttaggcctctct

SEQ ID NO: 864435 - DNA, 14 bp, Homo sapiens
aggcttagtttgtg

SEQ ID NO: 864436 - DNA, 16 bp, Homo sapiens
aggcttcacgccggga

SEQ ID NO: 864437 - DNA, 17 bp, Homo sapiens
aggcttcacgccgggag

SEQ ID NO: 864438 - DNA, 20 bp, Homo sapiens
aggcttcagcatatttatag

SEQ ID NO: 864439 - DNA, 16 bp, Homo sapiens
aggcttccccctttac

SEQ ID NO: 864440 - DNA, 20 bp, Homo sapiens
aggcttccctgacttgcttt

SEQ ID NO: 864441 - DNA, 21 bp, Homo sapiens
aggcttccctgacttgcttta

SEQ ID NO: 864442 - DNA, 18 bp, Homo sapiens
aggcttccgcgcccagcg

SEQ ID NO: 864443 - DNA, 20 bp, Homo sapiens
aggcttccgcgcccagcgct

SEQ ID NO: 864444 - DNA, 20 bp, Homo sapiens
aggcttccgtgtcctctccc

SEQ ID NO: 864445 - DNA, 10 bp, Homo sapiens
aggcttcctg

SEQ ID NO: 864446 - DNA, 16 bp, Homo sapiens
aggcttctcacggcga

SEQ ID NO: 864447 - DNA, 22 bp, Homo sapiens
aggcttctccaattctgcccaa

SEQ ID NO: 864448 - DNA, 16 bp, Homo sapiens
aggcttctccgccagc

SEQ ID NO: 864449 - DNA, 22 bp, Homo sapiens
aggcttctccgccagcctcctc

SEQ ID NO: 864450 - DNA, 17 bp, Homo sapiens
aggcttctgtaatcaat

SEQ ID NO: 864451 - DNA, 13 bp, Homo sapiens
aggcttgaagctg

SEQ ID NO: 864452 - DNA, 21 bp, Homo sapiens
aggcttgcccagtacatttaa

SEQ ID NO: 864453 - DNA, 20 bp, Homo sapiens
aggcttgcctgggctgggca

SEQ ID NO: 864454 - DNA, 21 bp, Homo sapiens
aggcttgggatttgctgtgta

SEQ ID NO: 864455 - DNA, 19 bp, Homo sapiens
aggcttggggaaaatggcc

SEQ ID NO: 864456 - DNA, 20 bp, Homo sapiens
aggcttgggggttttcaatg

SEQ ID NO: 864457 - DNA, 23 bp, Homo sapiens
aggcttgggggttttcaatgtga

SEQ ID NO: 864458 - DNA, 16 bp, Homo sapiens
aggcttgtcagagctg

SEQ ID NO: 864459 - DNA, 15 bp, Homo sapiens
aggctttaaaaagaa

SEQ ID NO: 864460 - DNA, 18 bp, Homo sapiens
aggctttaagctccagct

SEQ ID NO: 864461 - DNA, 17 bp, Homo sapiens
aggctttaataaaggcc

SEQ ID NO: 864462 - DNA, 13 bp, Homo sapiens
aggctttcaaaat

SEQ ID NO: 864463 - DNA, 14 bp, Homo sapiens
aggctttcaaatgt

SEQ ID NO: 864464 - DNA, 16 bp, Homo sapiens
aggctttcaaatgtac

SEQ ID NO: 864465 - DNA, 19 bp, Homo sapiens
aggctttcaattgtatttt

SEQ ID NO: 864466 - DNA, 19 bp, Homo sapiens
aggctttcactatttcctt

SEQ ID NO: 864467 - DNA, 23 bp, Homo sapiens
aggctttcaggctacctttttct

SEQ ID NO: 864468 - DNA, 20 bp, Homo sapiens
cagcggcccctgcatcccct

SEQ ID NO: 864469 - DNA, 15 bp, Homo sapiens
cagcggcctcagggt

SEQ ID NO: 864470 - DNA, 15 bp, Homo sapiens
cagcggccttgaaga

SEQ ID NO: 864471 - DNA, 22 bp, Homo sapiens
cagcggctcccctctgcttctc

SEQ ID NO: 864472 - DNA, 13 bp, Homo sapiens
cagcggctctggt

SEQ ID NO: 864473 - DNA, 16 bp, Homo sapiens
cagcggcttagccaag

SEQ ID NO: 864474 - DNA, 18 bp, Homo sapiens
cagcgggagacctgtgct

SEQ ID NO: 864475 - DNA, 19 bp, Homo sapiens
cagcgggagacctgtgcta

SEQ ID NO: 864476 - DNA, 20 bp, Homo sapiens
cagcgggcaaagagctcccg

SEQ ID NO: 864477 - DNA, 23 bp, Homo sapiens
cagcggtgggaaggaaaggcaga

SEQ ID NO: 864478 - DNA, 15 bp, Homo sapiens
cagcggtttggggag

SEQ ID NO: 864479 - DNA, 21 bp, Homo sapiens
cagcgtcccagtctctggcag

SEQ ID NO: 864480 - DNA, 22 bp, Homo sapiens
cagcgtcccctgctactcctgt

SEQ ID NO: 864481 - DNA, 12 bp, Homo sapiens
cagcgtctgcag

SEQ ID NO: 864482 - DNA, 22 bp, Homo sapiens
cagcgtgctggcgacactcagg

SEQ ID NO: 864483 - DNA, 15 bp, Homo sapiens
cagcgtgctttaaaa

SEQ ID NO: 864484 - DNA, 15 bp, Homo sapiens
cagcgtggcccaggc

SEQ ID NO: 864485 - DNA, 16 bp, Homo sapiens
cagcgtggcccaggcc

SEQ ID NO: 864486 - DNA, 15 bp, Homo sapiens
cagcgtgtggagcag

SEQ ID NO: 864487 - DNA, 16 bp, Homo sapiens
cagcgttcccttctcc

SEQ ID NO: 864488 - DNA, 19 bp, Homo sapiens
cagcgttcccttctccccc

SEQ ID NO: 864489 - DNA, 21 bp, Homo sapiens
cagcgtttagtttctagaggc

SEQ ID NO: 864490 - DNA, 24 bp, Homo sapiens
cagcgtttagtttctagaggcctc

SEQ ID NO: 864491 - DNA, 19 bp, Homo sapiens
cagcgtttttacctaggca

SEQ ID NO: 864492 - DNA, 22 bp, Homo sapiens
cagctaaagaagtttgaacatt

SEQ ID NO: 864493 - DNA, 22 bp, Homo sapiens
cagctaaagcccaacctcctga

SEQ ID NO: 864494 - DNA, 16 bp, Homo sapiens
cagctaaatgcaggga

SEQ ID NO: 864495 - DNA, 20 bp, Homo sapiens
cagctaaatgtaacttattc

SEQ ID NO: 864496 - DNA, 15 bp, Homo sapiens
cagctaactccgaga

SEQ ID NO: 864497 - DNA, 17 bp, Homo sapiens
cagctaactccgagagc

SEQ ID NO: 864498 - DNA, 19 bp, Homo sapiens
cagctaactccgagagcag

SEQ ID NO: 864499 - DNA, 12 bp, Homo sapiens
cagctaagaaaa

SEQ ID NO: 864500 - DNA, 23 bp, Homo sapiens
cagctaagaaaagattttaatca

SEQ ID NO: 864501 - DNA, 15 bp, Homo sapiens
cagctaagctaggaa

SEQ ID NO: 864502 - DNA, 13 bp, Homo sapiens
cagctaagctcac

SEQ ID NO: 864503 - DNA, 18 bp, Homo sapiens
cagctaatttttgtatgt

SEQ ID NO: 864504 - DNA, 22 bp, Homo sapiens
cagctaatttttgtatttttag

SEQ ID NO: 864505 - DNA, 13 bp, Homo sapiens
cagctacattcct

SEQ ID NO: 864506 - DNA, 15 bp, Homo sapiens
cagctacattcctca

SEQ ID NO: 864507 - DNA, 20 bp, Homo sapiens
cagctacattcctcagctgc

SEQ ID NO: 864508 - DNA, 22 bp, Homo sapiens
cagctaccccttctttgcaggg

SEQ ID NO: 864509 - DNA, 16 bp, Homo sapiens
cagctaccccttgtgg

SEQ ID NO: 864510 - DNA, 21 bp, Homo sapiens
cagctaccctttttctccagc

SEQ ID NO: 864511 - DNA, 17 bp, Homo sapiens
cagctaccggaaggagg

SEQ ID NO: 864512 - DNA, 14 bp, Homo sapiens
cagctactcagaag

SEQ ID NO: 864513 - DNA, 23 bp, Homo sapiens
cagctactcagaagcctgaggct

SEQ ID NO: 864514 - DNA, 16 bp, Homo sapiens
cagctactcaggaggc

SEQ ID NO: 864515 - DNA, 15 bp, Homo sapiens
cagctactctgtcca

SEQ ID NO: 864516 - DNA, 16 bp, Homo sapiens
cagctactctgtccag

SEQ ID NO: 864517 - DNA, 21 bp, Homo sapiens
cagctactctgtccaggccac

SEQ ID NO: 864518 - DNA, 19 bp, Homo sapiens
cagctactgatttttgtga

SEQ ID NO: 864519 - DNA, 13 bp, Homo sapiens
cagctactggaat

SEQ ID NO: 864520 - DNA, 14 bp, Homo sapiens
cagctactggaatg

SEQ ID NO: 864521 - DNA, 15 bp, Homo sapiens
cagctactgtaactt

SEQ ID NO: 864522 - DNA, 17 bp, Homo sapiens
cagctacttcctcctcc

SEQ ID NO: 864523 - DNA, 15 bp, Homo sapiens
cagctacttgggaag

SEQ ID NO: 864524 - DNA, 22 bp, Homo sapiens
cagctacttgggagcctgaggc

SEQ ID NO: 864525 - DNA, 17 bp, Homo sapiens
cagctacttggtttgtg

SEQ ID NO: 864526 - DNA, 13 bp, Homo sapiens
cagctagactgga

SEQ ID NO: 864527 - DNA, 20 bp, Homo sapiens
cagctaggaagagcaggact

SEQ ID NO: 864528 - DNA, 15 bp, Homo sapiens
cagctagtgccaaat

SEQ ID NO: 864529 - DNA, 13 bp, Homo sapiens
cagctagtgcctt

SEQ ID NO: 864530 - DNA, 15 bp, Homo sapiens
cagctatatatttcc

SEQ ID NO: 864531 - DNA, 24 bp, Homo sapiens
cagctatcgaacttcacaactagg

SEQ ID NO: 864532 - DNA, 16 bp, Homo sapiens
cagctatgaagtgctg

SEQ ID NO: 864533 - DNA, 16 bp, Homo sapiens
cagctatttcagcctc

SEQ ID NO: 864534 - DNA, 22 bp, Homo sapiens
cagctcaactcgggggcgcctg

SEQ ID NO: 864535 - DNA, 13 bp, Homo sapiens
cagctcaagtctt

SEQ ID NO: 864536 - DNA, 22 bp, Homo sapiens
cagctcaagtcttccctgatca

SEQ ID NO: 864537 - DNA, 20 bp, Homo sapiens
cagctcaatggactggaagg

SEQ ID NO: 864538 - DNA, 14 bp, Homo sapiens
cagctcacccctgg

SEQ ID NO: 864539 - DNA, 15 bp, Homo sapiens
cagctcacccctggg

SEQ ID NO: 864540 - DNA, 16 bp, Homo sapiens
cagctcacctctgaag

SEQ ID NO: 864541 - DNA, 13 bp, Homo sapiens
cagctcagaaccc

SEQ ID NO: 864542 - DNA, 18 bp, Homo sapiens
cagctcagaacccagggc

SEQ ID NO: 864543 - DNA, 21 bp, Homo sapiens
cagctcagaacccagggctct

SEQ ID NO: 864544 - DNA, 18 bp, Homo sapiens
cagctcagccctggcctg

SEQ ID NO: 864545 - DNA, 20 bp, Homo sapiens
cagctcagccctggcctggc

SEQ ID NO: 864546 - DNA, 23 bp, Homo sapiens
cagctcaggcacacttcttcttg

SEQ ID NO: 864547 - DNA, 17 bp, Homo sapiens
cagctcaggggacactg

SEQ ID NO: 864548 - DNA, 12 bp, Homo sapiens
cagctcagtccc

SEQ ID NO: 864549 - DNA, 21 bp, Homo sapiens
cagctcattatgaaaaacatc

SEQ ID NO: 864550 - DNA, 19 bp, Homo sapiens
cagctcatttaatcccagg

SEQ ID NO: 864551 - DNA, 21 bp, Homo sapiens
cagctcatttaatcccaggaa

SEQ ID NO: 864552 - DNA, 20 bp, Homo sapiens
cagctccacacattccagcc

SEQ ID NO: 864553 - DNA, 13 bp, Homo sapiens
cagctccaccctg

SEQ ID NO: 864554 - DNA, 19 bp, Homo sapiens
cagctccagaataccttct

SEQ ID NO: 864555 - DNA, 18 bp, Homo sapiens
cagctccaggacaccgct

SEQ ID NO: 864556 - DNA, 14 bp, Homo sapiens
cagctccaggccca

SEQ ID NO: 864557 - DNA, 17 bp, Homo sapiens
cagctccaggcccaccg

SEQ ID NO: 864558 - DNA, 21 bp, Homo sapiens
cagctccagggaatccaagcc

SEQ ID NO: 864559 - DNA, 13 bp, Homo sapiens
cagctccaggggc

SEQ ID NO: 864560 - DNA, 16 bp, Homo sapiens
cagctccaggggccct

SEQ ID NO: 864561 - DNA, 20 bp, Homo sapiens
cagctccaggggcccttggg

SEQ ID NO: 864562 - DNA, 17 bp, Homo sapiens
cagctccaggtggctct

SEQ ID NO: 864563 - DNA, 21 bp, Homo sapiens
cagctccaggtggctctgagg

SEQ ID NO: 864564 - DNA, 16 bp, Homo sapiens
cagctccagtgccgct

SEQ ID NO: 864565 - DNA, 21 bp, Homo sapiens
cagctcccaacgagcctcctc

SEQ ID NO: 864566 - DNA, 22 bp, Homo sapiens
cagctcccaacgagcctcctca

SEQ ID NO: 864567 - DNA, 21 bp, Homo sapiens
cagctcccaaggctctgagca

SEQ ID NO: 864568 - DNA, 19 bp, Homo sapiens
cagctcccaccccaccccc

SEQ ID NO: 864569 - DNA, 22 bp, Homo sapiens
cagctccccaactccctgccat

SEQ ID NO: 864570 - DNA, 13 bp, Homo sapiens
cagctccccaaga

SEQ ID NO: 864571 - DNA, 13 bp, Homo sapiens
cagctccccccgc

SEQ ID NO: 864572 - DNA, 18 bp, Homo sapiens
cagctccccggcactgca

SEQ ID NO: 864573 - DNA, 15 bp, Homo sapiens
cagctcccgctgtgg

SEQ ID NO: 864574 - DNA, 20 bp, Homo sapiens
cagctcccgctgtggccgca

SEQ ID NO: 864575 - DNA, 20 bp, Homo sapiens
cagctccctagactgcatcc

SEQ ID NO: 864576 - DNA, 15 bp, Homo sapiens
cagctccctaggaga

SEQ ID NO: 864577 - DNA, 17 bp, Homo sapiens
cagctccctcctgcaca

SEQ ID NO: 864578 - DNA, 21 bp, Homo sapiens
cagctccctcctgcacacaga

SEQ ID NO: 864579 - DNA, 17 bp, Homo sapiens
cagctccctgcaccgcc

SEQ ID NO: 864580 - DNA, 12 bp, Homo sapiens
cagctcccttgg

SEQ ID NO: 864581 - DNA, 17 bp, Homo sapiens
cagctcccttgggaagg

SEQ ID NO: 864582 - DNA, 23 bp, Homo sapiens
cagctcccttgggaaggacacag

SEQ ID NO: 864583 - DNA, 22 bp, Homo sapiens
cagctccctttctcaggagctt

SEQ ID NO: 864584 - DNA, 13 bp, Homo sapiens
cagctccgacctc

SEQ ID NO: 864585 - DNA, 16 bp, Homo sapiens
cagctccggcctgtcc

SEQ ID NO: 864586 - DNA, 21 bp, Homo sapiens
cagctccggcctgtcctccaa

SEQ ID NO: 864587 - DNA, 13 bp, Homo sapiens
cagctcctaaccc

SEQ ID NO: 864588 - DNA, 14 bp, Homo sapiens
cagctcctcccaca

SEQ ID NO: 864589 - DNA, 14 bp, Homo sapiens
cagctcctccctgt

SEQ ID NO: 864590 - DNA, 15 bp, Homo sapiens
cagctcctccctgtg

SEQ ID NO: 864591 - DNA, 18 bp, Homo sapiens
cagctcctccctgtgccc

SEQ ID NO: 864592 - DNA, 16 bp, Homo sapiens
cagcccctactgctgt

SEQ ID NO: 864593 - DNA, 17 bp, Homo sapiens
cagcccctactgctgtg

SEQ ID NO: 864594 - DNA, 20 bp, Homo sapiens
cagcccctatagcactgagc

SEQ ID NO: 864595 - DNA, 13 bp, Homo sapiens
cagcccctcccac

SEQ ID NO: 864596 - DNA, 14 bp, Homo sapiens
cagcccctcctctg

SEQ ID NO: 864597 - DNA, 21 bp, Homo sapiens
cagcccctcctctgccacctc

SEQ ID NO: 864598 - DNA, 23 bp, Homo sapiens
cagcccctcctctgccacctccc

SEQ ID NO: 864599 - DNA, 15 bp, Homo sapiens
cagcccctcgaggcc

SEQ ID NO: 864600 - DNA, 17 bp, Homo sapiens
cagcccctcgaggccta

SEQ ID NO: 864601 - DNA, 18 bp, Homo sapiens
cagcccctcgaggcctac

SEQ ID NO: 864602 - DNA, 18 bp, Homo sapiens
cagcccctctggtcgctc

SEQ ID NO: 864603 - DNA, 21 bp, Homo sapiens
cagcccctctggtcgctcctg

SEQ ID NO: 864604 - DNA, 17 bp, Homo sapiens
cagcccctcttcccttc

SEQ ID NO: 864605 - DNA, 15 bp, Homo sapiens
cagcccctcttgccc

SEQ ID NO: 864606 - DNA, 20 bp, Homo sapiens
cagcccctcttggagaagtc

SEQ ID NO: 864607 - DNA, 21 bp, Homo sapiens
cagcccctcttggagaagtct

SEQ ID NO: 864608 - DNA, 23 bp, Homo sapiens
cagcccctcttggagaagtctca

SEQ ID NO: 864609 - DNA, 22 bp, Homo sapiens
cagcccctgatctctgacctct

SEQ ID NO: 864610 - DNA, 14 bp, Homo sapiens
cagcccctggaccc

SEQ ID NO: 864611 - DNA, 20 bp, Homo sapiens
cagcctgctgacagacacta

SEQ ID NO: 864612 - DNA, 20 bp, Homo sapiens
cagcctgctgagagccccca

SEQ ID NO: 864613 - DNA, 22 bp, Homo sapiens
cagcctgctgagagcccccacc

SEQ ID NO: 864614 - DNA, 15 bp, Homo sapiens
cagcctgctgcccag

SEQ ID NO: 864615 - DNA, 12 bp, Homo sapiens
cagcctgctggc

SEQ ID NO: 864616 - DNA, 16 bp, Homo sapiens
cagcctgctggcaggg

SEQ ID NO: 864617 - DNA, 18 bp, Homo sapiens
cagcctgctggcagggcc

SEQ ID NO: 864618 - DNA, 14 bp, Homo sapiens
cagcctgctggggc

SEQ ID NO: 864619 - DNA, 15 bp, Homo sapiens
cagcctgctttggcc

SEQ ID NO: 864620 - DNA, 17 bp, Homo sapiens
cagcctgctttggcctt

SEQ ID NO: 864621 - DNA, 19 bp, Homo sapiens
cagcctgctttggcctttc

SEQ ID NO: 864622 - DNA, 20 bp, Homo sapiens
cagcctggagaggcctgggg

SEQ ID NO: 864623 - DNA, 17 bp, Homo sapiens
cagcctggatctcctca

SEQ ID NO: 864624 - DNA, 16 bp, Homo sapiens
cagcctggcacgaagg

SEQ ID NO: 864625 - DNA, 15 bp, Homo sapiens
cagcctggcatctgt

SEQ ID NO: 864626 - DNA, 17 bp, Homo sapiens
cagcctggcatctgtgc

SEQ ID NO: 864627 - DNA, 14 bp, Homo sapiens
cagcctggccagac

SEQ ID NO: 864628 - DNA, 18 bp, Homo sapiens
cagcctggccagacaaga

SEQ ID NO: 864629 - DNA, 18 bp, Homo sapiens
cagcctggccccggcctt

SEQ ID NO: 864630 - DNA, 18 bp, Homo sapiens
cagcctggctctgccccc

SEQ ID NO: 864631 - DNA, 14 bp, Homo sapiens
cagcctggcttctg

SEQ ID NO: 864632 - DNA, 15 bp, Homo sapiens
cagcctggcttctgg

SEQ ID NO: 864633 - DNA, 20 bp, Homo sapiens
cagcctggcttctggagccc

SEQ ID NO: 864634 - DNA, 16 bp, Homo sapiens
cagcctgggagcccag

SEQ ID NO: 864635 - DNA, 21 bp, Homo sapiens
cagcctgggcccatctccctg

SEQ ID NO: 864636 - DNA, 21 bp, Homo sapiens
cagcctggggctctctgaccc

SEQ ID NO: 864637 - DNA, 21 bp, Homo sapiens
cagcctggggctggcctccca

SEQ ID NO: 864638 - DNA, 20 bp, Homo sapiens
cagcctggtcaacatggtga

SEQ ID NO: 864639 - DNA, 21 bp, Homo sapiens
cagcctggttcagaataaatt

SEQ ID NO: 864640 - DNA, 19 bp, Homo sapiens
cagcctggtttagcctgga

SEQ ID NO: 864641 - DNA, 19 bp, Homo sapiens
cagcctgtaccttgctgtg

SEQ ID NO: 864642 - DNA, 20 bp, Homo sapiens
cagcctgtagctcccctgct

SEQ ID NO: 864643 - DNA, 23 bp, Homo sapiens
cagcctgtatgtggtgtggggcg

SEQ ID NO: 864644 - DNA, 19 bp, Homo sapiens
cagcctgtcccatggacac

SEQ ID NO: 864645 - DNA, 22 bp, Homo sapiens
cagcctgtcccatggacactcc

SEQ ID NO: 864646 - DNA, 17 bp, Homo sapiens
cagcctgtccctgaaag

SEQ ID NO: 864647 - DNA, 19 bp, Homo sapiens
cagcctgtccctgaaagag

SEQ ID NO: 864648 - DNA, 12 bp, Homo sapiens
cagcctgtcctg

SEQ ID NO: 864649 - DNA, 15 bp, Homo sapiens
cagcctgtctcgggc

SEQ ID NO: 864650 - DNA, 18 bp, Homo sapiens
cagcctgtctcgggctga

SEQ ID NO: 864651 - DNA, 21 bp, Homo sapiens
cagcctgtgagggagtgcaga

SEQ ID NO: 864652 - DNA, 15 bp, Homo sapiens
cagcctgtggcatct

SEQ ID NO: 864653 - DNA, 21 bp, Homo sapiens
cagcctgtggcatctttgcct

SEQ ID NO: 864654 - DNA, 12 bp, Homo sapiens
cagcctgtggcg

SEQ ID NO: 864655 - DNA, 18 bp, Homo sapiens
cagcctgtggcggtgcct

SEQ ID NO: 864656 - DNA, 20 bp, Homo sapiens
cagcctgtggcggtgcctgg

SEQ ID NO: 864657 - DNA, 16 bp, Homo sapiens
cagcctgttggacccg

SEQ ID NO: 864658 - DNA, 21 bp, Homo sapiens
cagccttagctctcccaactc

SEQ ID NO: 864659 - DNA, 17 bp, Homo sapiens
cagccttagctgccagt

SEQ ID NO: 864660 - DNA, 18 bp, Homo sapiens
cagccttagctgccagtg

SEQ ID NO: 864661 - DNA, 18 bp, Homo sapiens
cagccttatgtgttacat

SEQ ID NO: 864662 - DNA, 20 bp, Homo sapiens
cagccttatgtgttacatta

SEQ ID NO: 864663 - DNA, 23 bp, Homo sapiens
cagccttcagacagagaggactg

SEQ ID NO: 864664 - DNA, 11 bp, Homo sapiens
cagccttcccc

SEQ ID NO: 864665 - DNA, 18 bp, Homo sapiens
cagccttccccagctcca

SEQ ID NO: 864666 - DNA, 19 bp, Homo sapiens
cagccttcccctccctgta

SEQ ID NO: 864667 - DNA, 23 bp, Homo sapiens
cagccttccccttgcccagggct

SEQ ID NO: 864668 - DNA, 20 bp, Homo sapiens
cagccttccgggaactggag

SEQ ID NO: 864669 - DNA, 22 bp, Homo sapiens
cagccttcctctgcagctgacc

SEQ ID NO: 864670 - DNA, 15 bp, Homo sapiens
cagccttccttctgc

SEQ ID NO: 864671 - DNA, 19 bp, Homo sapiens
cagccttcggacagacata

SEQ ID NO: 864672 - DNA, 22 bp, Homo sapiens
cagccttcggagcgttctctgt

SEQ ID NO: 864673 - DNA, 22 bp, Homo sapiens
cagccttctccatatctccatg

SEQ ID NO: 864674 - DNA, 17 bp, Homo sapiens
cagccttctttttctgg

SEQ ID NO: 864675 - DNA, 18 bp, Homo sapiens
cagccttctttttctgga

SEQ ID NO: 864676 - DNA, 19 bp, Homo sapiens
cagccttctttttctggac

SEQ ID NO: 864677 - DNA, 13 bp, Homo sapiens
cagccttgaccac

SEQ ID NO: 864678 - DNA, 22 bp, Homo sapiens
cagccttgaccacggctgttcc

SEQ ID NO: 864679 - DNA, 15 bp, Homo sapiens
cagccttgagccctg

SEQ ID NO: 864680 - DNA, 19 bp, Homo sapiens
cagccttgcacacccactg

SEQ ID NO: 864681 - DNA, 14 bp, Homo sapiens
cagccttgggaccg

SEQ ID NO: 864682 - DNA, 18 bp, Homo sapiens
cagccttgggcctttcag

SEQ ID NO: 864683 - DNA, 17 bp, Homo sapiens
cagcctttcgttctgct

SEQ ID NO: 864684 - DNA, 14 bp, Homo sapiens
cagcctttgctccc

SEQ ID NO: 864685 - DNA, 18 bp, Homo sapiens
cagcctttgctccctccc

SEQ ID NO: 864686 - DNA, 21 bp, Homo sapiens
cagcctttgggtcctgggcag

SEQ ID NO: 864687 - DNA, 15 bp, Homo sapiens
cagcctttgtcaata

SEQ ID NO: 864688 - DNA, 15 bp, Homo sapiens
cagcctttgttaacc

SEQ ID NO: 864689 - DNA, 15 bp, Homo sapiens
cagccttttctggtc

SEQ ID NO: 864690 - DNA, 17 bp, Homo sapiens
cagccttttctggtccc

SEQ ID NO: 864691 - DNA, 18 bp, Homo sapiens
cagccttttctggtccct

SEQ ID NO: 864692 - DNA, 22 bp, Homo sapiens
cagccttttctggtccctcttc

SEQ ID NO: 864693 - DNA, 18 bp, Homo sapiens
cagcctttttgtttcaat

SEQ ID NO: 864694 - DNA, 16 bp, Homo sapiens
cagcgaagtagcttgc

SEQ ID NO: 864695 - DNA, 19 bp, Homo sapiens
cagcgaagtagcttgctcc

SEQ ID NO: 864696 - DNA, 18 bp, Homo sapiens
cagcgacctctctgcctc

SEQ ID NO: 864697 - DNA, 14 bp, Homo sapiens
cagcgactggatgc

SEQ ID NO: 864698 - DNA, 15 bp, Homo sapiens
cagcgagccacagga

SEQ ID NO: 864699 - DNA, 22 bp, Homo sapiens
cagcgagccacaggaacggccc

SEQ ID NO: 864700 - DNA, 14 bp, Homo sapiens
cagcgagcctgtgc

SEQ ID NO: 864701 - DNA, 16 bp, Homo sapiens
cagcgagcctgtgcct

SEQ ID NO: 864702 - DNA, 17 bp, Homo sapiens
cagcgaggaggctccag

SEQ ID NO: 864703 - DNA, 14 bp, Homo sapiens
cagcgagggcagct

SEQ ID NO: 864704 - DNA, 16 bp, Homo sapiens
cagcgagggcagctgc

SEQ ID NO: 864705 - DNA, 22 bp, Homo sapiens
cagcgagttgtggaaagcctct

SEQ ID NO: 864706 - DNA, 16 bp, Homo sapiens
cagcgatggcaggcct

SEQ ID NO: 864707 - DNA, 21 bp, Homo sapiens
cagcgatggcaggcctgaccc

SEQ ID NO: 864708 - DNA, 22 bp, Homo sapiens
cagcgatgtatgcagctatctg

SEQ ID NO: 864709 - DNA, 14 bp, Homo sapiens
cagcgcaggctgca

SEQ ID NO: 864710 - DNA, 18 bp, Homo sapiens
cagcgcaggctgcagagc

SEQ ID NO: 864711 - DNA, 19 bp, Homo sapiens
cagcgcagggctggcacgt

SEQ ID NO: 864712 - DNA, 20 bp, Homo sapiens
cagcgccaaatgttcatcct

SEQ ID NO: 864713 - DNA, 22 bp, Homo sapiens
cagcgccaaatgttcatcctca

SEQ ID NO: 864714 - DNA, 24 bp, Homo sapiens
cagcgccaagtaaacagggtacct

SEQ ID NO: 864715 - DNA, 12 bp, Homo sapiens
cagcgccaggct

SEQ ID NO: 864716 - DNA, 21 bp, Homo sapiens
cagcgccaggctgaccacagc

SEQ ID NO: 864717 - DNA, 13 bp, Homo sapiens
cagcgcccaggcc

SEQ ID NO: 864718 - DNA, 14 bp, Homo sapiens
cagcgcccaggcct

SEQ ID NO: 864719 - DNA, 17 bp, Homo sapiens
cagcgcccaggcctgct

SEQ ID NO: 864720 - DNA, 15 bp, Homo sapiens
cagcgcctccctcca

SEQ ID NO: 864721 - DNA, 16 bp, Homo sapiens
cagcgcctccctccac

SEQ ID NO: 864722 - DNA, 21 bp, Homo sapiens
cagcgcctccctccaccccag

SEQ ID NO: 864723 - DNA, 12 bp, Homo sapiens
cagcgcctttcc

SEQ ID NO: 864724 - DNA, 16 bp, Homo sapiens
cagcgctcgccacgct

SEQ ID NO: 864725 - DNA, 17 bp, Homo sapiens
cagcgctcggcccggag

SEQ ID NO: 864726 - DNA, 20 bp, Homo sapiens
cagcggattgctctggagca

SEQ ID NO: 864727 - DNA, 20 bp, Homo sapiens
cagcggcagtgggcctgctg

SEQ ID NO: 864728 - DNA, 14 bp, Homo sapiens
cagcggccccccgc

SEQ ID NO: 864729 - DNA, 15 bp, Homo sapiens
cagcggcccctccca

SEQ ID NO: 864730 - DNA, 16 bp, Homo sapiens
cagcggcccctgcatc

SEQ ID NO: 864731 - DNA, 19 bp, Homo sapiens
cagctgcttctccccccat

SEQ ID NO: 864732 - DNA, 20 bp, Homo sapiens
cagctgcttctccccccatc

SEQ ID NO: 864733 - DNA, 17 bp, Homo sapiens
cagctgcttctgctgcc

SEQ ID NO: 864734 - DNA, 20 bp, Homo sapiens
cagctgcttctgctgcctag

SEQ ID NO: 864735 - DNA, 15 bp, Homo sapiens
cagctgcttgtcctg

SEQ ID NO: 864736 - DNA, 17 bp, Homo sapiens
cagctgcttgtcctgct

SEQ ID NO: 864737 - DNA, 23 bp, Homo sapiens
cagctgcttgtcctgctctcttc

SEQ ID NO: 864738 - DNA, 16 bp, Homo sapiens
cagctgcttgtgggcc

SEQ ID NO: 864739 - DNA, 20 bp, Homo sapiens
cagctgctttgagctacagg

SEQ ID NO: 864740 - DNA, 11 bp, Homo sapiens
cagctgctttt

SEQ ID NO: 864741 - DNA, 22 bp, Homo sapiens
cagctggaaaagggtcttggga

SEQ ID NO: 864742 - DNA, 13 bp, Homo sapiens
cagctggacagag

SEQ ID NO: 864743 - DNA, 12 bp, Homo sapiens
cagctggaccat

SEQ ID NO: 864744 - DNA, 17 bp, Homo sapiens
cagctggaccatctctg

SEQ ID NO: 864745 - DNA, 20 bp, Homo sapiens
cagctggaccctgcttcacc

SEQ ID NO: 864746 - DNA, 23 bp, Homo sapiens
cagctggactctgcatcccagca

SEQ ID NO: 864747 - DNA, 22 bp, Homo sapiens
cagctggcccccagccctgggg

SEQ ID NO: 864748 - DNA, 17 bp, Homo sapiens
cagctggcccgtgacag

SEQ ID NO: 864749 - DNA, 19 bp, Homo sapiens
cagctggcccgtgacagac

SEQ ID NO: 864750 - DNA, 19 bp, Homo sapiens
cagctggccgggagcctga

SEQ ID NO: 864751 - DNA, 20 bp, Homo sapiens
cagctggcctaatcactctg

SEQ ID NO: 864752 - DNA, 21 bp, Homo sapiens
cagctggcctaatcactctga

SEQ ID NO: 864753 - DNA, 22 bp, Homo sapiens
cagctggcctaatcactctgag

SEQ ID NO: 864754 - DNA, 14 bp, Homo sapiens
cagctggcctgggg

SEQ ID NO: 864755 - DNA, 15 bp, Homo sapiens
cagctggcctggggt

SEQ ID NO: 864756 - DNA, 20 bp, Homo sapiens
cagctggctctccaccttgt

SEQ ID NO: 864757 - DNA, 20 bp, Homo sapiens
cagctgggaagcccttttta

SEQ ID NO: 864758 - DNA, 11 bp, Homo sapiens
cagctgggacc

SEQ ID NO: 864759 - DNA, 15 bp, Homo sapiens
cagctgggacccctc

SEQ ID NO: 864760 - DNA, 16 bp, Homo sapiens
cagctgggacctaatg

SEQ ID NO: 864761 - DNA, 13 bp, Homo sapiens
cagctgggagcac

SEQ ID NO: 864762 - DNA, 15 bp, Homo sapiens
cagctgggagccagt

SEQ ID NO: 864763 - DNA, 15 bp, Homo sapiens
cagctgggagcctgg

SEQ ID NO: 864764 - DNA, 16 bp, Homo sapiens
cagctgggagcctggt

SEQ ID NO: 864765 - DNA, 12 bp, Homo sapiens
cagctgggaggc

SEQ ID NO: 864766 - DNA, 22 bp, Homo sapiens
cagctgggaggcaagaggggtg

SEQ ID NO: 864767 - DNA, 17 bp, Homo sapiens
cagctgggcaaagccac

SEQ ID NO: 864768 - DNA, 12 bp, Homo sapiens
cagctgggcagt

SEQ ID NO: 864769 - DNA, 20 bp, Homo sapiens
cagctgggcagtgccagcca

SEQ ID NO: 864770 - DNA, 19 bp, Homo sapiens
cagctgggccccacctact

SEQ ID NO: 864771 - DNA, 15 bp, Homo sapiens
cagctgggccccatg

SEQ ID NO: 864772 - DNA, 14 bp, Homo sapiens
cagctgggctctgc

SEQ ID NO: 864773 - DNA, 16 bp, Homo sapiens
cagctgggctctgcaa

SEQ ID NO: 864774 - DNA, 15 bp, Homo sapiens
cagctgggcttggcc

SEQ ID NO: 864775 - DNA, 16 bp, Homo sapiens
cagctgggcttggcct

SEQ ID NO: 864776 - DNA, 19 bp, Homo sapiens
cagctgggcttggcctgga

SEQ ID NO: 864777 - DNA, 20 bp, Homo sapiens
cagctgggcttggcctggag

SEQ ID NO: 864778 - DNA, 23 bp, Homo sapiens
cagctggggagatgggggcttct

SEQ ID NO: 864779 - DNA, 14 bp, Homo sapiens
cagctggggtcctg

SEQ ID NO: 864780 - DNA, 14 bp, Homo sapiens
cagctgggtcaggc

SEQ ID NO: 864781 - DNA, 15 bp, Homo sapiens
cagctgggtcaggca

SEQ ID NO: 864782 - DNA, 18 bp, Homo sapiens
cagctgggtcaggcaggg

SEQ ID NO: 864783 - DNA, 20 bp, Homo sapiens
cagctgggtcaggcagggtg

SEQ ID NO: 864784 - DNA, 24 bp, Homo sapiens
cagctgggtggggcagcacacctc

SEQ ID NO: 864785 - DNA, 19 bp, Homo sapiens
cagctggtcagtctttgct

SEQ ID NO: 864786 - DNA, 13 bp, Homo sapiens
cagctggtcctcc

SEQ ID NO: 864787 - DNA, 13 bp, Homo sapiens
cagctggtcctgt

SEQ ID NO: 864788 - DNA, 21 bp, Homo sapiens
cagctggtgcaaattcagaac

SEQ ID NO: 864789 - DNA, 22 bp, Homo sapiens
cagctggtgccaaatagcccca

SEQ ID NO: 864790 - DNA, 23 bp, Homo sapiens
cagctggtgccaaatagccccag

SEQ ID NO: 864791 - DNA, 23 bp, Homo sapiens
cagctggtggccctgtgcctggg

SEQ ID NO: 864792 - DNA, 15 bp, Homo sapiens
cagctgtagccatgg

SEQ ID NO: 864793 - DNA, 18 bp, Homo sapiens
cagctgtagccatggctc

SEQ ID NO: 864794 - DNA, 19 bp, Homo sapiens
cagctgtagccatggctca

SEQ ID NO: 864795 - DNA, 17 bp, Homo sapiens
cagctgtagctcccgag

SEQ ID NO: 864796 - DNA, 17 bp, Homo sapiens
cagctgtatttatataa

SEQ ID NO: 864797 - DNA, 16 bp, Homo sapiens
cagctgtcaaggctca

SEQ ID NO: 864798 - DNA, 14 bp, Homo sapiens
cagctgtcaagggc

SEQ ID NO: 864799 - DNA, 15 bp, Homo sapiens
cagctgtcacctgct

SEQ ID NO: 864800 - DNA, 17 bp, Homo sapiens
cagctgtcacctgctca

SEQ ID NO: 864801 - DNA, 19 bp, Homo sapiens
cagctgtcacctgctcaca

SEQ ID NO: 864802 - DNA, 21 bp, Homo sapiens
cagctgtcacctgctcacagg

SEQ ID NO: 864803 - DNA, 22 bp, Homo sapiens
cagctgtcacctgctcacaggg

SEQ ID NO: 864804 - DNA, 23 bp, Homo sapiens
cagctgtcacctgctcacaggga

SEQ ID NO: 864805 - DNA, 20 bp, Homo sapiens
cagctgtcccctctccctgg

SEQ ID NO: 864806 - DNA, 22 bp, Homo sapiens
cagctgtcccctctccctgggg

SEQ ID NO: 864807 - DNA, 22 bp, Homo sapiens
cagctgtccctgtcaccaagct

SEQ ID NO: 864808 - DNA, 15 bp, Homo sapiens
cagctgtctgccagg

SEQ ID NO: 864809 - DNA, 14 bp, Homo sapiens
cagctgtgaaggct

SEQ ID NO: 864810 - DNA, 22 bp, Homo sapiens
cagctgtgaaggcttcactctt

SEQ ID NO: 864811 - DNA, 13 bp, Homo sapiens
cagctgtgcactt

SEQ ID NO: 864812 - DNA, 12 bp, Homo sapiens
cagctgtggcag

SEQ ID NO: 864813 - DNA, 19 bp, Homo sapiens
cagctgtggcagagttaca

SEQ ID NO: 864814 - DNA, 23 bp, Homo sapiens
cagctgtggcagagttacagttc

SEQ ID NO: 864815 - DNA, 22 bp, Homo sapiens
cagctgtgtctgccaaacacat

SEQ ID NO: 864816 - DNA, 19 bp, Homo sapiens
cagctgttcagctggttga

SEQ ID NO: 864817 - DNA, 16 bp, Homo sapiens
cagctgttcctgtgtt

SEQ ID NO: 864818 - DNA, 21 bp, Homo sapiens
cagctgtttctcatgaagcta

SEQ ID NO: 864819 - DNA, 15 bp, Homo sapiens
cagctgtttgtcata

SEQ ID NO: 864820 - DNA, 18 bp, Homo sapiens
cagctgttttcaaagccc

SEQ ID NO: 864821 - DNA, 21 bp, Homo sapiens
cagcttaaacccatacaatgt

SEQ ID NO: 864822 - DNA, 19 bp, Homo sapiens
cagcttaacattgacttct

SEQ ID NO: 864823 - DNA, 16 bp, Homo sapiens
cagcttagagttcttc

SEQ ID NO: 864824 - DNA, 15 bp, Homo sapiens
cagcttagatttcat

SEQ ID NO: 864825 - DNA, 16 bp, Homo sapiens
cagcttagatttcata

SEQ ID NO: 864826 - DNA, 17 bp, Homo sapiens
cagcttagggccctgga

SEQ ID NO: 864827 - DNA, 21 bp, Homo sapiens
cagcttatacgaaataattgt

SEQ ID NO: 864828 - DNA, 18 bp, Homo sapiens
cagcttatctcttttata

SEQ ID NO: 864829 - DNA, 22 bp, Homo sapiens
cagcttatgggatccttgtctt

SEQ ID NO: 864830 - DNA, 16 bp, Homo sapiens
cagcttcagaaagagc

SEQ ID NO: 864831 - DNA, 16 bp, Homo sapiens
cagcttcagctcaact

SEQ ID NO: 864832 - DNA, 14 bp, Homo sapiens
cagcttcatctttg

SEQ ID NO: 864833 - DNA, 19 bp, Homo sapiens
cagcttcatgcctttgtaa

SEQ ID NO: 864834 - DNA, 20 bp, Homo sapiens
cagcttcattatctgagttg

SEQ ID NO: 864835 - DNA, 21 bp, Homo sapiens
cagcttcattatctgagttgc

SEQ ID NO: 864836 - DNA, 13 bp, Homo sapiens
cagcttccaaagc

SEQ ID NO: 864837 - DNA, 16 bp, Homo sapiens
cagcttccaaagccta

SEQ ID NO: 864838 - DNA, 15 bp, Homo sapiens
cagcttcctcacacc

SEQ ID NO: 864839 - DNA, 17 bp, Homo sapiens
cagcttcctgagggcta

SEQ ID NO: 864840 - DNA, 18 bp, Homo sapiens
cagcttcctgtctgttta

SEQ ID NO: 864841 - DNA, 20 bp, Homo sapiens
cagcttcctgtctgtttata

SEQ ID NO: 864842 - DNA, 20 bp, Homo sapiens
cagcttcctttcctgtgtgt

SEQ ID NO: 864843 - DNA, 13 bp, Homo sapiens
cagcttcgaggac

SEQ ID NO: 864844 - DNA, 15 bp, Homo sapiens
cagcttcgaggacag

SEQ ID NO: 864845 - DNA, 17 bp, Homo sapiens
cagcttcgaggacagga

SEQ ID NO: 864846 - DNA, 20 bp, Homo sapiens
cagcttcggagggcccctgc

SEQ ID NO: 864847 - DNA, 17 bp, Homo sapiens
cagcttcggtgtgcaga

SEQ ID NO: 864848 - DNA, 15 bp, Homo sapiens
cagcttcgtgctgga

SEQ ID NO: 864849 - DNA, 22 bp, Homo sapiens
cagcttcgtttattttcaagaa

SEQ ID NO: 864850 - DNA, 15 bp, Homo sapiens
cagcttctctctccc

SEQ ID NO: 864851 - DNA, 19 bp, Homo sapiens
cagcttctctctccctgtc

SEQ ID NO: 864852 - DNA, 16 bp, Homo sapiens
caggatgaacccagga

SEQ ID NO: 864853 - DNA, 16 bp, Homo sapiens
caggatgacatagcca

SEQ ID NO: 864854 - DNA, 15 bp, Homo sapiens
caggatgaccctgcg

SEQ ID NO: 864855 - DNA, 17 bp, Homo sapiens
caggatgacctggataa

SEQ ID NO: 864856 - DNA, 19 bp, Homo sapiens
caggatgcacatttctgga

SEQ ID NO: 864857 - DNA, 21 bp, Homo sapiens
caggatgcccagatgaactga

SEQ ID NO: 864858 - DNA, 22 bp, Homo sapiens
caggatggaggggtggtcctga

SEQ ID NO: 864859 - DNA, 23 bp, Homo sapiens
caggatggcccttcccactggag

SEQ ID NO: 864860 - DNA, 15 bp, Homo sapiens
caggatggcctttcc

SEQ ID NO: 864861 - DNA, 22 bp, Homo sapiens
caggatggcctttccttccctc

SEQ ID NO: 864862 - DNA, 16 bp, Homo sapiens
caggatgggctgagct

SEQ ID NO: 864863 - DNA, 18 bp, Homo sapiens
caggatgggctgagctag

SEQ ID NO: 864864 - DNA, 22 bp, Homo sapiens
caggatgggctgagctagcctc

SEQ ID NO: 864865 - DNA, 22 bp, Homo sapiens
caggatggtctcgatctcctga

SEQ ID NO: 864866 - DNA, 17 bp, Homo sapiens
caggatggtgggcagga

SEQ ID NO: 864867 - DNA, 18 bp, Homo sapiens
caggattacagtgtagct

SEQ ID NO: 864868 - DNA, 14 bp, Homo sapiens
caggattcccttct

SEQ ID NO: 864869 - DNA, 17 bp, Homo sapiens
caggattcccttctggg

SEQ ID NO: 864870 - DNA, 13 bp, Homo sapiens
caggattgaagag

SEQ ID NO: 864871 - DNA, 15 bp, Homo sapiens
caggatttataaagc

SEQ ID NO: 864872 - DNA, 17 bp, Homo sapiens
caggatttataaagcaa

SEQ ID NO: 864873 - DNA, 18 bp, Homo sapiens
caggcaaaaaagggacag

SEQ ID NO: 864874 - DNA, 18 bp, Homo sapiens
caggcaaaatccttgctt

SEQ ID NO: 864875 - DNA, 22 bp, Homo sapiens
caggcaaagttttacagagagg

SEQ ID NO: 864876 - DNA, 15 bp, Homo sapiens
caggcaactgaggca

SEQ ID NO: 864877 - DNA, 17 bp, Homo sapiens
caggcaactgaggcaga

SEQ ID NO: 864878 - DNA, 20 bp, Homo sapiens
caggcaactgaggcagacag

SEQ ID NO: 864879 - DNA, 22 bp, Homo sapiens
caggcaactgaggcagacagca

SEQ ID NO: 864880 - DNA, 17 bp, Homo sapiens
caggcaagcccctcagc

SEQ ID NO: 864881 - DNA, 18 bp, Homo sapiens
caggcaagcccctcagcc

SEQ ID NO: 864882 - DNA, 21 bp, Homo sapiens
caggcaagcccctcagccctt

SEQ ID NO: 864883 - DNA, 24 bp, Homo sapiens
caggcaagcccctcagcccttgcc

SEQ ID NO: 864884 - DNA, 13 bp, Homo sapiens
caggcacacacag

SEQ ID NO: 864885 - DNA, 15 bp, Homo sapiens
caggcacacacagcc

SEQ ID NO: 864886 - DNA, 16 bp, Homo sapiens
caggcacacacagccc

SEQ ID NO: 864887 - DNA, 14 bp, Homo sapiens
caggcacacaccac

SEQ ID NO: 864888 - DNA, 16 bp, Homo sapiens
caggcacacagcagcc

SEQ ID NO: 864889 - DNA, 15 bp, Homo sapiens
caggcacacagggcc

SEQ ID NO: 864890 - DNA, 16 bp, Homo sapiens
caggcacagaggaggt

SEQ ID NO: 864891 - DNA, 13 bp, Homo sapiens
caggcacagctga

SEQ ID NO: 864892 - DNA, 20 bp, Homo sapiens
caggcaccaccaggagcagc

SEQ ID NO: 864893 - DNA, 21 bp, Homo sapiens
caggcaccaccaggagcagca

SEQ ID NO: 864894 - DNA, 22 bp, Homo sapiens
caggcaccaccaggagcagcag

SEQ ID NO: 864895 - DNA, 20 bp, Homo sapiens
caggcaccaggactagggct

SEQ ID NO: 864896 - DNA, 18 bp, Homo sapiens
caggcaccccctggagag

SEQ ID NO: 864897 - DNA, 22 bp, Homo sapiens
caggcacccggggccagagaca

SEQ ID NO: 864898 - DNA, 13 bp, Homo sapiens
caggcacccttct

SEQ ID NO: 864899 - DNA, 16 bp, Homo sapiens
caggcacccttctttc

SEQ ID NO: 864900 - DNA, 23 bp, Homo sapiens
caggcacccttctttcctcttcc

SEQ ID NO: 864901 - DNA, 17 bp, Homo sapiens
caggcaccgagaatgtt

SEQ ID NO: 864902 - DNA, 13 bp, Homo sapiens
caggcaccgggct

SEQ ID NO: 864903 - DNA, 15 bp, Homo sapiens
caggcaccgggctgg

SEQ ID NO: 864904 - DNA, 13 bp, Homo sapiens
caggcacctggcc

SEQ ID NO: 864905 - DNA, 14 bp, Homo sapiens
caggcacctggcct

SEQ ID NO: 864906 - DNA, 15 bp, Homo sapiens
caggcacctggcctg

SEQ ID NO: 864907 - DNA, 16 bp, Homo sapiens
caggcacctggcctgc

SEQ ID NO: 864908 - DNA, 18 bp, Homo sapiens
caggcacctggcctgctg

SEQ ID NO: 864909 - DNA, 19 bp, Homo sapiens
caggcacctggcctgctgg

SEQ ID NO: 864910 - DNA, 16 bp, Homo sapiens
caggcacgggtggtcc

SEQ ID NO: 864911 - DNA, 21 bp, Homo sapiens
caggcactctcatcaccccag

SEQ ID NO: 864912 - DNA, 18 bp, Homo sapiens
caggcactggctgaactt

SEQ ID NO: 864913 - DNA, 16 bp, Homo sapiens
caggcactgtggccct

SEQ ID NO: 864914 - DNA, 19 bp, Homo sapiens
caggcactgtggcccttct

SEQ ID NO: 864915 - DNA, 16 bp, Homo sapiens
caggcagaatggctgc

SEQ ID NO: 864916 - DNA, 19 bp, Homo sapiens
caggcagaatggctgcacg

SEQ ID NO: 864917 - DNA, 14 bp, Homo sapiens
caggcagacaagag

SEQ ID NO: 864918 - DNA, 17 bp, Homo sapiens
caggcagacaagagctg

SEQ ID NO: 864919 - DNA, 21 bp, Homo sapiens
caggcagacaagagctgctgt

SEQ ID NO: 864920 - DNA, 16 bp, Homo sapiens
caggcagactacacag

SEQ ID NO: 864921 - DNA, 15 bp, Homo sapiens
caggcagagaatcat

SEQ ID NO: 864922 - DNA, 21 bp, Homo sapiens
caggcagagagtacagactgc

SEQ ID NO: 864923 - DNA, 12 bp, Homo sapiens
caggcagagctg

SEQ ID NO: 864924 - DNA, 21 bp, Homo sapiens
caggcagagctgagggccctg

SEQ ID NO: 864925 - DNA, 17 bp, Homo sapiens
caggcagagctggagcc

SEQ ID NO: 864926 - DNA, 15 bp, Homo sapiens
caggcagaggcaact

SEQ ID NO: 864927 - DNA, 16 bp, Homo sapiens
caggcagatctgtgcc

SEQ ID NO: 864928 - DNA, 19 bp, Homo sapiens
caggcagatctgtgcccca

SEQ ID NO: 864929 - DNA, 22 bp, Homo sapiens
caggcagatctgtgccccatgc

SEQ ID NO: 864930 - DNA, 20 bp, Homo sapiens
caggcagcaccacactgggt

SEQ ID NO: 864931 - DNA, 15 bp, Homo sapiens
caggcagcagacaca

SEQ ID NO: 864932 - DNA, 18 bp, Homo sapiens
caggcagccaccagtgga

SEQ ID NO: 864933 - DNA, 22 bp, Homo sapiens
caggcagccaccagtggaccta

SEQ ID NO: 864934 - DNA, 13 bp, Homo sapiens
caggcagcccagc

SEQ ID NO: 864935 - DNA, 12 bp, Homo sapiens
caggcagcctca

SEQ ID NO: 864936 - DNA, 14 bp, Homo sapiens
caggcagcctcctt

SEQ ID NO: 864937 - DNA, 15 bp, Homo sapiens
caggcagcctccttt

SEQ ID NO: 864938 - DNA, 21 bp, Homo sapiens
caggcagcgatggtctcagaa

SEQ ID NO: 864939 - DNA, 17 bp, Homo sapiens
caggcagcgcagggctg

SEQ ID NO: 864940 - DNA, 18 bp, Homo sapiens
caggcagctatttcagcc

SEQ ID NO: 864941 - DNA, 21 bp, Homo sapiens
caggcagctatttcagcctcc

SEQ ID NO: 864942 - DNA, 15 bp, Homo sapiens
caggcagctccctcc

SEQ ID NO: 864943 - DNA, 15 bp, Homo sapiens
caggcagctggatga

SEQ ID NO: 864944 - DNA, 14 bp, Homo sapiens
caggcaggcactgt

SEQ ID NO: 864945 - DNA, 21 bp, Homo sapiens
caggcaggccagatggcccct

SEQ ID NO: 864946 - DNA, 20 bp, Homo sapiens
caggcaggccaggctgcctc

SEQ ID NO: 864947 - DNA, 15 bp, Homo sapiens
caggcaggcggctcc

SEQ ID NO: 864948 - DNA, 22 bp, Homo sapiens
caggcaggcggctcctcctcac

SEQ ID NO: 864949 - DNA, 19 bp, Homo sapiens
caggcaggctgtgcgctga

SEQ ID NO: 864950 - DNA, 14 bp, Homo sapiens
caggcagggagaag

SEQ ID NO: 864951 - DNA, 20 bp, Homo sapiens
caggcagggccaacccttct

SEQ ID NO: 864952 - DNA, 11 bp, Homo sapiens
caggcagggct

SEQ ID NO: 864953 - DNA, 13 bp, Homo sapiens
caggcagggctgc

SEQ ID NO: 864954 - DNA, 21 bp, Homo sapiens
caggcaggggcatctgtctgt

SEQ ID NO: 864955 - DNA, 15 bp, Homo sapiens
caggcaggggcccac

SEQ ID NO: 864956 - DNA, 12 bp, Homo sapiens
caggcaggggtg

SEQ ID NO: 864957 - DNA, 13 bp, Homo sapiens
caggcaggggtgg

SEQ ID NO: 864958 - DNA, 17 bp, Homo sapiens
caggcaggtcacagaaa

SEQ ID NO: 864959 - DNA, 17 bp, Homo sapiens
caggcaggtctgcaagg

SEQ ID NO: 864960 - DNA, 19 bp, Homo sapiens
caggcaggtctgcaagggc

SEQ ID NO: 864961 - DNA, 20 bp, Homo sapiens
caggcaggtctgcaagggcc

SEQ ID NO: 864962 - DNA, 22 bp, Homo sapiens
caggcaggtctgcaagggccca

SEQ ID NO: 864963 - DNA, 23 bp, Homo sapiens
caggcaggtctgcaagggcccag

SEQ ID NO: 864964 - DNA, 16 bp, Homo sapiens
caggcaggtgcctgga

SEQ ID NO: 864965 - DNA, 14 bp, Homo sapiens
caggcaggtttgcc

SEQ ID NO: 864966 - DNA, 20 bp, Homo sapiens
caggcagtcgggggctggcc

SEQ ID NO: 864967 - DNA, 20 bp, Homo sapiens
caggcataaaatagagtaaa

SEQ ID NO: 864968 - DNA, 23 bp, Homo sapiens
caggcataagctatcacctagca

SEQ ID NO: 864969 - DNA, 17 bp, Homo sapiens
caggcatagaggcttct

SEQ ID NO: 864970 - DNA, 18 bp, Homo sapiens
caggcataggcctgggtg

SEQ ID NO: 864971 - DNA, 12 bp, Homo sapiens
caggcatctcct

SEQ ID NO: 864972 - DNA, 15 bp, Homo sapiens
caggcatctccttgg

SEQ ID NO: 864973 - DNA, 16 bp, Homo sapiens
caggcatctccttggg

SEQ ID NO: 864974 - DNA, 18 bp, Homo sapiens
caggcatctccttgggct

SEQ ID NO: 864975 - DNA, 23 bp, Homo sapiens
caggcatgagccaccgcgcctgg

SEQ ID NO: 864976 - DNA, 17 bp, Homo sapiens
caggcatgagccactgc

SEQ ID NO: 864977 - DNA, 19 bp, Homo sapiens
caggcatgagccactgcac

SEQ ID NO: 864978 - DNA, 22 bp, Homo sapiens
caggcatgaggaatctgggagg

SEQ ID NO: 864979 - DNA, 14 bp, Homo sapiens
caggcatgcagctg

SEQ ID NO: 864980 - DNA, 15 bp, Homo sapiens
caggcatgcagctgc

SEQ ID NO: 864981 - DNA, 16 bp, Homo sapiens
caggcatgcagctgcc

SEQ ID NO: 864982 - DNA, 17 bp, Homo sapiens
caggcatgcagctgcct

SEQ ID NO: 864983 - DNA, 23 bp, Homo sapiens
caggcatgcagctgcctggggcc

SEQ ID NO: 864984 - DNA, 15 bp, Homo sapiens
caggcatgcctgtgt

SEQ ID NO: 864985 - DNA, 15 bp, Homo sapiens
caggcatggctcaga

SEQ ID NO: 864986 - DNA, 17 bp, Homo sapiens
caggcatggctcagagc

SEQ ID NO: 864987 - DNA, 20 bp, Homo sapiens
caggcatggtagctcatgcc

SEQ ID NO: 864988 - DNA, 22 bp, Homo sapiens
caggcatggtcccttaaggcac

SEQ ID NO: 864989 - DNA, 18 bp, Homo sapiens
caggcatgtgtcccttcc

SEQ ID NO: 864990 - DNA, 19 bp, Homo sapiens
caggcattgccaagggctt

SEQ ID NO: 864991 - DNA, 19 bp, Homo sapiens
caggcattggctcagcccg

SEQ ID NO: 864992 - DNA, 21 bp, Homo sapiens
caggcattggctcagcccgct

SEQ ID NO: 864993 - DNA, 22 bp, Homo sapiens
caggccaaagagtctccagttt

SEQ ID NO: 864994 - DNA, 16 bp, Homo sapiens
caggccaaagccccat

SEQ ID NO: 864995 - DNA, 18 bp, Homo sapiens
caggccaagagcagaggc

SEQ ID NO: 864996 - DNA, 21 bp, Homo sapiens
caggccaagcccaatacagcc

SEQ ID NO: 864997 - DNA, 24 bp, Homo sapiens
caggccacagtggggctgcaggca

SEQ ID NO: 864998 - DNA, 17 bp, Homo sapiens
caggccacccccatgga

SEQ ID NO: 864999 - DNA, 15 bp, Homo sapiens
caggccacccgggct

SEQ ID NO: 865000 - DNA, 16 bp, Homo sapiens
caggccacccgggctg

SEQ ID NO: 865001 - DNA, 18 bp, Homo sapiens
caggccacctccagaaac

SEQ ID NO: 865002 - DNA, 20 bp, Homo sapiens
caggccacctccccagcatt

SEQ ID NO: 865003 - DNA, 13 bp, Homo sapiens
caggccacctgcc

SEQ ID NO: 865004 - DNA, 18 bp, Homo sapiens
caggccacctgccccctt

SEQ ID NO: 865005 - DNA, 21 bp, Homo sapiens
caggccacctgcccccttctc

SEQ ID NO: 865006 - DNA, 17 bp, Homo sapiens
caggccactgtggccag

SEQ ID NO: 865007 - DNA, 15 bp, Homo sapiens
caggccagcccagcc

SEQ ID NO: 865008 - DNA, 19 bp, Homo sapiens
caggccagcccagccaggc

SEQ ID NO: 865009 - DNA, 20 bp, Homo sapiens
caggccagcccagccaggcc

SEQ ID NO: 865010 - DNA, 14 bp, Homo sapiens
caggccagcccccc

SEQ ID NO: 865011 - DNA, 15 bp, Homo sapiens
caggccagccccccc

SEQ ID NO: 865012 - DNA, 13 bp, Homo sapiens
caggccagcctcc

SEQ ID NO: 865013 - DNA, 19 bp, Homo sapiens
caggccagcctccgagagg

SEQ ID NO: 865014 - DNA, 21 bp, Homo sapiens
caggccagcctccgagaggga

SEQ ID NO: 865015 - DNA, 23 bp, Homo sapiens
caggccagcctccgagagggaga

SEQ ID NO: 865016 - DNA, 22 bp, Homo sapiens
caggccagggcagttgacaggt

SEQ ID NO: 865017 - DNA, 22 bp, Homo sapiens
caggccagggctcaccagctgg

SEQ ID NO: 865018 - DNA, 10 bp, Homo sapiens
caggccaggt

SEQ ID NO: 865019 - DNA, 18 bp, Homo sapiens
caggccaggtgaggtcca

SEQ ID NO: 865020 - DNA, 12 bp, Homo sapiens
caggccaggtgg

SEQ ID NO: 865021 - DNA, 18 bp, Homo sapiens
caggccaggtgggcggac

SEQ ID NO: 865022 - DNA, 17 bp, Homo sapiens
caggccagtgggcctgg

SEQ ID NO: 865023 - DNA, 16 bp, Homo sapiens
caggccatgtgagcca

SEQ ID NO: 865024 - DNA, 17 bp, Homo sapiens
caggccatgtgagccac

SEQ ID NO: 865025 - DNA, 18 bp, Homo sapiens
caggccatgtggcctgcc

SEQ ID NO: 865026 - DNA, 20 bp, Homo sapiens
caggccatgtggcctgccca

SEQ ID NO: 865027 - DNA, 15 bp, Homo sapiens
caggcccaaggaggg

SEQ ID NO: 865028 - DNA, 16 bp, Homo sapiens
caggcccaaggagggt

SEQ ID NO: 865029 - DNA, 17 bp, Homo sapiens
caggcccaaggctcccg

SEQ ID NO: 865030 - DNA, 10 bp, Homo sapiens
caggcccacc

SEQ ID NO: 865031 - DNA, 16 bp, Homo sapiens
caggcccacgaggagc

SEQ ID NO: 865032 - DNA, 15 bp, Homo sapiens
caggcccactcccca

SEQ ID NO: 865033 - DNA, 13 bp, Homo sapiens
caggcccagccct

SEQ ID NO: 865034 - DNA, 18 bp, Homo sapiens
caggcccagccctccttc

SEQ ID NO: 865035 - DNA, 16 bp, Homo sapiens
caggcccagctgctcc

SEQ ID NO: 865036 - DNA, 20 bp, Homo sapiens
caggcccatctcaggtgcca

SEQ ID NO: 865037 - DNA, 13 bp, Homo sapiens
caggccccagaca

SEQ ID NO: 865038 - DNA, 15 bp, Homo sapiens
caggccccaggaaag

SEQ ID NO: 865039 - DNA, 15 bp, Homo sapiens
caggcccccaccact

SEQ ID NO: 865040 - DNA, 18 bp, Homo sapiens
caggcccccggctttcct

SEQ ID NO: 865041 - DNA, 16 bp, Homo sapiens
caggccccctgcatct

SEQ ID NO: 865042 - DNA, 19 bp, Homo sapiens
caggccccgcttgtccagc

SEQ ID NO: 865043 - DNA, 15 bp, Homo sapiens
caggcccctgaggac

SEQ ID NO: 865044 - DNA, 15 bp, Homo sapiens
caggcccgcgggcac

SEQ ID NO: 865045 - DNA, 13 bp, Homo sapiens
caggcccgcttgc

SEQ ID NO: 865046 - DNA, 14 bp, Homo sapiens
caggcccgcttgct

SEQ ID NO: 865047 - DNA, 16 bp, Homo sapiens
caggcccgcttgctgg

SEQ ID NO: 865048 - DNA, 20 bp, Homo sapiens
caggcccggactcaccaact

SEQ ID NO: 865049 - DNA, 16 bp, Homo sapiens
caggcccggcagggcg

SEQ ID NO: 865050 - DNA, 14 bp, Homo sapiens
caggcccggggctg

SEQ ID NO: 865051 - DNA, 19 bp, Homo sapiens
caggcccgtcggagctgcc

SEQ ID NO: 865052 - DNA, 23 bp, Homo sapiens
caggcccgtcggagctgcctgca

SEQ ID NO: 865053 - DNA, 16 bp, Homo sapiens
caggcccgtgggcgca

SEQ ID NO: 865054 - DNA, 16 bp, Homo sapiens
caggccctccatgggc

SEQ ID NO: 865055 - DNA, 21 bp, Homo sapiens
caggccctccatgggctagtg

SEQ ID NO: 865056 - DNA, 13 bp, Homo sapiens
caggccctcccac

SEQ ID NO: 865057 - DNA, 18 bp, Homo sapiens
caggccctcccaccaccc

SEQ ID NO: 865058 - DNA, 20 bp, Homo sapiens
caggccctcccaccacccca

SEQ ID NO: 865059 - DNA, 21 bp, Homo sapiens
caggccctcccaccaccccat

SEQ ID NO: 865060 - DNA, 16 bp, Homo sapiens
caggcgggctcaagga

SEQ ID NO: 865061 - DNA, 12 bp, Homo sapiens
caggcggggcag

SEQ ID NO: 865062 - DNA, 20 bp, Homo sapiens
caggcggggcagtatgtgat

SEQ ID NO: 865063 - DNA, 15 bp, Homo sapiens
caggcggtgggcacc

SEQ ID NO: 865064 - DNA, 15 bp, Homo sapiens
caggcgtgagccact

SEQ ID NO: 865065 - DNA, 21 bp, Homo sapiens
caggcgtgagccactgttccc

SEQ ID NO: 865066 - DNA, 14 bp, Homo sapiens
caggcgtgtggcag

SEQ ID NO: 865067 - DNA, 22 bp, Homo sapiens
caggcgtgtggcagccacacgc

SEQ ID NO: 865068 - DNA, 23 bp, Homo sapiens
caggcgtgtggcagccacacgca

SEQ ID NO: 865069 - DNA, 15 bp, Homo sapiens
caggcgtttctgaag

SEQ ID NO: 865070 - DNA, 21 bp, Homo sapiens
caggctacaatcttcatttaa

SEQ ID NO: 865071 - DNA, 15 bp, Homo sapiens
caggctacctttttc

SEQ ID NO: 865072 - DNA, 16 bp, Homo sapiens
caggctactctcctcg

SEQ ID NO: 865073 - DNA, 13 bp, Homo sapiens
caggctagatccc

SEQ ID NO: 865074 - DNA, 18 bp, Homo sapiens
caggctagatccccggtg

SEQ ID NO: 865075 - DNA, 19 bp, Homo sapiens
caggctatggttgccaccc

SEQ ID NO: 865076 - DNA, 23 bp, Homo sapiens
caggctatggttgccaccccaac

SEQ ID NO: 865077 - DNA, 19 bp, Homo sapiens
caggctatttgttcagaga

SEQ ID NO: 865078 - DNA, 20 bp, Homo sapiens
caggctatttgttcagagag

SEQ ID NO: 865079 - DNA, 16 bp, Homo sapiens
caggctcactgccagg

SEQ ID NO: 865080 - DNA, 18 bp, Homo sapiens
caggctcactgccaggcc

SEQ ID NO: 865081 - DNA, 14 bp, Homo sapiens
caggctccaagagg

SEQ ID NO: 865082 - DNA, 16 bp, Homo sapiens
caggctccaagaggct

SEQ ID NO: 865083 - DNA, 17 bp, Homo sapiens
caggctccaagaggctg

SEQ ID NO: 865084 - DNA, 14 bp, Homo sapiens
caggctccagttga

SEQ ID NO: 865085 - DNA, 19 bp, Homo sapiens
caggctccagttgaacact

SEQ ID NO: 865086 - DNA, 17 bp, Homo sapiens
caggctccccagaactg

SEQ ID NO: 865087 - DNA, 18 bp, Homo sapiens
caggctccccagaactgg

SEQ ID NO: 865088 - DNA, 23 bp, Homo sapiens
caggctccccagaactggctggg

SEQ ID NO: 865089 - DNA, 12 bp, Homo sapiens
caggctccgccc

SEQ ID NO: 865090 - DNA, 18 bp, Homo sapiens
caggctccgcccttagtc

SEQ ID NO: 865091 - DNA, 22 bp, Homo sapiens
caggctccgcccttagtccccc

SEQ ID NO: 865092 - DNA, 15 bp, Homo sapiens
caggctcctggctgt

SEQ ID NO: 865093 - DNA, 21 bp, Homo sapiens
caggctcgtcagccacctggg

SEQ ID NO: 865094 - DNA, 15 bp, Homo sapiens
caggctctagagaga

SEQ ID NO: 865095 - DNA, 17 bp, Homo sapiens
caggctctgagacacac

SEQ ID NO: 865096 - DNA, 18 bp, Homo sapiens
caggctctgagacacacc

SEQ ID NO: 865097 - DNA, 14 bp, Homo sapiens
caggctctgggcac

SEQ ID NO: 865098 - DNA, 18 bp, Homo sapiens
caggctctgggcacagtg

SEQ ID NO: 865099 - DNA, 22 bp, Homo sapiens
caggctctgggcacagtgctgc

SEQ ID NO: 865100 - DNA, 14 bp, Homo sapiens
caggctctgggctc

SEQ ID NO: 865101 - DNA, 16 bp, Homo sapiens
caggctctgggctcag

SEQ ID NO: 865102 - DNA, 23 bp, Homo sapiens
caggctctgggctcagggctgga

SEQ ID NO: 865103 - DNA, 16 bp, Homo sapiens
caggctctgttcctca

SEQ ID NO: 865104 - DNA, 21 bp, Homo sapiens
caggctctgttcctcaatggc

SEQ ID NO: 865105 - DNA, 12 bp, Homo sapiens
caggctcttagc

SEQ ID NO: 865106 - DNA, 22 bp, Homo sapiens
caggctcttagcagcttccaga

SEQ ID NO: 865107 - DNA, 18 bp, Homo sapiens
caggctcttcctggacct

SEQ ID NO: 865108 - DNA, 20 bp, Homo sapiens
caggctcttcctggacctga

SEQ ID NO: 865109 - DNA, 14 bp, Homo sapiens
caggctcttctcct

SEQ ID NO: 865110 - DNA, 23 bp, Homo sapiens
caggctctttggggtcagccagg

SEQ ID NO: 865111 - DNA, 19 bp, Homo sapiens
caggctgaaatatccaccc

SEQ ID NO: 865112 - DNA, 20 bp, Homo sapiens
caggctgaaatatccaccca

SEQ ID NO: 865113 - DNA, 17 bp, Homo sapiens
caggctgaagagaggga

SEQ ID NO: 865114 - DNA, 18 bp, Homo sapiens
caggctgaagcaggttcc

SEQ ID NO: 865115 - DNA, 19 bp, Homo sapiens
caggctgacgttccgggca

SEQ ID NO: 865116 - DNA, 14 bp, Homo sapiens
caggctgagaactc

SEQ ID NO: 865117 - DNA, 12 bp, Homo sapiens
caggctgagcct

SEQ ID NO: 865118 - DNA, 13 bp, Homo sapiens
caggctgagcctc

SEQ ID NO: 865119 - DNA, 14 bp, Homo sapiens
caggctgagcctca

SEQ ID NO: 865120 - DNA, 15 bp, Homo sapiens
caggctgagcctcag

SEQ ID NO: 865121 - DNA, 17 bp, Homo sapiens
caggctgagcctcagtc

SEQ ID NO: 865122 - DNA, 11 bp, Homo sapiens
caggctgaggt

SEQ ID NO: 865123 - DNA, 17 bp, Homo sapiens
caggctgaggtggggaa

SEQ ID NO: 865124 - DNA, 20 bp, Homo sapiens
caggctgaggtggggaagga

SEQ ID NO: 865125 - DNA, 13 bp, Homo sapiens
caggctgcactgc

SEQ ID NO: 865126 - DNA, 17 bp, Homo sapiens
caggctgcactgcagtg

SEQ ID NO: 865127 - DNA, 21 bp, Homo sapiens
caggctgcactgcagtgatgg

SEQ ID NO: 865128 - DNA, 12 bp, Homo sapiens
caggctgcagag

SEQ ID NO: 865129 - DNA, 15 bp, Homo sapiens
caggctgcagagccc

SEQ ID NO: 865130 - DNA, 17 bp, Homo sapiens
caggctgcagagcccgg

SEQ ID NO: 865131 - DNA, 18 bp, Homo sapiens
caggctgcagagcccggc

SEQ ID NO: 865132 - DNA, 17 bp, Homo sapiens
cagggcccggccacacc

SEQ ID NO: 865133 - DNA, 18 bp, Homo sapiens
cagggcccggccacaccc

SEQ ID NO: 865134 - DNA, 20 bp, Homo sapiens
cagggcccggccacacccag

SEQ ID NO: 865135 - DNA, 13 bp, Homo sapiens
cagggccctgcag

SEQ ID NO: 865136 - DNA, 18 bp, Homo sapiens
cagggccctgcagagggg

SEQ ID NO: 865137 - DNA, 12 bp, Homo sapiens
cagggccctgcc

SEQ ID NO: 865138 - DNA, 16 bp, Homo sapiens
cagggccctgccccag

SEQ ID NO: 865139 - DNA, 20 bp, Homo sapiens
cagggccctgccccaggcct

SEQ ID NO: 865140 - DNA, 22 bp, Homo sapiens
cagggccctgccccaggcctgg

SEQ ID NO: 865141 - DNA, 13 bp, Homo sapiens
cagggcctaggac

SEQ ID NO: 865142 - DNA, 12 bp, Homo sapiens
cagggcctccct

SEQ ID NO: 865143 - DNA, 18 bp, Homo sapiens
cagggcctccctgttcac

SEQ ID NO: 865144 - DNA, 23 bp, Homo sapiens
cagggcctgaaacccgccctcag

SEQ ID NO: 865145 - DNA, 17 bp, Homo sapiens
cagggcctgacaccccc

SEQ ID NO: 865146 - DNA, 20 bp, Homo sapiens
cagggcctgacaccccctcc

SEQ ID NO: 865147 - DNA, 17 bp, Homo sapiens
cagggcctgacttgagc

SEQ ID NO: 865148 - DNA, 19 bp, Homo sapiens
cagggcctgacttgagcca

SEQ ID NO: 865149 - DNA, 17 bp, Homo sapiens
cagggcctggggcctga

SEQ ID NO: 865150 - DNA, 20 bp, Homo sapiens
cagggcctggggcctgagag

SEQ ID NO: 865151 - DNA, 18 bp, Homo sapiens
cagggcctgggggcagtg

SEQ ID NO: 865152 - DNA, 20 bp, Homo sapiens
cagggcctgggggcagtgac

SEQ ID NO: 865153 - DNA, 22 bp, Homo sapiens
cagggcctgggggcagtgactg

SEQ ID NO: 865154 - DNA, 15 bp, Homo sapiens
cagggccttgcccag

SEQ ID NO: 865155 - DNA, 17 bp, Homo sapiens
cagggccttgcccagag

SEQ ID NO: 865156 - DNA, 20 bp, Homo sapiens
cagggccttgcccagagatg

SEQ ID NO: 865157 - DNA, 19 bp, Homo sapiens
cagggccttggcccagggg

SEQ ID NO: 865158 - DNA, 20 bp, Homo sapiens
cagggcctttctcctcccca

SEQ ID NO: 865159 - DNA, 16 bp, Homo sapiens
cagggcggccagggac

SEQ ID NO: 865160 - DNA, 14 bp, Homo sapiens
cagggcggctgccg

SEQ ID NO: 865161 - DNA, 21 bp, Homo sapiens
cagggcgggcagagggctgga

SEQ ID NO: 865162 - DNA, 20 bp, Homo sapiens
cagggcgggggggggggcgg

SEQ ID NO: 865163 - DNA, 15 bp, Homo sapiens
cagggcggggggggt

SEQ ID NO: 865164 - DNA, 17 bp, Homo sapiens
cagggctaagagctagc

SEQ ID NO: 865165 - DNA, 16 bp, Homo sapiens
cagggctaccctgagc

SEQ ID NO: 865166 - DNA, 18 bp, Homo sapiens
cagggctaccctgagctg

SEQ ID NO: 865167 - DNA, 19 bp, Homo sapiens
cagggctaccctgagctga

SEQ ID NO: 865168 - DNA, 21 bp, Homo sapiens
cagggctagtgaagtggcctc

SEQ ID NO: 865169 - DNA, 12 bp, Homo sapiens
cagggctcacag

SEQ ID NO: 865170 - DNA, 18 bp, Homo sapiens
cagggctcacagggcagg

SEQ ID NO: 865171 - DNA, 19 bp, Homo sapiens
cagggctcacagggcaggc

SEQ ID NO: 865172 - DNA, 21 bp, Homo sapiens
cagggctcacagggcaggcct

SEQ ID NO: 865173 - DNA, 18 bp, Homo sapiens
cagggctcagagtgaccc

SEQ ID NO: 865174 - DNA, 12 bp, Homo sapiens
cagggctcccag

SEQ ID NO: 865175 - DNA, 17 bp, Homo sapiens
cagggctcctcccagct

SEQ ID NO: 865176 - DNA, 12 bp, Homo sapiens
cagggctctccc

SEQ ID NO: 865177 - DNA, 15 bp, Homo sapiens
cagggctctgcaggc

SEQ ID NO: 865178 - DNA, 20 bp, Homo sapiens
cagggctctgcaggccactg

SEQ ID NO: 865179 - DNA, 15 bp, Homo sapiens
cagggctgccctgag

SEQ ID NO: 865180 - DNA, 17 bp, Homo sapiens
cagggctgccctgagaa

SEQ ID NO: 865181 - DNA, 13 bp, Homo sapiens
cagggctgctccc

SEQ ID NO: 865182 - DNA, 23 bp, Homo sapiens
cagggctgctgggggcaactggc

SEQ ID NO: 865183 - DNA, 13 bp, Homo sapiens
cagggctggagcc

SEQ ID NO: 865184 - DNA, 22 bp, Homo sapiens
cagggctggagtgcgctcttgg

SEQ ID NO: 865185 - DNA, 12 bp, Homo sapiens
cagggctggatg

SEQ ID NO: 865186 - DNA, 22 bp, Homo sapiens
cagggctggcacgtgacaggct

SEQ ID NO: 865187 - DNA, 13 bp, Homo sapiens
cagggctggctcc

SEQ ID NO: 865188 - DNA, 17 bp, Homo sapiens
cagggctggggacagag

SEQ ID NO: 865189 - DNA, 20 bp, Homo sapiens
cagggctggggacagagggt

SEQ ID NO: 865190 - DNA, 12 bp, Homo sapiens
cagggctggtct

SEQ ID NO: 865191 - DNA, 17 bp, Homo sapiens
cagggctgtcccagccc

SEQ ID NO: 865192 - DNA, 13 bp, Homo sapiens
cagggctgtgctt

SEQ ID NO: 865193 - DNA, 14 bp, Homo sapiens
cagggctgtgcttg

SEQ ID NO: 865194 - DNA, 19 bp, Homo sapiens
cagggcttacctgtacact

SEQ ID NO: 865195 - DNA, 18 bp, Homo sapiens
cagggcttccccatcagc

SEQ ID NO: 865196 - DNA, 22 bp, Homo sapiens
cagggcttccccatcagctccc

SEQ ID NO: 865197 - DNA, 17 bp, Homo sapiens
cagggcttctcctcctc

SEQ ID NO: 865198 - DNA, 17 bp, Homo sapiens
cagggcttgctcctgcc

SEQ ID NO: 865199 - DNA, 17 bp, Homo sapiens
cagggcttttcccagga

SEQ ID NO: 865200 - DNA, 21 bp, Homo sapiens
caggggaattccctccccctc

SEQ ID NO: 865201 - DNA, 18 bp, Homo sapiens
caggggacactggcccca

SEQ ID NO: 865202 - DNA, 14 bp, Homo sapiens
caggggacagctgg

SEQ ID NO: 865203 - DNA, 17 bp, Homo sapiens
caggggaccacacctcc

SEQ ID NO: 865204 - DNA, 16 bp, Homo sapiens
caggggaccccactcc

SEQ ID NO: 865205 - DNA, 15 bp, Homo sapiens
caggggactcagccc

SEQ ID NO: 865206 - DNA, 18 bp, Homo sapiens
caggggactcagccctga

SEQ ID NO: 865207 - DNA, 20 bp, Homo sapiens
caggggagaagcgggctggg

SEQ ID NO: 865208 - DNA, 19 bp, Homo sapiens
caggggagaatgcagccca

SEQ ID NO: 865209 - DNA, 20 bp, Homo sapiens
caggggagaatgcagcccac

SEQ ID NO: 865210 - DNA, 21 bp, Homo sapiens
caggggagacaggagcctagc

SEQ ID NO: 865211 - DNA, 13 bp, Homo sapiens
caggggagaggca

SEQ ID NO: 865212 - DNA, 19 bp, Homo sapiens
caggggagaggcattgcct

SEQ ID NO: 865213 - DNA, 17 bp, Homo sapiens
caggggagagggtctgg

SEQ ID NO: 865214 - DNA, 20 bp, Homo sapiens
caggggagagggtctggaga

SEQ ID NO: 865215 - DNA, 17 bp, Homo sapiens
caggggagatggggagg

SEQ ID NO: 865216 - DNA, 12 bp, Homo sapiens
caggggagccag

SEQ ID NO: 865217 - DNA, 13 bp, Homo sapiens
caggggagccagc

SEQ ID NO: 865218 - DNA, 19 bp, Homo sapiens
caggggagccagctgcttg

SEQ ID NO: 865219 - DNA, 17 bp, Homo sapiens
caggggagccctgattt

SEQ ID NO: 865220 - DNA, 16 bp, Homo sapiens
caggggaggtgatagc

SEQ ID NO: 865221 - DNA, 21 bp, Homo sapiens
caggggatgtttacctggtgc

SEQ ID NO: 865222 - DNA, 23 bp, Homo sapiens
caggggatgtttacctggtgctc

SEQ ID NO: 865223 - DNA, 17 bp, Homo sapiens
caggggattgaagccct

SEQ ID NO: 865224 - DNA, 21 bp, Homo sapiens
caggggattgtctcagggccg

SEQ ID NO: 865225 - DNA, 15 bp, Homo sapiens
caggggcacctccgg

SEQ ID NO: 865226 - DNA, 18 bp, Homo sapiens
caggggcacctccggctg

SEQ ID NO: 865227 - DNA, 15 bp, Homo sapiens
caggggcagcaaggc

SEQ ID NO: 865228 - DNA, 19 bp, Homo sapiens
caggggcagcaaggccttg

SEQ ID NO: 865229 - DNA, 17 bp, Homo sapiens
caggggcaggcagggct

SEQ ID NO: 865230 - DNA, 14 bp, Homo sapiens
caggggcaggcctg

SEQ ID NO: 865231 - DNA, 15 bp, Homo sapiens
caggggcaggcctgg

SEQ ID NO: 865232 - DNA, 13 bp, Homo sapiens
caggggcaggcgc

SEQ ID NO: 865233 - DNA, 21 bp, Homo sapiens
caggggcaggcgcagaggtcc

SEQ ID NO: 865234 - DNA, 21 bp, Homo sapiens
caggggcaggtggtggagggg

SEQ ID NO: 865235 - DNA, 18 bp, Homo sapiens
caggggcagtcagtggag

SEQ ID NO: 865236 - DNA, 13 bp, Homo sapiens
caggggcatctgt

SEQ ID NO: 865237 - DNA, 18 bp, Homo sapiens
caggggcatctgtctgtc

SEQ ID NO: 865238 - DNA, 22 bp, Homo sapiens
caggggcatctgtctgtctgtg

SEQ ID NO: 865239 - DNA, 15 bp, Homo sapiens
cagggtctgtgtgaa

SEQ ID NO: 865240 - DNA, 19 bp, Homo sapiens
cagggtctgtgtgaatgtg

SEQ ID NO: 865241 - DNA, 20 bp, Homo sapiens
cagggtctgtgtgaatgtgg

SEQ ID NO: 865242 - DNA, 17 bp, Homo sapiens
cagggtcttccctacct

SEQ ID NO: 865243 - DNA, 21 bp, Homo sapiens
cagggtcttccctacctcagg

SEQ ID NO: 865244 - DNA, 14 bp, Homo sapiens
cagggtcttggctg

SEQ ID NO: 865245 - DNA, 22 bp, Homo sapiens
cagggtcttggctgcctgtggg

SEQ ID NO: 865246 - DNA, 15 bp, Homo sapiens
cagggtcttgggcta

SEQ ID NO: 865247 - DNA, 19 bp, Homo sapiens
cagggtcttgggctactgg

SEQ ID NO: 865248 - DNA, 22 bp, Homo sapiens
cagggtctttctgatgacgcct

SEQ ID NO: 865249 - DNA, 15 bp, Homo sapiens
cagggtcttttcatc

SEQ ID NO: 865250 - DNA, 21 bp, Homo sapiens
cagggtcttttcatctgggaa

SEQ ID NO: 865251 - DNA, 16 bp, Homo sapiens
cagggtgacagagtga

SEQ ID NO: 865252 - DNA, 16 bp, Homo sapiens
cagggtgacgcctgag

SEQ ID NO: 865253 - DNA, 17 bp, Homo sapiens
cagggtgacgcctgaga

SEQ ID NO: 865254 - DNA, 19 bp, Homo sapiens
cagggtgacggtgacaaag

SEQ ID NO: 865255 - DNA, 22 bp, Homo sapiens
cagggtgagagctgctctggaa

SEQ ID NO: 865256 - DNA, 22 bp, Homo sapiens
cagggtgagcagggtcaagcct

SEQ ID NO: 865257 - DNA, 17 bp, Homo sapiens
cagggtgcaggagcgcc

SEQ ID NO: 865258 - DNA, 22 bp, Homo sapiens
cagggtgcagtgtgagtgtgat

SEQ ID NO: 865259 - DNA, 15 bp, Homo sapiens
cagggtggagctgag

SEQ ID NO: 865260 - DNA, 22 bp, Homo sapiens
cagggtggagctgagaagagga

SEQ ID NO: 865261 - DNA, 17 bp, Homo sapiens
cagggtgggaagaaaga

SEQ ID NO: 865262 - DNA, 16 bp, Homo sapiens
cagggtgggaagagaa

SEQ ID NO: 865263 - DNA, 18 bp, Homo sapiens
cagggtgggaagagaaga

SEQ ID NO: 865264 - DNA, 15 bp, Homo sapiens
cagggtgggagccgg

SEQ ID NO: 865265 - DNA, 22 bp, Homo sapiens
cagggtgggagccgggaccctc

SEQ ID NO: 865266 - DNA, 17 bp, Homo sapiens
cagggtgggatggagga

SEQ ID NO: 865267 - DNA, 17 bp, Homo sapiens
cagggtgggcaaactct

SEQ ID NO: 865268 - DNA, 20 bp, Homo sapiens
cagggtgggcagcctatggg

SEQ ID NO: 865269 - DNA, 19 bp, Homo sapiens
cagggtgggccactctccc

SEQ ID NO: 865270 - DNA, 23 bp, Homo sapiens
cagggtgggccactctcccctcc

SEQ ID NO: 865271 - DNA, 18 bp, Homo sapiens
cagggtgggcttcctgcc

SEQ ID NO: 865272 - DNA, 19 bp, Homo sapiens
cagggtgggcttcctgccc

SEQ ID NO: 865273 - DNA, 11 bp, Homo sapiens
cagggtggggg

SEQ ID NO: 865274 - DNA, 12 bp, Homo sapiens
cagggtgggggg

SEQ ID NO: 865275 - DNA, 13 bp, Homo sapiens
cagggtggggggt

SEQ ID NO: 865276 - DNA, 21 bp, Homo sapiens
cagggtggggtctgggagggg

SEQ ID NO: 865277 - DNA, 16 bp, Homo sapiens
cagggtggtgctggga

SEQ ID NO: 865278 - DNA, 21 bp, Homo sapiens
cagggtggtggtattctgtca

SEQ ID NO: 865279 - DNA, 21 bp, Homo sapiens
cagggtggttagaggaaaaga

SEQ ID NO: 865280 - DNA, 15 bp, Homo sapiens
cagggtgtcctgagg

SEQ ID NO: 865281 - DNA, 22 bp, Homo sapiens
cagggtgtgactcgggagctgc

SEQ ID NO: 865282 - DNA, 16 bp, Homo sapiens
cagggtgtggggccat

SEQ ID NO: 865283 - DNA, 17 bp, Homo sapiens
cagggtgtggggccatg

SEQ ID NO: 865284 - DNA, 18 bp, Homo sapiens
cagggttcaaaatgtctg

SEQ ID NO: 865285 - DNA, 18 bp, Homo sapiens
cagggttcacttgggctc

SEQ ID NO: 865286 - DNA, 15 bp, Homo sapiens
cagggttcccccagc

SEQ ID NO: 865287 - DNA, 20 bp, Homo sapiens
cagggttcccccagccctgt

SEQ ID NO: 865288 - DNA, 22 bp, Homo sapiens
cagggttcccccagccctgtgg

SEQ ID NO: 865289 - DNA, 20 bp, Homo sapiens
cagggttgaccccagaggat

SEQ ID NO: 865290 - DNA, 13 bp, Homo sapiens
cagggttgggccc

SEQ ID NO: 865291 - DNA, 14 bp, Homo sapiens
cagggttgggccca

SEQ ID NO: 865292 - DNA, 20 bp, Homo sapiens
cagggttgggcccagatctg

SEQ ID NO: 865293 - DNA, 19 bp, Homo sapiens
cagggtttcaccatgttgc

SEQ ID NO: 865294 - DNA, 20 bp, Homo sapiens
cagggtttggctgtgtctaa

SEQ ID NO: 865295 - DNA, 14 bp, Homo sapiens
caggtaaaacaggg

SEQ ID NO: 865296 - DNA, 20 bp, Homo sapiens
caggtaaaacagggccacat

SEQ ID NO: 865297 - DNA, 23 bp, Homo sapiens
caggtaaaacagggccacataga

SEQ ID NO: 865298 - DNA, 19 bp, Homo sapiens
caggtaaagggcaaataat

SEQ ID NO: 865299 - DNA, 13 bp, Homo sapiens
caggtaataataa

SEQ ID NO: 865300 - DNA, 15 bp, Homo sapiens
caggtaataataaag

SEQ ID NO: 865301 - DNA, 21 bp, Homo sapiens
caggtaatatacctggtttac

SEQ ID NO: 865302 - DNA, 20 bp, Homo sapiens
caggtaatgagggactggaa

SEQ ID NO: 865303 - DNA, 16 bp, Homo sapiens
caggtaatttaaattg

SEQ ID NO: 865304 - DNA, 14 bp, Homo sapiens
caggtacagaaaac

SEQ ID NO: 865305 - DNA, 22 bp, Homo sapiens
caggtacagcgggctgtgcccg

SEQ ID NO: 865306 - DNA, 18 bp, Homo sapiens
caggtacaggagaggcag

SEQ ID NO: 865307 - DNA, 13 bp, Homo sapiens
caggtaccagctg

SEQ ID NO: 865308 - DNA, 20 bp, Homo sapiens
caggtacttcctcctgatgg

SEQ ID NO: 865309 - DNA, 20 bp, Homo sapiens
caggtacttggagggctcag

SEQ ID NO: 865310 - DNA, 22 bp, Homo sapiens
caggtagaattatctaatttat

SEQ ID NO: 865311 - DNA, 19 bp, Homo sapiens
caggtagcaagagagcagc

SEQ ID NO: 865312 - DNA, 13 bp, Homo sapiens
caggtaggccctt

SEQ ID NO: 865313 - DNA, 19 bp, Homo sapiens
caggtaggcccttgtcctg

SEQ ID NO: 865314 - DNA, 21 bp, Homo sapiens
caggtaggcccttgtcctgcc

SEQ ID NO: 865315 - DNA, 13 bp, Homo sapiens
caggtagtactgg

SEQ ID NO: 865316 - DNA, 20 bp, Homo sapiens
caggtagtattacaccaccg

SEQ ID NO: 865317 - DNA, 22 bp, Homo sapiens
caggtatatactttgaaaggag

SEQ ID NO: 865318 - DNA, 15 bp, Homo sapiens
caggtatctccagga

SEQ ID NO: 865319 - DNA, 16 bp, Homo sapiens
caggtatggctctgca

SEQ ID NO: 865320 - DNA, 19 bp, Homo sapiens
caggtatttttttaaatca

SEQ ID NO: 865321 - DNA, 13 bp, Homo sapiens
caggtcaccatcc

SEQ ID NO: 865322 - DNA, 17 bp, Homo sapiens
caggtcactgtcactgc

SEQ ID NO: 865323 - DNA, 16 bp, Homo sapiens
caggtcagccctgtgt

SEQ ID NO: 865324 - DNA, 18 bp, Homo sapiens
caggtcagccctgtgtct

SEQ ID NO: 865325 - DNA, 23 bp, Homo sapiens
caggtcagcctcctctccctagt

SEQ ID NO: 865326 - DNA, 18 bp, Homo sapiens
caggtcaggatgcacatt

SEQ ID NO: 865327 - DNA, 14 bp, Homo sapiens
caggtcagggctca

SEQ ID NO: 865328 - DNA, 15 bp, Homo sapiens
caggtcagggctcag

SEQ ID NO: 865329 - DNA, 17 bp, Homo sapiens
caggtcaggggctccct

SEQ ID NO: 865330 - DNA, 19 bp, Homo sapiens
caggtcagttgtaataaat

SEQ ID NO: 865331 - DNA, 20 bp, Homo sapiens
caggtcagttgtaataaatc

SEQ ID NO: 865332 - DNA, 22 bp, Homo sapiens
caggtcatcagatgcctgcttg

SEQ ID NO: 865333 - DNA, 20 bp, Homo sapiens
caggtcatgcagttcctggc

SEQ ID NO: 865334 - DNA, 14 bp, Homo sapiens
caggtccagctctg

SEQ ID NO: 865335 - DNA, 17 bp, Homo sapiens
caggtcccacctccagc

SEQ ID NO: 865336 - DNA, 19 bp, Homo sapiens
caggtcccacctccagccc

SEQ ID NO: 865337 - DNA, 23 bp, Homo sapiens
caggtcccacctccagcccggga

SEQ ID NO: 865338 - DNA, 20 bp, Homo sapiens
caggtcccacgtctggccag

SEQ ID NO: 865339 - DNA, 20 bp, Homo sapiens
caggtcccagccccttttcc

SEQ ID NO: 865340 - DNA, 15 bp, Homo sapiens
caggtcccagcgagc

SEQ ID NO: 865341 - DNA, 21 bp, Homo sapiens
caggtcccagcgagccacagg

SEQ ID NO: 865342 - DNA, 18 bp, Homo sapiens
caggtcccccgactgcct

SEQ ID NO: 865343 - DNA, 22 bp, Homo sapiens
caggtcccccgactgcctgtct

SEQ ID NO: 865344 - DNA, 20 bp, Homo sapiens
caggtcctagtcgggcaggg

SEQ ID NO: 865345 - DNA, 13 bp, Homo sapiens
caggtcctgccca

SEQ ID NO: 865346 - DNA, 18 bp, Homo sapiens
caggtcctgcccatgtgt

SEQ ID NO: 865347 - DNA, 22 bp, Homo sapiens
caggtcctgcccatgtgtcccc

SEQ ID NO: 865348 - DNA, 18 bp, Homo sapiens
caggtcctgtctctgcac

SEQ ID NO: 865349 - DNA, 17 bp, Homo sapiens
caggtctagactttctc

SEQ ID NO: 865350 - DNA, 19 bp, Homo sapiens
caggtctcaaggttctcat

SEQ ID NO: 865351 - DNA, 13 bp, Homo sapiens
caggtctcccacg

SEQ ID NO: 865352 - DNA, 17 bp, Homo sapiens
caggtctcctcttaaaa

SEQ ID NO: 865353 - DNA, 22 bp, Homo sapiens
caggtctcttcctttgctctga

SEQ ID NO: 865354 - DNA, 20 bp, Homo sapiens
caggtctgcaagggcccaga

SEQ ID NO: 865355 - DNA, 20 bp, Homo sapiens
caggtggagagcactagaag

SEQ ID NO: 865356 - DNA, 16 bp, Homo sapiens
caggtggcagagtgaa

SEQ ID NO: 865357 - DNA, 20 bp, Homo sapiens
caggtggcaggaccaggact

SEQ ID NO: 865358 - DNA, 21 bp, Homo sapiens
caggtggcaggaccaggacta

SEQ ID NO: 865359 - DNA, 15 bp, Homo sapiens
caggtggccatgcct

SEQ ID NO: 865360 - DNA, 19 bp, Homo sapiens
caggtggccgcccctgagg

SEQ ID NO: 865361 - DNA, 22 bp, Homo sapiens
caggtggcctcctggcccgccc

SEQ ID NO: 865362 - DNA, 14 bp, Homo sapiens
caggtggctgaccc

SEQ ID NO: 865363 - DNA, 15 bp, Homo sapiens
caggtggctgaccca

SEQ ID NO: 865364 - DNA, 16 bp, Homo sapiens
caggtgggcctggcgg

SEQ ID NO: 865365 - DNA, 22 bp, Homo sapiens
caggtgggcctggcggcctgtg

SEQ ID NO: 865366 - DNA, 22 bp, Homo sapiens
caggtgggcggacaaaagggcc

SEQ ID NO: 865367 - DNA, 12 bp, Homo sapiens
caggtgggctgg

SEQ ID NO: 865368 - DNA, 16 bp, Homo sapiens
caggtgggctgggccc

SEQ ID NO: 865369 - DNA, 15 bp, Homo sapiens
caggtggggaggggg

SEQ ID NO: 865370 - DNA, 18 bp, Homo sapiens
caggtggggcctcagcct

SEQ ID NO: 865371 - DNA, 18 bp, Homo sapiens
caggtgggggtgggctgc

SEQ ID NO: 865372 - DNA, 22 bp, Homo sapiens
caggtggggtgatggccagagg

SEQ ID NO: 865373 - DNA, 17 bp, Homo sapiens
caggtgggtgtgggaca

SEQ ID NO: 865374 - DNA, 16 bp, Homo sapiens
caggtggtggaggggc

SEQ ID NO: 865375 - DNA, 22 bp, Homo sapiens
caggtggtggaggggcgcccag

SEQ ID NO: 865376 - DNA, 19 bp, Homo sapiens
caggtggtggcactgagcc

SEQ ID NO: 865377 - DNA, 20 bp, Homo sapiens
caggtggttatggagagggt

SEQ ID NO: 865378 - DNA, 21 bp, Homo sapiens
caggtggttgggttctgcctt

SEQ ID NO: 865379 - DNA, 13 bp, Homo sapiens
caggtggttttta

SEQ ID NO: 865380 - DNA, 19 bp, Homo sapiens
caggtgtagctgagctgtg

SEQ ID NO: 865381 - DNA, 15 bp, Homo sapiens
caggtgtcaggcccg

SEQ ID NO: 865382 - DNA, 21 bp, Homo sapiens
caggtgtcatatatggggggc

SEQ ID NO: 865383 - DNA, 13 bp, Homo sapiens
caggtgtctgaca

SEQ ID NO: 865384 - DNA, 16 bp, Homo sapiens
caggtgtctgcctaga

SEQ ID NO: 865385 - DNA, 18 bp, Homo sapiens
caggtgtgagccactgcg

SEQ ID NO: 865386 - DNA, 17 bp, Homo sapiens
caggtgtgcacagaaaa

SEQ ID NO: 865387 - DNA, 19 bp, Homo sapiens
caggtgtgcacagaaaacc

SEQ ID NO: 865388 - DNA, 13 bp, Homo sapiens
caggtgtgcacgt

SEQ ID NO: 865389 - DNA, 12 bp, Homo sapiens
caggtgtgcctg

SEQ ID NO: 865390 - DNA, 17 bp, Homo sapiens
caggtgtgcctggaaga

SEQ ID NO: 865391 - DNA, 17 bp, Homo sapiens
caggtgtggtggctcat

SEQ ID NO: 865392 - DNA, 22 bp, Homo sapiens
caggtgttactgtaattcctca

SEQ ID NO: 865393 - DNA, 13 bp, Homo sapiens
caggtgttgccaa

SEQ ID NO: 865394 - DNA, 14 bp, Homo sapiens
caggtgttgccatt

SEQ ID NO: 865395 - DNA, 20 bp, Homo sapiens
caggtgttgccatttctctg

SEQ ID NO: 865396 - DNA, 16 bp, Homo sapiens
caggtgtttctttcct

SEQ ID NO: 865397 - DNA, 17 bp, Homo sapiens
caggttacgaagacaaa

SEQ ID NO: 865398 - DNA, 13 bp, Homo sapiens
caggttagaagaa

SEQ ID NO: 865399 - DNA, 22 bp, Homo sapiens
caggttattgcaataaagtata

SEQ ID NO: 865400 - DNA, 16 bp, Homo sapiens
caggttcaacccacag

SEQ ID NO: 865401 - DNA, 17 bp, Homo sapiens
caggttcaacccacagc

SEQ ID NO: 865402 - DNA, 16 bp, Homo sapiens
caggttcccccagcaa

SEQ ID NO: 865403 - DNA, 16 bp, Homo sapiens
caggttcctggggccg

SEQ ID NO: 865404 - DNA, 21 bp, Homo sapiens
caggttcctggggccgcctgc

SEQ ID NO: 865405 - DNA, 23 bp, Homo sapiens
caggttcctggggccgcctgccc

SEQ ID NO: 865406 - DNA, 22 bp, Homo sapiens
caggttctccgttagctcctgt

SEQ ID NO: 865407 - DNA, 24 bp, Homo sapiens
caggttctccgttagctcctgtgg

SEQ ID NO: 865408 - DNA, 20 bp, Homo sapiens
caggttctgtctggtgcccc

SEQ ID NO: 865409 - DNA, 20 bp, Homo sapiens
caggttgaggggctcctgga

SEQ ID NO: 865410 - DNA, 21 bp, Homo sapiens
caggttgaggggctcctggaa

SEQ ID NO: 865411 - DNA, 21 bp, Homo sapiens
caggttggggagacttggggc

SEQ ID NO: 865412 - DNA, 23 bp, Homo sapiens
caggttgtctgaagtcactgcac

SEQ ID NO: 865413 - DNA, 23 bp, Homo sapiens
caggttgtgaaataatttttaac

SEQ ID NO: 865414 - DNA, 14 bp, Homo sapiens
caggtttaagctgt

SEQ ID NO: 865415 - DNA, 22 bp, Homo sapiens
caggtttactggacaaaatcaa

SEQ ID NO: 865416 - DNA, 15 bp, Homo sapiens
caggtttcatttctt

SEQ ID NO: 865417 - DNA, 14 bp, Homo sapiens
caggtttgccagtg

SEQ ID NO: 865418 - DNA, 15 bp, Homo sapiens
caggtttgtcctggt

SEQ ID NO: 865419 - DNA, 18 bp, Homo sapiens
caggtttgtcctggtcat

SEQ ID NO: 865420 - DNA, 15 bp, Homo sapiens
caggttttgtaaaga

SEQ ID NO: 865421 - DNA, 23 bp, Homo sapiens
caggttttgttttttttcagcca

SEQ ID NO: 865422 - DNA, 11 bp, Homo sapiens
caggtttttcc

SEQ ID NO: 865423 - DNA, 13 bp, Homo sapiens
caggtttttcctt

SEQ ID NO: 865424 - DNA, 17 bp, Homo sapiens
cagtaaaaccctgttta

SEQ ID NO: 865425 - DNA, 14 bp, Homo sapiens
cagtaaaccactga

SEQ ID NO: 865426 - DNA, 23 bp, Homo sapiens
cagtagaggctatggacagggca

SEQ ID NO: 865427 - DNA, 23 bp, Homo sapiens
cagtagagtagggtagaaggaaa

SEQ ID NO: 865428 - DNA, 17 bp, Homo sapiens
cagtagatgtgcttctg

SEQ ID NO: 865429 - DNA, 14 bp, Homo sapiens
cagtagatttcctt

SEQ ID NO: 865430 - DNA, 21 bp, Homo sapiens
cagtagcacaagttatttaaa

SEQ ID NO: 865431 - DNA, 18 bp, Homo sapiens
cagtagcagcagaggcca

SEQ ID NO: 865432 - DNA, 17 bp, Homo sapiens
cagtagcatttttctaa

SEQ ID NO: 865433 - DNA, 19 bp, Homo sapiens
cagtagccaagttatattg

SEQ ID NO: 865434 - DNA, 20 bp, Homo sapiens
cagtagctgtggtgaggtgg

SEQ ID NO: 865435 - DNA, 19 bp, Homo sapiens
cagtaggaacaagctggct

SEQ ID NO: 865436 - DNA, 12 bp, Homo sapiens
cagtaggagccc

SEQ ID NO: 865437 - DNA, 18 bp, Homo sapiens
cagtaggatgtggaacct

SEQ ID NO: 865438 - DNA, 15 bp, Homo sapiens
cagtaggattgctgt

SEQ ID NO: 865439 - DNA, 17 bp, Homo sapiens
cagtaggtccaagggcc

SEQ ID NO: 865440 - DNA, 22 bp, Homo sapiens
cagtagtagcctccaggtttcc

SEQ ID NO: 865441 - DNA, 22 bp, Homo sapiens
cagtagttcacatacaaatcat

SEQ ID NO: 865442 - DNA, 16 bp, Homo sapiens
cagtagttttcaaaac

SEQ ID NO: 865443 - DNA, 13 bp, Homo sapiens
cagtatactgtgt

SEQ ID NO: 865444 - DNA, 21 bp, Homo sapiens
cagtatataataactttattg

SEQ ID NO: 865445 - DNA, 14 bp, Homo sapiens
cagtatcatgaagc

SEQ ID NO: 865446 - DNA, 14 bp, Homo sapiens
cagtatcccacatc

SEQ ID NO: 865447 - DNA, 15 bp, Homo sapiens
cagtatcccacatcc

SEQ ID NO: 865448 - DNA, 13 bp, Homo sapiens
cagtatctcaggg

SEQ ID NO: 865449 - DNA, 17 bp, Homo sapiens
cagtatctcttacatca

SEQ ID NO: 865450 - DNA, 16 bp, Homo sapiens
cagtatcttagagttt

SEQ ID NO: 865451 - DNA, 19 bp, Homo sapiens
cagtatgaattattcaatt

SEQ ID NO: 865452 - DNA, 14 bp, Homo sapiens
cagtatgatgaaaa

SEQ ID NO: 865453 - DNA, 21 bp, Homo sapiens
cagtatgatgaaaataatttt

SEQ ID NO: 865454 - DNA, 23 bp, Homo sapiens
cagtatgatgaaaataattttcc

SEQ ID NO: 865455 - DNA, 16 bp, Homo sapiens
cagtatgctgcccctg

SEQ ID NO: 865456 - DNA, 19 bp, Homo sapiens
cagtatgctttccctgagg

SEQ ID NO: 865457 - DNA, 23 bp, Homo sapiens
cagtatgggggttgtaaattggc

SEQ ID NO: 865458 - DNA, 18 bp, Homo sapiens
cagtatgtgatggactgg

SEQ ID NO: 865459 - DNA, 20 bp, Homo sapiens
cagtatgtgtcaactgagag

SEQ ID NO: 865460 - DNA, 22 bp, Homo sapiens
cagtatgtgtcaactgagagtc

SEQ ID NO: 865461 - DNA, 15 bp, Homo sapiens
cagtatgttgtcaaa

SEQ ID NO: 865462 - DNA, 22 bp, Homo sapiens
cagtattactgctgctgtgctt

SEQ ID NO: 865463 - DNA, 20 bp, Homo sapiens
cagtattactttctgccgct

SEQ ID NO: 865464 - DNA, 22 bp, Homo sapiens
cagtattactttctgccgctgt

SEQ ID NO: 865465 - DNA, 21 bp, Homo sapiens
cagtattagcaatactggaat

SEQ ID NO: 865466 - DNA, 22 bp, Homo sapiens
cagtattatgcatatataagtt

SEQ ID NO: 865467 - DNA, 22 bp, Homo sapiens
cagtattatttctccatcccct

SEQ ID NO: 865468 - DNA, 17 bp, Homo sapiens
cagtattctaaagtttt

SEQ ID NO: 865469 - DNA, 14 bp, Homo sapiens
cagtattctcagag

SEQ ID NO: 865470 - DNA, 16 bp, Homo sapiens
cagtattcttgtcaaa

SEQ ID NO: 865471 - DNA, 18 bp, Homo sapiens
cagtattgaaaacttcaa

SEQ ID NO: 865472 - DNA, 23 bp, Homo sapiens
cagtattgaaaacttcaaagctg

SEQ ID NO: 865473 - DNA, 18 bp, Homo sapiens
cagtattgccacctctgg

SEQ ID NO: 865474 - DNA, 13 bp, Homo sapiens
cagtatttccttc

SEQ ID NO: 865475 - DNA, 16 bp, Homo sapiens
cagtatttccttccac

SEQ ID NO: 865476 - DNA, 20 bp, Homo sapiens
cagtatttccttccactgta

SEQ ID NO: 865477 - DNA, 21 bp, Homo sapiens
cagtatttctcttttattctg

SEQ ID NO: 865478 - DNA, 19 bp, Homo sapiens
cagtattttaaatgaagtg

SEQ ID NO: 865479 - DNA, 11 bp, Homo sapiens
cagtattttcc

SEQ ID NO: 865480 - DNA, 14 bp, Homo sapiens
cagtattttggaga

SEQ ID NO: 865481 - DNA, 16 bp, Homo sapiens
cagtattttgtgtcct

SEQ ID NO: 865482 - DNA, 13 bp, Homo sapiens
cagtatttttaaa

SEQ ID NO: 865483 - DNA, 15 bp, Homo sapiens
cagtatttttaaagg

SEQ ID NO: 865484 - DNA, 14 bp, Homo sapiens
cagtatttttatac

SEQ ID NO: 865485 - DNA, 13 bp, Homo sapiens
cagtatttttgcc

SEQ ID NO: 865486 - DNA, 15 bp, Homo sapiens
cagtcaaaataattc

SEQ ID NO: 865487 - DNA, 15 bp, Homo sapiens
cagtcaaatctgggc

SEQ ID NO: 865488 - DNA, 15 bp, Homo sapiens
cagtcaacctgggca

SEQ ID NO: 865489 - DNA, 13 bp, Homo sapiens
cagtcaagaagaa

SEQ ID NO: 865490 - DNA, 19 bp, Homo sapiens
cagttcccttggcctcaga

SEQ ID NO: 865491 - DNA, 23 bp, Homo sapiens
cagttccgggagagcggctgccc

SEQ ID NO: 865492 - DNA, 21 bp, Homo sapiens
cagttcctatgacacagttat

SEQ ID NO: 865493 - DNA, 17 bp, Homo sapiens
cagttcctcgccctggg

SEQ ID NO: 865494 - DNA, 15 bp, Homo sapiens
cagttcctgctctct

SEQ ID NO: 865495 - DNA, 21 bp, Homo sapiens
cagttcctgctctctgctcat

SEQ ID NO: 865496 - DNA, 11 bp, Homo sapiens
cagttcctgta

SEQ ID NO: 865497 - DNA, 18 bp, Homo sapiens
cagttcctgtggctccct

SEQ ID NO: 865498 - DNA, 15 bp, Homo sapiens
cagttcctttagaaa

SEQ ID NO: 865499 - DNA, 14 bp, Homo sapiens
cagttcgtgtttga

SEQ ID NO: 865500 - DNA, 22 bp, Homo sapiens
cagttcgttggtagagccctca

SEQ ID NO: 865501 - DNA, 17 bp, Homo sapiens
cagttctactcaggctg

SEQ ID NO: 865502 - DNA, 12 bp, Homo sapiens
cagttctcacaa

SEQ ID NO: 865503 - DNA, 18 bp, Homo sapiens
cagttctcacaatgttgc

SEQ ID NO: 865504 - DNA, 16 bp, Homo sapiens
cagttctcactcctag

SEQ ID NO: 865505 - DNA, 11 bp, Homo sapiens
cagttctctgt

SEQ ID NO: 865506 - DNA, 12 bp, Homo sapiens
cagttctctgtg

SEQ ID NO: 865507 - DNA, 14 bp, Homo sapiens
cagttctgaaagct

SEQ ID NO: 865508 - DNA, 14 bp, Homo sapiens
cagttctgaagaat

SEQ ID NO: 865509 - DNA, 15 bp, Homo sapiens
cagttctgaataact

SEQ ID NO: 865510 - DNA, 12 bp, Homo sapiens
cagttctgcaaa

SEQ ID NO: 865511 - DNA, 14 bp, Homo sapiens
cagttctgctcctc

SEQ ID NO: 865512 - DNA, 16 bp, Homo sapiens
cagttctgctcctctc

SEQ ID NO: 865513 - DNA, 19 bp, Homo sapiens
cagttctgctcctctccag

SEQ ID NO: 865514 - DNA, 21 bp, Homo sapiens
cagttctgctcctctccaggc

SEQ ID NO: 865515 - DNA, 13 bp, Homo sapiens
cagttctgggcaa

SEQ ID NO: 865516 - DNA, 18 bp, Homo sapiens
cagttctgtcatatgtta

SEQ ID NO: 865517 - DNA, 20 bp, Homo sapiens
cagttctgtggtttcatgtt

SEQ ID NO: 865518 - DNA, 20 bp, Homo sapiens
cagttcttagattcagggga

SEQ ID NO: 865519 - DNA, 21 bp, Homo sapiens
cagttcttagattcaggggaa

SEQ ID NO: 865520 - DNA, 12 bp, Homo sapiens
cagttcttggac

SEQ ID NO: 865521 - DNA, 15 bp, Homo sapiens
cagttcttggacccc

SEQ ID NO: 865522 - DNA, 16 bp, Homo sapiens
cagttcttggtgactg

SEQ ID NO: 865523 - DNA, 21 bp, Homo sapiens
cagttctttataacaaaacag

SEQ ID NO: 865524 - DNA, 17 bp, Homo sapiens
cagttctttcctctttc

SEQ ID NO: 865525 - DNA, 20 bp, Homo sapiens
cagttctttcctctttctgc

SEQ ID NO: 865526 - DNA, 21 bp, Homo sapiens
cagttctttcctctttctgct

SEQ ID NO: 865527 - DNA, 23 bp, Homo sapiens
cagttgaagaagagaaaatttga

SEQ ID NO: 865528 - DNA, 20 bp, Homo sapiens
cagttgaatgacaacagaag

SEQ ID NO: 865529 - DNA, 21 bp, Homo sapiens
cagttgaatgacaacagaagc

SEQ ID NO: 865530 - DNA, 14 bp, Homo sapiens
cagttgaattttaa

SEQ ID NO: 865531 - DNA, 14 bp, Homo sapiens
cagttgacagcagg

SEQ ID NO: 865532 - DNA, 19 bp, Homo sapiens
cagttgacatccaaatcta

SEQ ID NO: 865533 - DNA, 16 bp, Homo sapiens
cagttgatcttcttca

SEQ ID NO: 865534 - DNA, 21 bp, Homo sapiens
cagttgcagagaattgtttct

SEQ ID NO: 865535 - DNA, 18 bp, Homo sapiens
cagttgccaccacctctg

SEQ ID NO: 865536 - DNA, 21 bp, Homo sapiens
cagttgccaccacctctgtgg

SEQ ID NO: 865537 - DNA, 20 bp, Homo sapiens
cagttgccatgtagacccct

SEQ ID NO: 865538 - DNA, 22 bp, Homo sapiens
cagttgccctagcccagactct

SEQ ID NO: 865539 - DNA, 23 bp, Homo sapiens
cagttgctcaaaaagaaatcaat

SEQ ID NO: 865540 - DNA, 13 bp, Homo sapiens
cagttgctgtgaa

SEQ ID NO: 865541 - DNA, 14 bp, Homo sapiens
cagttgctgtgaac

SEQ ID NO: 865542 - DNA, 20 bp, Homo sapiens
cagttgctgtgaactttcat

SEQ ID NO: 865543 - DNA, 16 bp, Homo sapiens
cagttggactctcagg

SEQ ID NO: 865544 - DNA, 18 bp, Homo sapiens
cagttggactctcaggga

SEQ ID NO: 865545 - DNA, 16 bp, Homo sapiens
cagttgggagcactgg

SEQ ID NO: 865546 - DNA, 20 bp, Homo sapiens
cagttgggagcactggagtg

SEQ ID NO: 865547 - DNA, 21 bp, Homo sapiens
cagttgggctcgcactgccca

SEQ ID NO: 865548 - DNA, 14 bp, Homo sapiens
cagttggggccctc

SEQ ID NO: 865549 - DNA, 20 bp, Homo sapiens
cagttggggccctcttgcca

SEQ ID NO: 865550 - DNA, 23 bp, Homo sapiens
cagttggggccctcttgccagcc

SEQ ID NO: 865551 - DNA, 14 bp, Homo sapiens
cagttggtaacttt

SEQ ID NO: 865552 - DNA, 17 bp, Homo sapiens
cagttggtaacttttgt

SEQ ID NO: 865553 - DNA, 23 bp, Homo sapiens
cagttgtagggttacagagacct

SEQ ID NO: 865554 - DNA, 23 bp, Homo sapiens
cagttgtctattctgagccttga

SEQ ID NO: 865555 - DNA, 14 bp, Homo sapiens
cagttgtctctgat

SEQ ID NO: 865556 - DNA, 15 bp, Homo sapiens
cagttgtctctgatg

SEQ ID NO: 865557 - DNA, 22 bp, Homo sapiens
cagttgtgtcataaattacaca

SEQ ID NO: 865558 - DNA, 17 bp, Homo sapiens
cagttgtttgcttcttg

SEQ ID NO: 865559 - DNA, 18 bp, Homo sapiens
cagttgtttgtttttgct

SEQ ID NO: 865560 - DNA, 16 bp, Homo sapiens
cagtttaatccttcta

SEQ ID NO: 865561 - DNA, 13 bp, Homo sapiens
cagtcccctctct

SEQ ID NO: 865562 - DNA, 18 bp, Homo sapiens
cagtcccctctctctggg

SEQ ID NO: 865563 - DNA, 14 bp, Homo sapiens
cagtccctaaagaa

SEQ ID NO: 865564 - DNA, 19 bp, Homo sapiens
cagtccctctggaaagaaa

SEQ ID NO: 865565 - DNA, 12 bp, Homo sapiens
cagtccctgggg

SEQ ID NO: 865566 - DNA, 21 bp, Homo sapiens
cagtccctgggggaagccctg

SEQ ID NO: 865567 - DNA, 22 bp, Homo sapiens
cagtccctgggggaagccctgg

SEQ ID NO: 865568 - DNA, 16 bp, Homo sapiens
cagtccgttgctgaaa

SEQ ID NO: 865569 - DNA, 18 bp, Homo sapiens
cagtcctagaatgtttca

SEQ ID NO: 865570 - DNA, 12 bp, Homo sapiens
cagtcctatttt

SEQ ID NO: 865571 - DNA, 20 bp, Homo sapiens
cagtcctccactcgacccag

SEQ ID NO: 865572 - DNA, 23 bp, Homo sapiens
cagtcctccactcgacccagaat

SEQ ID NO: 865573 - DNA, 21 bp, Homo sapiens
cagtcctccagaccaccagcc

SEQ ID NO: 865574 - DNA, 22 bp, Homo sapiens
cagtcctccagaccaccagccg

SEQ ID NO: 865575 - DNA, 14 bp, Homo sapiens
cagtcctcctggga

SEQ ID NO: 865576 - DNA, 21 bp, Homo sapiens
cagtcctctcccaagtccaca

SEQ ID NO: 865577 - DNA, 13 bp, Homo sapiens
cagtcctctttca

SEQ ID NO: 865578 - DNA, 15 bp, Homo sapiens
cagtcctgaggagag

SEQ ID NO: 865579 - DNA, 19 bp, Homo sapiens
cagtcctgcctcagcctcc

SEQ ID NO: 865580 - DNA, 13 bp, Homo sapiens
cagtcctgcctgg

SEQ ID NO: 865581 - DNA, 16 bp, Homo sapiens
cagtcctgcctggcca

SEQ ID NO: 865582 - DNA, 17 bp, Homo sapiens
cagtcctgcctggccag

SEQ ID NO: 865583 - DNA, 21 bp, Homo sapiens
cagtcctgcctggccaggcag

SEQ ID NO: 865584 - DNA, 16 bp, Homo sapiens
cagtcctgctccagaa

SEQ ID NO: 865585 - DNA, 21 bp, Homo sapiens
cagtcctgggagaacctcagg

SEQ ID NO: 865586 - DNA, 22 bp, Homo sapiens
cagtcctgggagaacctcaggc

SEQ ID NO: 865587 - DNA, 12 bp, Homo sapiens
cagtcctgggtt

SEQ ID NO: 865588 - DNA, 13 bp, Homo sapiens
cagtcctgggttg

SEQ ID NO: 865589 - DNA, 17 bp, Homo sapiens
cagtcctggtcctggct

SEQ ID NO: 865590 - DNA, 19 bp, Homo sapiens
cagtcctggtcctggctgc

SEQ ID NO: 865591 - DNA, 14 bp, Homo sapiens
cagtcctgttcaga

SEQ ID NO: 865592 - DNA, 21 bp, Homo sapiens
cagtcctttcccaccattcct

SEQ ID NO: 865593 - DNA, 23 bp, Homo sapiens
cagtcctttcccaccattcctgc

SEQ ID NO: 865594 - DNA, 21 bp, Homo sapiens
cagtcctttgtaaacagtgtt

SEQ ID NO: 865595 - DNA, 14 bp, Homo sapiens
cagtcgcaggatcc

SEQ ID NO: 865596 - DNA, 18 bp, Homo sapiens
cagtcgggggctggccta

SEQ ID NO: 865597 - DNA, 23 bp, Homo sapiens
cagtcgtaaaagagataataaga

SEQ ID NO: 865598 - DNA, 12 bp, Homo sapiens
cagtcgtgatgt

SEQ ID NO: 865599 - DNA, 19 bp, Homo sapiens
cagtcgtgatgtggaggaa

SEQ ID NO: 865600 - DNA, 14 bp, Homo sapiens
cagtcgtgcctgtg

SEQ ID NO: 865601 - DNA, 15 bp, Homo sapiens
cagtcgtgcctgtgt

SEQ ID NO: 865602 - DNA, 19 bp, Homo sapiens
cagtctaacagtttgcctg

SEQ ID NO: 865603 - DNA, 15 bp, Homo sapiens
cagtctaccctgtcc

SEQ ID NO: 865604 - DNA, 19 bp, Homo sapiens
cagtctcagaatgtcattt

SEQ ID NO: 865605 - DNA, 14 bp, Homo sapiens
cagtctcagagacc

SEQ ID NO: 865606 - DNA, 16 bp, Homo sapiens
cagtctcagagaccag

SEQ ID NO: 865607 - DNA, 17 bp, Homo sapiens
cagtctcagagaccagc

SEQ ID NO: 865608 - DNA, 19 bp, Homo sapiens
cagtctcagagaccagcac

SEQ ID NO: 865609 - DNA, 23 bp, Homo sapiens
cagtctcagagaccagcactcag

SEQ ID NO: 865610 - DNA, 18 bp, Homo sapiens
cagtctcaggagcatggg

SEQ ID NO: 865611 - DNA, 19 bp, Homo sapiens
cagtctcaggagcatgggg

SEQ ID NO: 865612 - DNA, 18 bp, Homo sapiens
cagtctcagttctcttgc

SEQ ID NO: 865613 - DNA, 14 bp, Homo sapiens
cagtctcatctcct

SEQ ID NO: 865614 - DNA, 19 bp, Homo sapiens
cagtctcatctcctgaccc

SEQ ID NO: 865615 - DNA, 20 bp, Homo sapiens
cagtctcatctcctgaccct

SEQ ID NO: 865616 - DNA, 14 bp, Homo sapiens
cagtctccagggac

SEQ ID NO: 865617 - DNA, 21 bp, Homo sapiens
cagtctcccaggccccctgca

SEQ ID NO: 865618 - DNA, 14 bp, Homo sapiens
cagtctccctccct

SEQ ID NO: 865619 - DNA, 18 bp, Homo sapiens
cagtctccctttcccttc

SEQ ID NO: 865620 - DNA, 20 bp, Homo sapiens
cagtctcctcactctgtccc

SEQ ID NO: 865621 - DNA, 14 bp, Homo sapiens
cagtctctcttaaa

SEQ ID NO: 865622 - DNA, 17 bp, Homo sapiens
cagtctctcttaaagtt

SEQ ID NO: 865623 - DNA, 20 bp, Homo sapiens
cagtctctgaatacacagta

SEQ ID NO: 865624 - DNA, 12 bp, Homo sapiens
cagtctcttcca

SEQ ID NO: 865625 - DNA, 15 bp, Homo sapiens
cagtctgaagtgcct

SEQ ID NO: 865626 - DNA, 21 bp, Homo sapiens
cagtctgcagagttctcctgg

SEQ ID NO: 865627 - DNA, 12 bp, Homo sapiens
cagtctgctcca

SEQ ID NO: 865628 - DNA, 11 bp, Homo sapiens
cagtctgctct

SEQ ID NO: 865629 - DNA, 15 bp, Homo sapiens
cagtctgctctgctg

SEQ ID NO: 865630 - DNA, 14 bp, Homo sapiens
cagtctgctgccct

SEQ ID NO: 865631 - DNA, 21 bp, Homo sapiens
cagtctgctgccctccatccc

SEQ ID NO: 865632 - DNA, 16 bp, Homo sapiens
cagtctgcttagaaat

SEQ ID NO: 865633 - DNA, 15 bp, Homo sapiens
cagtctggagagctg

SEQ ID NO: 865634 - DNA, 17 bp, Homo sapiens
cagtctggtttatataa

SEQ ID NO: 865635 - DNA, 20 bp, Homo sapiens
cagtctgtaaaatacatgta

SEQ ID NO: 865636 - DNA, 14 bp, Homo sapiens
cagtctgttatgca

SEQ ID NO: 865637 - DNA, 15 bp, Homo sapiens
cagtctgttatgcac

SEQ ID NO: 865638 - DNA, 21 bp, Homo sapiens
cagtctgttatgcactgtggt

SEQ ID NO: 865639 - DNA, 20 bp, Homo sapiens
cagtctgttcactgcattca

SEQ ID NO: 865640 - DNA, 21 bp, Homo sapiens
cagtctgttccccatggccac

SEQ ID NO: 865641 - DNA, 17 bp, Homo sapiens
cagtcttaatactttat

SEQ ID NO: 865642 - DNA, 15 bp, Homo sapiens
cagtgcactcgagcc

SEQ ID NO: 865643 - DNA, 13 bp, Homo sapiens
cagtgcagacagg

SEQ ID NO: 865644 - DNA, 14 bp, Homo sapiens
cagtgcagacaggc

SEQ ID NO: 865645 - DNA, 15 bp, Homo sapiens
cagtgcagacaggcc

SEQ ID NO: 865646 - DNA, 21 bp, Homo sapiens
cagtgcagacaggccatgtga

SEQ ID NO: 865647 - DNA, 16 bp, Homo sapiens
cagtgcagcccgtgtg

SEQ ID NO: 865648 - DNA, 22 bp, Homo sapiens
cagtgcagcccgtgtggcccct

SEQ ID NO: 865649 - DNA, 19 bp, Homo sapiens
cagtgcagtccatttccta

SEQ ID NO: 865650 - DNA, 22 bp, Homo sapiens
cagtgcagtttggtgtgtcctc

SEQ ID NO: 865651 - DNA, 21 bp, Homo sapiens
cagtgcatagttgtagacaaa

SEQ ID NO: 865652 - DNA, 22 bp, Homo sapiens
cagtgcatagttgtagacaaag

SEQ ID NO: 865653 - DNA, 17 bp, Homo sapiens
cagtgcatatgcaatgt

SEQ ID NO: 865654 - DNA, 14 bp, Homo sapiens
cagtgcatgcatgt

SEQ ID NO: 865655 - DNA, 15 bp, Homo sapiens
cagtgcatgcatgtt

SEQ ID NO: 865656 - DNA, 16 bp, Homo sapiens
cagtgcatgtgaagca

SEQ ID NO: 865657 - DNA, 18 bp, Homo sapiens
cagtgcatgtgaagcatg

SEQ ID NO: 865658 - DNA, 17 bp, Homo sapiens
cagtgcattttgtttct

SEQ ID NO: 865659 - DNA, 21 bp, Homo sapiens
cagtgcattttgtttctgtat

SEQ ID NO: 865660 - DNA, 23 bp, Homo sapiens
cagtgcattttgtttctgtatat

SEQ ID NO: 865661 - DNA, 18 bp, Homo sapiens
cagtgccacagcctgctg

SEQ ID NO: 865662 - DNA, 19 bp, Homo sapiens
cagtgccactgccccccga

SEQ ID NO: 865663 - DNA, 19 bp, Homo sapiens
cagtgccacttgacattcc

SEQ ID NO: 865664 - DNA, 17 bp, Homo sapiens
cagtgccagcaatgaca

SEQ ID NO: 865665 - DNA, 15 bp, Homo sapiens
cagtgccagctccag

SEQ ID NO: 865666 - DNA, 16 bp, Homo sapiens
cagtgccagctccagt

SEQ ID NO: 865667 - DNA, 19 bp, Homo sapiens
cagtgccagctccagtgcc

SEQ ID NO: 865668 - DNA, 19 bp, Homo sapiens
cagtgccagggtgggctgg

SEQ ID NO: 865669 - DNA, 23 bp, Homo sapiens
cagtgccagggtgggctggggac

SEQ ID NO: 865670 - DNA, 16 bp, Homo sapiens
cagtgcccaccaacat

SEQ ID NO: 865671 - DNA, 15 bp, Homo sapiens
cagtgcccatgtgta

SEQ ID NO: 865672 - DNA, 18 bp, Homo sapiens
cagtgccccagggagtcc

SEQ ID NO: 865673 - DNA, 22 bp, Homo sapiens
cagtgcccgttttaccaataaa

SEQ ID NO: 865674 - DNA, 11 bp, Homo sapiens
cagtgcccttt

SEQ ID NO: 865675 - DNA, 13 bp, Homo sapiens
cagtgccctttga

SEQ ID NO: 865676 - DNA, 19 bp, Homo sapiens
cagtgccgctcctgcttcc

SEQ ID NO: 865677 - DNA, 22 bp, Homo sapiens
cagtgccgctcctgcttcccct

SEQ ID NO: 865678 - DNA, 17 bp, Homo sapiens
cagtgcctcgaggcacc

SEQ ID NO: 865679 - DNA, 20 bp, Homo sapiens
cagtgcctcgaggcaccggc

SEQ ID NO: 865680 - DNA, 14 bp, Homo sapiens
cagtgcctcttcca

SEQ ID NO: 865681 - DNA, 15 bp, Homo sapiens
cagtgcctcttccag

SEQ ID NO: 865682 - DNA, 22 bp, Homo sapiens
cagtgcctcttccagtgaacat

SEQ ID NO: 865683 - DNA, 14 bp, Homo sapiens
cagtgcctctttga

SEQ ID NO: 865684 - DNA, 11 bp, Homo sapiens
cagtgcctgcc

SEQ ID NO: 865685 - DNA, 13 bp, Homo sapiens
cagtgcctgccac

SEQ ID NO: 865686 - DNA, 14 bp, Homo sapiens
cagtgcctgccact

SEQ ID NO: 865687 - DNA, 15 bp, Homo sapiens
cagtgcctgccactc

SEQ ID NO: 865688 - DNA, 21 bp, Homo sapiens
cagtgcctgccactctctggg

SEQ ID NO: 865689 - DNA, 23 bp, Homo sapiens
cagtgcctgccactctctgggac

SEQ ID NO: 865690 - DNA, 11 bp, Homo sapiens
cagtgcctgct

SEQ ID NO: 865691 - DNA, 21 bp, Homo sapiens
cataattctaagttatttact

SEQ ID NO: 865692 - DNA, 14 bp, Homo sapiens
cataattctgaaac

SEQ ID NO: 865693 - DNA, 17 bp, Homo sapiens
cataattgattaaaatc

SEQ ID NO: 865694 - DNA, 18 bp, Homo sapiens
cataattgattaaaatct

SEQ ID NO: 865695 - DNA, 13 bp, Homo sapiens
cataatttaaaaa

SEQ ID NO: 865696 - DNA, 14 bp, Homo sapiens
cataatttaaaaat

SEQ ID NO: 865697 - DNA, 22 bp, Homo sapiens
cataatttagtttcatataaag

SEQ ID NO: 865698 - DNA, 21 bp, Homo sapiens
cataatttgtcttagttgata

SEQ ID NO: 865699 - DNA, 22 bp, Homo sapiens
cataatttgtttaaaattctct

SEQ ID NO: 865700 - DNA, 23 bp, Homo sapiens
cataatttgtttaaaattctctt

SEQ ID NO: 865701 - DNA, 14 bp, Homo sapiens
cataatttgtttcc

SEQ ID NO: 865702 - DNA, 16 bp, Homo sapiens
cataatttgtttccag

SEQ ID NO: 865703 - DNA, 21 bp, Homo sapiens
cataattttagtaatttccta

SEQ ID NO: 865704 - DNA, 20 bp, Homo sapiens
cataattttcttcatgcaat

SEQ ID NO: 865705 - DNA, 14 bp, Homo sapiens
cataattttgcata

SEQ ID NO: 865706 - DNA, 22 bp, Homo sapiens
cataattttgcatactgaaaat

SEQ ID NO: 865707 - DNA, 14 bp, Homo sapiens
cataatttttgtac

SEQ ID NO: 865708 - DNA, 15 bp, Homo sapiens
cataatttttgtaca

SEQ ID NO: 865709 - DNA, 18 bp, Homo sapiens
cataattttttttaaaga

SEQ ID NO: 865710 - DNA, 19 bp, Homo sapiens
catacaaaaattagccggg

SEQ ID NO: 865711 - DNA, 17 bp, Homo sapiens
catacaaaataaatggt

SEQ ID NO: 865712 - DNA, 16 bp, Homo sapiens
catacaacacaaagag

SEQ ID NO: 865713 - DNA, 16 bp, Homo sapiens
catacaacagaaacca

SEQ ID NO: 865714 - DNA, 17 bp, Homo sapiens
catacaacagaaaccag

SEQ ID NO: 865715 - DNA, 19 bp, Homo sapiens
catacaagtttataaagag

SEQ ID NO: 865716 - DNA, 15 bp, Homo sapiens
catacaataaaagag

SEQ ID NO: 865717 - DNA, 11 bp, Homo sapiens
catacaatgta

SEQ ID NO: 865718 - DNA, 13 bp, Homo sapiens
catacaatgtatg

SEQ ID NO: 865719 - DNA, 19 bp, Homo sapiens
catacaatgtatgtacaat

SEQ ID NO: 865720 - DNA, 15 bp, Homo sapiens
catacaattccaaac

SEQ ID NO: 865721 - DNA, 12 bp, Homo sapiens
catacacacaca

SEQ ID NO: 865722 - DNA, 14 bp, Homo sapiens
catacacacacaaa

SEQ ID NO: 865723 - DNA, 23 bp, Homo sapiens
catacacagaggagtgcagcctt

SEQ ID NO: 865724 - DNA, 14 bp, Homo sapiens
catacacatacata

SEQ ID NO: 865725 - DNA, 22 bp, Homo sapiens
catacactgtagtttttgaaaa

SEQ ID NO: 865726 - DNA, 21 bp, Homo sapiens
catacactgtatgttatagaa

SEQ ID NO: 865727 - DNA, 14 bp, Homo sapiens
catacactgtgaac

SEQ ID NO: 865728 - DNA, 20 bp, Homo sapiens
catacactttgttgcaagat

SEQ ID NO: 865729 - DNA, 21 bp, Homo sapiens
catacagaggatgccttttct

SEQ ID NO: 865730 - DNA, 13 bp, Homo sapiens
catacagcctcta

SEQ ID NO: 865731 - DNA, 10 bp, Homo sapiens
catacagttt

SEQ ID NO: 865732 - DNA, 23 bp, Homo sapiens
catacataatgtttttcctttct

SEQ ID NO: 865733 - DNA, 13 bp, Homo sapiens
catacatacacat

SEQ ID NO: 865734 - DNA, 16 bp, Homo sapiens
catacatacatacata

SEQ ID NO: 865735 - DNA, 23 bp, Homo sapiens
catacatagacatttcaaaatta

SEQ ID NO: 865736 - DNA, 22 bp, Homo sapiens
catacatatatatatttgtaac

SEQ ID NO: 865737 - DNA, 14 bp, Homo sapiens
catacatatatatc

SEQ ID NO: 865738 - DNA, 17 bp, Homo sapiens
catacatatatatctga

SEQ ID NO: 865739 - DNA, 14 bp, Homo sapiens
catacatgctactt

SEQ ID NO: 865740 - DNA, 17 bp, Homo sapiens
catacattgtataggcc

SEQ ID NO: 865741 - DNA, 24 bp, Homo sapiens
catacatttataatgtttgctatt

SEQ ID NO: 865742 - DNA, 14 bp, Homo sapiens
cataccaatgaaaa

SEQ ID NO: 865743 - DNA, 22 bp, Homo sapiens
cataccactttgacacgcttca

SEQ ID NO: 865744 - DNA, 20 bp, Homo sapiens
catacccacacattccaggg

SEQ ID NO: 865745 - DNA, 23 bp, Homo sapiens
catacccacacattccagggctg

SEQ ID NO: 865746 - DNA, 14 bp, Homo sapiens
cataccccttattg

SEQ ID NO: 865747 - DNA, 15 bp, Homo sapiens
catacccgtgacagt

SEQ ID NO: 865748 - DNA, 19 bp, Homo sapiens
catacccgtgacagtggct

SEQ ID NO: 865749 - DNA, 13 bp, Homo sapiens
cataccctccccc

SEQ ID NO: 865750 - DNA, 21 bp, Homo sapiens
cataccgaccatcgtccagcc

SEQ ID NO: 865751 - DNA, 17 bp, Homo sapiens
cataccgcctcgtgcca

SEQ ID NO: 865752 - DNA, 22 bp, Homo sapiens
catacctcagaatgtaaaagaa

SEQ ID NO: 865753 - DNA, 20 bp, Homo sapiens
catacctcagataatatgtt

SEQ ID NO: 865754 - DNA, 14 bp, Homo sapiens
cataccttccttcc

SEQ ID NO: 865755 - DNA, 15 bp, Homo sapiens
cataccttccttccc

SEQ ID NO: 865756 - DNA, 16 bp, Homo sapiens
cataccttccttccct

SEQ ID NO: 865757 - DNA, 19 bp, Homo sapiens
cataccttctggttgcttc

SEQ ID NO: 865758 - DNA, 19 bp, Homo sapiens
cataccttgtgcattgtgg

SEQ ID NO: 865759 - DNA, 16 bp, Homo sapiens
catacctttccagggt

SEQ ID NO: 865760 - DNA, 18 bp, Homo sapiens
catacgcatcccatctct

SEQ ID NO: 865761 - DNA, 21 bp, Homo sapiens
catacgcatcccatctctccc

SEQ ID NO: 865762 - DNA, 23 bp, Homo sapiens
catacggtcaggtttaacatttg

SEQ ID NO: 865763 - DNA, 13 bp, Homo sapiens
catacgtacacat

SEQ ID NO: 865764 - DNA, 15 bp, Homo sapiens
catacgtgcacaggg

SEQ ID NO: 865765 - DNA, 21 bp, Homo sapiens
catactaaccagcagaaatgc

SEQ ID NO: 865766 - DNA, 16 bp, Homo sapiens
catactcctgggctca

SEQ ID NO: 865767 - DNA, 18 bp, Homo sapiens
catactcctgggctcaag

SEQ ID NO: 865768 - DNA, 20 bp, Homo sapiens
catactccttccatcaaata

SEQ ID NO: 865769 - DNA, 15 bp, Homo sapiens
catactgaaaatcca

SEQ ID NO: 865770 - DNA, 16 bp, Homo sapiens
catactgaaaatccaa

SEQ ID NO: 865771 - DNA, 15 bp, Homo sapiens
catactgattgggag

SEQ ID NO: 865772 - DNA, 17 bp, Homo sapiens
catactgattgggaggt

SEQ ID NO: 865773 - DNA, 16 bp, Homo sapiens
catactgcatgtaagc

SEQ ID NO: 865774 - DNA, 23 bp, Homo sapiens
catactgccgaagaattgtcttg

SEQ ID NO: 865775 - DNA, 19 bp, Homo sapiens
catactgcctactgttact

SEQ ID NO: 865776 - DNA, 12 bp, Homo sapiens
catactggcctc

SEQ ID NO: 865777 - DNA, 16 bp, Homo sapiens
catactggcctctgtg

SEQ ID NO: 865778 - DNA, 13 bp, Homo sapiens
catactggcctgg

SEQ ID NO: 865779 - DNA, 15 bp, Homo sapiens
catactggcctggac

SEQ ID NO: 865780 - DNA, 18 bp, Homo sapiens
catactggcctggactgt

SEQ ID NO: 865781 - DNA, 17 bp, Homo sapiens
catactgtaacattcag

SEQ ID NO: 865782 - DNA, 17 bp, Homo sapiens
catactgtatttttact

SEQ ID NO: 865783 - DNA, 15 bp, Homo sapiens
catactgtctctgga

SEQ ID NO: 865784 - DNA, 16 bp, Homo sapiens
catactgtctctggag

SEQ ID NO: 865785 - DNA, 23 bp, Homo sapiens
catactgtctgggattaagggca

SEQ ID NO: 865786 - DNA, 16 bp, Homo sapiens
catactgtgtatgttt

SEQ ID NO: 865787 - DNA, 21 bp, Homo sapiens
catactgttttgaataaattt

SEQ ID NO: 865788 - DNA, 13 bp, Homo sapiens
catacttaaaata

SEQ ID NO: 865789 - DNA, 19 bp, Homo sapiens
catacttacatttcagaca

SEQ ID NO: 865790 - DNA, 22 bp, Homo sapiens
catacttacctagtgaaacttt

SEQ ID NO: 865791 - DNA, 14 bp, Homo sapiens
catacttctctcag

SEQ ID NO: 865792 - DNA, 16 bp, Homo sapiens
catacttctctcagat

SEQ ID NO: 865793 - DNA, 12 bp, Homo sapiens
catactttatca

SEQ ID NO: 865794 - DNA, 12 bp, Homo sapiens
catactttctct

SEQ ID NO: 865795 - DNA, 22 bp, Homo sapiens
catactttgacaaggaaaatct

SEQ ID NO: 865796 - DNA, 15 bp, Homo sapiens
catactttgtaaata

SEQ ID NO: 865797 - DNA, 16 bp, Homo sapiens
catactttgtctgaaa

SEQ ID NO: 865798 - DNA, 17 bp, Homo sapiens
catactttttaaaaaac

SEQ ID NO: 865799 - DNA, 11 bp, Homo sapiens
catagaaaaat

SEQ ID NO: 865800 - DNA, 23 bp, Homo sapiens
catagaaaaatgtataaaaatta

SEQ ID NO: 865801 - DNA, 21 bp, Homo sapiens
catagacatcagtattctgcc

SEQ ID NO: 865802 - DNA, 15 bp, Homo sapiens
catagaccctgaggc

SEQ ID NO: 865803 - DNA, 17 bp, Homo sapiens
catagaggcccaggcac

SEQ ID NO: 865804 - DNA, 15 bp, Homo sapiens
catagaggcttctcc

SEQ ID NO: 865805 - DNA, 23 bp, Homo sapiens
catagatcagcaaaccggggcct

SEQ ID NO: 865806 - DNA, 14 bp, Homo sapiens
catagatcagccat

SEQ ID NO: 865807 - DNA, 18 bp, Homo sapiens
catagatcagccattaaa

SEQ ID NO: 865808 - DNA, 16 bp, Homo sapiens
catagatcctaagcca

SEQ ID NO: 865809 - DNA, 17 bp, Homo sapiens
catagattattataaac

SEQ ID NO: 865810 - DNA, 17 bp, Homo sapiens
catagattcacctgtaa

SEQ ID NO: 865811 - DNA, 18 bp, Homo sapiens
catagattcacctgtaaa

SEQ ID NO: 865812 - DNA, 20 bp, Homo sapiens
catagattcacctgtaaaac

SEQ ID NO: 865813 - DNA, 18 bp, Homo sapiens
catagatttattttacat

SEQ ID NO: 865814 - DNA, 21 bp, Homo sapiens
catagatttattttacattta

SEQ ID NO: 865815 - DNA, 21 bp, Homo sapiens
catagatttatttttcagttc

SEQ ID NO: 865816 - DNA, 22 bp, Homo sapiens
catagatttatttttcagttcc

SEQ ID NO: 865817 - DNA, 12 bp, Homo sapiens
catagcagcttt

SEQ ID NO: 865818 - DNA, 18 bp, Homo sapiens
catagcagctttgtctct

SEQ ID NO: 865819 - DNA, 14 bp, Homo sapiens
catagcagtatatg

SEQ ID NO: 865820 - DNA, 20 bp, Homo sapiens
catagcataatatgaagcct

SEQ ID NO: 865821 - DNA, 18 bp, Homo sapiens
catagcatagccagcatt

SEQ ID NO: 865822 - DNA, 21 bp, Homo sapiens
catagcatagctagagattgg

SEQ ID NO: 865823 - DNA, 23 bp, Homo sapiens
catagcatgcttcctttctctcc

SEQ ID NO: 865824 - DNA, 16 bp, Homo sapiens
catagcattaactaat

SEQ ID NO: 865825 - DNA, 15 bp, Homo sapiens
catagccaaagccag

SEQ ID NO: 865826 - DNA, 13 bp, Homo sapiens
catagccagcatt

SEQ ID NO: 865827 - DNA, 21 bp, Homo sapiens
catagccagcattcagcacac

SEQ ID NO: 865828 - DNA, 22 bp, Homo sapiens
catagccagcattcagcacaca

SEQ ID NO: 865829 - DNA, 13 bp, Homo sapiens
catagccataaat

SEQ ID NO: 865830 - DNA, 14 bp, Homo sapiens
catagcccttacct

SEQ ID NO: 865831 - DNA, 18 bp, Homo sapiens
catagccgattctctgcc

SEQ ID NO: 865832 - DNA, 20 bp, Homo sapiens
catagccgattctctgcccg

SEQ ID NO: 865833 - DNA, 16 bp, Homo sapiens
catagcctgcctgatc

SEQ ID NO: 865834 - DNA, 21 bp, Homo sapiens
catagccttggggttggacat

SEQ ID NO: 865835 - DNA, 23 bp, Homo sapiens
catagcgccgtgctgtaaataag

SEQ ID NO: 865836 - DNA, 18 bp, Homo sapiens
catagcgggggcctaaaa

SEQ ID NO: 865837 - DNA, 15 bp, Homo sapiens
catagcgtcctgccc

SEQ ID NO: 865838 - DNA, 17 bp, Homo sapiens
catagcgtcctgccctg

SEQ ID NO: 865839 - DNA, 20 bp, Homo sapiens
catagcgtcctgccctgccc

SEQ ID NO: 865840 - DNA, 16 bp, Homo sapiens
catagctattttcctt

SEQ ID NO: 865841 - DNA, 17 bp, Homo sapiens
catagctattttccttg

SEQ ID NO: 865842 - DNA, 12 bp, Homo sapiens
catagctctcct

SEQ ID NO: 865843 - DNA, 13 bp, Homo sapiens
catagctctcctt

SEQ ID NO: 865844 - DNA, 12 bp, Homo sapiens
catagctctggg

SEQ ID NO: 865845 - DNA, 20 bp, Homo sapiens
catagctctggggtgggcag

SEQ ID NO: 865846 - DNA, 14 bp, Homo sapiens
catagctgtctaga

SEQ ID NO: 865847 - DNA, 22 bp, Homo sapiens
catagctgttttagctgaggga

SEQ ID NO: 865848 - DNA, 18 bp, Homo sapiens
cataggaaaagtacattt

SEQ ID NO: 865849 - DNA, 19 bp, Homo sapiens
cataggaaaagtacattta

SEQ ID NO: 865850 - DNA, 22 bp, Homo sapiens
cataggaaaagtacatttaata

SEQ ID NO: 865851 - DNA, 21 bp, Homo sapiens
cataggaagacataaaacttt

SEQ ID NO: 865852 - DNA, 19 bp, Homo sapiens
cataggaagggatctgaga

SEQ ID NO: 865853 - DNA, 21 bp, Homo sapiens
cataggactaccgcaggcccg

SEQ ID NO: 865854 - DNA, 23 bp, Homo sapiens
cataggactaccgcaggcccgga

SEQ ID NO: 865855 - DNA, 17 bp, Homo sapiens
cataggaggcttctgtt

SEQ ID NO: 865856 - DNA, 22 bp, Homo sapiens
cataggaggggtctggacatgt

SEQ ID NO: 865857 - DNA, 16 bp, Homo sapiens
cataggagtttggagg

SEQ ID NO: 865858 - DNA, 19 bp, Homo sapiens
cataggagtttggaggaag

SEQ ID NO: 865859 - DNA, 22 bp, Homo sapiens
cataggattccaaggctttaaa

SEQ ID NO: 865860 - DNA, 18 bp, Homo sapiens
cataggcatcatttcaca

SEQ ID NO: 865861 - DNA, 16 bp, Homo sapiens
cataggcccagccagg

SEQ ID NO: 865862 - DNA, 17 bp, Homo sapiens
cataggcggtcatgtgt

SEQ ID NO: 865863 - DNA, 21 bp, Homo sapiens
cataggctggtggccttgggc

SEQ ID NO: 865864 - DNA, 12 bp, Homo sapiens
catagggctggg

SEQ ID NO: 865865 - DNA, 13 bp, Homo sapiens
cataggggcaggt

SEQ ID NO: 865866 - DNA, 15 bp, Homo sapiens
cataggggggagggt

SEQ ID NO: 865867 - DNA, 17 bp, Homo sapiens
catagggtcactttgcc

SEQ ID NO: 865868 - DNA, 21 bp, Homo sapiens
catagggtcactttgccatta

SEQ ID NO: 865869 - DNA, 19 bp, Homo sapiens
catagggtctgcagcctgc

SEQ ID NO: 865870 - DNA, 16 bp, Homo sapiens
cataggtatttcaaaa

SEQ ID NO: 865871 - DNA, 14 bp, Homo sapiens
cataggtcactggc

SEQ ID NO: 865872 - DNA, 19 bp, Homo sapiens
cataggtcactggctctcc

SEQ ID NO: 865873 - DNA, 22 bp, Homo sapiens
cataggtctctttgctttctgg

SEQ ID NO: 865874 - DNA, 16 bp, Homo sapiens
cataggtttctctccc

SEQ ID NO: 865875 - DNA, 19 bp, Homo sapiens
cataggtttctctccctcc

SEQ ID NO: 865876 - DNA, 22 bp, Homo sapiens
catagtaccaatcattttaatt

SEQ ID NO: 865877 - DNA, 20 bp, Homo sapiens
catagtaccatttatacaaa

SEQ ID NO: 865878 - DNA, 22 bp, Homo sapiens
catagtaccatttatacaaatt

SEQ ID NO: 865879 - DNA, 21 bp, Homo sapiens
catagtactctttgtagcaaa

SEQ ID NO: 865880 - DNA, 13 bp, Homo sapiens
catagtcccagct

SEQ ID NO: 865881 - DNA, 21 bp, Homo sapiens
catagtgacctgtgtttcact

SEQ ID NO: 865882 - DNA, 18 bp, Homo sapiens
catagtgatggttcccct

SEQ ID NO: 865883 - DNA, 20 bp, Homo sapiens
catagtgcaaaactgtgtca

SEQ ID NO: 865884 - DNA, 15 bp, Homo sapiens
catagtgcctttttc

SEQ ID NO: 865885 - DNA, 13 bp, Homo sapiens
catagtgctggga

SEQ ID NO: 865886 - DNA, 17 bp, Homo sapiens
catagtgtcaagaagga

SEQ ID NO: 865887 - DNA, 14 bp, Homo sapiens
catagtgtcctgcc

SEQ ID NO: 865888 - DNA, 17 bp, Homo sapiens
catagtgtcctgcccac

SEQ ID NO: 865889 - DNA, 21 bp, Homo sapiens
catagtgtcctgcccacccta

SEQ ID NO: 865890 - DNA, 16 bp, Homo sapiens
catagttaaaaaagaa

SEQ ID NO: 865891 - DNA, 12 bp, Homo sapiens
catagttcagaa

SEQ ID NO: 865892 - DNA, 19 bp, Homo sapiens
catagttcgtttaccttca

SEQ ID NO: 865893 - DNA, 17 bp, Homo sapiens
catagtttcaaatctgt

SEQ ID NO: 865894 - DNA, 22 bp, Homo sapiens
catagtttcaaatctgtaatca

SEQ ID NO: 865895 - DNA, 17 bp, Homo sapiens
catagtttttactgaac

SEQ ID NO: 865896 - DNA, 20 bp, Homo sapiens
catataaaagttgcgtttaa

SEQ ID NO: 865897 - DNA, 20 bp, Homo sapiens
catataaaggttatgaaaca

SEQ ID NO: 865898 - DNA, 14 bp, Homo sapiens
catataaccaaaat

SEQ ID NO: 865899 - DNA, 20 bp, Homo sapiens
catataacttatattgtaag

SEQ ID NO: 865900 - DNA, 22 bp, Homo sapiens
catataagtttgaaggaaacag

SEQ ID NO: 865901 - DNA, 17 bp, Homo sapiens
catataatgttgttatt

SEQ ID NO: 865902 - DNA, 15 bp, Homo sapiens
catatacatatatat

SEQ ID NO: 865903 - DNA, 15 bp, Homo sapiens
catatactataattg

SEQ ID NO: 865904 - DNA, 17 bp, Homo sapiens
catatactataattgta

SEQ ID NO: 865905 - DNA, 14 bp, Homo sapiens
catatagaaaacaa

SEQ ID NO: 865906 - DNA, 18 bp, Homo sapiens
catataggtgatgtttgc

SEQ ID NO: 865907 - DNA, 19 bp, Homo sapiens
catatagtaaacactcaat

SEQ ID NO: 865908 - DNA, 15 bp, Homo sapiens
catatagtctattca

SEQ ID NO: 865909 - DNA, 18 bp, Homo sapiens
catatataactagctaga

SEQ ID NO: 865910 - DNA, 14 bp, Homo sapiens
catatatatataca

SEQ ID NO: 865911 - DNA, 18 bp, Homo sapiens
catatatatatacacata

SEQ ID NO: 865912 - DNA, 19 bp, Homo sapiens
catatatatatacacatac

SEQ ID NO: 865913 - DNA, 20 bp, Homo sapiens
catatatatatacacataca

SEQ ID NO: 865914 - DNA, 23 bp, Homo sapiens
catatatatatacacatacatac

SEQ ID NO: 865915 - DNA, 20 bp, Homo sapiens
catatatatatttgtaacat

SEQ ID NO: 865916 - DNA, 16 bp, Homo sapiens
catatatattacaagg

SEQ ID NO: 865917 - DNA, 12 bp, Homo sapiens
catatatcaaga

SEQ ID NO: 865918 - DNA, 17 bp, Homo sapiens
catatctggtatatgtc

SEQ ID NO: 865919 - DNA, 20 bp, Homo sapiens
catatctggtatatgtcatt

SEQ ID NO: 865920 - DNA, 21 bp, Homo sapiens
catatctggtatatgtcatta

SEQ ID NO: 865921 - DNA, 21 bp, Homo sapiens
catatctgttcaacctcagta

SEQ ID NO: 865922 - DNA, 23 bp, Homo sapiens
catatcttaaagaaacagctttc

SEQ ID NO: 865923 - DNA, 19 bp, Homo sapiens
catatcttctatatctgaa

SEQ ID NO: 865924 - DNA, 22 bp, Homo sapiens
catatcttctatatctgaagag

SEQ ID NO: 865925 - DNA, 24 bp, Homo sapiens
catatcttctatatctgaagagta

SEQ ID NO: 865926 - DNA, 23 bp, Homo sapiens
catatcttgcgaatccaagctcc

SEQ ID NO: 865927 - DNA, 22 bp, Homo sapiens
catatgaccattgagtccctgc

SEQ ID NO: 865928 - DNA, 20 bp, Homo sapiens
catatgactcacatgatgca

SEQ ID NO: 865929 - DNA, 23 bp, Homo sapiens
catatgactgattactcagagca

SEQ ID NO: 865930 - DNA, 15 bp, Homo sapiens
catatgacttgatct

SEQ ID NO: 865931 - DNA, 23 bp, Homo sapiens
catatgagaatataccttattta

SEQ ID NO: 865932 - DNA, 23 bp, Homo sapiens
catatgagcctgccctcactccc

SEQ ID NO: 865933 - DNA, 22 bp, Homo sapiens
catatgatccagttaacatcat

SEQ ID NO: 865934 - DNA, 14 bp, Homo sapiens
catatgcagaaata

SEQ ID NO: 865935 - DNA, 20 bp, Homo sapiens
catatgcagaaatagacaaa

SEQ ID NO: 865936 - DNA, 18 bp, Homo sapiens
catatgcagtgttctaca

SEQ ID NO: 865937 - DNA, 16 bp, Homo sapiens
catatgcatgccaggc

SEQ ID NO: 865938 - DNA, 21 bp, Homo sapiens
catatgccaccccatgtgcct

SEQ ID NO: 865939 - DNA, 17 bp, Homo sapiens
catatgcctacagccct

SEQ ID NO: 865940 - DNA, 21 bp, Homo sapiens
catatgcctgaccccttgctc

SEQ ID NO: 865941 - DNA, 15 bp, Homo sapiens
catatggaggcctga

SEQ ID NO: 865942 - DNA, 16 bp, Homo sapiens
catatggatgttactc

SEQ ID NO: 865943 - DNA, 23 bp, Homo sapiens
catatggattttctattgttact

SEQ ID NO: 865944 - DNA, 15 bp, Homo sapiens
catatggcccagtgt

SEQ ID NO: 865945 - DNA, 22 bp, Homo sapiens
catatgggatattcccaagccg

SEQ ID NO: 865946 - DNA, 20 bp, Homo sapiens
catatggtctccattttaca

SEQ ID NO: 865947 - DNA, 13 bp, Homo sapiens
catatgtaaaata

SEQ ID NO: 865948 - DNA, 14 bp, Homo sapiens
catatgtaaaataa

SEQ ID NO: 865949 - DNA, 17 bp, Homo sapiens
catatgtagccttcaca

SEQ ID NO: 865950 - DNA, 15 bp, Homo sapiens
catatgttaaagctt

SEQ ID NO: 865951 - DNA, 16 bp, Homo sapiens
catatgtttccccatc

SEQ ID NO: 865952 - DNA, 19 bp, Homo sapiens
catatgtttccccatctct

SEQ ID NO: 865953 - DNA, 21 bp, Homo sapiens
catatgtttccccatctctgt

SEQ ID NO: 865954 - DNA, 18 bp, Homo sapiens
catattaagacagtgtac

SEQ ID NO: 865955 - DNA, 22 bp, Homo sapiens
catattaagacagtgtacaaaa

SEQ ID NO: 865956 - DNA, 14 bp, Homo sapiens
catattaattttct

SEQ ID NO: 865957 - DNA, 16 bp, Homo sapiens
catattaccacagaca

SEQ ID NO: 865958 - DNA, 16 bp, Homo sapiens
catattactgttgcat

SEQ ID NO: 865959 - DNA, 20 bp, Homo sapiens
catattaggaaaatatgggt

SEQ ID NO: 865960 - DNA, 13 bp, Homo sapiens
catattatgtctt

SEQ ID NO: 865961 - DNA, 14 bp, Homo sapiens
catattcacacctc

SEQ ID NO: 865962 - DNA, 14 bp, Homo sapiens
catattccagcagt

SEQ ID NO: 865963 - DNA, 15 bp, Homo sapiens
catattctaaaacca

SEQ ID NO: 865964 - DNA, 20 bp, Homo sapiens
catattctattgtattattt

SEQ ID NO: 865965 - DNA, 18 bp, Homo sapiens
catattctattgtttact

SEQ ID NO: 865966 - DNA, 16 bp, Homo sapiens
catattctgttggaag

SEQ ID NO: 865967 - DNA, 20 bp, Homo sapiens
catattcttttgatcacatt

SEQ ID NO: 865968 - DNA, 15 bp, Homo sapiens
catattgaaaagcac

SEQ ID NO: 865969 - DNA, 16 bp, Homo sapiens
catattgaatgtttcc

SEQ ID NO: 865970 - DNA, 17 bp, Homo sapiens
catattgatttccgtta

SEQ ID NO: 865971 - DNA, 16 bp, Homo sapiens
catattgctgagagaa

SEQ ID NO: 865972 - DNA, 22 bp, Homo sapiens
catattggattgcgcctttgta

SEQ ID NO: 865973 - DNA, 17 bp, Homo sapiens
catcaccaggtgcatct

SEQ ID NO: 865974 - DNA, 23 bp, Homo sapiens
catcaccatgggaggtggggcct

SEQ ID NO: 865975 - DNA, 14 bp, Homo sapiens
catcaccatttcct

SEQ ID NO: 865976 - DNA, 20 bp, Homo sapiens
catcaccatttcttggcatt

SEQ ID NO: 865977 - DNA, 15 bp, Homo sapiens
catcaccgctgggtg

SEQ ID NO: 865978 - DNA, 18 bp, Homo sapiens
catcacctcaggccaggt

SEQ ID NO: 865979 - DNA, 14 bp, Homo sapiens
catcacctctttgc

SEQ ID NO: 865980 - DNA, 16 bp, Homo sapiens
catcacctctttgccc

SEQ ID NO: 865981 - DNA, 20 bp, Homo sapiens
catcacctctttgcccccga

SEQ ID NO: 865982 - DNA, 19 bp, Homo sapiens
catcacctgaaacactgga

SEQ ID NO: 865983 - DNA, 20 bp, Homo sapiens
catcacctgaaacactggac

SEQ ID NO: 865984 - DNA, 22 bp, Homo sapiens
catcacctgaaacactggacct

SEQ ID NO: 865985 - DNA, 11 bp, Homo sapiens
catcacctgct

SEQ ID NO: 865986 - DNA, 13 bp, Homo sapiens
catcaccttcctg

SEQ ID NO: 865987 - DNA, 15 bp, Homo sapiens
catcacgacacattt

SEQ ID NO: 865988 - DNA, 23 bp, Homo sapiens
catcacgtaccccactgggccag

SEQ ID NO: 865989 - DNA, 13 bp, Homo sapiens
catcactcagccc

SEQ ID NO: 865990 - DNA, 14 bp, Homo sapiens
catcactcagcccc

SEQ ID NO: 865991 - DNA, 15 bp, Homo sapiens
catcactcagcccct

SEQ ID NO: 865992 - DNA, 17 bp, Homo sapiens
catcactcagcccctac

SEQ ID NO: 865993 - DNA, 15 bp, Homo sapiens
catcactccctggat

SEQ ID NO: 865994 - DNA, 15 bp, Homo sapiens
catcactcgcaggac

SEQ ID NO: 865995 - DNA, 16 bp, Homo sapiens
catcactcgcaggacc

SEQ ID NO: 865996 - DNA, 16 bp, Homo sapiens
catcactgccttggcc

SEQ ID NO: 865997 - DNA, 18 bp, Homo sapiens
catcactggactgcatgg

SEQ ID NO: 865998 - DNA, 13 bp, Homo sapiens
catcactgtaaag

SEQ ID NO: 865999 - DNA, 20 bp, Homo sapiens
catcactgtaaagacaaata

SEQ ID NO: 866000 - DNA, 21 bp, Homo sapiens
catcactgtaaagacaaataa

SEQ ID NO: 866001 - DNA, 22 bp, Homo sapiens
catcacttaacggaccaaagca

SEQ ID NO: 866002 - DNA, 15 bp, Homo sapiens
catcacttctccccg

SEQ ID NO: 866003 - DNA, 15 bp, Homo sapiens
catcacttcttccac

SEQ ID NO: 866004 - DNA, 15 bp, Homo sapiens
catcactttgaccta

SEQ ID NO: 866005 - DNA, 11 bp, Homo sapiens
catcagaaagg

SEQ ID NO: 866006 - DNA, 17 bp, Homo sapiens
catcagaacctgagcta

SEQ ID NO: 866007 - DNA, 14 bp, Homo sapiens
catcagaaggagaa

SEQ ID NO: 866008 - DNA, 15 bp, Homo sapiens
catcagaaggagaag

SEQ ID NO: 866009 - DNA, 23 bp, Homo sapiens
catcagaaggagaaggaaggaga

SEQ ID NO: 866010 - DNA, 18 bp, Homo sapiens
catcagactctagaaaaa

SEQ ID NO: 866011 - DNA, 19 bp, Homo sapiens
catcagcacgatttctgtt

SEQ ID NO: 866012 - DNA, 21 bp, Homo sapiens
catcagcacgatttctgttta

SEQ ID NO: 866013 - DNA, 14 bp, Homo sapiens
catcagccattttt

SEQ ID NO: 866014 - DNA, 18 bp, Homo sapiens
catcagccccacaggact

SEQ ID NO: 866015 - DNA, 14 bp, Homo sapiens
catcagcccctggg

SEQ ID NO: 866016 - DNA, 19 bp, Homo sapiens
catcagcccctgggaacag

SEQ ID NO: 866017 - DNA, 16 bp, Homo sapiens
catcagcgggtctcct

SEQ ID NO: 866018 - DNA, 17 bp, Homo sapiens
catcagcgggtctcctc

SEQ ID NO: 866019 - DNA, 22 bp, Homo sapiens
catcagcgggtctcctcccagc

SEQ ID NO: 866020 - DNA, 17 bp, Homo sapiens
catcagctcccaacgag

SEQ ID NO: 866021 - DNA, 19 bp, Homo sapiens
catcagctgtaagaagaga

SEQ ID NO: 866022 - DNA, 14 bp, Homo sapiens
catcaggagactgg

SEQ ID NO: 866023 - DNA, 11 bp, Homo sapiens
catcaggcact

SEQ ID NO: 866024 - DNA, 17 bp, Homo sapiens
catcaggcactggtggc

SEQ ID NO: 866025 - DNA, 17 bp, Homo sapiens
catcaggctgttattat

SEQ ID NO: 866026 - DNA, 18 bp, Homo sapiens
catcagggacaggatgac

SEQ ID NO: 866027 - DNA, 16 bp, Homo sapiens
catcagggccctgccc

SEQ ID NO: 866028 - DNA, 18 bp, Homo sapiens
catcagggccctgcccca

SEQ ID NO: 866029 - DNA, 20 bp, Homo sapiens
catcagggccctgccccagg

SEQ ID NO: 866030 - DNA, 15 bp, Homo sapiens
catcagggcctgggg

SEQ ID NO: 866031 - DNA, 23 bp, Homo sapiens
catcagggcctggggcctgagag

SEQ ID NO: 866032 - DNA, 18 bp, Homo sapiens
catcagggcctttctcct

SEQ ID NO: 866033 - DNA, 19 bp, Homo sapiens
catcagggggaagaagcag

SEQ ID NO: 866034 - DNA, 13 bp, Homo sapiens
catcagggtgggc

SEQ ID NO: 866035 - DNA, 22 bp, Homo sapiens
catcagggtgggccactctccc

SEQ ID NO: 866036 - DNA, 18 bp, Homo sapiens
catcaggtcccccccagg

SEQ ID NO: 866037 - DNA, 16 bp, Homo sapiens
catcagtagcattttt

SEQ ID NO: 866038 - DNA, 15 bp, Homo sapiens
catcagtccctatgt

SEQ ID NO: 866039 - DNA, 16 bp, Homo sapiens
catcagtgacagactg

SEQ ID NO: 866040 - DNA, 18 bp, Homo sapiens
catcagtgtgtaaataat

SEQ ID NO: 866041 - DNA, 17 bp, Homo sapiens
catcagtgttaaaaaat

SEQ ID NO: 866042 - DNA, 22 bp, Homo sapiens
catcagtgttaaaaaatttttg

SEQ ID NO: 866043 - DNA, 15 bp, Homo sapiens
catcagttcccccag

SEQ ID NO: 866044 - DNA, 17 bp, Homo sapiens
catcagttcccccagta

SEQ ID NO: 866045 - DNA, 19 bp, Homo sapiens
catcagttcctttgtgtgt

SEQ ID NO: 866046 - DNA, 14 bp, Homo sapiens
catcataaaataaa

SEQ ID NO: 866047 - DNA, 18 bp, Homo sapiens
catcataaaataaagtat

SEQ ID NO: 866048 - DNA, 20 bp, Homo sapiens
catcataaaataaagtatat

SEQ ID NO: 866049 - DNA, 22 bp, Homo sapiens
catcataaaataaagtatatat

SEQ ID NO: 866050 - DNA, 23 bp, Homo sapiens
catcataaaataaagtatatata

SEQ ID NO: 866051 - DNA, 14 bp, Homo sapiens
catcataattacat

SEQ ID NO: 866052 - DNA, 15 bp, Homo sapiens
catcataattacatt

SEQ ID NO: 866053 - DNA, 17 bp, Homo sapiens
catcataggaagggacc

SEQ ID NO: 866054 - DNA, 22 bp, Homo sapiens
catcataggaagggaccaaggc

SEQ ID NO: 866055 - DNA, 13 bp, Homo sapiens
catcataggtaac

SEQ ID NO: 866056 - DNA, 13 bp, Homo sapiens
catcatatgcctg

SEQ ID NO: 866057 - DNA, 12 bp, Homo sapiens
catcatcactgt

SEQ ID NO: 866058 - DNA, 15 bp, Homo sapiens
catcatcagggcctg

SEQ ID NO: 866059 - DNA, 13 bp, Homo sapiens
catcatccacccg

SEQ ID NO: 866060 - DNA, 22 bp, Homo sapiens
catcatccacccgctgcccctc

SEQ ID NO: 866061 - DNA, 16 bp, Homo sapiens
catcatcctaagctat

SEQ ID NO: 866062 - DNA, 14 bp, Homo sapiens
catcatcctttgtt

SEQ ID NO: 866063 - DNA, 13 bp, Homo sapiens
catcatctcctgc

SEQ ID NO: 866064 - DNA, 17 bp, Homo sapiens
catcatgaccagcaaat

SEQ ID NO: 866065 - DNA, 20 bp, Homo sapiens
catcatgccttgataaatat

SEQ ID NO: 866066 - DNA, 15 bp, Homo sapiens
catcatgtctattgt

SEQ ID NO: 866067 - DNA, 22 bp, Homo sapiens
catcattacccttccctgcact

SEQ ID NO: 866068 - DNA, 12 bp, Homo sapiens
catcattacttg

SEQ ID NO: 866069 - DNA, 17 bp, Homo sapiens
catcattataaacgtga

SEQ ID NO: 866070 - DNA, 12 bp, Homo sapiens
catcattcatga

SEQ ID NO: 866071 - DNA, 20 bp, Homo sapiens
catcattccctctcatctca

SEQ ID NO: 866072 - DNA, 12 bp, Homo sapiens
catcattctctg

SEQ ID NO: 866073 - DNA, 13 bp, Homo sapiens
catcattctgtgt

SEQ ID NO: 866074 - DNA, 21 bp, Homo sapiens
catcattcttgtgggagacag

SEQ ID NO: 866075 - DNA, 22 bp, Homo sapiens
catcattcttgtgggagacagc

SEQ ID NO: 866076 - DNA, 15 bp, Homo sapiens
catcattgtatatat

SEQ ID NO: 866077 - DNA, 19 bp, Homo sapiens
catcattgtatatatgtgt

SEQ ID NO: 866078 - DNA, 12 bp, Homo sapiens
catcatttcagc

SEQ ID NO: 866079 - DNA, 13 bp, Homo sapiens
catcatttcagcc

SEQ ID NO: 866080 - DNA, 15 bp, Homo sapiens
catcatttcagccaa

SEQ ID NO: 866081 - DNA, 21 bp, Homo sapiens
catcatttcagccaaagtcct

SEQ ID NO: 866082 - DNA, 14 bp, Homo sapiens
catcatttcctggg

SEQ ID NO: 866083 - DNA, 12 bp, Homo sapiens
catcatttctgt

SEQ ID NO: 866084 - DNA, 16 bp, Homo sapiens
catcattttgcattca

SEQ ID NO: 866085 - DNA, 18 bp, Homo sapiens
catcattttgcattcaaa

SEQ ID NO: 866086 - DNA, 21 bp, Homo sapiens
catccaaaatattttttgcaa

SEQ ID NO: 866087 - DNA, 23 bp, Homo sapiens
catccaaaatcttgatcagttaa

SEQ ID NO: 866088 - DNA, 16 bp, Homo sapiens
catccaaagcagacag

SEQ ID NO: 866089 - DNA, 21 bp, Homo sapiens
catccaaagcagacagctcca

SEQ ID NO: 866090 - DNA, 14 bp, Homo sapiens
catccaaagttgcc

SEQ ID NO: 866091 - DNA, 18 bp, Homo sapiens
catccaaataagaaacct

SEQ ID NO: 866092 - DNA, 15 bp, Homo sapiens
catccaacaagaaga

SEQ ID NO: 866093 - DNA, 17 bp, Homo sapiens
catccaaccactgtaca

SEQ ID NO: 866094 - DNA, 19 bp, Homo sapiens
catcctgaggccagtggcc

SEQ ID NO: 866095 - DNA, 20 bp, Homo sapiens
catcctgcaaaggcccttgt

SEQ ID NO: 866096 - DNA, 20 bp, Homo sapiens
catcctgcagcctcctcctg

SEQ ID NO: 866097 - DNA, 21 bp, Homo sapiens
catcctgctcttttgtgatga

SEQ ID NO: 866098 - DNA, 11 bp, Homo sapiens
catcctgctgg

SEQ ID NO: 866099 - DNA, 13 bp, Homo sapiens
catcctgcttctc

SEQ ID NO: 866100 - DNA, 12 bp, Homo sapiens
catcctggcccc

SEQ ID NO: 866101 - DNA, 14 bp, Homo sapiens
catcctggcccctc

SEQ ID NO: 866102 - DNA, 14 bp, Homo sapiens
catcctggcctcct

SEQ ID NO: 866103 - DNA, 11 bp, Homo sapiens
catcctggctg

SEQ ID NO: 866104 - DNA, 13 bp, Homo sapiens
catcctggctgcg

SEQ ID NO: 866105 - DNA, 15 bp, Homo sapiens
catcctgtataagca

SEQ ID NO: 866106 - DNA, 12 bp, Homo sapiens
catcctgtgaag

SEQ ID NO: 866107 - DNA, 23 bp, Homo sapiens
catcctgtgccactaaactacat

SEQ ID NO: 866108 - DNA, 19 bp, Homo sapiens
catcctgtttgtatgaaat

SEQ ID NO: 866109 - DNA, 14 bp, Homo sapiens
catccttgcctgtc

SEQ ID NO: 866110 - DNA, 16 bp, Homo sapiens
catccttgcctgtcta

SEQ ID NO: 866111 - DNA, 13 bp, Homo sapiens
catccttgtaata

SEQ ID NO: 866112 - DNA, 12 bp, Homo sapiens
catcctttccct

SEQ ID NO: 866113 - DNA, 16 bp, Homo sapiens
catcctttgcactgtc

SEQ ID NO: 866114 - DNA, 17 bp, Homo sapiens
catccttttctgcagag

SEQ ID NO: 866115 - DNA, 18 bp, Homo sapiens
catcgcaccattctgact

SEQ ID NO: 866116 - DNA, 13 bp, Homo sapiens
catcgcagcttcc

SEQ ID NO: 866117 - DNA, 14 bp, Homo sapiens
catcgcagcttcct

SEQ ID NO: 866118 - DNA, 20 bp, Homo sapiens
catcgcaggagtctctgcca

SEQ ID NO: 866119 - DNA, 21 bp, Homo sapiens
catcgcaggagtctctgccac

SEQ ID NO: 866120 - DNA, 20 bp, Homo sapiens
catcgccagaggtgcttcac

SEQ ID NO: 866121 - DNA, 16 bp, Homo sapiens
catcgccatcttcttc

SEQ ID NO: 866122 - DNA, 15 bp, Homo sapiens
catcgccccaactcc

SEQ ID NO: 866123 - DNA, 12 bp, Homo sapiens
catcgcctctgt

SEQ ID NO: 866124 - DNA, 20 bp, Homo sapiens
catcggacaagacccccagc

SEQ ID NO: 866125 - DNA, 21 bp, Homo sapiens
catcggacaagacccccagca

SEQ ID NO: 866126 - DNA, 17 bp, Homo sapiens
catcggaggctgggccc

SEQ ID NO: 866127 - DNA, 19 bp, Homo sapiens
catcggaggctgggcccct

SEQ ID NO: 866128 - DNA, 20 bp, Homo sapiens
catcggaggctgggcccctg

SEQ ID NO: 866129 - DNA, 22 bp, Homo sapiens
catcggaggctgggcccctggg

SEQ ID NO: 866130 - DNA, 23 bp, Homo sapiens
catcggaggctgggcccctggga

SEQ ID NO: 866131 - DNA, 20 bp, Homo sapiens
catcggccaagaatacttga

SEQ ID NO: 866132 - DNA, 21 bp, Homo sapiens
catcggccaagaatacttgaa

SEQ ID NO: 866133 - DNA, 13 bp, Homo sapiens
catcggccctgtc

SEQ ID NO: 866134 - DNA, 20 bp, Homo sapiens
catcgggagcacccagagca

SEQ ID NO: 866135 - DNA, 17 bp, Homo sapiens
catcgggcccagggaca

SEQ ID NO: 866136 - DNA, 13 bp, Homo sapiens
catcgggctgagg

SEQ ID NO: 866137 - DNA, 14 bp, Homo sapiens
catcgggggcctgc

SEQ ID NO: 866138 - DNA, 20 bp, Homo sapiens
catcggggggtgggagggat

SEQ ID NO: 866139 - DNA, 17 bp, Homo sapiens
catcggtaggcaaagga

SEQ ID NO: 866140 - DNA, 13 bp, Homo sapiens
catcggtgcctgg

SEQ ID NO: 866141 - DNA, 14 bp, Homo sapiens
catcgtagaagaga

SEQ ID NO: 866142 - DNA, 21 bp, Homo sapiens
catcgtagaagagatgtggca

SEQ ID NO: 866143 - DNA, 21 bp, Homo sapiens
catcgtataacacaatatgaa

SEQ ID NO: 866144 - DNA, 15 bp, Homo sapiens
catcgtccagccctc

SEQ ID NO: 866145 - DNA, 13 bp, Homo sapiens
catcgtcctggga

SEQ ID NO: 866146 - DNA, 23 bp, Homo sapiens
catcgtcctgggactcggagact

SEQ ID NO: 866147 - DNA, 17 bp, Homo sapiens
catcgtctcatcctcct

SEQ ID NO: 866148 - DNA, 18 bp, Homo sapiens
catcgtctcatcctcctt

SEQ ID NO: 866149 - DNA, 20 bp, Homo sapiens
catcgtctcatcctcctttc

SEQ ID NO: 866150 - DNA, 20 bp, Homo sapiens
catcgtgaaaccctgtctct

SEQ ID NO: 866151 - DNA, 13 bp, Homo sapiens
catcgtgaccctt

SEQ ID NO: 866152 - DNA, 19 bp, Homo sapiens
catcgtgacccttcagggc

SEQ ID NO: 866153 - DNA, 22 bp, Homo sapiens
catcgtgggtcactacagggag

SEQ ID NO: 866154 - DNA, 15 bp, Homo sapiens
catcgttccccaccc

SEQ ID NO: 866155 - DNA, 16 bp, Homo sapiens
catcgttgagacatca

SEQ ID NO: 866156 - DNA, 23 bp, Homo sapiens
catcgttgagacatcaggaaggt

SEQ ID NO: 866157 - DNA, 22 bp, Homo sapiens
catcgttttcttcactgtcctc

SEQ ID NO: 866158 - DNA, 19 bp, Homo sapiens
catctaaagctttatcttt

SEQ ID NO: 866159 - DNA, 15 bp, Homo sapiens
catctaacctcatct

SEQ ID NO: 866160 - DNA, 18 bp, Homo sapiens
catctaatgcttgtttat

SEQ ID NO: 866161 - DNA, 22 bp, Homo sapiens
catctaatgtctcttcctctgt

SEQ ID NO: 866162 - DNA, 21 bp, Homo sapiens
catctaattctctgtggaatg

SEQ ID NO: 866163 - DNA, 19 bp, Homo sapiens
catctacaatcagttgact

SEQ ID NO: 866164 - DNA, 21 bp, Homo sapiens
catctacctatacttaatcta

SEQ ID NO: 866165 - DNA, 19 bp, Homo sapiens
catctactgaatgacctct

SEQ ID NO: 866166 - DNA, 15 bp, Homo sapiens
catctacttaataaa

SEQ ID NO: 866167 - DNA, 16 bp, Homo sapiens
catctacttaataaat

SEQ ID NO: 866168 - DNA, 14 bp, Homo sapiens
catctacttcaggc

SEQ ID NO: 866169 - DNA, 17 bp, Homo sapiens
catctagcagctggcct

SEQ ID NO: 866170 - DNA, 13 bp, Homo sapiens
catctagccagcc

SEQ ID NO: 866171 - DNA, 22 bp, Homo sapiens
catctagccagcccctcttccc

SEQ ID NO: 866172 - DNA, 17 bp, Homo sapiens
catctatagaaagctat

SEQ ID NO: 866173 - DNA, 19 bp, Homo sapiens
catctatcgagtttgcaat

SEQ ID NO: 866174 - DNA, 15 bp, Homo sapiens
catctatctcaatcc

SEQ ID NO: 866175 - DNA, 16 bp, Homo sapiens
catctatctcaatcct

SEQ ID NO: 866176 - DNA, 20 bp, Homo sapiens
catctatctcatctatctca

SEQ ID NO: 866177 - DNA, 19 bp, Homo sapiens
catctatctggtgatttct

SEQ ID NO: 866178 - DNA, 13 bp, Homo sapiens
catctatgtcata

SEQ ID NO: 866179 - DNA, 13 bp, Homo sapiens
catctatttctga

SEQ ID NO: 866180 - DNA, 16 bp, Homo sapiens
catctcaaaacagagg

SEQ ID NO: 866181 - DNA, 20 bp, Homo sapiens
catctcaaaacagagggctg

SEQ ID NO: 866182 - DNA, 21 bp, Homo sapiens
catctcaaaacagagggctgc

SEQ ID NO: 866183 - DNA, 22 bp, Homo sapiens
catctcaaaacagagggctgca

SEQ ID NO: 866184 - DNA, 14 bp, Homo sapiens
catctcaaaattat

SEQ ID NO: 866185 - DNA, 13 bp, Homo sapiens
catctcacctctc

SEQ ID NO: 866186 - DNA, 13 bp, Homo sapiens
catctcagacctt

SEQ ID NO: 866187 - DNA, 13 bp, Homo sapiens
catctcagagtcc

SEQ ID NO: 866188 - DNA, 14 bp, Homo sapiens
catctcagcctcct

SEQ ID NO: 866189 - DNA, 19 bp, Homo sapiens
catctcagcctcctgagcc

SEQ ID NO: 866190 - DNA, 22 bp, Homo sapiens
catctcagcctcctgagcctgt

SEQ ID NO: 866191 - DNA, 18 bp, Homo sapiens
catctcaggagatttcat

SEQ ID NO: 866192 - DNA, 14 bp, Homo sapiens
catctcaggccacc

SEQ ID NO: 866193 - DNA, 15 bp, Homo sapiens
catctcaggccacct

SEQ ID NO: 866194 - DNA, 20 bp, Homo sapiens
catctcaggccacctgcccc

SEQ ID NO: 866195 - DNA, 12 bp, Homo sapiens
catctcaggtgc

SEQ ID NO: 866196 - DNA, 11 bp, Homo sapiens
catctcatcct

SEQ ID NO: 866197 - DNA, 18 bp, Homo sapiens
catctcatcctggcacgc

SEQ ID NO: 866198 - DNA, 18 bp, Homo sapiens
catctcatgaggggagag

SEQ ID NO: 866199 - DNA, 17 bp, Homo sapiens
catctcattccaacttc

SEQ ID NO: 866200 - DNA, 14 bp, Homo sapiens
catctccactccag

SEQ ID NO: 866201 - DNA, 11 bp, Homo sapiens
catctccaggg

SEQ ID NO: 866202 - DNA, 22 bp, Homo sapiens
catctccagggagcaagacaga

SEQ ID NO: 866203 - DNA, 14 bp, Homo sapiens
catctccagggagt

SEQ ID NO: 866204 - DNA, 19 bp, Homo sapiens
catctccagggagtcccct

SEQ ID NO: 866205 - DNA, 22 bp, Homo sapiens
catctccagggagtcccctccc

SEQ ID NO: 866206 - DNA, 14 bp, Homo sapiens
catctccatcagct

SEQ ID NO: 866207 - DNA, 15 bp, Homo sapiens
catctccatcagctg

SEQ ID NO: 866208 - DNA, 19 bp, Homo sapiens
catctccatcatatgcctg

SEQ ID NO: 866209 - DNA, 20 bp, Homo sapiens
catctccatcatatgcctga

SEQ ID NO: 866210 - DNA, 16 bp, Homo sapiens
catctccatgtagaat

SEQ ID NO: 866211 - DNA, 21 bp, Homo sapiens
catctcccacctagcagcacc

SEQ ID NO: 866212 - DNA, 22 bp, Homo sapiens
catctcccagataatgtgaaaa

SEQ ID NO: 866213 - DNA, 19 bp, Homo sapiens
catctccccaggcctccag

SEQ ID NO: 866214 - DNA, 15 bp, Homo sapiens
catctccctcccaca

SEQ ID NO: 866215 - DNA, 21 bp, Homo sapiens
catctccctccccagaaacag

SEQ ID NO: 866216 - DNA, 14 bp, Homo sapiens
catctccctgccat

SEQ ID NO: 866217 - DNA, 15 bp, Homo sapiens
catctccctgccatc

SEQ ID NO: 866218 - DNA, 18 bp, Homo sapiens
catctccctgccatcccc

SEQ ID NO: 866219 - DNA, 14 bp, Homo sapiens
catctccctgcctg

SEQ ID NO: 866220 - DNA, 15 bp, Homo sapiens
catctccctgcctgg

SEQ ID NO: 866221 - DNA, 16 bp, Homo sapiens
catctccctgcctggc

SEQ ID NO: 866222 - DNA, 14 bp, Homo sapiens
catctccctgcttt

SEQ ID NO: 866223 - DNA, 15 bp, Homo sapiens
catctccctgctttg

SEQ ID NO: 866224 - DNA, 15 bp, Homo sapiens
catctcccttcatta

SEQ ID NO: 866225 - DNA, 20 bp, Homo sapiens
catctccggggtggccacag

SEQ ID NO: 866226 - DNA, 20 bp, Homo sapiens
catctcctataatctgtcaa

SEQ ID NO: 866227 - DNA, 16 bp, Homo sapiens
catctcctgaccctcc

SEQ ID NO: 866228 - DNA, 22 bp, Homo sapiens
catctcctgccttcctcctggg

SEQ ID NO: 866229 - DNA, 22 bp, Homo sapiens
catctccttacctctggaaccc

SEQ ID NO: 866230 - DNA, 16 bp, Homo sapiens
catctccttttgcgct

SEQ ID NO: 866231 - DNA, 17 bp, Homo sapiens
catctcggggctgctgt

SEQ ID NO: 866232 - DNA, 19 bp, Homo sapiens
catctctaattggaagaaa

SEQ ID NO: 866233 - DNA, 16 bp, Homo sapiens
catctctcatcctcca

SEQ ID NO: 866234 - DNA, 12 bp, Homo sapiens
catctctcccac

SEQ ID NO: 866235 - DNA, 16 bp, Homo sapiens
catctctcccacttcc

SEQ ID NO: 866236 - DNA, 18 bp, Homo sapiens
catctctcccacttcctc

SEQ ID NO: 866237 - DNA, 13 bp, Homo sapiens
catctctccccaa

SEQ ID NO: 866238 - DNA, 20 bp, Homo sapiens
catctctccctcccctgcca

SEQ ID NO: 866239 - DNA, 14 bp, Homo sapiens
catctctctacctc

SEQ ID NO: 866240 - DNA, 16 bp, Homo sapiens
catctctctacctcca

SEQ ID NO: 866241 - DNA, 19 bp, Homo sapiens
catctctctacctccaccc

SEQ ID NO: 866242 - DNA, 20 bp, Homo sapiens
catctctctacctccaccct

SEQ ID NO: 866243 - DNA, 22 bp, Homo sapiens
catctctctactcctacctcag

SEQ ID NO: 866244 - DNA, 23 bp, Homo sapiens
catctctctactcctacctcagc

SEQ ID NO: 866245 - DNA, 13 bp, Homo sapiens
catctctctgccc

SEQ ID NO: 866246 - DNA, 13 bp, Homo sapiens
catctctctggct

SEQ ID NO: 866247 - DNA, 16 bp, Homo sapiens
catctctctggcttct

SEQ ID NO: 866248 - DNA, 20 bp, Homo sapiens
catctctctggggccctggg

SEQ ID NO: 866249 - DNA, 21 bp, Homo sapiens
catctctctggggccctgggc

SEQ ID NO: 866250 - DNA, 13 bp, Homo sapiens
catctctgaaaat

SEQ ID NO: 866251 - DNA, 10 bp, Homo sapiens
catctctgag

SEQ ID NO: 866252 - DNA, 21 bp, Homo sapiens
catctctgagtggaggaagcc

SEQ ID NO: 866253 - DNA, 13 bp, Homo sapiens
catctctgcttgg

SEQ ID NO: 866254 - DNA, 18 bp, Homo sapiens
catctctggaaggggcag

SEQ ID NO: 866255 - DNA, 16 bp, Homo sapiens
catctctggagccaga

SEQ ID NO: 866256 - DNA, 20 bp, Homo sapiens
catctctgtcccattccctg

SEQ ID NO: 866257 - DNA, 22 bp, Homo sapiens
catctctgtcccattccctggg

SEQ ID NO: 866258 - DNA, 22 bp, Homo sapiens
catctcttaaattttgttttct

SEQ ID NO: 866259 - DNA, 12 bp, Homo sapiens
catctcttcccc

SEQ ID NO: 866260 - DNA, 21 bp, Homo sapiens
catctcttcctccgaggccag

SEQ ID NO: 866261 - DNA, 17 bp, Homo sapiens
catctcttgtaaaagtt

SEQ ID NO: 866262 - DNA, 13 bp, Homo sapiens
catctctttgaat

SEQ ID NO: 866263 - DNA, 22 bp, Homo sapiens
catctctttgaattttctgtgt

SEQ ID NO: 866264 - DNA, 16 bp, Homo sapiens
catctgaaacccacag

SEQ ID NO: 866265 - DNA, 13 bp, Homo sapiens
catctgaaagcca

SEQ ID NO: 866266 - DNA, 14 bp, Homo sapiens
catctgaaagccac

SEQ ID NO: 866267 - DNA, 21 bp, Homo sapiens
catctgaaagttttgatttga

SEQ ID NO: 866268 - DNA, 19 bp, Homo sapiens
catctgaaggggcaaattc

SEQ ID NO: 866269 - DNA, 21 bp, Homo sapiens
catctgaaggggcaaattctt

SEQ ID NO: 866270 - DNA, 19 bp, Homo sapiens
catctgaccagcagcgcct

SEQ ID NO: 866271 - DNA, 21 bp, Homo sapiens
catctgaccagcagcgccttt

SEQ ID NO: 866272 - DNA, 18 bp, Homo sapiens
catctgaccttcaccttg

SEQ ID NO: 866273 - DNA, 18 bp, Homo sapiens
catctgactcacaagaag

SEQ ID NO: 866274 - DNA, 20 bp, Homo sapiens
catctgagaaacctgttgaa

SEQ ID NO: 866275 - DNA, 13 bp, Homo sapiens
catctgagaggct

SEQ ID NO: 866276 - DNA, 15 bp, Homo sapiens
catctgagcaagagc

SEQ ID NO: 866277 - DNA, 18 bp, Homo sapiens
catctgagtccagctccc

SEQ ID NO: 866278 - DNA, 15 bp, Homo sapiens
catctgagtcctgga

SEQ ID NO: 866279 - DNA, 17 bp, Homo sapiens
catctgatgtttcatat

SEQ ID NO: 866280 - DNA, 12 bp, Homo sapiens
catctgcaaaag

SEQ ID NO: 866281 - DNA, 20 bp, Homo sapiens
catctgcaaaaggcctcttg

SEQ ID NO: 866282 - DNA, 16 bp, Homo sapiens
catctgcaacaaaaag

SEQ ID NO: 866283 - DNA, 18 bp, Homo sapiens
catctgcaacaaaaagtc

SEQ ID NO: 866284 - DNA, 18 bp, Homo sapiens
catctgcacccttctttt

SEQ ID NO: 866285 - DNA, 14 bp, Homo sapiens
catctgcaggcacc

SEQ ID NO: 866286 - DNA, 19 bp, Homo sapiens
catctgcaggcaccgggct

SEQ ID NO: 866287 - DNA, 20 bp, Homo sapiens
catctgcaggcaccgggctg

SEQ ID NO: 866288 - DNA, 17 bp, Homo sapiens
catctgcatgtctactc

SEQ ID NO: 866289 - DNA, 16 bp, Homo sapiens
catctgcattcctgat

SEQ ID NO: 866290 - DNA, 13 bp, Homo sapiens
catctgcccaggg

SEQ ID NO: 866291 - DNA, 15 bp, Homo sapiens
catctgcccaggggt

SEQ ID NO: 866292 - DNA, 21 bp, Homo sapiens
catctgcccaggggtgccccc

SEQ ID NO: 866293 - DNA, 23 bp, Homo sapiens
catctgcccaggggtgccccctc

SEQ ID NO: 866294 - DNA, 18 bp, Homo sapiens
catctgcccctcccccaa

SEQ ID NO: 866295 - DNA, 15 bp, Homo sapiens
catctgccctccctg

SEQ ID NO: 866296 - DNA, 20 bp, Homo sapiens
catctgccttaaaaccaaag

SEQ ID NO: 866297 - DNA, 23 bp, Homo sapiens
catctgcgtgacaataaaacatt

SEQ ID NO: 866298 - DNA, 13 bp, Homo sapiens
catctgctgcagt

SEQ ID NO: 866299 - DNA, 14 bp, Homo sapiens
catctgctgcagtt

SEQ ID NO: 866300 - DNA, 19 bp, Homo sapiens
catctgctggtccgtggga

SEQ ID NO: 866301 - DNA, 15 bp, Homo sapiens
catctgctgtgtgga

SEQ ID NO: 866302 - DNA, 20 bp, Homo sapiens
catctgcttacaattccctg

SEQ ID NO: 866303 - DNA, 16 bp, Homo sapiens
catctggaatctggag

SEQ ID NO: 866304 - DNA, 21 bp, Homo sapiens
catctggagggttctaagtgg

SEQ ID NO: 866305 - DNA, 18 bp, Homo sapiens
catctggctctaattcac

SEQ ID NO: 866306 - DNA, 23 bp, Homo sapiens
catctggctggaaagcagagcct

SEQ ID NO: 866307 - DNA, 13 bp, Homo sapiens
catctgggacaaa

SEQ ID NO: 866308 - DNA, 17 bp, Homo sapiens
catctgggctcctccag

SEQ ID NO: 866309 - DNA, 16 bp, Homo sapiens
catctgggtagctgta

SEQ ID NO: 866310 - DNA, 20 bp, Homo sapiens
catctgggtagctgtaaggc

SEQ ID NO: 866311 - DNA, 15 bp, Homo sapiens
catctgggtgccctg

SEQ ID NO: 866312 - DNA, 23 bp, Homo sapiens
catctggtgtaggaagttttttc

SEQ ID NO: 866313 - DNA, 18 bp, Homo sapiens
catctgtaaatatcccag

SEQ ID NO: 866314 - DNA, 19 bp, Homo sapiens
catctgtaaatatcccaga

SEQ ID NO: 866315 - DNA, 20 bp, Homo sapiens
catctgtaaatatcccagag

SEQ ID NO: 866316 - DNA, 21 bp, Homo sapiens
catctgtaaatatcccagaga

SEQ ID NO: 866317 - DNA, 17 bp, Homo sapiens
catctgtaagagcttgc

SEQ ID NO: 866318 - DNA, 23 bp, Homo sapiens
catctgtaagagcttgctccaga

SEQ ID NO: 866319 - DNA, 12 bp, Homo sapiens
catctgtagata

SEQ ID NO: 866320 - DNA, 18 bp, Homo sapiens
catctgtataccctctgt

SEQ ID NO: 866321 - DNA, 17 bp, Homo sapiens
catctgtccctccggga

SEQ ID NO: 866322 - DNA, 18 bp, Homo sapiens
catctgtccctccgggac

SEQ ID NO: 866323 - DNA, 11 bp, Homo sapiens
catctgtcctc

SEQ ID NO: 866324 - DNA, 21 bp, Homo sapiens
catctgtcctcaccctgtggg

SEQ ID NO: 866325 - DNA, 23 bp, Homo sapiens
catctgtctgccaacctaaaact

SEQ ID NO: 866326 - DNA, 14 bp, Homo sapiens
catctgtctgtcct

SEQ ID NO: 866327 - DNA, 15 bp, Homo sapiens
catctgtctgtccta

SEQ ID NO: 866328 - DNA, 18 bp, Homo sapiens
catctgtctgtcctaccc

SEQ ID NO: 866329 - DNA, 23 bp, Homo sapiens
catctgtcttcagcacattccac

SEQ ID NO: 866330 - DNA, 14 bp, Homo sapiens
catctgtgatggga

SEQ ID NO: 866331 - DNA, 15 bp, Homo sapiens
catctgtgattccct

SEQ ID NO: 866332 - DNA, 18 bp, Homo sapiens
catctgtgcactgcccat

SEQ ID NO: 866333 - DNA, 14 bp, Homo sapiens
catctgtggagctg

SEQ ID NO: 866334 - DNA, 22 bp, Homo sapiens
catctgtggagctgccacagag

SEQ ID NO: 866335 - DNA, 16 bp, Homo sapiens
catctgtgtgcgtggc

SEQ ID NO: 866336 - DNA, 13 bp, Homo sapiens
catctgtgtgtgt

SEQ ID NO: 866337 - DNA, 19 bp, Homo sapiens
catctgtgtttcaagtggg

SEQ ID NO: 866338 - DNA, 19 bp, Homo sapiens
catctgttagcagagtctg

SEQ ID NO: 866339 - DNA, 22 bp, Homo sapiens
catctgttagcagagtctgtct

SEQ ID NO: 866340 - DNA, 15 bp, Homo sapiens
catctgttagggcct

SEQ ID NO: 866341 - DNA, 18 bp, Homo sapiens
catctgttatcctgctag

SEQ ID NO: 866342 - DNA, 14 bp, Homo sapiens
catcttaaaaacaa

SEQ ID NO: 866343 - DNA, 15 bp, Homo sapiens
catcttaaaaacaac

SEQ ID NO: 866344 - DNA, 13 bp, Homo sapiens
catcttaaactaa

SEQ ID NO: 866345 - DNA, 22 bp, Homo sapiens
catcttaaatctaaacaaaaaa

SEQ ID NO: 866346 - DNA, 17 bp, Homo sapiens
catcttaaatgacagtg

SEQ ID NO: 866347 - DNA, 21 bp, Homo sapiens
catcttacctctcatgcgtgt

SEQ ID NO: 866348 - DNA, 17 bp, Homo sapiens
catcttagacctccaca

SEQ ID NO: 866349 - DNA, 21 bp, Homo sapiens
catcttaggttggcaaaaagg

SEQ ID NO: 866350 - DNA, 15 bp, Homo sapiens
catcttattgaataa

SEQ ID NO: 866351 - DNA, 14 bp, Homo sapiens
catcttcaaagctt

SEQ ID NO: 866352 - DNA, 18 bp, Homo sapiens
catcttcactcttcactt

SEQ ID NO: 866353 - DNA, 15 bp, Homo sapiens
catcttcactgcaat

SEQ ID NO: 866354 - DNA, 14 bp, Homo sapiens
catcttcacttcta

SEQ ID NO: 866355 - DNA, 23 bp, Homo sapiens
catcttcagttgtctctgatgca

SEQ ID NO: 866356 - DNA, 22 bp, Homo sapiens
catcttccacctcacctctttg

SEQ ID NO: 866357 - DNA, 13 bp, Homo sapiens
catcttccacctg

SEQ ID NO: 866358 - DNA, 14 bp, Homo sapiens
catcttccacctgt

SEQ ID NO: 866359 - DNA, 21 bp, Homo sapiens
catcttcccagcagggccact

SEQ ID NO: 866360 - DNA, 14 bp, Homo sapiens
catcttcctgctgc

SEQ ID NO: 866361 - DNA, 15 bp, Homo sapiens
catcttcctgctgct

SEQ ID NO: 866362 - DNA, 16 bp, Homo sapiens
catcttcctgtgtcct

SEQ ID NO: 866363 - DNA, 17 bp, Homo sapiens
catcttctccatctggc

SEQ ID NO: 866364 - DNA, 18 bp, Homo sapiens
catcttctccccgaggct

SEQ ID NO: 866365 - DNA, 20 bp, Homo sapiens
catcttctccccgaggctgc

SEQ ID NO: 866366 - DNA, 23 bp, Homo sapiens
catcttctccccgaggctgcccc

SEQ ID NO: 866367 - DNA, 13 bp, Homo sapiens
catcttctggaat

SEQ ID NO: 866368 - DNA, 14 bp, Homo sapiens
catcttctggaata

SEQ ID NO: 866369 - DNA, 19 bp, Homo sapiens
catcttctggagtctccag

SEQ ID NO: 866370 - DNA, 22 bp, Homo sapiens
catcttcttcccttaactccaa

SEQ ID NO: 866371 - DNA, 19 bp, Homo sapiens
catcttgactaggtattgt

SEQ ID NO: 866372 - DNA, 18 bp, Homo sapiens
catcttgatctttgagcc

SEQ ID NO: 866373 - DNA, 22 bp, Homo sapiens
catcttgccaagggtccctgtg

SEQ ID NO: 866374 - DNA, 20 bp, Homo sapiens
catcttgctaccagtattta

SEQ ID NO: 866375 - DNA, 15 bp, Homo sapiens
catcttgtggggcca

SEQ ID NO: 866376 - DNA, 17 bp, Homo sapiens
catcttgtggggccagg

SEQ ID NO: 866377 - DNA, 18 bp, Homo sapiens
catcttgtggggccagga

SEQ ID NO: 866378 - DNA, 16 bp, Homo sapiens
catcttgttcttcccc

SEQ ID NO: 866379 - DNA, 10 bp, Homo sapiens
catctttaag

SEQ ID NO: 866380 - DNA, 21 bp, Homo sapiens
catctttacgtactgtaactg

SEQ ID NO: 866381 - DNA, 22 bp, Homo sapiens
catctttacgtactgtaactgc

SEQ ID NO: 866382 - DNA, 22 bp, Homo sapiens
catctttatagaaggaatttgt

SEQ ID NO: 866383 - DNA, 17 bp, Homo sapiens
catctttatctgttctt

SEQ ID NO: 866384 - DNA, 17 bp, Homo sapiens
catctttattgaaattc

SEQ ID NO: 866385 - DNA, 13 bp, Homo sapiens
catctttcctgtc

SEQ ID NO: 866386 - DNA, 16 bp, Homo sapiens
catctttcttctattt

SEQ ID NO: 866387 - DNA, 21 bp, Homo sapiens
catctttcttctattttattc

SEQ ID NO: 866388 - DNA, 17 bp, Homo sapiens
catctttgatccttctg

SEQ ID NO: 866389 - DNA, 23 bp, Homo sapiens
catctttgatccttctgagctcc

SEQ ID NO: 866390 - DNA, 19 bp, Homo sapiens
catctttgtttttaaaata

SEQ ID NO: 866391 - DNA, 13 bp, Homo sapiens
catcttttatcta

SEQ ID NO: 866392 - DNA, 17 bp, Homo sapiens
catcttttattcttttt

SEQ ID NO: 866393 - DNA, 21 bp, Homo sapiens
catcttttctaatcacagtgt

SEQ ID NO: 866394 - DNA, 19 bp, Homo sapiens
catcttttctagagacaca

SEQ ID NO: 866395 - DNA, 15 bp, Homo sapiens
catcttttgatcttt

SEQ ID NO: 866396 - DNA, 22 bp, Homo sapiens
catcttttgtattaagaaagga

SEQ ID NO: 866397 - DNA, 21 bp, Homo sapiens
catctttttaacctgcaaaat

SEQ ID NO: 866398 - DNA, 21 bp, Homo sapiens
catctttttatgcaaaagtca

SEQ ID NO: 866399 - DNA, 16 bp, Homo sapiens
catgaaaaacaaacaa

SEQ ID NO: 866400 - DNA, 19 bp, Homo sapiens
catgaaaaacacggcagct

SEQ ID NO: 866401 - DNA, 20 bp, Homo sapiens
catgaaaaacacggcagctg

SEQ ID NO: 866402 - DNA, 13 bp, Homo sapiens
catgaaaaagcag

SEQ ID NO: 866403 - DNA, 18 bp, Homo sapiens
catgaaaaagcagctacc

SEQ ID NO: 866404 - DNA, 15 bp, Homo sapiens
catgaaaaagctgct

SEQ ID NO: 866405 - DNA, 13 bp, Homo sapiens
catgaaaaatttt

SEQ ID NO: 866406 - DNA, 18 bp, Homo sapiens
catgaaaacacacataca

SEQ ID NO: 866407 - DNA, 13 bp, Homo sapiens
catgaaaacacat

SEQ ID NO: 866408 - DNA, 15 bp, Homo sapiens
catgaaaacacattt

SEQ ID NO: 866409 - DNA, 17 bp, Homo sapiens
catgaaaacacattttt

SEQ ID NO: 866410 - DNA, 13 bp, Homo sapiens
catgaaaacgttt

SEQ ID NO: 866411 - DNA, 21 bp, Homo sapiens
catgaaaacgttttattgtgt

SEQ ID NO: 866412 - DNA, 22 bp, Homo sapiens
catgaaaacgttttattgtgtt

SEQ ID NO: 866413 - DNA, 14 bp, Homo sapiens
catgaaaataccat

SEQ ID NO: 866414 - DNA, 14 bp, Homo sapiens
catgaaaatgacat

SEQ ID NO: 866415 - DNA, 11 bp, Homo sapiens
catgaaaattt

SEQ ID NO: 866416 - DNA, 13 bp, Homo sapiens
catgaaaatttta

SEQ ID NO: 866417 - DNA, 17 bp, Homo sapiens
catgaaaattttaaaaa

SEQ ID NO: 866418 - DNA, 13 bp, Homo sapiens
catgaaacagaaa

SEQ ID NO: 866419 - DNA, 19 bp, Homo sapiens
catgaaacagaaacaaaaa

SEQ ID NO: 866420 - DNA, 21 bp, Homo sapiens
catgaaacggaggcagatgga

SEQ ID NO: 866421 - DNA, 17 bp, Homo sapiens
catgaaagacttctcta

SEQ ID NO: 866422 - DNA, 15 bp, Homo sapiens
catgaaagtcttact

SEQ ID NO: 866423 - DNA, 15 bp, Homo sapiens
catgaaatatgcatc

SEQ ID NO: 866424 - DNA, 17 bp, Homo sapiens
catgaaattgtatctca

SEQ ID NO: 866425 - DNA, 15 bp, Homo sapiens
catgaaccctcttgc

SEQ ID NO: 866426 - DNA, 17 bp, Homo sapiens
catgaaccctcttgcca

SEQ ID NO: 866427 - DNA, 22 bp, Homo sapiens
catgaaccctcttgccatcctg

SEQ ID NO: 866428 - DNA, 23 bp, Homo sapiens
catgaaccctcttgccatcctga

SEQ ID NO: 866429 - DNA, 18 bp, Homo sapiens
catgaactacgtgacctc

SEQ ID NO: 866430 - DNA, 15 bp, Homo sapiens
catgaagaatagaaa

SEQ ID NO: 866431 - DNA, 14 bp, Homo sapiens
catgaagaatgcat

SEQ ID NO: 866432 - DNA, 18 bp, Homo sapiens
catgaagaatgcattcaa

SEQ ID NO: 866433 - DNA, 19 bp, Homo sapiens
catgaagaatgcattcaaa

SEQ ID NO: 866434 - DNA, 14 bp, Homo sapiens
catgaagacaggac

SEQ ID NO: 866435 - DNA, 15 bp, Homo sapiens
catgaagacaggaca

SEQ ID NO: 866436 - DNA, 16 bp, Homo sapiens
catgaagacaggacag

SEQ ID NO: 866437 - DNA, 14 bp, Homo sapiens
catgaagacaggat

SEQ ID NO: 866438 - DNA, 15 bp, Homo sapiens
catgaagagaagcaa

SEQ ID NO: 866439 - DNA, 18 bp, Homo sapiens
catgaagagaagcaattt

SEQ ID NO: 866440 - DNA, 21 bp, Homo sapiens
catgaagaggagattggccag

SEQ ID NO: 866441 - DNA, 20 bp, Homo sapiens
catgaagataaacacagctg

SEQ ID NO: 866442 - DNA, 14 bp, Homo sapiens
catgaagcataatt

SEQ ID NO: 866443 - DNA, 20 bp, Homo sapiens
catgaagcataatttgttta

SEQ ID NO: 866444 - DNA, 12 bp, Homo sapiens
catgaagcatta

SEQ ID NO: 866445 - DNA, 16 bp, Homo sapiens
catgaagctaataaaa

SEQ ID NO: 866446 - DNA, 16 bp, Homo sapiens
catgaaggtaaataaa

SEQ ID NO: 866447 - DNA, 17 bp, Homo sapiens
catgaaggtaaataaaa

SEQ ID NO: 866448 - DNA, 20 bp, Homo sapiens
catgaaggtaaataaaaaga

SEQ ID NO: 866449 - DNA, 22 bp, Homo sapiens
catgaaggtaaataaaaagaaa

SEQ ID NO: 866450 - DNA, 16 bp, Homo sapiens
catgaagtaaattatg

SEQ ID NO: 866451 - DNA, 17 bp, Homo sapiens
catgaagtaaattatgt

SEQ ID NO: 866452 - DNA, 16 bp, Homo sapiens
catgaataaaacactc

SEQ ID NO: 866453 - DNA, 19 bp, Homo sapiens
catgaataacatttaaatt

SEQ ID NO: 866454 - DNA, 22 bp, Homo sapiens
catgaatactatccatgtaata

SEQ ID NO: 866455 - DNA, 23 bp, Homo sapiens
catgaatactatccatgtaataa

SEQ ID NO: 866456 - DNA, 23 bp, Homo sapiens
catgaatcgggctaaggtccctg

SEQ ID NO: 866457 - DNA, 17 bp, Homo sapiens
catgaatctctgcctct

SEQ ID NO: 866458 - DNA, 19 bp, Homo sapiens
catgaatctctgcctctcc

SEQ ID NO: 866459 - DNA, 13 bp, Homo sapiens
catgaatctttca

SEQ ID NO: 866460 - DNA, 20 bp, Homo sapiens
catgaatctttcatacatat

SEQ ID NO: 866461 - DNA, 22 bp, Homo sapiens
catgaatctttcatacatatat

SEQ ID NO: 866462 - DNA, 13 bp, Homo sapiens
catgaatgctttt

SEQ ID NO: 866463 - DNA, 13 bp, Homo sapiens
catgaatgtatca

SEQ ID NO: 866464 - DNA, 18 bp, Homo sapiens
catgaatgtatcaggaaa

SEQ ID NO: 866465 - DNA, 15 bp, Homo sapiens
catgaatgtgctggt

SEQ ID NO: 866466 - DNA, 16 bp, Homo sapiens
catgaatgtgctggtg

SEQ ID NO: 866467 - DNA, 20 bp, Homo sapiens
catgaattactgtatataaa

SEQ ID NO: 866468 - DNA, 17 bp, Homo sapiens
catgaattattacagtg

SEQ ID NO: 866469 - DNA, 12 bp, Homo sapiens
catgaattccct

SEQ ID NO: 866470 - DNA, 18 bp, Homo sapiens
catgaattcttatgctta

SEQ ID NO: 866471 - DNA, 22 bp, Homo sapiens
catgaatttattgcacattgtt

SEQ ID NO: 866472 - DNA, 23 bp, Homo sapiens
catgaatttattgcacattgttc

SEQ ID NO: 866473 - DNA, 17 bp, Homo sapiens
catgaattttaaagtat

SEQ ID NO: 866474 - DNA, 21 bp, Homo sapiens
catgaattttaaagtatgcat

SEQ ID NO: 866475 - DNA, 21 bp, Homo sapiens
catgaatttttttcatcttct

SEQ ID NO: 866476 - DNA, 16 bp, Homo sapiens
catgacaaacctagct

SEQ ID NO: 866477 - DNA, 13 bp, Homo sapiens
catgacaaagact

SEQ ID NO: 866478 - DNA, 19 bp, Homo sapiens
catgacaactttgccagct

SEQ ID NO: 866479 - DNA, 18 bp, Homo sapiens
catgacaagccccaggca

SEQ ID NO: 866480 - DNA, 19 bp, Homo sapiens
catgacaagccccaggcag

SEQ ID NO: 866481 - DNA, 20 bp, Homo sapiens
catgacaagccccaggcagg

SEQ ID NO: 866482 - DNA, 12 bp, Homo sapiens
catgacagaggc

SEQ ID NO: 866483 - DNA, 22 bp, Homo sapiens
catgacagaggctgcacccctg

SEQ ID NO: 866484 - DNA, 14 bp, Homo sapiens
catgacagcctcca

SEQ ID NO: 866485 - DNA, 20 bp, Homo sapiens
catgacagcctgcagcagga

SEQ ID NO: 866486 - DNA, 18 bp, Homo sapiens
catgacatatgacttgat

SEQ ID NO: 866487 - DNA, 13 bp, Homo sapiens
catgacatcaaaa

SEQ ID NO: 866488 - DNA, 15 bp, Homo sapiens
catgacatgttatat

SEQ ID NO: 866489 - DNA, 16 bp, Homo sapiens
catgacatttcatctg

SEQ ID NO: 866490 - DNA, 20 bp, Homo sapiens
catgacatttcatctgggtg

SEQ ID NO: 866491 - DNA, 17 bp, Homo sapiens
catgaccacatagcatg

SEQ ID NO: 866492 - DNA, 15 bp, Homo sapiens
catgaccactgggcc

SEQ ID NO: 866493 - DNA, 17 bp, Homo sapiens
catgaccactgggcctg

SEQ ID NO: 866494 - DNA, 12 bp, Homo sapiens
catgaccagcaa

SEQ ID NO: 866495 - DNA, 18 bp, Homo sapiens
catgaccatactgaggga

SEQ ID NO: 866496 - DNA, 18 bp, Homo sapiens
catgacccacccctgtgc

SEQ ID NO: 866497 - DNA, 15 bp, Homo sapiens
catgacccagcctga

SEQ ID NO: 866498 - DNA, 15 bp, Homo sapiens
catgaccccttctct

SEQ ID NO: 866499 - DNA, 18 bp, Homo sapiens
catgaccccttctctctc

SEQ ID NO: 866500 - DNA, 22 bp, Homo sapiens
catgaccccttctctctccaga

SEQ ID NO: 866501 - DNA, 16 bp, Homo sapiens
catgaccctctgtccc

SEQ ID NO: 866502 - DNA, 18 bp, Homo sapiens
catgaccctctgtcccca

SEQ ID NO: 866503 - DNA, 13 bp, Homo sapiens
catgaccctgggc

SEQ ID NO: 866504 - DNA, 14 bp, Homo sapiens
catgaccctgggct

SEQ ID NO: 866505 - DNA, 20 bp, Homo sapiens
catgacctaccaggacagaa

SEQ ID NO: 866506 - DNA, 21 bp, Homo sapiens
catgacctaccaggacagaac

SEQ ID NO: 866507 - DNA, 13 bp, Homo sapiens
catgacctccatt

SEQ ID NO: 866508 - DNA, 12 bp, Homo sapiens
catgacctcccc

SEQ ID NO: 866509 - DNA, 16 bp, Homo sapiens
catgacctgtgaccag

SEQ ID NO: 866510 - DNA, 19 bp, Homo sapiens
catgacgccagataaaatg

SEQ ID NO: 866511 - DNA, 16 bp, Homo sapiens
catgactaatgctttt

SEQ ID NO: 866512 - DNA, 21 bp, Homo sapiens
catgactaatgctttttagaa

SEQ ID NO: 866513 - DNA, 14 bp, Homo sapiens
catgactaattttt

SEQ ID NO: 866514 - DNA, 17 bp, Homo sapiens
catgactcgggggtggg

SEQ ID NO: 866515 - DNA, 13 bp, Homo sapiens
catgactcttgga

SEQ ID NO: 866516 - DNA, 22 bp, Homo sapiens
catgactcttggagcctctttt

SEQ ID NO: 866517 - DNA, 17 bp, Homo sapiens
catgactctttattgtc

SEQ ID NO: 866518 - DNA, 19 bp, Homo sapiens
catgactctttattgtctg

SEQ ID NO: 866519 - DNA, 11 bp, Homo sapiens
catgactgcac

SEQ ID NO: 866520 - DNA, 17 bp, Homo sapiens
catgactgcacccagct

SEQ ID NO: 866521 - DNA, 19 bp, Homo sapiens
catgactgcacccagctcc

SEQ ID NO: 866522 - DNA, 18 bp, Homo sapiens
catgactggctgtctgcc

SEQ ID NO: 866523 - DNA, 21 bp, Homo sapiens
catgactggctgtctgcctgt

SEQ ID NO: 866524 - DNA, 20 bp, Homo sapiens
catgactgggcctcccttgg

SEQ ID NO: 866525 - DNA, 13 bp, Homo sapiens
catgactgtgacc

SEQ ID NO: 866526 - DNA, 14 bp, Homo sapiens
catgactgtttctt

SEQ ID NO: 866527 - DNA, 22 bp, Homo sapiens
catgactgtttcttttgtaaag

SEQ ID NO: 866528 - DNA, 14 bp, Homo sapiens
catgagaagagggc

SEQ ID NO: 866529 - DNA, 15 bp, Homo sapiens
catgagaagagggcc

SEQ ID NO: 866530 - DNA, 12 bp, Homo sapiens
catgagaatcta

SEQ ID NO: 866531 - DNA, 19 bp, Homo sapiens
catgagaatctatatttaa

SEQ ID NO: 866532 - DNA, 20 bp, Homo sapiens
catgagaatttgcaacaggg

SEQ ID NO: 866533 - DNA, 23 bp, Homo sapiens
catgagagaattgtatcatttga

SEQ ID NO: 866534 - DNA, 16 bp, Homo sapiens
catgagataaataaaa

SEQ ID NO: 866535 - DNA, 17 bp, Homo sapiens
catgagatggagaggct

SEQ ID NO: 866536 - DNA, 18 bp, Homo sapiens
catgagatggagaggctg

SEQ ID NO: 866537 - DNA, 18 bp, Homo sapiens
catgagcacctccagctg

SEQ ID NO: 866538 - DNA, 19 bp, Homo sapiens
catgagcacctccagctgt

SEQ ID NO: 866539 - DNA, 22 bp, Homo sapiens
catgagccactgtgcttggcca

SEQ ID NO: 866540 - DNA, 13 bp, Homo sapiens
catgagcctgccc

SEQ ID NO: 866541 - DNA, 19 bp, Homo sapiens
catgagcctgcccgctgca

SEQ ID NO: 866542 - DNA, 14 bp, Homo sapiens
catgagcctgctgg

SEQ ID NO: 866543 - DNA, 20 bp, Homo sapiens
catgagcctgctggaagccc

SEQ ID NO: 866544 - DNA, 14 bp, Homo sapiens
catgagctccagac

SEQ ID NO: 866545 - DNA, 23 bp, Homo sapiens
catgagctccagacccccagcaa

SEQ ID NO: 866546 - DNA, 22 bp, Homo sapiens
catgagctcggggtccaccagt

SEQ ID NO: 866547 - DNA, 11 bp, Homo sapiens
catgagctgct

SEQ ID NO: 866548 - DNA, 14 bp, Homo sapiens
catgagctgctgtg

SEQ ID NO: 866549 - DNA, 20 bp, Homo sapiens
catgagctgctgtgcccagc

SEQ ID NO: 866550 - DNA, 20 bp, Homo sapiens
catgaggacatgatggagcg

SEQ ID NO: 866551 - DNA, 14 bp, Homo sapiens
catgaggaccaggg

SEQ ID NO: 866552 - DNA, 21 bp, Homo sapiens
catgaggactctattctttaa

SEQ ID NO: 866553 - DNA, 15 bp, Homo sapiens
catgaggccatctca

SEQ ID NO: 866554 - DNA, 16 bp, Homo sapiens
catgaggccatctcag

SEQ ID NO: 866555 - DNA, 17 bp, Homo sapiens
catgagggatcacaggg

SEQ ID NO: 866556 - DNA, 14 bp, Homo sapiens
catgaggggagagg

SEQ ID NO: 866557 - DNA, 22 bp, Homo sapiens
catgagtagataatttcagggt

SEQ ID NO: 866558 - DNA, 19 bp, Homo sapiens
catgagtatctgtgggagt

SEQ ID NO: 866559 - DNA, 18 bp, Homo sapiens
catgagtcagatacacaa

SEQ ID NO: 866560 - DNA, 17 bp, Homo sapiens
catgagtccttgaaaat

SEQ ID NO: 866561 - DNA, 19 bp, Homo sapiens
catgagtccttgaaaatat

SEQ ID NO: 866562 - DNA, 18 bp, Homo sapiens
catgagttccagaaagta

SEQ ID NO: 866563 - DNA, 19 bp, Homo sapiens
catgagttccagaaagtaa

SEQ ID NO: 866564 - DNA, 20 bp, Homo sapiens
catgagttccagaaagtaaa

SEQ ID NO: 866565 - DNA, 23 bp, Homo sapiens
catgagttggggtctggcagcct

SEQ ID NO: 866566 - DNA, 17 bp, Homo sapiens
catgagttgtcagcttt

SEQ ID NO: 866567 - DNA, 21 bp, Homo sapiens
catgagttgtcagctttgact

SEQ ID NO: 866568 - DNA, 14 bp, Homo sapiens
catgatacattttt

SEQ ID NO: 866569 - DNA, 15 bp, Homo sapiens
catgatataacttta

SEQ ID NO: 866570 - DNA, 21 bp, Homo sapiens
catgatcagacatacagctgc

SEQ ID NO: 866571 - DNA, 24 bp, Homo sapiens
catgatcatagctcactgcagcct

SEQ ID NO: 866572 - DNA, 15 bp, Homo sapiens
catgatctccctgcc

SEQ ID NO: 866573 - DNA, 12 bp, Homo sapiens
catgatctgtat

SEQ ID NO: 866574 - DNA, 19 bp, Homo sapiens
catgatgccctcccctcag

SEQ ID NO: 866575 - DNA, 12 bp, Homo sapiens
catgatgggaaa

SEQ ID NO: 866576 - DNA, 17 bp, Homo sapiens
catgatgggaaaatatt

SEQ ID NO: 866577 - DNA, 19 bp, Homo sapiens
catgatgggaaaatatttc

SEQ ID NO: 866578 - DNA, 22 bp, Homo sapiens
catgatgggaatagggagacag

SEQ ID NO: 866579 - DNA, 23 bp, Homo sapiens
catgatgggaatagggagacagg

SEQ ID NO: 866580 - DNA, 15 bp, Homo sapiens
catgatgtttgccca

SEQ ID NO: 866581 - DNA, 21 bp, Homo sapiens
catgatgtttgcccaaaattt

SEQ ID NO: 866582 - DNA, 24 bp, Homo sapiens
catgattaaccacttcagctgact

SEQ ID NO: 866583 - DNA, 12 bp, Homo sapiens
catgattagcaa

SEQ ID NO: 866584 - DNA, 19 bp, Homo sapiens
catgattatagaaggctgt

SEQ ID NO: 866585 - DNA, 18 bp, Homo sapiens
catgattcttctcttgtg

SEQ ID NO: 866586 - DNA, 19 bp, Homo sapiens
catgatttagggaagcagg

SEQ ID NO: 866587 - DNA, 22 bp, Homo sapiens
catgatttagggaagcagggac

SEQ ID NO: 866588 - DNA, 14 bp, Homo sapiens
catgatttatatat

SEQ ID NO: 866589 - DNA, 16 bp, Homo sapiens
catgatttatatatgg

SEQ ID NO: 866590 - DNA, 17 bp, Homo sapiens
catgatttatatatggc

SEQ ID NO: 866591 - DNA, 20 bp, Homo sapiens
catgatttatatatggcata

SEQ ID NO: 866592 - DNA, 12 bp, Homo sapiens
catgatttcctt

SEQ ID NO: 866593 - DNA, 18 bp, Homo sapiens
catgatttccttgaatgt

SEQ ID NO: 866594 - DNA, 13 bp, Homo sapiens
catgatttgaaaa

SEQ ID NO: 866595 - DNA, 19 bp, Homo sapiens
catgatttgaaaaaaagca

SEQ ID NO: 866596 - DNA, 16 bp, Homo sapiens
catgatttgtcccagc

SEQ ID NO: 866597 - DNA, 22 bp, Homo sapiens
catgatttgtcccagcctgggg

SEQ ID NO: 866598 - DNA, 22 bp, Homo sapiens
catgattttaagtttctctgca

SEQ ID NO: 866599 - DNA, 24 bp, Homo sapiens
catgattttaagtttctctgcaga

SEQ ID NO: 866600 - DNA, 16 bp, Homo sapiens
catgattttacaagta

SEQ ID NO: 866601 - DNA, 17 bp, Homo sapiens
catgcaaaatatgttta

SEQ ID NO: 866602 - DNA, 22 bp, Homo sapiens
catgcaaaatcaggaaaggctg

SEQ ID NO: 866603 - DNA, 14 bp, Homo sapiens
catgcaaatgctgt

SEQ ID NO: 866604 - DNA, 22 bp, Homo sapiens
catgcaaatgctgtattcttct

SEQ ID NO: 866605 - DNA, 15 bp, Homo sapiens
catgcaaggtcattt

SEQ ID NO: 866606 - DNA, 17 bp, Homo sapiens
catgcaaggtcattttt

SEQ ID NO: 866607 - DNA, 18 bp, Homo sapiens
catgcaaggtcatttttt

SEQ ID NO: 866608 - DNA, 14 bp, Homo sapiens
catgcacacacttg

SEQ ID NO: 866609 - DNA, 19 bp, Homo sapiens
catgcacacggctggtcac

SEQ ID NO: 866610 - DNA, 20 bp, Homo sapiens
catgcacacggctggtcact

SEQ ID NO: 866611 - DNA, 14 bp, Homo sapiens
catgcacagctgct

SEQ ID NO: 866612 - DNA, 21 bp, Homo sapiens
catgcacagctgcttgtcctg

SEQ ID NO: 866613 - DNA, 14 bp, Homo sapiens
catgcacagtattt

SEQ ID NO: 866614 - DNA, 17 bp, Homo sapiens
catgcacagtatttgta

SEQ ID NO: 866615 - DNA, 18 bp, Homo sapiens
catgcacagtatttgtaa

SEQ ID NO: 866616 - DNA, 19 bp, Homo sapiens
catgcacagtatttgtaat

SEQ ID NO: 866617 - DNA, 20 bp, Homo sapiens
catgcacagtatttgtaatt

SEQ ID NO: 866618 - DNA, 15 bp, Homo sapiens
catgcacatttatat

SEQ ID NO: 866619 - DNA, 18 bp, Homo sapiens
catgcaccaggactggct

SEQ ID NO: 866620 - DNA, 20 bp, Homo sapiens
catgcaccctcatacacaga

SEQ ID NO: 866621 - DNA, 22 bp, Homo sapiens
catgcaccttatatttctgtgt

SEQ ID NO: 866622 - DNA, 23 bp, Homo sapiens
catgcaccttatatttctgtgta

SEQ ID NO: 866623 - DNA, 16 bp, Homo sapiens
catgcacgggcatgca

SEQ ID NO: 866624 - DNA, 22 bp, Homo sapiens
catgcacgggcatgcacacggc

SEQ ID NO: 866625 - DNA, 20 bp, Homo sapiens
catgcactgatgttgtgttt

SEQ ID NO: 866626 - DNA, 17 bp, Homo sapiens
catgcacttaaagaagt

SEQ ID NO: 866627 - DNA, 12 bp, Homo sapiens
catgcagaacac

SEQ ID NO: 866628 - DNA, 16 bp, Homo sapiens
catgcagcccatgccc

SEQ ID NO: 866629 - DNA, 22 bp, Homo sapiens
catgcagcccatgcccacctgc

SEQ ID NO: 866630 - DNA, 15 bp, Homo sapiens
catgcagcccctggg

SEQ ID NO: 866631 - DNA, 22 bp, Homo sapiens
catgcagcctaaggctgtatga

SEQ ID NO: 866632 - DNA, 20 bp, Homo sapiens
catgcagctcttcaacatga

SEQ ID NO: 866633 - DNA, 13 bp, Homo sapiens
catgcagctgcct

SEQ ID NO: 866634 - DNA, 18 bp, Homo sapiens
catgcaggaagaggccca

SEQ ID NO: 866635 - DNA, 20 bp, Homo sapiens
catgcaggaagaggcccact

SEQ ID NO: 866636 - DNA, 11 bp, Homo sapiens
catgcaggagg

SEQ ID NO: 866637 - DNA, 13 bp, Homo sapiens
catgcaggccctt

SEQ ID NO: 866638 - DNA, 20 bp, Homo sapiens
catgcagttcattattttgt

SEQ ID NO: 866639 - DNA, 17 bp, Homo sapiens
catgcagttcctggccc

SEQ ID NO: 866640 - DNA, 20 bp, Homo sapiens
catgcatagagtgtgatgta

SEQ ID NO: 866641 - DNA, 14 bp, Homo sapiens
catgcatataatga

SEQ ID NO: 866642 - DNA, 18 bp, Homo sapiens
catgcatataatgaataa

SEQ ID NO: 866643 - DNA, 21 bp, Homo sapiens
catgcatataatgaataaatc

SEQ ID NO: 866644 - DNA, 21 bp, Homo sapiens
catgcatatcattaaacaaat

SEQ ID NO: 866645 - DNA, 22 bp, Homo sapiens
catgcatccatttactgacact

SEQ ID NO: 866646 - DNA, 14 bp, Homo sapiens
catgcattttgcag

SEQ ID NO: 866647 - DNA, 11 bp, Homo sapiens
catgccaccct

SEQ ID NO: 866648 - DNA, 13 bp, Homo sapiens
catgccaccctca

SEQ ID NO: 866649 - DNA, 14 bp, Homo sapiens
catgctgggatttc

SEQ ID NO: 866650 - DNA, 20 bp, Homo sapiens
catgctgggccactggggac

SEQ ID NO: 866651 - DNA, 15 bp, Homo sapiens
catgctggttacctg

SEQ ID NO: 866652 - DNA, 19 bp, Homo sapiens
catgctgtccctgcactgt

SEQ ID NO: 866653 - DNA, 21 bp, Homo sapiens
catgctgtccctgcactgtgc

SEQ ID NO: 866654 - DNA, 19 bp, Homo sapiens
catgctgtgctctttgaag

SEQ ID NO: 866655 - DNA, 13 bp, Homo sapiens
catgcttaataaa

SEQ ID NO: 866656 - DNA, 14 bp, Homo sapiens
catgcttaataaac

SEQ ID NO: 866657 - DNA, 12 bp, Homo sapiens
catgcttacctt

SEQ ID NO: 866658 - DNA, 22 bp, Homo sapiens
catgcttactttttaattttta

SEQ ID NO: 866659 - DNA, 13 bp, Homo sapiens
catgcttagaaag

SEQ ID NO: 866660 - DNA, 13 bp, Homo sapiens
catgcttagagca

SEQ ID NO: 866661 - DNA, 14 bp, Homo sapiens
catgcttagagcat

SEQ ID NO: 866662 - DNA, 15 bp, Homo sapiens
catgcttagagcatg

SEQ ID NO: 866663 - DNA, 13 bp, Homo sapiens
catgcttagctta

SEQ ID NO: 866664 - DNA, 18 bp, Homo sapiens
ccaaatgttaactgccaa

SEQ ID NO: 866665 - DNA, 16 bp, Homo sapiens
ccaaatgttcatcctc

SEQ ID NO: 866666 - DNA, 17 bp, Homo sapiens
ccaaattataagggccc

SEQ ID NO: 866667 - DNA, 19 bp, Homo sapiens
ccaaattatcctggtcttt

SEQ ID NO: 866668 - DNA, 23 bp, Homo sapiens
ccaaattattaattgtcctgtgt

SEQ ID NO: 866669 - DNA, 15 bp, Homo sapiens
ccaaattcagtttca

SEQ ID NO: 866670 - DNA, 19 bp, Homo sapiens
ccaaattcagtttcataaa

SEQ ID NO: 866671 - DNA, 22 bp, Homo sapiens
ccaaattgctcctaagcttcaa

SEQ ID NO: 866672 - DNA, 14 bp, Homo sapiens
ccaaattgcttcta

SEQ ID NO: 866673 - DNA, 16 bp, Homo sapiens
ccaaattgcttctagg

SEQ ID NO: 866674 - DNA, 19 bp, Homo sapiens
ccaaattgcttgagcctgg

SEQ ID NO: 866675 - DNA, 14 bp, Homo sapiens
ccaaattgtttgta

SEQ ID NO: 866676 - DNA, 18 bp, Homo sapiens
ccaaatttcctgtttgaa

SEQ ID NO: 866677 - DNA, 13 bp, Homo sapiens
ccaacaaaccatc

SEQ ID NO: 866678 - DNA, 15 bp, Homo sapiens
ccaacaactctgcct

SEQ ID NO: 866679 - DNA, 20 bp, Homo sapiens
ccaacaagaagaaatatgaa

SEQ ID NO: 866680 - DNA, 23 bp, Homo sapiens
ccaacaaggttggcaccccagct

SEQ ID NO: 866681 - DNA, 22 bp, Homo sapiens
ccaacaataaacaggaatttta

SEQ ID NO: 866682 - DNA, 14 bp, Homo sapiens
ccaacaatggggtg

SEQ ID NO: 866683 - DNA, 16 bp, Homo sapiens
ccaacaatggggtggg

SEQ ID NO: 866684 - DNA, 12 bp, Homo sapiens
ccaacacagttg

SEQ ID NO: 866685 - DNA, 13 bp, Homo sapiens
ccaacaccaagca

SEQ ID NO: 866686 - DNA, 22 bp, Homo sapiens
ccaacaccaagcacagcagcct

SEQ ID NO: 866687 - DNA, 21 bp, Homo sapiens
ccaacaccacagacacacaca

SEQ ID NO: 866688 - DNA, 23 bp, Homo sapiens
ccaacaccacagacacacacacg

SEQ ID NO: 866689 - DNA, 22 bp, Homo sapiens
ccaacacccccgacggcctcca

SEQ ID NO: 866690 - DNA, 12 bp, Homo sapiens
ccaacacctgct

SEQ ID NO: 866691 - DNA, 15 bp, Homo sapiens
ccaacacctgctgcg

SEQ ID NO: 866692 - DNA, 17 bp, Homo sapiens
ccaacactgtctgcccc

SEQ ID NO: 866693 - DNA, 17 bp, Homo sapiens
ccaacactgtgccctgg

SEQ ID NO: 866694 - DNA, 18 bp, Homo sapiens
ccaacactgtgccctggt

SEQ ID NO: 866695 - DNA, 20 bp, Homo sapiens
ccaacagcaagggagatttt

SEQ ID NO: 866696 - DNA, 19 bp, Homo sapiens
ccaacagggtagatttctc

SEQ ID NO: 866697 - DNA, 21 bp, Homo sapiens
ccaacagggtagatttctctt

SEQ ID NO: 866698 - DNA, 22 bp, Homo sapiens
ccaacaggtgctgaactgtgca

SEQ ID NO: 866699 - DNA, 23 bp, Homo sapiens
ccaacaggtgctgaactgtgcat

SEQ ID NO: 866700 - DNA, 15 bp, Homo sapiens
ccaacaggtggcagg

SEQ ID NO: 866701 - DNA, 16 bp, Homo sapiens
ccaacatcaacatctt

SEQ ID NO: 866702 - DNA, 17 bp, Homo sapiens
ccaacatcacagcccag

SEQ ID NO: 866703 - DNA, 15 bp, Homo sapiens
ccaacatccagatct

SEQ ID NO: 866704 - DNA, 21 bp, Homo sapiens
ccaacatcccattgccctggt

SEQ ID NO: 866705 - DNA, 17 bp, Homo sapiens
ccaacatcgtgaaaccc

SEQ ID NO: 866706 - DNA, 16 bp, Homo sapiens
ccaacatctccctccc

SEQ ID NO: 866707 - DNA, 12 bp, Homo sapiens
ccaacatctttg

SEQ ID NO: 866708 - DNA, 21 bp, Homo sapiens
ccaacatgcactgatgttgtg

SEQ ID NO: 866709 - DNA, 23 bp, Homo sapiens
ccaacatgcactgatgttgtgtt

SEQ ID NO: 866710 - DNA, 15 bp, Homo sapiens
ccaacatggagaaac

SEQ ID NO: 866711 - DNA, 13 bp, Homo sapiens
ccaccacactgaa

SEQ ID NO: 866712 - DNA, 20 bp, Homo sapiens
ccaccacagccagcacctgg

SEQ ID NO: 866713 - DNA, 16 bp, Homo sapiens
ccaccaccacgcctgg

SEQ ID NO: 866714 - DNA, 14 bp, Homo sapiens
ccaccaccactggc

SEQ ID NO: 866715 - DNA, 14 bp, Homo sapiens
ccaccaccctcagg

SEQ ID NO: 866716 - DNA, 18 bp, Homo sapiens
ccaccaccctcaggtgcc

SEQ ID NO: 866717 - DNA, 12 bp, Homo sapiens
ccaccacctagg

SEQ ID NO: 866718 - DNA, 20 bp, Homo sapiens
ccaccacctaggccactcct

SEQ ID NO: 866719 - DNA, 22 bp, Homo sapiens
ccaccacctgacggctggggac

SEQ ID NO: 866720 - DNA, 22 bp, Homo sapiens
ccaccaccttggactcctccca

SEQ ID NO: 866721 - DNA, 19 bp, Homo sapiens
ccaccacgtctgccaggcc

SEQ ID NO: 866722 - DNA, 21 bp, Homo sapiens
ccaccacgtctgccaggccca

SEQ ID NO: 866723 - DNA, 15 bp, Homo sapiens
ccaccactagagctg

SEQ ID NO: 866724 - DNA, 20 bp, Homo sapiens
ccaccactaggactctgagg

SEQ ID NO: 866725 - DNA, 14 bp, Homo sapiens
ccaccactggccac

SEQ ID NO: 866726 - DNA, 19 bp, Homo sapiens
ccaccactggccaccaggc

SEQ ID NO: 866727 - DNA, 21 bp, Homo sapiens
ccaccactggccaccaggctg

SEQ ID NO: 866728 - DNA, 23 bp, Homo sapiens
ccaccactggccaccaggctggc

SEQ ID NO: 866729 - DNA, 19 bp, Homo sapiens
ccaccacttccagagccag

SEQ ID NO: 866730 - DNA, 20 bp, Homo sapiens
ccaccagaacgcaccccact

SEQ ID NO: 866731 - DNA, 16 bp, Homo sapiens
ccaccagacgccttcc

SEQ ID NO: 866732 - DNA, 23 bp, Homo sapiens
ccaccagactgacaaatgtgtat

SEQ ID NO: 866733 - DNA, 15 bp, Homo sapiens
ccaccagagccggga

SEQ ID NO: 866734 - DNA, 14 bp, Homo sapiens
ccaccagcagcaca

SEQ ID NO: 866735 - DNA, 15 bp, Homo sapiens
ccaccagcagcacaa

SEQ ID NO: 866736 - DNA, 23 bp, Homo sapiens
ccaccagcagcacaattctgtcc

SEQ ID NO: 866737 - DNA, 13 bp, Homo sapiens
ccaccagccagcc

SEQ ID NO: 866738 - DNA, 19 bp, Homo sapiens
ccaccagccagccctggcc

SEQ ID NO: 866739 - DNA, 20 bp, Homo sapiens
ccaccagcccccgccccaga

SEQ ID NO: 866740 - DNA, 20 bp, Homo sapiens
ccaccagccgccccagcccc

SEQ ID NO: 866741 - DNA, 21 bp, Homo sapiens
ccaccagccgccccagcccct

SEQ ID NO: 866742 - DNA, 20 bp, Homo sapiens
ccaccagcgttcccttctcc

SEQ ID NO: 866743 - DNA, 21 bp, Homo sapiens
ccaccagcgttcccttctccc

SEQ ID NO: 866744 - DNA, 14 bp, Homo sapiens
ccaccagctccaca

SEQ ID NO: 866745 - DNA, 16 bp, Homo sapiens
ccaccagctccacaca

SEQ ID NO: 866746 - DNA, 16 bp, Homo sapiens
ccaccagctctgccgt

SEQ ID NO: 866747 - DNA, 20 bp, Homo sapiens
ccaccagcttaagcgttcat

SEQ ID NO: 866748 - DNA, 17 bp, Homo sapiens
ccaccaggactgaaaga

SEQ ID NO: 866749 - DNA, 12 bp, Homo sapiens
ccaccaggagca

SEQ ID NO: 866750 - DNA, 18 bp, Homo sapiens
ccaccaggagcacctgga

SEQ ID NO: 866751 - DNA, 17 bp, Homo sapiens
ccaccaggagcagcagc

SEQ ID NO: 866752 - DNA, 22 bp, Homo sapiens
ccaccaggagcagcagccagca

SEQ ID NO: 866753 - DNA, 19 bp, Homo sapiens
ccaccaggctggcgcagcc

SEQ ID NO: 866754 - DNA, 20 bp, Homo sapiens
ccaccaggctggcgcagcca

SEQ ID NO: 866755 - DNA, 21 bp, Homo sapiens
ccaccaggctggcgcagccaa

SEQ ID NO: 866756 - DNA, 19 bp, Homo sapiens
ccaccagggagcttcctgg

SEQ ID NO: 866757 - DNA, 23 bp, Homo sapiens
ccaccagggagcttcctggctct

SEQ ID NO: 866758 - DNA, 19 bp, Homo sapiens
ccaccaggggaaggaagga

SEQ ID NO: 866759 - DNA, 18 bp, Homo sapiens
ccaccagggtcccaggaa

SEQ ID NO: 866760 - DNA, 15 bp, Homo sapiens
ccaccagggtggacc

SEQ ID NO: 866761 - DNA, 16 bp, Homo sapiens
ccaccagggtggacca

SEQ ID NO: 866762 - DNA, 19 bp, Homo sapiens
ccaccagggtggaccaggc

SEQ ID NO: 866763 - DNA, 20 bp, Homo sapiens
ccaccagggtggaccaggcc

SEQ ID NO: 866764 - DNA, 23 bp, Homo sapiens
ccaccagggtggaccaggcctgg

SEQ ID NO: 866765 - DNA, 19 bp, Homo sapiens
ccaccaggtgcctttcaaa

SEQ ID NO: 866766 - DNA, 14 bp, Homo sapiens
ccaccagtcactgt

SEQ ID NO: 866767 - DNA, 13 bp, Homo sapiens
ccaccagtggacc

SEQ ID NO: 866768 - DNA, 16 bp, Homo sapiens
ccaccagtggacctag

SEQ ID NO: 866769 - DNA, 15 bp, Homo sapiens
ccaccagtgtagcat

SEQ ID NO: 866770 - DNA, 23 bp, Homo sapiens
ccaccagtgtagcatcttcctct

SEQ ID NO: 866771 - DNA, 21 bp, Homo sapiens
ccaccatcaccaccgcctctg

SEQ ID NO: 866772 - DNA, 18 bp, Homo sapiens
ccaccatcaccagacagg

SEQ ID NO: 866773 - DNA, 15 bp, Homo sapiens
ccaccatcactcact

SEQ ID NO: 866774 - DNA, 14 bp, Homo sapiens
ccaccatcctgcag

SEQ ID NO: 866775 - DNA, 15 bp, Homo sapiens
ccaccatcctgcagc

SEQ ID NO: 866776 - DNA, 22 bp, Homo sapiens
ccaccatgaccccttctctctc

SEQ ID NO: 866777 - DNA, 21 bp, Homo sapiens
ccaccatgcactgtaaatatc

SEQ ID NO: 866778 - DNA, 13 bp, Homo sapiens
ccaccatgcagcc

SEQ ID NO: 866779 - DNA, 14 bp, Homo sapiens
ccaccatgcccagc

SEQ ID NO: 866780 - DNA, 17 bp, Homo sapiens
ccaccatgcttgcctga

SEQ ID NO: 866781 - DNA, 21 bp, Homo sapiens
ccaccatgcttgcctgaagct

SEQ ID NO: 866782 - DNA, 22 bp, Homo sapiens
ccaccatgcttgcctgaagctt

SEQ ID NO: 866783 - DNA, 19 bp, Homo sapiens
ccaccatggaccagcccat

SEQ ID NO: 866784 - DNA, 12 bp, Homo sapiens
ccaccattcctg

SEQ ID NO: 866785 - DNA, 21 bp, Homo sapiens
ccacccaaaccccttcccacg

SEQ ID NO: 866786 - DNA, 19 bp, Homo sapiens
ccacccaaccctatctcct

SEQ ID NO: 866787 - DNA, 21 bp, Homo sapiens
ccacccaaccctatctcctga

SEQ ID NO: 866788 - DNA, 15 bp, Homo sapiens
ccacccaagagagga

SEQ ID NO: 866789 - DNA, 19 bp, Homo sapiens
ccacccaagagaggaagga

SEQ ID NO: 866790 - DNA, 16 bp, Homo sapiens
ccacccaagccctcct

SEQ ID NO: 866791 - DNA, 21 bp, Homo sapiens
ccacccaagcttggcagccga

SEQ ID NO: 866792 - DNA, 22 bp, Homo sapiens
ccacccaattcaaaacattgtg

SEQ ID NO: 866793 - DNA, 20 bp, Homo sapiens
ccacccacacagctgcccta

SEQ ID NO: 866794 - DNA, 13 bp, Homo sapiens
ccacccaccccac

SEQ ID NO: 866795 - DNA, 12 bp, Homo sapiens
ccacccaccccc

SEQ ID NO: 866796 - DNA, 13 bp, Homo sapiens
ccacccaccccca

SEQ ID NO: 866797 - DNA, 15 bp, Homo sapiens
ccacccacccccagg

SEQ ID NO: 866798 - DNA, 19 bp, Homo sapiens
ccacccacctccctgcctc

SEQ ID NO: 866799 - DNA, 16 bp, Homo sapiens
ccacccacctcggcct

SEQ ID NO: 866800 - DNA, 12 bp, Homo sapiens
ccacccagccca

SEQ ID NO: 866801 - DNA, 22 bp, Homo sapiens
ccacccagcccattctctctcc

SEQ ID NO: 866802 - DNA, 14 bp, Homo sapiens
ccacccagcccttc

SEQ ID NO: 866803 - DNA, 21 bp, Homo sapiens
ccacccagcccttccttgggc

SEQ ID NO: 866804 - DNA, 12 bp, Homo sapiens
ccacccagctcc

SEQ ID NO: 866805 - DNA, 13 bp, Homo sapiens
ccacccagctcca

SEQ ID NO: 866806 - DNA, 16 bp, Homo sapiens
ccacccagctggtcct

SEQ ID NO: 866807 - DNA, 12 bp, Homo sapiens
ccacccaggagg

SEQ ID NO: 866808 - DNA, 14 bp, Homo sapiens
ccacccaggaggga

SEQ ID NO: 866809 - DNA, 17 bp, Homo sapiens
ccacccaggagggaggg

SEQ ID NO: 866810 - DNA, 21 bp, Homo sapiens
ccacccaggctgcactgcagt

SEQ ID NO: 866811 - DNA, 14 bp, Homo sapiens
ccacccagggagct

SEQ ID NO: 866812 - DNA, 13 bp, Homo sapiens
ccacccaggtccc

SEQ ID NO: 866813 - DNA, 13 bp, Homo sapiens
ccacccagtgctg

SEQ ID NO: 866814 - DNA, 16 bp, Homo sapiens
ccacccagtgctgcca

SEQ ID NO: 866815 - DNA, 20 bp, Homo sapiens
ccacccagtgctgccatgcc

SEQ ID NO: 866816 - DNA, 21 bp, Homo sapiens
ccacccatcctaccaatgcat

SEQ ID NO: 866817 - DNA, 14 bp, Homo sapiens
ccacccatcgctgt

SEQ ID NO: 866818 - DNA, 17 bp, Homo sapiens
ccacccatcgctgtgtg

SEQ ID NO: 866819 - DNA, 15 bp, Homo sapiens
ccacccatcttcctg

SEQ ID NO: 866820 - DNA, 21 bp, Homo sapiens
ccacccatcttcctgctgctg

SEQ ID NO: 866821 - DNA, 13 bp, Homo sapiens
ccacccatgggga

SEQ ID NO: 866822 - DNA, 16 bp, Homo sapiens
ccacccattcccccat

SEQ ID NO: 866823 - DNA, 15 bp, Homo sapiens
ccacagccagcacct

SEQ ID NO: 866824 - DNA, 18 bp, Homo sapiens
ccacagccagcacctggc

SEQ ID NO: 866825 - DNA, 20 bp, Homo sapiens
ccacagccctgtcagtgcag

SEQ ID NO: 866826 - DNA, 15 bp, Homo sapiens
ccacagccgcagcct

SEQ ID NO: 866827 - DNA, 19 bp, Homo sapiens
ccacagcctcccctgccag

SEQ ID NO: 866828 - DNA, 12 bp, Homo sapiens
ccacagcctgct

SEQ ID NO: 866829 - DNA, 16 bp, Homo sapiens
ccacagcctgctggca

SEQ ID NO: 866830 - DNA, 18 bp, Homo sapiens
ccacagcctgctggcagg

SEQ ID NO: 866831 - DNA, 19 bp, Homo sapiens
ccacagcctgctggcaggg

SEQ ID NO: 866832 - DNA, 22 bp, Homo sapiens
ccacagcctgctggcagggcca

SEQ ID NO: 866833 - DNA, 19 bp, Homo sapiens
ccacagccttcggacagac

SEQ ID NO: 866834 - DNA, 24 bp, Homo sapiens
ccacagcgccagcctcagactgga

SEQ ID NO: 866835 - DNA, 21 bp, Homo sapiens
ccacagcgtccctggcgcagg

SEQ ID NO: 866836 - DNA, 21 bp, Homo sapiens
ccacagctatttagaagcatc

SEQ ID NO: 866837 - DNA, 15 bp, Homo sapiens
ccacagctcccaccc

SEQ ID NO: 866838 - DNA, 16 bp, Homo sapiens
ccacagctgagaatgt

SEQ ID NO: 866839 - DNA, 11 bp, Homo sapiens
ccacagctgct

SEQ ID NO: 866840 - DNA, 13 bp, Homo sapiens
ccacagctgctgg

SEQ ID NO: 866841 - DNA, 14 bp, Homo sapiens
ccacagctgctgga

SEQ ID NO: 866842 - DNA, 17 bp, Homo sapiens
ccacagctgctgttctc

SEQ ID NO: 866843 - DNA, 21 bp, Homo sapiens
ccacagctgctgttctcagga

SEQ ID NO: 866844 - DNA, 20 bp, Homo sapiens
ccacagctgggcagggtgag

SEQ ID NO: 866845 - DNA, 22 bp, Homo sapiens
ccacagctttgcacccctttcc

SEQ ID NO: 866846 - DNA, 15 bp, Homo sapiens
ccacaggaacggccc

SEQ ID NO: 866847 - DNA, 16 bp, Homo sapiens
ccacaggactgagccc

SEQ ID NO: 866848 - DNA, 22 bp, Homo sapiens
ccacaggactgagccctctcac

SEQ ID NO: 866849 - DNA, 18 bp, Homo sapiens
ccacaggagggccagcgc

SEQ ID NO: 866850 - DNA, 19 bp, Homo sapiens
ccacaggcaggtcacagaa

SEQ ID NO: 866851 - DNA, 16 bp, Homo sapiens
ccacaggccgccctgc

SEQ ID NO: 866852 - DNA, 17 bp, Homo sapiens
ccacaggccgccctgcg

SEQ ID NO: 866853 - DNA, 21 bp, Homo sapiens
ccacaggcttagggacaggac

SEQ ID NO: 866854 - DNA, 16 bp, Homo sapiens
ccacagggaaccctgc

SEQ ID NO: 866855 - DNA, 17 bp, Homo sapiens
ccacagggcaaggacac

SEQ ID NO: 866856 - DNA, 20 bp, Homo sapiens
ccacagggctaagagctagc

SEQ ID NO: 866857 - DNA, 17 bp, Homo sapiens
ccacaggggcaggcctg

SEQ ID NO: 866858 - DNA, 19 bp, Homo sapiens
ccacaggggcaggcctggg

SEQ ID NO: 866859 - DNA, 15 bp, Homo sapiens
ccacagtactcactt

SEQ ID NO: 866860 - DNA, 17 bp, Homo sapiens
ccacagtagtcttgatg

SEQ ID NO: 866861 - DNA, 23 bp, Homo sapiens
ccacagtatattttatttcaatg

SEQ ID NO: 866862 - DNA, 14 bp, Homo sapiens
ccacagtcaaagaa

SEQ ID NO: 866863 - DNA, 14 bp, Homo sapiens
ccacagtcactgga

SEQ ID NO: 866864 - DNA, 15 bp, Homo sapiens
ccacagtcactggat

SEQ ID NO: 866865 - DNA, 14 bp, Homo sapiens
ccacagtcccccac

SEQ ID NO: 866866 - DNA, 21 bp, Homo sapiens
ccacagtcccccacccacctc

SEQ ID NO: 866867 - DNA, 23 bp, Homo sapiens
ccacagtcccccacccacctcct

SEQ ID NO: 866868 - DNA, 19 bp, Homo sapiens
ccacagtgagaggggaggg

SEQ ID NO: 866869 - DNA, 21 bp, Homo sapiens
ccacagtgagaggggagggct

SEQ ID NO: 866870 - DNA, 14 bp, Homo sapiens
ccacagtgctgctt

SEQ ID NO: 866871 - DNA, 15 bp, Homo sapiens
ccacagtgctgcttc

SEQ ID NO: 866872 - DNA, 19 bp, Homo sapiens
ccacagtgggtggcacctc

SEQ ID NO: 866873 - DNA, 22 bp, Homo sapiens
ccacagtgggtggcacctcctg

SEQ ID NO: 866874 - DNA, 23 bp, Homo sapiens
ccacagtgggtggcacctcctga

SEQ ID NO: 866875 - DNA, 23 bp, Homo sapiens
ccacagtgtcactggtcaggtgc

SEQ ID NO: 866876 - DNA, 19 bp, Homo sapiens
ccacagtgttgtgcccctt

SEQ ID NO: 866877 - DNA, 20 bp, Homo sapiens
ccacagttgccaccacctct

SEQ ID NO: 866878 - DNA, 21 bp, Homo sapiens
ccacagttttaataagaacag

SEQ ID NO: 866879 - DNA, 20 bp, Homo sapiens
ccacataagaaggcaatttt

SEQ ID NO: 866880 - DNA, 14 bp, Homo sapiens
ccacataatttttg

SEQ ID NO: 866881 - DNA, 20 bp, Homo sapiens
ccacatacaacacaaagaga

SEQ ID NO: 866882 - DNA, 18 bp, Homo sapiens
ccacatacgcagggggaa

SEQ ID NO: 866883 - DNA, 21 bp, Homo sapiens
ccacatagcatgcttcctttc

SEQ ID NO: 866884 - DNA, 22 bp, Homo sapiens
ccacatagtgatggttcccctg

SEQ ID NO: 866885 - DNA, 14 bp, Homo sapiens
ccacatataacact

SEQ ID NO: 866886 - DNA, 14 bp, Homo sapiens
ccacatcaaagagg

SEQ ID NO: 866887 - DNA, 19 bp, Homo sapiens
ccacatccaactccagcaa

SEQ ID NO: 866888 - DNA, 15 bp, Homo sapiens
ccacatccacacacg

SEQ ID NO: 866889 - DNA, 12 bp, Homo sapiens
ccacatcccagc

SEQ ID NO: 866890 - DNA, 14 bp, Homo sapiens
ccacatcccagcag

SEQ ID NO: 866891 - DNA, 16 bp, Homo sapiens
ccacatcccagcagcc

SEQ ID NO: 866892 - DNA, 17 bp, Homo sapiens
ccacatcccagcagccc

SEQ ID NO: 866893 - DNA, 18 bp, Homo sapiens
ccacatcccagcagccca

SEQ ID NO: 866894 - DNA, 21 bp, Homo sapiens
ccacatccccagagcccagct

SEQ ID NO: 866895 - DNA, 24 bp, Homo sapiens
ccacatccccagagcccagctctt

SEQ ID NO: 866896 - DNA, 15 bp, Homo sapiens
ccacatctgccagac

SEQ ID NO: 866897 - DNA, 19 bp, Homo sapiens
ccacatctgcctcctctcc

SEQ ID NO: 866898 - DNA, 12 bp, Homo sapiens
ccacatctgtcc

SEQ ID NO: 866899 - DNA, 17 bp, Homo sapiens
ccacatctgtcctcacc

SEQ ID NO: 866900 - DNA, 18 bp, Homo sapiens
ccacatctgtcctcaccc

SEQ ID NO: 866901 - DNA, 19 bp, Homo sapiens
ccacatctgtcctcaccct

SEQ ID NO: 866902 - DNA, 20 bp, Homo sapiens
ccacatctgtcctcaccctg

SEQ ID NO: 866903 - DNA, 13 bp, Homo sapiens
ccacatcttgact

SEQ ID NO: 866904 - DNA, 15 bp, Homo sapiens
ccacatgacctccat

SEQ ID NO: 866905 - DNA, 22 bp, Homo sapiens
ccacatgaggccatctcaggag

SEQ ID NO: 866906 - DNA, 14 bp, Homo sapiens
ccacatgctgcctg

SEQ ID NO: 866907 - DNA, 15 bp, Homo sapiens
ccacatgctgcctgg

SEQ ID NO: 866908 - DNA, 18 bp, Homo sapiens
ccacatgctgcctggcac

SEQ ID NO: 866909 - DNA, 19 bp, Homo sapiens
ccacatgctgcctggcaca

SEQ ID NO: 866910 - DNA, 23 bp, Homo sapiens
ccacatgctgcctggcacagacc

SEQ ID NO: 866911 - DNA, 12 bp, Homo sapiens
ccacatgggacc

SEQ ID NO: 866912 - DNA, 16 bp, Homo sapiens
ccacatggtgtctccc

SEQ ID NO: 866913 - DNA, 17 bp, Homo sapiens
ccacatggtgtctccca

SEQ ID NO: 866914 - DNA, 20 bp, Homo sapiens
ccacatggtgtctcccaaca

SEQ ID NO: 866915 - DNA, 18 bp, Homo sapiens
ccacatggtgtggccatc

SEQ ID NO: 866916 - DNA, 19 bp, Homo sapiens
ccacatggtgtggccatca

SEQ ID NO: 866917 - DNA, 20 bp, Homo sapiens
ccacatgtacagacatacat

SEQ ID NO: 866918 - DNA, 14 bp, Homo sapiens
ccacatgtacataa

SEQ ID NO: 866919 - DNA, 14 bp, Homo sapiens
ccacatgtcaccgt

SEQ ID NO: 866920 - DNA, 14 bp, Homo sapiens
ccacatgtcccaga

SEQ ID NO: 866921 - DNA, 13 bp, Homo sapiens
ccacattaaagaa

SEQ ID NO: 866922 - DNA, 13 bp, Homo sapiens
ccacattctactt

SEQ ID NO: 866923 - DNA, 18 bp, Homo sapiens
ccacattgacagtggtgg

SEQ ID NO: 866924 - DNA, 17 bp, Homo sapiens
ccacattgatttttcta

SEQ ID NO: 866925 - DNA, 15 bp, Homo sapiens
ccacattgcctcatt

SEQ ID NO: 866926 - DNA, 22 bp, Homo sapiens
ccacattgcctcatttcttcct

SEQ ID NO: 866927 - DNA, 16 bp, Homo sapiens
ccacatttccatggtg

SEQ ID NO: 866928 - DNA, 22 bp, Homo sapiens
ccacatttggaatactttttgt

SEQ ID NO: 866929 - DNA, 16 bp, Homo sapiens
ccacatttgggctcag

SEQ ID NO: 866930 - DNA, 21 bp, Homo sapiens
ccacgcaggggctctgagccc

SEQ ID NO: 866931 - DNA, 15 bp, Homo sapiens
ccacgcatacacaca

SEQ ID NO: 866932 - DNA, 15 bp, Homo sapiens
ccacgccactgcctc

SEQ ID NO: 866933 - DNA, 16 bp, Homo sapiens
ccacgccactgcctcc

SEQ ID NO: 866934 - DNA, 17 bp, Homo sapiens
ccacgcccgtcctgcct

SEQ ID NO: 866935 - DNA, 18 bp, Homo sapiens
ccacgcccgtcctgcctg

SEQ ID NO: 866936 - DNA, 22 bp, Homo sapiens
ccacgcccgtcctgcctgtggc

SEQ ID NO: 866937 - DNA, 17 bp, Homo sapiens
ccacgccctctcctccc

SEQ ID NO: 866938 - DNA, 19 bp, Homo sapiens
ccacgccctctcctccccc

SEQ ID NO: 866939 - DNA, 16 bp, Homo sapiens
ccacgccggcctctgc

SEQ ID NO: 866940 - DNA, 18 bp, Homo sapiens
ccacgcctcctggccaga

SEQ ID NO: 866941 - DNA, 14 bp, Homo sapiens
ccacgccttgacct

SEQ ID NO: 866942 - DNA, 18 bp, Homo sapiens
ccacgcgggggccttgag

SEQ ID NO: 866943 - DNA, 13 bp, Homo sapiens
ccacgctcagtgc

SEQ ID NO: 866944 - DNA, 14 bp, Homo sapiens
ccacgctcagtgcc

SEQ ID NO: 866945 - DNA, 15 bp, Homo sapiens
ccacgctcagtgccc

SEQ ID NO: 866946 - DNA, 12 bp, Homo sapiens
ccacgctccagc

SEQ ID NO: 866947 - DNA, 13 bp, Homo sapiens
ccacgctccagct

SEQ ID NO: 866948 - DNA, 11 bp, Homo sapiens
ccacgctgtcc

SEQ ID NO: 866949 - DNA, 12 bp, Homo sapiens
ccacgctgtcct

SEQ ID NO: 866950 - DNA, 20 bp, Homo sapiens
ccacgctgtctccagacccc

SEQ ID NO: 866951 - DNA, 14 bp, Homo sapiens
ccacgcttctccgg

SEQ ID NO: 866952 - DNA, 15 bp, Homo sapiens
ccacggacccccaga

SEQ ID NO: 866953 - DNA, 18 bp, Homo sapiens
ccacggacgtttccatca

SEQ ID NO: 866954 - DNA, 22 bp, Homo sapiens
ccacggagcagttcagagtgga

SEQ ID NO: 866955 - DNA, 20 bp, Homo sapiens
ccacggagccactcctctga

SEQ ID NO: 866956 - DNA, 21 bp, Homo sapiens
ccacggagccactcctctgac

SEQ ID NO: 866957 - DNA, 19 bp, Homo sapiens
ccacggagggaggcaccat

SEQ ID NO: 866958 - DNA, 14 bp, Homo sapiens
ccacggccaccctc

SEQ ID NO: 866959 - DNA, 15 bp, Homo sapiens
ccacggccaccctcc

SEQ ID NO: 866960 - DNA, 12 bp, Homo sapiens
ccacggccttgt

SEQ ID NO: 866961 - DNA, 17 bp, Homo sapiens
ccacggggatcacagcg

SEQ ID NO: 866962 - DNA, 20 bp, Homo sapiens
ccacggggcagttagagcag

SEQ ID NO: 866963 - DNA, 18 bp, Homo sapiens
ccacggtccgcggcctgc

SEQ ID NO: 866964 - DNA, 22 bp, Homo sapiens
ccacggtccgcggcctgcaccg

SEQ ID NO: 866965 - DNA, 17 bp, Homo sapiens
ccacggtctgagctagc

SEQ ID NO: 866966 - DNA, 21 bp, Homo sapiens
ccacggtctgttcttgaagca

SEQ ID NO: 866967 - DNA, 21 bp, Homo sapiens
ccacggtgcgtggctgtggca

SEQ ID NO: 866968 - DNA, 21 bp, Homo sapiens
ccacggtttatcctcttggtg

SEQ ID NO: 866969 - DNA, 12 bp, Homo sapiens
ccacgtcccacc

SEQ ID NO: 866970 - DNA, 17 bp, Homo sapiens
ccacgtcccaccccacc

SEQ ID NO: 866971 - DNA, 19 bp, Homo sapiens
ccacgtcccaccccacctc

SEQ ID NO: 866972 - DNA, 20 bp, Homo sapiens
ccacgtcccaccccacctct

SEQ ID NO: 866973 - DNA, 13 bp, Homo sapiens
ccacgtcccagca

SEQ ID NO: 866974 - DNA, 18 bp, Homo sapiens
ccacgtcccagcatccct

SEQ ID NO: 866975 - DNA, 15 bp, Homo sapiens
ccacgtccccctggg

SEQ ID NO: 866976 - DNA, 17 bp, Homo sapiens
ccacgtcccgctgcctc

SEQ ID NO: 866977 - DNA, 19 bp, Homo sapiens
ccacgtcccgctgcctcct

SEQ ID NO: 866978 - DNA, 14 bp, Homo sapiens
ccacgtctgccagg

SEQ ID NO: 866979 - DNA, 15 bp, Homo sapiens
ccacgtctgccaggc

SEQ ID NO: 866980 - DNA, 22 bp, Homo sapiens
ccacgtctggctccctgcccct

SEQ ID NO: 866981 - DNA, 17 bp, Homo sapiens
ccacgtgaaactgctgt

SEQ ID NO: 866982 - DNA, 20 bp, Homo sapiens
ccacgtgaaatttgcctctg

SEQ ID NO: 866983 - DNA, 23 bp, Homo sapiens
ccacgtgaaatttgcctctgtcc

SEQ ID NO: 866984 - DNA, 17 bp, Homo sapiens
ccacgtgagagaatctg

SEQ ID NO: 866985 - DNA, 21 bp, Homo sapiens
ccacgtgagagaatctgcctg

SEQ ID NO: 866986 - DNA, 15 bp, Homo sapiens
ccacgtgccaggccc

SEQ ID NO: 866987 - DNA, 22 bp, Homo sapiens
ccacgtggatgggcaaagcttg

SEQ ID NO: 866988 - DNA, 13 bp, Homo sapiens
ccacgtggcctct

SEQ ID NO: 866989 - DNA, 17 bp, Homo sapiens
ccacgtggcctctctct

SEQ ID NO: 866990 - DNA, 14 bp, Homo sapiens
ccacgtgtatagta

SEQ ID NO: 866991 - DNA, 22 bp, Homo sapiens
ccacgtgtatagtatctgtata

SEQ ID NO: 866992 - DNA, 18 bp, Homo sapiens
ccacgtgtccgtccaccc

SEQ ID NO: 866993 - DNA, 22 bp, Homo sapiens
ccacgtgtccgtccacccttcc

SEQ ID NO: 866994 - DNA, 16 bp, Homo sapiens
ccacgtgtcttccact

SEQ ID NO: 866995 - DNA, 19 bp, Homo sapiens
ccacgtgtgctgtggccag

SEQ ID NO: 866996 - DNA, 21 bp, Homo sapiens
ccacgtgtgctgtggccaggc

SEQ ID NO: 866997 - DNA, 16 bp, Homo sapiens
ccacgtgtggcctccg

SEQ ID NO: 866998 - DNA, 17 bp, Homo sapiens
ccacgttcagggagggg

SEQ ID NO: 866999 - DNA, 20 bp, Homo sapiens
ccacgttcagggaggggccg

SEQ ID NO: 867000 - DNA, 20 bp, Homo sapiens
ccacgttccacagttgccac

SEQ ID NO: 867001 - DNA, 16 bp, Homo sapiens
ccacgttctcacaccc

SEQ ID NO: 867002 - DNA, 13 bp, Homo sapiens
ccacgtttctaaa

SEQ ID NO: 867003 - DNA, 12 bp, Homo sapiens
ccactaaaaata

SEQ ID NO: 867004 - DNA, 14 bp, Homo sapiens
ccactaaaaatatt

SEQ ID NO: 867005 - DNA, 20 bp, Homo sapiens
ccactaaagcttcagactca

SEQ ID NO: 867006 - DNA, 22 bp, Homo sapiens
ccactaaatctccaagacctgg

SEQ ID NO: 867007 - DNA, 19 bp, Homo sapiens
ccactaaccatccccaact

SEQ ID NO: 867008 - DNA, 14 bp, Homo sapiens
ccactaagcagagg

SEQ ID NO: 867009 - DNA, 13 bp, Homo sapiens
ccactacacctgg

SEQ ID NO: 867010 - DNA, 17 bp, Homo sapiens
ccactacacctggctga

SEQ ID NO: 867011 - DNA, 18 bp, Homo sapiens
ccactacactccagcctg

SEQ ID NO: 867012 - DNA, 20 bp, Homo sapiens
ccactacactccagcctgag

SEQ ID NO: 867013 - DNA, 15 bp, Homo sapiens
ccactacattctgtt

SEQ ID NO: 867014 - DNA, 16 bp, Homo sapiens
ccactacattctgtta

SEQ ID NO: 867015 - DNA, 18 bp, Homo sapiens
ccactacattctgttaat

SEQ ID NO: 867016 - DNA, 14 bp, Homo sapiens
ccactaccagccag

SEQ ID NO: 867017 - DNA, 15 bp, Homo sapiens
ccactaccagccagc

SEQ ID NO: 867018 - DNA, 16 bp, Homo sapiens
ccactaccagccagcc

SEQ ID NO: 867019 - DNA, 18 bp, Homo sapiens
ccactaccagccagcctc

SEQ ID NO: 867020 - DNA, 14 bp, Homo sapiens
ccactactgcagca

SEQ ID NO: 867021 - DNA, 22 bp, Homo sapiens
ccactagagggcccatcaggca

SEQ ID NO: 867022 - DNA, 23 bp, Homo sapiens
ccactaggaatcccagaggtggg

SEQ ID NO: 867023 - DNA, 17 bp, Homo sapiens
ccactaggtgtccccaa

SEQ ID NO: 867024 - DNA, 21 bp, Homo sapiens
ccactatcccaatcaaagaat

SEQ ID NO: 867025 - DNA, 18 bp, Homo sapiens
ccactcaaaatatgtcaa

SEQ ID NO: 867026 - DNA, 15 bp, Homo sapiens
ccactcaccagggtc

SEQ ID NO: 867027 - DNA, 17 bp, Homo sapiens
ccactcaccagggtccg

SEQ ID NO: 867028 - DNA, 12 bp, Homo sapiens
ccactcaccccc

SEQ ID NO: 867029 - DNA, 19 bp, Homo sapiens
ccactcacccttcctggcc

SEQ ID NO: 867030 - DNA, 14 bp, Homo sapiens
ccactcagccccta

SEQ ID NO: 867031 - DNA, 15 bp, Homo sapiens
ccactcagctgtcct

SEQ ID NO: 867032 - DNA, 13 bp, Homo sapiens
ccactcaggaggc

SEQ ID NO: 867033 - DNA, 20 bp, Homo sapiens
ccactcaggaggctgaggca

SEQ ID NO: 867034 - DNA, 16 bp, Homo sapiens
ccactcaggggacccc

SEQ ID NO: 867035 - DNA, 20 bp, Homo sapiens
ccactcaggtgcacacatca

SEQ ID NO: 867036 - DNA, 17 bp, Homo sapiens
ccactcagtctcttcca

SEQ ID NO: 867037 - DNA, 16 bp, Homo sapiens
ccactcagtgcctcca

SEQ ID NO: 867038 - DNA, 13 bp, Homo sapiens
ccactccaaactc

SEQ ID NO: 867039 - DNA, 18 bp, Homo sapiens
ccactccaagccccctgg

SEQ ID NO: 867040 - DNA, 22 bp, Homo sapiens
ccactccaagccccctggcagc

SEQ ID NO: 867041 - DNA, 14 bp, Homo sapiens
ccactccaccctgt

SEQ ID NO: 867042 - DNA, 17 bp, Homo sapiens
ccactccagacccctgg

SEQ ID NO: 867043 - DNA, 19 bp, Homo sapiens
ccactccagacccctggct

SEQ ID NO: 867044 - DNA, 20 bp, Homo sapiens
ccactccagacccctggctt

SEQ ID NO: 867045 - DNA, 22 bp, Homo sapiens
ccactggggaatgctcccagct

SEQ ID NO: 867046 - DNA, 18 bp, Homo sapiens
ccactggggactttattt

SEQ ID NO: 867047 - DNA, 18 bp, Homo sapiens
ccactggggtccagggag

SEQ ID NO: 867048 - DNA, 20 bp, Homo sapiens
ccactgggtctcactcctga

SEQ ID NO: 867049 - DNA, 21 bp, Homo sapiens
ccactgggtctcactcctgag

SEQ ID NO: 867050 - DNA, 15 bp, Homo sapiens
ccactgggtgagaga

SEQ ID NO: 867051 - DNA, 18 bp, Homo sapiens
ccactggtacttcctttc

SEQ ID NO: 867052 - DNA, 19 bp, Homo sapiens
ccactggttaaaataaagc

SEQ ID NO: 867053 - DNA, 14 bp, Homo sapiens
ccactgtaaaatga

SEQ ID NO: 867054 - DNA, 11 bp, Homo sapiens
ccactgtagct

SEQ ID NO: 867055 - DNA, 12 bp, Homo sapiens
ccactgtagcta

SEQ ID NO: 867056 - DNA, 20 bp, Homo sapiens
ccactgtccccctacccacc

SEQ ID NO: 867057 - DNA, 21 bp, Homo sapiens
ccactgtccccctacccaccg

SEQ ID NO: 867058 - DNA, 13 bp, Homo sapiens
ccactgtccgcct

SEQ ID NO: 867059 - DNA, 12 bp, Homo sapiens
ccactgtcctgg

SEQ ID NO: 867060 - DNA, 22 bp, Homo sapiens
ccactgtcctgggcgccctgga

SEQ ID NO: 867061 - DNA, 14 bp, Homo sapiens
ccactgtgaagaga

SEQ ID NO: 867062 - DNA, 15 bp, Homo sapiens
ccactgtgaagagaa

SEQ ID NO: 867063 - DNA, 18 bp, Homo sapiens
ccactgtgccactgactt

SEQ ID NO: 867064 - DNA, 20 bp, Homo sapiens
ccactgtgcctcagagacca

SEQ ID NO: 867065 - DNA, 21 bp, Homo sapiens
ccactgtgcctttgcaaatca

SEQ ID NO: 867066 - DNA, 14 bp, Homo sapiens
ccactgtggccaga

SEQ ID NO: 867067 - DNA, 15 bp, Homo sapiens
ccactgtggccagag

SEQ ID NO: 867068 - DNA, 18 bp, Homo sapiens
ccactgtggccagagctg

SEQ ID NO: 867069 - DNA, 20 bp, Homo sapiens
ccactgtggccagagctgga

SEQ ID NO: 867070 - DNA, 12 bp, Homo sapiens
ccactgtgtata

SEQ ID NO: 867071 - DNA, 11 bp, Homo sapiens
ccactgtgtct

SEQ ID NO: 867072 - DNA, 14 bp, Homo sapiens
ccactgtgtctctg

SEQ ID NO: 867073 - DNA, 16 bp, Homo sapiens
ccactgtgtctctgtt

SEQ ID NO: 867074 - DNA, 16 bp, Homo sapiens
ccactgtgtgccttct

SEQ ID NO: 867075 - DNA, 17 bp, Homo sapiens
ccactgtgtgttgacac

SEQ ID NO: 867076 - DNA, 14 bp, Homo sapiens
ccactgttatcaaa

SEQ ID NO: 867077 - DNA, 21 bp, Homo sapiens
ccactgttgagccccagtgct

SEQ ID NO: 867078 - DNA, 17 bp, Homo sapiens
ccactgtttctcttgag

SEQ ID NO: 867079 - DNA, 18 bp, Homo sapiens
ccacttagccgcaccctg

SEQ ID NO: 867080 - DNA, 15 bp, Homo sapiens
ccacttagccgtcca

SEQ ID NO: 867081 - DNA, 16 bp, Homo sapiens
ccacttatgctgctgt

SEQ ID NO: 867082 - DNA, 17 bp, Homo sapiens
ccacttcaagtgaccac

SEQ ID NO: 867083 - DNA, 14 bp, Homo sapiens
ccacttcaccccca

SEQ ID NO: 867084 - DNA, 19 bp, Homo sapiens
ccacttcacccccaacttc

SEQ ID NO: 867085 - DNA, 13 bp, Homo sapiens
ccacttcactgtg

SEQ ID NO: 867086 - DNA, 20 bp, Homo sapiens
ccacttcattccagcagctg

SEQ ID NO: 867087 - DNA, 23 bp, Homo sapiens
ccacttcattcttgaaagctgtg

SEQ ID NO: 867088 - DNA, 15 bp, Homo sapiens
ccacttcccacttgc

SEQ ID NO: 867089 - DNA, 20 bp, Homo sapiens
ccacttcccatctccaggga

SEQ ID NO: 867090 - DNA, 17 bp, Homo sapiens
ccacttcctcctacctg

SEQ ID NO: 867091 - DNA, 23 bp, Homo sapiens
ccacttcctttcctactgtcctg

SEQ ID NO: 867092 - DNA, 14 bp, Homo sapiens
ccacttctccatgc

SEQ ID NO: 867093 - DNA, 12 bp, Homo sapiens
ccacttctctgc

SEQ ID NO: 867094 - DNA, 17 bp, Homo sapiens
ccacttctctgctgcct

SEQ ID NO: 867095 - DNA, 19 bp, Homo sapiens
ccacttctctgctgcctct

SEQ ID NO: 867096 - DNA, 13 bp, Homo sapiens
ccacttctggcat

SEQ ID NO: 867097 - DNA, 19 bp, Homo sapiens
ccacttctggcatgggaca

SEQ ID NO: 867098 - DNA, 17 bp, Homo sapiens
ccacttctggccacatc

SEQ ID NO: 867099 - DNA, 17 bp, Homo sapiens
ccacttctggcctccag

SEQ ID NO: 867100 - DNA, 18 bp, Homo sapiens
ccacttctggcctccagc

SEQ ID NO: 867101 - DNA, 18 bp, Homo sapiens
ccacttctggtcccctgt

SEQ ID NO: 867102 - DNA, 21 bp, Homo sapiens
ccacttctggtcccctgtggt

SEQ ID NO: 867103 - DNA, 15 bp, Homo sapiens
ccacttctgtgggca

SEQ ID NO: 867104 - DNA, 23 bp, Homo sapiens
ccacttctgtgggcatggccgct

SEQ ID NO: 867105 - DNA, 23 bp, Homo sapiens
ccacttcttaaaggcctggaacc

SEQ ID NO: 867106 - DNA, 18 bp, Homo sapiens
ccacttcttcctttctct

SEQ ID NO: 867107 - DNA, 22 bp, Homo sapiens
ccacttcttcctttctctttct

SEQ ID NO: 867108 - DNA, 16 bp, Homo sapiens
ccacttcttggttcct

SEQ ID NO: 867109 - DNA, 14 bp, Homo sapiens
ccacttgacattcc

SEQ ID NO: 867110 - DNA, 21 bp, Homo sapiens
ccacttgacattccttgtcac

SEQ ID NO: 867111 - DNA, 19 bp, Homo sapiens
ccacttgactggcacacac

SEQ ID NO: 867112 - DNA, 14 bp, Homo sapiens
ccacttgattgaga

SEQ ID NO: 867113 - DNA, 17 bp, Homo sapiens
ccacttgcctcttcctt

SEQ ID NO: 867114 - DNA, 14 bp, Homo sapiens
ccacttgcctgggg

SEQ ID NO: 867115 - DNA, 17 bp, Homo sapiens
ccacttgggtcttccct

SEQ ID NO: 867116 - DNA, 20 bp, Homo sapiens
ccacttgtcaaagaaggtgc

SEQ ID NO: 867117 - DNA, 19 bp, Homo sapiens
ccacttgtcccactatctg

SEQ ID NO: 867118 - DNA, 15 bp, Homo sapiens
ccacttgtccgctgg

SEQ ID NO: 867119 - DNA, 19 bp, Homo sapiens
ccactttcacgtggcctcc

SEQ ID NO: 867120 - DNA, 13 bp, Homo sapiens
ccactttctgttc

SEQ ID NO: 867121 - DNA, 20 bp, Homo sapiens
ccactttgcagctaaaataa

SEQ ID NO: 867122 - DNA, 16 bp, Homo sapiens
ccactttgctgttcct

SEQ ID NO: 867123 - DNA, 16 bp, Homo sapiens
ccactttgtctgtaca

SEQ ID NO: 867124 - DNA, 18 bp, Homo sapiens
ccactttgtctgtacata

SEQ ID NO: 867125 - DNA, 14 bp, Homo sapiens
ccactttgttggaa

SEQ ID NO: 867126 - DNA, 23 bp, Homo sapiens
ccacttttaaaggaatgtgaaat

SEQ ID NO: 867127 - DNA, 17 bp, Homo sapiens
ccacttttcttcttcct

SEQ ID NO: 867128 - DNA, 18 bp, Homo sapiens
ccacttttgcccacctct

SEQ ID NO: 867129 - DNA, 19 bp, Homo sapiens
ccagaaaaaaaaaaactta

SEQ ID NO: 867130 - DNA, 23 bp, Homo sapiens
ccagaaaaataaatgtcactgcc

SEQ ID NO: 867131 - DNA, 19 bp, Homo sapiens
ccagaaacacccctctgtc

SEQ ID NO: 867132 - DNA, 17 bp, Homo sapiens
ccagaaacagctgcttc

SEQ ID NO: 867133 - DNA, 15 bp, Homo sapiens
ccagaaacagggaca

SEQ ID NO: 867134 - DNA, 15 bp, Homo sapiens
ccagaaacagtggga

SEQ ID NO: 867135 - DNA, 22 bp, Homo sapiens
ccagaaacagtgggagccctga

SEQ ID NO: 867136 - DNA, 13 bp, Homo sapiens
ccagaaacatctc

SEQ ID NO: 867137 - DNA, 22 bp, Homo sapiens
ccagaaactcctgtttctcctt

SEQ ID NO: 867138 - DNA, 20 bp, Homo sapiens
ccagaaagcctcctgccccc

SEQ ID NO: 867139 - DNA, 15 bp, Homo sapiens
ccagaaagcctctct

SEQ ID NO: 867140 - DNA, 18 bp, Homo sapiens
ccagaaagcctctctctc

SEQ ID NO: 867141 - DNA, 23 bp, Homo sapiens
ccagaaagcctctctctccctcc

SEQ ID NO: 867142 - DNA, 13 bp, Homo sapiens
ccagaaagctgcc

SEQ ID NO: 867143 - DNA, 18 bp, Homo sapiens
ccagaaagctgccagagc

SEQ ID NO: 867144 - DNA, 23 bp, Homo sapiens
ccagaaaggatatttaagaaaat

SEQ ID NO: 867145 - DNA, 13 bp, Homo sapiens
ccagaaatcactg

SEQ ID NO: 867146 - DNA, 14 bp, Homo sapiens
ccagaaatcactgt

SEQ ID NO: 867147 - DNA, 17 bp, Homo sapiens
ccagaaatcactgtgaa

SEQ ID NO: 867148 - DNA, 16 bp, Homo sapiens
ccagaaatcattttac

SEQ ID NO: 867149 - DNA, 14 bp, Homo sapiens
ccagaaatgggcag

SEQ ID NO: 867150 - DNA, 24 bp, Homo sapiens
ccagcacatggccatagaggccca

SEQ ID NO: 867151 - DNA, 16 bp, Homo sapiens
ccagcaccctctcctg

SEQ ID NO: 867152 - DNA, 18 bp, Homo sapiens
ccagcaccctctcctggg

SEQ ID NO: 867153 - DNA, 20 bp, Homo sapiens
ccagcaccctctcctggggg

SEQ ID NO: 867154 - DNA, 23 bp, Homo sapiens
ccagcaccctctcctgggggtgg

SEQ ID NO: 867155 - DNA, 21 bp, Homo sapiens
ccagcaccttctttctggact

SEQ ID NO: 867156 - DNA, 22 bp, Homo sapiens
ccagcaccttctttctggactg

SEQ ID NO: 867157 - DNA, 16 bp, Homo sapiens
ccagcaccttgcagat

SEQ ID NO: 867158 - DNA, 18 bp, Homo sapiens
ccagcactaaagcagtgg

SEQ ID NO: 867159 - DNA, 13 bp, Homo sapiens
ccagcactcagcc

SEQ ID NO: 867160 - DNA, 14 bp, Homo sapiens
ccagcactgcctcc

SEQ ID NO: 867161 - DNA, 15 bp, Homo sapiens
ccagcactgtctcag

SEQ ID NO: 867162 - DNA, 21 bp, Homo sapiens
ccagcactttgggaggccaag

SEQ ID NO: 867163 - DNA, 20 bp, Homo sapiens
ccagcactttgggaggccga

SEQ ID NO: 867164 - DNA, 23 bp, Homo sapiens
ccagcagaaatgcccccattctc

SEQ ID NO: 867165 - DNA, 21 bp, Homo sapiens
ccagcagacagagccaggaga

SEQ ID NO: 867166 - DNA, 23 bp, Homo sapiens
ccagcagagcccaccagccagcc

SEQ ID NO: 867167 - DNA, 17 bp, Homo sapiens
ccagcagaggcaggctg

SEQ ID NO: 867168 - DNA, 11 bp, Homo sapiens
ccagcagaggg

SEQ ID NO: 867169 - DNA, 22 bp, Homo sapiens
ccagcagagggcgccaccacca

SEQ ID NO: 867170 - DNA, 15 bp, Homo sapiens
ccagcagcacaattc

SEQ ID NO: 867171 - DNA, 17 bp, Homo sapiens
ccagcagcagaatggaa

SEQ ID NO: 867172 - DNA, 22 bp, Homo sapiens
ccagcagcaggatgggctgagc

SEQ ID NO: 867173 - DNA, 13 bp, Homo sapiens
ccagcagcatggc

SEQ ID NO: 867174 - DNA, 23 bp, Homo sapiens
ccagcagcatggcatagccccgg

SEQ ID NO: 867175 - DNA, 19 bp, Homo sapiens
ccagcagccagctctcagc

SEQ ID NO: 867176 - DNA, 21 bp, Homo sapiens
ccagcagccctaaggatctct

SEQ ID NO: 867177 - DNA, 12 bp, Homo sapiens
ccagcagcctcg

SEQ ID NO: 867178 - DNA, 15 bp, Homo sapiens
ccagcagcctcgcac

SEQ ID NO: 867179 - DNA, 20 bp, Homo sapiens
ccagcagcctcgcacaggcc

SEQ ID NO: 867180 - DNA, 12 bp, Homo sapiens
ccagcagcctgg

SEQ ID NO: 867181 - DNA, 15 bp, Homo sapiens
ccagcagcctggacc

SEQ ID NO: 867182 - DNA, 20 bp, Homo sapiens
ccagcagcctggaccctgtg

SEQ ID NO: 867183 - DNA, 12 bp, Homo sapiens
ccagcagcgcct

SEQ ID NO: 867184 - DNA, 17 bp, Homo sapiens
ccagcagcgcctttccc

SEQ ID NO: 867185 - DNA, 19 bp, Homo sapiens
ccagcagcggtaccccagg

SEQ ID NO: 867186 - DNA, 17 bp, Homo sapiens
ccagcagctgaagtctc

SEQ ID NO: 867187 - DNA, 12 bp, Homo sapiens
ccagcagctgca

SEQ ID NO: 867188 - DNA, 13 bp, Homo sapiens
ccagcagctgcac

SEQ ID NO: 867189 - DNA, 22 bp, Homo sapiens
ccagcaggaaggaccccacatc

SEQ ID NO: 867190 - DNA, 22 bp, Homo sapiens
ccagcaggaggttctgggcctc

SEQ ID NO: 867191 - DNA, 21 bp, Homo sapiens
ccagcaggcaggcactgtggc

SEQ ID NO: 867192 - DNA, 15 bp, Homo sapiens
ccagcaggcccagca

SEQ ID NO: 867193 - DNA, 17 bp, Homo sapiens
ccagcaggcccagcatg

SEQ ID NO: 867194 - DNA, 21 bp, Homo sapiens
ccagcaggcccagcatgcagg

SEQ ID NO: 867195 - DNA, 21 bp, Homo sapiens
ccagcaggctcctggctgtgc

SEQ ID NO: 867196 - DNA, 19 bp, Homo sapiens
ccagcaggggggctgtgcc

SEQ ID NO: 867197 - DNA, 21 bp, Homo sapiens
ccagcagggtcttttcatctg

SEQ ID NO: 867198 - DNA, 22 bp, Homo sapiens
ccagcagggtcttttcatctgg

SEQ ID NO: 867199 - DNA, 18 bp, Homo sapiens
ccagcaggtgctgacttc

SEQ ID NO: 867200 - DNA, 13 bp, Homo sapiens
ccagcaggtgtgg

SEQ ID NO: 867201 - DNA, 17 bp, Homo sapiens
ccagcaggtgtggtggc

SEQ ID NO: 867202 - DNA, 14 bp, Homo sapiens
ccagcagtgaatgc

SEQ ID NO: 867203 - DNA, 15 bp, Homo sapiens
ccagcagtgaatgct

SEQ ID NO: 867204 - DNA, 18 bp, Homo sapiens
ccagcagtgggggtcaga

SEQ ID NO: 867205 - DNA, 15 bp, Homo sapiens
ccagcagtgtggaga

SEQ ID NO: 867206 - DNA, 18 bp, Homo sapiens
ccagcagtgtggagaccc

SEQ ID NO: 867207 - DNA, 21 bp, Homo sapiens
ccagcagtgtggagaccctgc

SEQ ID NO: 867208 - DNA, 15 bp, Homo sapiens
ccagcagttttcaag

SEQ ID NO: 867209 - DNA, 13 bp, Homo sapiens
ccagcatacattt

SEQ ID NO: 867210 - DNA, 17 bp, Homo sapiens
ccagcatacattttctg

SEQ ID NO: 867211 - DNA, 19 bp, Homo sapiens
ccagcataggggggagggt

SEQ ID NO: 867212 - DNA, 19 bp, Homo sapiens
ccagcatccagcctgtgtg

SEQ ID NO: 867213 - DNA, 13 bp, Homo sapiens
ccagcatccctgg

SEQ ID NO: 867214 - DNA, 15 bp, Homo sapiens
ccagcatccctggag

SEQ ID NO: 867215 - DNA, 17 bp, Homo sapiens
ccagcatccctggagca

SEQ ID NO: 867216 - DNA, 19 bp, Homo sapiens
ccagcatccctggagcagg

SEQ ID NO: 867217 - DNA, 17 bp, Homo sapiens
ccagcatcgggggcctg

SEQ ID NO: 867218 - DNA, 17 bp, Homo sapiens
ccagcatctcagcgcca

SEQ ID NO: 867219 - DNA, 11 bp, Homo sapiens
ccagcatctcc

SEQ ID NO: 867220 - DNA, 18 bp, Homo sapiens
ccagcatgcaccacgggc

SEQ ID NO: 867221 - DNA, 20 bp, Homo sapiens
ccagcatgcaccacgggccc

SEQ ID NO: 867222 - DNA, 17 bp, Homo sapiens
ccagcattcagcacaca

SEQ ID NO: 867223 - DNA, 15 bp, Homo sapiens
ccagcattccagccc

SEQ ID NO: 867224 - DNA, 17 bp, Homo sapiens
ccagcattccagcccct

SEQ ID NO: 867225 - DNA, 16 bp, Homo sapiens
ccagcattccagctct

SEQ ID NO: 867226 - DNA, 17 bp, Homo sapiens
ccagcattccagctctg

SEQ ID NO: 867227 - DNA, 13 bp, Homo sapiens
ccagcattccttt

SEQ ID NO: 867228 - DNA, 13 bp, Homo sapiens
ccagcattgctgg

SEQ ID NO: 867229 - DNA, 20 bp, Homo sapiens
ccagccaaagaaatgggcct

SEQ ID NO: 867230 - DNA, 18 bp, Homo sapiens
ccagccaaagcctcctcc

SEQ ID NO: 867231 - DNA, 19 bp, Homo sapiens
ccagccaaagcctcctcca

SEQ ID NO: 867232 - DNA, 17 bp, Homo sapiens
ccagccaactctgggaa

SEQ ID NO: 867233 - DNA, 14 bp, Homo sapiens
ccagccaagggtcc

SEQ ID NO: 867234 - DNA, 15 bp, Homo sapiens
ccagccacagagcaa

SEQ ID NO: 867235 - DNA, 21 bp, Homo sapiens
ccagccaccaccctcaggtgc

SEQ ID NO: 867236 - DNA, 11 bp, Homo sapiens
ccagccacccc

SEQ ID NO: 867237 - DNA, 17 bp, Homo sapiens
ccagccacccccaggca

SEQ ID NO: 867238 - DNA, 16 bp, Homo sapiens
ccagccacccctgcca

SEQ ID NO: 867239 - DNA, 16 bp, Homo sapiens
ccagccacgactgcca

SEQ ID NO: 867240 - DNA, 17 bp, Homo sapiens
ccagccacggagggagg

SEQ ID NO: 867241 - DNA, 12 bp, Homo sapiens
ccagccactcca

SEQ ID NO: 867242 - DNA, 22 bp, Homo sapiens
ccagccactcgggaggctgaga

SEQ ID NO: 867243 - DNA, 14 bp, Homo sapiens
ccagccagacccca

SEQ ID NO: 867244 - DNA, 15 bp, Homo sapiens
ccagccagcagccag

SEQ ID NO: 867245 - DNA, 12 bp, Homo sapiens
ccagccagccac

SEQ ID NO: 867246 - DNA, 16 bp, Homo sapiens
ccagagaagccccgca

SEQ ID NO: 867247 - DNA, 16 bp, Homo sapiens
ccagagaaggacggtg

SEQ ID NO: 867248 - DNA, 20 bp, Homo sapiens
ccagagaaggacggtgccaa

SEQ ID NO: 867249 - DNA, 21 bp, Homo sapiens
ccagagaaggacggtgccaag

SEQ ID NO: 867250 - DNA, 24 bp, Homo sapiens
ccagagaatagatcagtatttcac

SEQ ID NO: 867251 - DNA, 23 bp, Homo sapiens
ccagagacaggaaaatcctctgg

SEQ ID NO: 867252 - DNA, 18 bp, Homo sapiens
ccagagaccccttccttt

SEQ ID NO: 867253 - DNA, 21 bp, Homo sapiens
ccagagaccccttcctttcct

SEQ ID NO: 867254 - DNA, 18 bp, Homo sapiens
ccagagacctgaggcaga

SEQ ID NO: 867255 - DNA, 21 bp, Homo sapiens
ccagagacctgaggcagatga

SEQ ID NO: 867256 - DNA, 18 bp, Homo sapiens
ccagagactgggatggga

SEQ ID NO: 867257 - DNA, 14 bp, Homo sapiens
ccagagagacagac

SEQ ID NO: 867258 - DNA, 19 bp, Homo sapiens
ccagagagagaagtgcccc

SEQ ID NO: 867259 - DNA, 23 bp, Homo sapiens
ccagagagagaagtgcccctgct

SEQ ID NO: 867260 - DNA, 13 bp, Homo sapiens
ccagagagaggag

SEQ ID NO: 867261 - DNA, 16 bp, Homo sapiens
ccagagagcagctccc

SEQ ID NO: 867262 - DNA, 12 bp, Homo sapiens
ccagagagcagg

SEQ ID NO: 867263 - DNA, 16 bp, Homo sapiens
ccagagagcaggcagg

SEQ ID NO: 867264 - DNA, 19 bp, Homo sapiens
ccagagagcaggcaggggc

SEQ ID NO: 867265 - DNA, 13 bp, Homo sapiens
ccagagagcaggg

SEQ ID NO: 867266 - DNA, 18 bp, Homo sapiens
ccagagagcaggggagct

SEQ ID NO: 867267 - DNA, 16 bp, Homo sapiens
ccagagaggaatcaga

SEQ ID NO: 867268 - DNA, 19 bp, Homo sapiens
ccagagaggagcacctgaa

SEQ ID NO: 867269 - DNA, 19 bp, Homo sapiens
ccagagaggcactcagtga

SEQ ID NO: 867270 - DNA, 12 bp, Homo sapiens
ccagagaggctc

SEQ ID NO: 867271 - DNA, 20 bp, Homo sapiens
ccagagaggctcaacaagga

SEQ ID NO: 867272 - DNA, 14 bp, Homo sapiens
ccagagagggccca

SEQ ID NO: 867273 - DNA, 18 bp, Homo sapiens
ccagagagggcccagctg

SEQ ID NO: 867274 - DNA, 19 bp, Homo sapiens
ccagagagggcccagctgt

SEQ ID NO: 867275 - DNA, 17 bp, Homo sapiens
ccagagagtcctctgga

SEQ ID NO: 867276 - DNA, 18 bp, Homo sapiens
ccagagagtcctctggat

SEQ ID NO: 867277 - DNA, 14 bp, Homo sapiens
ccagagagtggctc

SEQ ID NO: 867278 - DNA, 16 bp, Homo sapiens
ccagagagtggctcct

SEQ ID NO: 867279 - DNA, 20 bp, Homo sapiens
ccagagatgcctccaccgct

SEQ ID NO: 867280 - DNA, 17 bp, Homo sapiens
ccagagattcattttct

SEQ ID NO: 867281 - DNA, 19 bp, Homo sapiens
ccagagcaacctctcactc

SEQ ID NO: 867282 - DNA, 21 bp, Homo sapiens
ccagagcaacctctcactccc

SEQ ID NO: 867283 - DNA, 13 bp, Homo sapiens
ccagagcacagga

SEQ ID NO: 867284 - DNA, 22 bp, Homo sapiens
ccagagcacccccaagcctggg

SEQ ID NO: 867285 - DNA, 22 bp, Homo sapiens
ccagagcactgggttgcagggg

SEQ ID NO: 867286 - DNA, 12 bp, Homo sapiens
ccagagcagagt

SEQ ID NO: 867287 - DNA, 17 bp, Homo sapiens
ccagagcaggagcccct

SEQ ID NO: 867288 - DNA, 19 bp, Homo sapiens
ccagagcaggaggcccctg

SEQ ID NO: 867289 - DNA, 23 bp, Homo sapiens
ccagagcaggaggcccctggccc

SEQ ID NO: 867290 - DNA, 20 bp, Homo sapiens
ccagagcattacgtgagcca

SEQ ID NO: 867291 - DNA, 20 bp, Homo sapiens
ccagagcatttccaacacca

SEQ ID NO: 867292 - DNA, 22 bp, Homo sapiens
ccagagcatttccaacaccaca

SEQ ID NO: 867293 - DNA, 18 bp, Homo sapiens
ccagagccacctggatct

SEQ ID NO: 867294 - DNA, 22 bp, Homo sapiens
ccagagccagaaagggtgccag

SEQ ID NO: 867295 - DNA, 19 bp, Homo sapiens
ccagagccagcctgggact

SEQ ID NO: 867296 - DNA, 14 bp, Homo sapiens
ccagagcccagctc

SEQ ID NO: 867297 - DNA, 16 bp, Homo sapiens
ccagagcccagctctt

SEQ ID NO: 867298 - DNA, 22 bp, Homo sapiens
ccagagcccagctcttgctctc

SEQ ID NO: 867299 - DNA, 14 bp, Homo sapiens
ccagagccccaagc

SEQ ID NO: 867300 - DNA, 14 bp, Homo sapiens
ccagagccccacac

SEQ ID NO: 867301 - DNA, 21 bp, Homo sapiens
ccagagcccttcactgccatg

SEQ ID NO: 867302 - DNA, 12 bp, Homo sapiens
ccagagcccttg

SEQ ID NO: 867303 - DNA, 18 bp, Homo sapiens
ccagagccggccgccttc

SEQ ID NO: 867304 - DNA, 22 bp, Homo sapiens
ccagagcctctggcccctcacc

SEQ ID NO: 867305 - DNA, 15 bp, Homo sapiens
ccaggctggtctcaa

SEQ ID NO: 867306 - DNA, 21 bp, Homo sapiens
ccaggctggtcttgaattcct

SEQ ID NO: 867307 - DNA, 21 bp, Homo sapiens
ccaggctggtttcgaactcct

SEQ ID NO: 867308 - DNA, 17 bp, Homo sapiens
ccaggctgtgggcctca

SEQ ID NO: 867309 - DNA, 23 bp, Homo sapiens
ccaggcttgcctgggctgggcag

SEQ ID NO: 867310 - DNA, 22 bp, Homo sapiens
ccaggcttggatggaacatgcc

SEQ ID NO: 867311 - DNA, 14 bp, Homo sapiens
ccaggcttggcctt

SEQ ID NO: 867312 - DNA, 21 bp, Homo sapiens
ccaggctttctggagttccca

SEQ ID NO: 867313 - DNA, 14 bp, Homo sapiens
ccagggaaggtggg

SEQ ID NO: 867314 - DNA, 17 bp, Homo sapiens
ccagggaatccaagcct

SEQ ID NO: 867315 - DNA, 21 bp, Homo sapiens
ccagggacacacagcctagca

SEQ ID NO: 867316 - DNA, 15 bp, Homo sapiens
ccagggacagacgct

SEQ ID NO: 867317 - DNA, 16 bp, Homo sapiens
ccagggacagaggcca

SEQ ID NO: 867318 - DNA, 20 bp, Homo sapiens
ccagggacagaggccaagga

SEQ ID NO: 867319 - DNA, 23 bp, Homo sapiens
ccagggacagaggccaaggactg

SEQ ID NO: 867320 - DNA, 20 bp, Homo sapiens
ccagggacattgcagagtgg

SEQ ID NO: 867321 - DNA, 16 bp, Homo sapiens
ccagggacccttgcct

SEQ ID NO: 867322 - DNA, 20 bp, Homo sapiens
ccagggacccttgcctgcct

SEQ ID NO: 867323 - DNA, 18 bp, Homo sapiens
ccagggagctctggggac

SEQ ID NO: 867324 - DNA, 24 bp, Homo sapiens
ccagggagctgatgccccttctcc

SEQ ID NO: 867325 - DNA, 21 bp, Homo sapiens
ccagggagcttcctggctctg

SEQ ID NO: 867326 - DNA, 13 bp, Homo sapiens
ccagggaggagag

SEQ ID NO: 867327 - DNA, 14 bp, Homo sapiens
ccagggaggagagg

SEQ ID NO: 867328 - DNA, 15 bp, Homo sapiens
ccagggaggagagga

SEQ ID NO: 867329 - DNA, 22 bp, Homo sapiens
ccagggaggcagagcgggaggg

SEQ ID NO: 867330 - DNA, 16 bp, Homo sapiens
ccagggaggcagcgtg

SEQ ID NO: 867331 - DNA, 19 bp, Homo sapiens
ccagggaggcagcgtgggc

SEQ ID NO: 867332 - DNA, 21 bp, Homo sapiens
ccagggaggcagcgtgggctc

SEQ ID NO: 867333 - DNA, 12 bp, Homo sapiens
ccagggaggcgc

SEQ ID NO: 867334 - DNA, 14 bp, Homo sapiens
ccagggaggcgcag

SEQ ID NO: 867335 - DNA, 17 bp, Homo sapiens
ccagggaggcgcaggga

SEQ ID NO: 867336 - DNA, 20 bp, Homo sapiens
ccagggaggcgcagggacat

SEQ ID NO: 867337 - DNA, 14 bp, Homo sapiens
ccagggagtccagg

SEQ ID NO: 867338 - DNA, 16 bp, Homo sapiens
ccagggagtccagggt

SEQ ID NO: 867339 - DNA, 23 bp, Homo sapiens
ccagggagtccagggtttctctg

SEQ ID NO: 867340 - DNA, 16 bp, Homo sapiens
ccagggagtcccctcc

SEQ ID NO: 867341 - DNA, 16 bp, Homo sapiens
ccagggagtgagcagc

SEQ ID NO: 867342 - DNA, 20 bp, Homo sapiens
ccagggagtgagcagctact

SEQ ID NO: 867343 - DNA, 21 bp, Homo sapiens
ccagggatgattcaagccatt

SEQ ID NO: 867344 - DNA, 12 bp, Homo sapiens
ccagggatgctg

SEQ ID NO: 867345 - DNA, 13 bp, Homo sapiens
ccagggatgctgg

SEQ ID NO: 867346 - DNA, 21 bp, Homo sapiens
ccagggatgctgggctgggcc

SEQ ID NO: 867347 - DNA, 21 bp, Homo sapiens
ccagggatgggggatgggcca

SEQ ID NO: 867348 - DNA, 22 bp, Homo sapiens
ccagggatgggggatgggccag

SEQ ID NO: 867349 - DNA, 21 bp, Homo sapiens
ccagggcaagggttaaggcct

SEQ ID NO: 867350 - DNA, 13 bp, Homo sapiens
ccagggcaatgcc

SEQ ID NO: 867351 - DNA, 16 bp, Homo sapiens
ccagggcaatgccatc

SEQ ID NO: 867352 - DNA, 20 bp, Homo sapiens
ccagggcaatgccatcagcc

SEQ ID NO: 867353 - DNA, 15 bp, Homo sapiens
ccagggcagcagccg

SEQ ID NO: 867354 - DNA, 13 bp, Homo sapiens
ccagggcagcctc

SEQ ID NO: 867355 - DNA, 22 bp, Homo sapiens
ccagggcagggtctgggctggg

SEQ ID NO: 867356 - DNA, 16 bp, Homo sapiens
ccagggcatgtgtatg

SEQ ID NO: 867357 - DNA, 21 bp, Homo sapiens
ccagggccacgtgccaggccc

SEQ ID NO: 867358 - DNA, 15 bp, Homo sapiens
ccagggccaggggtc

SEQ ID NO: 867359 - DNA, 12 bp, Homo sapiens
ccagggcccaga

SEQ ID NO: 867360 - DNA, 16 bp, Homo sapiens
ccagggcccagagccc

SEQ ID NO: 867361 - DNA, 14 bp, Homo sapiens
ccagggcccaggcc

SEQ ID NO: 867362 - DNA, 15 bp, Homo sapiens
ccagggcccaggcca

SEQ ID NO: 867363 - DNA, 16 bp, Homo sapiens
ccagggcccaggccat

SEQ ID NO: 867364 - DNA, 12 bp, Homo sapiens
ccagggccccca

SEQ ID NO: 867365 - DNA, 14 bp, Homo sapiens
ccagggcccccacc

SEQ ID NO: 867366 - DNA, 21 bp, Homo sapiens
ccagggcccccaccgaggttc

SEQ ID NO: 867367 - DNA, 17 bp, Homo sapiens
ccagggcccccatctca

SEQ ID NO: 867368 - DNA, 17 bp, Homo sapiens
ccagggcccctggatct

SEQ ID NO: 867369 - DNA, 13 bp, Homo sapiens
ccagggccctccc

SEQ ID NO: 867370 - DNA, 15 bp, Homo sapiens
ccagggccctcccag

SEQ ID NO: 867371 - DNA, 16 bp, Homo sapiens
ccagggccctcccagc

SEQ ID NO: 867372 - DNA, 18 bp, Homo sapiens
ccagggccctcccagccc

SEQ ID NO: 867373 - DNA, 15 bp, Homo sapiens
ccagggccctggatg

SEQ ID NO: 867374 - DNA, 14 bp, Homo sapiens
ccagggccctgggc

SEQ ID NO: 867375 - DNA, 17 bp, Homo sapiens
ccagggcctactgccac

SEQ ID NO: 867376 - DNA, 14 bp, Homo sapiens
ccagggcctaggac

SEQ ID NO: 867377 - DNA, 13 bp, Homo sapiens
ccagggcctccag

SEQ ID NO: 867378 - DNA, 23 bp, Homo sapiens
ccagggcctccctgttcacggtg

SEQ ID NO: 867379 - DNA, 14 bp, Homo sapiens
ccagggcctctcca

SEQ ID NO: 867380 - DNA, 19 bp, Homo sapiens
ccagggcctgggggcagtg

SEQ ID NO: 867381 - DNA, 14 bp, Homo sapiens
ccagggcggccagg

SEQ ID NO: 867382 - DNA, 19 bp, Homo sapiens
ccagggctagtgacttgtg

SEQ ID NO: 867383 - DNA, 17 bp, Homo sapiens
ccagggctatagctcag

SEQ ID NO: 867384 - DNA, 21 bp, Homo sapiens
ccagggctatagctcaggacc

SEQ ID NO: 867385 - DNA, 19 bp, Homo sapiens
ccagggctcaccagctggg

SEQ ID NO: 867386 - DNA, 12 bp, Homo sapiens
ccagggctcagc

SEQ ID NO: 867387 - DNA, 14 bp, Homo sapiens
ccagggctccagcc

SEQ ID NO: 867388 - DNA, 19 bp, Homo sapiens
ccagggctccagcccctct

SEQ ID NO: 867389 - DNA, 21 bp, Homo sapiens
ccagggctccagcccctcttg

SEQ ID NO: 867390 - DNA, 18 bp, Homo sapiens
ccagggctccctcctgga

SEQ ID NO: 867391 - DNA, 16 bp, Homo sapiens
ccagggctctgcccca

SEQ ID NO: 867392 - DNA, 19 bp, Homo sapiens
ccagggctctgccccagtc

SEQ ID NO: 867393 - DNA, 14 bp, Homo sapiens
ccagggctgcccct

SEQ ID NO: 867394 - DNA, 11 bp, Homo sapiens
ccagggctgga

SEQ ID NO: 867395 - DNA, 17 bp, Homo sapiens
ccagggctggagacttc

SEQ ID NO: 867396 - DNA, 19 bp, Homo sapiens
ccagggctggagacttcct

SEQ ID NO: 867397 - DNA, 15 bp, Homo sapiens
ccagggctggatgga

SEQ ID NO: 867398 - DNA, 18 bp, Homo sapiens
ccagggctggatggacag

SEQ ID NO: 867399 - DNA, 22 bp, Homo sapiens
ccagggctggatggacagacac

SEQ ID NO: 867400 - DNA, 23 bp, Homo sapiens
ccagggctggatggacagacacc

SEQ ID NO: 867401 - DNA, 19 bp, Homo sapiens
ccagggctggggtgagcct

SEQ ID NO: 867402 - DNA, 12 bp, Homo sapiens
ccagggctgtcc

SEQ ID NO: 867403 - DNA, 14 bp, Homo sapiens
ccagggctgtcctt

SEQ ID NO: 867404 - DNA, 17 bp, Homo sapiens
ccagggctgtccttaga

SEQ ID NO: 867405 - DNA, 21 bp, Homo sapiens
ccaggggaaaatcagcctgct

SEQ ID NO: 867406 - DNA, 19 bp, Homo sapiens
ccaggggaaagatgagctt

SEQ ID NO: 867407 - DNA, 12 bp, Homo sapiens
ccaggggaacct

SEQ ID NO: 867408 - DNA, 20 bp, Homo sapiens
ccaggggaaggccctgaggc

SEQ ID NO: 867409 - DNA, 13 bp, Homo sapiens
ccaggggaccaca

SEQ ID NO: 867410 - DNA, 17 bp, Homo sapiens
ccaggggactgttcctt

SEQ ID NO: 867411 - DNA, 19 bp, Homo sapiens
ccaggggagaatgcagccc

SEQ ID NO: 867412 - DNA, 21 bp, Homo sapiens
ccaggggagaatgcagcccac

SEQ ID NO: 867413 - DNA, 13 bp, Homo sapiens
ccaggggagccag

SEQ ID NO: 867414 - DNA, 14 bp, Homo sapiens
ccaggggagccagc

SEQ ID NO: 867415 - DNA, 16 bp, Homo sapiens
ccaggggagccagctg

SEQ ID NO: 867416 - DNA, 16 bp, Homo sapiens
ccaggggagttgtgtc

SEQ ID NO: 867417 - DNA, 12 bp, Homo sapiens
ccaggggcagca

SEQ ID NO: 867418 - DNA, 18 bp, Homo sapiens
ccaggggcagcaaggcct

SEQ ID NO: 867419 - DNA, 12 bp, Homo sapiens
ccaggggcaggc

SEQ ID NO: 867420 - DNA, 16 bp, Homo sapiens
ccaggggcaggcaggg

SEQ ID NO: 867421 - DNA, 17 bp, Homo sapiens
ccaggggcaggcagggc

SEQ ID NO: 867422 - DNA, 18 bp, Homo sapiens
ccaggggcaggcagggct

SEQ ID NO: 867423 - DNA, 23 bp, Homo sapiens
ccaggggcatgtattggcctgga

SEQ ID NO: 867424 - DNA, 19 bp, Homo sapiens
ccaggggcccacagggaac

SEQ ID NO: 867425 - DNA, 19 bp, Homo sapiens
ccaggggccggccagtggc

SEQ ID NO: 867426 - DNA, 15 bp, Homo sapiens
ccagtcccacactgt

SEQ ID NO: 867427 - DNA, 14 bp, Homo sapiens
ccagtcccaggggc

SEQ ID NO: 867428 - DNA, 14 bp, Homo sapiens
ccagtcccattcct

SEQ ID NO: 867429 - DNA, 21 bp, Homo sapiens
ccagtccccacccctgccccc

SEQ ID NO: 867430 - DNA, 15 bp, Homo sapiens
ccagtccccagccct

SEQ ID NO: 867431 - DNA, 19 bp, Homo sapiens
ccagtccccatttctgcct

SEQ ID NO: 867432 - DNA, 20 bp, Homo sapiens
ccagtccccatttctgcctc

SEQ ID NO: 867433 - DNA, 16 bp, Homo sapiens
ccagtgggaactgtgc

SEQ ID NO: 867434 - DNA, 12 bp, Homo sapiens
ccagtgggacag

SEQ ID NO: 867435 - DNA, 16 bp, Homo sapiens
ccagtgggacagagga

SEQ ID NO: 867436 - DNA, 11 bp, Homo sapiens
ccagtgggagg

SEQ ID NO: 867437 - DNA, 15 bp, Homo sapiens
ccagtgggaggggca

SEQ ID NO: 867438 - DNA, 19 bp, Homo sapiens
ccagtgggaggggcaggct

SEQ ID NO: 867439 - DNA, 20 bp, Homo sapiens
ccagtgggaggggcaggctg

SEQ ID NO: 867440 - DNA, 23 bp, Homo sapiens
ccagtgggaggggcaggctgaca

SEQ ID NO: 867441 - DNA, 18 bp, Homo sapiens
ccagtgggatgggctcta

SEQ ID NO: 867442 - DNA, 22 bp, Homo sapiens
ccagtgggatgggctctacctc

SEQ ID NO: 867443 - DNA, 20 bp, Homo sapiens
ccagtgggccagccacagag

SEQ ID NO: 867444 - DNA, 14 bp, Homo sapiens
ccagtgggcctggt

SEQ ID NO: 867445 - DNA, 21 bp, Homo sapiens
ccagtgggcctggtagcacat

SEQ ID NO: 867446 - DNA, 10 bp, Homo sapiens
ccagtgggct

SEQ ID NO: 867447 - DNA, 16 bp, Homo sapiens
ccagtgggctgtgttg

SEQ ID NO: 867448 - DNA, 21 bp, Homo sapiens
ccagtggggacagggaggggg

SEQ ID NO: 867449 - DNA, 15 bp, Homo sapiens
ccagtggggcctgtg

SEQ ID NO: 867450 - DNA, 16 bp, Homo sapiens
ccagtggggcctgtgg

SEQ ID NO: 867451 - DNA, 16 bp, Homo sapiens
ccagtgggtctgggat

SEQ ID NO: 867452 - DNA, 21 bp, Homo sapiens
ccagtgggtgatgcttttgct

SEQ ID NO: 867453 - DNA, 23 bp, Homo sapiens
ccagtgggtgatgcttttgctgc

SEQ ID NO: 867454 - DNA, 15 bp, Homo sapiens
ccagtggtatcctgt

SEQ ID NO: 867455 - DNA, 20 bp, Homo sapiens
ccagtggtctggaaacagct

SEQ ID NO: 867456 - DNA, 19 bp, Homo sapiens
ccagtggtttccagtcatg

SEQ ID NO: 867457 - DNA, 19 bp, Homo sapiens
ccagtgtagcatcttcctc

SEQ ID NO: 867458 - DNA, 21 bp, Homo sapiens
ccagtgtagcatcttcctctg

SEQ ID NO: 867459 - DNA, 15 bp, Homo sapiens
ccagtgtagccttgc

SEQ ID NO: 867460 - DNA, 17 bp, Homo sapiens
ccagtgtattttgtcca

SEQ ID NO: 867461 - DNA, 19 bp, Homo sapiens
ccagtgtattttgtccaag

SEQ ID NO: 867462 - DNA, 15 bp, Homo sapiens
ccagtgtcccctttc

SEQ ID NO: 867463 - DNA, 21 bp, Homo sapiens
ccagtgtctataaaagaaaca

SEQ ID NO: 867464 - DNA, 22 bp, Homo sapiens
ccagtgtgcccaaaagccatgt

SEQ ID NO: 867465 - DNA, 17 bp, Homo sapiens
ccagtgttagggaaggg

SEQ ID NO: 867466 - DNA, 13 bp, Homo sapiens
ccagtgttcctga

SEQ ID NO: 867467 - DNA, 17 bp, Homo sapiens
ccagtgttcctgaagct

SEQ ID NO: 867468 - DNA, 19 bp, Homo sapiens
ccagtgttcctgaagctgc

SEQ ID NO: 867469 - DNA, 23 bp, Homo sapiens
ccagtgttcctgaagctgctgtg

SEQ ID NO: 867470 - DNA, 17 bp, Homo sapiens
ccagtgttgcctcctcc

SEQ ID NO: 867471 - DNA, 19 bp, Homo sapiens
ccagtgttgcctcctccca

SEQ ID NO: 867472 - DNA, 19 bp, Homo sapiens
ccagtgttgtgggcttcct

SEQ ID NO: 867473 - DNA, 20 bp, Homo sapiens
ccagtgttgtttgtaaataa

SEQ ID NO: 867474 - DNA, 22 bp, Homo sapiens
ccagtgttgtttgtaaataaga

SEQ ID NO: 867475 - DNA, 21 bp, Homo sapiens
ccagtgtttgggatgaccagg

SEQ ID NO: 867476 - DNA, 16 bp, Homo sapiens
ccagtgttttctttga

SEQ ID NO: 867477 - DNA, 15 bp, Homo sapiens
ccagttaaagattat

SEQ ID NO: 867478 - DNA, 14 bp, Homo sapiens
ccagttaaagccac

SEQ ID NO: 867479 - DNA, 21 bp, Homo sapiens
ccagttaatactccagagaca

SEQ ID NO: 867480 - DNA, 23 bp, Homo sapiens
ccagttactcaggaggctgaggc

SEQ ID NO: 867481 - DNA, 20 bp, Homo sapiens
ccagttataaagaggtcaca

SEQ ID NO: 867482 - DNA, 12 bp, Homo sapiens
ccagttcaaagt

SEQ ID NO: 867483 - DNA, 15 bp, Homo sapiens
ccagttcaaagtgta

SEQ ID NO: 867484 - DNA, 21 bp, Homo sapiens
ccagttcaggagtcccaagga

SEQ ID NO: 867485 - DNA, 16 bp, Homo sapiens
ccagttccagttccca

SEQ ID NO: 867486 - DNA, 24 bp, Homo sapiens
ccagttcctgctctctgctcatgg

SEQ ID NO: 867487 - DNA, 19 bp, Homo sapiens
ccagttctacaagcatatt

SEQ ID NO: 867488 - DNA, 22 bp, Homo sapiens
ccagttctaggggagaagagcc

SEQ ID NO: 867489 - DNA, 18 bp, Homo sapiens
ccagttctgaataacttg

SEQ ID NO: 867490 - DNA, 15 bp, Homo sapiens
ccagttctgctcctc

SEQ ID NO: 867491 - DNA, 16 bp, Homo sapiens
ccagttctgctcctct

SEQ ID NO: 867492 - DNA, 21 bp, Homo sapiens
ccagttctgctcctctccagg

SEQ ID NO: 867493 - DNA, 17 bp, Homo sapiens
ccagttgaataaaagtg

SEQ ID NO: 867494 - DNA, 16 bp, Homo sapiens
ccagttgatctgctct

SEQ ID NO: 867495 - DNA, 19 bp, Homo sapiens
ccagttgatctgctctgtt

SEQ ID NO: 867496 - DNA, 14 bp, Homo sapiens
ccagttgcctttta

SEQ ID NO: 867497 - DNA, 13 bp, Homo sapiens
ccagttggacaca

SEQ ID NO: 867498 - DNA, 18 bp, Homo sapiens
ccagttgggactcaggat

SEQ ID NO: 867499 - DNA, 20 bp, Homo sapiens
ccagttgggagcactggagt

SEQ ID NO: 867500 - DNA, 13 bp, Homo sapiens
ccagttggtgact

SEQ ID NO: 867501 - DNA, 19 bp, Homo sapiens
ccagttggtgactgggaaa

SEQ ID NO: 867502 - DNA, 18 bp, Homo sapiens
ccagttgtatattattct

SEQ ID NO: 867503 - DNA, 21 bp, Homo sapiens
ccagttgttagattaagaaat

SEQ ID NO: 867504 - DNA, 16 bp, Homo sapiens
ccagtttattctgtgg

SEQ ID NO: 867505 - DNA, 21 bp, Homo sapiens
ccagtttcaggtgtttagttg

SEQ ID NO: 867506 - DNA, 13 bp, Homo sapiens
ccagtttctcctt

SEQ ID NO: 867507 - DNA, 22 bp, Homo sapiens
ccagtttcttcttacacttctt

SEQ ID NO: 867508 - DNA, 14 bp, Homo sapiens
ccagtttctttccc

SEQ ID NO: 867509 - DNA, 13 bp, Homo sapiens
ccagtttgcagaa

SEQ ID NO: 867510 - DNA, 15 bp, Homo sapiens
ccagtttgcatgatt

SEQ ID NO: 867511 - DNA, 14 bp, Homo sapiens
ccagtttgcatttg

SEQ ID NO: 867512 - DNA, 20 bp, Homo sapiens
ccagtttgggtaaaatactt

SEQ ID NO: 867513 - DNA, 13 bp, Homo sapiens
ccagttttctggt

SEQ ID NO: 867514 - DNA, 16 bp, Homo sapiens
ccagttttctggtagg

SEQ ID NO: 867515 - DNA, 17 bp, Homo sapiens
ccagtttttgaggagcc

SEQ ID NO: 867516 - DNA, 16 bp, Homo sapiens
ccagtttttgtttttg

SEQ ID NO: 867517 - DNA, 23 bp, Homo sapiens
ccataaaaaggaacaagactgac

SEQ ID NO: 867518 - DNA, 15 bp, Homo sapiens
ccataaaaccctata

SEQ ID NO: 867519 - DNA, 15 bp, Homo sapiens
ccataaaagaagttt

SEQ ID NO: 867520 - DNA, 22 bp, Homo sapiens
ccataaacacccatgaatcaaa

SEQ ID NO: 867521 - DNA, 14 bp, Homo sapiens
ccataaagccttta

SEQ ID NO: 867522 - DNA, 17 bp, Homo sapiens
ccataaagcctttaaaa

SEQ ID NO: 867523 - DNA, 21 bp, Homo sapiens
ccataaagggtgtaggggcca

SEQ ID NO: 867524 - DNA, 21 bp, Homo sapiens
ccataacaccgtcccagggct

SEQ ID NO: 867525 - DNA, 13 bp, Homo sapiens
ccataacagccaa

SEQ ID NO: 867526 - DNA, 13 bp, Homo sapiens
ccataacgtgccc

SEQ ID NO: 867527 - DNA, 13 bp, Homo sapiens
ccataacttgaaa

SEQ ID NO: 867528 - DNA, 17 bp, Homo sapiens
ccataagcctccattta

SEQ ID NO: 867529 - DNA, 21 bp, Homo sapiens
ccataagcctccatttagttc

SEQ ID NO: 867530 - DNA, 15 bp, Homo sapiens
ccataaggaatgtag

SEQ ID NO: 867531 - DNA, 16 bp, Homo sapiens
ccataataaccctgcc

SEQ ID NO: 867532 - DNA, 20 bp, Homo sapiens
ccataataaccctgccagtg

SEQ ID NO: 867533 - DNA, 18 bp, Homo sapiens
ccataatagttagccctc

SEQ ID NO: 867534 - DNA, 14 bp, Homo sapiens
ccataatctggact

SEQ ID NO: 867535 - DNA, 21 bp, Homo sapiens
ccataatctggactcctctgt

SEQ ID NO: 867536 - DNA, 21 bp, Homo sapiens
ccataatgctactgtctcact

SEQ ID NO: 867537 - DNA, 21 bp, Homo sapiens
ccataatgtctttaaatcact

SEQ ID NO: 867538 - DNA, 14 bp, Homo sapiens
ccataattatgaaa

SEQ ID NO: 867539 - DNA, 21 bp, Homo sapiens
ccataattttcttcatgcaat

SEQ ID NO: 867540 - DNA, 13 bp, Homo sapiens
ccataattttgca

SEQ ID NO: 867541 - DNA, 23 bp, Homo sapiens
ccataattttgcatactgaaaat

SEQ ID NO: 867542 - DNA, 15 bp, Homo sapiens
ccatacaatgtatgt

SEQ ID NO: 867543 - DNA, 16 bp, Homo sapiens
ccatacaatgtatgta

SEQ ID NO: 867544 - DNA, 17 bp, Homo sapiens
ccatacaatgtatgtac

SEQ ID NO: 867545 - DNA, 19 bp, Homo sapiens
ccatacaatttcatcctcc

SEQ ID NO: 867546 - DNA, 11 bp, Homo sapiens
ccatacacaca

SEQ ID NO: 867547 - DNA, 13 bp, Homo sapiens
ccatacacacaca

SEQ ID NO: 867548 - DNA, 18 bp, Homo sapiens
ccatacacacacaaacca

SEQ ID NO: 867549 - DNA, 21 bp, Homo sapiens
ccataccgaccatcgtccagc

SEQ ID NO: 867550 - DNA, 15 bp, Homo sapiens
ccatagcttccatga

SEQ ID NO: 867551 - DNA, 20 bp, Homo sapiens
ccataggaagacataaaact

SEQ ID NO: 867552 - DNA, 23 bp, Homo sapiens
ccataggaagacataaaacttta

SEQ ID NO: 867553 - DNA, 20 bp, Homo sapiens
ccataggactaccgcaggcc

SEQ ID NO: 867554 - DNA, 21 bp, Homo sapiens
ccataggactaccgcaggccc

SEQ ID NO: 867555 - DNA, 17 bp, Homo sapiens
ccataggccaaggtgca

SEQ ID NO: 867556 - DNA, 12 bp, Homo sapiens
ccatagggagct

SEQ ID NO: 867557 - DNA, 23 bp, Homo sapiens
ccatagggtctgcagcctgctgg

SEQ ID NO: 867558 - DNA, 16 bp, Homo sapiens
ccataggtttctctcc

SEQ ID NO: 867559 - DNA, 21 bp, Homo sapiens
ccatagtggatcactcaccat

SEQ ID NO: 867560 - DNA, 20 bp, Homo sapiens
ccatagtggggcctgggagg

SEQ ID NO: 867561 - DNA, 17 bp, Homo sapiens
ccatagttttgtttaat

SEQ ID NO: 867562 - DNA, 21 bp, Homo sapiens
ccatagttttgtttaatttgc

SEQ ID NO: 867563 - DNA, 16 bp, Homo sapiens
ccatataagtttgaag

SEQ ID NO: 867564 - DNA, 17 bp, Homo sapiens
ccatatagtctattcat

SEQ ID NO: 867565 - DNA, 15 bp, Homo sapiens
ccatatatgctgtat

SEQ ID NO: 867566 - DNA, 20 bp, Homo sapiens
ccatatatttaatatgtcaa

SEQ ID NO: 867567 - DNA, 13 bp, Homo sapiens
ccatatccctgcc

SEQ ID NO: 867568 - DNA, 19 bp, Homo sapiens
ccatatctccttcccctac

SEQ ID NO: 867569 - DNA, 14 bp, Homo sapiens
ccatatcttgcgaa

SEQ ID NO: 867570 - DNA, 21 bp, Homo sapiens
ccatatcttgcgaatccaagc

SEQ ID NO: 867571 - DNA, 22 bp, Homo sapiens
ccatatcttgcgaatccaagct

SEQ ID NO: 867572 - DNA, 22 bp, Homo sapiens
ccatatggaggactgtgacaga

SEQ ID NO: 867573 - DNA, 22 bp, Homo sapiens
ccatatggattttctattgtta

SEQ ID NO: 867574 - DNA, 16 bp, Homo sapiens
ccatatgtctgcttct

SEQ ID NO: 867575 - DNA, 12 bp, Homo sapiens
ccatattaaatt

SEQ ID NO: 867576 - DNA, 20 bp, Homo sapiens
ccatattaaattttttgttg

SEQ ID NO: 867577 - DNA, 23 bp, Homo sapiens
ccatattaaattttttgttgaca

SEQ ID NO: 867578 - DNA, 16 bp, Homo sapiens
ccatattaattgcctg

SEQ ID NO: 867579 - DNA, 20 bp, Homo sapiens
ccatattaattgcctgttaa

SEQ ID NO: 867580 - DNA, 14 bp, Homo sapiens
ccatattgtaaaac

SEQ ID NO: 867581 - DNA, 18 bp, Homo sapiens
ccatatttgatttctaat

SEQ ID NO: 867582 - DNA, 18 bp, Homo sapiens
ccatcaacaaaaattgtc

SEQ ID NO: 867583 - DNA, 19 bp, Homo sapiens
ccatcaactaaaacattat

SEQ ID NO: 867584 - DNA, 15 bp, Homo sapiens
ccatcaaggtccagt

SEQ ID NO: 867585 - DNA, 19 bp, Homo sapiens
ccatcaaggtccagtggaa

SEQ ID NO: 867586 - DNA, 17 bp, Homo sapiens
ccatcaataaagtaccc

SEQ ID NO: 867587 - DNA, 15 bp, Homo sapiens
ccatcacatgaccac

SEQ ID NO: 867588 - DNA, 17 bp, Homo sapiens
ccatcaccaccgcctct

SEQ ID NO: 867589 - DNA, 16 bp, Homo sapiens
ccatcaccctcaccca

SEQ ID NO: 867590 - DNA, 18 bp, Homo sapiens
ccatcaccctcacccact

SEQ ID NO: 867591 - DNA, 18 bp, Homo sapiens
ccatcaccctcttcctgt

SEQ ID NO: 867592 - DNA, 14 bp, Homo sapiens
ccatcacctctact

SEQ ID NO: 867593 - DNA, 17 bp, Homo sapiens
ccatcacctgaaacact

SEQ ID NO: 867594 - DNA, 19 bp, Homo sapiens
ccatcacctgaaacactgg

SEQ ID NO: 867595 - DNA, 18 bp, Homo sapiens
ccatcactagaagaaaag

SEQ ID NO: 867596 - DNA, 20 bp, Homo sapiens
ccatcactagagtgctctga

SEQ ID NO: 867597 - DNA, 12 bp, Homo sapiens
ccatcactcact

SEQ ID NO: 867598 - DNA, 15 bp, Homo sapiens
ccatcactcactcac

SEQ ID NO: 867599 - DNA, 14 bp, Homo sapiens
ccatcactcagccc

SEQ ID NO: 867600 - DNA, 18 bp, Homo sapiens
ccatcactgcgccactgc

SEQ ID NO: 867601 - DNA, 21 bp, Homo sapiens
ccatcactgcgccactgctcc

SEQ ID NO: 867602 - DNA, 21 bp, Homo sapiens
ccatcagcaggctccagttga

SEQ ID NO: 867603 - DNA, 17 bp, Homo sapiens
ccatcagcccctgggaa

SEQ ID NO: 867604 - DNA, 18 bp, Homo sapiens
ccatcagcgggtctcctc

SEQ ID NO: 867605 - DNA, 12 bp, Homo sapiens
ccatcagctccc

SEQ ID NO: 867606 - DNA, 15 bp, Homo sapiens
ccatcagctcccaac

SEQ ID NO: 867607 - DNA, 17 bp, Homo sapiens
ccatcaggctgttatta

SEQ ID NO: 867608 - DNA, 22 bp, Homo sapiens
ccatcaggctgttattatgaag

SEQ ID NO: 867609 - DNA, 14 bp, Homo sapiens
ccatcagggccctg

SEQ ID NO: 867610 - DNA, 20 bp, Homo sapiens
ccatcagggccctgccccag

SEQ ID NO: 867611 - DNA, 19 bp, Homo sapiens
ccatcagggttctcttagc

SEQ ID NO: 867612 - DNA, 14 bp, Homo sapiens
ccatcagtgcatga

SEQ ID NO: 867613 - DNA, 21 bp, Homo sapiens
ccatcagttcccccagtacct

SEQ ID NO: 867614 - DNA, 15 bp, Homo sapiens
ccatcatcactgtaa

SEQ ID NO: 867615 - DNA, 20 bp, Homo sapiens
ccatcatcactgtaaagaca

SEQ ID NO: 867616 - DNA, 23 bp, Homo sapiens
ccatcatcctttgttctgagcat

SEQ ID NO: 867617 - DNA, 10 bp, Homo sapiens
ccatcatgtc

SEQ ID NO: 867618 - DNA, 15 bp, Homo sapiens
ccatcatgtggccca

SEQ ID NO: 867619 - DNA, 19 bp, Homo sapiens
ccatcattacccttccctg

SEQ ID NO: 867620 - DNA, 17 bp, Homo sapiens
ccatcattataaacgtg

SEQ ID NO: 867621 - DNA, 20 bp, Homo sapiens
ccatccacgtggcctctctc

SEQ ID NO: 867622 - DNA, 21 bp, Homo sapiens
ccatccacgtggcctctctct

SEQ ID NO: 867623 - DNA, 16 bp, Homo sapiens
ccatccactctaccct

SEQ ID NO: 867624 - DNA, 22 bp, Homo sapiens
ccatccactctaccctcccacc

SEQ ID NO: 867625 - DNA, 19 bp, Homo sapiens
ccatccagccacggaggga

SEQ ID NO: 867626 - DNA, 14 bp, Homo sapiens
ccatccagggtctg

SEQ ID NO: 867627 - DNA, 15 bp, Homo sapiens
ccatccagggtctgg

SEQ ID NO: 867628 - DNA, 16 bp, Homo sapiens
ccatccagtggactct

SEQ ID NO: 867629 - DNA, 19 bp, Homo sapiens
ccatccagtgtctcacagc

SEQ ID NO: 867630 - DNA, 23 bp, Homo sapiens
ccatccagttttggatcttttta

SEQ ID NO: 867631 - DNA, 13 bp, Homo sapiens
ccatccatcccta

SEQ ID NO: 867632 - DNA, 16 bp, Homo sapiens
ccatccatctccaggg

SEQ ID NO: 867633 - DNA, 23 bp, Homo sapiens
ccatccatctgtccgtccagagc

SEQ ID NO: 867634 - DNA, 17 bp, Homo sapiens
ccatccattaggccagc

SEQ ID NO: 867635 - DNA, 18 bp, Homo sapiens
ccatccattaggccagca

SEQ ID NO: 867636 - DNA, 15 bp, Homo sapiens
ccatccattctggaa

SEQ ID NO: 867637 - DNA, 16 bp, Homo sapiens
ccatcccaccagcccc

SEQ ID NO: 867638 - DNA, 11 bp, Homo sapiens
ccatcccaggg

SEQ ID NO: 867639 - DNA, 12 bp, Homo sapiens
ccatcccagggt

SEQ ID NO: 867640 - DNA, 11 bp, Homo sapiens
ccatcccatga

SEQ ID NO: 867641 - DNA, 20 bp, Homo sapiens
ccatcccattttcatcctga

SEQ ID NO: 867642 - DNA, 15 bp, Homo sapiens
ccatccccaccagct

SEQ ID NO: 867643 - DNA, 15 bp, Homo sapiens
ccatccccaccttca

SEQ ID NO: 867644 - DNA, 22 bp, Homo sapiens
ccatccccatcctccagcttct

SEQ ID NO: 867645 - DNA, 13 bp, Homo sapiens
ccatccccctgcc

SEQ ID NO: 867646 - DNA, 14 bp, Homo sapiens
ccatccccctgccc

SEQ ID NO: 867647 - DNA, 19 bp, Homo sapiens
ccatccccctgccctcgtg

SEQ ID NO: 867648 - DNA, 14 bp, Homo sapiens
ccatcccctccccg

SEQ ID NO: 867649 - DNA, 15 bp, Homo sapiens
ccatcccctggactg

SEQ ID NO: 867650 - DNA, 15 bp, Homo sapiens
ccatcccctttcctc

SEQ ID NO: 867651 - DNA, 21 bp, Homo sapiens
ccatcccctttcctccccacc

SEQ ID NO: 867652 - DNA, 13 bp, Homo sapiens
ccatcccgaagcc

SEQ ID NO: 867653 - DNA, 13 bp, Homo sapiens
cccacaccccagc

SEQ ID NO: 867654 - DNA, 17 bp, Homo sapiens
cccacaccccagcccac

SEQ ID NO: 867655 - DNA, 22 bp, Homo sapiens
cccacaccccagcccaccctgc

SEQ ID NO: 867656 - DNA, 18 bp, Homo sapiens
cccacaccgtcttccttc

SEQ ID NO: 867657 - DNA, 13 bp, Homo sapiens
cccacacctcagt

SEQ ID NO: 867658 - DNA, 16 bp, Homo sapiens
cccacacctccctact

SEQ ID NO: 867659 - DNA, 18 bp, Homo sapiens
cccacacctccctactcc

SEQ ID NO: 867660 - DNA, 14 bp, Homo sapiens
cccacacctcctct

SEQ ID NO: 867661 - DNA, 17 bp, Homo sapiens
cccacacctcctctcac

SEQ ID NO: 867662 - DNA, 16 bp, Homo sapiens
cccacacggcagcccc

SEQ ID NO: 867663 - DNA, 14 bp, Homo sapiens
cccacactaacctg

SEQ ID NO: 867664 - DNA, 13 bp, Homo sapiens
cccacactccact

SEQ ID NO: 867665 - DNA, 23 bp, Homo sapiens
cccacactcccaaggttggagcc

SEQ ID NO: 867666 - DNA, 19 bp, Homo sapiens
cccacactgtgcagaccca

SEQ ID NO: 867667 - DNA, 17 bp, Homo sapiens
cccacactgtggccagg

SEQ ID NO: 867668 - DNA, 21 bp, Homo sapiens
cccacactgtggccaggcctt

SEQ ID NO: 867669 - DNA, 15 bp, Homo sapiens
cccacacttccctgg

SEQ ID NO: 867670 - DNA, 16 bp, Homo sapiens
cccacacttccctggc

SEQ ID NO: 867671 - DNA, 20 bp, Homo sapiens
cccacagactccggcctgta

SEQ ID NO: 867672 - DNA, 14 bp, Homo sapiens
cccacagagcctgg

SEQ ID NO: 867673 - DNA, 14 bp, Homo sapiens
cccacagagtgctg

SEQ ID NO: 867674 - DNA, 20 bp, Homo sapiens
cccacagatgtctctggggc

SEQ ID NO: 867675 - DNA, 22 bp, Homo sapiens
cccacagatgtctctggggcag

SEQ ID NO: 867676 - DNA, 15 bp, Homo sapiens
cccacagcgagcctg

SEQ ID NO: 867677 - DNA, 16 bp, Homo sapiens
cccacagcgagcctgt

SEQ ID NO: 867678 - DNA, 20 bp, Homo sapiens
cccacagcgagcctgtgcct

SEQ ID NO: 867679 - DNA, 17 bp, Homo sapiens
cccacagctcccacccc

SEQ ID NO: 867680 - DNA, 19 bp, Homo sapiens
cccacagctctgggcctct

SEQ ID NO: 867681 - DNA, 20 bp, Homo sapiens
cccacagctctgggcctctt

SEQ ID NO: 867682 - DNA, 15 bp, Homo sapiens
cccacagcttcctga

SEQ ID NO: 867683 - DNA, 19 bp, Homo sapiens
cccacagcttcctgagggc

SEQ ID NO: 867684 - DNA, 13 bp, Homo sapiens
cccacaggagggc

SEQ ID NO: 867685 - DNA, 21 bp, Homo sapiens
cccacaggagggccagcgctg

SEQ ID NO: 867686 - DNA, 23 bp, Homo sapiens
cccacagtatattttatttcaat

SEQ ID NO: 867687 - DNA, 16 bp, Homo sapiens
cccacagttttaataa

SEQ ID NO: 867688 - DNA, 18 bp, Homo sapiens
cccacatccaactccagc

SEQ ID NO: 867689 - DNA, 17 bp, Homo sapiens
cccacatcccatcgtct

SEQ ID NO: 867690 - DNA, 21 bp, Homo sapiens
cccacatccttctcactgcca

SEQ ID NO: 867691 - DNA, 19 bp, Homo sapiens
cccacatgtggccatggcc

SEQ ID NO: 867692 - DNA, 14 bp, Homo sapiens
cccacattccgaca

SEQ ID NO: 867693 - DNA, 14 bp, Homo sapiens
cccacattggaccc

SEQ ID NO: 867694 - DNA, 18 bp, Homo sapiens
cccaccaaatcatcctga

SEQ ID NO: 867695 - DNA, 18 bp, Homo sapiens
cccaccaactctgcactc

SEQ ID NO: 867696 - DNA, 14 bp, Homo sapiens
cccaccacactgaa

SEQ ID NO: 867697 - DNA, 12 bp, Homo sapiens
cccaccacagca

SEQ ID NO: 867698 - DNA, 16 bp, Homo sapiens
cccaccacctaggcca

SEQ ID NO: 867699 - DNA, 19 bp, Homo sapiens
cccaccacctaggccactc

SEQ ID NO: 867700 - DNA, 21 bp, Homo sapiens
cccaccacctaggccactcct

SEQ ID NO: 867701 - DNA, 20 bp, Homo sapiens
cccaccacgcatgctcagtg

SEQ ID NO: 867702 - DNA, 16 bp, Homo sapiens
cccaccacgtctggct

SEQ ID NO: 867703 - DNA, 23 bp, Homo sapiens
cccaccacgtctggctccctgcc

SEQ ID NO: 867704 - DNA, 14 bp, Homo sapiens
cccaccactcaggc

SEQ ID NO: 867705 - DNA, 21 bp, Homo sapiens
cccaccagaacgcaccccact

SEQ ID NO: 867706 - DNA, 19 bp, Homo sapiens
cccaccgaggttcccaggg

SEQ ID NO: 867707 - DNA, 20 bp, Homo sapiens
cccaccgatggagcccccag

SEQ ID NO: 867708 - DNA, 21 bp, Homo sapiens
cccaccgatggagcccccaga

SEQ ID NO: 867709 - DNA, 14 bp, Homo sapiens
cccaccgccctcct

SEQ ID NO: 867710 - DNA, 17 bp, Homo sapiens
cccaccgccctcctcca

SEQ ID NO: 867711 - DNA, 14 bp, Homo sapiens
cccaccgctcagtg

SEQ ID NO: 867712 - DNA, 18 bp, Homo sapiens
cccaccgctcagtgtcag

SEQ ID NO: 867713 - DNA, 17 bp, Homo sapiens
cccaccggaactgggct

SEQ ID NO: 867714 - DNA, 22 bp, Homo sapiens
cccaccggaactgggctggcgc

SEQ ID NO: 867715 - DNA, 21 bp, Homo sapiens
cccaccgggagcctccccctc

SEQ ID NO: 867716 - DNA, 17 bp, Homo sapiens
cccaccggtccagctgg

SEQ ID NO: 867717 - DNA, 19 bp, Homo sapiens
cccaccgtccgccctgctc

SEQ ID NO: 867718 - DNA, 23 bp, Homo sapiens
cccaccgtccgccctgctcctcc

SEQ ID NO: 867719 - DNA, 13 bp, Homo sapiens
cccaccgtctcgg

SEQ ID NO: 867720 - DNA, 15 bp, Homo sapiens
cccacctactgcact

SEQ ID NO: 867721 - DNA, 16 bp, Homo sapiens
cccacctactgcactt

SEQ ID NO: 867722 - DNA, 18 bp, Homo sapiens
cccacctacttgtgactg

SEQ ID NO: 867723 - DNA, 15 bp, Homo sapiens
cccacctagtgcccc

SEQ ID NO: 867724 - DNA, 18 bp, Homo sapiens
cccacctcaacccagagg

SEQ ID NO: 867725 - DNA, 12 bp, Homo sapiens
cccacctccacc

SEQ ID NO: 867726 - DNA, 16 bp, Homo sapiens
cccacctccacccagc

SEQ ID NO: 867727 - DNA, 17 bp, Homo sapiens
cccacctccacccagcc

SEQ ID NO: 867728 - DNA, 20 bp, Homo sapiens
cccacctccacccagcccct

SEQ ID NO: 867729 - DNA, 18 bp, Homo sapiens
cccacctccagcccggga

SEQ ID NO: 867730 - DNA, 12 bp, Homo sapiens
cccacctcccat

SEQ ID NO: 867731 - DNA, 12 bp, Homo sapiens
cccacctccctg

SEQ ID NO: 867732 - DNA, 15 bp, Homo sapiens
cccacctcccttccc

SEQ ID NO: 867733 - DNA, 12 bp, Homo sapiens
cccacctcctgc

SEQ ID NO: 867734 - DNA, 20 bp, Homo sapiens
cccacctcgctcccctctgg

SEQ ID NO: 867735 - DNA, 23 bp, Homo sapiens
cccacctctcttttcctctctgt

SEQ ID NO: 867736 - DNA, 18 bp, Homo sapiens
cccacctgacacaccagg

SEQ ID NO: 867737 - DNA, 12 bp, Homo sapiens
cccacctgctga

SEQ ID NO: 867738 - DNA, 13 bp, Homo sapiens
cccacctgctgag

SEQ ID NO: 867739 - DNA, 13 bp, Homo sapiens
cccacctggacac

SEQ ID NO: 867740 - DNA, 17 bp, Homo sapiens
cccacctggacacacac

SEQ ID NO: 867741 - DNA, 16 bp, Homo sapiens
cccacctggagcccgc

SEQ ID NO: 867742 - DNA, 18 bp, Homo sapiens
cccacctggagcccgctt

SEQ ID NO: 867743 - DNA, 13 bp, Homo sapiens
cccacctggccac

SEQ ID NO: 867744 - DNA, 17 bp, Homo sapiens
cccacctggccacctga

SEQ ID NO: 867745 - DNA, 14 bp, Homo sapiens
cccacctggggtct

SEQ ID NO: 867746 - DNA, 13 bp, Homo sapiens
cccacctgtagct

SEQ ID NO: 867747 - DNA, 14 bp, Homo sapiens
cccacctgtagctg

SEQ ID NO: 867748 - DNA, 19 bp, Homo sapiens
cccacctgtttctggaaga

SEQ ID NO: 867749 - DNA, 17 bp, Homo sapiens
cccacctgttttctgaa

SEQ ID NO: 867750 - DNA, 23 bp, Homo sapiens
cccacctgttttctgaaacacac

SEQ ID NO: 867751 - DNA, 11 bp, Homo sapiens
cccagacacat

SEQ ID NO: 867752 - DNA, 16 bp, Homo sapiens
cccagacactggtttg

SEQ ID NO: 867753 - DNA, 19 bp, Homo sapiens
cccagacagacatctctgc

SEQ ID NO: 867754 - DNA, 20 bp, Homo sapiens
cccagacaggccctccctgt

SEQ ID NO: 867755 - DNA, 20 bp, Homo sapiens
cccagacagggtgggcttcc

SEQ ID NO: 867756 - DNA, 22 bp, Homo sapiens
cccagacagtggatatgaccca

SEQ ID NO: 867757 - DNA, 17 bp, Homo sapiens
cccagaccaaccctggg

SEQ ID NO: 867758 - DNA, 18 bp, Homo sapiens
cccagaccaaccctggga

SEQ ID NO: 867759 - DNA, 20 bp, Homo sapiens
cccagaccaaccctgggacc

SEQ ID NO: 867760 - DNA, 17 bp, Homo sapiens
cccagaccccagggcag

SEQ ID NO: 867761 - DNA, 22 bp, Homo sapiens
cccagacctgttagcagacagg

SEQ ID NO: 867762 - DNA, 22 bp, Homo sapiens
cccagaccttaagacactgtga

SEQ ID NO: 867763 - DNA, 18 bp, Homo sapiens
cccagacgcatagactga

SEQ ID NO: 867764 - DNA, 23 bp, Homo sapiens
cccagactaaaggatccagagag

SEQ ID NO: 867765 - DNA, 23 bp, Homo sapiens
cccagactagatgtagtattttt

SEQ ID NO: 867766 - DNA, 15 bp, Homo sapiens
cccagactctgagct

SEQ ID NO: 867767 - DNA, 15 bp, Homo sapiens
cccagactgagctct

SEQ ID NO: 867768 - DNA, 16 bp, Homo sapiens
cccagactgagctctc

SEQ ID NO: 867769 - DNA, 18 bp, Homo sapiens
cccagactgagctctcca

SEQ ID NO: 867770 - DNA, 21 bp, Homo sapiens
cccagactgagctctccaggc

SEQ ID NO: 867771 - DNA, 22 bp, Homo sapiens
cccagactgagctctccaggcc

SEQ ID NO: 867772 - DNA, 17 bp, Homo sapiens
cccagactgatgagcac

SEQ ID NO: 867773 - DNA, 15 bp, Homo sapiens
cccagactgggccca

SEQ ID NO: 867774 - DNA, 17 bp, Homo sapiens
cccagactgggcccagg

SEQ ID NO: 867775 - DNA, 18 bp, Homo sapiens
cccagactgggcccaggc

SEQ ID NO: 867776 - DNA, 19 bp, Homo sapiens
cccagactgggcccaggca

SEQ ID NO: 867777 - DNA, 21 bp, Homo sapiens
cccagactgggcccaggcagg

SEQ ID NO: 867778 - DNA, 23 bp, Homo sapiens
cccagagaagctggaagcctgcc

SEQ ID NO: 867779 - DNA, 22 bp, Homo sapiens
cccagagaaggacggtgccaag

SEQ ID NO: 867780 - DNA, 15 bp, Homo sapiens
cccagagacaggaaa

SEQ ID NO: 867781 - DNA, 18 bp, Homo sapiens
cccagagagagctctgca

SEQ ID NO: 867782 - DNA, 14 bp, Homo sapiens
cccagagagaggag

SEQ ID NO: 867783 - DNA, 13 bp, Homo sapiens
cccagagagcagg

SEQ ID NO: 867784 - DNA, 16 bp, Homo sapiens
cccagagagcaggcag

SEQ ID NO: 867785 - DNA, 13 bp, Homo sapiens
cccagagaggcac

SEQ ID NO: 867786 - DNA, 22 bp, Homo sapiens
cccagagaggcactcagtgagc

SEQ ID NO: 867787 - DNA, 16 bp, Homo sapiens
cccagagatgcctcca

SEQ ID NO: 867788 - DNA, 20 bp, Homo sapiens
cccagagatgcctccaccgc

SEQ ID NO: 867789 - DNA, 21 bp, Homo sapiens
cccagagatgcctccaccgct

SEQ ID NO: 867790 - DNA, 16 bp, Homo sapiens
cccagagcacccccaa

SEQ ID NO: 867791 - DNA, 14 bp, Homo sapiens
cccagagcaggaag

SEQ ID NO: 867792 - DNA, 16 bp, Homo sapiens
cccagagcaggaggcc

SEQ ID NO: 867793 - DNA, 19 bp, Homo sapiens
cccagagcaggaggcccct

SEQ ID NO: 867794 - DNA, 22 bp, Homo sapiens
cccagagcattacgtgagccag

SEQ ID NO: 867795 - DNA, 13 bp, Homo sapiens
cccagagccacct

SEQ ID NO: 867796 - DNA, 16 bp, Homo sapiens
cccagagccacctgga

SEQ ID NO: 867797 - DNA, 17 bp, Homo sapiens
cccagagccagggctgt

SEQ ID NO: 867798 - DNA, 13 bp, Homo sapiens
cccagagcccagc

SEQ ID NO: 867799 - DNA, 14 bp, Homo sapiens
cccagagcccagct

SEQ ID NO: 867800 - DNA, 19 bp, Homo sapiens
cccagagcccagctcttgc

SEQ ID NO: 867801 - DNA, 14 bp, Homo sapiens
cccagagccccact

SEQ ID NO: 867802 - DNA, 16 bp, Homo sapiens
cccagagccccactcc

SEQ ID NO: 867803 - DNA, 12 bp, Homo sapiens
cccagagccctt

SEQ ID NO: 867804 - DNA, 18 bp, Homo sapiens
cccagagcctctgctgga

SEQ ID NO: 867805 - DNA, 20 bp, Homo sapiens
cccagagcctggctgcccat

SEQ ID NO: 867806 - DNA, 20 bp, Homo sapiens
cccagagcgaggaaaggatt

SEQ ID NO: 867807 - DNA, 22 bp, Homo sapiens
cccagagctcatcccccctgct

SEQ ID NO: 867808 - DNA, 15 bp, Homo sapiens
cccagagctggcctc

SEQ ID NO: 867809 - DNA, 20 bp, Homo sapiens
cccagagctggcctccccca

SEQ ID NO: 867810 - DNA, 13 bp, Homo sapiens
cccagagctgtgc

SEQ ID NO: 867811 - DNA, 15 bp, Homo sapiens
cccagagctgtgcca

SEQ ID NO: 867812 - DNA, 13 bp, Homo sapiens
cccagagctgttt

SEQ ID NO: 867813 - DNA, 20 bp, Homo sapiens
cccagagctgtttatggcct

SEQ ID NO: 867814 - DNA, 20 bp, Homo sapiens
cccagagcttattggccact

SEQ ID NO: 867815 - DNA, 23 bp, Homo sapiens
cccagaggaaggggccagaggct

SEQ ID NO: 867816 - DNA, 13 bp, Homo sapiens
cccagaggctccc

SEQ ID NO: 867817 - DNA, 14 bp, Homo sapiens
cccagaggctccca

SEQ ID NO: 867818 - DNA, 13 bp, Homo sapiens
cccagagggccca

SEQ ID NO: 867819 - DNA, 14 bp, Homo sapiens
cccagagggcccag

SEQ ID NO: 867820 - DNA, 15 bp, Homo sapiens
cccagagggcccagg

SEQ ID NO: 867821 - DNA, 16 bp, Homo sapiens
cccagagggcccaggc

SEQ ID NO: 867822 - DNA, 15 bp, Homo sapiens
cccagaggtccagcc

SEQ ID NO: 867823 - DNA, 14 bp, Homo sapiens
cccagaggtggccc

SEQ ID NO: 867824 - DNA, 16 bp, Homo sapiens
cccagaggtggccctt

SEQ ID NO: 867825 - DNA, 18 bp, Homo sapiens
cccagaggttatctgcct

SEQ ID NO: 867826 - DNA, 19 bp, Homo sapiens
cccagaggttatctgcctg

SEQ ID NO: 867827 - DNA, 20 bp, Homo sapiens
cccagaggttatctgcctgg

SEQ ID NO: 867828 - DNA, 22 bp, Homo sapiens
cccagaggttatctgcctggcc

SEQ ID NO: 867829 - DNA, 21 bp, Homo sapiens
cccagagtagagccaggtgct

SEQ ID NO: 867830 - DNA, 15 bp, Homo sapiens
cccagagtcatctga

SEQ ID NO: 867831 - DNA, 14 bp, Homo sapiens
cccagagtgctgtc

SEQ ID NO: 867832 - DNA, 18 bp, Homo sapiens
cccagagtgctgtcggga

SEQ ID NO: 867833 - DNA, 22 bp, Homo sapiens
cccagagtgctgtcgggaccac

SEQ ID NO: 867834 - DNA, 21 bp, Homo sapiens
cccagagtggagtctgagtct

SEQ ID NO: 867835 - DNA, 14 bp, Homo sapiens
cccagagtgggaga

SEQ ID NO: 867836 - DNA, 17 bp, Homo sapiens
cccagagtgtgaaactt

SEQ ID NO: 867837 - DNA, 16 bp, Homo sapiens
cccagagtgtgggaag

SEQ ID NO: 867838 - DNA, 20 bp, Homo sapiens
cccagagttgctgtgccgtg

SEQ ID NO: 867839 - DNA, 20 bp, Homo sapiens
cccagatagagctgggtggc

SEQ ID NO: 867840 - DNA, 23 bp, Homo sapiens
cccagatagagctgggtggcctg

SEQ ID NO: 867841 - DNA, 21 bp, Homo sapiens
cccagatcaggaaccagggcc

SEQ ID NO: 867842 - DNA, 13 bp, Homo sapiens
cccagatctgcct

SEQ ID NO: 867843 - DNA, 15 bp, Homo sapiens
cccagatctgcctgg

SEQ ID NO: 867844 - DNA, 18 bp, Homo sapiens
cccagatctgcctgggcc

SEQ ID NO: 867845 - DNA, 22 bp, Homo sapiens
cccagatctgcctgggcctgtg

SEQ ID NO: 867846 - DNA, 19 bp, Homo sapiens
cccagatctggtcccttgc

SEQ ID NO: 867847 - DNA, 23 bp, Homo sapiens
cccagatggctggaaggggtcca

SEQ ID NO: 867848 - DNA, 15 bp, Homo sapiens
cccagatgtgtcccc

SEQ ID NO: 867849 - DNA, 18 bp, Homo sapiens
cccagattttgctgtata

SEQ ID NO: 867850 - DNA, 20 bp, Homo sapiens
cccagcaacacaagctggaa

SEQ ID NO: 867851 - DNA, 15 bp, Homo sapiens
cccagcaacgcccct

SEQ ID NO: 867852 - DNA, 18 bp, Homo sapiens
cccagcaattatgaaaat

SEQ ID NO: 867853 - DNA, 21 bp, Homo sapiens
cccagcacagatgaggagcag

SEQ ID NO: 867854 - DNA, 14 bp, Homo sapiens
cccagcacagccac

SEQ ID NO: 867855 - DNA, 18 bp, Homo sapiens
cccagcacagcttgacct

SEQ ID NO: 867856 - DNA, 18 bp, Homo sapiens
cccagcacatgaaacctt

SEQ ID NO: 867857 - DNA, 19 bp, Homo sapiens
cccagcacatggccataga

SEQ ID NO: 867858 - DNA, 16 bp, Homo sapiens
cccagcacctgcctcc

SEQ ID NO: 867859 - DNA, 16 bp, Homo sapiens
cccagcactaaagcag

SEQ ID NO: 867860 - DNA, 17 bp, Homo sapiens
cccagcactaaagcagt

SEQ ID NO: 867861 - DNA, 21 bp, Homo sapiens
cccagcactaaggccgtgtct

SEQ ID NO: 867862 - DNA, 16 bp, Homo sapiens
cccagcactgcctcct

SEQ ID NO: 867863 - DNA, 21 bp, Homo sapiens
cccagcactgcttgaggaaaa

SEQ ID NO: 867864 - DNA, 18 bp, Homo sapiens
cccagcacttgtgttgtc

SEQ ID NO: 867865 - DNA, 15 bp, Homo sapiens
cccagcactttggga

SEQ ID NO: 867866 - DNA, 17 bp, Homo sapiens
cccagcactttgggagg

SEQ ID NO: 867867 - DNA, 20 bp, Homo sapiens
cccagcactttgggaggcca

SEQ ID NO: 867868 - DNA, 21 bp, Homo sapiens
cccagcactttgggaggctga

SEQ ID NO: 867869 - DNA, 22 bp, Homo sapiens
cccagctacctcaaccaatgcc

SEQ ID NO: 867870 - DNA, 20 bp, Homo sapiens
cccagctacgtgggaggctg

SEQ ID NO: 867871 - DNA, 20 bp, Homo sapiens
cccagctactcgggaggctg

SEQ ID NO: 867872 - DNA, 17 bp, Homo sapiens
cccagctactctgtcca

SEQ ID NO: 867873 - DNA, 20 bp, Homo sapiens
cccagctactctgtccaggc

SEQ ID NO: 867874 - DNA, 22 bp, Homo sapiens
cccagctactctgtccaggcca

SEQ ID NO: 867875 - DNA, 18 bp, Homo sapiens
cccagctacttgggaagc

SEQ ID NO: 867876 - DNA, 19 bp, Homo sapiens
cccagctacttgggaagct

SEQ ID NO: 867877 - DNA, 17 bp, Homo sapiens
cccagctacttgggagc

SEQ ID NO: 867878 - DNA, 13 bp, Homo sapiens
cccagctaggaag

SEQ ID NO: 867879 - DNA, 12 bp, Homo sapiens
cccagctcagca

SEQ ID NO: 867880 - DNA, 16 bp, Homo sapiens
cccagctcagctcagc

SEQ ID NO: 867881 - DNA, 14 bp, Homo sapiens
cccagctccagggg

SEQ ID NO: 867882 - DNA, 13 bp, Homo sapiens
cccagctcccccc

SEQ ID NO: 867883 - DNA, 12 bp, Homo sapiens
cccagctccgga

SEQ ID NO: 867884 - DNA, 13 bp, Homo sapiens
cccagctcctcac

SEQ ID NO: 867885 - DNA, 12 bp, Homo sapiens
cccagctcctcc

SEQ ID NO: 867886 - DNA, 12 bp, Homo sapiens
cccagctcctct

SEQ ID NO: 867887 - DNA, 21 bp, Homo sapiens
cccagctcctctgagccatac

SEQ ID NO: 867888 - DNA, 18 bp, Homo sapiens
cccagctcctttctcctg

SEQ ID NO: 867889 - DNA, 22 bp, Homo sapiens
cccagctcctttctcctgtgaa

SEQ ID NO: 867890 - DNA, 23 bp, Homo sapiens
cccagctcctttctcctgtgaat

SEQ ID NO: 867891 - DNA, 13 bp, Homo sapiens
cccagctctaagc

SEQ ID NO: 867892 - DNA, 19 bp, Homo sapiens
cccagctctaagcagccag

SEQ ID NO: 867893 - DNA, 13 bp, Homo sapiens
cccagctctccct

SEQ ID NO: 867894 - DNA, 17 bp, Homo sapiens
cccagctctccctctgg

SEQ ID NO: 867895 - DNA, 21 bp, Homo sapiens
cccagctctccctctggccct

SEQ ID NO: 867896 - DNA, 12 bp, Homo sapiens
cccagctctgcg

SEQ ID NO: 867897 - DNA, 13 bp, Homo sapiens
cccagctctggct

SEQ ID NO: 867898 - DNA, 20 bp, Homo sapiens
cccagctctggtgagtcttg

SEQ ID NO: 867899 - DNA, 19 bp, Homo sapiens
cccagctcttgctctcttg

SEQ ID NO: 867900 - DNA, 22 bp, Homo sapiens
cccagctgcacctgccagcctg

SEQ ID NO: 867901 - DNA, 12 bp, Homo sapiens
cccagctgcact

SEQ ID NO: 867902 - DNA, 12 bp, Homo sapiens
cccagctgccag

SEQ ID NO: 867903 - DNA, 18 bp, Homo sapiens
cccagctgccaggcggcc

SEQ ID NO: 867904 - DNA, 21 bp, Homo sapiens
cccagctgccaggcggccctg

SEQ ID NO: 867905 - DNA, 13 bp, Homo sapiens
cccagctgctccc

SEQ ID NO: 867906 - DNA, 17 bp, Homo sapiens
cccagctgctcccctgc

SEQ ID NO: 867907 - DNA, 21 bp, Homo sapiens
cccagctgctcccctgccacg

SEQ ID NO: 867908 - DNA, 11 bp, Homo sapiens
cccagctggga

SEQ ID NO: 867909 - DNA, 12 bp, Homo sapiens
cccagctgggag

SEQ ID NO: 867910 - DNA, 13 bp, Homo sapiens
cccagctgggagg

SEQ ID NO: 867911 - DNA, 15 bp, Homo sapiens
cccagctgggaggca

SEQ ID NO: 867912 - DNA, 21 bp, Homo sapiens
cccagctgggaggcaagaggg

SEQ ID NO: 867913 - DNA, 24 bp, Homo sapiens
cccagctgggctctgccaccctac

SEQ ID NO: 867914 - DNA, 17 bp, Homo sapiens
cccagctggtcctgtgg

SEQ ID NO: 867915 - DNA, 18 bp, Homo sapiens
cccagctggtcctgtgga

SEQ ID NO: 867916 - DNA, 20 bp, Homo sapiens
cccagctggtcctgtggatg

SEQ ID NO: 867917 - DNA, 23 bp, Homo sapiens
cccagctggtggccctgtgcctg

SEQ ID NO: 867918 - DNA, 21 bp, Homo sapiens
cccagctgtgcccctccccca

SEQ ID NO: 867919 - DNA, 22 bp, Homo sapiens
cccagcttaaaggggctagagt

SEQ ID NO: 867920 - DNA, 21 bp, Homo sapiens
cccagcttcaaagcttaaaaa

SEQ ID NO: 867921 - DNA, 15 bp, Homo sapiens
cccagcttcctggtg

SEQ ID NO: 867922 - DNA, 16 bp, Homo sapiens
cccagcttcctggtgt

SEQ ID NO: 867923 - DNA, 19 bp, Homo sapiens
cccagcttctctctccctg

SEQ ID NO: 867924 - DNA, 13 bp, Homo sapiens
cccagcttgcccc

SEQ ID NO: 867925 - DNA, 14 bp, Homo sapiens
cccagcttgctgag

SEQ ID NO: 867926 - DNA, 19 bp, Homo sapiens
cccagcttgggcccagctg

SEQ ID NO: 867927 - DNA, 11 bp, Homo sapiens
cccaggaacaa

SEQ ID NO: 867928 - DNA, 18 bp, Homo sapiens
cccaggaacgctctcctc

SEQ ID NO: 867929 - DNA, 16 bp, Homo sapiens
cccaggacaagcacga

SEQ ID NO: 867930 - DNA, 15 bp, Homo sapiens
cccaggacagtttat

SEQ ID NO: 867931 - DNA, 13 bp, Homo sapiens
cccaggaccagct

SEQ ID NO: 867932 - DNA, 22 bp, Homo sapiens
cccaggaccagctggggcgtgg

SEQ ID NO: 867933 - DNA, 20 bp, Homo sapiens
cccaggacccctgtccagga

SEQ ID NO: 867934 - DNA, 18 bp, Homo sapiens
cccaggacctggctgcca

SEQ ID NO: 867935 - DNA, 19 bp, Homo sapiens
cccaggacgccactcattt

SEQ ID NO: 867936 - DNA, 22 bp, Homo sapiens
cccaggacgccactcatttcat

SEQ ID NO: 867937 - DNA, 16 bp, Homo sapiens
cccaggacgcttctga

SEQ ID NO: 867938 - DNA, 18 bp, Homo sapiens
cccaggacgcttctgaat

SEQ ID NO: 867939 - DNA, 19 bp, Homo sapiens
cccaggacgcttctgaatg

SEQ ID NO: 867940 - DNA, 17 bp, Homo sapiens
cccaggactcaccctcc

SEQ ID NO: 867941 - DNA, 18 bp, Homo sapiens
cccaggactctggcttct

SEQ ID NO: 867942 - DNA, 19 bp, Homo sapiens
cccaggagagccagccctc

SEQ ID NO: 867943 - DNA, 19 bp, Homo sapiens
cccaggagatgggtccagg

SEQ ID NO: 867944 - DNA, 19 bp, Homo sapiens
cccaggagctctgcgccag

SEQ ID NO: 867945 - DNA, 22 bp, Homo sapiens
cccaggagctctgcgccaggca

SEQ ID NO: 867946 - DNA, 22 bp, Homo sapiens
cccaggagctgagtcacctcct

SEQ ID NO: 867947 - DNA, 17 bp, Homo sapiens
cccaggagctgcccaga

SEQ ID NO: 867948 - DNA, 19 bp, Homo sapiens
cccaggaggaccgcctgcc

SEQ ID NO: 867949 - DNA, 22 bp, Homo sapiens
cccaggaggaccgcctgccctg

SEQ ID NO: 867950 - DNA, 23 bp, Homo sapiens
cccaggaggaccgcctgccctgc

SEQ ID NO: 867951 - DNA, 13 bp, Homo sapiens
cccaggaggctga

SEQ ID NO: 867952 - DNA, 17 bp, Homo sapiens
cccaggagttcaagacc

SEQ ID NO: 867953 - DNA, 23 bp, Homo sapiens
cccaggagtttgagacaagccct

SEQ ID NO: 867954 - DNA, 19 bp, Homo sapiens
cccaggattcccccagcca

SEQ ID NO: 867955 - DNA, 21 bp, Homo sapiens
cccaggcaagcagctggtcag

SEQ ID NO: 867956 - DNA, 21 bp, Homo sapiens
cccaggcaccaccaggagcag

SEQ ID NO: 867957 - DNA, 18 bp, Homo sapiens
cccaggcagacaaccttg

SEQ ID NO: 867958 - DNA, 19 bp, Homo sapiens
cccaggcagacaaccttgt

SEQ ID NO: 867959 - DNA, 12 bp, Homo sapiens
cccaggcagcca

SEQ ID NO: 867960 - DNA, 17 bp, Homo sapiens
cccaggcagccaccagt

SEQ ID NO: 867961 - DNA, 19 bp, Homo sapiens
cccaggcagccaccagtgg

SEQ ID NO: 867962 - DNA, 17 bp, Homo sapiens
cccaggcagcctcaagg

SEQ ID NO: 867963 - DNA, 12 bp, Homo sapiens
cccaggcagcta

SEQ ID NO: 867964 - DNA, 22 bp, Homo sapiens
cccaggcagctatttcagcctc

SEQ ID NO: 867965 - DNA, 13 bp, Homo sapiens
cccaggcaggctg

SEQ ID NO: 867966 - DNA, 21 bp, Homo sapiens
cccaggcatctccttgggctg

SEQ ID NO: 867967 - DNA, 17 bp, Homo sapiens
cccaggcatgcagctgc

SEQ ID NO: 867968 - DNA, 20 bp, Homo sapiens
cccaggccggagcccagata

SEQ ID NO: 867969 - DNA, 14 bp, Homo sapiens
cccaggccgggaag

SEQ ID NO: 867970 - DNA, 19 bp, Homo sapiens
cccaggccgggaagagcca

SEQ ID NO: 867971 - DNA, 20 bp, Homo sapiens
cccaggccgggaagagccac

SEQ ID NO: 867972 - DNA, 23 bp, Homo sapiens
cccaggccgggaagagccacctg

SEQ ID NO: 867973 - DNA, 13 bp, Homo sapiens
cccaggccgttcc

SEQ ID NO: 867974 - DNA, 14 bp, Homo sapiens
cccaggccgttccc

SEQ ID NO: 867975 - DNA, 21 bp, Homo sapiens
cccaggccgttccccttggct

SEQ ID NO: 867976 - DNA, 15 bp, Homo sapiens
cccaggcctccagcc

SEQ ID NO: 867977 - DNA, 19 bp, Homo sapiens
cccaggcctccagcctctc

SEQ ID NO: 867978 - DNA, 13 bp, Homo sapiens
cccaggcctctgt

SEQ ID NO: 867979 - DNA, 17 bp, Homo sapiens
cccaggcctgcctgcat

SEQ ID NO: 867980 - DNA, 16 bp, Homo sapiens
cccaggcctgctggca

SEQ ID NO: 867981 - DNA, 18 bp, Homo sapiens
cccaggcctgctggcatc

SEQ ID NO: 867982 - DNA, 12 bp, Homo sapiens
cccaggcctgga

SEQ ID NO: 867983 - DNA, 23 bp, Homo sapiens
cccaggcctggcctcgcctgcct

SEQ ID NO: 867984 - DNA, 15 bp, Homo sapiens
cccaggcctggctcc

SEQ ID NO: 867985 - DNA, 22 bp, Homo sapiens
cccaggcctggctccccgaggg

SEQ ID NO: 867986 - DNA, 21 bp, Homo sapiens
cccaggcctgggatgcagtga

SEQ ID NO: 867987 - DNA, 14 bp, Homo sapiens
cccaggcctgggtt

SEQ ID NO: 867988 - DNA, 17 bp, Homo sapiens
cccaggccttgctgact

SEQ ID NO: 867989 - DNA, 20 bp, Homo sapiens
cccaggccttgctgactctc

SEQ ID NO: 867990 - DNA, 14 bp, Homo sapiens
cccaggcctttgga

SEQ ID NO: 867991 - DNA, 18 bp, Homo sapiens
cccaggctccgcccttag

SEQ ID NO: 867992 - DNA, 23 bp, Homo sapiens
cccaggctccgcccttagtcccc

SEQ ID NO: 867993 - DNA, 17 bp, Homo sapiens
cccaggctcgtggactg

SEQ ID NO: 867994 - DNA, 14 bp, Homo sapiens
cccaggctgagcct

SEQ ID NO: 867995 - DNA, 15 bp, Homo sapiens
cccaggctgagcctc

SEQ ID NO: 867996 - DNA, 14 bp, Homo sapiens
cccaggctggagac

SEQ ID NO: 867997 - DNA, 16 bp, Homo sapiens
cccaggctggagaccc

SEQ ID NO: 867998 - DNA, 13 bp, Homo sapiens
cccaggctggagt

SEQ ID NO: 867999 - DNA, 20 bp, Homo sapiens
cccaggctggagtgcaatga

SEQ ID NO: 868000 - DNA, 20 bp, Homo sapiens
cccaggctggagtgtagtgg

SEQ ID NO: 868001 - DNA, 12 bp, Homo sapiens
cccaggctggga

SEQ ID NO: 868002 - DNA, 21 bp, Homo sapiens
cccaggctgggaactcatctg

SEQ ID NO: 868003 - DNA, 14 bp, Homo sapiens
cccaggcttttgct

SEQ ID NO: 868004 - DNA, 18 bp, Homo sapiens
cccagggacagaggccaa

SEQ ID NO: 868005 - DNA, 23 bp, Homo sapiens
cccagggacagaggccaaggact

SEQ ID NO: 868006 - DNA, 14 bp, Homo sapiens
cccagggagaggcc

SEQ ID NO: 868007 - DNA, 18 bp, Homo sapiens
cccagggagaggccatga

SEQ ID NO: 868008 - DNA, 14 bp, Homo sapiens
cccagggagctctg

SEQ ID NO: 868009 - DNA, 13 bp, Homo sapiens
cccagggagctga

SEQ ID NO: 868010 - DNA, 20 bp, Homo sapiens
cccagggagctgatgcccct

SEQ ID NO: 868011 - DNA, 16 bp, Homo sapiens
cccagggaggcagcgt

SEQ ID NO: 868012 - DNA, 13 bp, Homo sapiens
cccagggagtcca

SEQ ID NO: 868013 - DNA, 18 bp, Homo sapiens
cccagggagtgagcagct

SEQ ID NO: 868014 - DNA, 19 bp, Homo sapiens
cccagggagtgagcagcta

SEQ ID NO: 868015 - DNA, 20 bp, Homo sapiens
cccagggagtgagcagctac

SEQ ID NO: 868016 - DNA, 23 bp, Homo sapiens
cccagggcaagggttaaggcctg

SEQ ID NO: 868017 - DNA, 11 bp, Homo sapiens
cccagggcccc

SEQ ID NO: 868018 - DNA, 20 bp, Homo sapiens
cccagggcccgggcacccac

SEQ ID NO: 868019 - DNA, 15 bp, Homo sapiens
cccagggcctccagg

SEQ ID NO: 868020 - DNA, 19 bp, Homo sapiens
cccagggcctccagggccc

SEQ ID NO: 868021 - DNA, 14 bp, Homo sapiens
cccagggcctgact

SEQ ID NO: 868022 - DNA, 20 bp, Homo sapiens
cccagggcctgacttgagcc

SEQ ID NO: 868023 - DNA, 20 bp, Homo sapiens
cccagggcctgcttcccctt

SEQ ID NO: 868024 - DNA, 14 bp, Homo sapiens
cccagggcctgggg

SEQ ID NO: 868025 - DNA, 16 bp, Homo sapiens
cccagggcctgggggc

SEQ ID NO: 868026 - DNA, 18 bp, Homo sapiens
cccagggcctgggggcag

SEQ ID NO: 868027 - DNA, 24 bp, Homo sapiens
cccagggcctgggggcagtgactg

SEQ ID NO: 868028 - DNA, 14 bp, Homo sapiens
cccagggcctgtct

SEQ ID NO: 868029 - DNA, 15 bp, Homo sapiens
cccagggcctgtctc

SEQ ID NO: 868030 - DNA, 16 bp, Homo sapiens
cccagggctcagcctg

SEQ ID NO: 868031 - DNA, 20 bp, Homo sapiens
cccagggctcagcctggtgg

SEQ ID NO: 868032 - DNA, 22 bp, Homo sapiens
cccagggctccctcctggagca

SEQ ID NO: 868033 - DNA, 15 bp, Homo sapiens
cccagggctcctgca

SEQ ID NO: 868034 - DNA, 19 bp, Homo sapiens
cccagggctctgcaggcca

SEQ ID NO: 868035 - DNA, 11 bp, Homo sapiens
cccagggctgc

SEQ ID NO: 868036 - DNA, 14 bp, Homo sapiens
cccagggctgggag

SEQ ID NO: 868037 - DNA, 21 bp, Homo sapiens
cccagggctgggaggaaggac

SEQ ID NO: 868038 - DNA, 17 bp, Homo sapiens
cccaggggaaggccctg

SEQ ID NO: 868039 - DNA, 18 bp, Homo sapiens
cccaggggacaagggatt

SEQ ID NO: 868040 - DNA, 21 bp, Homo sapiens
cccaggggagagggtctggag

SEQ ID NO: 868041 - DNA, 22 bp, Homo sapiens
cccaggggagagggtctggaga

SEQ ID NO: 868042 - DNA, 14 bp, Homo sapiens
cccaggggagccag

SEQ ID NO: 868043 - DNA, 18 bp, Homo sapiens
cccaggggagccagctgc

SEQ ID NO: 868044 - DNA, 22 bp, Homo sapiens
cccaggggagccagctgcttga

SEQ ID NO: 868045 - DNA, 18 bp, Homo sapiens
cccaggggcagcaaggcc

SEQ ID NO: 868046 - DNA, 12 bp, Homo sapiens
cccaggggccgg

SEQ ID NO: 868047 - DNA, 20 bp, Homo sapiens
cccaggggtcccagccaccc

SEQ ID NO: 868048 - DNA, 17 bp, Homo sapiens
cccaggggtgccccctc

SEQ ID NO: 868049 - DNA, 14 bp, Homo sapiens
cccagggtcccacc

SEQ ID NO: 868050 - DNA, 15 bp, Homo sapiens
cccagggtcccaccc

SEQ ID NO: 868051 - DNA, 14 bp, Homo sapiens
cccagggtcctgtg

SEQ ID NO: 868052 - DNA, 16 bp, Homo sapiens
cccagggtcctgtgcc

SEQ ID NO: 868053 - DNA, 17 bp, Homo sapiens
cccagggtcgtctttgt

SEQ ID NO: 868054 - DNA, 18 bp, Homo sapiens
cccagggtcttccctacc

SEQ ID NO: 868055 - DNA, 12 bp, Homo sapiens
cccagggtgcag

SEQ ID NO: 868056 - DNA, 17 bp, Homo sapiens
cccaggtaccagctgcg

SEQ ID NO: 868057 - DNA, 19 bp, Homo sapiens
cccaggtaccagctgcgct

SEQ ID NO: 868058 - DNA, 15 bp, Homo sapiens
cccaggtcaccggga

SEQ ID NO: 868059 - DNA, 19 bp, Homo sapiens
cccaggtcagccctgtgtc

SEQ ID NO: 868060 - DNA, 13 bp, Homo sapiens
cccaggtccttcc

SEQ ID NO: 868061 - DNA, 14 bp, Homo sapiens
cccaggtctcttcc

SEQ ID NO: 868062 - DNA, 14 bp, Homo sapiens
cccaggtcttcctg

SEQ ID NO: 868063 - DNA, 17 bp, Homo sapiens
cccaggtcttcctgctt

SEQ ID NO: 868064 - DNA, 18 bp, Homo sapiens
cccaggtcttcctgcttt

SEQ ID NO: 868065 - DNA, 15 bp, Homo sapiens
cccaggtgatttcct

SEQ ID NO: 868066 - DNA, 22 bp, Homo sapiens
cccaggtgcagccccagggcct

SEQ ID NO: 868067 - DNA, 16 bp, Homo sapiens
cccaggtggctgaccc

SEQ ID NO: 868068 - DNA, 14 bp, Homo sapiens
cccaggtgggactt

SEQ ID NO: 868069 - DNA, 17 bp, Homo sapiens
cccaggttcccccagca

SEQ ID NO: 868070 - DNA, 19 bp, Homo sapiens
cccaggttcccccagcaag

SEQ ID NO: 868071 - DNA, 18 bp, Homo sapiens
cccagtcggccccatctc

SEQ ID NO: 868072 - DNA, 22 bp, Homo sapiens
cccagtcggccccatctctcat

SEQ ID NO: 868073 - DNA, 18 bp, Homo sapiens
cccagtctcatctcctga

SEQ ID NO: 868074 - DNA, 20 bp, Homo sapiens
cccagtctcatctcctgacc

SEQ ID NO: 868075 - DNA, 20 bp, Homo sapiens
cccagtctcctctccatttt

SEQ ID NO: 868076 - DNA, 17 bp, Homo sapiens
cccagtctgttccccat

SEQ ID NO: 868077 - DNA, 12 bp, Homo sapiens
cccagtcttcct

SEQ ID NO: 868078 - DNA, 14 bp, Homo sapiens
cccagtcttccttg

SEQ ID NO: 868079 - DNA, 20 bp, Homo sapiens
cccagtgaactcctgccagg

SEQ ID NO: 868080 - DNA, 18 bp, Homo sapiens
cccagtgaatccctggga

SEQ ID NO: 868081 - DNA, 12 bp, Homo sapiens
cccagtgacact

SEQ ID NO: 868082 - DNA, 19 bp, Homo sapiens
cccagtgacacttcagaga

SEQ ID NO: 868083 - DNA, 14 bp, Homo sapiens
cccagtgacagcta

SEQ ID NO: 868084 - DNA, 14 bp, Homo sapiens
cccagtgccactgc

SEQ ID NO: 868085 - DNA, 19 bp, Homo sapiens
cccagtgccagctccagtg

SEQ ID NO: 868086 - DNA, 18 bp, Homo sapiens
cccagtgccgagaaggaa

SEQ ID NO: 868087 - DNA, 14 bp, Homo sapiens
cccagtgcctgcca

SEQ ID NO: 868088 - DNA, 19 bp, Homo sapiens
cccagtgcctgccactctc

SEQ ID NO: 868089 - DNA, 20 bp, Homo sapiens
cccagtgcggacccttccca

SEQ ID NO: 868090 - DNA, 12 bp, Homo sapiens
cccagtgctgcc

SEQ ID NO: 868091 - DNA, 13 bp, Homo sapiens
cccagtgctgcca

SEQ ID NO: 868092 - DNA, 22 bp, Homo sapiens
cccagtggaattccaacttgaa

SEQ ID NO: 868093 - DNA, 18 bp, Homo sapiens
cccagtggcctcaaccct

SEQ ID NO: 868094 - DNA, 21 bp, Homo sapiens
cccagtggcctcaaccctccc

SEQ ID NO: 868095 - DNA, 14 bp, Homo sapiens
cccagtgggacaga

SEQ ID NO: 868096 - DNA, 16 bp, Homo sapiens
cccagtgggacagagg

SEQ ID NO: 868097 - DNA, 18 bp, Homo sapiens
cccagtgggaggggcagg

SEQ ID NO: 868098 - DNA, 21 bp, Homo sapiens
cccagtgggaggggcaggctg

SEQ ID NO: 868099 - DNA, 13 bp, Homo sapiens
cccagtgggctgt

SEQ ID NO: 868100 - DNA, 16 bp, Homo sapiens
cccagtggggacaggg

SEQ ID NO: 868101 - DNA, 21 bp, Homo sapiens
cccagtgtcaagttgtgcttg

SEQ ID NO: 868102 - DNA, 22 bp, Homo sapiens
cccagtgtcaagttgtgcttgt

SEQ ID NO: 868103 - DNA, 20 bp, Homo sapiens
cccagttaatactccagaga

SEQ ID NO: 868104 - DNA, 22 bp, Homo sapiens
cccagttaatactccagagaca

SEQ ID NO: 868105 - DNA, 22 bp, Homo sapiens
cccagttacttttttacactga

SEQ ID NO: 868106 - DNA, 19 bp, Homo sapiens
cccagttcaggagtcccaa

SEQ ID NO: 868107 - DNA, 22 bp, Homo sapiens
cccagttcaggagtcccaagga

SEQ ID NO: 868108 - DNA, 19 bp, Homo sapiens
cccagttcagtctgtaggg

SEQ ID NO: 868109 - DNA, 20 bp, Homo sapiens
cccagttcctatgacacagt

SEQ ID NO: 868110 - DNA, 21 bp, Homo sapiens
cccagttcctgtggctccctc

SEQ ID NO: 868111 - DNA, 15 bp, Homo sapiens
cccagttctgctcct

SEQ ID NO: 868112 - DNA, 20 bp, Homo sapiens
cccagttctgctcctctcca

SEQ ID NO: 868113 - DNA, 21 bp, Homo sapiens
cccagttctgctcctctccag

SEQ ID NO: 868114 - DNA, 17 bp, Homo sapiens
cccagtttcttcttaca

SEQ ID NO: 868115 - DNA, 22 bp, Homo sapiens
cccagtttgcagaaaagcacct

SEQ ID NO: 868116 - DNA, 19 bp, Homo sapiens
cccataataaccctgccag

SEQ ID NO: 868117 - DNA, 20 bp, Homo sapiens
cccataataaccctgccagt

SEQ ID NO: 868118 - DNA, 23 bp, Homo sapiens
cccataataaccctgccagtgcc

SEQ ID NO: 868119 - DNA, 22 bp, Homo sapiens
cccataattttttttttccttt

SEQ ID NO: 868120 - DNA, 15 bp, Homo sapiens
cccatacaatgtatg

SEQ ID NO: 868121 - DNA, 22 bp, Homo sapiens
cccatacaatgtatgtacaata

SEQ ID NO: 868122 - DNA, 16 bp, Homo sapiens
cccatactcagcctgc

SEQ ID NO: 868123 - DNA, 14 bp, Homo sapiens
cccatactgagcct

SEQ ID NO: 868124 - DNA, 22 bp, Homo sapiens
cccatagatcttctgaaatgaa

SEQ ID NO: 868125 - DNA, 14 bp, Homo sapiens
cccatagcagcttt

SEQ ID NO: 868126 - DNA, 19 bp, Homo sapiens
cccatagctattttccttg

SEQ ID NO: 868127 - DNA, 21 bp, Homo sapiens
cccatagtggggcctgggagg

SEQ ID NO: 868128 - DNA, 11 bp, Homo sapiens
cccatatcatg

SEQ ID NO: 868129 - DNA, 14 bp, Homo sapiens
cccatatccctccc

SEQ ID NO: 868130 - DNA, 19 bp, Homo sapiens
cccatattgtaaaacaggt

SEQ ID NO: 868131 - DNA, 13 bp, Homo sapiens
cccatatttcatc

SEQ ID NO: 868132 - DNA, 16 bp, Homo sapiens
cccatcaagtgcagtc

SEQ ID NO: 868133 - DNA, 21 bp, Homo sapiens
cccatcacagggttgggccca

SEQ ID NO: 868134 - DNA, 22 bp, Homo sapiens
cccatcacagggttgggcccag

SEQ ID NO: 868135 - DNA, 18 bp, Homo sapiens
cccatcaccatgggaggt

SEQ ID NO: 868136 - DNA, 18 bp, Homo sapiens
cccatcacctctactgtc

SEQ ID NO: 868137 - DNA, 17 bp, Homo sapiens
cccatcactcgcaggac

SEQ ID NO: 868138 - DNA, 18 bp, Homo sapiens
cccatcactcgcaggacc

SEQ ID NO: 868139 - DNA, 19 bp, Homo sapiens
cccatcactcgcaggacca

SEQ ID NO: 868140 - DNA, 15 bp, Homo sapiens
cccatcactggagca

SEQ ID NO: 868141 - DNA, 19 bp, Homo sapiens
cccatcaggctgttattat

SEQ ID NO: 868142 - DNA, 22 bp, Homo sapiens
cccatcagtgctccctcacatg

SEQ ID NO: 868143 - DNA, 12 bp, Homo sapiens
cccatcatgtgg

SEQ ID NO: 868144 - DNA, 14 bp, Homo sapiens
cccatcatgtggcc

SEQ ID NO: 868145 - DNA, 20 bp, Homo sapiens
cccatccaaccactgtacac

SEQ ID NO: 868146 - DNA, 23 bp, Homo sapiens
cccatccagccacggagggaggc

SEQ ID NO: 868147 - DNA, 13 bp, Homo sapiens
cccatcccagggt

SEQ ID NO: 868148 - DNA, 14 bp, Homo sapiens
cccatcccagggtc

SEQ ID NO: 868149 - DNA, 16 bp, Homo sapiens
cccatcccattttcat

SEQ ID NO: 868150 - DNA, 12 bp, Homo sapiens
cccatccccacc

SEQ ID NO: 868151 - DNA, 14 bp, Homo sapiens
cccatccccaccag

SEQ ID NO: 868152 - DNA, 19 bp, Homo sapiens
cccatccccatcctccagc

SEQ ID NO: 868153 - DNA, 12 bp, Homo sapiens
cccatccccctg

SEQ ID NO: 868154 - DNA, 17 bp, Homo sapiens
cccatccccctgccctc

SEQ ID NO: 868155 - DNA, 14 bp, Homo sapiens
cccatcccctcaac

SEQ ID NO: 868156 - DNA, 16 bp, Homo sapiens
cccatcccctcaacac

SEQ ID NO: 868157 - DNA, 22 bp, Homo sapiens
cccatcccctcaacaccctgct

SEQ ID NO: 868158 - DNA, 15 bp, Homo sapiens
cccatccctaccact

SEQ ID NO: 868159 - DNA, 13 bp, Homo sapiens
cccatccctgctt

SEQ ID NO: 868160 - DNA, 16 bp, Homo sapiens
cccatccctgcttgcc

SEQ ID NO: 868161 - DNA, 17 bp, Homo sapiens
cccatccctgtcatttt

SEQ ID NO: 868162 - DNA, 19 bp, Homo sapiens
cccatcctaccaatgcatg

SEQ ID NO: 868163 - DNA, 13 bp, Homo sapiens
cccatcctaccct

SEQ ID NO: 868164 - DNA, 15 bp, Homo sapiens
cccatcctcacccag

SEQ ID NO: 868165 - DNA, 16 bp, Homo sapiens
cccatcctcatccctg

SEQ ID NO: 868166 - DNA, 15 bp, Homo sapiens
cccatcctccccttc

SEQ ID NO: 868167 - DNA, 18 bp, Homo sapiens
cccatcctccccttccct

SEQ ID NO: 868168 - DNA, 12 bp, Homo sapiens
cccatcctgcca

SEQ ID NO: 868169 - DNA, 15 bp, Homo sapiens
cccatcctgccatcc

SEQ ID NO: 868170 - DNA, 13 bp, Homo sapiens
cccatcctggggc

SEQ ID NO: 868171 - DNA, 12 bp, Homo sapiens
cccatcggccct

SEQ ID NO: 868172 - DNA, 21 bp, Homo sapiens
cccatcggccctgtcccctgg

SEQ ID NO: 868173 - DNA, 19 bp, Homo sapiens
cccatcggtgtccatttat

SEQ ID NO: 868174 - DNA, 18 bp, Homo sapiens
cccatcgtccaccccagt

SEQ ID NO: 868175 - DNA, 10 bp, Homo sapiens
cccatctagg

SEQ ID NO: 868176 - DNA, 21 bp, Homo sapiens
cccatctatgtcccttgctgt

SEQ ID NO: 868177 - DNA, 15 bp, Homo sapiens
cccatctcagcctcc

SEQ ID NO: 868178 - DNA, 16 bp, Homo sapiens
cccatctcagcctcct

SEQ ID NO: 868179 - DNA, 18 bp, Homo sapiens
cccatctcaggtgccact

SEQ ID NO: 868180 - DNA, 18 bp, Homo sapiens
cccatctcatcctggcac

SEQ ID NO: 868181 - DNA, 14 bp, Homo sapiens
cccatctccccagg

SEQ ID NO: 868182 - DNA, 15 bp, Homo sapiens
cccatctccccaggc

SEQ ID NO: 868183 - DNA, 19 bp, Homo sapiens
cccatctccccaggcctcc

SEQ ID NO: 868184 - DNA, 17 bp, Homo sapiens
cccatctccctgcctgg

SEQ ID NO: 868185 - DNA, 15 bp, Homo sapiens
cccatctccctgctt

SEQ ID NO: 868186 - DNA, 17 bp, Homo sapiens
cccatctccctgctttg

SEQ ID NO: 868187 - DNA, 18 bp, Homo sapiens
cccatctccttacctctg

SEQ ID NO: 868188 - DNA, 23 bp, Homo sapiens
cccatctccttacctctggaacc

SEQ ID NO: 868189 - DNA, 12 bp, Homo sapiens
cccatctctccc

SEQ ID NO: 868190 - DNA, 19 bp, Homo sapiens
cccatctctcccacttcct

SEQ ID NO: 868191 - DNA, 21 bp, Homo sapiens
cccatctctccctcccctgcc

SEQ ID NO: 868192 - DNA, 11 bp, Homo sapiens
cccatctctgt

SEQ ID NO: 868193 - DNA, 19 bp, Homo sapiens
ccccagaccaaccctggga

SEQ ID NO: 868194 - DNA, 20 bp, Homo sapiens
ccccagaccaaccctgggac

SEQ ID NO: 868195 - DNA, 17 bp, Homo sapiens
ccccagacgcatagact

SEQ ID NO: 868196 - DNA, 15 bp, Homo sapiens
ccccagactagatgt

SEQ ID NO: 868197 - DNA, 19 bp, Homo sapiens
ccccagactcagctccaga

SEQ ID NO: 868198 - DNA, 21 bp, Homo sapiens
ccccagactgggcccaggcag

SEQ ID NO: 868199 - DNA, 23 bp, Homo sapiens
ccccagactgggcccaggcaggt

SEQ ID NO: 868200 - DNA, 15 bp, Homo sapiens
ccccagactgtagag

SEQ ID NO: 868201 - DNA, 16 bp, Homo sapiens
ccccagactgtagaga

SEQ ID NO: 868202 - DNA, 23 bp, Homo sapiens
ccccagagagaccctgcaagacc

SEQ ID NO: 868203 - DNA, 20 bp, Homo sapiens
ccccagagagcaggcagggg

SEQ ID NO: 868204 - DNA, 22 bp, Homo sapiens
ccccagagagcaggcaggggca

SEQ ID NO: 868205 - DNA, 18 bp, Homo sapiens
ccccagagaggcactcag

SEQ ID NO: 868206 - DNA, 13 bp, Homo sapiens
ccccagagcactg

SEQ ID NO: 868207 - DNA, 11 bp, Homo sapiens
ccccagagcca

SEQ ID NO: 868208 - DNA, 14 bp, Homo sapiens
ccccagagccaggg

SEQ ID NO: 868209 - DNA, 17 bp, Homo sapiens
ccccagagccagggctg

SEQ ID NO: 868210 - DNA, 13 bp, Homo sapiens
ccccagagcccag

SEQ ID NO: 868211 - DNA, 17 bp, Homo sapiens
ccccagagcccagctct

SEQ ID NO: 868212 - DNA, 21 bp, Homo sapiens
ccccagagctgtttatggcct

SEQ ID NO: 868213 - DNA, 23 bp, Homo sapiens
ccccagagctgtttatggcctca

SEQ ID NO: 868214 - DNA, 15 bp, Homo sapiens
ccccagaggccttgt

SEQ ID NO: 868215 - DNA, 17 bp, Homo sapiens
ccccagaggctcccaat

SEQ ID NO: 868216 - DNA, 13 bp, Homo sapiens
ccccagaggtggc

SEQ ID NO: 868217 - DNA, 16 bp, Homo sapiens
ccccagaggtggccct

SEQ ID NO: 868218 - DNA, 18 bp, Homo sapiens
ccccagaggtggcccttg

SEQ ID NO: 868219 - DNA, 21 bp, Homo sapiens
ccccagagtgggatccacttc

SEQ ID NO: 868220 - DNA, 16 bp, Homo sapiens
ccccagatagagctgg

SEQ ID NO: 868221 - DNA, 20 bp, Homo sapiens
ccccagatagagctgggtgg

SEQ ID NO: 868222 - DNA, 23 bp, Homo sapiens
ccccagatagagctgggtggcct

SEQ ID NO: 868223 - DNA, 22 bp, Homo sapiens
ccccagatctcccactgcgggg

SEQ ID NO: 868224 - DNA, 15 bp, Homo sapiens
ccccagatctgcctg

SEQ ID NO: 868225 - DNA, 17 bp, Homo sapiens
ccccagatctgcctggg

SEQ ID NO: 868226 - DNA, 22 bp, Homo sapiens
ccccagatctgcctgggcctgt

SEQ ID NO: 868227 - DNA, 17 bp, Homo sapiens
ccccagcacagccacct

SEQ ID NO: 868228 - DNA, 18 bp, Homo sapiens
ccccagcacagccacctc

SEQ ID NO: 868229 - DNA, 22 bp, Homo sapiens
ccccagcactaaggccgtgtct

SEQ ID NO: 868230 - DNA, 11 bp, Homo sapiens
ccccagcactt

SEQ ID NO: 868231 - DNA, 22 bp, Homo sapiens
ccccagcagaatggaggcaggg

SEQ ID NO: 868232 - DNA, 20 bp, Homo sapiens
ccccagcagaggcaggctgg

SEQ ID NO: 868233 - DNA, 19 bp, Homo sapiens
ccccagcagtttctgtcct

SEQ ID NO: 868234 - DNA, 18 bp, Homo sapiens
ccccagcatcgggggcct

SEQ ID NO: 868235 - DNA, 16 bp, Homo sapiens
ccccagccagcccttc

SEQ ID NO: 868236 - DNA, 23 bp, Homo sapiens
ccccagccagcccttccctggcc

SEQ ID NO: 868237 - DNA, 11 bp, Homo sapiens
ccccagccagg

SEQ ID NO: 868238 - DNA, 15 bp, Homo sapiens
ccccagccaggctat

SEQ ID NO: 868239 - DNA, 14 bp, Homo sapiens
ccccagcccaaagg

SEQ ID NO: 868240 - DNA, 12 bp, Homo sapiens
ccccagcccaga

SEQ ID NO: 868241 - DNA, 18 bp, Homo sapiens
ccccagcccccagggccc

SEQ ID NO: 868242 - DNA, 14 bp, Homo sapiens
ccccagccccttct

SEQ ID NO: 868243 - DNA, 11 bp, Homo sapiens
ccccagccctc

SEQ ID NO: 868244 - DNA, 19 bp, Homo sapiens
ccccagccctccttatcaa

SEQ ID NO: 868245 - DNA, 12 bp, Homo sapiens
ccccagccctgg

SEQ ID NO: 868246 - DNA, 13 bp, Homo sapiens
ccccagccctggc

SEQ ID NO: 868247 - DNA, 19 bp, Homo sapiens
ccccagccctggctctgca

SEQ ID NO: 868248 - DNA, 14 bp, Homo sapiens
ccccagccctgggc

SEQ ID NO: 868249 - DNA, 13 bp, Homo sapiens
ccccagccctgtg

SEQ ID NO: 868250 - DNA, 11 bp, Homo sapiens
ccccagccctt

SEQ ID NO: 868251 - DNA, 17 bp, Homo sapiens
ccccagcccttctgcct

SEQ ID NO: 868252 - DNA, 16 bp, Homo sapiens
ccccagcctaggacgc

SEQ ID NO: 868253 - DNA, 14 bp, Homo sapiens
ccccagcctatgag

SEQ ID NO: 868254 - DNA, 22 bp, Homo sapiens
ccccagcctatgagcatcctga

SEQ ID NO: 868255 - DNA, 14 bp, Homo sapiens
ccccagcctcagcc

SEQ ID NO: 868256 - DNA, 12 bp, Homo sapiens
ccccagcctcca

SEQ ID NO: 868257 - DNA, 15 bp, Homo sapiens
ccccagcctccaggc

SEQ ID NO: 868258 - DNA, 14 bp, Homo sapiens
ccccagcctctggc

SEQ ID NO: 868259 - DNA, 15 bp, Homo sapiens
ccccagcctctggca

SEQ ID NO: 868260 - DNA, 20 bp, Homo sapiens
ccccagcctgacctgagact

SEQ ID NO: 868261 - DNA, 12 bp, Homo sapiens
ccccagcctggc

SEQ ID NO: 868262 - DNA, 13 bp, Homo sapiens
ccccagcctggcc

SEQ ID NO: 868263 - DNA, 15 bp, Homo sapiens
ccccagcctggccag

SEQ ID NO: 868264 - DNA, 14 bp, Homo sapiens
ccccagcctgggcc

SEQ ID NO: 868265 - DNA, 15 bp, Homo sapiens
ccccagcctgggccc

SEQ ID NO: 868266 - DNA, 23 bp, Homo sapiens
ccccagcggctgttccccctgcc

SEQ ID NO: 868267 - DNA, 16 bp, Homo sapiens
ccccagcgtcagtttc

SEQ ID NO: 868268 - DNA, 14 bp, Homo sapiens
ccccagctcaatgg

SEQ ID NO: 868269 - DNA, 14 bp, Homo sapiens
ccccagctcccttg

SEQ ID NO: 868270 - DNA, 17 bp, Homo sapiens
ccccagctcccttggga

SEQ ID NO: 868271 - DNA, 11 bp, Homo sapiens
ccccagctccg

SEQ ID NO: 868272 - DNA, 19 bp, Homo sapiens
ccccagctccgacctctct

SEQ ID NO: 868273 - DNA, 15 bp, Homo sapiens
ccccagctccttggc

SEQ ID NO: 868274 - DNA, 22 bp, Homo sapiens
ccccagctccttggctgcagcc

SEQ ID NO: 868275 - DNA, 22 bp, Homo sapiens
ccccagctctaagcagccagga

SEQ ID NO: 868276 - DNA, 24 bp, Homo sapiens
ccccagctctaagcagccaggagg

SEQ ID NO: 868277 - DNA, 17 bp, Homo sapiens
ccccagctctggcttcc

SEQ ID NO: 868278 - DNA, 14 bp, Homo sapiens
ccccagctctggtg

SEQ ID NO: 868279 - DNA, 10 bp, Homo sapiens
ccccagctga

SEQ ID NO: 868280 - DNA, 12 bp, Homo sapiens
ccccagctgcca

SEQ ID NO: 868281 - DNA, 13 bp, Homo sapiens
ccccagctgccag

SEQ ID NO: 868282 - DNA, 14 bp, Homo sapiens
ccccagctgccagg

SEQ ID NO: 868283 - DNA, 22 bp, Homo sapiens
ccccagctgccaggcggccctg

SEQ ID NO: 868284 - DNA, 13 bp, Homo sapiens
ccccagctgggag

SEQ ID NO: 868285 - DNA, 14 bp, Homo sapiens
ccccagctgggagg

SEQ ID NO: 868286 - DNA, 22 bp, Homo sapiens
ccccagctgggaggcaagaggg

SEQ ID NO: 868287 - DNA, 22 bp, Homo sapiens
ccccagcttctctctccctgtc

SEQ ID NO: 868288 - DNA, 19 bp, Homo sapiens
ccccaggacccctgtccag

SEQ ID NO: 868289 - DNA, 21 bp, Homo sapiens
ccccaggacccctgtccagga

SEQ ID NO: 868290 - DNA, 15 bp, Homo sapiens
ccccaggactctggc

SEQ ID NO: 868291 - DNA, 18 bp, Homo sapiens
ccccaggcactgtttgga

SEQ ID NO: 868292 - DNA, 14 bp, Homo sapiens
ccccaggcagaggg

SEQ ID NO: 868293 - DNA, 11 bp, Homo sapiens
ccccaggcagc

SEQ ID NO: 868294 - DNA, 12 bp, Homo sapiens
ccccaggcagcc

SEQ ID NO: 868295 - DNA, 13 bp, Homo sapiens
ccccaggcagcca

SEQ ID NO: 868296 - DNA, 19 bp, Homo sapiens
ccccaggcagccaccagtg

SEQ ID NO: 868297 - DNA, 22 bp, Homo sapiens
ccccaggcatctgttagcagag

SEQ ID NO: 868298 - DNA, 23 bp, Homo sapiens
ccccaggcatctgttagcagagt

SEQ ID NO: 868299 - DNA, 12 bp, Homo sapiens
ccccaggccagg

SEQ ID NO: 868300 - DNA, 16 bp, Homo sapiens
ccccaggccaggtagc

SEQ ID NO: 868301 - DNA, 11 bp, Homo sapiens
ccccaggccca

SEQ ID NO: 868302 - DNA, 16 bp, Homo sapiens
ccccaggcccagccct

SEQ ID NO: 868303 - DNA, 17 bp, Homo sapiens
ccccaggcccagccctc

SEQ ID NO: 868304 - DNA, 19 bp, Homo sapiens
ccccaggcccagccctcct

SEQ ID NO: 868305 - DNA, 21 bp, Homo sapiens
ccccaggcccgcgggcacagc

SEQ ID NO: 868306 - DNA, 22 bp, Homo sapiens
ccccaggccctactacccattg

SEQ ID NO: 868307 - DNA, 16 bp, Homo sapiens
ccccaggccctcccac

SEQ ID NO: 868308 - DNA, 17 bp, Homo sapiens
ccccaggccctcccacc

SEQ ID NO: 868309 - DNA, 15 bp, Homo sapiens
ccccaggccctccct

SEQ ID NO: 868310 - DNA, 16 bp, Homo sapiens
ccccaggccctccctg

SEQ ID NO: 868311 - DNA, 18 bp, Homo sapiens
ccccaggccggagcccag

SEQ ID NO: 868312 - DNA, 17 bp, Homo sapiens
ccccaggcctccagcct

SEQ ID NO: 868313 - DNA, 18 bp, Homo sapiens
ccccaggcctccagcctc

SEQ ID NO: 868314 - DNA, 14 bp, Homo sapiens
ccccaggcctccta

SEQ ID NO: 868315 - DNA, 21 bp, Homo sapiens
ccccaggcctcctaggggaag

SEQ ID NO: 868316 - DNA, 21 bp, Homo sapiens
ccccaggcctgaaagaggctg

SEQ ID NO: 868317 - DNA, 18 bp, Homo sapiens
ccccaggcctggacgggc

SEQ ID NO: 868318 - DNA, 13 bp, Homo sapiens
ccccaggcctggc

SEQ ID NO: 868319 - DNA, 15 bp, Homo sapiens
ccccaggctggagac

SEQ ID NO: 868320 - DNA, 19 bp, Homo sapiens
ccccaggctggagtgcagt

SEQ ID NO: 868321 - DNA, 15 bp, Homo sapiens
cccctacccctgccc

SEQ ID NO: 868322 - DNA, 19 bp, Homo sapiens
cccctaccgatggtcccag

SEQ ID NO: 868323 - DNA, 14 bp, Homo sapiens
cccctactgctgtg

SEQ ID NO: 868324 - DNA, 18 bp, Homo sapiens
cccctagaaacccaagct

SEQ ID NO: 868325 - DNA, 21 bp, Homo sapiens
cccctagaaacccaagctcct

SEQ ID NO: 868326 - DNA, 19 bp, Homo sapiens
cccctagaataatctcatc

SEQ ID NO: 868327 - DNA, 23 bp, Homo sapiens
cccctagaataatctcatccccc

SEQ ID NO: 868328 - DNA, 20 bp, Homo sapiens
cccctaggatgctgcagcag

SEQ ID NO: 868329 - DNA, 19 bp, Homo sapiens
cccctatccacccagccca

SEQ ID NO: 868330 - DNA, 17 bp, Homo sapiens
cccctatcttgtcctgg

SEQ ID NO: 868331 - DNA, 19 bp, Homo sapiens
cccctatcttgtcctggaa

SEQ ID NO: 868332 - DNA, 13 bp, Homo sapiens
cccctcaacaccc

SEQ ID NO: 868333 - DNA, 17 bp, Homo sapiens
cccctcaacaccctgct

SEQ ID NO: 868334 - DNA, 12 bp, Homo sapiens
cccctcaacctc

SEQ ID NO: 868335 - DNA, 12 bp, Homo sapiens
cccctcaccacc

SEQ ID NO: 868336 - DNA, 14 bp, Homo sapiens
cccctcaccacccc

SEQ ID NO: 868337 - DNA, 15 bp, Homo sapiens
cccctcaccccagct

SEQ ID NO: 868338 - DNA, 11 bp, Homo sapiens
cccctcaccct

SEQ ID NO: 868339 - DNA, 13 bp, Homo sapiens
cccctcaccttgc

SEQ ID NO: 868340 - DNA, 12 bp, Homo sapiens
cccctcactctg

SEQ ID NO: 868341 - DNA, 21 bp, Homo sapiens
cccctcactctgtcagccagc

SEQ ID NO: 868342 - DNA, 16 bp, Homo sapiens
cccctcagagcccatg

SEQ ID NO: 868343 - DNA, 22 bp, Homo sapiens
cccctcagattttatattttct

SEQ ID NO: 868344 - DNA, 13 bp, Homo sapiens
cccctcagccctt

SEQ ID NO: 868345 - DNA, 17 bp, Homo sapiens
cccctcagcccttgccc

SEQ ID NO: 868346 - DNA, 16 bp, Homo sapiens
cccctcagcctcttct

SEQ ID NO: 868347 - DNA, 12 bp, Homo sapiens
cccctcagcctg

SEQ ID NO: 868348 - DNA, 21 bp, Homo sapiens
cccctcagcctgcccacctct

SEQ ID NO: 868349 - DNA, 23 bp, Homo sapiens
cccctcagcgcaggctgcagagc

SEQ ID NO: 868350 - DNA, 19 bp, Homo sapiens
cccctcagggggccagctg

SEQ ID NO: 868351 - DNA, 22 bp, Homo sapiens
cccctcagggggccagctgggg

SEQ ID NO: 868352 - DNA, 23 bp, Homo sapiens
cccctcagggggccagctgggga

SEQ ID NO: 868353 - DNA, 17 bp, Homo sapiens
cccctccaaacctccag

SEQ ID NO: 868354 - DNA, 18 bp, Homo sapiens
cccctccaaacctccagc

SEQ ID NO: 868355 - DNA, 20 bp, Homo sapiens
cccctccaaacctccagcct

SEQ ID NO: 868356 - DNA, 18 bp, Homo sapiens
cccctccacagctgcagc

SEQ ID NO: 868357 - DNA, 12 bp, Homo sapiens
cccctccactgt

SEQ ID NO: 868358 - DNA, 14 bp, Homo sapiens
cccctccactgtca

SEQ ID NO: 868359 - DNA, 23 bp, Homo sapiens
cccctccagaccctgcctgagcc

SEQ ID NO: 868360 - DNA, 21 bp, Homo sapiens
cccctcccaagcgttcctggc

SEQ ID NO: 868361 - DNA, 11 bp, Homo sapiens
cccctcccacc

SEQ ID NO: 868362 - DNA, 12 bp, Homo sapiens
cccctcccacca

SEQ ID NO: 868363 - DNA, 13 bp, Homo sapiens
cccctcccacctc

SEQ ID NO: 868364 - DNA, 12 bp, Homo sapiens
cccctcccaggg

SEQ ID NO: 868365 - DNA, 19 bp, Homo sapiens
cccctcccaggggagccag

SEQ ID NO: 868366 - DNA, 12 bp, Homo sapiens
cccctccccact

SEQ ID NO: 868367 - DNA, 12 bp, Homo sapiens
cccctccccagc

SEQ ID NO: 868368 - DNA, 13 bp, Homo sapiens
cccctccccagcc

SEQ ID NO: 868369 - DNA, 16 bp, Homo sapiens
cccctccccagccagc

SEQ ID NO: 868370 - DNA, 19 bp, Homo sapiens
cccctccccagctcccttg

SEQ ID NO: 868371 - DNA, 21 bp, Homo sapiens
cccctcccccaacccccaccc

SEQ ID NO: 868372 - DNA, 17 bp, Homo sapiens
cccctcccccactcctc

SEQ ID NO: 868373 - DNA, 13 bp, Homo sapiens
cccctcccccagc

SEQ ID NO: 868374 - DNA, 15 bp, Homo sapiens
cccctcccccagctg

SEQ ID NO: 868375 - DNA, 15 bp, Homo sapiens
cccctccccccactt

SEQ ID NO: 868376 - DNA, 17 bp, Homo sapiens
cccctccccccagactc

SEQ ID NO: 868377 - DNA, 18 bp, Homo sapiens
cccctccccccagactct

SEQ ID NO: 868378 - DNA, 20 bp, Homo sapiens
cccctccccctgagattcag

SEQ ID NO: 868379 - DNA, 14 bp, Homo sapiens
cccctcccccttct

SEQ ID NO: 868380 - DNA, 13 bp, Homo sapiens
cccctcccctcag

SEQ ID NO: 868381 - DNA, 14 bp, Homo sapiens
cccctcccctcagc

SEQ ID NO: 868382 - DNA, 15 bp, Homo sapiens
cccctcccctcagcc

SEQ ID NO: 868383 - DNA, 19 bp, Homo sapiens
cccctcccctggggacgcc

SEQ ID NO: 868384 - DNA, 14 bp, Homo sapiens
cccctccctaccct

SEQ ID NO: 868385 - DNA, 10 bp, Homo sapiens
cccctccctc

SEQ ID NO: 868386 - DNA, 14 bp, Homo sapiens
cccctccctcaggg

SEQ ID NO: 868387 - DNA, 12 bp, Homo sapiens
cccctccctccc

SEQ ID NO: 868388 - DNA, 17 bp, Homo sapiens
cccctccctcttctgcc

SEQ ID NO: 868389 - DNA, 20 bp, Homo sapiens
cccctccctgcccaaactcc

SEQ ID NO: 868390 - DNA, 16 bp, Homo sapiens
cccctccctgcctgct

SEQ ID NO: 868391 - DNA, 15 bp, Homo sapiens
cccctccctggctcc

SEQ ID NO: 868392 - DNA, 12 bp, Homo sapiens
cccctcccttgc

SEQ ID NO: 868393 - DNA, 18 bp, Homo sapiens
cccctccgccgtgccggc

SEQ ID NO: 868394 - DNA, 13 bp, Homo sapiens
cccctccgcctcc

SEQ ID NO: 868395 - DNA, 13 bp, Homo sapiens
cccctcctccagc

SEQ ID NO: 868396 - DNA, 22 bp, Homo sapiens
cccctcctccagcccctgtccc

SEQ ID NO: 868397 - DNA, 18 bp, Homo sapiens
cccctcctccccctttgg

SEQ ID NO: 868398 - DNA, 21 bp, Homo sapiens
cccctcctctagctgtggggg

SEQ ID NO: 868399 - DNA, 13 bp, Homo sapiens
cccctcctctccc

SEQ ID NO: 868400 - DNA, 15 bp, Homo sapiens
cccctcctctcccat

SEQ ID NO: 868401 - DNA, 11 bp, Homo sapiens
cccctcctctg

SEQ ID NO: 868402 - DNA, 14 bp, Homo sapiens
cccctcctctgcca

SEQ ID NO: 868403 - DNA, 15 bp, Homo sapiens
cccctcctcttccct

SEQ ID NO: 868404 - DNA, 16 bp, Homo sapiens
cccctcctcttccgag

SEQ ID NO: 868405 - DNA, 13 bp, Homo sapiens
cccctcctgctcc

SEQ ID NO: 868406 - DNA, 18 bp, Homo sapiens
cccctcctgctcctccct

SEQ ID NO: 868407 - DNA, 12 bp, Homo sapiens
cccctccttgca

SEQ ID NO: 868408 - DNA, 21 bp, Homo sapiens
cccctccttgcaaccaggcag

SEQ ID NO: 868409 - DNA, 16 bp, Homo sapiens
cccctcgactcagcac

SEQ ID NO: 868410 - DNA, 17 bp, Homo sapiens
cccctcgactcagcacc

SEQ ID NO: 868411 - DNA, 13 bp, Homo sapiens
cccctcgaggcct

SEQ ID NO: 868412 - DNA, 16 bp, Homo sapiens
cccctcgaggcctaca

SEQ ID NO: 868413 - DNA, 17 bp, Homo sapiens
cccctcgaggcctacag

SEQ ID NO: 868414 - DNA, 17 bp, Homo sapiens
cccctcgcaaccctgcc

SEQ ID NO: 868415 - DNA, 16 bp, Homo sapiens
cccctcgcacacaggg

SEQ ID NO: 868416 - DNA, 13 bp, Homo sapiens
cccctcgccagct

SEQ ID NO: 868417 - DNA, 16 bp, Homo sapiens
cccctcgccagcttgg

SEQ ID NO: 868418 - DNA, 14 bp, Homo sapiens
cccctcgctgctgc

SEQ ID NO: 868419 - DNA, 15 bp, Homo sapiens
cccctcggagcctgt

SEQ ID NO: 868420 - DNA, 18 bp, Homo sapiens
cccctcgggggcctgtgg

SEQ ID NO: 868421 - DNA, 20 bp, Homo sapiens
cccctcggggtgtcagaaat

SEQ ID NO: 868422 - DNA, 17 bp, Homo sapiens
cccctcgtcctgtccca

SEQ ID NO: 868423 - DNA, 18 bp, Homo sapiens
cccctcgtgcgcatctca

SEQ ID NO: 868424 - DNA, 23 bp, Homo sapiens
cccctcgtgtgactctcttggat

SEQ ID NO: 868425 - DNA, 22 bp, Homo sapiens
cccctctcagaacatactgatt

SEQ ID NO: 868426 - DNA, 13 bp, Homo sapiens
cccctctcccctc

SEQ ID NO: 868427 - DNA, 21 bp, Homo sapiens
cccctgtcccacctggctccc

SEQ ID NO: 868428 - DNA, 18 bp, Homo sapiens
cccctgtcccatgcaggc

SEQ ID NO: 868429 - DNA, 15 bp, Homo sapiens
cccctgtcccattct

SEQ ID NO: 868430 - DNA, 13 bp, Homo sapiens
cccctgtccccag

SEQ ID NO: 868431 - DNA, 16 bp, Homo sapiens
cccctgtccccagtcc

SEQ ID NO: 868432 - DNA, 12 bp, Homo sapiens
cccctgtcctga

SEQ ID NO: 868433 - DNA, 23 bp, Homo sapiens
cccctgtcgcccacccagctggt

SEQ ID NO: 868434 - DNA, 12 bp, Homo sapiens
cccctgtggcca

SEQ ID NO: 868435 - DNA, 14 bp, Homo sapiens
cccctgtggccaac

SEQ ID NO: 868436 - DNA, 24 bp, Homo sapiens
cccctgtggggatctcaggggctg

SEQ ID NO: 868437 - DNA, 19 bp, Homo sapiens
cccctgtggtaactttgca

SEQ ID NO: 868438 - DNA, 22 bp, Homo sapiens
cccctgtggtaactttgcaggc

SEQ ID NO: 868439 - DNA, 15 bp, Homo sapiens
cccctgttcactcta

SEQ ID NO: 868440 - DNA, 14 bp, Homo sapiens
cccctgttcatgcc

SEQ ID NO: 868441 - DNA, 23 bp, Homo sapiens
cccctgttgaggtgggtgggcct

SEQ ID NO: 868442 - DNA, 22 bp, Homo sapiens
ccccttaagggttgaaggcagt

SEQ ID NO: 868443 - DNA, 23 bp, Homo sapiens
ccccttaagggttgaaggcagtc

SEQ ID NO: 868444 - DNA, 21 bp, Homo sapiens
ccccttaatcttgctttcttt

SEQ ID NO: 868445 - DNA, 19 bp, Homo sapiens
ccccttattgctgccaaaa

SEQ ID NO: 868446 - DNA, 13 bp, Homo sapiens
ccccttcagtgcc

SEQ ID NO: 868447 - DNA, 22 bp, Homo sapiens
ccccttccagatcactgccaca

SEQ ID NO: 868448 - DNA, 13 bp, Homo sapiens
ccccttccatgtg

SEQ ID NO: 868449 - DNA, 21 bp, Homo sapiens
ccccttccccactgcctgccc

SEQ ID NO: 868450 - DNA, 15 bp, Homo sapiens
cccccaacctcaggg

SEQ ID NO: 868451 - DNA, 13 bp, Homo sapiens
cccccaagcctgg

SEQ ID NO: 868452 - DNA, 17 bp, Homo sapiens
cccccaagcctgggctt

SEQ ID NO: 868453 - DNA, 19 bp, Homo sapiens
cccccaagctgttttcttc

SEQ ID NO: 868454 - DNA, 18 bp, Homo sapiens
cccccaaggttttggagt

SEQ ID NO: 868455 - DNA, 12 bp, Homo sapiens
cccccaataaag

SEQ ID NO: 868456 - DNA, 13 bp, Homo sapiens
cccccaataaagg

SEQ ID NO: 868457 - DNA, 17 bp, Homo sapiens
cccccacaaggaaccct

SEQ ID NO: 868458 - DNA, 12 bp, Homo sapiens
cccccacccacc

SEQ ID NO: 868459 - DNA, 14 bp, Homo sapiens
cccccacccccagc

SEQ ID NO: 868460 - DNA, 15 bp, Homo sapiens
cccccaccccttccc

SEQ ID NO: 868461 - DNA, 19 bp, Homo sapiens
cccccaccggaactgggct

SEQ ID NO: 868462 - DNA, 20 bp, Homo sapiens
cccccaccggaactgggctg

SEQ ID NO: 868463 - DNA, 16 bp, Homo sapiens
cccccaccggtccagc

SEQ ID NO: 868464 - DNA, 13 bp, Homo sapiens
cccccacctgaca

SEQ ID NO: 868465 - DNA, 14 bp, Homo sapiens
cccccaccttgatc

SEQ ID NO: 868466 - DNA, 21 bp, Homo sapiens
cccccaccttggtccctctca

SEQ ID NO: 868467 - DNA, 12 bp, Homo sapiens
cccccactcagt

SEQ ID NO: 868468 - DNA, 14 bp, Homo sapiens
cccccactccagct

SEQ ID NO: 868469 - DNA, 18 bp, Homo sapiens
cccccactcccccttccc

SEQ ID NO: 868470 - DNA, 20 bp, Homo sapiens
cccccacttagtgctggtcc

SEQ ID NO: 868471 - DNA, 22 bp, Homo sapiens
cccccacttgcctcttccttga

SEQ ID NO: 868472 - DNA, 22 bp, Homo sapiens
cccccagaaaagaaagctacag

SEQ ID NO: 868473 - DNA, 12 bp, Homo sapiens
cccccagaaagc

SEQ ID NO: 868474 - DNA, 15 bp, Homo sapiens
cccccagaaagcctc

SEQ ID NO: 868475 - DNA, 19 bp, Homo sapiens
cccccagaaagcctcctgc

SEQ ID NO: 868476 - DNA, 20 bp, Homo sapiens
cccccagaaagcctcctgcc

SEQ ID NO: 868477 - DNA, 21 bp, Homo sapiens
cccccagaaagcctcctgccc

SEQ ID NO: 868478 - DNA, 20 bp, Homo sapiens
cccccagaaagctgccagag

SEQ ID NO: 868479 - DNA, 23 bp, Homo sapiens
cccccagaccccgcccctgggga

SEQ ID NO: 868480 - DNA, 23 bp, Homo sapiens
cccccagagcacccccaagcctg

SEQ ID NO: 868481 - DNA, 19 bp, Homo sapiens
cccccagagccagggctgt

SEQ ID NO: 868482 - DNA, 16 bp, Homo sapiens
cccccagaggtggccc

SEQ ID NO: 868483 - DNA, 18 bp, Homo sapiens
cccccagaggtggccctt

SEQ ID NO: 868484 - DNA, 20 bp, Homo sapiens
cccccagatagagctgggtg

SEQ ID NO: 868485 - DNA, 15 bp, Homo sapiens
cccccagcagaggca

SEQ ID NO: 868486 - DNA, 22 bp, Homo sapiens
cccccagcagaggcaggctggg

SEQ ID NO: 868487 - DNA, 22 bp, Homo sapiens
cccccagcatcgggggcctgca

SEQ ID NO: 868488 - DNA, 11 bp, Homo sapiens
cccccagccag

SEQ ID NO: 868489 - DNA, 15 bp, Homo sapiens
cccccagccaggcta

SEQ ID NO: 868490 - DNA, 19 bp, Homo sapiens
cccccagccatgccagctg

SEQ ID NO: 868491 - DNA, 23 bp, Homo sapiens
cccccagccatgccagctggcct

SEQ ID NO: 868492 - DNA, 12 bp, Homo sapiens
cccccagcccaa

SEQ ID NO: 868493 - DNA, 13 bp, Homo sapiens
cccccagcccagg

SEQ ID NO: 868494 - DNA, 24 bp, Homo sapiens
cccccagccccgactccagccagc

SEQ ID NO: 868495 - DNA, 12 bp, Homo sapiens
cccccagccctg

SEQ ID NO: 868496 - DNA, 13 bp, Homo sapiens
cccccagccctgt

SEQ ID NO: 868497 - DNA, 12 bp, Homo sapiens
cccccagcctat

SEQ ID NO: 868498 - DNA, 20 bp, Homo sapiens
cccccagcctatgagcatcc

SEQ ID NO: 868499 - DNA, 19 bp, Homo sapiens
cccccagcctccagagaag

SEQ ID NO: 868500 - DNA, 12 bp, Homo sapiens
cccccagcctgg

SEQ ID NO: 868501 - DNA, 15 bp, Homo sapiens
cccccagccttgttt

SEQ ID NO: 868502 - DNA, 12 bp, Homo sapiens
cccccagctcct

SEQ ID NO: 868503 - DNA, 22 bp, Homo sapiens
cccccagctctaagcagccagg

SEQ ID NO: 868504 - DNA, 15 bp, Homo sapiens
cccccagcttctctc

SEQ ID NO: 868505 - DNA, 16 bp, Homo sapiens
cccccaggatctgggt

SEQ ID NO: 868506 - DNA, 12 bp, Homo sapiens
cccccaggccct

SEQ ID NO: 868507 - DNA, 18 bp, Homo sapiens
cccccaggccctcccacc

SEQ ID NO: 868508 - DNA, 17 bp, Homo sapiens
cccccagggcctccagg

SEQ ID NO: 868509 - DNA, 21 bp, Homo sapiens
cccccagggcctccagggccc

SEQ ID NO: 868510 - DNA, 13 bp, Homo sapiens
cccccagttccta

SEQ ID NO: 868511 - DNA, 14 bp, Homo sapiens
cccccatcccaggg

SEQ ID NO: 868512 - DNA, 15 bp, Homo sapiens
cccccatcccagggt

SEQ ID NO: 868513 - DNA, 16 bp, Homo sapiens
cccccatcccagggtc

SEQ ID NO: 868514 - DNA, 22 bp, Homo sapiens
cccccatccccatcctccagct

SEQ ID NO: 868515 - DNA, 18 bp, Homo sapiens
cccccatccctaccactg

SEQ ID NO: 868516 - DNA, 19 bp, Homo sapiens
cccccatcctccccttccc

SEQ ID NO: 868517 - DNA, 19 bp, Homo sapiens
cccccatctccccaggcct

SEQ ID NO: 868518 - DNA, 13 bp, Homo sapiens
cccccatctctga

SEQ ID NO: 868519 - DNA, 14 bp, Homo sapiens
cccccatctctgag

SEQ ID NO: 868520 - DNA, 19 bp, Homo sapiens
cccccatctgtcttcagca

SEQ ID NO: 868521 - DNA, 19 bp, Homo sapiens
cccccatgctgccttcagg

SEQ ID NO: 868522 - DNA, 20 bp, Homo sapiens
cccccatgtggcagcccatg

SEQ ID NO: 868523 - DNA, 13 bp, Homo sapiens
cccccatgtggct

SEQ ID NO: 868524 - DNA, 22 bp, Homo sapiens
cccccatgttgtaatgctgcac

SEQ ID NO: 868525 - DNA, 17 bp, Homo sapiens
cccccattctcatctgc

SEQ ID NO: 868526 - DNA, 19 bp, Homo sapiens
cccccattctcccagtctc

SEQ ID NO: 868527 - DNA, 15 bp, Homo sapiens
ccccccaaagtgctg

SEQ ID NO: 868528 - DNA, 17 bp, Homo sapiens
ccccccacacttccctg

SEQ ID NO: 868529 - DNA, 12 bp, Homo sapiens
ccccccacccac

SEQ ID NO: 868530 - DNA, 12 bp, Homo sapiens
ccccccaccgct

SEQ ID NO: 868531 - DNA, 13 bp, Homo sapiens
ccccccagcctct

SEQ ID NO: 868532 - DNA, 12 bp, Homo sapiens
ccccccagcctg

SEQ ID NO: 868533 - DNA, 13 bp, Homo sapiens
cccccccacccac

SEQ ID NO: 868534 - DNA, 13 bp, Homo sapiens
cccccccagcctg

SEQ ID NO: 868535 - DNA, 12 bp, Homo sapiens
cccccccttcca

SEQ ID NO: 868536 - DNA, 13 bp, Homo sapiens
cccccctctcctc

SEQ ID NO: 868537 - DNA, 12 bp, Homo sapiens
cccccctgctgc

SEQ ID NO: 868538 - DNA, 19 bp, Homo sapiens
cccccctgctgcccagtgc

SEQ ID NO: 868539 - DNA, 20 bp, Homo sapiens
ccccccttgaatctgcaggg

SEQ ID NO: 868540 - DNA, 11 bp, Homo sapiens
cccccctttgg

SEQ ID NO: 868541 - DNA, 16 bp, Homo sapiens
cccccgacactgctgc

SEQ ID NO: 868542 - DNA, 19 bp, Homo sapiens
cccccgaccaatccccagc

SEQ ID NO: 868543 - DNA, 16 bp, Homo sapiens
cccccgactgcctgtc

SEQ ID NO: 868544 - DNA, 13 bp, Homo sapiens
cccccgagccctg

SEQ ID NO: 868545 - DNA, 23 bp, Homo sapiens
cccccgagccctgactcctggac

SEQ ID NO: 868546 - DNA, 14 bp, Homo sapiens
cccccgcacagcca

SEQ ID NO: 868547 - DNA, 17 bp, Homo sapiens
cccccgcaccaagcaga

SEQ ID NO: 868548 - DNA, 13 bp, Homo sapiens
cccccgcagaggc

SEQ ID NO: 868549 - DNA, 22 bp, Homo sapiens
cccccgcagtccccagcccttc

SEQ ID NO: 868550 - DNA, 15 bp, Homo sapiens
cccccgccacggcca

SEQ ID NO: 868551 - DNA, 12 bp, Homo sapiens
cccccgccactc

SEQ ID NO: 868552 - DNA, 12 bp, Homo sapiens
cccccgccccct

SEQ ID NO: 868553 - DNA, 14 bp, Homo sapiens
cccccgccccctgc

SEQ ID NO: 868554 - DNA, 16 bp, Homo sapiens
cccccgccccctgccc

SEQ ID NO: 868555 - DNA, 18 bp, Homo sapiens
cccccgccccgccccaca

SEQ ID NO: 868556 - DNA, 23 bp, Homo sapiens
cccccgccccgcccccgccccgc

SEQ ID NO: 868557 - DNA, 14 bp, Homo sapiens
cccccgcctgccac

SEQ ID NO: 868558 - DNA, 21 bp, Homo sapiens
cccccgcgctcgcccagcagg

SEQ ID NO: 868559 - DNA, 13 bp, Homo sapiens
cccccgctggagg

SEQ ID NO: 868560 - DNA, 23 bp, Homo sapiens
cccccgctgtaatgaaacacctt

SEQ ID NO: 868561 - DNA, 22 bp, Homo sapiens
cccccgggcctgcacagatacc

SEQ ID NO: 868562 - DNA, 24 bp, Homo sapiens
cccccgggtttggcgggccaagga

SEQ ID NO: 868563 - DNA, 19 bp, Homo sapiens
ccccctaaacccctgtccc

SEQ ID NO: 868564 - DNA, 19 bp, Homo sapiens
ccccctagaataatctcat

SEQ ID NO: 868565 - DNA, 16 bp, Homo sapiens
ccctgatctctgacct

SEQ ID NO: 868566 - DNA, 16 bp, Homo sapiens
ccctgatgcagcctgt

SEQ ID NO: 868567 - DNA, 16 bp, Homo sapiens
ccctgattgacctgct

SEQ ID NO: 868568 - DNA, 22 bp, Homo sapiens
ccctgattgacctgctccgctg

SEQ ID NO: 868569 - DNA, 14 bp, Homo sapiens
ccctgcaaaaagaa

SEQ ID NO: 868570 - DNA, 21 bp, Homo sapiens
ccctgcaacttctatcctttc

SEQ ID NO: 868571 - DNA, 19 bp, Homo sapiens
ccctgcaagagtggtccta

SEQ ID NO: 868572 - DNA, 14 bp, Homo sapiens
ccctgcaagcccgt

SEQ ID NO: 868573 - DNA, 14 bp, Homo sapiens
ccctgcacaggcac

SEQ ID NO: 868574 - DNA, 15 bp, Homo sapiens
ccctgcaccctccta

SEQ ID NO: 868575 - DNA, 12 bp, Homo sapiens
ccctgcaccctt

SEQ ID NO: 868576 - DNA, 18 bp, Homo sapiens
ccctgcaccgccgcagaa

SEQ ID NO: 868577 - DNA, 20 bp, Homo sapiens
ccctgcaccgccgcagaagc

SEQ ID NO: 868578 - DNA, 22 bp, Homo sapiens
ccctgcaccgccgcagaagcag

SEQ ID NO: 868579 - DNA, 13 bp, Homo sapiens
ccctgcacctgct

SEQ ID NO: 868580 - DNA, 12 bp, Homo sapiens
ccctgcacctgg

SEQ ID NO: 868581 - DNA, 16 bp, Homo sapiens
ccctgcacctggcctg

SEQ ID NO: 868582 - DNA, 13 bp, Homo sapiens
ccctgcacgtcat

SEQ ID NO: 868583 - DNA, 14 bp, Homo sapiens
ccctgcacgtcatg

SEQ ID NO: 868584 - DNA, 15 bp, Homo sapiens
ccctgcacgtcatgg

SEQ ID NO: 868585 - DNA, 19 bp, Homo sapiens
ccctgcactaaagccagcc

SEQ ID NO: 868586 - DNA, 14 bp, Homo sapiens
ccctgcactgtgcc

SEQ ID NO: 868587 - DNA, 15 bp, Homo sapiens
ccctgcactgtgccc

SEQ ID NO: 868588 - DNA, 18 bp, Homo sapiens
ccctgcagacctcaagcc

SEQ ID NO: 868589 - DNA, 21 bp, Homo sapiens
ccctgcagacctcaagccatc

SEQ ID NO: 868590 - DNA, 16 bp, Homo sapiens
ccctgcagagcaataa

SEQ ID NO: 868591 - DNA, 18 bp, Homo sapiens
ccctgcagatgccaccct

SEQ ID NO: 868592 - DNA, 13 bp, Homo sapiens
ccctgcagcacgc

SEQ ID NO: 868593 - DNA, 12 bp, Homo sapiens
ccctgcagccca

SEQ ID NO: 868594 - DNA, 17 bp, Homo sapiens
ccctgcagcccaccaga

SEQ ID NO: 868595 - DNA, 18 bp, Homo sapiens
ccctgcagcccccactca

SEQ ID NO: 868596 - DNA, 18 bp, Homo sapiens
ccctgcaggacttgccac

SEQ ID NO: 868597 - DNA, 16 bp, Homo sapiens
ccctgcaggagcaggg

SEQ ID NO: 868598 - DNA, 22 bp, Homo sapiens
ccctgcaggagcagggcggctg

SEQ ID NO: 868599 - DNA, 16 bp, Homo sapiens
ccctgcaggcacagag

SEQ ID NO: 868600 - DNA, 20 bp, Homo sapiens
ccctgcaggctgcaggaggg

SEQ ID NO: 868601 - DNA, 22 bp, Homo sapiens
ccctgcaggctgcaggagggca

SEQ ID NO: 868602 - DNA, 21 bp, Homo sapiens
ccctgcagtttggccctggag

SEQ ID NO: 868603 - DNA, 23 bp, Homo sapiens
ccctgcagtttggccctggagcc

SEQ ID NO: 868604 - DNA, 24 bp, Homo sapiens
ccctgcagtttggccctggagcca

SEQ ID NO: 868605 - DNA, 13 bp, Homo sapiens
ccctgcataatgt

SEQ ID NO: 868606 - DNA, 12 bp, Homo sapiens
ccctgcatcctg

SEQ ID NO: 868607 - DNA, 18 bp, Homo sapiens
ccctgcatcctgaggcca

SEQ ID NO: 868608 - DNA, 19 bp, Homo sapiens
ccctgcatctgaccagcag

SEQ ID NO: 868609 - DNA, 21 bp, Homo sapiens
ccctgcattttcctcttgtcc

SEQ ID NO: 868610 - DNA, 16 bp, Homo sapiens
ccctgccaatgctcca

SEQ ID NO: 868611 - DNA, 13 bp, Homo sapiens
ccctgccacagcc

SEQ ID NO: 868612 - DNA, 14 bp, Homo sapiens
ccctgccacagcca

SEQ ID NO: 868613 - DNA, 16 bp, Homo sapiens
ccctgccaccgactgc

SEQ ID NO: 868614 - DNA, 19 bp, Homo sapiens
ccctgccaccgactgccca

SEQ ID NO: 868615 - DNA, 20 bp, Homo sapiens
ccctgccaccgactgcccag

SEQ ID NO: 868616 - DNA, 13 bp, Homo sapiens
ccctgccactcac

SEQ ID NO: 868617 - DNA, 16 bp, Homo sapiens
ccctgccactgggctc

SEQ ID NO: 868618 - DNA, 17 bp, Homo sapiens
ccctgccactgggctct

SEQ ID NO: 868619 - DNA, 22 bp, Homo sapiens
ccctggacaggcagcctccttt

SEQ ID NO: 868620 - DNA, 14 bp, Homo sapiens
ccctggacctggga

SEQ ID NO: 868621 - DNA, 18 bp, Homo sapiens
ccctggaccttgggccta

SEQ ID NO: 868622 - DNA, 14 bp, Homo sapiens
ccctggactgggag

SEQ ID NO: 868623 - DNA, 14 bp, Homo sapiens
ccctggagccagac

SEQ ID NO: 868624 - DNA, 23 bp, Homo sapiens
ccctggagccagactctggtctt

SEQ ID NO: 868625 - DNA, 13 bp, Homo sapiens
ccctggagccagg

SEQ ID NO: 868626 - DNA, 21 bp, Homo sapiens
ccctggagccagggcagagga

SEQ ID NO: 868627 - DNA, 17 bp, Homo sapiens
ccctggagccatccctt

SEQ ID NO: 868628 - DNA, 19 bp, Homo sapiens
ccctggaggcactgaagtg

SEQ ID NO: 868629 - DNA, 13 bp, Homo sapiens
ccctggagtcagg

SEQ ID NO: 868630 - DNA, 14 bp, Homo sapiens
ccctggagtcaggg

SEQ ID NO: 868631 - DNA, 17 bp, Homo sapiens
ccctggagtgtgtcaga

SEQ ID NO: 868632 - DNA, 21 bp, Homo sapiens
ccctggagtgtgtcagagccc

SEQ ID NO: 868633 - DNA, 22 bp, Homo sapiens
ccctggatcacgacgctgcaga

SEQ ID NO: 868634 - DNA, 22 bp, Homo sapiens
ccctggatgggcattgggctga

SEQ ID NO: 868635 - DNA, 18 bp, Homo sapiens
ccctggatgtcccctgtc

SEQ ID NO: 868636 - DNA, 22 bp, Homo sapiens
ccctggatgtcccctgtcccac

SEQ ID NO: 868637 - DNA, 21 bp, Homo sapiens
ccctggatgtgaagctcacac

SEQ ID NO: 868638 - DNA, 19 bp, Homo sapiens
ccctggatgtgtggggcat

SEQ ID NO: 868639 - DNA, 15 bp, Homo sapiens
ccctggcagcacagc

SEQ ID NO: 868640 - DNA, 16 bp, Homo sapiens
ccctggcagcacagcc

SEQ ID NO: 868641 - DNA, 21 bp, Homo sapiens
ccctggcagcacagcccaggg

SEQ ID NO: 868642 - DNA, 13 bp, Homo sapiens
ccctggcagcagc

SEQ ID NO: 868643 - DNA, 15 bp, Homo sapiens
ccctggcagcagcag

SEQ ID NO: 868644 - DNA, 15 bp, Homo sapiens
ccctggcagctgccc

SEQ ID NO: 868645 - DNA, 11 bp, Homo sapiens
ccctggcatga

SEQ ID NO: 868646 - DNA, 22 bp, Homo sapiens
ccctggccaccttgtcctggct

SEQ ID NO: 868647 - DNA, 18 bp, Homo sapiens
ccctggccactaaagctt

SEQ ID NO: 868648 - DNA, 21 bp, Homo sapiens
ccctggccactaaagcttcag

SEQ ID NO: 868649 - DNA, 23 bp, Homo sapiens
ccctggccactgaaaagctttcc

SEQ ID NO: 868650 - DNA, 15 bp, Homo sapiens
ccctggccagctctg

SEQ ID NO: 868651 - DNA, 18 bp, Homo sapiens
ccctggcccaccccccag

SEQ ID NO: 868652 - DNA, 21 bp, Homo sapiens
ccctggcccaccccccagcct

SEQ ID NO: 868653 - DNA, 18 bp, Homo sapiens
ccctggccccgcctgcct

SEQ ID NO: 868654 - DNA, 16 bp, Homo sapiens
ccctggccctgaggtg

SEQ ID NO: 868655 - DNA, 13 bp, Homo sapiens
ccctggcctcact

SEQ ID NO: 868656 - DNA, 22 bp, Homo sapiens
ccctggcctcagttcccagctc

SEQ ID NO: 868657 - DNA, 11 bp, Homo sapiens
ccctggcctcc

SEQ ID NO: 868658 - DNA, 21 bp, Homo sapiens
ccctggcctctgtgccttctt

SEQ ID NO: 868659 - DNA, 14 bp, Homo sapiens
ccctggcctgaact

SEQ ID NO: 868660 - DNA, 14 bp, Homo sapiens
ccctggcctgctgg

SEQ ID NO: 868661 - DNA, 22 bp, Homo sapiens
ccctggccttaaaaggggccca

SEQ ID NO: 868662 - DNA, 22 bp, Homo sapiens
ccctggcggccccaactcgggc

SEQ ID NO: 868663 - DNA, 20 bp, Homo sapiens
ccctggctcccacaggccct

SEQ ID NO: 868664 - DNA, 14 bp, Homo sapiens
ccctggctcccacc

SEQ ID NO: 868665 - DNA, 16 bp, Homo sapiens
ccctggctccctcctc

SEQ ID NO: 868666 - DNA, 18 bp, Homo sapiens
ccctggctccctcctcca

SEQ ID NO: 868667 - DNA, 13 bp, Homo sapiens
ccctggctcctcc

SEQ ID NO: 868668 - DNA, 16 bp, Homo sapiens
ccctggctcctccgtc

SEQ ID NO: 868669 - DNA, 17 bp, Homo sapiens
ccctggctcctccgtct

SEQ ID NO: 868670 - DNA, 18 bp, Homo sapiens
ccctggctcctccgtctg

SEQ ID NO: 868671 - DNA, 13 bp, Homo sapiens
ccctggctctgca

SEQ ID NO: 868672 - DNA, 16 bp, Homo sapiens
ccctggctctgcccct

SEQ ID NO: 868673 - DNA, 23 bp, Homo sapiens
ccctggctgaccccaaagagcct

SEQ ID NO: 868674 - DNA, 13 bp, Homo sapiens
ccctggctgccct

SEQ ID NO: 868675 - DNA, 18 bp, Homo sapiens
ccctggctgccctggccc

SEQ ID NO: 868676 - DNA, 19 bp, Homo sapiens
ccctggctgccctggccct

SEQ ID NO: 868677 - DNA, 14 bp, Homo sapiens
ccctggctgctgcc

SEQ ID NO: 868678 - DNA, 18 bp, Homo sapiens
ccctggctgctgccccca

SEQ ID NO: 868679 - DNA, 23 bp, Homo sapiens
ccctggctgggacgtggctcagc

SEQ ID NO: 868680 - DNA, 22 bp, Homo sapiens
ccctggctgtactgctcaggct

SEQ ID NO: 868681 - DNA, 23 bp, Homo sapiens
ccctggcttgtaactccaccaac

SEQ ID NO: 868682 - DNA, 17 bp, Homo sapiens
ccctggcttttcactgc

SEQ ID NO: 868683 - DNA, 18 bp, Homo sapiens
ccctgggacacagaccca

SEQ ID NO: 868684 - DNA, 23 bp, Homo sapiens
ccctgggacatcaggagactggg

SEQ ID NO: 868685 - DNA, 14 bp, Homo sapiens
ccctgggagacaac

SEQ ID NO: 868686 - DNA, 14 bp, Homo sapiens
ccctgggagagaag

SEQ ID NO: 868687 - DNA, 22 bp, Homo sapiens
ccctgggagcgcctgaccctgg

SEQ ID NO: 868688 - DNA, 17 bp, Homo sapiens
ccctgggagctctggga

SEQ ID NO: 868689 - DNA, 15 bp, Homo sapiens
ccctgggatgcctca

SEQ ID NO: 868690 - DNA, 12 bp, Homo sapiens
ccctgggatgct

SEQ ID NO: 868691 - DNA, 19 bp, Homo sapiens
ccctgggatgctgacccag

SEQ ID NO: 868692 - DNA, 20 bp, Homo sapiens
ccctgggatgggaccaggga

SEQ ID NO: 868693 - DNA, 21 bp, Homo sapiens
ccctgggcagatgtcccccac

SEQ ID NO: 868694 - DNA, 16 bp, Homo sapiens
ccctgggccacctcct

SEQ ID NO: 868695 - DNA, 20 bp, Homo sapiens
ccctgggccacctcctaccc

SEQ ID NO: 868696 - DNA, 12 bp, Homo sapiens
ccctgggccagg

SEQ ID NO: 868697 - DNA, 20 bp, Homo sapiens
ccctgggccccaccacctag

SEQ ID NO: 868698 - DNA, 16 bp, Homo sapiens
ccctgggcccctccac

SEQ ID NO: 868699 - DNA, 16 bp, Homo sapiens
ccctgggccctgggct

SEQ ID NO: 868700 - DNA, 15 bp, Homo sapiens
ccctgggctctgccc

SEQ ID NO: 868701 - DNA, 17 bp, Homo sapiens
ccctgggctgaaactga

SEQ ID NO: 868702 - DNA, 12 bp, Homo sapiens
ccctgggctgga

SEQ ID NO: 868703 - DNA, 14 bp, Homo sapiens
ccctgggctggact

SEQ ID NO: 868704 - DNA, 16 bp, Homo sapiens
ccctgggctggactgg

SEQ ID NO: 868705 - DNA, 15 bp, Homo sapiens
ccctgggctgtccag

SEQ ID NO: 868706 - DNA, 17 bp, Homo sapiens
ccctgggctgtccagcc

SEQ ID NO: 868707 - DNA, 20 bp, Homo sapiens
ccctgggctgtccagcctta

SEQ ID NO: 868708 - DNA, 20 bp, Homo sapiens
ccctgggcttggcctgctgt

SEQ ID NO: 868709 - DNA, 22 bp, Homo sapiens
ccctgggctttcacgggcccca

SEQ ID NO: 868710 - DNA, 13 bp, Homo sapiens
ccctggggaaata

SEQ ID NO: 868711 - DNA, 17 bp, Homo sapiens
ccctggggacagagcca

SEQ ID NO: 868712 - DNA, 20 bp, Homo sapiens
ccctggggacagagccaccc

SEQ ID NO: 868713 - DNA, 16 bp, Homo sapiens
ccctggggagccctca

SEQ ID NO: 868714 - DNA, 17 bp, Homo sapiens
ccctggggagccctcag

SEQ ID NO: 868715 - DNA, 20 bp, Homo sapiens
ccctggggagccctcaggct

SEQ ID NO: 868716 - DNA, 23 bp, Homo sapiens
ccctggggatcttcccacaggag

SEQ ID NO: 868717 - DNA, 15 bp, Homo sapiens
ccctggggcaggggt

SEQ ID NO: 868718 - DNA, 16 bp, Homo sapiens
ccctggggcaggggtg

SEQ ID NO: 868719 - DNA, 19 bp, Homo sapiens
ccctggggcgggcagccag

SEQ ID NO: 868720 - DNA, 21 bp, Homo sapiens
ccctggggcgggcagccaggc

SEQ ID NO: 868721 - DNA, 13 bp, Homo sapiens
ccctggggctgct

SEQ ID NO: 868722 - DNA, 15 bp, Homo sapiens
ccctggggcttctcc

SEQ ID NO: 868723 - DNA, 18 bp, Homo sapiens
ccctggggcttctcctga

SEQ ID NO: 868724 - DNA, 21 bp, Homo sapiens
ccctggggcttctcctgaccc

SEQ ID NO: 868725 - DNA, 20 bp, Homo sapiens
ccctgggggaagccctggat

SEQ ID NO: 868726 - DNA, 19 bp, Homo sapiens
ccctgggggtctgggcgtc

SEQ ID NO: 868727 - DNA, 17 bp, Homo sapiens
ccctggggtggccacca

SEQ ID NO: 868728 - DNA, 15 bp, Homo sapiens
ccctggggtggccag

SEQ ID NO: 868729 - DNA, 17 bp, Homo sapiens
ccctggggtggccaggg

SEQ ID NO: 868730 - DNA, 22 bp, Homo sapiens
ccctggggtgggatctgagctc

SEQ ID NO: 868731 - DNA, 22 bp, Homo sapiens
ccctgggtctggggacaggccc

SEQ ID NO: 868732 - DNA, 13 bp, Homo sapiens
ccctgggtgccat

SEQ ID NO: 868733 - DNA, 17 bp, Homo sapiens
ccctgggtgggctctgt

SEQ ID NO: 868734 - DNA, 16 bp, Homo sapiens
ccctgggtgggtggtg

SEQ ID NO: 868735 - DNA, 23 bp, Homo sapiens
ccctgggttcagaaatgctgcct

SEQ ID NO: 868736 - DNA, 19 bp, Homo sapiens
ccctggtaaaccaagcctc

SEQ ID NO: 868737 - DNA, 15 bp, Homo sapiens
ccctggtcctggcct

SEQ ID NO: 868738 - DNA, 17 bp, Homo sapiens
ccctggtcctggcctcc

SEQ ID NO: 868739 - DNA, 16 bp, Homo sapiens
ccctggtccttccagg

SEQ ID NO: 868740 - DNA, 14 bp, Homo sapiens
ccctggtctgtgga

SEQ ID NO: 868741 - DNA, 15 bp, Homo sapiens
ccctggtcttctcta

SEQ ID NO: 868742 - DNA, 16 bp, Homo sapiens
ccctggtgacctcctg

SEQ ID NO: 868743 - DNA, 23 bp, Homo sapiens
ccctgccactgggctctggacct

SEQ ID NO: 868744 - DNA, 14 bp, Homo sapiens
ccctgccagtgaag

SEQ ID NO: 868745 - DNA, 22 bp, Homo sapiens
ccctgccagtgaagtccttcag

SEQ ID NO: 868746 - DNA, 14 bp, Homo sapiens
ccctgccagtgcca

SEQ ID NO: 868747 - DNA, 16 bp, Homo sapiens
ccctgccagtgccagg

SEQ ID NO: 868748 - DNA, 20 bp, Homo sapiens
ccctgccagtgccagggtgg

SEQ ID NO: 868749 - DNA, 13 bp, Homo sapiens
ccctgccatcccc

SEQ ID NO: 868750 - DNA, 17 bp, Homo sapiens
ccctgccatcttcccag

SEQ ID NO: 868751 - DNA, 22 bp, Homo sapiens
ccctgccattttttaagagaca

SEQ ID NO: 868752 - DNA, 10 bp, Homo sapiens
ccctgcccaa

SEQ ID NO: 868753 - DNA, 22 bp, Homo sapiens
ccctgcccaaacccttaactga

SEQ ID NO: 868754 - DNA, 16 bp, Homo sapiens
ccctgcccaagggcct

SEQ ID NO: 868755 - DNA, 22 bp, Homo sapiens
ccctgcccaagggcctcccacc

SEQ ID NO: 868756 - DNA, 14 bp, Homo sapiens
ccctgcccaccccc

SEQ ID NO: 868757 - DNA, 14 bp, Homo sapiens
ccctgcccagcctg

SEQ ID NO: 868758 - DNA, 13 bp, Homo sapiens
ccctgcccatccg

SEQ ID NO: 868759 - DNA, 15 bp, Homo sapiens
ccctgccccacacct

SEQ ID NO: 868760 - DNA, 16 bp, Homo sapiens
ccctgccccagcccct

SEQ ID NO: 868761 - DNA, 17 bp, Homo sapiens
ccctgccccagccccta

SEQ ID NO: 868762 - DNA, 17 bp, Homo sapiens
ccctgccccaggcctgg

SEQ ID NO: 868763 - DNA, 16 bp, Homo sapiens
ccctgcccccacttcc

SEQ ID NO: 868764 - DNA, 20 bp, Homo sapiens
ccctgcccccacttcctgtt

SEQ ID NO: 868765 - DNA, 19 bp, Homo sapiens
ccctgcccccatctcccca

SEQ ID NO: 868766 - DNA, 22 bp, Homo sapiens
ccctgcccccatctccccaggc

SEQ ID NO: 868767 - DNA, 14 bp, Homo sapiens
ccctgccccccagc

SEQ ID NO: 868768 - DNA, 21 bp, Homo sapiens
ccctgccccccagcctctggc

SEQ ID NO: 868769 - DNA, 16 bp, Homo sapiens
ccctgccccgcccccc

SEQ ID NO: 868770 - DNA, 17 bp, Homo sapiens
ccctgccccgcccccca

SEQ ID NO: 868771 - DNA, 17 bp, Homo sapiens
ccctgccccgggatgca

SEQ ID NO: 868772 - DNA, 15 bp, Homo sapiens
ccctgcccctaggat

SEQ ID NO: 868773 - DNA, 21 bp, Homo sapiens
ccctgcccctccccaaaagaa

SEQ ID NO: 868774 - DNA, 17 bp, Homo sapiens
ccctgcccctcccttca

SEQ ID NO: 868775 - DNA, 13 bp, Homo sapiens
ccctgcccctgcc

SEQ ID NO: 868776 - DNA, 14 bp, Homo sapiens
ccctgcccctgtcc

SEQ ID NO: 868777 - DNA, 14 bp, Homo sapiens
ccctgccccttaac

SEQ ID NO: 868778 - DNA, 12 bp, Homo sapiens
ccctgcccgcca

SEQ ID NO: 868779 - DNA, 17 bp, Homo sapiens
ccctgcccgctcccaac

SEQ ID NO: 868780 - DNA, 15 bp, Homo sapiens
ccctgcccggggagc

SEQ ID NO: 868781 - DNA, 23 bp, Homo sapiens
ccctgcccggggagctgcagagc

SEQ ID NO: 868782 - DNA, 14 bp, Homo sapiens
ccctgccctcgtgg

SEQ ID NO: 868783 - DNA, 22 bp, Homo sapiens
ccctgccctcgtggccagcccg

SEQ ID NO: 868784 - DNA, 13 bp, Homo sapiens
ccctgccctgctg

SEQ ID NO: 868785 - DNA, 21 bp, Homo sapiens
ccctgcccttcctcagggccc

SEQ ID NO: 868786 - DNA, 13 bp, Homo sapiens
ccctgcccttggc

SEQ ID NO: 868787 - DNA, 15 bp, Homo sapiens
ccctgcccttggcac

SEQ ID NO: 868788 - DNA, 15 bp, Homo sapiens
ccctgccgtcaccac

SEQ ID NO: 868789 - DNA, 19 bp, Homo sapiens
ccctgccgtcaccaccacc

SEQ ID NO: 868790 - DNA, 15 bp, Homo sapiens
ccctgcctcagccag

SEQ ID NO: 868791 - DNA, 17 bp, Homo sapiens
ccctgcctcagccaggc

SEQ ID NO: 868792 - DNA, 13 bp, Homo sapiens
ccctgcctcctgc

SEQ ID NO: 868793 - DNA, 23 bp, Homo sapiens
ccctgcctcctgccaccccttcc

SEQ ID NO: 868794 - DNA, 14 bp, Homo sapiens
ccctgcctcctgga

SEQ ID NO: 868795 - DNA, 20 bp, Homo sapiens
ccctgcctcgagggccgcct

SEQ ID NO: 868796 - DNA, 21 bp, Homo sapiens
ccctgcctcgagggccgcctg

SEQ ID NO: 868797 - DNA, 12 bp, Homo sapiens
ccctgcctctca

SEQ ID NO: 868798 - DNA, 9 bp, Homo sapiens
ccctgcctg

SEQ ID NO: 868799 - DNA, 13 bp, Homo sapiens
ccctgcctgaccc

SEQ ID NO: 868800 - DNA, 16 bp, Homo sapiens
ccctgcctgagcccag

SEQ ID NO: 868801 - DNA, 21 bp, Homo sapiens
ccctgcctgagcccaggagct

SEQ ID NO: 868802 - DNA, 16 bp, Homo sapiens
ccctgcctgaggagga

SEQ ID NO: 868803 - DNA, 20 bp, Homo sapiens
ccctgcctgagggcccctct

SEQ ID NO: 868804 - DNA, 23 bp, Homo sapiens
ccctgcctgagggcccctctgcc

SEQ ID NO: 868805 - DNA, 11 bp, Homo sapiens
ccctgcctgcc

SEQ ID NO: 868806 - DNA, 14 bp, Homo sapiens
ccctgcctgccgct

SEQ ID NO: 868807 - DNA, 20 bp, Homo sapiens
ccctgcctgccgctgcacct

SEQ ID NO: 868808 - DNA, 24 bp, Homo sapiens
ccctgcctgccgctgcacctgcct

SEQ ID NO: 868809 - DNA, 17 bp, Homo sapiens
ccctggtgacctcctgt

SEQ ID NO: 868810 - DNA, 18 bp, Homo sapiens
ccctggtgacctcctgtc

SEQ ID NO: 868811 - DNA, 19 bp, Homo sapiens
ccctggtgacctcctgtca

SEQ ID NO: 868812 - DNA, 17 bp, Homo sapiens
ccctggtgcctctgtgc

SEQ ID NO: 868813 - DNA, 19 bp, Homo sapiens
ccctggtgcctctgtgcac

SEQ ID NO: 868814 - DNA, 13 bp, Homo sapiens
ccctggtgctcct

SEQ ID NO: 868815 - DNA, 17 bp, Homo sapiens
ccctggtgctgccacac

SEQ ID NO: 868816 - DNA, 17 bp, Homo sapiens
ccctggtggacagtcct

SEQ ID NO: 868817 - DNA, 19 bp, Homo sapiens
ccctggtggacagtcctgg

SEQ ID NO: 868818 - DNA, 21 bp, Homo sapiens
ccctggtggacagtcctggga

SEQ ID NO: 868819 - DNA, 20 bp, Homo sapiens
ccctggtggtattttatttt

SEQ ID NO: 868820 - DNA, 19 bp, Homo sapiens
ccctggttatattctcacg

SEQ ID NO: 868821 - DNA, 14 bp, Homo sapiens
ccctggttgcctct

SEQ ID NO: 868822 - DNA, 15 bp, Homo sapiens
ccctggtttgcagct

SEQ ID NO: 868823 - DNA, 19 bp, Homo sapiens
ccctgtaacgtaacccatt

SEQ ID NO: 868824 - DNA, 21 bp, Homo sapiens
ccctgtaacgtaacccattaa

SEQ ID NO: 868825 - DNA, 12 bp, Homo sapiens
ccctgtaaggtt

SEQ ID NO: 868826 - DNA, 13 bp, Homo sapiens
ccctgtacagtga

SEQ ID NO: 868827 - DNA, 16 bp, Homo sapiens
ccctgtacagtgaatg

SEQ ID NO: 868828 - DNA, 13 bp, Homo sapiens
ccctgtacccacc

SEQ ID NO: 868829 - DNA, 18 bp, Homo sapiens
ccctgtacccaccccagc

SEQ ID NO: 868830 - DNA, 20 bp, Homo sapiens
ccctgtacccaccccagcac

SEQ ID NO: 868831 - DNA, 21 bp, Homo sapiens
ccctgtacccaccccagcaca

SEQ ID NO: 868832 - DNA, 23 bp, Homo sapiens
ccctgtacccaccccagcacagc

SEQ ID NO: 868833 - DNA, 15 bp, Homo sapiens
ccctgtagctcagtc

SEQ ID NO: 868834 - DNA, 16 bp, Homo sapiens
ccctgtagctctgcct

SEQ ID NO: 868835 - DNA, 18 bp, Homo sapiens
ccctgtagctctgcctcc

SEQ ID NO: 868836 - DNA, 21 bp, Homo sapiens
ccctgtagctctgcctccctc

SEQ ID NO: 868837 - DNA, 20 bp, Homo sapiens
ccctgtattttctttctcta

SEQ ID NO: 868838 - DNA, 14 bp, Homo sapiens
ccctgtcacacact

SEQ ID NO: 868839 - DNA, 14 bp, Homo sapiens
ccctgtcagtgcag

SEQ ID NO: 868840 - DNA, 17 bp, Homo sapiens
ccctgtcagtgcagccc

SEQ ID NO: 868841 - DNA, 21 bp, Homo sapiens
ccctgtcagtgcagcccgtgt

SEQ ID NO: 868842 - DNA, 17 bp, Homo sapiens
ccctgtcagtttcccct

SEQ ID NO: 868843 - DNA, 21 bp, Homo sapiens
ccctgtcagtttcccctctcg

SEQ ID NO: 868844 - DNA, 20 bp, Homo sapiens
ccctgtcatccagctcactc

SEQ ID NO: 868845 - DNA, 19 bp, Homo sapiens
ccctgtcatttgaacctgg

SEQ ID NO: 868846 - DNA, 22 bp, Homo sapiens
ccctgtccaaaagcgccctcac

SEQ ID NO: 868847 - DNA, 12 bp, Homo sapiens
ccctgtccagcc

SEQ ID NO: 868848 - DNA, 23 bp, Homo sapiens
ccctgtccaggatggagggtcca

SEQ ID NO: 868849 - DNA, 22 bp, Homo sapiens
ccctgtcccacccacacagctg

SEQ ID NO: 868850 - DNA, 23 bp, Homo sapiens
ccctgtcccacccacacagctgc

SEQ ID NO: 868851 - DNA, 15 bp, Homo sapiens
ccctgtcccaccccc

SEQ ID NO: 868852 - DNA, 15 bp, Homo sapiens
ccctgtcccaggccg

SEQ ID NO: 868853 - DNA, 21 bp, Homo sapiens
ccctgtcccatgcaggccctt

SEQ ID NO: 868854 - DNA, 22 bp, Homo sapiens
ccctgtccccaagacacttccc

SEQ ID NO: 868855 - DNA, 20 bp, Homo sapiens
ccctgtccccaggcccagcc

SEQ ID NO: 868856 - DNA, 14 bp, Homo sapiens
ccctgtccccagtc

SEQ ID NO: 868857 - DNA, 21 bp, Homo sapiens
ccctgtccccagtccccagcc

SEQ ID NO: 868858 - DNA, 23 bp, Homo sapiens
ccctgtccccagtccccagccct

SEQ ID NO: 868859 - DNA, 12 bp, Homo sapiens
ccctgtccccca

SEQ ID NO: 868860 - DNA, 16 bp, Homo sapiens
ccctgtcccccagcat

SEQ ID NO: 868861 - DNA, 19 bp, Homo sapiens
ccctgtcccccagcatcgg

SEQ ID NO: 868862 - DNA, 15 bp, Homo sapiens
ccctgtcccccagct

SEQ ID NO: 868863 - DNA, 16 bp, Homo sapiens
ccctgtcccccagctc

SEQ ID NO: 868864 - DNA, 22 bp, Homo sapiens
ccctgtccccctcccctcccag

SEQ ID NO: 868865 - DNA, 14 bp, Homo sapiens
ccctgtcccctgga

SEQ ID NO: 868866 - DNA, 13 bp, Homo sapiens
ccctgtccctgcc

SEQ ID NO: 868867 - DNA, 18 bp, Homo sapiens
ccctgtccctgccccgcc

SEQ ID NO: 868868 - DNA, 15 bp, Homo sapiens
ccctgtcctcctcgg

SEQ ID NO: 868869 - DNA, 13 bp, Homo sapiens
ccctgtcctgcag

SEQ ID NO: 868870 - DNA, 14 bp, Homo sapiens
ccctgtcctgcagt

SEQ ID NO: 868871 - DNA, 20 bp, Homo sapiens
ccctgtcctgcagtcccaca

SEQ ID NO: 868872 - DNA, 20 bp, Homo sapiens
ccctgtcgagacacttgcct

SEQ ID NO: 868873 - DNA, 16 bp, Homo sapiens
ccctgtctagagaggg

SEQ ID NO: 868874 - DNA, 20 bp, Homo sapiens
ccctgtctcaaaaaaagaaa

SEQ ID NO: 868875 - DNA, 23 bp, Homo sapiens
ccctgtctcaaaaaaagaaaaag

SEQ ID NO: 868876 - DNA, 13 bp, Homo sapiens
ccctgtctccagc

SEQ ID NO: 868877 - DNA, 15 bp, Homo sapiens
ccctgtctccagctg

SEQ ID NO: 868878 - DNA, 19 bp, Homo sapiens
ccctgtctccagctgcctg

SEQ ID NO: 868879 - DNA, 14 bp, Homo sapiens
ccctgtctctacta

SEQ ID NO: 868880 - DNA, 13 bp, Homo sapiens
ccctgtctggaag

SEQ ID NO: 868881 - DNA, 17 bp, Homo sapiens
ccctgtgacatggtgcc

SEQ ID NO: 868882 - DNA, 21 bp, Homo sapiens
ccctgtgacatggtgcctgag

SEQ ID NO: 868883 - DNA, 24 bp, Homo sapiens
ccctgtgacatggtgcctgagagg

SEQ ID NO: 868884 - DNA, 18 bp, Homo sapiens
ccctgtgaccctctcact

SEQ ID NO: 868885 - DNA, 13 bp, Homo sapiens
ccctgtgccccca

SEQ ID NO: 868886 - DNA, 15 bp, Homo sapiens
ccctgtgcccccagc

SEQ ID NO: 868887 - DNA, 18 bp, Homo sapiens
ccctgtgcccccagcctc

SEQ ID NO: 868888 - DNA, 20 bp, Homo sapiens
ccctgtgcccccagcctcag

SEQ ID NO: 868889 - DNA, 21 bp, Homo sapiens
ccctgtgcccccagcctcagc

SEQ ID NO: 868890 - DNA, 14 bp, Homo sapiens
ccctgtgccgcact

SEQ ID NO: 868891 - DNA, 22 bp, Homo sapiens
ccctgtgcctaacaccagcgtt

SEQ ID NO: 868892 - DNA, 12 bp, Homo sapiens
ccctgtgcctgg

SEQ ID NO: 868893 - DNA, 21 bp, Homo sapiens
ccctgtgcctgggccctgggc

SEQ ID NO: 868894 - DNA, 20 bp, Homo sapiens
ccctgtgctcccctgccaca

SEQ ID NO: 868895 - DNA, 14 bp, Homo sapiens
ccctgtgctggtgt

SEQ ID NO: 868896 - DNA, 22 bp, Homo sapiens
ccctgtgctggtgtcctgacca

SEQ ID NO: 868897 - DNA, 22 bp, Homo sapiens
ccctgtggaagcatggctgtct

SEQ ID NO: 868898 - DNA, 14 bp, Homo sapiens
ccctgtggaaggga

SEQ ID NO: 868899 - DNA, 12 bp, Homo sapiens
ccctgtggagtc

SEQ ID NO: 868900 - DNA, 18 bp, Homo sapiens
ccctgtggagtccagctc

SEQ ID NO: 868901 - DNA, 19 bp, Homo sapiens
ccctgtggagtccagctct

SEQ ID NO: 868902 - DNA, 16 bp, Homo sapiens
ccctgtggccaactgc

SEQ ID NO: 868903 - DNA, 20 bp, Homo sapiens
ccctgtgggaccgcctggcc

SEQ ID NO: 868904 - DNA, 21 bp, Homo sapiens
ccctgtgggaccgcctggccc

SEQ ID NO: 868905 - DNA, 22 bp, Homo sapiens
ccctgtgggaccgcctggccct

SEQ ID NO: 868906 - DNA, 15 bp, Homo sapiens
ccctgtggggatctc

SEQ ID NO: 868907 - DNA, 17 bp, Homo sapiens
ccctgtggggcaggagt

SEQ ID NO: 868908 - DNA, 22 bp, Homo sapiens
ccctgtggggcaggagtgccag

SEQ ID NO: 868909 - DNA, 18 bp, Homo sapiens
ccctgtgggggtggccat

SEQ ID NO: 868910 - DNA, 20 bp, Homo sapiens
ccctgtgtcagagcctacct

SEQ ID NO: 868911 - DNA, 16 bp, Homo sapiens
ccctgtgtgtgtcccc

SEQ ID NO: 868912 - DNA, 20 bp, Homo sapiens
ccctgtgttctgggctgggg

SEQ ID NO: 868913 - DNA, 16 bp, Homo sapiens
ccctgttatctgctag

SEQ ID NO: 868914 - DNA, 14 bp, Homo sapiens
ccctgttcactcta

SEQ ID NO: 868915 - DNA, 22 bp, Homo sapiens
ccctgttcactctacttagcat

SEQ ID NO: 868916 - DNA, 13 bp, Homo sapiens
ccctgttcattgt

SEQ ID NO: 868917 - DNA, 13 bp, Homo sapiens
ccctgttccctgg

SEQ ID NO: 868918 - DNA, 12 bp, Homo sapiens
ccctgttctctt

SEQ ID NO: 868919 - DNA, 21 bp, Homo sapiens
ccctgttctggtatttcccct

SEQ ID NO: 868920 - DNA, 12 bp, Homo sapiens
ccctgttcttcc

SEQ ID NO: 868921 - DNA, 14 bp, Homo sapiens
ccctgttcttcctc

SEQ ID NO: 868922 - DNA, 21 bp, Homo sapiens
ccctgttcttcctccagctgc

SEQ ID NO: 868923 - DNA, 23 bp, Homo sapiens
ccctgttgattatcttcagccca

SEQ ID NO: 868924 - DNA, 13 bp, Homo sapiens
ccctgttggcagc

SEQ ID NO: 868925 - DNA, 19 bp, Homo sapiens
ccctgttggcagctctagc

SEQ ID NO: 868926 - DNA, 16 bp, Homo sapiens
ccctgtttaatattta

SEQ ID NO: 868927 - DNA, 21 bp, Homo sapiens
ccctgtttaatatttaaacag

SEQ ID NO: 868928 - DNA, 19 bp, Homo sapiens
ccctgtttactggttcttg

SEQ ID NO: 868929 - DNA, 14 bp, Homo sapiens
ccctgtttctccac

SEQ ID NO: 868930 - DNA, 15 bp, Homo sapiens
ccctgttttctgagc

SEQ ID NO: 868931 - DNA, 16 bp, Homo sapiens
ccctgttttctgagcc

SEQ ID NO: 868932 - DNA, 23 bp, Homo sapiens
ccctgttttctgagcccgggctg

SEQ ID NO: 868933 - DNA, 15 bp, Homo sapiens
cccttctctgcctcc

SEQ ID NO: 868934 - DNA, 14 bp, Homo sapiens
cccttctctgctcc

SEQ ID NO: 868935 - DNA, 16 bp, Homo sapiens
cccttctctgctccac

SEQ ID NO: 868936 - DNA, 12 bp, Homo sapiens
cccttctgcctt

SEQ ID NO: 868937 - DNA, 12 bp, Homo sapiens
cccttctgggca

SEQ ID NO: 868938 - DNA, 19 bp, Homo sapiens
cccttctgggcttcattct

SEQ ID NO: 868939 - DNA, 20 bp, Homo sapiens
cccttcttcccgccccacct

SEQ ID NO: 868940 - DNA, 21 bp, Homo sapiens
cccttcttcccgccccacctc

SEQ ID NO: 868941 - DNA, 22 bp, Homo sapiens
cccttcttgctgccctgcccca

SEQ ID NO: 868942 - DNA, 20 bp, Homo sapiens
cccttcttgggtctgccctg

SEQ ID NO: 868943 - DNA, 19 bp, Homo sapiens
cccttctttttcttctttt

SEQ ID NO: 868944 - DNA, 20 bp, Homo sapiens
cccttgaagaggggaggggc

SEQ ID NO: 868945 - DNA, 13 bp, Homo sapiens
cccttgaagcaat

SEQ ID NO: 868946 - DNA, 16 bp, Homo sapiens
cccttgaagcaataac

SEQ ID NO: 868947 - DNA, 19 bp, Homo sapiens
cccttgaagcaataactcc

SEQ ID NO: 868948 - DNA, 15 bp, Homo sapiens
cccttgacaccgggg

SEQ ID NO: 868949 - DNA, 15 bp, Homo sapiens
cccttgacacctgct

SEQ ID NO: 868950 - DNA, 23 bp, Homo sapiens
cccttgacgtcaagtctccttcc

SEQ ID NO: 868951 - DNA, 18 bp, Homo sapiens
cccttgactgtacagaga

SEQ ID NO: 868952 - DNA, 17 bp, Homo sapiens
cccttgactttgctcct

SEQ ID NO: 868953 - DNA, 14 bp, Homo sapiens
cccttgagaaacct

SEQ ID NO: 868954 - DNA, 22 bp, Homo sapiens
cccttgagaaaccttattgtac

SEQ ID NO: 868955 - DNA, 14 bp, Homo sapiens
cccttgagacctca

SEQ ID NO: 868956 - DNA, 18 bp, Homo sapiens
cccttgagacctcagcca

SEQ ID NO: 868957 - DNA, 22 bp, Homo sapiens
cccttgaggaaacaacagcttt

SEQ ID NO: 868958 - DNA, 22 bp, Homo sapiens
cccttgaggggccccagcgtct

SEQ ID NO: 868959 - DNA, 18 bp, Homo sapiens
cccttgatgggtgctgcc

SEQ ID NO: 868960 - DNA, 19 bp, Homo sapiens
cccttgattcccaccgtac

SEQ ID NO: 868961 - DNA, 17 bp, Homo sapiens
cccttgcaagccataac

SEQ ID NO: 868962 - DNA, 14 bp, Homo sapiens
cccttgcaggggtc

SEQ ID NO: 868963 - DNA, 13 bp, Homo sapiens
cccttgccagaca

SEQ ID NO: 868964 - DNA, 15 bp, Homo sapiens
cccttgccagacatg

SEQ ID NO: 868965 - DNA, 12 bp, Homo sapiens
cccttgcccagg

SEQ ID NO: 868966 - DNA, 14 bp, Homo sapiens
cccttgcccagggc

SEQ ID NO: 868967 - DNA, 22 bp, Homo sapiens
cccttgcccagggctcagcctg

SEQ ID NO: 868968 - DNA, 23 bp, Homo sapiens
cccttgcccagggctcagcctgg

SEQ ID NO: 868969 - DNA, 15 bp, Homo sapiens
cccttgcccatcagc

SEQ ID NO: 868970 - DNA, 19 bp, Homo sapiens
cccttgccccaggccaggt

SEQ ID NO: 868971 - DNA, 22 bp, Homo sapiens
cccttgccccaggccaggtagc

SEQ ID NO: 868972 - DNA, 15 bp, Homo sapiens
cccttgcccccatcc

SEQ ID NO: 868973 - DNA, 13 bp, Homo sapiens
cccttgccctccg

SEQ ID NO: 868974 - DNA, 18 bp, Homo sapiens
cccttgcctccccatttc

SEQ ID NO: 868975 - DNA, 19 bp, Homo sapiens
cccttgcctccccatttcc

SEQ ID NO: 868976 - DNA, 15 bp, Homo sapiens
cccttgcctgcctcc

SEQ ID NO: 868977 - DNA, 14 bp, Homo sapiens
ccgccccccagagc

SEQ ID NO: 868978 - DNA, 17 bp, Homo sapiens
ccgccccccagagccag

SEQ ID NO: 868979 - DNA, 14 bp, Homo sapiens
ccgcccccgccccg

SEQ ID NO: 868980 - DNA, 16 bp, Homo sapiens
ccgccccctgccctcc

SEQ ID NO: 868981 - DNA, 15 bp, Homo sapiens
ccgccccgggctggc

SEQ ID NO: 868982 - DNA, 12 bp, Homo sapiens
ccgcccctgagg

SEQ ID NO: 868983 - DNA, 23 bp, Homo sapiens
ccgcccctggccgcgctccgggc

SEQ ID NO: 868984 - DNA, 14 bp, Homo sapiens
ccgcccctggggaa

SEQ ID NO: 868985 - DNA, 22 bp, Homo sapiens
ccgcccgagggatggtgcccct

SEQ ID NO: 868986 - DNA, 15 bp, Homo sapiens
ccgccctcacctctg

SEQ ID NO: 868987 - DNA, 16 bp, Homo sapiens
ccgccctcacctgcag

SEQ ID NO: 868988 - DNA, 21 bp, Homo sapiens
ccgccctcacctgcagagaaa

SEQ ID NO: 868989 - DNA, 11 bp, Homo sapiens
ccgccctccat

SEQ ID NO: 868990 - DNA, 13 bp, Homo sapiens
ccgccctcctcca

SEQ ID NO: 868991 - DNA, 15 bp, Homo sapiens
ccgccctcttcctga

SEQ ID NO: 868992 - DNA, 12 bp, Homo sapiens
ccgccctgccac

SEQ ID NO: 868993 - DNA, 14 bp, Homo sapiens
ccgccctgctcctc

SEQ ID NO: 868994 - DNA, 19 bp, Homo sapiens
ccgccctgctcctccctgg

SEQ ID NO: 868995 - DNA, 22 bp, Homo sapiens
ccgccctgctcctccctggctg

SEQ ID NO: 868996 - DNA, 17 bp, Homo sapiens
ccgccctggacagatgg

SEQ ID NO: 868997 - DNA, 19 bp, Homo sapiens
ccgccctgggctggactgg

SEQ ID NO: 868998 - DNA, 20 bp, Homo sapiens
ccgccctgggctgtctgtca

SEQ ID NO: 868999 - DNA, 15 bp, Homo sapiens
ccgccgatcccaggt

SEQ ID NO: 869000 - DNA, 17 bp, Homo sapiens
ccgccgatcccaggtgc

SEQ ID NO: 869001 - DNA, 13 bp, Homo sapiens
ccggtggctctgg

SEQ ID NO: 869002 - DNA, 15 bp, Homo sapiens
ccggtgtccctggat

SEQ ID NO: 869003 - DNA, 11 bp, Homo sapiens
ccggtgtcctt

SEQ ID NO: 869004 - DNA, 17 bp, Homo sapiens
ccggttcagacccctgc

SEQ ID NO: 869005 - DNA, 14 bp, Homo sapiens
ccgtaccccaccct

SEQ ID NO: 869006 - DNA, 17 bp, Homo sapiens
ccgtactctcacatgtg

SEQ ID NO: 869007 - DNA, 15 bp, Homo sapiens
ccgtagggagtacct

SEQ ID NO: 869008 - DNA, 13 bp, Homo sapiens
ccgtagtctcctg

SEQ ID NO: 869009 - DNA, 14 bp, Homo sapiens
ccgtatcacagtgt

SEQ ID NO: 869010 - DNA, 22 bp, Homo sapiens
ccgtatctcaggaagtccagcc

SEQ ID NO: 869011 - DNA, 13 bp, Homo sapiens
ccgtatctccctg

SEQ ID NO: 869012 - DNA, 22 bp, Homo sapiens
ccgtatctgcagaatgggccac

SEQ ID NO: 869013 - DNA, 16 bp, Homo sapiens
ccgtcaccaccacccc

SEQ ID NO: 869014 - DNA, 17 bp, Homo sapiens
ccgtcaccaccacccct

SEQ ID NO: 869015 - DNA, 20 bp, Homo sapiens
ccgtcaccacgactggccag

SEQ ID NO: 869016 - DNA, 17 bp, Homo sapiens
ccgtcacccctgtttct

SEQ ID NO: 869017 - DNA, 12 bp, Homo sapiens
ccgtcacgcttt

SEQ ID NO: 869018 - DNA, 16 bp, Homo sapiens
ccgtcacgctttcatg

SEQ ID NO: 869019 - DNA, 19 bp, Homo sapiens
ccgtcagccatcagccatg

SEQ ID NO: 869020 - DNA, 16 bp, Homo sapiens
ccgtcagggagaggtc

SEQ ID NO: 869021 - DNA, 15 bp, Homo sapiens
ccgtcatgttcctca

SEQ ID NO: 869022 - DNA, 15 bp, Homo sapiens
ccgtcattgctgctg

SEQ ID NO: 869023 - DNA, 17 bp, Homo sapiens
ccgtcattgctgctgct

SEQ ID NO: 869024 - DNA, 21 bp, Homo sapiens
ccgtccacccaggctgcactg

SEQ ID NO: 869025 - DNA, 15 bp, Homo sapiens
ccgtccacccttcca

SEQ ID NO: 869026 - DNA, 12 bp, Homo sapiens
ccgtccagagcc

SEQ ID NO: 869027 - DNA, 18 bp, Homo sapiens
ccgtccaggagcctgtgc

SEQ ID NO: 869028 - DNA, 21 bp, Homo sapiens
ccgtccaggggagatggggag

SEQ ID NO: 869029 - DNA, 18 bp, Homo sapiens
ccgtccatatcagaactg

SEQ ID NO: 869030 - DNA, 14 bp, Homo sapiens
ccgtccatccccct

SEQ ID NO: 869031 - DNA, 20 bp, Homo sapiens
ccgtccatggcaccagcccc

SEQ ID NO: 869032 - DNA, 23 bp, Homo sapiens
ccgtccatggcaccagccccctg

SEQ ID NO: 869033 - DNA, 15 bp, Homo sapiens
ccgtccattcttcag

SEQ ID NO: 869034 - DNA, 14 bp, Homo sapiens
ccgtcccagggctc

SEQ ID NO: 869035 - DNA, 18 bp, Homo sapiens
ccgtcccatatcctgcct

SEQ ID NO: 869036 - DNA, 13 bp, Homo sapiens
ccgtcccccccca

SEQ ID NO: 869037 - DNA, 16 bp, Homo sapiens
ccgtccccccccaggc

SEQ ID NO: 869038 - DNA, 19 bp, Homo sapiens
ccgtccccccccaggccct

SEQ ID NO: 869039 - DNA, 17 bp, Homo sapiens
ccgtcccctctcccctt

SEQ ID NO: 869040 - DNA, 13 bp, Homo sapiens
ccgtcccctgcag

SEQ ID NO: 869041 - DNA, 14 bp, Homo sapiens
ccgtcccctgcagc

SEQ ID NO: 869042 - DNA, 19 bp, Homo sapiens
ccgtcccctgcagcctggg

SEQ ID NO: 869043 - DNA, 21 bp, Homo sapiens
ccgtcccctgcagcctgggtc

SEQ ID NO: 869044 - DNA, 17 bp, Homo sapiens
ccgtcccgcacagtgga

SEQ ID NO: 869045 - DNA, 16 bp, Homo sapiens
ccgtcctccctcagcc

SEQ ID NO: 869046 - DNA, 18 bp, Homo sapiens
ccgtcctccctcagcctc

SEQ ID NO: 869047 - DNA, 14 bp, Homo sapiens
ccgtcctgcctgtg

SEQ ID NO: 869048 - DNA, 15 bp, Homo sapiens
ccgtcctgcctgtgg

SEQ ID NO: 869049 - DNA, 16 bp, Homo sapiens
ccgtcctgcctgtggc

SEQ ID NO: 869050 - DNA, 18 bp, Homo sapiens
ccgtcctgctgtccctgt

SEQ ID NO: 869051 - DNA, 12 bp, Homo sapiens
ccgtcgaccagg

SEQ ID NO: 869052 - DNA, 20 bp, Homo sapiens
ccgtctccaggggctgcttc

SEQ ID NO: 869053 - DNA, 12 bp, Homo sapiens
ccgtctcctccc

SEQ ID NO: 869054 - DNA, 14 bp, Homo sapiens
ccgtctcctccctc

SEQ ID NO: 869055 - DNA, 14 bp, Homo sapiens
ccgtctcggccctg

SEQ ID NO: 869056 - DNA, 15 bp, Homo sapiens
ccgtctcggccctga

SEQ ID NO: 869057 - DNA, 17 bp, Homo sapiens
ccgtctcggccctgaac

SEQ ID NO: 869058 - DNA, 23 bp, Homo sapiens
ccgtctcggccctgaaccacgag

SEQ ID NO: 869059 - DNA, 14 bp, Homo sapiens
ccgtctctgtcccg

SEQ ID NO: 869060 - DNA, 14 bp, Homo sapiens
ccgtctctgtcctc

SEQ ID NO: 869061 - DNA, 17 bp, Homo sapiens
ccgtctgaccctctgcg

SEQ ID NO: 869062 - DNA, 22 bp, Homo sapiens
ccgtctgactccagagtctgag

SEQ ID NO: 869063 - DNA, 12 bp, Homo sapiens
ccgtctgcaggg

SEQ ID NO: 869064 - DNA, 19 bp, Homo sapiens
ccgtctggggttcagcccc

SEQ ID NO: 869065 - DNA, 20 bp, Homo sapiens
ccgtctggggttcagcccct

SEQ ID NO: 869066 - DNA, 22 bp, Homo sapiens
ccgtctgtctcagagtcccagg

SEQ ID NO: 869067 - DNA, 11 bp, Homo sapiens
ccgtctgtctg

SEQ ID NO: 869068 - DNA, 23 bp, Homo sapiens
ccgtcttcaatctctgttctgct

SEQ ID NO: 869069 - DNA, 20 bp, Homo sapiens
ccgtcttccctagaccttgg

SEQ ID NO: 869070 - DNA, 17 bp, Homo sapiens
ccgtgaaaacggagctg

SEQ ID NO: 869071 - DNA, 18 bp, Homo sapiens
ccgtgaaaacggagctga

SEQ ID NO: 869072 - DNA, 23 bp, Homo sapiens
ccgtgaagcagtgcctcgaggca

SEQ ID NO: 869073 - DNA, 22 bp, Homo sapiens
ccgtgacagactcctgaggaca

SEQ ID NO: 869074 - DNA, 13 bp, Homo sapiens
ccgtgacagtggc

SEQ ID NO: 869075 - DNA, 10 bp, Homo sapiens
ccgtgaccta

SEQ ID NO: 869076 - DNA, 11 bp, Homo sapiens
ccgtgacctat

SEQ ID NO: 869077 - DNA, 12 bp, Homo sapiens
ccgtgacctatt

SEQ ID NO: 869078 - DNA, 21 bp, Homo sapiens
ccgtgagggcaagagggggac

SEQ ID NO: 869079 - DNA, 18 bp, Homo sapiens
ccgtgagtgacatagcct

SEQ ID NO: 869080 - DNA, 20 bp, Homo sapiens
ccgtgagtgacatagcctca

SEQ ID NO: 869081 - DNA, 20 bp, Homo sapiens
ccgtgatccatccatctcca

SEQ ID NO: 869082 - DNA, 18 bp, Homo sapiens
ccgtgatggagaggacag

SEQ ID NO: 869083 - DNA, 19 bp, Homo sapiens
ccgtgatggagaggacaga

SEQ ID NO: 869084 - DNA, 20 bp, Homo sapiens
ccgtgatggagaggacagag

SEQ ID NO: 869085 - DNA, 23 bp, Homo sapiens
ccgtgatgtagggtaaggtgcct

SEQ ID NO: 869086 - DNA, 16 bp, Homo sapiens
ccgtgatttggaagag

SEQ ID NO: 869087 - DNA, 19 bp, Homo sapiens
ccgtgatttggaagagagg

SEQ ID NO: 869088 - DNA, 15 bp, Homo sapiens
ccgtgcatcccagat

SEQ ID NO: 869089 - DNA, 16 bp, Homo sapiens
ccgtgccaaccccacc

SEQ ID NO: 869090 - DNA, 21 bp, Homo sapiens
ccgtgccaaccccacccagct

SEQ ID NO: 869091 - DNA, 23 bp, Homo sapiens
ccgtgccaaccccacccagctcc

SEQ ID NO: 869092 - DNA, 21 bp, Homo sapiens
ccgtgcccacgagggtctccc

SEQ ID NO: 869093 - DNA, 16 bp, Homo sapiens
ccgtgcccaggccctt

SEQ ID NO: 869094 - DNA, 14 bp, Homo sapiens
ccgtgccccacctc

SEQ ID NO: 869095 - DNA, 20 bp, Homo sapiens
ccgtgccccacctccccaca

SEQ ID NO: 869096 - DNA, 21 bp, Homo sapiens
ccgtgcccccgcctgccaccg

SEQ ID NO: 869097 - DNA, 15 bp, Homo sapiens
ccgtgccccgcctcc

SEQ ID NO: 869098 - DNA, 17 bp, Homo sapiens
ccgtgcccctttccttc

SEQ ID NO: 869099 - DNA, 16 bp, Homo sapiens
ccgtgcccgcaggaac

SEQ ID NO: 869100 - DNA, 19 bp, Homo sapiens
ccgtgcccgcaggaactgg

SEQ ID NO: 869101 - DNA, 23 bp, Homo sapiens
ccgtgcccgcaggaactgggctg

SEQ ID NO: 869102 - DNA, 23 bp, Homo sapiens
ccgtgccggcggcagccccactt

SEQ ID NO: 869103 - DNA, 22 bp, Homo sapiens
ccgtgcctccaccaccactggc

SEQ ID NO: 869104 - DNA, 16 bp, Homo sapiens
ccgtgccttcagctct

SEQ ID NO: 869105 - DNA, 17 bp, Homo sapiens
ccgtgccttcagctcta

SEQ ID NO: 869106 - DNA, 18 bp, Homo sapiens
ccgtgctgacagctgctc

SEQ ID NO: 869107 - DNA, 14 bp, Homo sapiens
ccgtgctgggcagc

SEQ ID NO: 869108 - DNA, 14 bp, Homo sapiens
ccgtggaccttcct

SEQ ID NO: 869109 - DNA, 22 bp, Homo sapiens
ccgtggaggaggaaggcaagag

SEQ ID NO: 869110 - DNA, 23 bp, Homo sapiens
ccgtggaggaggaaggcaagagg

SEQ ID NO: 869111 - DNA, 22 bp, Homo sapiens
ccgtggattgcacgtggcctct

SEQ ID NO: 869112 - DNA, 13 bp, Homo sapiens
ccgtggcacagct

SEQ ID NO: 869113 - DNA, 18 bp, Homo sapiens
ccgtggcacagctgggag

SEQ ID NO: 869114 - DNA, 17 bp, Homo sapiens
ccgtggcctgggcttgg

SEQ ID NO: 869115 - DNA, 14 bp, Homo sapiens
ccgtggctctggga

SEQ ID NO: 869116 - DNA, 21 bp, Homo sapiens
ccgtggctctgggagagccag

SEQ ID NO: 869117 - DNA, 22 bp, Homo sapiens
ccgtggctctgggagagccagc

SEQ ID NO: 869118 - DNA, 15 bp, Homo sapiens
ccgtggcttcccgct

SEQ ID NO: 869119 - DNA, 20 bp, Homo sapiens
ccgtggcttgggctggtcag

SEQ ID NO: 869120 - DNA, 21 bp, Homo sapiens
ccgtgggcgcaaaggtgcctc

SEQ ID NO: 869121 - DNA, 14 bp, Homo sapiens
ccgtggggaagggg

SEQ ID NO: 869122 - DNA, 18 bp, Homo sapiens
cctacactcacctgcact

SEQ ID NO: 869123 - DNA, 15 bp, Homo sapiens
cctacagaggaggcc

SEQ ID NO: 869124 - DNA, 22 bp, Homo sapiens
cctacagaggaggcctcaaagc

SEQ ID NO: 869125 - DNA, 15 bp, Homo sapiens
cctacagcactactg

SEQ ID NO: 869126 - DNA, 18 bp, Homo sapiens
cctacagcactactgggt

SEQ ID NO: 869127 - DNA, 21 bp, Homo sapiens
cctacagctttgatccctgac

SEQ ID NO: 869128 - DNA, 14 bp, Homo sapiens
cctacaggctgacg

SEQ ID NO: 869129 - DNA, 16 bp, Homo sapiens
cctacagtgctgtgta

SEQ ID NO: 869130 - DNA, 15 bp, Homo sapiens
cctacagttttaact

SEQ ID NO: 869131 - DNA, 17 bp, Homo sapiens
cctacagttttaactgt

SEQ ID NO: 869132 - DNA, 19 bp, Homo sapiens
cctacagttttaactgtgg

SEQ ID NO: 869133 - DNA, 21 bp, Homo sapiens
cctacagttttaactgtggat

SEQ ID NO: 869134 - DNA, 22 bp, Homo sapiens
cctacagttttaactgtggata

SEQ ID NO: 869135 - DNA, 16 bp, Homo sapiens
cctacatccagctcct

SEQ ID NO: 869136 - DNA, 17 bp, Homo sapiens
cctacatgccccctccc

SEQ ID NO: 869137 - DNA, 15 bp, Homo sapiens
cctacattccctctc

SEQ ID NO: 869138 - DNA, 12 bp, Homo sapiens
cctaccaaaaat

SEQ ID NO: 869139 - DNA, 20 bp, Homo sapiens
cctaccaaaaattgccaagt

SEQ ID NO: 869140 - DNA, 13 bp, Homo sapiens
cctaccaatgcat

SEQ ID NO: 869141 - DNA, 16 bp, Homo sapiens
cctaccaatgcatgca

SEQ ID NO: 869142 - DNA, 14 bp, Homo sapiens
cctaccacagtgtc

SEQ ID NO: 869143 - DNA, 17 bp, Homo sapiens
cctaccaccccttcctg

SEQ ID NO: 869144 - DNA, 18 bp, Homo sapiens
cctaccaccccttcctgt

SEQ ID NO: 869145 - DNA, 19 bp, Homo sapiens
cctaccagcgcccgctggg

SEQ ID NO: 869146 - DNA, 14 bp, Homo sapiens
cctaccatgctgct

SEQ ID NO: 869147 - DNA, 19 bp, Homo sapiens
cctacccaatgtctcccac

SEQ ID NO: 869148 - DNA, 20 bp, Homo sapiens
cctacccaatgtctcccaca

SEQ ID NO: 869149 - DNA, 21 bp, Homo sapiens
cctacccaatgtctcccacac

SEQ ID NO: 869150 - DNA, 18 bp, Homo sapiens
cctacccaccgatggagc

SEQ ID NO: 869151 - DNA, 14 bp, Homo sapiens
cctacccagcgtgg

SEQ ID NO: 869152 - DNA, 20 bp, Homo sapiens
cctacccagcgtggcccagg

SEQ ID NO: 869153 - DNA, 21 bp, Homo sapiens
cctacccagcgtggcccaggc

SEQ ID NO: 869154 - DNA, 19 bp, Homo sapiens
cctaccccacaccaggccg

SEQ ID NO: 869155 - DNA, 21 bp, Homo sapiens
cctaccccacaccaggccgtc

SEQ ID NO: 869156 - DNA, 23 bp, Homo sapiens
cctaccccacaccaggccgtcct

SEQ ID NO: 869157 - DNA, 11 bp, Homo sapiens
cctaccccacc

SEQ ID NO: 869158 - DNA, 14 bp, Homo sapiens
cctaccccaccacg

SEQ ID NO: 869159 - DNA, 12 bp, Homo sapiens
cctaccccatag

SEQ ID NO: 869160 - DNA, 16 bp, Homo sapiens
cctaccccctcatccc

SEQ ID NO: 869161 - DNA, 16 bp, Homo sapiens
cctaccccctcttcaa

SEQ ID NO: 869162 - DNA, 21 bp, Homo sapiens
cctaccccctcttcaaagcag

SEQ ID NO: 869163 - DNA, 13 bp, Homo sapiens
cctacccctgccc

SEQ ID NO: 869164 - DNA, 17 bp, Homo sapiens
cctacccctgccctgct

SEQ ID NO: 869165 - DNA, 18 bp, Homo sapiens
cctaccccttcctgtcct

SEQ ID NO: 869166 - DNA, 20 bp, Homo sapiens
cctaccccttcctgtcctgc

SEQ ID NO: 869167 - DNA, 23 bp, Homo sapiens
cctaccccttcctgtcctgcctc

SEQ ID NO: 869168 - DNA, 21 bp, Homo sapiens
cctaccctatggggaggccct

SEQ ID NO: 869169 - DNA, 19 bp, Homo sapiens
cctaccctcgggcccacct

SEQ ID NO: 869170 - DNA, 23 bp, Homo sapiens
cctaccctgcctcccttgacttt

SEQ ID NO: 869171 - DNA, 14 bp, Homo sapiens
cctaccctggactt

SEQ ID NO: 869172 - DNA, 16 bp, Homo sapiens
cctacccttcctgcat

SEQ ID NO: 869173 - DNA, 16 bp, Homo sapiens
cctaccgagtctcttc

SEQ ID NO: 869174 - DNA, 20 bp, Homo sapiens
cctaccgagtctcttctcca

SEQ ID NO: 869175 - DNA, 22 bp, Homo sapiens
cctaccgagtctcttctccact

SEQ ID NO: 869176 - DNA, 16 bp, Homo sapiens
cctaccgatggtccca

SEQ ID NO: 869177 - DNA, 19 bp, Homo sapiens
cctaccgtactccctgcac

SEQ ID NO: 869178 - DNA, 13 bp, Homo sapiens
cctacctcagcct

SEQ ID NO: 869179 - DNA, 13 bp, Homo sapiens
cctacctgatgga

SEQ ID NO: 869180 - DNA, 21 bp, Homo sapiens
cctacctgattggtgcaaccc

SEQ ID NO: 869181 - DNA, 14 bp, Homo sapiens
cctacctgtgcctg

SEQ ID NO: 869182 - DNA, 17 bp, Homo sapiens
cctacgcagatgctgtc

SEQ ID NO: 869183 - DNA, 18 bp, Homo sapiens
cctacgcagatgctgtca

SEQ ID NO: 869184 - DNA, 17 bp, Homo sapiens
cctacggagtcagccag

SEQ ID NO: 869185 - DNA, 18 bp, Homo sapiens
cctacgttcctggccccc

SEQ ID NO: 869186 - DNA, 18 bp, Homo sapiens
cctacgtttgcaccgcct

SEQ ID NO: 869187 - DNA, 22 bp, Homo sapiens
cctacgtttgcaccgcctgccc

SEQ ID NO: 869188 - DNA, 21 bp, Homo sapiens
cctactacccattgttccctt

SEQ ID NO: 869189 - DNA, 19 bp, Homo sapiens
cctactaggagaggggggc

SEQ ID NO: 869190 - DNA, 22 bp, Homo sapiens
cctactaggccattagcccttc

SEQ ID NO: 869191 - DNA, 16 bp, Homo sapiens
cctactatcactgaac

SEQ ID NO: 869192 - DNA, 16 bp, Homo sapiens
cctactccactgccct

SEQ ID NO: 869193 - DNA, 18 bp, Homo sapiens
cctactccactgccctgg

SEQ ID NO: 869194 - DNA, 19 bp, Homo sapiens
cctactccactgccctggc

SEQ ID NO: 869195 - DNA, 20 bp, Homo sapiens
cctactccctcttcactgtg

SEQ ID NO: 869196 - DNA, 13 bp, Homo sapiens
cctactccctgca

SEQ ID NO: 869197 - DNA, 17 bp, Homo sapiens
cctactccgctcactga

SEQ ID NO: 869198 - DNA, 14 bp, Homo sapiens
cctactccgttcct

SEQ ID NO: 869199 - DNA, 16 bp, Homo sapiens
cctactccgttcctgg

SEQ ID NO: 869200 - DNA, 12 bp, Homo sapiens
cctactctgtgt

SEQ ID NO: 869201 - DNA, 22 bp, Homo sapiens
cctactgaaccctgcctcttgt

SEQ ID NO: 869202 - DNA, 12 bp, Homo sapiens
cctactgcccac

SEQ ID NO: 869203 - DNA, 11 bp, Homo sapiens
cctactgctgt

SEQ ID NO: 869204 - DNA, 16 bp, Homo sapiens
cctactggacgctgcc

SEQ ID NO: 869205 - DNA, 15 bp, Homo sapiens
cctactggagtcccg

SEQ ID NO: 869206 - DNA, 15 bp, Homo sapiens
cctacttagggaaga

SEQ ID NO: 869207 - DNA, 13 bp, Homo sapiens
cctacttcccctt

SEQ ID NO: 869208 - DNA, 16 bp, Homo sapiens
cctacttccccttcct

SEQ ID NO: 869209 - DNA, 20 bp, Homo sapiens
cctacttctgactttacttg

SEQ ID NO: 869210 - DNA, 16 bp, Homo sapiens
cctacttcttttgctc

SEQ ID NO: 869211 - DNA, 18 bp, Homo sapiens
cctacttgtgactgaagg

SEQ ID NO: 869212 - DNA, 15 bp, Homo sapiens
cctactttgactttt

SEQ ID NO: 869213 - DNA, 17 bp, Homo sapiens
cctactttgcttccgcc

SEQ ID NO: 869214 - DNA, 19 bp, Homo sapiens
cctactttgcttccgccac

SEQ ID NO: 869215 - DNA, 17 bp, Homo sapiens
cctagaaacccaagctc

SEQ ID NO: 869216 - DNA, 23 bp, Homo sapiens
cctagaaatatctttctcttacc

SEQ ID NO: 869217 - DNA, 22 bp, Homo sapiens
cctagaaattgaacaaaaatgt

SEQ ID NO: 869218 - DNA, 16 bp, Homo sapiens
cctagaacatccctgg

SEQ ID NO: 869219 - DNA, 17 bp, Homo sapiens
cctagaagaaaacccga

SEQ ID NO: 869220 - DNA, 20 bp, Homo sapiens
cctagaagagcacagagccc

SEQ ID NO: 869221 - DNA, 21 bp, Homo sapiens
cctagaagagcacagagccct

SEQ ID NO: 869222 - DNA, 11 bp, Homo sapiens
cctagaatgtc

SEQ ID NO: 869223 - DNA, 19 bp, Homo sapiens
cctagaatgtttcatttgc

SEQ ID NO: 869224 - DNA, 18 bp, Homo sapiens
cctagacaacctttctgt

SEQ ID NO: 869225 - DNA, 18 bp, Homo sapiens
cctagaccagtttgcatg

SEQ ID NO: 869226 - DNA, 17 bp, Homo sapiens
cctagacttctgagtaa

SEQ ID NO: 869227 - DNA, 21 bp, Homo sapiens
cctagagaatgggatgtgtga

SEQ ID NO: 869228 - DNA, 16 bp, Homo sapiens
cctccctcccacactt

SEQ ID NO: 869229 - DNA, 13 bp, Homo sapiens
cctccctcccagc

SEQ ID NO: 869230 - DNA, 19 bp, Homo sapiens
cctccctcccggcatggga

SEQ ID NO: 869231 - DNA, 19 bp, Homo sapiens
cctccctcccggctgcccc

SEQ ID NO: 869232 - DNA, 13 bp, Homo sapiens
cctccctccctct

SEQ ID NO: 869233 - DNA, 14 bp, Homo sapiens
cctccctccctctc

SEQ ID NO: 869234 - DNA, 14 bp, Homo sapiens
cctccctccctctt

SEQ ID NO: 869235 - DNA, 11 bp, Homo sapiens
cctccctcctc

SEQ ID NO: 869236 - DNA, 15 bp, Homo sapiens
cctccctcctcaggg

SEQ ID NO: 869237 - DNA, 15 bp, Homo sapiens
cctccctcctgccga

SEQ ID NO: 869238 - DNA, 14 bp, Homo sapiens
cctccctcgtgggc

SEQ ID NO: 869239 - DNA, 21 bp, Homo sapiens
cctccctcgtgggcttgtgct

SEQ ID NO: 869240 - DNA, 13 bp, Homo sapiens
cctccctctctct

SEQ ID NO: 869241 - DNA, 13 bp, Homo sapiens
cctccctctcttc

SEQ ID NO: 869242 - DNA, 15 bp, Homo sapiens
cctccctctgcccca

SEQ ID NO: 869243 - DNA, 19 bp, Homo sapiens
cctccctgactccctgtgg

SEQ ID NO: 869244 - DNA, 16 bp, Homo sapiens
cctccctgagcctgca

SEQ ID NO: 869245 - DNA, 20 bp, Homo sapiens
cctccctgcatctgaccagc

SEQ ID NO: 869246 - DNA, 22 bp, Homo sapiens
cctccctgcatctgaccagcag

SEQ ID NO: 869247 - DNA, 12 bp, Homo sapiens
cctccctgcccc

SEQ ID NO: 869248 - DNA, 18 bp, Homo sapiens
cctccctgccccccaagg

SEQ ID NO: 869249 - DNA, 18 bp, Homo sapiens
cctccctgcccctccctt

SEQ ID NO: 869250 - DNA, 12 bp, Homo sapiens
cctccctgcctc

SEQ ID NO: 869251 - DNA, 13 bp, Homo sapiens
cctccctgcctga

SEQ ID NO: 869252 - DNA, 16 bp, Homo sapiens
cctccctgcctgctcc

SEQ ID NO: 869253 - DNA, 18 bp, Homo sapiens
cctccctgctcctcatgg

SEQ ID NO: 869254 - DNA, 12 bp, Homo sapiens
cctccctgctgt

SEQ ID NO: 869255 - DNA, 15 bp, Homo sapiens
cctccctgctgtgcc

SEQ ID NO: 869256 - DNA, 23 bp, Homo sapiens
cctccctgctgtgccatgctggg

SEQ ID NO: 869257 - DNA, 14 bp, Homo sapiens
cctccctggcactg

SEQ ID NO: 869258 - DNA, 13 bp, Homo sapiens
cctccctggctcc

SEQ ID NO: 869259 - DNA, 14 bp, Homo sapiens
cctccctggctgcc

SEQ ID NO: 869260 - DNA, 21 bp, Homo sapiens
cctccctggctgccctggccc

SEQ ID NO: 869261 - DNA, 15 bp, Homo sapiens
cctccctgggccacc

SEQ ID NO: 869262 - DNA, 17 bp, Homo sapiens
cctccctgggccacctc

SEQ ID NO: 869263 - DNA, 22 bp, Homo sapiens
cctccctgggccacctcctacc

SEQ ID NO: 869264 - DNA, 12 bp, Homo sapiens
cctccctgggtt

SEQ ID NO: 869265 - DNA, 15 bp, Homo sapiens
cctccctgggttcag

SEQ ID NO: 869266 - DNA, 14 bp, Homo sapiens
cctccctgtcctcc

SEQ ID NO: 869267 - DNA, 14 bp, Homo sapiens
cctccctgtctcca

SEQ ID NO: 869268 - DNA, 15 bp, Homo sapiens
cctccctgtctccag

SEQ ID NO: 869269 - DNA, 16 bp, Homo sapiens
cctccctgtctccagc

SEQ ID NO: 869270 - DNA, 22 bp, Homo sapiens
cctccctgtctccagctgcctg

SEQ ID NO: 869271 - DNA, 16 bp, Homo sapiens
cctccctgtctccagg

SEQ ID NO: 869272 - DNA, 18 bp, Homo sapiens
cctccctgtgcccccagc

SEQ ID NO: 869273 - DNA, 16 bp, Homo sapiens
cctccctgtttctcca

SEQ ID NO: 869274 - DNA, 17 bp, Homo sapiens
cctcccttacagagcat

SEQ ID NO: 869275 - DNA, 10 bp, Homo sapiens
cctcccttcc

SEQ ID NO: 869276 - DNA, 12 bp, Homo sapiens
cctcccttccca

SEQ ID NO: 869277 - DNA, 13 bp, Homo sapiens
cctcccttcccag

SEQ ID NO: 869278 - DNA, 15 bp, Homo sapiens
cctcccttcccagtg

SEQ ID NO: 869279 - DNA, 16 bp, Homo sapiens
cctcccttcccagtgg

SEQ ID NO: 869280 - DNA, 22 bp, Homo sapiens
cctcccttccgaccctctggga

SEQ ID NO: 869281 - DNA, 22 bp, Homo sapiens
cctcccttccttttccctgctt

SEQ ID NO: 869282 - DNA, 15 bp, Homo sapiens
cctcccttctccctg

SEQ ID NO: 869283 - DNA, 16 bp, Homo sapiens
cctcccttctccctgg

SEQ ID NO: 869284 - DNA, 17 bp, Homo sapiens
cctcccttctccctgga

SEQ ID NO: 869285 - DNA, 13 bp, Homo sapiens
cctcccttctgct

SEQ ID NO: 869286 - DNA, 16 bp, Homo sapiens
cctcccttctgctact

SEQ ID NO: 869287 - DNA, 17 bp, Homo sapiens
cctcccttctgctactg

SEQ ID NO: 869288 - DNA, 18 bp, Homo sapiens
cctcccttgccccaggcc

SEQ ID NO: 869289 - DNA, 22 bp, Homo sapiens
cctcccttgccccaggccaggt

SEQ ID NO: 869290 - DNA, 12 bp, Homo sapiens
cctcccttgctc

SEQ ID NO: 869291 - DNA, 23 bp, Homo sapiens
cctcccttggaaacctgccctgc

SEQ ID NO: 869292 - DNA, 20 bp, Homo sapiens
cctcccttggggcctatgca

SEQ ID NO: 869293 - DNA, 19 bp, Homo sapiens
cctcccttgggttctgata

SEQ ID NO: 869294 - DNA, 20 bp, Homo sapiens
cctccgaccacttccagggg

SEQ ID NO: 869295 - DNA, 22 bp, Homo sapiens
cctccgaccacttccaggggaa

SEQ ID NO: 869296 - DNA, 16 bp, Homo sapiens
cctccgacctctctcg

SEQ ID NO: 869297 - DNA, 16 bp, Homo sapiens
cctccgactccagata

SEQ ID NO: 869298 - DNA, 17 bp, Homo sapiens
cctccgagaggcagcca

SEQ ID NO: 869299 - DNA, 14 bp, Homo sapiens
cctccgagcttggg

SEQ ID NO: 869300 - DNA, 15 bp, Homo sapiens
cctccgcagtgtctc

SEQ ID NO: 869301 - DNA, 17 bp, Homo sapiens
cctccgcagtgtctcca

SEQ ID NO: 869302 - DNA, 16 bp, Homo sapiens
cctccgccctgccact

SEQ ID NO: 869303 - DNA, 18 bp, Homo sapiens
cctccgccctgccactca

SEQ ID NO: 869304 - DNA, 16 bp, Homo sapiens
cctccgcctccaggaa

SEQ ID NO: 869305 - DNA, 13 bp, Homo sapiens
cctccgcctggga

SEQ ID NO: 869306 - DNA, 16 bp, Homo sapiens
cctccgcctgtgtcca

SEQ ID NO: 869307 - DNA, 20 bp, Homo sapiens
cctccgcgtgatcaaagcca

SEQ ID NO: 869308 - DNA, 17 bp, Homo sapiens
cctccgcttgccagagg

SEQ ID NO: 869309 - DNA, 19 bp, Homo sapiens
cctccgcttgccagaggcc

SEQ ID NO: 869310 - DNA, 14 bp, Homo sapiens
cctccggagcctca

SEQ ID NO: 869311 - DNA, 19 bp, Homo sapiens
cctccggaggagcagcctc

SEQ ID NO: 869312 - DNA, 12 bp, Homo sapiens
cctccggcctcc

SEQ ID NO: 869313 - DNA, 16 bp, Homo sapiens
cctccggcctcccctc

SEQ ID NO: 869314 - DNA, 18 bp, Homo sapiens
cctccggcgtcttgccca

SEQ ID NO: 869315 - DNA, 15 bp, Homo sapiens
cctccgggcagggga

SEQ ID NO: 869316 - DNA, 22 bp, Homo sapiens
cctccgggcaggggagccaggg

SEQ ID NO: 869317 - DNA, 22 bp, Homo sapiens
cctccgtcatccatgccctccc

SEQ ID NO: 869318 - DNA, 18 bp, Homo sapiens
cctccgtccacccaggct

SEQ ID NO: 869319 - DNA, 16 bp, Homo sapiens
cctcctcacccccagc

SEQ ID NO: 869320 - DNA, 22 bp, Homo sapiens
cctcctcacctcatgcccaccc

SEQ ID NO: 869321 - DNA, 15 bp, Homo sapiens
cctcctcacctctgg

SEQ ID NO: 869322 - DNA, 16 bp, Homo sapiens
cctcctcagcctctgc

SEQ ID NO: 869323 - DNA, 19 bp, Homo sapiens
cctcctcagcctctgcaac

SEQ ID NO: 869324 - DNA, 22 bp, Homo sapiens
cctcctcagctgcatggagcct

SEQ ID NO: 869325 - DNA, 15 bp, Homo sapiens
cctcctcaggcccag

SEQ ID NO: 869326 - DNA, 13 bp, Homo sapiens
cctcctcaggggg

SEQ ID NO: 869327 - DNA, 14 bp, Homo sapiens
cctcctcagggggt

SEQ ID NO: 869328 - DNA, 14 bp, Homo sapiens
cctcctcagtgaag

SEQ ID NO: 869329 - DNA, 12 bp, Homo sapiens
cctcctcatgta

SEQ ID NO: 869330 - DNA, 21 bp, Homo sapiens
cctcctcatgtacataccctg

SEQ ID NO: 869331 - DNA, 15 bp, Homo sapiens
cctcctccacaccag

SEQ ID NO: 869332 - DNA, 17 bp, Homo sapiens
cctcctccacagtgctg

SEQ ID NO: 869333 - DNA, 18 bp, Homo sapiens
cctcctccacagtgctgc

SEQ ID NO: 869334 - DNA, 13 bp, Homo sapiens
cctcctccactca

SEQ ID NO: 869335 - DNA, 14 bp, Homo sapiens
cctcctccactcac

SEQ ID NO: 869336 - DNA, 22 bp, Homo sapiens
cctcctccactcactccagccc

SEQ ID NO: 869337 - DNA, 15 bp, Homo sapiens
cctcctccactccac

SEQ ID NO: 869338 - DNA, 16 bp, Homo sapiens
cctcctccagcccctg

SEQ ID NO: 869339 - DNA, 15 bp, Homo sapiens
cctcctccaggcctg

SEQ ID NO: 869340 - DNA, 12 bp, Homo sapiens
cctcctccagta

SEQ ID NO: 869341 - DNA, 21 bp, Homo sapiens
cctcctccatcacctgaaaca

SEQ ID NO: 869342 - DNA, 15 bp, Homo sapiens
cctcctcccatccag

SEQ ID NO: 869343 - DNA, 14 bp, Homo sapiens
cctcctcccatgtc

SEQ ID NO: 869344 - DNA, 13 bp, Homo sapiens
cctcctcccccag

SEQ ID NO: 869345 - DNA, 16 bp, Homo sapiens
cctcctccccctgttc

SEQ ID NO: 869346 - DNA, 13 bp, Homo sapiens
cctcctccccctt

SEQ ID NO: 869347 - DNA, 14 bp, Homo sapiens
cctcctcccccttt

SEQ ID NO: 869348 - DNA, 14 bp, Homo sapiens
cctcctcccctcct

SEQ ID NO: 869349 - DNA, 14 bp, Homo sapiens
cctcctccctccaa

SEQ ID NO: 869350 - DNA, 20 bp, Homo sapiens
cctcctccctccaagcctgg

SEQ ID NO: 869351 - DNA, 18 bp, Homo sapiens
cctcctccctcctgccga

SEQ ID NO: 869352 - DNA, 13 bp, Homo sapiens
cctcctccctgca

SEQ ID NO: 869353 - DNA, 17 bp, Homo sapiens
cctcctccctgcatctg

SEQ ID NO: 869354 - DNA, 12 bp, Homo sapiens
cctcctcctgac

SEQ ID NO: 869355 - DNA, 23 bp, Homo sapiens
cctcctcgctcctccttcccagg

SEQ ID NO: 869356 - DNA, 18 bp, Homo sapiens
cctcctcggagagcagca

SEQ ID NO: 869357 - DNA, 19 bp, Homo sapiens
cctcctctaaggttgggca

SEQ ID NO: 869358 - DNA, 14 bp, Homo sapiens
cctcctctcagtgt

SEQ ID NO: 869359 - DNA, 14 bp, Homo sapiens
cctcctctccatgc

SEQ ID NO: 869360 - DNA, 14 bp, Homo sapiens
cctcctctcccatc

SEQ ID NO: 869361 - DNA, 19 bp, Homo sapiens
cctcctctcccatccttga

SEQ ID NO: 869362 - DNA, 12 bp, Homo sapiens
cctcctctgcca

SEQ ID NO: 869363 - DNA, 15 bp, Homo sapiens
cctcctctgccacct

SEQ ID NO: 869364 - DNA, 18 bp, Homo sapiens
cctcctctgccacctccc

SEQ ID NO: 869365 - DNA, 15 bp, Homo sapiens
cctcctctgcctaca

SEQ ID NO: 869366 - DNA, 14 bp, Homo sapiens
cctcctctgctggg

SEQ ID NO: 869367 - DNA, 11 bp, Homo sapiens
cctcctctggc

SEQ ID NO: 869368 - DNA, 23 bp, Homo sapiens
cctcctctggcaggcttccccct

SEQ ID NO: 869369 - DNA, 22 bp, Homo sapiens
cctcctcttcccttagcctctc

SEQ ID NO: 869370 - DNA, 12 bp, Homo sapiens
cctcctcttgga

SEQ ID NO: 869371 - DNA, 20 bp, Homo sapiens
cctcctgaaacttacacaca

SEQ ID NO: 869372 - DNA, 19 bp, Homo sapiens
cctcctgaagcctctgccc

SEQ ID NO: 869373 - DNA, 23 bp, Homo sapiens
cctcctgacaacgtctcttcaag

SEQ ID NO: 869374 - DNA, 18 bp, Homo sapiens
cctcctgatggccaagag

SEQ ID NO: 869375 - DNA, 13 bp, Homo sapiens
cctcctgcagaca

SEQ ID NO: 869376 - DNA, 19 bp, Homo sapiens
cctcctgcagacacctgga

SEQ ID NO: 869377 - DNA, 19 bp, Homo sapiens
cctcctgcagaccacgccc

SEQ ID NO: 869378 - DNA, 11 bp, Homo sapiens
cctcctgcagt

SEQ ID NO: 869379 - DNA, 21 bp, Homo sapiens
cctcctgcccagctcctcaca

SEQ ID NO: 869380 - DNA, 22 bp, Homo sapiens
cctcctgcccagctcctcacat

SEQ ID NO: 869381 - DNA, 19 bp, Homo sapiens
cctcctgcccaggagagcc

SEQ ID NO: 869382 - DNA, 23 bp, Homo sapiens
cctcctgcccaggagagccagcc

SEQ ID NO: 869383 - DNA, 19 bp, Homo sapiens
cctcctgccccctgccagt

SEQ ID NO: 869384 - DNA, 16 bp, Homo sapiens
cctcctgccctgtccc

SEQ ID NO: 869385 - DNA, 14 bp, Homo sapiens
cctcctgcctcagc

SEQ ID NO: 869386 - DNA, 17 bp, Homo sapiens
cctcctgcggctcagcc

SEQ ID NO: 869387 - DNA, 22 bp, Homo sapiens
cctcctgcggctcagccttgca

SEQ ID NO: 869388 - DNA, 11 bp, Homo sapiens
cctcctgctca

SEQ ID NO: 869389 - DNA, 20 bp, Homo sapiens
cctcctgctcctcacccctg

SEQ ID NO: 869390 - DNA, 14 bp, Homo sapiens
cctcctgctcctcc

SEQ ID NO: 869391 - DNA, 15 bp, Homo sapiens
cctcctgctcctccc

SEQ ID NO: 869392 - DNA, 19 bp, Homo sapiens
cctcctgctcctccctgcc

SEQ ID NO: 869393 - DNA, 13 bp, Homo sapiens
cctcctgctttta

SEQ ID NO: 869394 - DNA, 21 bp, Homo sapiens
cctcctggaaccttgctgtcc

SEQ ID NO: 869395 - DNA, 22 bp, Homo sapiens
cctcctggaatcagtatttcct

SEQ ID NO: 869396 - DNA, 13 bp, Homo sapiens
cctcctggagcag

SEQ ID NO: 869397 - DNA, 14 bp, Homo sapiens
cctcctggagcaga

SEQ ID NO: 869398 - DNA, 16 bp, Homo sapiens
cctcctggaggaccag

SEQ ID NO: 869399 - DNA, 12 bp, Homo sapiens
cctcctggccag

SEQ ID NO: 869400 - DNA, 20 bp, Homo sapiens
cctcctggcccgccctcacc

SEQ ID NO: 869401 - DNA, 20 bp, Homo sapiens
cctcctgggattggctgtga

SEQ ID NO: 869402 - DNA, 17 bp, Homo sapiens
cctcctgggggctggct

SEQ ID NO: 869403 - DNA, 21 bp, Homo sapiens
cctcctgggggctggctccca

SEQ ID NO: 869404 - DNA, 12 bp, Homo sapiens
cctcctggtcct

SEQ ID NO: 869405 - DNA, 22 bp, Homo sapiens
cctcctggtcctggacacctcc

SEQ ID NO: 869406 - DNA, 17 bp, Homo sapiens
cctcctggtttcctttc

SEQ ID NO: 869407 - DNA, 22 bp, Homo sapiens
cctcctgtaaatggtgtacata

SEQ ID NO: 869408 - DNA, 18 bp, Homo sapiens
cctcctgtcactcactga

SEQ ID NO: 869409 - DNA, 21 bp, Homo sapiens
cctcctgtctaatttgcacct

SEQ ID NO: 869410 - DNA, 17 bp, Homo sapiens
cctcctgtgccccagct

SEQ ID NO: 869411 - DNA, 14 bp, Homo sapiens
cctcctgtgcctgg

SEQ ID NO: 869412 - DNA, 15 bp, Homo sapiens
cctcctgttccgtgt

SEQ ID NO: 869413 - DNA, 14 bp, Homo sapiens
cctcctgttctgaa

SEQ ID NO: 869414 - DNA, 17 bp, Homo sapiens
cctcctgttctgcccac

SEQ ID NO: 869415 - DNA, 18 bp, Homo sapiens
cctcctgttttctccctc

SEQ ID NO: 869416 - DNA, 21 bp, Homo sapiens
cctcctgttttctccctctca

SEQ ID NO: 869417 - DNA, 22 bp, Homo sapiens
cctccttcagacaccctcaacc

SEQ ID NO: 869418 - DNA, 17 bp, Homo sapiens
cctccttccacctccct

SEQ ID NO: 869419 - DNA, 16 bp, Homo sapiens
cctccttccagcactg

SEQ ID NO: 869420 - DNA, 12 bp, Homo sapiens
cctccttcccag

SEQ ID NO: 869421 - DNA, 14 bp, Homo sapiens
cctccttcccatgc

SEQ ID NO: 869422 - DNA, 17 bp, Homo sapiens
cctccttcccatgcctg

SEQ ID NO: 869423 - DNA, 11 bp, Homo sapiens
cctccttcccc

SEQ ID NO: 869424 - DNA, 16 bp, Homo sapiens
cctccttcccgccgcc

SEQ ID NO: 869425 - DNA, 14 bp, Homo sapiens
cctccttccctcct

SEQ ID NO: 869426 - DNA, 12 bp, Homo sapiens
cctccttcctgg

SEQ ID NO: 869427 - DNA, 15 bp, Homo sapiens
cctccttcctgggac

SEQ ID NO: 869428 - DNA, 22 bp, Homo sapiens
cctccttcctgggaccccctcg

SEQ ID NO: 869429 - DNA, 13 bp, Homo sapiens
cctccttctcctt

SEQ ID NO: 869430 - DNA, 17 bp, Homo sapiens
cctccttgcaaccaggc

SEQ ID NO: 869431 - DNA, 20 bp, Homo sapiens
cctccttgcaaccaggcagc

SEQ ID NO: 869432 - DNA, 19 bp, Homo sapiens
cctccttgcctcctgtgta

SEQ ID NO: 869433 - DNA, 12 bp, Homo sapiens
cctccttgctga

SEQ ID NO: 869434 - DNA, 16 bp, Homo sapiens
cctccttgtgttgcac

SEQ ID NO: 869435 - DNA, 16 bp, Homo sapiens
cctcctttctgtgccc

SEQ ID NO: 869436 - DNA, 23 bp, Homo sapiens
cctcctttgtcttttttttcatc

SEQ ID NO: 869437 - DNA, 15 bp, Homo sapiens
cctccttttcacttt

SEQ ID NO: 869438 - DNA, 18 bp, Homo sapiens
cctccttttgcttgaaac

SEQ ID NO: 869439 - DNA, 21 bp, Homo sapiens
cctcctttttccatgccctaa

SEQ ID NO: 869440 - DNA, 17 bp, Homo sapiens
cctcgaaccaaggcagc

SEQ ID NO: 869441 - DNA, 23 bp, Homo sapiens
cctcgaaccaaggcagcctccag

SEQ ID NO: 869442 - DNA, 15 bp, Homo sapiens
cctctctgctctgcg

SEQ ID NO: 869443 - DNA, 16 bp, Homo sapiens
cctctctgctctgcgt

SEQ ID NO: 869444 - DNA, 15 bp, Homo sapiens
cctctctggcctccc

SEQ ID NO: 869445 - DNA, 19 bp, Homo sapiens
cctctctggcctcccaccc

SEQ ID NO: 869446 - DNA, 21 bp, Homo sapiens
cctctctgggacctaggggga

SEQ ID NO: 869447 - DNA, 12 bp, Homo sapiens
cctctctgggcc

SEQ ID NO: 869448 - DNA, 21 bp, Homo sapiens
cctctctgggggaggcagggc

SEQ ID NO: 869449 - DNA, 23 bp, Homo sapiens
cctctctgggggaggcagggctg

SEQ ID NO: 869450 - DNA, 19 bp, Homo sapiens
cctctctgtgtccctgctg

SEQ ID NO: 869451 - DNA, 22 bp, Homo sapiens
cctctcttaagatgtccagggc

SEQ ID NO: 869452 - DNA, 21 bp, Homo sapiens
cctctcttcagcccctagtgc

SEQ ID NO: 869453 - DNA, 11 bp, Homo sapiens
cctctcttccc

SEQ ID NO: 869454 - DNA, 13 bp, Homo sapiens
cctctcttcttcc

SEQ ID NO: 869455 - DNA, 13 bp, Homo sapiens
cctctcttgcacc

SEQ ID NO: 869456 - DNA, 18 bp, Homo sapiens
cctctcttgcacccgcct

SEQ ID NO: 869457 - DNA, 13 bp, Homo sapiens
cctctcttgcccc

SEQ ID NO: 869458 - DNA, 22 bp, Homo sapiens
cctctcttttcctctctgtctg

SEQ ID NO: 869459 - DNA, 21 bp, Homo sapiens
cctctgaaattaaagaaatga

SEQ ID NO: 869460 - DNA, 16 bp, Homo sapiens
cctctgacagcagcct

SEQ ID NO: 869461 - DNA, 17 bp, Homo sapiens
cctctgacagcagcctg

SEQ ID NO: 869462 - DNA, 18 bp, Homo sapiens
cctctgacagcagcctgt

SEQ ID NO: 869463 - DNA, 21 bp, Homo sapiens
cctctgacagcagcctgtgag

SEQ ID NO: 869464 - DNA, 22 bp, Homo sapiens
cctctgaccctagctctttcct

SEQ ID NO: 869465 - DNA, 23 bp, Homo sapiens
cctctgaccctccttctattttc

SEQ ID NO: 869466 - DNA, 14 bp, Homo sapiens
cctctgacctgcac

SEQ ID NO: 869467 - DNA, 15 bp, Homo sapiens
cctctgacctgcagg

SEQ ID NO: 869468 - DNA, 17 bp, Homo sapiens
cctctgacctgcaggcc

SEQ ID NO: 869469 - DNA, 12 bp, Homo sapiens
cctctgactcag

SEQ ID NO: 869470 - DNA, 16 bp, Homo sapiens
cctctgactcagggct

SEQ ID NO: 869471 - DNA, 14 bp, Homo sapiens
cctctgactctgag

SEQ ID NO: 869472 - DNA, 18 bp, Homo sapiens
cctctgactctgagtcca

SEQ ID NO: 869473 - DNA, 13 bp, Homo sapiens
cctctgaggacag

SEQ ID NO: 869474 - DNA, 16 bp, Homo sapiens
cctctgatctccatgg

SEQ ID NO: 869475 - DNA, 15 bp, Homo sapiens
cctctgattgttccc

SEQ ID NO: 869476 - DNA, 14 bp, Homo sapiens
cctctgcaactgca

SEQ ID NO: 869477 - DNA, 16 bp, Homo sapiens
cctctgcaactgctca

SEQ ID NO: 869478 - DNA, 11 bp, Homo sapiens
cctctgcacaa

SEQ ID NO: 869479 - DNA, 19 bp, Homo sapiens
cctctgcacctttgcacgt

SEQ ID NO: 869480 - DNA, 21 bp, Homo sapiens
cctctgcactactgacatgtg

SEQ ID NO: 869481 - DNA, 16 bp, Homo sapiens
cctctgcactcccacc

SEQ ID NO: 869482 - DNA, 14 bp, Homo sapiens
cctctgcagaatcc

SEQ ID NO: 869483 - DNA, 14 bp, Homo sapiens
cctctgcagcaata

SEQ ID NO: 869484 - DNA, 19 bp, Homo sapiens
cctctgcagcaataaagca

SEQ ID NO: 869485 - DNA, 16 bp, Homo sapiens
cctctgcagcacttta

SEQ ID NO: 869486 - DNA, 15 bp, Homo sapiens
cctctgcagccggag

SEQ ID NO: 869487 - DNA, 23 bp, Homo sapiens
cctctgcagccggaggaggagat

SEQ ID NO: 869488 - DNA, 13 bp, Homo sapiens
cctctgcagctga

SEQ ID NO: 869489 - DNA, 17 bp, Homo sapiens
cctctgcagctgacctc

SEQ ID NO: 869490 - DNA, 16 bp, Homo sapiens
cctctgcagtgccttg

SEQ ID NO: 869491 - DNA, 14 bp, Homo sapiens
cctctgcattttgt

SEQ ID NO: 869492 - DNA, 20 bp, Homo sapiens
cctctgccaaaggatgtgat

SEQ ID NO: 869493 - DNA, 22 bp, Homo sapiens
cctctgccaaaggatgtgatat

SEQ ID NO: 869494 - DNA, 12 bp, Homo sapiens
cctctgccacct

SEQ ID NO: 869495 - DNA, 14 bp, Homo sapiens
cctctgccagcgcc

SEQ ID NO: 869496 - DNA, 14 bp, Homo sapiens
cctctgcccagctt

SEQ ID NO: 869497 - DNA, 11 bp, Homo sapiens
cctctgcccca

SEQ ID NO: 869498 - DNA, 16 bp, Homo sapiens
cctctgccccaagcag

SEQ ID NO: 869499 - DNA, 18 bp, Homo sapiens
cctctgccccaagcagcc

SEQ ID NO: 869500 - DNA, 19 bp, Homo sapiens
cctctgccccaagcagcca

SEQ ID NO: 869501 - DNA, 20 bp, Homo sapiens
cctctgccccaagcagccag

SEQ ID NO: 869502 - DNA, 18 bp, Homo sapiens
cctctgcccgcagagccc

SEQ ID NO: 869503 - DNA, 14 bp, Homo sapiens
cctctgccctgcct

SEQ ID NO: 869504 - DNA, 15 bp, Homo sapiens
cctctgccctgcctc

SEQ ID NO: 869505 - DNA, 15 bp, Homo sapiens
cctctgcccttcccc

SEQ ID NO: 869506 - DNA, 20 bp, Homo sapiens
cctctgccggtcgggcagcc

SEQ ID NO: 869507 - DNA, 17 bp, Homo sapiens
cctctgcctacagccag

SEQ ID NO: 869508 - DNA, 11 bp, Homo sapiens
cctctgcctca

SEQ ID NO: 869509 - DNA, 14 bp, Homo sapiens
cctctgcctcaatg

SEQ ID NO: 869510 - DNA, 14 bp, Homo sapiens
cctctgcctcctca

SEQ ID NO: 869511 - DNA, 13 bp, Homo sapiens
cctctgcctgcac

SEQ ID NO: 869512 - DNA, 20 bp, Homo sapiens
cctctgcctgcactccctgg

SEQ ID NO: 869513 - DNA, 16 bp, Homo sapiens
cctctgcctgccccgc

SEQ ID NO: 869514 - DNA, 14 bp, Homo sapiens
cctctgcctgtccc

SEQ ID NO: 869515 - DNA, 18 bp, Homo sapiens
cctctgcctgtccctctc

SEQ ID NO: 869516 - DNA, 22 bp, Homo sapiens
cctctgcctgtccctctcaggc

SEQ ID NO: 869517 - DNA, 19 bp, Homo sapiens
cctctgcctgtctccccca

SEQ ID NO: 869518 - DNA, 14 bp, Homo sapiens
cctctgccttcagg

SEQ ID NO: 869519 - DNA, 17 bp, Homo sapiens
cctctgccttcaggctt

SEQ ID NO: 869520 - DNA, 19 bp, Homo sapiens
cctctgccttcaggcttct

SEQ ID NO: 869521 - DNA, 20 bp, Homo sapiens
cctctgctatgcattttctt

SEQ ID NO: 869522 - DNA, 22 bp, Homo sapiens
cctctgctatgcattttcttca

SEQ ID NO: 869523 - DNA, 20 bp, Homo sapiens
cctctgctcaccgcccatca

SEQ ID NO: 869524 - DNA, 21 bp, Homo sapiens
cctctgctcaccgcccatcag

SEQ ID NO: 869525 - DNA, 20 bp, Homo sapiens
cctctgctccaaaggaaatc

SEQ ID NO: 869526 - DNA, 13 bp, Homo sapiens
cctctgctccagc

SEQ ID NO: 869527 - DNA, 13 bp, Homo sapiens
cctctgctcccca

SEQ ID NO: 869528 - DNA, 21 bp, Homo sapiens
cctctgctctgaggcttccag

SEQ ID NO: 869529 - DNA, 19 bp, Homo sapiens
cctctgctctgcctggagt

SEQ ID NO: 869530 - DNA, 14 bp, Homo sapiens
cctctgctgagtgc

SEQ ID NO: 869531 - DNA, 19 bp, Homo sapiens
cctctgctgagtgctgggc

SEQ ID NO: 869532 - DNA, 14 bp, Homo sapiens
cctctgctgccatg

SEQ ID NO: 869533 - DNA, 12 bp, Homo sapiens
cctctgctgctg

SEQ ID NO: 869534 - DNA, 17 bp, Homo sapiens
cctctgctgctgcccgg

SEQ ID NO: 869535 - DNA, 11 bp, Homo sapiens
cctctgctggg

SEQ ID NO: 869536 - DNA, 18 bp, Homo sapiens
cctctgcttactttttat

SEQ ID NO: 869537 - DNA, 15 bp, Homo sapiens
cctctgcttctcatc

SEQ ID NO: 869538 - DNA, 12 bp, Homo sapiens
cctctggacacg

SEQ ID NO: 869539 - DNA, 15 bp, Homo sapiens
cctctggacagccag

SEQ ID NO: 869540 - DNA, 16 bp, Homo sapiens
cctctggacagttgtg

SEQ ID NO: 869541 - DNA, 16 bp, Homo sapiens
cctctggacggcaggc

SEQ ID NO: 869542 - DNA, 21 bp, Homo sapiens
cctctggacggcaggctcact

SEQ ID NO: 869543 - DNA, 22 bp, Homo sapiens
cctctggaggcctctggccctc

SEQ ID NO: 869544 - DNA, 17 bp, Homo sapiens
cctctggaggggtgtgg

SEQ ID NO: 869545 - DNA, 20 bp, Homo sapiens
cctctggaggggtgtggctc

SEQ ID NO: 869546 - DNA, 14 bp, Homo sapiens
cctctggagtggcc

SEQ ID NO: 869547 - DNA, 23 bp, Homo sapiens
cctcttgccactgcctcttcctc

SEQ ID NO: 869548 - DNA, 12 bp, Homo sapiens
cctcttgccagc

SEQ ID NO: 869549 - DNA, 15 bp, Homo sapiens
cctcttgccagcctc

SEQ ID NO: 869550 - DNA, 16 bp, Homo sapiens
cctcttgccagcctcc

SEQ ID NO: 869551 - DNA, 18 bp, Homo sapiens
cctcttgccagcctcctt

SEQ ID NO: 869552 - DNA, 20 bp, Homo sapiens
cctcttgccagcctccttgc

SEQ ID NO: 869553 - DNA, 23 bp, Homo sapiens
cctcttgccagcctccttgctga

SEQ ID NO: 869554 - DNA, 13 bp, Homo sapiens
cctcttgcccgca

SEQ ID NO: 869555 - DNA, 19 bp, Homo sapiens
cctcttgcccgtcggccct

SEQ ID NO: 869556 - DNA, 14 bp, Homo sapiens
cctcttgcctctct

SEQ ID NO: 869557 - DNA, 16 bp, Homo sapiens
cctcttgcctctctca

SEQ ID NO: 869558 - DNA, 17 bp, Homo sapiens
cctcttgcctctctcag

SEQ ID NO: 869559 - DNA, 17 bp, Homo sapiens
cctcttgcgggcctgga

SEQ ID NO: 869560 - DNA, 16 bp, Homo sapiens
cctcttgctgtctctg

SEQ ID NO: 869561 - DNA, 17 bp, Homo sapiens
cctcttggacctctgct

SEQ ID NO: 869562 - DNA, 21 bp, Homo sapiens
cctcttggacctctgctctga

SEQ ID NO: 869563 - DNA, 20 bp, Homo sapiens
cctgacacactaaccaagct

SEQ ID NO: 869564 - DNA, 13 bp, Homo sapiens
cctgacaccccct

SEQ ID NO: 869565 - DNA, 14 bp, Homo sapiens
cctgacaccccctc

SEQ ID NO: 869566 - DNA, 13 bp, Homo sapiens
cctgacactccct

SEQ ID NO: 869567 - DNA, 15 bp, Homo sapiens
cctgacactttaatt

SEQ ID NO: 869568 - DNA, 14 bp, Homo sapiens
cctgacagaaggtg

SEQ ID NO: 869569 - DNA, 16 bp, Homo sapiens
cctgacagaaggtgcc

SEQ ID NO: 869570 - DNA, 18 bp, Homo sapiens
cctgacagccttccccag

SEQ ID NO: 869571 - DNA, 22 bp, Homo sapiens
cctgacagccttccccagctcc

SEQ ID NO: 869572 - DNA, 22 bp, Homo sapiens
cctgacaggtgaggtctgttcc

SEQ ID NO: 869573 - DNA, 23 bp, Homo sapiens
cctgacaggtgaggtctgttcct

SEQ ID NO: 869574 - DNA, 18 bp, Homo sapiens
cctgacagtcttgtgctt

SEQ ID NO: 869575 - DNA, 17 bp, Homo sapiens
cctgaggaaagcctcct

SEQ ID NO: 869576 - DNA, 13 bp, Homo sapiens
cctgaggaactgt

SEQ ID NO: 869577 - DNA, 16 bp, Homo sapiens
cctgaggacagctgtc

SEQ ID NO: 869578 - DNA, 16 bp, Homo sapiens
cctgaggacctctcag

SEQ ID NO: 869579 - DNA, 19 bp, Homo sapiens
cctgaggactgatttcaga

SEQ ID NO: 869580 - DNA, 15 bp, Homo sapiens
cctgaggagccctga

SEQ ID NO: 869581 - DNA, 17 bp, Homo sapiens
cctgaggagccctgagg

SEQ ID NO: 869582 - DNA, 20 bp, Homo sapiens
cctgaggagccctgaggacc

SEQ ID NO: 869583 - DNA, 20 bp, Homo sapiens
cctgccactgggctctggac

SEQ ID NO: 869584 - DNA, 14 bp, Homo sapiens
cctgcctcagcctc

SEQ ID NO: 869585 - DNA, 20 bp, Homo sapiens
cctgcctcagcctccccagt

SEQ ID NO: 869586 - DNA, 13 bp, Homo sapiens
ccttccatttttg

SEQ ID NO: 869587 - DNA, 22 bp, Homo sapiens
ccttccatttttgatttagtga

SEQ ID NO: 869588 - DNA, 20 bp, Homo sapiens
ccttcccaaggttactcagc

SEQ ID NO: 869589 - DNA, 13 bp, Homo sapiens
ccttcccacatgc

SEQ ID NO: 869590 - DNA, 16 bp, Homo sapiens
ccttcccacatgcctg

SEQ ID NO: 869591 - DNA, 20 bp, Homo sapiens
ccttcccacctactgcactt

SEQ ID NO: 869592 - DNA, 13 bp, Homo sapiens
ccttcccagccct

SEQ ID NO: 869593 - DNA, 13 bp, Homo sapiens
ccttcccagggac

SEQ ID NO: 869594 - DNA, 15 bp, Homo sapiens
ccttcccatctcttc

SEQ ID NO: 869595 - DNA, 17 bp, Homo sapiens
ccttcccatttctctac

SEQ ID NO: 869596 - DNA, 21 bp, Homo sapiens
ccttccccaacttccctagtc

SEQ ID NO: 869597 - DNA, 12 bp, Homo sapiens
ccttccccagac

SEQ ID NO: 869598 - DNA, 23 bp, Homo sapiens
ccttccccagactcagctccaga

SEQ ID NO: 869599 - DNA, 22 bp, Homo sapiens
ccttccccagctttgctgcctg

SEQ ID NO: 869600 - DNA, 19 bp, Homo sapiens
ccttccccaggcccaccat

SEQ ID NO: 869601 - DNA, 15 bp, Homo sapiens
ccttcccccagccca

SEQ ID NO: 869602 - DNA, 21 bp, Homo sapiens
ccttcccccatcccctttcct

SEQ ID NO: 869603 - DNA, 22 bp, Homo sapiens
ccttcccccatcccctttcctc

SEQ ID NO: 869604 - DNA, 23 bp, Homo sapiens
ccttcccccatcccctttcctcc

SEQ ID NO: 869605 - DNA, 19 bp, Homo sapiens
ccttccccctccaatccca

SEQ ID NO: 869606 - DNA, 17 bp, Homo sapiens
ccttccccctcccaggg

SEQ ID NO: 869607 - DNA, 20 bp, Homo sapiens
ccttccccctgtagactagt

SEQ ID NO: 869608 - DNA, 23 bp, Homo sapiens
ccttcccccttttttgtccccca

SEQ ID NO: 869609 - DNA, 18 bp, Homo sapiens
ccttccccgtcccctgca

SEQ ID NO: 869610 - DNA, 18 bp, Homo sapiens
ccttcccctccctggctc

SEQ ID NO: 869611 - DNA, 12 bp, Homo sapiens
ccttcccctgca

SEQ ID NO: 869612 - DNA, 13 bp, Homo sapiens
ccttcccctgcac

SEQ ID NO: 869613 - DNA, 15 bp, Homo sapiens
ccttcccctgcacct

SEQ ID NO: 869614 - DNA, 14 bp, Homo sapiens
ccttcccctgctga

SEQ ID NO: 869615 - DNA, 18 bp, Homo sapiens
ccttcccctgctgacctt

SEQ ID NO: 869616 - DNA, 17 bp, Homo sapiens
ccttccccttccccgtc

SEQ ID NO: 869617 - DNA, 17 bp, Homo sapiens
ccttccccttctgtgtc

SEQ ID NO: 869618 - DNA, 18 bp, Homo sapiens
ccttccccttctgtgtca

SEQ ID NO: 869619 - DNA, 20 bp, Homo sapiens
ccttccccttgcccagggct

SEQ ID NO: 869620 - DNA, 19 bp, Homo sapiens
ccttccccttttgcctggc

SEQ ID NO: 869621 - DNA, 20 bp, Homo sapiens
ccttccccttttgcctggct

SEQ ID NO: 869622 - DNA, 16 bp, Homo sapiens
ctgagtcccaggagct

SEQ ID NO: 869623 - DNA, 22 bp, Homo sapiens
ctgagtcccaggagctgcccag

SEQ ID NO: 869624 - DNA, 17 bp, Homo sapiens
ctgagtccctccatgca

SEQ ID NO: 869625 - DNA, 19 bp, Homo sapiens
ctgagtccctccatgcaaa

SEQ ID NO: 869626 - DNA, 15 bp, Homo sapiens
ctgagtcctgagact

SEQ ID NO: 869627 - DNA, 16 bp, Homo sapiens
ctgagtcctgagactt

SEQ ID NO: 869628 - DNA, 13 bp, Homo sapiens
ctgagtcctgtct

SEQ ID NO: 869629 - DNA, 18 bp, Homo sapiens
ctgagtcctgtctctgcc

SEQ ID NO: 869630 - DNA, 14 bp, Homo sapiens
ctgagtctcctgtg

SEQ ID NO: 869631 - DNA, 16 bp, Homo sapiens
ctgagtctgagtcctg

SEQ ID NO: 869632 - DNA, 22 bp, Homo sapiens
ctgagtctgagtcctgtctctg

SEQ ID NO: 869633 - DNA, 22 bp, Homo sapiens
ctgagtctggacctccatccct

SEQ ID NO: 869634 - DNA, 21 bp, Homo sapiens
ctgagtgaaaaatctgtggaa

SEQ ID NO: 869635 - DNA, 15 bp, Homo sapiens
ctgagtgaacctgta

SEQ ID NO: 869636 - DNA, 21 bp, Homo sapiens
ctgagtgaccgggggctgctg

SEQ ID NO: 869637 - DNA, 14 bp, Homo sapiens
ctgagtgagtgtgt

SEQ ID NO: 869638 - DNA, 16 bp, Homo sapiens
ctgagtgagtgtgtgt

SEQ ID NO: 869639 - DNA, 23 bp, Homo sapiens
ctgagtgcagccaaaggggagcc

SEQ ID NO: 869640 - DNA, 13 bp, Homo sapiens
ctgagtgccccac

SEQ ID NO: 869641 - DNA, 14 bp, Homo sapiens
ctgagtgccccact

SEQ ID NO: 869642 - DNA, 22 bp, Homo sapiens
ctgagtgcgggctgaggccaga

SEQ ID NO: 869643 - DNA, 15 bp, Homo sapiens
ctgagtgctgggcac

SEQ ID NO: 869644 - DNA, 17 bp, Homo sapiens
ctgagtggaatgcaggg

SEQ ID NO: 869645 - DNA, 18 bp, Homo sapiens
ctgagtggaatgcaggga

SEQ ID NO: 869646 - DNA, 14 bp, Homo sapiens
ctgagtggaggaag

SEQ ID NO: 869647 - DNA, 18 bp, Homo sapiens
ctgagtggatctccaagg

SEQ ID NO: 869648 - DNA, 14 bp, Homo sapiens
ctgagtggccagcc

SEQ ID NO: 869649 - DNA, 15 bp, Homo sapiens
ctgagtgggaagccc

SEQ ID NO: 869650 - DNA, 16 bp, Homo sapiens
ctgagtggggagcagt

SEQ ID NO: 869651 - DNA, 22 bp, Homo sapiens
ctgagtggtcactggtcagggc

SEQ ID NO: 869652 - DNA, 23 bp, Homo sapiens
ctgagtggtcactggtcagggca

SEQ ID NO: 869653 - DNA, 15 bp, Homo sapiens
ctgagtggtgttttt

SEQ ID NO: 869654 - DNA, 22 bp, Homo sapiens
ctgagtgttcaaactactgtac

SEQ ID NO: 869655 - DNA, 17 bp, Homo sapiens
ctgagttacagaaatga

SEQ ID NO: 869656 - DNA, 15 bp, Homo sapiens
ctgagttacttgtct

SEQ ID NO: 869657 - DNA, 15 bp, Homo sapiens
ctgagttggagctca

SEQ ID NO: 869658 - DNA, 20 bp, Homo sapiens
ctgagttggagctcattctg

SEQ ID NO: 869659 - DNA, 21 bp, Homo sapiens
ctgagttggagctcattctgt

SEQ ID NO: 869660 - DNA, 14 bp, Homo sapiens
ctgagttggcagac

SEQ ID NO: 869661 - DNA, 22 bp, Homo sapiens
ctgagttggcagaccgggcccc

SEQ ID NO: 869662 - DNA, 23 bp, Homo sapiens
ctgagttggcagaccgggccccc

SEQ ID NO: 869663 - DNA, 14 bp, Homo sapiens
ctgagttgttctaa

SEQ ID NO: 869664 - DNA, 15 bp, Homo sapiens
ctgagttgttctaac

SEQ ID NO: 869665 - DNA, 15 bp, Homo sapiens
ctgagtttaccattt

SEQ ID NO: 869666 - DNA, 17 bp, Homo sapiens
ctgagtttaccatttgt

SEQ ID NO: 869667 - DNA, 22 bp, Homo sapiens
ctgagtttaccatttgtaataa

SEQ ID NO: 869668 - DNA, 17 bp, Homo sapiens
ctgagtttcattctcct

SEQ ID NO: 869669 - DNA, 16 bp, Homo sapiens
ctgagtttcccttcct

SEQ ID NO: 869670 - DNA, 19 bp, Homo sapiens
ctgagtttcctatgggaac

SEQ ID NO: 869671 - DNA, 20 bp, Homo sapiens
ctgagtttcctatgggaaca

SEQ ID NO: 869672 - DNA, 17 bp, Homo sapiens
ctgagttttgatgctgt

SEQ ID NO: 869673 - DNA, 21 bp, Homo sapiens
ctgagttttgatgctgtattt

SEQ ID NO: 869674 - DNA, 14 bp, Homo sapiens
ctgagttttgtgtt

SEQ ID NO: 869675 - DNA, 17 bp, Homo sapiens
ctgagttttgtgtttgt

SEQ ID NO: 869676 - DNA, 19 bp, Homo sapiens
ctgagttttgtgtttgttg

SEQ ID NO: 869677 - DNA, 14 bp, Homo sapiens
ctgataaagaaaga

SEQ ID NO: 869678 - DNA, 16 bp, Homo sapiens
ctgataaagcacagct

SEQ ID NO: 869679 - DNA, 14 bp, Homo sapiens
ctgcaaaggccctt

SEQ ID NO: 869680 - DNA, 23 bp, Homo sapiens
ctgcaaaggcccttgtcattgcc

SEQ ID NO: 869681 - DNA, 20 bp, Homo sapiens
ctgcaaaggtggcaatgctt

SEQ ID NO: 869682 - DNA, 22 bp, Homo sapiens
ctgcaaatattagcaaagaagc

SEQ ID NO: 869683 - DNA, 22 bp, Homo sapiens
ctgcccatgtgtcccctcactc

SEQ ID NO: 869684 - DNA, 21 bp, Homo sapiens
ctgccccaaataacttcagtc

SEQ ID NO: 869685 - DNA, 17 bp, Homo sapiens
ctgccccaacctgctga

SEQ ID NO: 869686 - DNA, 17 bp, Homo sapiens
ctgccccaactcctgga

SEQ ID NO: 869687 - DNA, 18 bp, Homo sapiens
ctgccccaactcctggaa

SEQ ID NO: 869688 - DNA, 21 bp, Homo sapiens
ctgccccaactcctggaagct

SEQ ID NO: 869689 - DNA, 13 bp, Homo sapiens
ctgccccaagccc

SEQ ID NO: 869690 - DNA, 21 bp, Homo sapiens
ctgccccaaggccccagggac

SEQ ID NO: 869691 - DNA, 22 bp, Homo sapiens
ctgccccaaggccccagggaca

SEQ ID NO: 869692 - DNA, 16 bp, Homo sapiens
ctgccccacacctcct

SEQ ID NO: 869693 - DNA, 14 bp, Homo sapiens
ctgccccacacgga

SEQ ID NO: 869694 - DNA, 16 bp, Homo sapiens
ctgccccacacggact

SEQ ID NO: 869695 - DNA, 11 bp, Homo sapiens
ctgccccaccc

SEQ ID NO: 869696 - DNA, 18 bp, Homo sapiens
ctgccccaccccatccag

SEQ ID NO: 869697 - DNA, 22 bp, Homo sapiens
ctgccccaccccatccagccag

SEQ ID NO: 869698 - DNA, 21 bp, Homo sapiens
ctgccccaccttgccagggca

SEQ ID NO: 869699 - DNA, 18 bp, Homo sapiens
ctgccccacttctggcat

SEQ ID NO: 869700 - DNA, 13 bp, Homo sapiens
ctgccccagccag

SEQ ID NO: 869701 - DNA, 16 bp, Homo sapiens
ctgccccagcccagat

SEQ ID NO: 869702 - DNA, 16 bp, Homo sapiens
ctgccccagcccctaa

SEQ ID NO: 869703 - DNA, 13 bp, Homo sapiens
ctgccccagctct

SEQ ID NO: 869704 - DNA, 18 bp, Homo sapiens
ctgccccagctctggctt

SEQ ID NO: 869705 - DNA, 12 bp, Homo sapiens
ctgccccaggcc

SEQ ID NO: 869706 - DNA, 17 bp, Homo sapiens
ctgccccaggccctact

SEQ ID NO: 869707 - DNA, 20 bp, Homo sapiens
ctgccccaggccggagccca

SEQ ID NO: 869708 - DNA, 14 bp, Homo sapiens
ctgccccaggcctg

SEQ ID NO: 869709 - DNA, 17 bp, Homo sapiens
ctgccccatcctccagc

SEQ ID NO: 869710 - DNA, 12 bp, Homo sapiens
ctgcccccactg

SEQ ID NO: 869711 - DNA, 14 bp, Homo sapiens
ctgcccccacttcc

SEQ ID NO: 869712 - DNA, 18 bp, Homo sapiens
ctgcccccacttcctgtt

SEQ ID NO: 869713 - DNA, 21 bp, Homo sapiens
ctgcccccagaaagcctcctg

SEQ ID NO: 869714 - DNA, 23 bp, Homo sapiens
ctgcccccagaaagcctcctgcc

SEQ ID NO: 869715 - DNA, 15 bp, Homo sapiens
ctgcccccatcacct

SEQ ID NO: 869716 - DNA, 22 bp, Homo sapiens
ctgcccccatcacctctactgt

SEQ ID NO: 869717 - DNA, 23 bp, Homo sapiens
ctgcccccatcacctctactgtc

SEQ ID NO: 869718 - DNA, 15 bp, Homo sapiens
ctgcccccatccagc

SEQ ID NO: 869719 - DNA, 16 bp, Homo sapiens
ctgcccccatccagcc

SEQ ID NO: 869720 - DNA, 18 bp, Homo sapiens
ctgcccccatccagccac

SEQ ID NO: 869721 - DNA, 20 bp, Homo sapiens
ctgcccccatccagccacgg

SEQ ID NO: 869722 - DNA, 22 bp, Homo sapiens
ctgcccccatccagccacggag

SEQ ID NO: 869723 - DNA, 18 bp, Homo sapiens
ctgcccccatctccccag

SEQ ID NO: 869724 - DNA, 19 bp, Homo sapiens
ctgcccccatctccccagg

SEQ ID NO: 869725 - DNA, 23 bp, Homo sapiens
ctgccccccaaggttctggttcc

SEQ ID NO: 869726 - DNA, 22 bp, Homo sapiens
ctgcccccgctcccgctcccag

SEQ ID NO: 869727 - DNA, 21 bp, Homo sapiens
ctgccccctatcttgtcctgg

SEQ ID NO: 869728 - DNA, 22 bp, Homo sapiens
ctgccccctatcttgtcctgga

SEQ ID NO: 869729 - DNA, 12 bp, Homo sapiens
ctgccccctccc

SEQ ID NO: 869730 - DNA, 16 bp, Homo sapiens
ctgccccctcccccat

SEQ ID NO: 869731 - DNA, 20 bp, Homo sapiens
ctgccccctcccccatgggc

SEQ ID NO: 869732 - DNA, 19 bp, Homo sapiens
ctgccccctcgggggcctg

SEQ ID NO: 869733 - DNA, 20 bp, Homo sapiens
ctgccccctcgggggcctgt

SEQ ID NO: 869734 - DNA, 13 bp, Homo sapiens
ctgccccctgcca

SEQ ID NO: 869735 - DNA, 18 bp, Homo sapiens
ctgccccctgctgccatg

SEQ ID NO: 869736 - DNA, 15 bp, Homo sapiens
ctgccccctgcttgg

SEQ ID NO: 869737 - DNA, 12 bp, Homo sapiens
ctgccccctggg

SEQ ID NO: 869738 - DNA, 15 bp, Homo sapiens
ctgccccctgggctg

SEQ ID NO: 869739 - DNA, 21 bp, Homo sapiens
ctgccccctgggctggggcct

SEQ ID NO: 869740 - DNA, 22 bp, Homo sapiens
ctgccccctggtggacagtcct

SEQ ID NO: 869741 - DNA, 16 bp, Homo sapiens
ctgcccccttccccag

SEQ ID NO: 869742 - DNA, 17 bp, Homo sapiens
ctgcccccttccccagc

SEQ ID NO: 869743 - DNA, 18 bp, Homo sapiens
ctgcccccttccccagcc

SEQ ID NO: 869744 - DNA, 22 bp, Homo sapiens
ctgcccccttccccagccctta

SEQ ID NO: 869745 - DNA, 14 bp, Homo sapiens
ctgcccccttctcc

SEQ ID NO: 869746 - DNA, 16 bp, Homo sapiens
ctgcccccttctccca

SEQ ID NO: 869747 - DNA, 22 bp, Homo sapiens
ctgcccccttctcccacactgc

SEQ ID NO: 869748 - DNA, 17 bp, Homo sapiens
ctgccccgcccagctgc

SEQ ID NO: 869749 - DNA, 14 bp, Homo sapiens
ctgccccgcccccc

SEQ ID NO: 869750 - DNA, 21 bp, Homo sapiens
ctgccccgccccccagagcca

SEQ ID NO: 869751 - DNA, 21 bp, Homo sapiens
ctgccccgccttcgtgtgctg

SEQ ID NO: 869752 - DNA, 18 bp, Homo sapiens
ctgccccggacctacctc

SEQ ID NO: 869753 - DNA, 17 bp, Homo sapiens
ctgccccgggtgcctca

SEQ ID NO: 869754 - DNA, 16 bp, Homo sapiens
ctgccccgttccctgt

SEQ ID NO: 869755 - DNA, 23 bp, Homo sapiens
ctgccccgttccctgtcagaggc

SEQ ID NO: 869756 - DNA, 17 bp, Homo sapiens
ctgcccctaggatgctg

SEQ ID NO: 869757 - DNA, 22 bp, Homo sapiens
ctgcccctcagggggccagctg

SEQ ID NO: 869758 - DNA, 14 bp, Homo sapiens
ctgcccctccccca

SEQ ID NO: 869759 - DNA, 13 bp, Homo sapiens
ctgcccctccccg

SEQ ID NO: 869760 - DNA, 14 bp, Homo sapiens
ctgcccctccccgt

SEQ ID NO: 869761 - DNA, 17 bp, Homo sapiens
ctgcccctcccttcaac

SEQ ID NO: 869762 - DNA, 12 bp, Homo sapiens
ctgcccctcctg

SEQ ID NO: 869763 - DNA, 20 bp, Homo sapiens
ctgcccctcctggagcagaa

SEQ ID NO: 869764 - DNA, 13 bp, Homo sapiens
ctgcccctcgcac

SEQ ID NO: 869765 - DNA, 14 bp, Homo sapiens
ctgcccctcgcaca

SEQ ID NO: 869766 - DNA, 20 bp, Homo sapiens
ctgcccctcgcacacagggc

SEQ ID NO: 869767 - DNA, 13 bp, Homo sapiens
ctgcccctctcac

SEQ ID NO: 869768 - DNA, 14 bp, Homo sapiens
ctgcccctctttct

SEQ ID NO: 869769 - DNA, 14 bp, Homo sapiens
ctgcccctgccccg

SEQ ID NO: 869770 - DNA, 20 bp, Homo sapiens
ctgcccctgctgtgctgctc

SEQ ID NO: 869771 - DNA, 14 bp, Homo sapiens
ctgcccctgtctgg

SEQ ID NO: 869772 - DNA, 17 bp, Homo sapiens
ctgcccctgtctggaag

SEQ ID NO: 869773 - DNA, 18 bp, Homo sapiens
ctgcccctgtctggaaga

SEQ ID NO: 869774 - DNA, 18 bp, Homo sapiens
ctgccccttaaccccaag

SEQ ID NO: 869775 - DNA, 21 bp, Homo sapiens
ctgccccttaaccccaaggac

SEQ ID NO: 869776 - DNA, 13 bp, Homo sapiens
ctgccccttgcaa

SEQ ID NO: 869777 - DNA, 16 bp, Homo sapiens
ctgccccttgcaagcc

SEQ ID NO: 869778 - DNA, 14 bp, Homo sapiens
ctgccccttgggca

SEQ ID NO: 869779 - DNA, 17 bp, Homo sapiens
ctgcccgactcaggtcc

SEQ ID NO: 869780 - DNA, 15 bp, Homo sapiens
ctgcccgcagagccc

SEQ ID NO: 869781 - DNA, 18 bp, Homo sapiens
ctgcccgctgcaatgcct

SEQ ID NO: 869782 - DNA, 20 bp, Homo sapiens
ctgcccggcagggtcctaga

SEQ ID NO: 869783 - DNA, 15 bp, Homo sapiens
ctgcccggcgcctgc

SEQ ID NO: 869784 - DNA, 20 bp, Homo sapiens
ctgcccggcgcctgccctgc

SEQ ID NO: 869785 - DNA, 18 bp, Homo sapiens
ctgcccgggccccttgct

SEQ ID NO: 869786 - DNA, 18 bp, Homo sapiens
ctgcccggggagctgcag

SEQ ID NO: 869787 - DNA, 20 bp, Homo sapiens
ctgcccggggagctgcagag

SEQ ID NO: 869788 - DNA, 13 bp, Homo sapiens
ctgcccggggcag

SEQ ID NO: 869789 - DNA, 23 bp, Homo sapiens
ctgcccggggcagctgccagaga

SEQ ID NO: 869790 - DNA, 22 bp, Homo sapiens
ctgcccggggtggggtgcactc

SEQ ID NO: 869791 - DNA, 21 bp, Homo sapiens
ctgcccgtcttcagcctagcc

SEQ ID NO: 869792 - DNA, 12 bp, Homo sapiens
ctgccctaagcc

SEQ ID NO: 869793 - DNA, 21 bp, Homo sapiens
ctgccctagagcacactgtag

SEQ ID NO: 869794 - DNA, 20 bp, Homo sapiens
ctgccctagctgaccccgag

SEQ ID NO: 869795 - DNA, 12 bp, Homo sapiens
ctgccctcactc

SEQ ID NO: 869796 - DNA, 22 bp, Homo sapiens
ctgccctcagggactgcaccct

SEQ ID NO: 869797 - DNA, 15 bp, Homo sapiens
ctgccctccatcccg

SEQ ID NO: 869798 - DNA, 21 bp, Homo sapiens
ctgccctccccagagcactgg

SEQ ID NO: 869799 - DNA, 17 bp, Homo sapiens
ctgccctcccgcacctt

SEQ ID NO: 869800 - DNA, 14 bp, Homo sapiens
ctgccctccctcag

SEQ ID NO: 869801 - DNA, 18 bp, Homo sapiens
ctgccctccctcagccgt

SEQ ID NO: 869802 - DNA, 14 bp, Homo sapiens
ctgccctccctcgg

SEQ ID NO: 869803 - DNA, 21 bp, Homo sapiens
ctgccctccctcggccccacc

SEQ ID NO: 869804 - DNA, 16 bp, Homo sapiens
ctgccctccctggagc

SEQ ID NO: 869805 - DNA, 17 bp, Homo sapiens
ctgccctccggaggagc

SEQ ID NO: 869806 - DNA, 19 bp, Homo sapiens
ctgccctccggaggagcag

SEQ ID NO: 869807 - DNA, 21 bp, Homo sapiens
ctgccctccggaggagcagcc

SEQ ID NO: 869808 - DNA, 17 bp, Homo sapiens
ctgccctcgtggccagc

SEQ ID NO: 869809 - DNA, 20 bp, Homo sapiens
ctgccctcgtggccagcccg

SEQ ID NO: 869810 - DNA, 22 bp, Homo sapiens
ctgccctcgtggccagcccggc

SEQ ID NO: 869811 - DNA, 20 bp, Homo sapiens
ctgccctctagagccttcag

SEQ ID NO: 869812 - DNA, 18 bp, Homo sapiens
ctgccctctccctgtgtt

SEQ ID NO: 869813 - DNA, 19 bp, Homo sapiens
ctgccctctgctctgcctg

SEQ ID NO: 869814 - DNA, 21 bp, Homo sapiens
ctgccctctgctctgcctgga

SEQ ID NO: 869815 - DNA, 22 bp, Homo sapiens
ctgcctcctccctcccagctgc

SEQ ID NO: 869816 - DNA, 19 bp, Homo sapiens
ctgcctcctcgttcctttc

SEQ ID NO: 869817 - DNA, 24 bp, Homo sapiens
ctgcctcctcttcaactgaccagc

SEQ ID NO: 869818 - DNA, 18 bp, Homo sapiens
ctgcctcctgctctctgg

SEQ ID NO: 869819 - DNA, 23 bp, Homo sapiens
ctgcctcctggtttcctttctca

SEQ ID NO: 869820 - DNA, 19 bp, Homo sapiens
ctgcctcgaaacacagaaa

SEQ ID NO: 869821 - DNA, 16 bp, Homo sapiens
ctgcctcgagggccgc

SEQ ID NO: 869822 - DNA, 23 bp, Homo sapiens
ctgcctcgagggccgcctgcctt

SEQ ID NO: 869823 - DNA, 14 bp, Homo sapiens
ctgcctcggactcc

SEQ ID NO: 869824 - DNA, 15 bp, Homo sapiens
ctgcctcggactcca

SEQ ID NO: 869825 - DNA, 16 bp, Homo sapiens
ctgcctcggactccat

SEQ ID NO: 869826 - DNA, 20 bp, Homo sapiens
ctgcctcggactccatggct

SEQ ID NO: 869827 - DNA, 17 bp, Homo sapiens
ctgcctctatgccctgc

SEQ ID NO: 869828 - DNA, 21 bp, Homo sapiens
ctgcctctatgccctgcagag

SEQ ID NO: 869829 - DNA, 23 bp, Homo sapiens
ctgcctctatgccctgcagagca

SEQ ID NO: 869830 - DNA, 14 bp, Homo sapiens
ctgcctctccaggc

SEQ ID NO: 869831 - DNA, 17 bp, Homo sapiens
ctgcctctcccaggctg

SEQ ID NO: 869832 - DNA, 15 bp, Homo sapiens
ctgcctctccctctg

SEQ ID NO: 869833 - DNA, 16 bp, Homo sapiens
ctgcctctccctctgg

SEQ ID NO: 869834 - DNA, 16 bp, Homo sapiens
ctgcctctccctgggt

SEQ ID NO: 869835 - DNA, 18 bp, Homo sapiens
ctgcctctccctgggtct

SEQ ID NO: 869836 - DNA, 21 bp, Homo sapiens
ctgcctctccctgggtctggg

SEQ ID NO: 869837 - DNA, 18 bp, Homo sapiens
ctgcctctcggtggccag

SEQ ID NO: 869838 - DNA, 19 bp, Homo sapiens
ctgcctctgacagcagcct

SEQ ID NO: 869839 - DNA, 20 bp, Homo sapiens
ctgcctctgacagcagcctg

SEQ ID NO: 869840 - DNA, 23 bp, Homo sapiens
ctgcctctgacagcagcctgtga

SEQ ID NO: 869841 - DNA, 10 bp, Homo sapiens
ctgcctctgc

SEQ ID NO: 869842 - DNA, 19 bp, Homo sapiens
ctgcctctgggcagcctgc

SEQ ID NO: 869843 - DNA, 23 bp, Homo sapiens
ctgcctctgggcagcctgctttg

SEQ ID NO: 869844 - DNA, 15 bp, Homo sapiens
ctgcctctgtggaag

SEQ ID NO: 869845 - DNA, 21 bp, Homo sapiens
ctgcctctgtgtagccgccct

SEQ ID NO: 869846 - DNA, 15 bp, Homo sapiens
ctgcctcttctctac

SEQ ID NO: 869847 - DNA, 22 bp, Homo sapiens
ctgcctcttctcttgacagtct

SEQ ID NO: 869848 - DNA, 16 bp, Homo sapiens
ctgcctcttctgggag

SEQ ID NO: 869849 - DNA, 16 bp, Homo sapiens
ctgcctcttctgtggg

SEQ ID NO: 869850 - DNA, 11 bp, Homo sapiens
ctgcctcttgg

SEQ ID NO: 869851 - DNA, 13 bp, Homo sapiens
ctgcctcttggct

SEQ ID NO: 869852 - DNA, 16 bp, Homo sapiens
ctgcctcttggcttct

SEQ ID NO: 869853 - DNA, 19 bp, Homo sapiens
ctgcctcttggcttctcag

SEQ ID NO: 869854 - DNA, 21 bp, Homo sapiens
ctgcctcttgtttctgtgccc

SEQ ID NO: 869855 - DNA, 22 bp, Homo sapiens
ctgcctcttgtttctgtgcccc

SEQ ID NO: 869856 - DNA, 18 bp, Homo sapiens
ctgcctctttccctagga

SEQ ID NO: 869857 - DNA, 17 bp, Homo sapiens
ctgcctgaaacagccat

SEQ ID NO: 869858 - DNA, 18 bp, Homo sapiens
ctgcctgaataaagagcc

SEQ ID NO: 869859 - DNA, 15 bp, Homo sapiens
ctgcctgacagcctt

SEQ ID NO: 869860 - DNA, 20 bp, Homo sapiens
ctgcctgacatttggagtgt

SEQ ID NO: 869861 - DNA, 21 bp, Homo sapiens
ctgcctgaggaggaggacaca

SEQ ID NO: 869862 - DNA, 11 bp, Homo sapiens
ctgcctgaggg

SEQ ID NO: 869863 - DNA, 18 bp, Homo sapiens
ctgcctgagggcccctct

SEQ ID NO: 869864 - DNA, 20 bp, Homo sapiens
ctgcctgagggcccctctgc

SEQ ID NO: 869865 - DNA, 13 bp, Homo sapiens
ctgcctgatccct

SEQ ID NO: 869866 - DNA, 18 bp, Homo sapiens
ctgcctgcaatatttgaa

SEQ ID NO: 869867 - DNA, 13 bp, Homo sapiens
ctgcctgcactcc

SEQ ID NO: 869868 - DNA, 23 bp, Homo sapiens
ctgcctgcactccctggccttgc

SEQ ID NO: 869869 - DNA, 16 bp, Homo sapiens
ctgcctgcagaggtct

SEQ ID NO: 869870 - DNA, 19 bp, Homo sapiens
ctgcctgcagaggtctgtg

SEQ ID NO: 869871 - DNA, 17 bp, Homo sapiens
ctgcctgcagcacatgc

SEQ ID NO: 869872 - DNA, 20 bp, Homo sapiens
ctgcctgcagtactttacct

SEQ ID NO: 869873 - DNA, 15 bp, Homo sapiens
ctgcctgccaaagta

SEQ ID NO: 869874 - DNA, 23 bp, Homo sapiens
ctgcctgccaaagtagtcctggc

SEQ ID NO: 869875 - DNA, 12 bp, Homo sapiens
ctgcctgccacc

SEQ ID NO: 869876 - DNA, 17 bp, Homo sapiens
ctgcctgccaccctgcc

SEQ ID NO: 869877 - DNA, 16 bp, Homo sapiens
ctgcctgcccacccgt

SEQ ID NO: 869878 - DNA, 13 bp, Homo sapiens
ctgcctgcccact

SEQ ID NO: 869879 - DNA, 21 bp, Homo sapiens
ctgcctgccccacccacccca

SEQ ID NO: 869880 - DNA, 16 bp, Homo sapiens
ctgcctgccccccagt

SEQ ID NO: 869881 - DNA, 23 bp, Homo sapiens
ctgcctgccccccagtctcccca

SEQ ID NO: 869882 - DNA, 15 bp, Homo sapiens
ctgcctgccccgccc

SEQ ID NO: 869883 - DNA, 18 bp, Homo sapiens
ctgcctgcccctgctgct

SEQ ID NO: 869884 - DNA, 17 bp, Homo sapiens
ctgcctgccctgcctca

SEQ ID NO: 869885 - DNA, 12 bp, Homo sapiens
ctgcctgcctcc

SEQ ID NO: 869886 - DNA, 13 bp, Homo sapiens
ctgcctgcctcca

SEQ ID NO: 869887 - DNA, 12 bp, Homo sapiens
ctgcctgcctgt

SEQ ID NO: 869888 - DNA, 15 bp, Homo sapiens
ctgcctgcctgtctg

SEQ ID NO: 869889 - DNA, 15 bp, Homo sapiens
ctgcctgcgtcttcc

SEQ ID NO: 869890 - DNA, 16 bp, Homo sapiens
ctgcctgctccttggc

SEQ ID NO: 869891 - DNA, 15 bp, Homo sapiens
ctgcctgctgagatg

SEQ ID NO: 869892 - DNA, 16 bp, Homo sapiens
ctgcctgctgagatga

SEQ ID NO: 869893 - DNA, 18 bp, Homo sapiens
ctgcctgctgtgctggga

SEQ ID NO: 869894 - DNA, 12 bp, Homo sapiens
ctgcctggactt

SEQ ID NO: 869895 - DNA, 22 bp, Homo sapiens
ctgcctggagtgtcggatcctg

SEQ ID NO: 869896 - DNA, 12 bp, Homo sapiens
ctgcctggcagg

SEQ ID NO: 869897 - DNA, 21 bp, Homo sapiens
ctgcctggccactgctcccta

SEQ ID NO: 869898 - DNA, 16 bp, Homo sapiens
ctgcctggccaggcag

SEQ ID NO: 869899 - DNA, 12 bp, Homo sapiens
ctgcctggccat

SEQ ID NO: 869900 - DNA, 15 bp, Homo sapiens
ctgcctggccatgct

SEQ ID NO: 869901 - DNA, 16 bp, Homo sapiens
ctgcctggccatgctg

SEQ ID NO: 869902 - DNA, 13 bp, Homo sapiens
ctgcctggcccct

SEQ ID NO: 869903 - DNA, 14 bp, Homo sapiens
ctgcctggcctggc

SEQ ID NO: 869904 - DNA, 22 bp, Homo sapiens
ctgcctggcggggttggccctt

SEQ ID NO: 869905 - DNA, 12 bp, Homo sapiens
ctgcctgggagc

SEQ ID NO: 869906 - DNA, 17 bp, Homo sapiens
ctgcctgggccgtggca

SEQ ID NO: 869907 - DNA, 23 bp, Homo sapiens
ctgcctgggccgtggcacagctg

SEQ ID NO: 869908 - DNA, 22 bp, Homo sapiens
ctgcctgggcctgtgcagcagc

SEQ ID NO: 869909 - DNA, 24 bp, Homo sapiens
ctgcctgggcctgtgcagcagccc

SEQ ID NO: 869910 - DNA, 17 bp, Homo sapiens
ctgcctgggccttggct

SEQ ID NO: 869911 - DNA, 19 bp, Homo sapiens
ctgcctgggctgttggcac

SEQ ID NO: 869912 - DNA, 20 bp, Homo sapiens
ctgcctgggctgttggcact

SEQ ID NO: 869913 - DNA, 13 bp, Homo sapiens
ctgcctggggccc

SEQ ID NO: 869914 - DNA, 17 bp, Homo sapiens
ctgcctggggcctccag

SEQ ID NO: 869915 - DNA, 19 bp, Homo sapiens
ctgcctggtctgtctggat

SEQ ID NO: 869916 - DNA, 22 bp, Homo sapiens
ctgcctgtaattaaactagttt

SEQ ID NO: 869917 - DNA, 16 bp, Homo sapiens
ctgcctgtagcagtga

SEQ ID NO: 869918 - DNA, 15 bp, Homo sapiens
ctgcctgtagttagg

SEQ ID NO: 869919 - DNA, 17 bp, Homo sapiens
ctgcctgtagttaggaa

SEQ ID NO: 869920 - DNA, 22 bp, Homo sapiens
ctgcctgtattttcgggattct

SEQ ID NO: 869921 - DNA, 15 bp, Homo sapiens
ctgcctgtccccatg

SEQ ID NO: 869922 - DNA, 21 bp, Homo sapiens
ctgcctgtccctaccccatgg

SEQ ID NO: 869923 - DNA, 19 bp, Homo sapiens
ctgcctgtccctctcaggc

SEQ ID NO: 869924 - DNA, 18 bp, Homo sapiens
ctgcctgtctgccccagc

SEQ ID NO: 869925 - DNA, 15 bp, Homo sapiens
ctgcctgtctgtctc

SEQ ID NO: 869926 - DNA, 18 bp, Homo sapiens
ctgcctgtgcatgacctg

SEQ ID NO: 869927 - DNA, 11 bp, Homo sapiens
ctgcctgtgcc

SEQ ID NO: 869928 - DNA, 17 bp, Homo sapiens
ctgcctgtgccatgccc

SEQ ID NO: 869929 - DNA, 22 bp, Homo sapiens
ctgcctgtgccatgcccaaggc

SEQ ID NO: 869930 - DNA, 14 bp, Homo sapiens
ctgcctgtgctgtg

SEQ ID NO: 869931 - DNA, 23 bp, Homo sapiens
ctgcctgtggcgccgtctccagg

SEQ ID NO: 869932 - DNA, 17 bp, Homo sapiens
ctgccttaaaaccaaag

SEQ ID NO: 869933 - DNA, 19 bp, Homo sapiens
ctgccttaaaaccaaagag

SEQ ID NO: 869934 - DNA, 20 bp, Homo sapiens
ctgccttactggtttcccca

SEQ ID NO: 869935 - DNA, 20 bp, Homo sapiens
ctgccttagtctcagtttgt

SEQ ID NO: 869936 - DNA, 17 bp, Homo sapiens
ctgccttatcttgcacc

SEQ ID NO: 869937 - DNA, 15 bp, Homo sapiens
ctgccttcagggaga

SEQ ID NO: 869938 - DNA, 13 bp, Homo sapiens
ctgccttcagtag

SEQ ID NO: 869939 - DNA, 18 bp, Homo sapiens
ctgctacctcactggggt

SEQ ID NO: 869940 - DNA, 19 bp, Homo sapiens
ctgctacctcccttgcctt

SEQ ID NO: 869941 - DNA, 21 bp, Homo sapiens
ctgctacgttcctattgtcat

SEQ ID NO: 869942 - DNA, 17 bp, Homo sapiens
ctgctactacccgagcc

SEQ ID NO: 869943 - DNA, 20 bp, Homo sapiens
ctgctactacccgagcccag

SEQ ID NO: 869944 - DNA, 17 bp, Homo sapiens
ctgctactctgttcctt

SEQ ID NO: 869945 - DNA, 15 bp, Homo sapiens
ctgctactgcccctc

SEQ ID NO: 869946 - DNA, 20 bp, Homo sapiens
ctgctactgcccctctccga

SEQ ID NO: 869947 - DNA, 18 bp, Homo sapiens
ctgctactgtaattttat

SEQ ID NO: 869948 - DNA, 20 bp, Homo sapiens
ctgctacttcactgtcatct

SEQ ID NO: 869949 - DNA, 14 bp, Homo sapiens
ctgctagagcagac

SEQ ID NO: 869950 - DNA, 16 bp, Homo sapiens
ctgctagagcagacag

SEQ ID NO: 869951 - DNA, 17 bp, Homo sapiens
ctgctagagcagacagg

SEQ ID NO: 869952 - DNA, 16 bp, Homo sapiens
ctgctagattttaatt

SEQ ID NO: 869953 - DNA, 23 bp, Homo sapiens
ctgctagattttaatttatttgt

SEQ ID NO: 869954 - DNA, 13 bp, Homo sapiens
ctgctagcaggcc

SEQ ID NO: 869955 - DNA, 20 bp, Homo sapiens
ctgctagcaggccccctagg

SEQ ID NO: 869956 - DNA, 21 bp, Homo sapiens
ctgctagcaggccccctagga

SEQ ID NO: 869957 - DNA, 15 bp, Homo sapiens
ctgctaggccagagc

SEQ ID NO: 869958 - DNA, 15 bp, Homo sapiens
ctgctaggcgagtgc

SEQ ID NO: 869959 - DNA, 23 bp, Homo sapiens
ctgctaggcgagtgccaggactc

SEQ ID NO: 869960 - DNA, 16 bp, Homo sapiens
ctgctaggcgctgggg

SEQ ID NO: 869961 - DNA, 23 bp, Homo sapiens
ctgctaggtgggccagcccctcc

SEQ ID NO: 869962 - DNA, 14 bp, Homo sapiens
ctgctatagcctgg

SEQ ID NO: 869963 - DNA, 22 bp, Homo sapiens
ctgctatattaacatcatctta

SEQ ID NO: 869964 - DNA, 20 bp, Homo sapiens
ctgctatccccatctccctg

SEQ ID NO: 869965 - DNA, 18 bp, Homo sapiens
ctgctatgacagctggct

SEQ ID NO: 869966 - DNA, 16 bp, Homo sapiens
ctgctattatgtaaca

SEQ ID NO: 869967 - DNA, 22 bp, Homo sapiens
ctgctattatgtaacatccaga

SEQ ID NO: 869968 - DNA, 23 bp, Homo sapiens
ctgctattatgtaacatccagaa

SEQ ID NO: 869969 - DNA, 14 bp, Homo sapiens
ctgctatttgaagt

SEQ ID NO: 869970 - DNA, 23 bp, Homo sapiens
ctgctcaagaagacatggagact

SEQ ID NO: 869971 - DNA, 23 bp, Homo sapiens
ctgctcaccgcccatcagggttc

SEQ ID NO: 869972 - DNA, 19 bp, Homo sapiens
ctgctcacggaccccatgt

SEQ ID NO: 869973 - DNA, 18 bp, Homo sapiens
ctgctcagaacttgctgc

SEQ ID NO: 869974 - DNA, 13 bp, Homo sapiens
ctgctcagacaga

SEQ ID NO: 869975 - DNA, 14 bp, Homo sapiens
ctgctcagagcttt

SEQ ID NO: 869976 - DNA, 23 bp, Homo sapiens
ctgctcagagctttaaaagtatc

SEQ ID NO: 869977 - DNA, 15 bp, Homo sapiens
ctgctcagcagccag

SEQ ID NO: 869978 - DNA, 16 bp, Homo sapiens
ctgctcagcagccagt

SEQ ID NO: 869979 - DNA, 12 bp, Homo sapiens
ctgcgcctccag

SEQ ID NO: 869980 - DNA, 14 bp, Homo sapiens
ctgcgcctccatcc

SEQ ID NO: 869981 - DNA, 14 bp, Homo sapiens
ctgcgcctgcaggc

SEQ ID NO: 869982 - DNA, 16 bp, Homo sapiens
ctgcgcggactcgccc

SEQ ID NO: 869983 - DNA, 14 bp, Homo sapiens
ctgcgctagcagcc

SEQ ID NO: 869984 - DNA, 16 bp, Homo sapiens
ctgcgctagcagccct

SEQ ID NO: 869985 - DNA, 19 bp, Homo sapiens
ctgcgctagcagcccttgt

SEQ ID NO: 869986 - DNA, 20 bp, Homo sapiens
ctgcgctagcagcccttgtg

SEQ ID NO: 869987 - DNA, 17 bp, Homo sapiens
ctgcgctctctttgcaa

SEQ ID NO: 869988 - DNA, 16 bp, Homo sapiens
ctgcgcttctgctgga

SEQ ID NO: 869989 - DNA, 17 bp, Homo sapiens
ctgcgcttctgctggag

SEQ ID NO: 869990 - DNA, 13 bp, Homo sapiens
ctgcgcttgcttt

SEQ ID NO: 869991 - DNA, 14 bp, Homo sapiens
ctgcggaaaaggaa

SEQ ID NO: 869992 - DNA, 21 bp, Homo sapiens
ctgcggacaccgtggcctggg

SEQ ID NO: 869993 - DNA, 22 bp, Homo sapiens
ctgcggacaccgtggcctgggc

SEQ ID NO: 869994 - DNA, 23 bp, Homo sapiens
ctgcggaggaaggaggacccagg

SEQ ID NO: 869995 - DNA, 23 bp, Homo sapiens
ctgcggagtgaagaggggcagcc

SEQ ID NO: 869996 - DNA, 15 bp, Homo sapiens
ctgcggatctcagct

SEQ ID NO: 869997 - DNA, 15 bp, Homo sapiens
ctgcggccgcccccc

SEQ ID NO: 869998 - DNA, 16 bp, Homo sapiens
ctgcggctcagccttg

SEQ ID NO: 869999 - DNA, 17 bp, Homo sapiens
ctgcggctcagccttgc

SEQ ID NO: 870000 - DNA, 20 bp, Homo sapiens
ctgcggctttcactgctgag

SEQ ID NO: 870001 - DNA, 13 bp, Homo sapiens
ctgcgggaggctg

SEQ ID NO: 870002 - DNA, 18 bp, Homo sapiens
ctgcgggaggctggggcc

SEQ ID NO: 870003 - DNA, 18 bp, Homo sapiens
ctgcgggatggtcctggg

SEQ ID NO: 870004 - DNA, 19 bp, Homo sapiens
ctgcgggatggtcctgggg

SEQ ID NO: 870005 - DNA, 20 bp, Homo sapiens
ctgcgggatggtcctggggc

SEQ ID NO: 870006 - DNA, 22 bp, Homo sapiens
ctgcgggatggtcctggggctc

SEQ ID NO: 870007 - DNA, 15 bp, Homo sapiens
ctgcgggccacaggg

SEQ ID NO: 870008 - DNA, 15 bp, Homo sapiens
ctgcgggccagggtc

SEQ ID NO: 870009 - DNA, 14 bp, Homo sapiens
ctgcgggctccctc

SEQ ID NO: 870010 - DNA, 19 bp, Homo sapiens
ctgcgggctccctcctctg

SEQ ID NO: 870011 - DNA, 19 bp, Homo sapiens
ctgcgggtcctcagctgct

SEQ ID NO: 870012 - DNA, 15 bp, Homo sapiens
ctgcgggtctgaagg

SEQ ID NO: 870013 - DNA, 23 bp, Homo sapiens
ctgcgggtgaacaaagcagccac

SEQ ID NO: 870014 - DNA, 22 bp, Homo sapiens
ctgcggtagatgggagggaggc

SEQ ID NO: 870015 - DNA, 23 bp, Homo sapiens
ctgcggtgaagttgaggcttata

SEQ ID NO: 870016 - DNA, 22 bp, Homo sapiens
ctgcggtttgttggatcttcaa

SEQ ID NO: 870017 - DNA, 20 bp, Homo sapiens
ctgcgtcagaccagtactgg

SEQ ID NO: 870018 - DNA, 21 bp, Homo sapiens
ctgcgtcagaccagtactggg

SEQ ID NO: 870019 - DNA, 14 bp, Homo sapiens
ctgcgtccaccagg

SEQ ID NO: 870020 - DNA, 17 bp, Homo sapiens
ctgcgtccaccaggcct

SEQ ID NO: 870021 - DNA, 16 bp, Homo sapiens
ctgcgtccccactccc

SEQ ID NO: 870022 - DNA, 15 bp, Homo sapiens
ctgcgtcctcctcac

SEQ ID NO: 870023 - DNA, 18 bp, Homo sapiens
ctgcgtcctcctcacctc

SEQ ID NO: 870024 - DNA, 20 bp, Homo sapiens
ctgcgtcctgacgccctgcg

SEQ ID NO: 870025 - DNA, 13 bp, Homo sapiens
ctgcgtcggccct

SEQ ID NO: 870026 - DNA, 19 bp, Homo sapiens
ctgcgtgacaataaaacat

SEQ ID NO: 870027 - DNA, 12 bp, Homo sapiens
ctgcgtgccatc

SEQ ID NO: 870028 - DNA, 17 bp, Homo sapiens
ctgcgttggtccagagc

SEQ ID NO: 870029 - DNA, 22 bp, Homo sapiens
ctgcgttttctccgggtcctcc

SEQ ID NO: 870030 - DNA, 20 bp, Homo sapiens
ctgcgttttggaagctctga

SEQ ID NO: 870031 - DNA, 19 bp, Homo sapiens
ctgctaaggctcctccttg

SEQ ID NO: 870032 - DNA, 16 bp, Homo sapiens
ctgctaagtaatttag

SEQ ID NO: 870033 - DNA, 23 bp, Homo sapiens
ctgctaatacctcttactttgct

SEQ ID NO: 870034 - DNA, 21 bp, Homo sapiens
ctgctaattcccaacatttct

SEQ ID NO: 870035 - DNA, 18 bp, Homo sapiens
ctgctacaagtgttttag

SEQ ID NO: 870036 - DNA, 20 bp, Homo sapiens
ctgctacagcaatttctaat

SEQ ID NO: 870037 - DNA, 17 bp, Homo sapiens
ctgctacccactgccag

SEQ ID NO: 870038 - DNA, 18 bp, Homo sapiens
ctgctaccgccctgggct

SEQ ID NO: 870039 - DNA, 19 bp, Homo sapiens
ctgctaccgccctgggctg

SEQ ID NO: 870040 - DNA, 20 bp, Homo sapiens
ctgctaccgccctgggctgg

SEQ ID NO: 870041 - DNA, 21 bp, Homo sapiens
ctgctaccgccctgggctgga

SEQ ID NO: 870042 - DNA, 23 bp, Homo sapiens
ctgctaccgccctgggctggact

SEQ ID NO: 870043 - DNA, 12 bp, Homo sapiens
ctgctacctcac

SEQ ID NO: 870044 - DNA, 18 bp, Homo sapiens
ctggaagccatggtcccg

SEQ ID NO: 870045 - DNA, 17 bp, Homo sapiens
ctggaagcccctgggcc

SEQ ID NO: 870046 - DNA, 20 bp, Homo sapiens
ctggaagcccctgggcccag

SEQ ID NO: 870047 - DNA, 12 bp, Homo sapiens
ctggaagctgtg

SEQ ID NO: 870048 - DNA, 12 bp, Homo sapiens
ctggaaggaatg

SEQ ID NO: 870049 - DNA, 12 bp, Homo sapiens
ctggaaggcagg

SEQ ID NO: 870050 - DNA, 17 bp, Homo sapiens
ctggaaggcagggcaga

SEQ ID NO: 870051 - DNA, 20 bp, Homo sapiens
ctggaaggcagggcagaggg

SEQ ID NO: 870052 - DNA, 12 bp, Homo sapiens
ctggaaggctgg

SEQ ID NO: 870053 - DNA, 14 bp, Homo sapiens
ctggaaggctggct

SEQ ID NO: 870054 - DNA, 17 bp, Homo sapiens
ctggaaggctggctgag

SEQ ID NO: 870055 - DNA, 18 bp, Homo sapiens
ctggaaggggcagcagga

SEQ ID NO: 870056 - DNA, 15 bp, Homo sapiens
ctggaaggggcagcc

SEQ ID NO: 870057 - DNA, 16 bp, Homo sapiens
ctggaaggggcagccc

SEQ ID NO: 870058 - DNA, 23 bp, Homo sapiens
ctggaagtcatctcattccactg

SEQ ID NO: 870059 - DNA, 16 bp, Homo sapiens
ctggaagtccaatgtg

SEQ ID NO: 870060 - DNA, 19 bp, Homo sapiens
ctggaagtccaatgtggca

SEQ ID NO: 870061 - DNA, 16 bp, Homo sapiens
ctggaagttgtggata

SEQ ID NO: 870062 - DNA, 20 bp, Homo sapiens
ctggaagttttgcatttatg

SEQ ID NO: 870063 - DNA, 15 bp, Homo sapiens
ctggaataatttgta

SEQ ID NO: 870064 - DNA, 19 bp, Homo sapiens
ctggaataatttgtaaatg

SEQ ID NO: 870065 - DNA, 23 bp, Homo sapiens
ctggaatcaggaatattttccaa

SEQ ID NO: 870066 - DNA, 22 bp, Homo sapiens
ctggaatcagtatttccttcca

SEQ ID NO: 870067 - DNA, 21 bp, Homo sapiens
ctggaatcctgaaagggcact

SEQ ID NO: 870068 - DNA, 15 bp, Homo sapiens
ctggaatctcatgat

SEQ ID NO: 870069 - DNA, 15 bp, Homo sapiens
ctggaatcttcccca

SEQ ID NO: 870070 - DNA, 13 bp, Homo sapiens
ctggaatgaggga

SEQ ID NO: 870071 - DNA, 15 bp, Homo sapiens
ctggaatgagggagg

SEQ ID NO: 870072 - DNA, 16 bp, Homo sapiens
ctggaatgagggaggc

SEQ ID NO: 870073 - DNA, 22 bp, Homo sapiens
ctggaatgggagacctgttggc

SEQ ID NO: 870074 - DNA, 16 bp, Homo sapiens
ctggaatggtgttttg

SEQ ID NO: 870075 - DNA, 22 bp, Homo sapiens
ctggaatggtgttttgtcagac

SEQ ID NO: 870076 - DNA, 14 bp, Homo sapiens
ctggaatgtaatca

SEQ ID NO: 870077 - DNA, 22 bp, Homo sapiens
ctggaatgtttttccctcccca

SEQ ID NO: 870078 - DNA, 21 bp, Homo sapiens
ctggaattcagcaccctgggt

SEQ ID NO: 870079 - DNA, 23 bp, Homo sapiens
ctggaattcagcaccctgggtgc

SEQ ID NO: 870080 - DNA, 22 bp, Homo sapiens
ctggaattgtggctatcctgat

SEQ ID NO: 870081 - DNA, 13 bp, Homo sapiens
ctggacaaagaat

SEQ ID NO: 870082 - DNA, 21 bp, Homo sapiens
ctggacaagccaacttgtaaa

SEQ ID NO: 870083 - DNA, 23 bp, Homo sapiens
ctggacaatctcacaccttagct

SEQ ID NO: 870084 - DNA, 22 bp, Homo sapiens
ctggacacaataggtctttctc

SEQ ID NO: 870085 - DNA, 16 bp, Homo sapiens
ctggacacacactcac

SEQ ID NO: 870086 - DNA, 18 bp, Homo sapiens
ctggacacacactcacca

SEQ ID NO: 870087 - DNA, 22 bp, Homo sapiens
ctggacacacactcaccagtgg

SEQ ID NO: 870088 - DNA, 11 bp, Homo sapiens
ctggacacact

SEQ ID NO: 870089 - DNA, 21 bp, Homo sapiens
ctggacacactaaactctggg

SEQ ID NO: 870090 - DNA, 22 bp, Homo sapiens
ctggacacactaaactctgggg

SEQ ID NO: 870091 - DNA, 15 bp, Homo sapiens
ctggacacccctgct

SEQ ID NO: 870092 - DNA, 14 bp, Homo sapiens
ctggacacctccca

SEQ ID NO: 870093 - DNA, 15 bp, Homo sapiens
ctggacacctcccag

SEQ ID NO: 870094 - DNA, 18 bp, Homo sapiens
ctggacacctcccagggg

SEQ ID NO: 870095 - DNA, 20 bp, Homo sapiens
ctggacacctcccaggggac

SEQ ID NO: 870096 - DNA, 21 bp, Homo sapiens
ctggacacctcccaggggact

SEQ ID NO: 870097 - DNA, 15 bp, Homo sapiens
ctggacactcagacc

SEQ ID NO: 870098 - DNA, 12 bp, Homo sapiens
ctggacagacag

SEQ ID NO: 870099 - DNA, 20 bp, Homo sapiens
ctggacagaggggactctgg

SEQ ID NO: 870100 - DNA, 19 bp, Homo sapiens
ctggacagatggacgcagg

SEQ ID NO: 870101 - DNA, 13 bp, Homo sapiens
ctggacagatggc

SEQ ID NO: 870102 - DNA, 21 bp, Homo sapiens
ctggacagatggcccaaggga

SEQ ID NO: 870103 - DNA, 17 bp, Homo sapiens
ctggacagcagaagcct

SEQ ID NO: 870104 - DNA, 18 bp, Homo sapiens
ctggacagcagaagcctc

SEQ ID NO: 870105 - DNA, 20 bp, Homo sapiens
ctggacagcagaagcctcca

SEQ ID NO: 870106 - DNA, 22 bp, Homo sapiens
ctggacagcagaagcctccaag

SEQ ID NO: 870107 - DNA, 15 bp, Homo sapiens
ctggacagccagtga

SEQ ID NO: 870108 - DNA, 22 bp, Homo sapiens
ctggacagccagtgacctttga

SEQ ID NO: 870109 - DNA, 17 bp, Homo sapiens
ctggacagcggcagtgg

SEQ ID NO: 870110 - DNA, 20 bp, Homo sapiens
ctggacaggcagcctccttt

SEQ ID NO: 870111 - DNA, 15 bp, Homo sapiens
ctggacaggctctgc

SEQ ID NO: 870112 - DNA, 18 bp, Homo sapiens
ctggacatactgctggag

SEQ ID NO: 870113 - DNA, 22 bp, Homo sapiens
ctggacatactgctggagtcca

SEQ ID NO: 870114 - DNA, 17 bp, Homo sapiens
ctggacatagagaggga

SEQ ID NO: 870115 - DNA, 18 bp, Homo sapiens
ctggacatagagagggag

SEQ ID NO: 870116 - DNA, 17 bp, Homo sapiens
ctggacatcaccagtcc

SEQ ID NO: 870117 - DNA, 22 bp, Homo sapiens
ctggacatgagatggagaggct

SEQ ID NO: 870118 - DNA, 23 bp, Homo sapiens
ctggacatgagatggagaggctg

SEQ ID NO: 870119 - DNA, 12 bp, Homo sapiens
ctggacatggcc

SEQ ID NO: 870120 - DNA, 18 bp, Homo sapiens
ctggacatggcccattgg

SEQ ID NO: 870121 - DNA, 17 bp, Homo sapiens
ctggacattttttcagt

SEQ ID NO: 870122 - DNA, 12 bp, Homo sapiens
ctggaccaaagg

SEQ ID NO: 870123 - DNA, 21 bp, Homo sapiens
ctggaccaaccctgtttcctg

SEQ ID NO: 870124 - DNA, 22 bp, Homo sapiens
ctggaccaaccctgtttcctga

SEQ ID NO: 870125 - DNA, 23 bp, Homo sapiens
ctggaccaaccctgtttcctgag

SEQ ID NO: 870126 - DNA, 17 bp, Homo sapiens
ctggaccaccagcccca

SEQ ID NO: 870127 - DNA, 20 bp, Homo sapiens
ctggaccaccagccccagca

SEQ ID NO: 870128 - DNA, 15 bp, Homo sapiens
ctggaccactgggca

SEQ ID NO: 870129 - DNA, 16 bp, Homo sapiens
ctggaccagctggcct

SEQ ID NO: 870130 - DNA, 16 bp, Homo sapiens
ctggaccatctctgta

SEQ ID NO: 870131 - DNA, 19 bp, Homo sapiens
ctggaccattcctgtccct

SEQ ID NO: 870132 - DNA, 15 bp, Homo sapiens
ctggaccccactggc

SEQ ID NO: 870133 - DNA, 17 bp, Homo sapiens
ctggaccccactggctg

SEQ ID NO: 870134 - DNA, 19 bp, Homo sapiens
ctggaccccatctgtgaat

SEQ ID NO: 870135 - DNA, 21 bp, Homo sapiens
ctggaccccattctgagctcc

SEQ ID NO: 870136 - DNA, 19 bp, Homo sapiens
ctggaccccctgcccgcca

SEQ ID NO: 870137 - DNA, 20 bp, Homo sapiens
ctggaccccgtttcattttt

SEQ ID NO: 870138 - DNA, 14 bp, Homo sapiens
ctggacccctggac

SEQ ID NO: 870139 - DNA, 13 bp, Homo sapiens
ctggacccctggg

SEQ ID NO: 870140 - DNA, 14 bp, Homo sapiens
ctggacccctgggg

SEQ ID NO: 870141 - DNA, 17 bp, Homo sapiens
ctggacccctggggtgg

SEQ ID NO: 870142 - DNA, 20 bp, Homo sapiens
ctggacccctggggtggcca

SEQ ID NO: 870143 - DNA, 22 bp, Homo sapiens
ctggacccctggggtggccagg

SEQ ID NO: 870144 - DNA, 23 bp, Homo sapiens
ctggacccctggggtggccaggg

SEQ ID NO: 870145 - DNA, 15 bp, Homo sapiens
ctggaccctgtggat

SEQ ID NO: 870146 - DNA, 16 bp, Homo sapiens
ctggaccgagatgtga

SEQ ID NO: 870147 - DNA, 22 bp, Homo sapiens
ctggaccgagatgtgagtcctg

SEQ ID NO: 870148 - DNA, 21 bp, Homo sapiens
ctggaccgctgactgcaccag

SEQ ID NO: 870149 - DNA, 17 bp, Homo sapiens
ctggacctatgcaggga

SEQ ID NO: 870150 - DNA, 21 bp, Homo sapiens
ctggagtgtcggatcctgtga

SEQ ID NO: 870151 - DNA, 23 bp, Homo sapiens
ctggagtgtgagggtcctgcagc

SEQ ID NO: 870152 - DNA, 15 bp, Homo sapiens
ctggagtgtgtcaga

SEQ ID NO: 870153 - DNA, 22 bp, Homo sapiens
ctggagtgtgtcagagcccagg

SEQ ID NO: 870154 - DNA, 23 bp, Homo sapiens
ctggagtgtgtcagagcccaggg

SEQ ID NO: 870155 - DNA, 22 bp, Homo sapiens
ctggagttcccacccaagccct

SEQ ID NO: 870156 - DNA, 13 bp, Homo sapiens
ctggagtttaata

SEQ ID NO: 870157 - DNA, 22 bp, Homo sapiens
ctggagtttctctaaagtcact

SEQ ID NO: 870158 - DNA, 13 bp, Homo sapiens
ctggataaaatga

SEQ ID NO: 870159 - DNA, 13 bp, Homo sapiens
ctggataaaccac

SEQ ID NO: 870160 - DNA, 22 bp, Homo sapiens
ctggataaaccaccctctgggg

SEQ ID NO: 870161 - DNA, 23 bp, Homo sapiens
ctggatactgcaaaggcttgtgg

SEQ ID NO: 870162 - DNA, 13 bp, Homo sapiens
ctggatagacttg

SEQ ID NO: 870163 - DNA, 14 bp, Homo sapiens
ctggatagacttgg

SEQ ID NO: 870164 - DNA, 16 bp, Homo sapiens
ctggatagacttggga

SEQ ID NO: 870165 - DNA, 15 bp, Homo sapiens
ctggatattttcaaa

SEQ ID NO: 870166 - DNA, 16 bp, Homo sapiens
ctggatattttcaaat

SEQ ID NO: 870167 - DNA, 22 bp, Homo sapiens
ctggatattttcaaattgtatc

SEQ ID NO: 870168 - DNA, 24 bp, Homo sapiens
ctggatcacgacgctgcagagcac

SEQ ID NO: 870169 - DNA, 17 bp, Homo sapiens
ctggatcagggaatcca

SEQ ID NO: 870170 - DNA, 17 bp, Homo sapiens
ctggatcagtcctttga

SEQ ID NO: 870171 - DNA, 21 bp, Homo sapiens
ctggatcagtcctttgatcag

SEQ ID NO: 870172 - DNA, 19 bp, Homo sapiens
ctggatcctagccttatcc

SEQ ID NO: 870173 - DNA, 23 bp, Homo sapiens
ctggatctcctcaagtccccaag

SEQ ID NO: 870174 - DNA, 19 bp, Homo sapiens
ctggatctcctcccttacc

SEQ ID NO: 870175 - DNA, 13 bp, Homo sapiens
ctggatctcctgc

SEQ ID NO: 870176 - DNA, 18 bp, Homo sapiens
ctggatctcctgctgcct

SEQ ID NO: 870177 - DNA, 22 bp, Homo sapiens
ctggatctcctgctgccttttc

SEQ ID NO: 870178 - DNA, 13 bp, Homo sapiens
ctggatctgaccc

SEQ ID NO: 870179 - DNA, 16 bp, Homo sapiens
ctggatctgaccctcc

SEQ ID NO: 870180 - DNA, 20 bp, Homo sapiens
ctggatctgggaccctttcc

SEQ ID NO: 870181 - DNA, 17 bp, Homo sapiens
ctggatcttctatcatt

SEQ ID NO: 870182 - DNA, 21 bp, Homo sapiens
ctggatcttctatcattccaa

SEQ ID NO: 870183 - DNA, 13 bp, Homo sapiens
ctggatgaaattt

SEQ ID NO: 870184 - DNA, 23 bp, Homo sapiens
ctggatgaagattctcctgtgct

SEQ ID NO: 870185 - DNA, 13 bp, Homo sapiens
ctggatgaaggca

SEQ ID NO: 870186 - DNA, 14 bp, Homo sapiens
ctggatgaaggcaa

SEQ ID NO: 870187 - DNA, 15 bp, Homo sapiens
ctggatgatactaat

SEQ ID NO: 870188 - DNA, 23 bp, Homo sapiens
ctggatgatactaataaactaat

SEQ ID NO: 870189 - DNA, 22 bp, Homo sapiens
ctggatgatttcatcttctgga

SEQ ID NO: 870190 - DNA, 14 bp, Homo sapiens
ctggatgcccagga

SEQ ID NO: 870191 - DNA, 16 bp, Homo sapiens
ctggatgcccaggaat

SEQ ID NO: 870192 - DNA, 23 bp, Homo sapiens
ctggatgcccatccactgggtgt

SEQ ID NO: 870193 - DNA, 15 bp, Homo sapiens
ctggatgccttcccc

SEQ ID NO: 870194 - DNA, 14 bp, Homo sapiens
ctggatggacagac

SEQ ID NO: 870195 - DNA, 15 bp, Homo sapiens
ctggatggacagaca

SEQ ID NO: 870196 - DNA, 21 bp, Homo sapiens
ctggatggacagacacctccc

SEQ ID NO: 870197 - DNA, 23 bp, Homo sapiens
ctggatggcaccagaggctgcag

SEQ ID NO: 870198 - DNA, 20 bp, Homo sapiens
ctggatggcacctcaggctg

SEQ ID NO: 870199 - DNA, 19 bp, Homo sapiens
ctggatggcccctccttgc

SEQ ID NO: 870200 - DNA, 20 bp, Homo sapiens
ctggatggcccctccttgca

SEQ ID NO: 870201 - DNA, 13 bp, Homo sapiens
ctggatgggagga

SEQ ID NO: 870202 - DNA, 17 bp, Homo sapiens
ctggatgggcattgggc

SEQ ID NO: 870203 - DNA, 21 bp, Homo sapiens
ctggatgggggtgcaggcagc

SEQ ID NO: 870204 - DNA, 23 bp, Homo sapiens
ctggatggtattaatcttgtgta

SEQ ID NO: 870205 - DNA, 22 bp, Homo sapiens
ctggatggtcctcttaccaaca

SEQ ID NO: 870206 - DNA, 19 bp, Homo sapiens
ctggatgtgaagctcacac

SEQ ID NO: 870207 - DNA, 20 bp, Homo sapiens
ctggatgtgaagctcacact

SEQ ID NO: 870208 - DNA, 15 bp, Homo sapiens
ctggatgtttggaaa

SEQ ID NO: 870209 - DNA, 13 bp, Homo sapiens
ctggattaaactt

SEQ ID NO: 870210 - DNA, 23 bp, Homo sapiens
ctggattaaacttaatctaaatg

SEQ ID NO: 870211 - DNA, 17 bp, Homo sapiens
ctggattcaaatttatt

SEQ ID NO: 870212 - DNA, 17 bp, Homo sapiens
ctggattcacgccctct

SEQ ID NO: 870213 - DNA, 23 bp, Homo sapiens
ctggattcacgccctcttgtttc

SEQ ID NO: 870214 - DNA, 22 bp, Homo sapiens
ctggattcagccttctttttct

SEQ ID NO: 870215 - DNA, 22 bp, Homo sapiens
ctggattccagcagtgaatgct

SEQ ID NO: 870216 - DNA, 14 bp, Homo sapiens
ctggattccctttt

SEQ ID NO: 870217 - DNA, 20 bp, Homo sapiens
ctggattggctataacatgt

SEQ ID NO: 870218 - DNA, 21 bp, Homo sapiens
ctggcaaaaggatctttgtgg

SEQ ID NO: 870219 - DNA, 23 bp, Homo sapiens
ctggcaaaaggatctttgtggcc

SEQ ID NO: 870220 - DNA, 23 bp, Homo sapiens
ctggcaaaatagttctgcaggtt

SEQ ID NO: 870221 - DNA, 16 bp, Homo sapiens
ctggcaaacatgaaaa

SEQ ID NO: 870222 - DNA, 17 bp, Homo sapiens
ctggcaaaccctcccag

SEQ ID NO: 870223 - DNA, 19 bp, Homo sapiens
ctggcaaaccctcccagaa

SEQ ID NO: 870224 - DNA, 19 bp, Homo sapiens
ctggcaaacttcagactga

SEQ ID NO: 870225 - DNA, 16 bp, Homo sapiens
ctggcaaagcagaatg

SEQ ID NO: 870226 - DNA, 20 bp, Homo sapiens
ctggcaaagcttttagaaat

SEQ ID NO: 870227 - DNA, 18 bp, Homo sapiens
ctggcaaaggtggctctc

SEQ ID NO: 870228 - DNA, 21 bp, Homo sapiens
ctggcaaaggtggctctccag

SEQ ID NO: 870229 - DNA, 15 bp, Homo sapiens
ctggcaacacagagg

SEQ ID NO: 870230 - DNA, 22 bp, Homo sapiens
ctggcaacatagtgagatccca

SEQ ID NO: 870231 - DNA, 14 bp, Homo sapiens
ctggcaacatcttt

SEQ ID NO: 870232 - DNA, 14 bp, Homo sapiens
ctggcaagaatgtg

SEQ ID NO: 870233 - DNA, 18 bp, Homo sapiens
ctggcaagagcagatact

SEQ ID NO: 870234 - DNA, 14 bp, Homo sapiens
ctggcaagcaggga

SEQ ID NO: 870235 - DNA, 20 bp, Homo sapiens
ctggcaaggactttgtacat

SEQ ID NO: 870236 - DNA, 19 bp, Homo sapiens
ctggcaaggcattcctcat

SEQ ID NO: 870237 - DNA, 12 bp, Homo sapiens
ctggcaataaac

SEQ ID NO: 870238 - DNA, 18 bp, Homo sapiens
ctggcaatcaatacagct

SEQ ID NO: 870239 - DNA, 19 bp, Homo sapiens
ctggcaattgtctatttat

SEQ ID NO: 870240 - DNA, 14 bp, Homo sapiens
ctggcacagaccag

SEQ ID NO: 870241 - DNA, 18 bp, Homo sapiens
ctggcacagaccaggcct

SEQ ID NO: 870242 - DNA, 13 bp, Homo sapiens
ctggcacagaggt

SEQ ID NO: 870243 - DNA, 17 bp, Homo sapiens
ctggcacagggcagtgg

SEQ ID NO: 870244 - DNA, 17 bp, Homo sapiens
ctggcacagtgatgccg

SEQ ID NO: 870245 - DNA, 18 bp, Homo sapiens
ctggcacagtgatgccgg

SEQ ID NO: 870246 - DNA, 19 bp, Homo sapiens
ctggcacagtgatgccggg

SEQ ID NO: 870247 - DNA, 19 bp, Homo sapiens
ctggcacatcagaaaggaa

SEQ ID NO: 870248 - DNA, 23 bp, Homo sapiens
ctggcacccaccgtctcggccct

SEQ ID NO: 870249 - DNA, 19 bp, Homo sapiens
ctggcacccaccgtggagg

SEQ ID NO: 870250 - DNA, 17 bp, Homo sapiens
ctggcaccgccttctct

SEQ ID NO: 870251 - DNA, 16 bp, Homo sapiens
ctggcacctgaaatta

SEQ ID NO: 870252 - DNA, 15 bp, Homo sapiens
ctggcacgaaggccc

SEQ ID NO: 870253 - DNA, 17 bp, Homo sapiens
ctggcacgtgacaggct

SEQ ID NO: 870254 - DNA, 18 bp, Homo sapiens
ctggcacgtgacaggctc

SEQ ID NO: 870255 - DNA, 22 bp, Homo sapiens
ctggcactataatgtaagctct

SEQ ID NO: 870256 - DNA, 14 bp, Homo sapiens
ctggcactctgtgg

SEQ ID NO: 870257 - DNA, 20 bp, Homo sapiens
ctggcactgactgggcatag

SEQ ID NO: 870258 - DNA, 14 bp, Homo sapiens
ctggcactgggagg

SEQ ID NO: 870259 - DNA, 21 bp, Homo sapiens
ctggcacttggagacttgtat

SEQ ID NO: 870260 - DNA, 20 bp, Homo sapiens
ctggcagaaacaggaggctc

SEQ ID NO: 870261 - DNA, 13 bp, Homo sapiens
ctggcagaactga

SEQ ID NO: 870262 - DNA, 16 bp, Homo sapiens
ctggcagaactgagct

SEQ ID NO: 870263 - DNA, 20 bp, Homo sapiens
ctggcagaactgagctcctc

SEQ ID NO: 870264 - DNA, 20 bp, Homo sapiens
ctggcagacacaacccaata

SEQ ID NO: 870265 - DNA, 11 bp, Homo sapiens
ctggcagagca

SEQ ID NO: 870266 - DNA, 17 bp, Homo sapiens
ctggcagagcacagccc

SEQ ID NO: 870267 - DNA, 18 bp, Homo sapiens
ctggcagagcctctgaga

SEQ ID NO: 870268 - DNA, 14 bp, Homo sapiens
ctggcagcacagcc

SEQ ID NO: 870269 - DNA, 16 bp, Homo sapiens
ctggcagcacagccca

SEQ ID NO: 870270 - DNA, 17 bp, Homo sapiens
ctggcagcacagcccag

SEQ ID NO: 870271 - DNA, 23 bp, Homo sapiens
ctggcagcacagcccagggcctg

SEQ ID NO: 870272 - DNA, 13 bp, Homo sapiens
ctggcagcagcag

SEQ ID NO: 870273 - DNA, 16 bp, Homo sapiens
ctggacttgcctctgc

SEQ ID NO: 870274 - DNA, 17 bp, Homo sapiens
ctggactttaaaaaaac

SEQ ID NO: 870275 - DNA, 18 bp, Homo sapiens
ctggactttcctgcaact

SEQ ID NO: 870276 - DNA, 13 bp, Homo sapiens
ctggactttctct

SEQ ID NO: 870277 - DNA, 19 bp, Homo sapiens
ctggactttctctaataat

SEQ ID NO: 870278 - DNA, 14 bp, Homo sapiens
ctggagaactagag

SEQ ID NO: 870279 - DNA, 21 bp, Homo sapiens
ctggagaagaatatcaaataa

SEQ ID NO: 870280 - DNA, 21 bp, Homo sapiens
ctggagaagcagtgagccgca

SEQ ID NO: 870281 - DNA, 13 bp, Homo sapiens
ctggagaagctga

SEQ ID NO: 870282 - DNA, 17 bp, Homo sapiens
ctggagaagctgatgct

SEQ ID NO: 870283 - DNA, 19 bp, Homo sapiens
ctggagaagctgatgcttt

SEQ ID NO: 870284 - DNA, 19 bp, Homo sapiens
ctggagaccagggagcctt

SEQ ID NO: 870285 - DNA, 12 bp, Homo sapiens
ctggagaccccc

SEQ ID NO: 870286 - DNA, 17 bp, Homo sapiens
ctggagacttcctctgg

SEQ ID NO: 870287 - DNA, 22 bp, Homo sapiens
ctggagaggaagccagtggagc

SEQ ID NO: 870288 - DNA, 19 bp, Homo sapiens
ctggagaggacggccctgc

SEQ ID NO: 870289 - DNA, 16 bp, Homo sapiens
ctggagaggcctgggg

SEQ ID NO: 870290 - DNA, 18 bp, Homo sapiens
ctggagaggtggctgcgc

SEQ ID NO: 870291 - DNA, 22 bp, Homo sapiens
ctggagataacagcctcttgcc

SEQ ID NO: 870292 - DNA, 16 bp, Homo sapiens
ctggagatagctgggg

SEQ ID NO: 870293 - DNA, 23 bp, Homo sapiens
ctggagatattataagggagagc

SEQ ID NO: 870294 - DNA, 20 bp, Homo sapiens
ctggagatctgaacccagct

SEQ ID NO: 870295 - DNA, 21 bp, Homo sapiens
ctggagatctgaacccagctg

SEQ ID NO: 870296 - DNA, 16 bp, Homo sapiens
ctggagatgaggccag

SEQ ID NO: 870297 - DNA, 19 bp, Homo sapiens
ctggagatgaggccagacc

SEQ ID NO: 870298 - DNA, 15 bp, Homo sapiens
ctggagatgcagcta

SEQ ID NO: 870299 - DNA, 20 bp, Homo sapiens
ctggagcaagaaggaaggag

SEQ ID NO: 870300 - DNA, 20 bp, Homo sapiens
ctggagcacttgttttaaaa

SEQ ID NO: 870301 - DNA, 18 bp, Homo sapiens
ctggagcagccaaggccg

SEQ ID NO: 870302 - DNA, 22 bp, Homo sapiens
ctggagcagcggattgctctgg

SEQ ID NO: 870303 - DNA, 23 bp, Homo sapiens
ctggagcagcggattgctctgga

SEQ ID NO: 870304 - DNA, 15 bp, Homo sapiens
ctggagcatcccagg

SEQ ID NO: 870305 - DNA, 17 bp, Homo sapiens
ctggagcatcccaggcg

SEQ ID NO: 870306 - DNA, 12 bp, Homo sapiens
ctggagcatctg

SEQ ID NO: 870307 - DNA, 22 bp, Homo sapiens
ctggagcatctgactcacaaga

SEQ ID NO: 870308 - DNA, 17 bp, Homo sapiens
ctggagccaagtccaga

SEQ ID NO: 870309 - DNA, 19 bp, Homo sapiens
ctggagccaagtccagatt

SEQ ID NO: 870310 - DNA, 16 bp, Homo sapiens
ctggagccacaggcag

SEQ ID NO: 870311 - DNA, 21 bp, Homo sapiens
ctggagccagactctggtctt

SEQ ID NO: 870312 - DNA, 14 bp, Homo sapiens
ctggagccagagag

SEQ ID NO: 870313 - DNA, 15 bp, Homo sapiens
ctggagccagagaga

SEQ ID NO: 870314 - DNA, 13 bp, Homo sapiens
ctggagccagggc

SEQ ID NO: 870315 - DNA, 15 bp, Homo sapiens
ctggagccagggcag

SEQ ID NO: 870316 - DNA, 18 bp, Homo sapiens
ctggagccagggcagagg

SEQ ID NO: 870317 - DNA, 13 bp, Homo sapiens
ctggagccatccc

SEQ ID NO: 870318 - DNA, 13 bp, Homo sapiens
ctggagcccacag

SEQ ID NO: 870319 - DNA, 22 bp, Homo sapiens
ctggagcccacagcgagcctgt

SEQ ID NO: 870320 - DNA, 13 bp, Homo sapiens
ctggagcccagga

SEQ ID NO: 870321 - DNA, 12 bp, Homo sapiens
ctggagccccca

SEQ ID NO: 870322 - DNA, 13 bp, Homo sapiens
ctggagcccccag

SEQ ID NO: 870323 - DNA, 21 bp, Homo sapiens
ctggagcccccagcagaggca

SEQ ID NO: 870324 - DNA, 21 bp, Homo sapiens
ctggagcccctcctcccccgg

SEQ ID NO: 870325 - DNA, 12 bp, Homo sapiens
ctggagcccctg

SEQ ID NO: 870326 - DNA, 14 bp, Homo sapiens
ctggagcccctggg

SEQ ID NO: 870327 - DNA, 18 bp, Homo sapiens
ctggagcccctgggtggg

SEQ ID NO: 870328 - DNA, 18 bp, Homo sapiens
ctggagcccgcttcaagc

SEQ ID NO: 870329 - DNA, 20 bp, Homo sapiens
ctggagcccgcttcaagctc

SEQ ID NO: 870330 - DNA, 11 bp, Homo sapiens
ctggagccctg

SEQ ID NO: 870331 - DNA, 12 bp, Homo sapiens
ctggagccctgt

SEQ ID NO: 870332 - DNA, 24 bp, Homo sapiens
ctggagccctgttggcagctctag

SEQ ID NO: 870333 - DNA, 23 bp, Homo sapiens
ctggagcctccactgcctctgga

SEQ ID NO: 870334 - DNA, 18 bp, Homo sapiens
ctggagcgccacacactg

SEQ ID NO: 870335 - DNA, 16 bp, Homo sapiens
ctggagcggggatctg

SEQ ID NO: 870336 - DNA, 19 bp, Homo sapiens
ctggagcgtttgctgtgcc

SEQ ID NO: 870337 - DNA, 16 bp, Homo sapiens
ctggagctctgtgggt

SEQ ID NO: 870338 - DNA, 13 bp, Homo sapiens
ctggagctgaggt

SEQ ID NO: 870339 - DNA, 14 bp, Homo sapiens
ctggagctgggaga

SEQ ID NO: 870340 - DNA, 18 bp, Homo sapiens
ctggaggaacacttgatg

SEQ ID NO: 870341 - DNA, 18 bp, Homo sapiens
ctggaggaaccacatata

SEQ ID NO: 870342 - DNA, 22 bp, Homo sapiens
ctggaggaaggggggttgcagt

SEQ ID NO: 870343 - DNA, 19 bp, Homo sapiens
ctggaggaagtggggtctg

SEQ ID NO: 870344 - DNA, 22 bp, Homo sapiens
ctggaggaagtggggtctggcc

SEQ ID NO: 870345 - DNA, 22 bp, Homo sapiens
ctggaggaagttctccagcttc

SEQ ID NO: 870346 - DNA, 23 bp, Homo sapiens
ctggaggaagttctccagcttca

SEQ ID NO: 870347 - DNA, 19 bp, Homo sapiens
ctggaggaatacattttat

SEQ ID NO: 870348 - DNA, 21 bp, Homo sapiens
ctggaggaattcagctcagct

SEQ ID NO: 870349 - DNA, 16 bp, Homo sapiens
ctggaggacagaggga

SEQ ID NO: 870350 - DNA, 13 bp, Homo sapiens
ctggaggagagaa

SEQ ID NO: 870351 - DNA, 17 bp, Homo sapiens
ctggaggagcagcagct

SEQ ID NO: 870352 - DNA, 18 bp, Homo sapiens
ctggaggaggggaagctg

SEQ ID NO: 870353 - DNA, 17 bp, Homo sapiens
ctggaggatgtgggcag

SEQ ID NO: 870354 - DNA, 19 bp, Homo sapiens
ctggaggatgtgggcagct

SEQ ID NO: 870355 - DNA, 13 bp, Homo sapiens
ctggaggcaagag

SEQ ID NO: 870356 - DNA, 18 bp, Homo sapiens
ctggaggcaagagggagg

SEQ ID NO: 870357 - DNA, 14 bp, Homo sapiens
ctggaggcagggcc

SEQ ID NO: 870358 - DNA, 22 bp, Homo sapiens
ctggaggcagggccttgcccag

SEQ ID NO: 870359 - DNA, 23 bp, Homo sapiens
ctggaggcagggccttgcccaga

SEQ ID NO: 870360 - DNA, 15 bp, Homo sapiens
ctggaggcaggggct

SEQ ID NO: 870361 - DNA, 14 bp, Homo sapiens
ctggaggcccctgg

SEQ ID NO: 870362 - DNA, 21 bp, Homo sapiens
ctggaggcccctggagccaga

SEQ ID NO: 870363 - DNA, 14 bp, Homo sapiens
ctggaggcctcagg

SEQ ID NO: 870364 - DNA, 16 bp, Homo sapiens
ctggaggcctcaggtg

SEQ ID NO: 870365 - DNA, 23 bp, Homo sapiens
ctggaggctgcagagctgaccca

SEQ ID NO: 870366 - DNA, 19 bp, Homo sapiens
ctggaggctgcctgctgtg

SEQ ID NO: 870367 - DNA, 23 bp, Homo sapiens
ctggagggaagagtggaggtgga

SEQ ID NO: 870368 - DNA, 15 bp, Homo sapiens
ctggagggatgcccc

SEQ ID NO: 870369 - DNA, 23 bp, Homo sapiens
ctggagggatgcccccaggcagc

SEQ ID NO: 870370 - DNA, 15 bp, Homo sapiens
ctggagggcacttcc

SEQ ID NO: 870371 - DNA, 23 bp, Homo sapiens
ctggagggcacttcctccacagt

SEQ ID NO: 870372 - DNA, 13 bp, Homo sapiens
ctggaggggaggg

SEQ ID NO: 870373 - DNA, 13 bp, Homo sapiens
ctggaggggctgt

SEQ ID NO: 870374 - DNA, 16 bp, Homo sapiens
ctggaggggtgtggct

SEQ ID NO: 870375 - DNA, 20 bp, Homo sapiens
ctggaggtactgagacaggg

SEQ ID NO: 870376 - DNA, 12 bp, Homo sapiens
ctggaggtgctg

SEQ ID NO: 870377 - DNA, 15 bp, Homo sapiens
ctggaggtgggcatg

SEQ ID NO: 870378 - DNA, 21 bp, Homo sapiens
ctggaggtgggcatgccaccc

SEQ ID NO: 870379 - DNA, 24 bp, Homo sapiens
ctggaggtgggcatgccaccctca

SEQ ID NO: 870380 - DNA, 13 bp, Homo sapiens
ctggagtcccacc

SEQ ID NO: 870381 - DNA, 14 bp, Homo sapiens
ctggagtccctgtg

SEQ ID NO: 870382 - DNA, 13 bp, Homo sapiens
ctggagtcctctc

SEQ ID NO: 870383 - DNA, 15 bp, Homo sapiens
ctggagtcctctcca

SEQ ID NO: 870384 - DNA, 17 bp, Homo sapiens
ctggagtcctctccaga

SEQ ID NO: 870385 - DNA, 16 bp, Homo sapiens
ctggagtctcctgagg

SEQ ID NO: 870386 - DNA, 21 bp, Homo sapiens
ctggagtgaggcttccaggct

SEQ ID NO: 870387 - DNA, 24 bp, Homo sapiens
ctggagtgaggcttccaggctctt

SEQ ID NO: 870388 - DNA, 16 bp, Homo sapiens
ctggagtgatggtgtc

SEQ ID NO: 870389 - DNA, 16 bp, Homo sapiens
ctggagtgcagtggca

SEQ ID NO: 870390 - DNA, 16 bp, Homo sapiens
ctggagtgccctgcag

SEQ ID NO: 870391 - DNA, 17 bp, Homo sapiens
ctggagtgccctgcagg

SEQ ID NO: 870392 - DNA, 19 bp, Homo sapiens
ctggagtgccctgcaggca

SEQ ID NO: 870393 - DNA, 20 bp, Homo sapiens
ctggagtgccctgcaggcac

SEQ ID NO: 870394 - DNA, 19 bp, Homo sapiens
ctggagtgcgctcttggtc

SEQ ID NO: 870395 - DNA, 14 bp, Homo sapiens
ctggagtgctgctt

SEQ ID NO: 870396 - DNA, 13 bp, Homo sapiens
ctggagtgtagtg

SEQ ID NO: 870397 - DNA, 12 bp, Homo sapiens
ctggcagcccag

SEQ ID NO: 870398 - DNA, 13 bp, Homo sapiens
ctggcagccgtgc

SEQ ID NO: 870399 - DNA, 24 bp, Homo sapiens
ctggcagctcctctccttgggctc

SEQ ID NO: 870400 - DNA, 12 bp, Homo sapiens
ctggcagctctc

SEQ ID NO: 870401 - DNA, 21 bp, Homo sapiens
ctggcagctgagagccctgct

SEQ ID NO: 870402 - DNA, 20 bp, Homo sapiens
ctggcagctgcccctcctgg

SEQ ID NO: 870403 - DNA, 23 bp, Homo sapiens
ctggcagctgcccctcctggagc

SEQ ID NO: 870404 - DNA, 16 bp, Homo sapiens
ctggcagctgctgtgg

SEQ ID NO: 870405 - DNA, 23 bp, Homo sapiens
ctggcagctggaccatctctgta

SEQ ID NO: 870406 - DNA, 21 bp, Homo sapiens
ctggcaggacctgcctagcat

SEQ ID NO: 870407 - DNA, 17 bp, Homo sapiens
ctggcaggcttccccct

SEQ ID NO: 870408 - DNA, 20 bp, Homo sapiens
ctggcagggccacctgcagg

SEQ ID NO: 870409 - DNA, 21 bp, Homo sapiens
ctggcagggccacctgcagga

SEQ ID NO: 870410 - DNA, 22 bp, Homo sapiens
ctggcagggccagggcaatgcc

SEQ ID NO: 870411 - DNA, 16 bp, Homo sapiens
ctggcagggctcacac

SEQ ID NO: 870412 - DNA, 19 bp, Homo sapiens
ctggcagggctcacactcc

SEQ ID NO: 870413 - DNA, 12 bp, Homo sapiens
ctggcaggtgca

SEQ ID NO: 870414 - DNA, 14 bp, Homo sapiens
ctggcaggtgcaga

SEQ ID NO: 870415 - DNA, 16 bp, Homo sapiens
ctggcaggtgcagatg

SEQ ID NO: 870416 - DNA, 16 bp, Homo sapiens
ctggcagtccgtggga

SEQ ID NO: 870417 - DNA, 22 bp, Homo sapiens
ctggcagtcctggaagccagct

SEQ ID NO: 870418 - DNA, 17 bp, Homo sapiens
ctggcagtggctctcag

SEQ ID NO: 870419 - DNA, 19 bp, Homo sapiens
ctggcagtggctctcagag

SEQ ID NO: 870420 - DNA, 17 bp, Homo sapiens
ctggcagttgaacagag

SEQ ID NO: 870421 - DNA, 15 bp, Homo sapiens
ctggcagtttaaaaa

SEQ ID NO: 870422 - DNA, 20 bp, Homo sapiens
ctggcagtttatatttaact

SEQ ID NO: 870423 - DNA, 17 bp, Homo sapiens
ctggcatcgcaccattc

SEQ ID NO: 870424 - DNA, 23 bp, Homo sapiens
ctggcatcgcaccattctgactc

SEQ ID NO: 870425 - DNA, 14 bp, Homo sapiens
ctggcatctgtgcg

SEQ ID NO: 870426 - DNA, 14 bp, Homo sapiens
ctggcatctgtgtg

SEQ ID NO: 870427 - DNA, 18 bp, Homo sapiens
ctggcatcttagacctcc

SEQ ID NO: 870428 - DNA, 17 bp, Homo sapiens
ctggcatgacactctag

SEQ ID NO: 870429 - DNA, 22 bp, Homo sapiens
ctggcatggattaatagagttg

SEQ ID NO: 870430 - DNA, 13 bp, Homo sapiens
ctggcatgggaca

SEQ ID NO: 870431 - DNA, 18 bp, Homo sapiens
ctggcatggtgcagggag

SEQ ID NO: 870432 - DNA, 19 bp, Homo sapiens
ctggcatgtttcactcctg

SEQ ID NO: 870433 - DNA, 14 bp, Homo sapiens
ctggcatgttttct

SEQ ID NO: 870434 - DNA, 17 bp, Homo sapiens
ctggcattaattattaa

SEQ ID NO: 870435 - DNA, 18 bp, Homo sapiens
ctggcattaattattaat

SEQ ID NO: 870436 - DNA, 23 bp, Homo sapiens
ctggcattaattattaataccaa

SEQ ID NO: 870437 - DNA, 17 bp, Homo sapiens
ctggcattcttgtacag

SEQ ID NO: 870438 - DNA, 21 bp, Homo sapiens
ctggcatttgctgatttctag

SEQ ID NO: 870439 - DNA, 16 bp, Homo sapiens
ctggcatttgtttcct

SEQ ID NO: 870440 - DNA, 21 bp, Homo sapiens
ctggccaaagagcctttccaa

SEQ ID NO: 870441 - DNA, 17 bp, Homo sapiens
ctggccaaatatgcact

SEQ ID NO: 870442 - DNA, 20 bp, Homo sapiens
ctggccaaatatgcactttc

SEQ ID NO: 870443 - DNA, 23 bp, Homo sapiens
ctggccaaggggtgggcctgtga

SEQ ID NO: 870444 - DNA, 16 bp, Homo sapiens
ctggccaaggtgtcca

SEQ ID NO: 870445 - DNA, 19 bp, Homo sapiens
ctggccaaggtgtccaggg

SEQ ID NO: 870446 - DNA, 19 bp, Homo sapiens
ctggccacatcagccccac

SEQ ID NO: 870447 - DNA, 21 bp, Homo sapiens
ctggccacatcagccccacag

SEQ ID NO: 870448 - DNA, 20 bp, Homo sapiens
ctggccaccagccatcctcc

SEQ ID NO: 870449 - DNA, 15 bp, Homo sapiens
ctggccaccaggctg

SEQ ID NO: 870450 - DNA, 16 bp, Homo sapiens
ctggccaccaggctgg

SEQ ID NO: 870451 - DNA, 19 bp, Homo sapiens
ctggccaccccagagtggg

SEQ ID NO: 870452 - DNA, 21 bp, Homo sapiens
ctggccaccccagagtgggag

SEQ ID NO: 870453 - DNA, 15 bp, Homo sapiens
ctggccacccctccc

SEQ ID NO: 870454 - DNA, 15 bp, Homo sapiens
ctggccaccctggcc

SEQ ID NO: 870455 - DNA, 16 bp, Homo sapiens
ctggccaccctggccc

SEQ ID NO: 870456 - DNA, 15 bp, Homo sapiens
ctggccacccttggc

SEQ ID NO: 870457 - DNA, 16 bp, Homo sapiens
ctggccacctctctcc

SEQ ID NO: 870458 - DNA, 18 bp, Homo sapiens
ctggccacctctctcctt

SEQ ID NO: 870459 - DNA, 15 bp, Homo sapiens
ctggccacctgaggt

SEQ ID NO: 870460 - DNA, 18 bp, Homo sapiens
ctggccactaaagcttca

SEQ ID NO: 870461 - DNA, 17 bp, Homo sapiens
ctggccactgctcccta

SEQ ID NO: 870462 - DNA, 15 bp, Homo sapiens
ctggccactgtccct

SEQ ID NO: 870463 - DNA, 20 bp, Homo sapiens
ctggccactgtccctgtcct

SEQ ID NO: 870464 - DNA, 13 bp, Homo sapiens
ctggccagaatgc

SEQ ID NO: 870465 - DNA, 16 bp, Homo sapiens
ctggccagacaagaag

SEQ ID NO: 870466 - DNA, 17 bp, Homo sapiens
ctggccagcaaggcagg

SEQ ID NO: 870467 - DNA, 15 bp, Homo sapiens
ctggccagcaccctc

SEQ ID NO: 870468 - DNA, 12 bp, Homo sapiens
ctggccaggatg

SEQ ID NO: 870469 - DNA, 23 bp, Homo sapiens
ctggccaggatggaggggtggtc

SEQ ID NO: 870470 - DNA, 14 bp, Homo sapiens
ctggccagggccac

SEQ ID NO: 870471 - DNA, 20 bp, Homo sapiens
ctggccagggccacgctcca

SEQ ID NO: 870472 - DNA, 15 bp, Homo sapiens
ctggccagtccaggc

SEQ ID NO: 870473 - DNA, 17 bp, Homo sapiens
ctggccagtccaggctg

SEQ ID NO: 870474 - DNA, 19 bp, Homo sapiens
ctggccagtcctggtcctg

SEQ ID NO: 870475 - DNA, 13 bp, Homo sapiens
ctggccagtgttt

SEQ ID NO: 870476 - DNA, 20 bp, Homo sapiens
ctggccatctccctccccag

SEQ ID NO: 870477 - DNA, 22 bp, Homo sapiens
ctggccatgaatctctgcctct

SEQ ID NO: 870478 - DNA, 14 bp, Homo sapiens
ctggccatgctgtc

SEQ ID NO: 870479 - DNA, 15 bp, Homo sapiens
ctggccatgctgtcc

SEQ ID NO: 870480 - DNA, 18 bp, Homo sapiens
ctggccatgctgtccctg

SEQ ID NO: 870481 - DNA, 22 bp, Homo sapiens
ctggccatgctgtccctgcact

SEQ ID NO: 870482 - DNA, 17 bp, Homo sapiens
ctggccatgtcacctgg

SEQ ID NO: 870483 - DNA, 20 bp, Homo sapiens
ctggccatttggccccaggg

SEQ ID NO: 870484 - DNA, 16 bp, Homo sapiens
ctggccatttttctgg

SEQ ID NO: 870485 - DNA, 18 bp, Homo sapiens
ctggccatttttctgggg

SEQ ID NO: 870486 - DNA, 14 bp, Homo sapiens
ctggcccaaagcag

SEQ ID NO: 870487 - DNA, 18 bp, Homo sapiens
ctggcccaccccccagcc

SEQ ID NO: 870488 - DNA, 22 bp, Homo sapiens
ctggcccaccccccagcctcca

SEQ ID NO: 870489 - DNA, 12 bp, Homo sapiens
ctggcccagaaa

SEQ ID NO: 870490 - DNA, 15 bp, Homo sapiens
ctggcccagaaagcc

SEQ ID NO: 870491 - DNA, 10 bp, Homo sapiens
ctggcccagc

SEQ ID NO: 870492 - DNA, 17 bp, Homo sapiens
ctggcccagccaaaccc

SEQ ID NO: 870493 - DNA, 22 bp, Homo sapiens
ctggcccagccaactgccccgg

SEQ ID NO: 870494 - DNA, 15 bp, Homo sapiens
ctggcccagccggcc

SEQ ID NO: 870495 - DNA, 20 bp, Homo sapiens
ctggcccagccggcctctct

SEQ ID NO: 870496 - DNA, 21 bp, Homo sapiens
ctggcccagccggcctctctg

SEQ ID NO: 870497 - DNA, 22 bp, Homo sapiens
ctggcccagccggcctctctgg

SEQ ID NO: 870498 - DNA, 17 bp, Homo sapiens
ctggcccagcggcccct

SEQ ID NO: 870499 - DNA, 18 bp, Homo sapiens
ctggcccagcggcccctc

SEQ ID NO: 870500 - DNA, 13 bp, Homo sapiens
ctggcccaggcct

SEQ ID NO: 870501 - DNA, 21 bp, Homo sapiens
ctggcccaggtaacatgttta

SEQ ID NO: 870502 - DNA, 16 bp, Homo sapiens
ctggcccatctcagcc

SEQ ID NO: 870503 - DNA, 19 bp, Homo sapiens
ctggcccatctcagcctcc

SEQ ID NO: 870504 - DNA, 14 bp, Homo sapiens
ctggccccacagga

SEQ ID NO: 870505 - DNA, 14 bp, Homo sapiens
ctggccccagccct

SEQ ID NO: 870506 - DNA, 15 bp, Homo sapiens
ctggccccagccctg

SEQ ID NO: 870507 - DNA, 16 bp, Homo sapiens
ctggccccagccctgc

SEQ ID NO: 870508 - DNA, 18 bp, Homo sapiens
ctggccccagccctgctg

SEQ ID NO: 870509 - DNA, 13 bp, Homo sapiens
ctggccccagcct

SEQ ID NO: 870510 - DNA, 17 bp, Homo sapiens
ctggccccagcctgggc

SEQ ID NO: 870511 - DNA, 23 bp, Homo sapiens
ctggccccagtgcggttcctcat

SEQ ID NO: 870512 - DNA, 15 bp, Homo sapiens
ctggcccccagccct

SEQ ID NO: 870513 - DNA, 16 bp, Homo sapiens
ctggcccccagccctg

SEQ ID NO: 870514 - DNA, 18 bp, Homo sapiens
ctggccccctcattcaga

SEQ ID NO: 870515 - DNA, 16 bp, Homo sapiens
ctggccccgccgcctg

SEQ ID NO: 870516 - DNA, 15 bp, Homo sapiens
ctggccccgcctgcc

SEQ ID NO: 870517 - DNA, 21 bp, Homo sapiens
ctggccccgggctctggccac

SEQ ID NO: 870518 - DNA, 22 bp, Homo sapiens
ctggccccgggctctggccacc

SEQ ID NO: 870519 - DNA, 18 bp, Homo sapiens
ctggcccctagaatcagc

SEQ ID NO: 870520 - DNA, 15 bp, Homo sapiens
ctggcccctcacctg

SEQ ID NO: 870521 - DNA, 16 bp, Homo sapiens
ctggctaactggaagc

SEQ ID NO: 870522 - DNA, 19 bp, Homo sapiens
ctggctacatcccagcctg

SEQ ID NO: 870523 - DNA, 20 bp, Homo sapiens
ctggctagagtcctcactcc

SEQ ID NO: 870524 - DNA, 21 bp, Homo sapiens
ctggctagcattcctcaggaa

SEQ ID NO: 870525 - DNA, 13 bp, Homo sapiens
ctggctatgcatt

SEQ ID NO: 870526 - DNA, 14 bp, Homo sapiens
ctggctatgcattt

SEQ ID NO: 870527 - DNA, 15 bp, Homo sapiens
ctggctatgcatttg

SEQ ID NO: 870528 - DNA, 18 bp, Homo sapiens
ctggctcacgcgttctgg

SEQ ID NO: 870529 - DNA, 21 bp, Homo sapiens
ctggctcacgcgttctgggag

SEQ ID NO: 870530 - DNA, 15 bp, Homo sapiens
ctggctcagcctgtc

SEQ ID NO: 870531 - DNA, 20 bp, Homo sapiens
ctggctcagggtcaaagaca

SEQ ID NO: 870532 - DNA, 14 bp, Homo sapiens
ctggctcatgcccc

SEQ ID NO: 870533 - DNA, 15 bp, Homo sapiens
ctggctcatgcccct

SEQ ID NO: 870534 - DNA, 17 bp, Homo sapiens
ctggctccagaggacct

SEQ ID NO: 870535 - DNA, 19 bp, Homo sapiens
ctggctccagaggacctga

SEQ ID NO: 870536 - DNA, 20 bp, Homo sapiens
ctggctccccctccccaggc

SEQ ID NO: 870537 - DNA, 21 bp, Homo sapiens
ctggctccccctccccaggct

SEQ ID NO: 870538 - DNA, 20 bp, Homo sapiens
ctggctccccgagggctcag

SEQ ID NO: 870539 - DNA, 22 bp, Homo sapiens
ctggctccctcctccaggcctg

SEQ ID NO: 870540 - DNA, 12 bp, Homo sapiens
ctggctccctgc

SEQ ID NO: 870541 - DNA, 13 bp, Homo sapiens
ctggctccgcagg

SEQ ID NO: 870542 - DNA, 17 bp, Homo sapiens
ctggctcctgaggggca

SEQ ID NO: 870543 - DNA, 19 bp, Homo sapiens
ctggctccttgcagcaggg

SEQ ID NO: 870544 - DNA, 17 bp, Homo sapiens
ctggctctaccctgtct

SEQ ID NO: 870545 - DNA, 17 bp, Homo sapiens
ctggctctcatggggtc

SEQ ID NO: 870546 - DNA, 16 bp, Homo sapiens
ctggctctccaagtgc

SEQ ID NO: 870547 - DNA, 15 bp, Homo sapiens
ctggctctcctggcc

SEQ ID NO: 870548 - DNA, 17 bp, Homo sapiens
ctggctctcctggccct

SEQ ID NO: 870549 - DNA, 15 bp, Homo sapiens
ctgggagattcaagg

SEQ ID NO: 870550 - DNA, 15 bp, Homo sapiens
ctgggagccacgcct

SEQ ID NO: 870551 - DNA, 17 bp, Homo sapiens
ctgggagccacttctcc

SEQ ID NO: 870552 - DNA, 19 bp, Homo sapiens
ctgggagccagtgtgccca

SEQ ID NO: 870553 - DNA, 17 bp, Homo sapiens
ctgggagccgcctgctt

SEQ ID NO: 870554 - DNA, 20 bp, Homo sapiens
ctgggagcctcgcccctcca

SEQ ID NO: 870555 - DNA, 16 bp, Homo sapiens
ctgggagctcaaggcc

SEQ ID NO: 870556 - DNA, 13 bp, Homo sapiens
ctgggagctctgc

SEQ ID NO: 870557 - DNA, 20 bp, Homo sapiens
ctgggagctgcgccggacag

SEQ ID NO: 870558 - DNA, 14 bp, Homo sapiens
ctgggaggaagcag

SEQ ID NO: 870559 - DNA, 21 bp, Homo sapiens
ctgggaggaagcaggttgagg

SEQ ID NO: 870560 - DNA, 14 bp, Homo sapiens
ctgggaggaggaag

SEQ ID NO: 870561 - DNA, 14 bp, Homo sapiens
ctgggaggagggag

SEQ ID NO: 870562 - DNA, 19 bp, Homo sapiens
ctgggaggagggagaggga

SEQ ID NO: 870563 - DNA, 20 bp, Homo sapiens
ctgggaggatcctgagctgc

SEQ ID NO: 870564 - DNA, 21 bp, Homo sapiens
ctgggaggatcctgagctgct

SEQ ID NO: 870565 - DNA, 24 bp, Homo sapiens
ctgggaggatcctgagctgctgtt

SEQ ID NO: 870566 - DNA, 16 bp, Homo sapiens
ctgggaggatttgaca

SEQ ID NO: 870567 - DNA, 17 bp, Homo sapiens
ctgggaggcaagaaaag

SEQ ID NO: 870568 - DNA, 19 bp, Homo sapiens
ctgggaggcaagaaaagga

SEQ ID NO: 870569 - DNA, 17 bp, Homo sapiens
ctgggaggcaagagggg

SEQ ID NO: 870570 - DNA, 18 bp, Homo sapiens
ctgggaggcaagaggggt

SEQ ID NO: 870571 - DNA, 20 bp, Homo sapiens
ctgggaggcaagaggggtgg

SEQ ID NO: 870572 - DNA, 23 bp, Homo sapiens
ctgggaggcaagaggggtggaga

SEQ ID NO: 870573 - DNA, 13 bp, Homo sapiens
ctgggaggcagag

SEQ ID NO: 870574 - DNA, 16 bp, Homo sapiens
ctgggaggcagggctc

SEQ ID NO: 870575 - DNA, 13 bp, Homo sapiens
ctgggagggaagt

SEQ ID NO: 870576 - DNA, 11 bp, Homo sapiens
ctgggagggca

SEQ ID NO: 870577 - DNA, 13 bp, Homo sapiens
ctgggagggcagc

SEQ ID NO: 870578 - DNA, 19 bp, Homo sapiens
ctgggagggcagcagggct

SEQ ID NO: 870579 - DNA, 13 bp, Homo sapiens
ctgggagggggct

SEQ ID NO: 870580 - DNA, 15 bp, Homo sapiens
ctgggagggggtgag

SEQ ID NO: 870581 - DNA, 16 bp, Homo sapiens
ctgggagggggtgaga

SEQ ID NO: 870582 - DNA, 20 bp, Homo sapiens
ctgggaggttaaaaagaaaa

SEQ ID NO: 870583 - DNA, 21 bp, Homo sapiens
ctgggaggttgggaggctgtg

SEQ ID NO: 870584 - DNA, 22 bp, Homo sapiens
ctgggagtcacacagtgttgga

SEQ ID NO: 870585 - DNA, 16 bp, Homo sapiens
ctgggagtcagagccc

SEQ ID NO: 870586 - DNA, 19 bp, Homo sapiens
ctgggagtcagagccctgg

SEQ ID NO: 870587 - DNA, 21 bp, Homo sapiens
ctgggagtcagagccctggct

SEQ ID NO: 870588 - DNA, 14 bp, Homo sapiens
ctgggagtcccctt

SEQ ID NO: 870589 - DNA, 20 bp, Homo sapiens
ctgggagtccctacctgctt

SEQ ID NO: 870590 - DNA, 16 bp, Homo sapiens
ctgggagtccttacct

SEQ ID NO: 870591 - DNA, 18 bp, Homo sapiens
ctgggagtccttacctcg

SEQ ID NO: 870592 - DNA, 21 bp, Homo sapiens
ctgggagtgtccttagtgtat

SEQ ID NO: 870593 - DNA, 18 bp, Homo sapiens
ctgggatatggctgccca

SEQ ID NO: 870594 - DNA, 20 bp, Homo sapiens
ctgggatatggctgcccagg

SEQ ID NO: 870595 - DNA, 23 bp, Homo sapiens
ctgggatcgtgcatttgaggggc

SEQ ID NO: 870596 - DNA, 17 bp, Homo sapiens
ctgggatctgattgagg

SEQ ID NO: 870597 - DNA, 16 bp, Homo sapiens
ctgggatctggtggtc

SEQ ID NO: 870598 - DNA, 22 bp, Homo sapiens
ctgggatgacaggcgcctgcca

SEQ ID NO: 870599 - DNA, 17 bp, Homo sapiens
ctgggatgacaggtgtg

SEQ ID NO: 870600 - DNA, 22 bp, Homo sapiens
ctgggatgacaggtgtgagcca

SEQ ID NO: 870601 - DNA, 17 bp, Homo sapiens
ctgggatgagccgctgt

SEQ ID NO: 870602 - DNA, 21 bp, Homo sapiens
ctgggatgagccgctgtgagc

SEQ ID NO: 870603 - DNA, 16 bp, Homo sapiens
ctgggatgctgaccca

SEQ ID NO: 870604 - DNA, 14 bp, Homo sapiens
ctgggatggaacct

SEQ ID NO: 870605 - DNA, 15 bp, Homo sapiens
ctgggatggacagga

SEQ ID NO: 870606 - DNA, 16 bp, Homo sapiens
ctgggatgggaccagg

SEQ ID NO: 870607 - DNA, 17 bp, Homo sapiens
ctgggccccactggaca

SEQ ID NO: 870608 - DNA, 18 bp, Homo sapiens
ctgggccccactggacaa

SEQ ID NO: 870609 - DNA, 23 bp, Homo sapiens
ctgggccccactggacaacactg

SEQ ID NO: 870610 - DNA, 21 bp, Homo sapiens
ctggggacccacccagcccct

SEQ ID NO: 870611 - DNA, 15 bp, Homo sapiens
ctggggaccctccag

SEQ ID NO: 870612 - DNA, 20 bp, Homo sapiens
ctggggacctggcactggga

SEQ ID NO: 870613 - DNA, 19 bp, Homo sapiens
ctggggacgccaaggaggt

SEQ ID NO: 870614 - DNA, 23 bp, Homo sapiens
ctggggactcctcaaaccacttg

SEQ ID NO: 870615 - DNA, 16 bp, Homo sapiens
ctggggactctggcac

SEQ ID NO: 870616 - DNA, 18 bp, Homo sapiens
ctggggacttgtgtctgc

SEQ ID NO: 870617 - DNA, 21 bp, Homo sapiens
ctggggagaaagaggggcctg

SEQ ID NO: 870618 - DNA, 14 bp, Homo sapiens
ctggggagaaagta

SEQ ID NO: 870619 - DNA, 17 bp, Homo sapiens
ctggggagatgggggct

SEQ ID NO: 870620 - DNA, 17 bp, Homo sapiens
ctggggagccctcaggc

SEQ ID NO: 870621 - DNA, 19 bp, Homo sapiens
ctggggagccctcaggctc

SEQ ID NO: 870622 - DNA, 17 bp, Homo sapiens
ctggggagctcctggga

SEQ ID NO: 870623 - DNA, 12 bp, Homo sapiens
ctggggaggagc

SEQ ID NO: 870624 - DNA, 20 bp, Homo sapiens
ctggggaggaggagagagtc

SEQ ID NO: 870625 - DNA, 12 bp, Homo sapiens
ctggggaggcag

SEQ ID NO: 870626 - DNA, 13 bp, Homo sapiens
ctggggaggcagg

SEQ ID NO: 870627 - DNA, 20 bp, Homo sapiens
ctggggagggctgcagtcac

SEQ ID NO: 870628 - DNA, 21 bp, Homo sapiens
ctggggagggctgcagtcaca

SEQ ID NO: 870629 - DNA, 23 bp, Homo sapiens
ctggggagggctgcagtcacatt

SEQ ID NO: 870630 - DNA, 17 bp, Homo sapiens
ctggggagggggtacct

SEQ ID NO: 870631 - DNA, 21 bp, Homo sapiens
ctggggaggtgggaggccagg

SEQ ID NO: 870632 - DNA, 23 bp, Homo sapiens
ctggggaggtgggaggccaggcg

SEQ ID NO: 870633 - DNA, 20 bp, Homo sapiens
ctggggagtgggacagagtc

SEQ ID NO: 870634 - DNA, 17 bp, Homo sapiens
ctggggatcttcccaca

SEQ ID NO: 870635 - DNA, 19 bp, Homo sapiens
ctggggatcttcccacagg

SEQ ID NO: 870636 - DNA, 12 bp, Homo sapiens
ctggggatgggt

SEQ ID NO: 870637 - DNA, 23 bp, Homo sapiens
ctggggatggtggcacaggcact

SEQ ID NO: 870638 - DNA, 20 bp, Homo sapiens
ctggggatgtaaccaagctg

SEQ ID NO: 870639 - DNA, 16 bp, Homo sapiens
ctggggatgtgggagg

SEQ ID NO: 870640 - DNA, 22 bp, Homo sapiens
ctggggatgtgggagggagcag

SEQ ID NO: 870641 - DNA, 14 bp, Homo sapiens
ctggggcaagtccc

SEQ ID NO: 870642 - DNA, 16 bp, Homo sapiens
ctggggcacagtccag

SEQ ID NO: 870643 - DNA, 14 bp, Homo sapiens
ctggggcacggcgg

SEQ ID NO: 870644 - DNA, 22 bp, Homo sapiens
ctggggcagaggggcagccgct

SEQ ID NO: 870645 - DNA, 24 bp, Homo sapiens
ctggggcagaggggcagccgctag

SEQ ID NO: 870646 - DNA, 18 bp, Homo sapiens
ctggggcagcactcccca

SEQ ID NO: 870647 - DNA, 15 bp, Homo sapiens
ctggggcaggctctc

SEQ ID NO: 870648 - DNA, 18 bp, Homo sapiens
ctggggcaggctctctcc

SEQ ID NO: 870649 - DNA, 19 bp, Homo sapiens
ctggggcaggctctctcct

SEQ ID NO: 870650 - DNA, 18 bp, Homo sapiens
ctggggcaggctgggcca

SEQ ID NO: 870651 - DNA, 20 bp, Homo sapiens
ctggggcaggggcctgggcc

SEQ ID NO: 870652 - DNA, 18 bp, Homo sapiens
ctggggcatcctgtgcca

SEQ ID NO: 870653 - DNA, 19 bp, Homo sapiens
ctggggcatgtgtgcctgt

SEQ ID NO: 870654 - DNA, 21 bp, Homo sapiens
ctggggccacaaatcaaagca

SEQ ID NO: 870655 - DNA, 15 bp, Homo sapiens
ctggggccacacaga

SEQ ID NO: 870656 - DNA, 17 bp, Homo sapiens
ctggggccacacagaaa

SEQ ID NO: 870657 - DNA, 15 bp, Homo sapiens
ctggggccagaggct

SEQ ID NO: 870658 - DNA, 17 bp, Homo sapiens
ctggggccagaggctgg

SEQ ID NO: 870659 - DNA, 12 bp, Homo sapiens
ctggggccaggg

SEQ ID NO: 870660 - DNA, 15 bp, Homo sapiens
ctggggccagggcag

SEQ ID NO: 870661 - DNA, 16 bp, Homo sapiens
ctggggccagggcaga

SEQ ID NO: 870662 - DNA, 16 bp, Homo sapiens
ctggggcccagcccct

SEQ ID NO: 870663 - DNA, 18 bp, Homo sapiens
ctggggccccgctgggat

SEQ ID NO: 870664 - DNA, 17 bp, Homo sapiens
ctggggccctgggcctc

SEQ ID NO: 870665 - DNA, 18 bp, Homo sapiens
ctggggccctgggcctca

SEQ ID NO: 870666 - DNA, 13 bp, Homo sapiens
ctggggccgcctg

SEQ ID NO: 870667 - DNA, 15 bp, Homo sapiens
ctggggccgcctgcc

SEQ ID NO: 870668 - DNA, 16 bp, Homo sapiens
ctggggccgcctgccc

SEQ ID NO: 870669 - DNA, 19 bp, Homo sapiens
ctggggccgcctgccctgc

SEQ ID NO: 870670 - DNA, 23 bp, Homo sapiens
ctggggcctagcgatctctcctg

SEQ ID NO: 870671 - DNA, 19 bp, Homo sapiens
ctggggcctccagaagctg

SEQ ID NO: 870672 - DNA, 22 bp, Homo sapiens
ctggggcctccagaagctgctc

SEQ ID NO: 870673 - DNA, 19 bp, Homo sapiens
ctggggcctcggagcctca

SEQ ID NO: 870674 - DNA, 12 bp, Homo sapiens
ctggggcctctt

SEQ ID NO: 870675 - DNA, 12 bp, Homo sapiens
ctggggcctgac

SEQ ID NO: 870676 - DNA, 15 bp, Homo sapiens
ctggggcctgactgc

SEQ ID NO: 870677 - DNA, 16 bp, Homo sapiens
ctggggcctgactgct

SEQ ID NO: 870678 - DNA, 18 bp, Homo sapiens
ctggggcctgactgctca

SEQ ID NO: 870679 - DNA, 20 bp, Homo sapiens
ctggggcctgactgctcaga

SEQ ID NO: 870680 - DNA, 13 bp, Homo sapiens
ctggggcctgaga

SEQ ID NO: 870681 - DNA, 16 bp, Homo sapiens
ctggggcctgagagaa

SEQ ID NO: 870682 - DNA, 16 bp, Homo sapiens
ctggggcggtgtgtgt

SEQ ID NO: 870683 - DNA, 21 bp, Homo sapiens
ctggggctcacggggcctcca

SEQ ID NO: 870684 - DNA, 22 bp, Homo sapiens
ctggggctcacggggcctccaa

SEQ ID NO: 870685 - DNA, 14 bp, Homo sapiens
ctggggctccctct

SEQ ID NO: 870686 - DNA, 22 bp, Homo sapiens
ctggggctcccttcatctccag

SEQ ID NO: 870687 - DNA, 19 bp, Homo sapiens
ctggggctcctttctccag

SEQ ID NO: 870688 - DNA, 14 bp, Homo sapiens
ctggggctctgtgc

SEQ ID NO: 870689 - DNA, 19 bp, Homo sapiens
ctggggctctgtgcaggga

SEQ ID NO: 870690 - DNA, 12 bp, Homo sapiens
ctggggctgaac

SEQ ID NO: 870691 - DNA, 20 bp, Homo sapiens
ctggggctgaggctgaggca

SEQ ID NO: 870692 - DNA, 19 bp, Homo sapiens
ctggggctgccagcctgag

SEQ ID NO: 870693 - DNA, 23 bp, Homo sapiens
ctggggctgccagcctgagcgga

SEQ ID NO: 870694 - DNA, 15 bp, Homo sapiens
ctggggctgctcccc

SEQ ID NO: 870695 - DNA, 17 bp, Homo sapiens
ctggggctgcttaggaa

SEQ ID NO: 870696 - DNA, 14 bp, Homo sapiens
ctggggctggcctc

SEQ ID NO: 870697 - DNA, 18 bp, Homo sapiens
ctggggctggcctcccaa

SEQ ID NO: 870698 - DNA, 19 bp, Homo sapiens
ctggggcttatgggtggct

SEQ ID NO: 870699 - DNA, 15 bp, Homo sapiens
ctggggcttctcctg

SEQ ID NO: 870700 - DNA, 18 bp, Homo sapiens
ctggggcttgtcctgtgc

SEQ ID NO: 870701 - DNA, 19 bp, Homo sapiens
ctggggcttgtcctgtgct

SEQ ID NO: 870702 - DNA, 20 bp, Homo sapiens
ctggggcttgtcctgtgctt

SEQ ID NO: 870703 - DNA, 13 bp, Homo sapiens
ctgggggaagaag

SEQ ID NO: 870704 - DNA, 15 bp, Homo sapiens
ctgggggaagaagct

SEQ ID NO: 870705 - DNA, 13 bp, Homo sapiens
ctgggggaagggt

SEQ ID NO: 870706 - DNA, 20 bp, Homo sapiens
ctgggggaatgagcccagag

SEQ ID NO: 870707 - DNA, 21 bp, Homo sapiens
ctgggggacccctggctctgg

SEQ ID NO: 870708 - DNA, 15 bp, Homo sapiens
ctgggggacctttgt

SEQ ID NO: 870709 - DNA, 13 bp, Homo sapiens
ctgggggactggg

SEQ ID NO: 870710 - DNA, 22 bp, Homo sapiens
ctgggggactgggagtcagagc

SEQ ID NO: 870711 - DNA, 11 bp, Homo sapiens
ctgggggaggc

SEQ ID NO: 870712 - DNA, 13 bp, Homo sapiens
ctgggggaggcag

SEQ ID NO: 870713 - DNA, 20 bp, Homo sapiens
ctgggggaggcagggctgga

SEQ ID NO: 870714 - DNA, 15 bp, Homo sapiens
ctgggggagtgtgag

SEQ ID NO: 870715 - DNA, 18 bp, Homo sapiens
ctgggggagttttcctct

SEQ ID NO: 870716 - DNA, 16 bp, Homo sapiens
ctgggggattgaggtg

SEQ ID NO: 870717 - DNA, 13 bp, Homo sapiens
ctgggggcaaagg

SEQ ID NO: 870718 - DNA, 21 bp, Homo sapiens
ctgggggcagctgtcctgaac

SEQ ID NO: 870719 - DNA, 14 bp, Homo sapiens
ctgggggcaggagg

SEQ ID NO: 870720 - DNA, 15 bp, Homo sapiens
ctgggggcaggccag

SEQ ID NO: 870721 - DNA, 16 bp, Homo sapiens
ctgggggcagtgactg

SEQ ID NO: 870722 - DNA, 14 bp, Homo sapiens
ctgggggccatgag

SEQ ID NO: 870723 - DNA, 20 bp, Homo sapiens
ctgggggccatgagctccag

SEQ ID NO: 870724 - DNA, 14 bp, Homo sapiens
ctgggggccccagg

SEQ ID NO: 870725 - DNA, 12 bp, Homo sapiens
ctgggggctggc

SEQ ID NO: 870726 - DNA, 22 bp, Homo sapiens
ctggggggagggacagggcagg

SEQ ID NO: 870727 - DNA, 22 bp, Homo sapiens
ctggggggatgttctgcctctc

SEQ ID NO: 870728 - DNA, 17 bp, Homo sapiens
ctggggggctttggcct

SEQ ID NO: 870729 - DNA, 19 bp, Homo sapiens
ctgggggtgaggaggacaa

SEQ ID NO: 870730 - DNA, 15 bp, Homo sapiens
ctgggggtgccagga

SEQ ID NO: 870731 - DNA, 14 bp, Homo sapiens
ctgggggtggcagg

SEQ ID NO: 870732 - DNA, 15 bp, Homo sapiens
ctgggggtgggccag

SEQ ID NO: 870733 - DNA, 19 bp, Homo sapiens
ctgggggtggggaggtgtc

SEQ ID NO: 870734 - DNA, 24 bp, Homo sapiens
ctggggtaggctgtctgtgccatg

SEQ ID NO: 870735 - DNA, 13 bp, Homo sapiens
ctggtatgatgta

SEQ ID NO: 870736 - DNA, 13 bp, Homo sapiens
ctggtattaaatg

SEQ ID NO: 870737 - DNA, 20 bp, Homo sapiens
ctggtattagttaaaacaca

SEQ ID NO: 870738 - DNA, 21 bp, Homo sapiens
ctggtattagttaaaacacat

SEQ ID NO: 870739 - DNA, 22 bp, Homo sapiens
ctggtattcacagaaagctaga

SEQ ID NO: 870740 - DNA, 14 bp, Homo sapiens
ctggtattctctct

SEQ ID NO: 870741 - DNA, 21 bp, Homo sapiens
ctggtattctctctatgcaaa

SEQ ID NO: 870742 - DNA, 18 bp, Homo sapiens
ctggtattctgttctgga

SEQ ID NO: 870743 - DNA, 20 bp, Homo sapiens
ctggtattctgttctggagg

SEQ ID NO: 870744 - DNA, 17 bp, Homo sapiens
ctgtaaatctaacatta

SEQ ID NO: 870745 - DNA, 17 bp, Homo sapiens
ctgtaacaaattgggat

SEQ ID NO: 870746 - DNA, 16 bp, Homo sapiens
ctgtaacaagccagat

SEQ ID NO: 870747 - DNA, 18 bp, Homo sapiens
ctgtaacacaagccacag

SEQ ID NO: 870748 - DNA, 21 bp, Homo sapiens
ctgtaacacaagccacagaag

SEQ ID NO: 870749 - DNA, 15 bp, Homo sapiens
ctgtaacacagctga

SEQ ID NO: 870750 - DNA, 23 bp, Homo sapiens
ctgtaacctcttcagaggccctc

SEQ ID NO: 870751 - DNA, 19 bp, Homo sapiens
ctgtaactacaatgatggt

SEQ ID NO: 870752 - DNA, 16 bp, Homo sapiens
ctgtaactactttata

SEQ ID NO: 870753 - DNA, 20 bp, Homo sapiens
ctgtggggatctcaggggct

SEQ ID NO: 870754 - DNA, 19 bp, Homo sapiens
ctgtggggatttctcccag

SEQ ID NO: 870755 - DNA, 19 bp, Homo sapiens
ctgtggggcaggagtgcca

SEQ ID NO: 870756 - DNA, 20 bp, Homo sapiens
ctgtggggcaggagtgccag

SEQ ID NO: 870757 - DNA, 20 bp, Homo sapiens
ctgtggggcttacagaaatg

SEQ ID NO: 870758 - DNA, 18 bp, Homo sapiens
ctgtgggggactggctgg

SEQ ID NO: 870759 - DNA, 22 bp, Homo sapiens
ctgtgggggtcatcagggaggg

SEQ ID NO: 870760 - DNA, 11 bp, Homo sapiens
ctgtggggtgg

SEQ ID NO: 870761 - DNA, 22 bp, Homo sapiens
ctgtggggtggagcactggact

SEQ ID NO: 870762 - DNA, 14 bp, Homo sapiens
ctgtggggtgtagg

SEQ ID NO: 870763 - DNA, 13 bp, Homo sapiens
ctgtgggtctctg

SEQ ID NO: 870764 - DNA, 22 bp, Homo sapiens
ctgtgggtctgggagtcacaca

SEQ ID NO: 870765 - DNA, 22 bp, Homo sapiens
ctgtgggtgaagacagagggaa

SEQ ID NO: 870766 - DNA, 15 bp, Homo sapiens
ctgtgggtggggagg

SEQ ID NO: 870767 - DNA, 16 bp, Homo sapiens
ctgtgggtgtctccct

SEQ ID NO: 870768 - DNA, 20 bp, Homo sapiens
ctgtgggtgtgggtgggagt

SEQ ID NO: 870769 - DNA, 19 bp, Homo sapiens
ctgtgggtgttctttcctg

SEQ ID NO: 870770 - DNA, 20 bp, Homo sapiens
ctgtgggtttgggtgcctcc

SEQ ID NO: 870771 - DNA, 19 bp, Homo sapiens
ctgtggtacaaatgtgata

SEQ ID NO: 870772 - DNA, 16 bp, Homo sapiens
ctgtggtaggggcagg

SEQ ID NO: 870773 - DNA, 21 bp, Homo sapiens
ctgtggtaggggcagggaggc

SEQ ID NO: 870774 - DNA, 12 bp, Homo sapiens
ctgtggtcacag

SEQ ID NO: 870775 - DNA, 11 bp, Homo sapiens
ctgtggtccta

SEQ ID NO: 870776 - DNA, 22 bp, Homo sapiens
ctgtggtctataaaataaactt

SEQ ID NO: 870777 - DNA, 23 bp, Homo sapiens
ctgtggtctataaaataaacttc

SEQ ID NO: 870778 - DNA, 17 bp, Homo sapiens
ctgtggtgaagtgtggc

SEQ ID NO: 870779 - DNA, 22 bp, Homo sapiens
ctgtggtgaagtgtggctggtg

SEQ ID NO: 870780 - DNA, 24 bp, Homo sapiens
ctgtggtgaagtgtggctggtgtc

SEQ ID NO: 870781 - DNA, 19 bp, Homo sapiens
ctgtggtgatgtgcctgta

SEQ ID NO: 870782 - DNA, 16 bp, Homo sapiens
ctgtggtgatgttgcc

SEQ ID NO: 870783 - DNA, 17 bp, Homo sapiens
ctgtggtggctccccct

SEQ ID NO: 870784 - DNA, 20 bp, Homo sapiens
ctgtggtgggaacattcgag

SEQ ID NO: 870785 - DNA, 15 bp, Homo sapiens
ctgtggttcctctgc

SEQ ID NO: 870786 - DNA, 17 bp, Homo sapiens
ctgtggttctataataa

SEQ ID NO: 870787 - DNA, 15 bp, Homo sapiens
ctgtggttgcatttg

SEQ ID NO: 870788 - DNA, 16 bp, Homo sapiens
ctgtggtttcagatgt

SEQ ID NO: 870789 - DNA, 21 bp, Homo sapiens
ctgtggtttcagatgtgcaat

SEQ ID NO: 870790 - DNA, 18 bp, Homo sapiens
ctgtggtttcatgttagt

SEQ ID NO: 870791 - DNA, 16 bp, Homo sapiens
ctgtggttttattaca

SEQ ID NO: 870792 - DNA, 16 bp, Homo sapiens
ctgtggttttcccctc

SEQ ID NO: 870793 - DNA, 13 bp, Homo sapiens
ctgtgtaaagact

SEQ ID NO: 870794 - DNA, 16 bp, Homo sapiens
ctgtgtaaatatatgt

SEQ ID NO: 870795 - DNA, 15 bp, Homo sapiens
ctgtgtaaccttggg

SEQ ID NO: 870796 - DNA, 19 bp, Homo sapiens
ctgtgtaactttaaacatc

SEQ ID NO: 870797 - DNA, 19 bp, Homo sapiens
ctgtgtaatcatttcttgg

SEQ ID NO: 870798 - DNA, 15 bp, Homo sapiens
ctgtgtacaaagaaa

SEQ ID NO: 870799 - DNA, 17 bp, Homo sapiens
ctgtgtacaattttagt

SEQ ID NO: 870800 - DNA, 20 bp, Homo sapiens
ctgtgtagaaactggaagct

SEQ ID NO: 870801 - DNA, 20 bp, Homo sapiens
ctgtgtagagaatgtcactg

SEQ ID NO: 870802 - DNA, 19 bp, Homo sapiens
ctgtgtagccgccctgaga

SEQ ID NO: 870803 - DNA, 13 bp, Homo sapiens
ctgtgtatcatta

SEQ ID NO: 870804 - DNA, 17 bp, Homo sapiens
ctgtgtatcattaaaat

SEQ ID NO: 870805 - DNA, 23 bp, Homo sapiens
ctgtgtatcattaaaatatatgt

SEQ ID NO: 870806 - DNA, 15 bp, Homo sapiens
ctgtgtatgttttat

SEQ ID NO: 870807 - DNA, 15 bp, Homo sapiens
ctgtgtattccaaga

SEQ ID NO: 870808 - DNA, 17 bp, Homo sapiens
ctgtgtatttatttaaa

SEQ ID NO: 870809 - DNA, 15 bp, Homo sapiens
ctgtgtccagcagct

SEQ ID NO: 870810 - DNA, 16 bp, Homo sapiens
ctgtgtccagcagctg

SEQ ID NO: 870811 - DNA, 18 bp, Homo sapiens
ctgtgtccagcagctgcg

SEQ ID NO: 870812 - DNA, 13 bp, Homo sapiens
ctgtgtccatgcg

SEQ ID NO: 870813 - DNA, 18 bp, Homo sapiens
ctgtgtccatgcgctcag

SEQ ID NO: 870814 - DNA, 22 bp, Homo sapiens
ctgtgtccatgcgctcagggcc

SEQ ID NO: 870815 - DNA, 15 bp, Homo sapiens
ctgtgtcccatgacc

SEQ ID NO: 870816 - DNA, 13 bp, Homo sapiens
ctgtgtcccctga

SEQ ID NO: 870817 - DNA, 21 bp, Homo sapiens
ctgtgtcccctgacctgtcca

SEQ ID NO: 870818 - DNA, 19 bp, Homo sapiens
ctgtgtcctaaatgcaaag

SEQ ID NO: 870819 - DNA, 12 bp, Homo sapiens
ctgtgtcctccc

SEQ ID NO: 870820 - DNA, 17 bp, Homo sapiens
ctgtgtcctctagttga

SEQ ID NO: 870821 - DNA, 18 bp, Homo sapiens
ctgtgtcctctgcctggg

SEQ ID NO: 870822 - DNA, 23 bp, Homo sapiens
ctgtgtcctctgcctgggctctg

SEQ ID NO: 870823 - DNA, 23 bp, Homo sapiens
ctgtgtcctgaaacgctcctttg

SEQ ID NO: 870824 - DNA, 14 bp, Homo sapiens
ctgtgtcctggtgc

SEQ ID NO: 870825 - DNA, 20 bp, Homo sapiens
ctgtgtcctggtgctctctg

SEQ ID NO: 870826 - DNA, 17 bp, Homo sapiens
ctgtgtccttcctccac

SEQ ID NO: 870827 - DNA, 18 bp, Homo sapiens
ctgtgtccttgcacctgc

SEQ ID NO: 870828 - DNA, 17 bp, Homo sapiens
ctgtgtctctgcatcca

SEQ ID NO: 870829 - DNA, 12 bp, Homo sapiens
ctgtgtctctgt

SEQ ID NO: 870830 - DNA, 17 bp, Homo sapiens
ctgtgtctctgtttcct

SEQ ID NO: 870831 - DNA, 18 bp, Homo sapiens
ctgtgtctctgtttcctg

SEQ ID NO: 870832 - DNA, 18 bp, Homo sapiens
ctgtgtctgccaaacaca

SEQ ID NO: 870833 - DNA, 22 bp, Homo sapiens
ctgtgtctgcccaatgaataat

SEQ ID NO: 870834 - DNA, 20 bp, Homo sapiens
ctgtgtctggcgttctcaag

SEQ ID NO: 870835 - DNA, 19 bp, Homo sapiens
ctgtgtctgtcacaggctg

SEQ ID NO: 870836 - DNA, 13 bp, Homo sapiens
ctgtgtgaaaatg

SEQ ID NO: 870837 - DNA, 19 bp, Homo sapiens
ctgtgtgaacgtgtatgta

SEQ ID NO: 870838 - DNA, 14 bp, Homo sapiens
ctgtgtgaatgtgg

SEQ ID NO: 870839 - DNA, 23 bp, Homo sapiens
ctgtgtgacagaatcttgtattt

SEQ ID NO: 870840 - DNA, 22 bp, Homo sapiens
ctgtgtgagaggggcgcctttt

SEQ ID NO: 870841 - DNA, 23 bp, Homo sapiens
ctgtgtgagaggggcgccttttc

SEQ ID NO: 870842 - DNA, 20 bp, Homo sapiens
ctgtgtgaggctgtgtctct

SEQ ID NO: 870843 - DNA, 16 bp, Homo sapiens
ctgtgtgatgaacttt

SEQ ID NO: 870844 - DNA, 19 bp, Homo sapiens
ctgtgtgatgaactttctc

SEQ ID NO: 870845 - DNA, 14 bp, Homo sapiens
ctgtgtgattaaaa

SEQ ID NO: 870846 - DNA, 18 bp, Homo sapiens
ctgtgtgcaagtgtgtgc

SEQ ID NO: 870847 - DNA, 12 bp, Homo sapiens
ctgtgtgcccaa

SEQ ID NO: 870848 - DNA, 19 bp, Homo sapiens
ctgtgtgcccaagtgggca

SEQ ID NO: 870849 - DNA, 18 bp, Homo sapiens
ctgtgtgcctgggggagt

SEQ ID NO: 870850 - DNA, 19 bp, Homo sapiens
ctgtgtgcgtggcgtggcc

SEQ ID NO: 870851 - DNA, 14 bp, Homo sapiens
ctgtgtgctgtttg

SEQ ID NO: 870852 - DNA, 17 bp, Homo sapiens
ctgtgtggcagttaatt

SEQ ID NO: 870853 - DNA, 11 bp, Homo sapiens
ctgtgtggcca

SEQ ID NO: 870854 - DNA, 22 bp, Homo sapiens
ctgtgtggccaaccaggaccca

SEQ ID NO: 870855 - DNA, 15 bp, Homo sapiens
ctgtgtgggatactt

SEQ ID NO: 870856 - DNA, 18 bp, Homo sapiens
ctgtgtggtggagccagg

SEQ ID NO: 870857 - DNA, 21 bp, Homo sapiens
ctgtgtggtggagccagggcc

SEQ ID NO: 870858 - DNA, 14 bp, Homo sapiens
ctgtgtgtatattg

SEQ ID NO: 870859 - DNA, 16 bp, Homo sapiens
ctgtgtgtcagttttc

SEQ ID NO: 870860 - DNA, 21 bp, Homo sapiens
ctgtgtgtccaaaactgcctc

SEQ ID NO: 870861 - DNA, 22 bp, Homo sapiens
ctgtgtgtccaaaactgcctca

SEQ ID NO: 870862 - DNA, 15 bp, Homo sapiens
ctgtgtgtctgtcct

SEQ ID NO: 870863 - DNA, 18 bp, Homo sapiens
ctgtgtgtgagtgtgaat

SEQ ID NO: 870864 - DNA, 14 bp, Homo sapiens
ctgtgtgtgccctg

SEQ ID NO: 870865 - DNA, 12 bp, Homo sapiens
ctgtgtgtgtga

SEQ ID NO: 870866 - DNA, 18 bp, Homo sapiens
ctgtgtgtgtgaatgaac

SEQ ID NO: 870867 - DNA, 23 bp, Homo sapiens
ctgtgtgtgtgaatgaacactct

SEQ ID NO: 870868 - DNA, 21 bp, Homo sapiens
ctgtgtgtgtggcgtggcccg

SEQ ID NO: 870869 - DNA, 12 bp, Homo sapiens
ctgtgtgttagt

SEQ ID NO: 870870 - DNA, 16 bp, Homo sapiens
ctgtgtgttagttccc

SEQ ID NO: 870871 - DNA, 14 bp, Homo sapiens
ctgtgtgttgacac

SEQ ID NO: 870872 - DNA, 15 bp, Homo sapiens
ctgtgtgttgacact

SEQ ID NO: 870873 - DNA, 14 bp, Homo sapiens
ctgtgtgtttgaca

SEQ ID NO: 870874 - DNA, 15 bp, Homo sapiens
ctgtgttaagaggac

SEQ ID NO: 870875 - DNA, 15 bp, Homo sapiens
ctgtgttaattgcgt

SEQ ID NO: 870876 - DNA, 23 bp, Homo sapiens
ctgtgttaattgcgtagaggcta

SEQ ID NO: 870877 - DNA, 15 bp, Homo sapiens
ctgtgttacccaggc

SEQ ID NO: 870878 - DNA, 22 bp, Homo sapiens
ctgtgttactaaaaaaaagatg

SEQ ID NO: 870879 - DNA, 15 bp, Homo sapiens
ctgtgttactgcttt

SEQ ID NO: 870880 - DNA, 21 bp, Homo sapiens
ctgtgttaggatgcggctttc

SEQ ID NO: 870881 - DNA, 23 bp, Homo sapiens
ctgtgttaggatgcggctttctc

SEQ ID NO: 870882 - DNA, 18 bp, Homo sapiens
ctgtgttagtgtctgtcc

SEQ ID NO: 870883 - DNA, 20 bp, Homo sapiens
ctgtgttagtgtctgtccat

SEQ ID NO: 870884 - DNA, 17 bp, Homo sapiens
ctgtgttcaaaaatata

SEQ ID NO: 870885 - DNA, 16 bp, Homo sapiens
ctgtgttcaatattta

SEQ ID NO: 870886 - DNA, 22 bp, Homo sapiens
ctgtgttcaatatttagaaaat

SEQ ID NO: 870887 - DNA, 16 bp, Homo sapiens
ctgtgttcccagaggc

SEQ ID NO: 870888 - DNA, 12 bp, Homo sapiens
ctgtgttctggg

SEQ ID NO: 870889 - DNA, 18 bp, Homo sapiens
ctgtgttctgggctgggg

SEQ ID NO: 870890 - DNA, 14 bp, Homo sapiens
ctgtgttcttgctg

SEQ ID NO: 870891 - DNA, 20 bp, Homo sapiens
ctgtgttgactgctgctccc

SEQ ID NO: 870892 - DNA, 17 bp, Homo sapiens
ctgtgttgccaagctcc

SEQ ID NO: 870893 - DNA, 23 bp, Homo sapiens
ctgtgttgccacagtagaactgt

SEQ ID NO: 870894 - DNA, 20 bp, Homo sapiens
ctgtgttgcgtgtcgtgggt

SEQ ID NO: 870895 - DNA, 14 bp, Homo sapiens
ctgtgttgcttcaa

SEQ ID NO: 870896 - DNA, 18 bp, Homo sapiens
ctgtgttgtattaacaaa

SEQ ID NO: 870897 - DNA, 16 bp, Homo sapiens
ctgtgttgtcccatct

SEQ ID NO: 870898 - DNA, 19 bp, Homo sapiens
ctgtgttgtctctagagca

SEQ ID NO: 870899 - DNA, 22 bp, Homo sapiens
ctgtgttgtctctagagcaggg

SEQ ID NO: 870900 - DNA, 21 bp, Homo sapiens
ctgtgtttcgcattaagcaca

SEQ ID NO: 870901 - DNA, 23 bp, Homo sapiens
ctgtgtttcgcattaagcacaca

SEQ ID NO: 870902 - DNA, 17 bp, Homo sapiens
ctgtgtttgtcctgggt

SEQ ID NO: 870903 - DNA, 18 bp, Homo sapiens
ctgtgtttgtcctgggtt

SEQ ID NO: 870904 - DNA, 14 bp, Homo sapiens
ctgtgtttgttcct

SEQ ID NO: 870905 - DNA, 16 bp, Homo sapiens
ctgtgttttgaaagaa

SEQ ID NO: 870906 - DNA, 20 bp, Homo sapiens
ctgttaaaaaagaaatctgt

SEQ ID NO: 870907 - DNA, 18 bp, Homo sapiens
ctgttaaaatgtacactg

SEQ ID NO: 870908 - DNA, 13 bp, Homo sapiens
ctgttaaactgtt

SEQ ID NO: 870909 - DNA, 21 bp, Homo sapiens
ctgttaaactgttagcactgt

SEQ ID NO: 870910 - DNA, 11 bp, Homo sapiens
ctgttaaatac

SEQ ID NO: 870911 - DNA, 15 bp, Homo sapiens
ctgttaaatacagga

SEQ ID NO: 870912 - DNA, 22 bp, Homo sapiens
ctgttaacatctagcctaaagt

SEQ ID NO: 870913 - DNA, 14 bp, Homo sapiens
ctgttaactgaata

SEQ ID NO: 870914 - DNA, 17 bp, Homo sapiens
ctgttaactgaatacca

SEQ ID NO: 870915 - DNA, 22 bp, Homo sapiens
ctgttaactgaataccactctg

SEQ ID NO: 870916 - DNA, 15 bp, Homo sapiens
ctgttaacttattca

SEQ ID NO: 870917 - DNA, 19 bp, Homo sapiens
ctgttaacttattcaaaga

SEQ ID NO: 870918 - DNA, 14 bp, Homo sapiens
ctgttaagaaagga

SEQ ID NO: 870919 - DNA, 22 bp, Homo sapiens
ctgttaagaaaggatataaaag

SEQ ID NO: 870920 - DNA, 23 bp, Homo sapiens
ctgttaagaaaggatataaaagg

SEQ ID NO: 870921 - DNA, 20 bp, Homo sapiens
ctgttaatttataatgtatt

SEQ ID NO: 870922 - DNA, 15 bp, Homo sapiens
ctgttaatttatagg

SEQ ID NO: 870923 - DNA, 18 bp, Homo sapiens
ctgttaatttttatactg

SEQ ID NO: 870924 - DNA, 16 bp, Homo sapiens
ctgttacactggagga

SEQ ID NO: 870925 - DNA, 19 bp, Homo sapiens
ctgttacactttttggaag

SEQ ID NO: 870926 - DNA, 20 bp, Homo sapiens
ctgttacagtaatgtcataa

SEQ ID NO: 870927 - DNA, 15 bp, Homo sapiens
ctgttaccacattgg

SEQ ID NO: 870928 - DNA, 15 bp, Homo sapiens
ctgttaccatgtcac

SEQ ID NO: 870929 - DNA, 18 bp, Homo sapiens
ctgttaccatgtcactgt

SEQ ID NO: 870930 - DNA, 17 bp, Homo sapiens
ctgttactgcttctctt

SEQ ID NO: 870931 - DNA, 18 bp, Homo sapiens
ctgttacttgcttcagtg

SEQ ID NO: 870932 - DNA, 23 bp, Homo sapiens
ctgttactttctttcagatgttt

SEQ ID NO: 870933 - DNA, 14 bp, Homo sapiens
ctgttagatgctga

SEQ ID NO: 870934 - DNA, 15 bp, Homo sapiens
ctgttagatgctgaa

SEQ ID NO: 870935 - DNA, 14 bp, Homo sapiens
ctgttagcactgtt

SEQ ID NO: 870936 - DNA, 18 bp, Homo sapiens
ctgttagcactgttgatg

SEQ ID NO: 870937 - DNA, 15 bp, Homo sapiens
ctgttagggccttgg

SEQ ID NO: 870938 - DNA, 13 bp, Homo sapiens
ctgttagtcattt

SEQ ID NO: 870939 - DNA, 18 bp, Homo sapiens
ctgttagtcatttgctga

SEQ ID NO: 870940 - DNA, 16 bp, Homo sapiens
ctgttagtctccccac

SEQ ID NO: 870941 - DNA, 14 bp, Homo sapiens
ctgttataactctg

SEQ ID NO: 870942 - DNA, 23 bp, Homo sapiens
ctgttatcaaacaccaacataaa

SEQ ID NO: 870943 - DNA, 19 bp, Homo sapiens
ctgttatgatttccttcaa

SEQ ID NO: 870944 - DNA, 20 bp, Homo sapiens
ctgttatgatttccttcaat

SEQ ID NO: 870945 - DNA, 21 bp, Homo sapiens
ctgttatgcactgtggtttca

SEQ ID NO: 870946 - DNA, 19 bp, Homo sapiens
ctgttatgctgtgacacat

SEQ ID NO: 870947 - DNA, 14 bp, Homo sapiens
ctgttatttagact

SEQ ID NO: 870948 - DNA, 16 bp, Homo sapiens
ctgttatttagactca

SEQ ID NO: 870949 - DNA, 19 bp, Homo sapiens
ctgttatttattattaatt

SEQ ID NO: 870950 - DNA, 22 bp, Homo sapiens
ctgttcaaacccagtcttgtgg

SEQ ID NO: 870951 - DNA, 16 bp, Homo sapiens
ctgttcaaagctgcct

SEQ ID NO: 870952 - DNA, 12 bp, Homo sapiens
ctgttcaatact

SEQ ID NO: 870953 - DNA, 14 bp, Homo sapiens
ctgttcacccacag

SEQ ID NO: 870954 - DNA, 18 bp, Homo sapiens
ctgttcacccacagggct

SEQ ID NO: 870955 - DNA, 16 bp, Homo sapiens
ctgttcacggtgacac

SEQ ID NO: 870956 - DNA, 18 bp, Homo sapiens
ctgttcacggtgacacag

SEQ ID NO: 870957 - DNA, 23 bp, Homo sapiens
ctgttcacggtgacacaggtcag

SEQ ID NO: 870958 - DNA, 15 bp, Homo sapiens
ctgttcactcactct

SEQ ID NO: 870959 - DNA, 17 bp, Homo sapiens
ctgttcacttttcctcc

SEQ ID NO: 870960 - DNA, 15 bp, Homo sapiens
ctgttcagcaaacta

SEQ ID NO: 870961 - DNA, 12 bp, Homo sapiens
ctgttcagctgg

SEQ ID NO: 870962 - DNA, 14 bp, Homo sapiens
ctgttcagtactct

SEQ ID NO: 870963 - DNA, 12 bp, Homo sapiens
ctgttcagtgag

SEQ ID NO: 870964 - DNA, 14 bp, Homo sapiens
ctgttcagtgcttt

SEQ ID NO: 870965 - DNA, 20 bp, Homo sapiens
ctgttcagtgctttttcctt

SEQ ID NO: 870966 - DNA, 19 bp, Homo sapiens
ctgttcatcaccagtctgt

SEQ ID NO: 870967 - DNA, 16 bp, Homo sapiens
ctgttcatgctccaag

SEQ ID NO: 870968 - DNA, 17 bp, Homo sapiens
ctgttcatgctccaaga

SEQ ID NO: 870969 - DNA, 18 bp, Homo sapiens
ctgttccaatgaaaaaat

SEQ ID NO: 870970 - DNA, 13 bp, Homo sapiens
ctgttccagactc

SEQ ID NO: 870971 - DNA, 18 bp, Homo sapiens
ctgttcccaaattttcta

SEQ ID NO: 870972 - DNA, 16 bp, Homo sapiens
ctgttcccaaggaagc

SEQ ID NO: 870973 - DNA, 17 bp, Homo sapiens
ctgttcccacctgctgg

SEQ ID NO: 870974 - DNA, 16 bp, Homo sapiens
ctgttccccctgtgca

SEQ ID NO: 870975 - DNA, 15 bp, Homo sapiens
ctgttcccccttcac

SEQ ID NO: 870976 - DNA, 16 bp, Homo sapiens
ctgttcccccttcaca

SEQ ID NO: 870977 - DNA, 23 bp, Homo sapiens
ctgttcccccttcacaaagccca

SEQ ID NO: 870978 - DNA, 12 bp, Homo sapiens
ctgttcccctca

SEQ ID NO: 870979 - DNA, 22 bp, Homo sapiens
ctgttcccctcactggatgaaa

SEQ ID NO: 870980 - DNA, 15 bp, Homo sapiens
ctgttcccctctccc

SEQ ID NO: 870981 - DNA, 18 bp, Homo sapiens
ctgttcccctctcccttc

SEQ ID NO: 870982 - DNA, 14 bp, Homo sapiens
ctgttccctcctgg

SEQ ID NO: 870983 - DNA, 15 bp, Homo sapiens
ctgttccctcctggt

SEQ ID NO: 870984 - DNA, 20 bp, Homo sapiens
ctgttccctcctggtcctgg

SEQ ID NO: 870985 - DNA, 14 bp, Homo sapiens
ctgttccctctgct

SEQ ID NO: 870986 - DNA, 11 bp, Homo sapiens
ctgttccctgg

SEQ ID NO: 870987 - DNA, 19 bp, Homo sapiens
ctgttccctggagtcaggg

SEQ ID NO: 870988 - DNA, 12 bp, Homo sapiens
ctgttccctggg

SEQ ID NO: 870989 - DNA, 13 bp, Homo sapiens
ctgttcccttgca

SEQ ID NO: 870990 - DNA, 11 bp, Homo sapiens
ctgttcccttt

SEQ ID NO: 870991 - DNA, 16 bp, Homo sapiens
ctgttccctttgcctt

SEQ ID NO: 870992 - DNA, 15 bp, Homo sapiens
ctgttcctcccccat

SEQ ID NO: 870993 - DNA, 12 bp, Homo sapiens
ctgttcctgtgt

SEQ ID NO: 870994 - DNA, 16 bp, Homo sapiens
ctgttccttagacctt

SEQ ID NO: 870995 - DNA, 12 bp, Homo sapiens
ctgttcctttta

SEQ ID NO: 870996 - DNA, 21 bp, Homo sapiens
ctgttccttttctctcctgtg

SEQ ID NO: 870997 - DNA, 18 bp, Homo sapiens
ctgttcggaaggggttcc

SEQ ID NO: 870998 - DNA, 23 bp, Homo sapiens
ctgttcggaaggggttcctcaaa

SEQ ID NO: 870999 - DNA, 16 bp, Homo sapiens
ctgttctaacatgtaa

SEQ ID NO: 871000 - DNA, 20 bp, Homo sapiens
ctgttctacatagatgctta

SEQ ID NO: 871001 - DNA, 18 bp, Homo sapiens
ctgttctatcccacccaa

SEQ ID NO: 871002 - DNA, 16 bp, Homo sapiens
ctgttctatgccttta

SEQ ID NO: 871003 - DNA, 20 bp, Homo sapiens
ctgttctatgcctttagtca

SEQ ID NO: 871004 - DNA, 14 bp, Homo sapiens
ctgttctccctttc

SEQ ID NO: 871005 - DNA, 17 bp, Homo sapiens
ctgttctccctttctct

SEQ ID NO: 871006 - DNA, 18 bp, Homo sapiens
ctgttctccctttctctc

SEQ ID NO: 871007 - DNA, 20 bp, Homo sapiens
ctgttctccctttctctctc

SEQ ID NO: 871008 - DNA, 22 bp, Homo sapiens
ctgttctccctttctctctcct

SEQ ID NO: 871009 - DNA, 13 bp, Homo sapiens
ctgttctctgctg

SEQ ID NO: 871010 - DNA, 18 bp, Homo sapiens
ctgttctgaaatgttctt

SEQ ID NO: 871011 - DNA, 15 bp, Homo sapiens
ctgttctgatttact

SEQ ID NO: 871012 - DNA, 13 bp, Homo sapiens
ctgttctggggga

SEQ ID NO: 871013 - DNA, 20 bp, Homo sapiens
ctgttctgggggacagagaa

SEQ ID NO: 871014 - DNA, 24 bp, Homo sapiens
ctgttctggtatttcccctgtcag

SEQ ID NO: 871015 - DNA, 14 bp, Homo sapiens
ctgttctgtagctt

SEQ ID NO: 871016 - DNA, 18 bp, Homo sapiens
ctgttctgtagctttctg

SEQ ID NO: 871017 - DNA, 11 bp, Homo sapiens
ctgttctgtgt

SEQ ID NO: 871018 - DNA, 17 bp, Homo sapiens
ctgttctgtttggcact

SEQ ID NO: 871019 - DNA, 21 bp, Homo sapiens
ctgttctgtttggcacttgta

SEQ ID NO: 871020 - DNA, 17 bp, Homo sapiens
ctgttctgttttgcctg

SEQ ID NO: 871021 - DNA, 16 bp, Homo sapiens
ctgttcttacaaatgt

SEQ ID NO: 871022 - DNA, 23 bp, Homo sapiens
ctgttcttagagtgtagctgtaa

SEQ ID NO: 871023 - DNA, 14 bp, Homo sapiens
ctgttcttcctcca

SEQ ID NO: 871024 - DNA, 13 bp, Homo sapiens
ctgttcttccttc

SEQ ID NO: 871025 - DNA, 18 bp, Homo sapiens
ctgttcttgaagctgggc

SEQ ID NO: 871026 - DNA, 19 bp, Homo sapiens
ctgttcttggcttggaaga

SEQ ID NO: 871027 - DNA, 15 bp, Homo sapiens
ctgttcttggggccc

SEQ ID NO: 871028 - DNA, 12 bp, Homo sapiens
ctgttctttacc

SEQ ID NO: 871029 - DNA, 15 bp, Homo sapiens
ctgttctttccaaag

SEQ ID NO: 871030 - DNA, 19 bp, Homo sapiens
ctgttctttccaaagtaca

SEQ ID NO: 871031 - DNA, 13 bp, Homo sapiens
ctgttctttctgg

SEQ ID NO: 871032 - DNA, 14 bp, Homo sapiens
ctgttctttctggc

SEQ ID NO: 871033 - DNA, 21 bp, Homo sapiens
ctgttctttctggctatgcat

SEQ ID NO: 871034 - DNA, 12 bp, Homo sapiens
ctgttgaaaatt

SEQ ID NO: 871035 - DNA, 14 bp, Homo sapiens
ctgttgaaaattat

SEQ ID NO: 871036 - DNA, 20 bp, Homo sapiens
ctgttgaaacacacgtgctg

SEQ ID NO: 871037 - DNA, 17 bp, Homo sapiens
ctgttgaagacttcctc

SEQ ID NO: 871038 - DNA, 22 bp, Homo sapiens
ctgttgacacaggtctttccta

SEQ ID NO: 871039 - DNA, 21 bp, Homo sapiens
ctgttgacatatttaatgttt

SEQ ID NO: 871040 - DNA, 18 bp, Homo sapiens
ctgttgacatcagcctgc

SEQ ID NO: 871041 - DNA, 20 bp, Homo sapiens
ctgttgagccccagtgctgg

SEQ ID NO: 871042 - DNA, 18 bp, Homo sapiens
ctgttgagggccactttt

SEQ ID NO: 871043 - DNA, 17 bp, Homo sapiens
ctgttgaggtggctgta

SEQ ID NO: 871044 - DNA, 14 bp, Homo sapiens
ctgttgaggtgggt

SEQ ID NO: 871045 - DNA, 22 bp, Homo sapiens
ctgttgaggtgggtgggcctga

SEQ ID NO: 871046 - DNA, 13 bp, Homo sapiens
ctgttgatacaaa

SEQ ID NO: 871047 - DNA, 15 bp, Homo sapiens
ctgttgatacaaacc

SEQ ID NO: 871048 - DNA, 23 bp, Homo sapiens
ctgttgatctacccgtgcctggg

SEQ ID NO: 871049 - DNA, 17 bp, Homo sapiens
ctgttgatgaggcctct

SEQ ID NO: 871050 - DNA, 21 bp, Homo sapiens
ctgttgatgaggcctcttgga

SEQ ID NO: 871051 - DNA, 15 bp, Homo sapiens
ctgttgatgggaaaa

SEQ ID NO: 871052 - DNA, 22 bp, Homo sapiens
ctgttgatgtatctgagttgcc

SEQ ID NO: 871053 - DNA, 21 bp, Homo sapiens
ctgttgattaatttctgccat

SEQ ID NO: 871054 - DNA, 15 bp, Homo sapiens
ctgttgattgcagga

SEQ ID NO: 871055 - DNA, 20 bp, Homo sapiens
ctgttgatttctttccagag

SEQ ID NO: 871056 - DNA, 13 bp, Homo sapiens
ctgttgccacaac

SEQ ID NO: 871057 - DNA, 13 bp, Homo sapiens
ctgttgcccccca

SEQ ID NO: 871058 - DNA, 18 bp, Homo sapiens
ctgttgccttatttctca

SEQ ID NO: 871059 - DNA, 21 bp, Homo sapiens
ctgttgcgacgcgggcttctg

SEQ ID NO: 871060 - DNA, 18 bp, Homo sapiens
ctgttgcgctcccgcatt

SEQ ID NO: 871061 - DNA, 18 bp, Homo sapiens
ctgttgctatagagccta

SEQ ID NO: 871062 - DNA, 16 bp, Homo sapiens
ctgttgctgaagtcat

SEQ ID NO: 871063 - DNA, 14 bp, Homo sapiens
ctgttgctttacag

SEQ ID NO: 871064 - DNA, 17 bp, Homo sapiens
ctgttgctttcttcctg

SEQ ID NO: 871065 - DNA, 18 bp, Homo sapiens
ctgttggacagctgcttg

SEQ ID NO: 871066 - DNA, 14 bp, Homo sapiens
ctgttggagcaaac

SEQ ID NO: 871067 - DNA, 14 bp, Homo sapiens
ctgttggaggaccc

SEQ ID NO: 871068 - DNA, 15 bp, Homo sapiens
ctgttggaggacccc

SEQ ID NO: 871069 - DNA, 21 bp, Homo sapiens
ctgttggaggaccccgagggc

SEQ ID NO: 871070 - DNA, 23 bp, Homo sapiens
ctgttggaggaccccgagggctg

SEQ ID NO: 871071 - DNA, 17 bp, Homo sapiens
ctgttggcaggcccact

SEQ ID NO: 871072 - DNA, 17 bp, Homo sapiens
ctgttggcctgtgggcc

SEQ ID NO: 871073 - DNA, 20 bp, Homo sapiens
ctgttggcctgtgggcctca

SEQ ID NO: 871074 - DNA, 23 bp, Homo sapiens
ctgttggcctgtgggcctcacct

SEQ ID NO: 871075 - DNA, 17 bp, Homo sapiens
ctgttgggaacagcatg

SEQ ID NO: 871076 - DNA, 12 bp, Homo sapiens
ctgttgggctga

SEQ ID NO: 871077 - DNA, 18 bp, Homo sapiens
ctgttgggtttttgctgt

SEQ ID NO: 871078 - DNA, 18 bp, Homo sapiens
ctgttggtcctctctctg

SEQ ID NO: 871079 - DNA, 15 bp, Homo sapiens
ctgttggttcaaact

SEQ ID NO: 871080 - DNA, 20 bp, Homo sapiens
ctgttgtaagtaataatttg

SEQ ID NO: 871081 - DNA, 12 bp, Homo sapiens
ctgttgtaatag

SEQ ID NO: 871082 - DNA, 16 bp, Homo sapiens
ctgttgtacacagtct

SEQ ID NO: 871083 - DNA, 15 bp, Homo sapiens
ctgttgtcattgctg

SEQ ID NO: 871084 - DNA, 18 bp, Homo sapiens
ctgttgtgagctttgaag

SEQ ID NO: 871085 - DNA, 20 bp, Homo sapiens
ctgttgttccattttatgca

SEQ ID NO: 871086 - DNA, 22 bp, Homo sapiens
ctgttgttgttaatgaaaatgt

SEQ ID NO: 871087 - DNA, 23 bp, Homo sapiens
ctgttgttgttaatgaaaatgtc

SEQ ID NO: 871088 - DNA, 19 bp, Homo sapiens
ctgtttaaagtcacatccc

SEQ ID NO: 871089 - DNA, 15 bp, Homo sapiens
ctgtttacaagaaaa

SEQ ID NO: 871090 - DNA, 18 bp, Homo sapiens
ctgtttacaagaaaaaat

SEQ ID NO: 871091 - DNA, 15 bp, Homo sapiens
ctgtttacctggcag

SEQ ID NO: 871092 - DNA, 18 bp, Homo sapiens
ctgtttacctggcagtgg

SEQ ID NO: 871093 - DNA, 18 bp, Homo sapiens
ctgtttactgattagagt

SEQ ID NO: 871094 - DNA, 13 bp, Homo sapiens
ctgtttactgctt

SEQ ID NO: 871095 - DNA, 15 bp, Homo sapiens
ctgtttactggttct

SEQ ID NO: 871096 - DNA, 14 bp, Homo sapiens
ctgtttagaacaca

SEQ ID NO: 871097 - DNA, 17 bp, Homo sapiens
ctgtttagcagcagcct

SEQ ID NO: 871098 - DNA, 21 bp, Homo sapiens
ctgtttagcttcctccagagg

SEQ ID NO: 871099 - DNA, 19 bp, Homo sapiens
ctgtttaggttcccctgtc

SEQ ID NO: 871100 - DNA, 17 bp, Homo sapiens
ctgtttagtagcagtga

SEQ ID NO: 871101 - DNA, 19 bp, Homo sapiens
ctgtttataatctgaagat

SEQ ID NO: 871102 - DNA, 19 bp, Homo sapiens
ctgtttatatattgaaagt

SEQ ID NO: 871103 - DNA, 17 bp, Homo sapiens
ctgtttatggcctcagc

SEQ ID NO: 871104 - DNA, 18 bp, Homo sapiens
ctgtttatggcctcagct

SEQ ID NO: 871105 - DNA, 14 bp, Homo sapiens
ctgtttattaatct

SEQ ID NO: 871106 - DNA, 13 bp, Homo sapiens
ctgtttattactt

SEQ ID NO: 871107 - DNA, 19 bp, Homo sapiens
ctgtttattacttccatga

SEQ ID NO: 871108 - DNA, 21 bp, Homo sapiens
ctgtttattacttccatgaat

SEQ ID NO: 871109 - DNA, 15 bp, Homo sapiens
ctgtttattcccatc

SEQ ID NO: 871110 - DNA, 22 bp, Homo sapiens
ctgtttattcttccagaatgct

SEQ ID NO: 871111 - DNA, 18 bp, Homo sapiens
ctgtttattttttttggc

SEQ ID NO: 871112 - DNA, 22 bp, Homo sapiens
ctgtttattttttttggcctgt

SEQ ID NO: 871113 - DNA, 20 bp, Homo sapiens
ctgtttcactgaaatgtttg

SEQ ID NO: 871114 - DNA, 22 bp, Homo sapiens
ctgtttcactgaaatgtttgga

SEQ ID NO: 871115 - DNA, 16 bp, Homo sapiens
ctgtttcacttgctct

SEQ ID NO: 871116 - DNA, 13 bp, Homo sapiens
ctgtttcagaccc

SEQ ID NO: 871117 - DNA, 21 bp, Homo sapiens
ctgtttcagctaaatgcaggg

SEQ ID NO: 871118 - DNA, 18 bp, Homo sapiens
ctgtttcattcactgtgc

SEQ ID NO: 871119 - DNA, 15 bp, Homo sapiens
ctgtttccaaatccc

SEQ ID NO: 871120 - DNA, 14 bp, Homo sapiens
ctgtttcctcttga

SEQ ID NO: 871121 - DNA, 14 bp, Homo sapiens
ctgtttcctgaaat

SEQ ID NO: 871122 - DNA, 15 bp, Homo sapiens
ctgtttcctgaaata

SEQ ID NO: 871123 - DNA, 16 bp, Homo sapiens
ctgtttcctgaaatat

SEQ ID NO: 871124 - DNA, 20 bp, Homo sapiens
ctgtttcctgacattgtctc

SEQ ID NO: 871125 - DNA, 16 bp, Homo sapiens
ctgtttcctgggcacg

SEQ ID NO: 871126 - DNA, 11 bp, Homo sapiens
ctgtttctaag

SEQ ID NO: 871127 - DNA, 17 bp, Homo sapiens
ctgtaactgagagaaag

SEQ ID NO: 871128 - DNA, 19 bp, Homo sapiens
ctgtaactgcccagcccct

SEQ ID NO: 871129 - DNA, 19 bp, Homo sapiens
ctgtaactgctgagccact

SEQ ID NO: 871130 - DNA, 16 bp, Homo sapiens
ctgtaacttaaaatag

SEQ ID NO: 871131 - DNA, 19 bp, Homo sapiens
ctgtaacttccaaataaat

SEQ ID NO: 871132 - DNA, 17 bp, Homo sapiens
ctgtaagaagagactgg

SEQ ID NO: 871133 - DNA, 16 bp, Homo sapiens
ctgtaagaagagccat

SEQ ID NO: 871134 - DNA, 13 bp, Homo sapiens
ctgtaagagcttg

SEQ ID NO: 871135 - DNA, 19 bp, Homo sapiens
ctgtaagatgttgttttag

SEQ ID NO: 871136 - DNA, 13 bp, Homo sapiens
ctgtaagcctgca

SEQ ID NO: 871137 - DNA, 16 bp, Homo sapiens
ctgtaagcctgcaagc

SEQ ID NO: 871138 - DNA, 17 bp, Homo sapiens
ctgtaagcctgcaagcc

SEQ ID NO: 871139 - DNA, 18 bp, Homo sapiens
ctgtaagcctgcaagcct

SEQ ID NO: 871140 - DNA, 23 bp, Homo sapiens
ctgtaagcttttaagaaaaacaa

SEQ ID NO: 871141 - DNA, 12 bp, Homo sapiens
ctgtaagggcag

SEQ ID NO: 871142 - DNA, 19 bp, Homo sapiens
ctgtaagtaattgccacag

SEQ ID NO: 871143 - DNA, 17 bp, Homo sapiens
ctgtaagtgtagctcaa

SEQ ID NO: 871144 - DNA, 14 bp, Homo sapiens
ctgtaagtttattt

SEQ ID NO: 871145 - DNA, 21 bp, Homo sapiens
ctgtaagtttattttttctac

SEQ ID NO: 871146 - DNA, 22 bp, Homo sapiens
ctgtaagtttattttttctaca

SEQ ID NO: 871147 - DNA, 12 bp, Homo sapiens
ctgtaataatag

SEQ ID NO: 871148 - DNA, 14 bp, Homo sapiens
ctgtaatattgtaa

SEQ ID NO: 871149 - DNA, 13 bp, Homo sapiens
ctgtaatatttac

SEQ ID NO: 871150 - DNA, 14 bp, Homo sapiens
ctgtaatatttaca

SEQ ID NO: 871151 - DNA, 21 bp, Homo sapiens
ctgtaatatttacaatgtatt

SEQ ID NO: 871152 - DNA, 18 bp, Homo sapiens
ctgtaatcagctctcctg

SEQ ID NO: 871153 - DNA, 19 bp, Homo sapiens
ctgtaatcatataataaat

SEQ ID NO: 871154 - DNA, 14 bp, Homo sapiens
ctgtaatcccagca

SEQ ID NO: 871155 - DNA, 16 bp, Homo sapiens
ctgtaatcccagcact

SEQ ID NO: 871156 - DNA, 19 bp, Homo sapiens
ctgtaatcccagctactcg

SEQ ID NO: 871157 - DNA, 19 bp, Homo sapiens
ctgtaatcctagcactttg

SEQ ID NO: 871158 - DNA, 17 bp, Homo sapiens
ctgtaatcttgttgata

SEQ ID NO: 871159 - DNA, 20 bp, Homo sapiens
ctgtaatctttttctccacc

SEQ ID NO: 871160 - DNA, 19 bp, Homo sapiens
ctgtaatgagtcagtgaag

SEQ ID NO: 871161 - DNA, 21 bp, Homo sapiens
ctgtaatgtaggcacttttat

SEQ ID NO: 871162 - DNA, 15 bp, Homo sapiens
ctgtaattacatatt

SEQ ID NO: 871163 - DNA, 20 bp, Homo sapiens
ctgtaattacatatttgact

SEQ ID NO: 871164 - DNA, 15 bp, Homo sapiens
ctgtaattcaggttt

SEQ ID NO: 871165 - DNA, 18 bp, Homo sapiens
ctgtaattgaatattatt

SEQ ID NO: 871166 - DNA, 14 bp, Homo sapiens
ctgtaattgcaaaa

SEQ ID NO: 871167 - DNA, 16 bp, Homo sapiens
ctgtaattgtgtgtga

SEQ ID NO: 871168 - DNA, 18 bp, Homo sapiens
ctgtaatttgtgatacaa

SEQ ID NO: 871169 - DNA, 15 bp, Homo sapiens
ctgtacaaatataag

SEQ ID NO: 871170 - DNA, 17 bp, Homo sapiens
ctgtacaaatataagaa

SEQ ID NO: 871171 - DNA, 16 bp, Homo sapiens
ctgtacacaactcact

SEQ ID NO: 871172 - DNA, 22 bp, Homo sapiens
ctgtacacaactcactcctttt

SEQ ID NO: 871173 - DNA, 18 bp, Homo sapiens
ctgtacacacccgcctga

SEQ ID NO: 871174 - DNA, 23 bp, Homo sapiens
ctgtacacattcctgcattcatg

SEQ ID NO: 871175 - DNA, 14 bp, Homo sapiens
ctgtacagagactc

SEQ ID NO: 871176 - DNA, 18 bp, Homo sapiens
ctgtacagagactctatt

SEQ ID NO: 871177 - DNA, 19 bp, Homo sapiens
ctgtacagatcaagaaaaa

SEQ ID NO: 871178 - DNA, 13 bp, Homo sapiens
ctgtacaggaaaa

SEQ ID NO: 871179 - DNA, 19 bp, Homo sapiens
ctgtacaggaaggtgcctg

SEQ ID NO: 871180 - DNA, 11 bp, Homo sapiens
ctgtacagtgt

SEQ ID NO: 871181 - DNA, 13 bp, Homo sapiens
ctgtacagtgtta

SEQ ID NO: 871182 - DNA, 19 bp, Homo sapiens
ctgtacataaattccagag

SEQ ID NO: 871183 - DNA, 13 bp, Homo sapiens
ctgtacatactgg

SEQ ID NO: 871184 - DNA, 14 bp, Homo sapiens
ctgtacatactggc

SEQ ID NO: 871185 - DNA, 16 bp, Homo sapiens
ctgtacatactggcct

SEQ ID NO: 871186 - DNA, 21 bp, Homo sapiens
ctgtacatactggcctctgtg

SEQ ID NO: 871187 - DNA, 23 bp, Homo sapiens
ctgtacatactggcctctgtgat

SEQ ID NO: 871188 - DNA, 23 bp, Homo sapiens
ctgtacatgaaaacacatttttc

SEQ ID NO: 871189 - DNA, 20 bp, Homo sapiens
ctgtacattgtgagctctgg

SEQ ID NO: 871190 - DNA, 21 bp, Homo sapiens
ctgtacattgtgagctctggt

SEQ ID NO: 871191 - DNA, 14 bp, Homo sapiens
ctgtacatttaaaa

SEQ ID NO: 871192 - DNA, 21 bp, Homo sapiens
ctgtacattttttttcaagtg

SEQ ID NO: 871193 - DNA, 16 bp, Homo sapiens
ctgtaccacagacaca

SEQ ID NO: 871194 - DNA, 13 bp, Homo sapiens
ctgtaccacatct

SEQ ID NO: 871195 - DNA, 18 bp, Homo sapiens
ctgtaccacatctgctct

SEQ ID NO: 871196 - DNA, 19 bp, Homo sapiens
ctgtaccagcccagatgtt

SEQ ID NO: 871197 - DNA, 17 bp, Homo sapiens
ctgtacccaccccagca

SEQ ID NO: 871198 - DNA, 23 bp, Homo sapiens
ctgtacccaccccagcacagcca

SEQ ID NO: 871199 - DNA, 15 bp, Homo sapiens
ctgtacccagctcct

SEQ ID NO: 871200 - DNA, 23 bp, Homo sapiens
ctgtacccagctccttttgtccc

SEQ ID NO: 871201 - DNA, 23 bp, Homo sapiens
ctgtaccctcgcatgactgttac

SEQ ID NO: 871202 - DNA, 21 bp, Homo sapiens
ctgtacccttccacctcctag

SEQ ID NO: 871203 - DNA, 22 bp, Homo sapiens
ctgtaccgtcgacaagaatgtc

SEQ ID NO: 871204 - DNA, 14 bp, Homo sapiens
ctgtacctcagtgg

SEQ ID NO: 871205 - DNA, 15 bp, Homo sapiens
ctgtacctcagtgga

SEQ ID NO: 871206 - DNA, 21 bp, Homo sapiens
ctgtacctcttgagccttgaa

SEQ ID NO: 871207 - DNA, 17 bp, Homo sapiens
ctgtacctgttcctccc

SEQ ID NO: 871208 - DNA, 21 bp, Homo sapiens
ctgtacctgttccttagacct

SEQ ID NO: 871209 - DNA, 13 bp, Homo sapiens
ctgtacgaaaaag

SEQ ID NO: 871210 - DNA, 14 bp, Homo sapiens
ctgtacgaaaaaga

SEQ ID NO: 871211 - DNA, 22 bp, Homo sapiens
ctgtactagcttttgaaatcca

SEQ ID NO: 871212 - DNA, 21 bp, Homo sapiens
ctgtactataagtagttggtt

SEQ ID NO: 871213 - DNA, 23 bp, Homo sapiens
ctgtactatcctgtaaatatatc

SEQ ID NO: 871214 - DNA, 14 bp, Homo sapiens
ctgtactcagagca

SEQ ID NO: 871215 - DNA, 19 bp, Homo sapiens
ctgtactcagagcagagca

SEQ ID NO: 871216 - DNA, 20 bp, Homo sapiens
ctgtactcaggaggctgagg

SEQ ID NO: 871217 - DNA, 16 bp, Homo sapiens
ctgtactcttgctgat

SEQ ID NO: 871218 - DNA, 13 bp, Homo sapiens
ctgtactgcatgt

SEQ ID NO: 871219 - DNA, 18 bp, Homo sapiens
ctgtactgcatgtgactt

SEQ ID NO: 871220 - DNA, 16 bp, Homo sapiens
ctgtactggccagtgt

SEQ ID NO: 871221 - DNA, 13 bp, Homo sapiens
ctgtacttaataa

SEQ ID NO: 871222 - DNA, 15 bp, Homo sapiens
ctgtacttcaagtta

SEQ ID NO: 871223 - DNA, 20 bp, Homo sapiens
ctgtacttcagtatgtgtca

SEQ ID NO: 871224 - DNA, 16 bp, Homo sapiens
ctgtacttcttgaata

SEQ ID NO: 871225 - DNA, 22 bp, Homo sapiens
ctgtacttgaagtctaaaagca

SEQ ID NO: 871226 - DNA, 24 bp, Homo sapiens
ctgtacttgtcctcagcttgggct

SEQ ID NO: 871227 - DNA, 12 bp, Homo sapiens
ctgtttctaaga

SEQ ID NO: 871228 - DNA, 15 bp, Homo sapiens
ctgtttctaagaaaa

SEQ ID NO: 871229 - DNA, 13 bp, Homo sapiens
ctgtttctcaagt

SEQ ID NO: 871230 - DNA, 14 bp, Homo sapiens
ctgtttctcatgaa

SEQ ID NO: 871231 - DNA, 17 bp, Homo sapiens
ctgtttctcatgaagct

SEQ ID NO: 871232 - DNA, 21 bp, Homo sapiens
ctgtttctctgccgctacctc

SEQ ID NO: 871233 - DNA, 17 bp, Homo sapiens
ctgtttctcttgagctg

SEQ ID NO: 871234 - DNA, 21 bp, Homo sapiens
ctgtttctcttgagctggcct

SEQ ID NO: 871235 - DNA, 16 bp, Homo sapiens
ctgtttctctttcctt

SEQ ID NO: 871236 - DNA, 17 bp, Homo sapiens
ctgtttctgcttgctct

SEQ ID NO: 871237 - DNA, 20 bp, Homo sapiens
ctgtttctggaagactgctc

SEQ ID NO: 871238 - DNA, 15 bp, Homo sapiens
ctgtttctgtagaaa

SEQ ID NO: 871239 - DNA, 15 bp, Homo sapiens
ctgtttcttcttgtg

SEQ ID NO: 871240 - DNA, 23 bp, Homo sapiens
ctgtttcttgctctctctccctg

SEQ ID NO: 871241 - DNA, 15 bp, Homo sapiens
ctgtttgacacctct

SEQ ID NO: 871242 - DNA, 23 bp, Homo sapiens
ctgtttgacacctcttttttcgt

SEQ ID NO: 871243 - DNA, 23 bp, Homo sapiens
ctgtttgatataccaaattaaaa

SEQ ID NO: 871244 - DNA, 20 bp, Homo sapiens
ctgtttgatgctatttatgc

SEQ ID NO: 871245 - DNA, 23 bp, Homo sapiens
ctgtttgatgctatttatgcaag

SEQ ID NO: 871246 - DNA, 11 bp, Homo sapiens
ctgtttgatgt

SEQ ID NO: 871247 - DNA, 17 bp, Homo sapiens
ctgtttgatgtatgtgt

SEQ ID NO: 871248 - DNA, 18 bp, Homo sapiens
ctgtttgatgtatgtgtg

SEQ ID NO: 871249 - DNA, 19 bp, Homo sapiens
ctgtttgatgtatgtgtga

SEQ ID NO: 871250 - DNA, 18 bp, Homo sapiens
ctgtttgcatttgataca

SEQ ID NO: 871251 - DNA, 17 bp, Homo sapiens
ctgtttgccaagctgaa

SEQ ID NO: 871252 - DNA, 18 bp, Homo sapiens
ctgtttgccaagctgaag

SEQ ID NO: 871253 - DNA, 12 bp, Homo sapiens
ctgtttggactg

SEQ ID NO: 871254 - DNA, 15 bp, Homo sapiens
ctgtttggcacttgt

SEQ ID NO: 871255 - DNA, 17 bp, Homo sapiens
ctgtttggcacttgtat

SEQ ID NO: 871256 - DNA, 20 bp, Homo sapiens
ctgtttggcacttgtattta

SEQ ID NO: 871257 - DNA, 22 bp, Homo sapiens
ctgtttggcctttcttggggag

SEQ ID NO: 871258 - DNA, 22 bp, Homo sapiens
ctgtttgggagactgtgctctc

SEQ ID NO: 871259 - DNA, 18 bp, Homo sapiens
ctgtttggtcgagtcttt

SEQ ID NO: 871260 - DNA, 16 bp, Homo sapiens
ctgtttggtggggtgg

SEQ ID NO: 871261 - DNA, 14 bp, Homo sapiens
ctgtttgtaaatta

SEQ ID NO: 871262 - DNA, 15 bp, Homo sapiens
ctgtttgtaaattat

SEQ ID NO: 871263 - DNA, 14 bp, Homo sapiens
ctgtttgtatattt

SEQ ID NO: 871264 - DNA, 15 bp, Homo sapiens
ctgtttgtatatttg

SEQ ID NO: 871265 - DNA, 15 bp, Homo sapiens
ctgtttgtatgaaat

SEQ ID NO: 871266 - DNA, 16 bp, Homo sapiens
ctgtttgtcctgagat

SEQ ID NO: 871267 - DNA, 12 bp, Homo sapiens
ctgtttgttatg

SEQ ID NO: 871268 - DNA, 23 bp, Homo sapiens
ctgtttgttgagtgcactgactg

SEQ ID NO: 871269 - DNA, 24 bp, Homo sapiens
ctgtttgttgagtgcactgactgt

SEQ ID NO: 871270 - DNA, 15 bp, Homo sapiens
ctgtttgtttcaaga

SEQ ID NO: 871271 - DNA, 22 bp, Homo sapiens
ctgtttgtttttaaaaagcaaa

SEQ ID NO: 871272 - DNA, 24 bp, Homo sapiens
ctgtttgtttttaaaaagcaaatc

SEQ ID NO: 871273 - DNA, 16 bp, Homo sapiens
ctgttttagaaattgg

SEQ ID NO: 871274 - DNA, 16 bp, Homo sapiens
ctgttttagctgaggg

SEQ ID NO: 871275 - DNA, 21 bp, Homo sapiens
ctgttttagtgtttatgttta

SEQ ID NO: 871276 - DNA, 14 bp, Homo sapiens
ctgttttatactgt

SEQ ID NO: 871277 - DNA, 24 bp, Homo sapiens
ctgttttatgttgatctgcatatt

SEQ ID NO: 871278 - DNA, 13 bp, Homo sapiens
ctgttttcaaagc

SEQ ID NO: 871279 - DNA, 15 bp, Homo sapiens
ctgttttcaataaca

SEQ ID NO: 871280 - DNA, 16 bp, Homo sapiens
ctgttttcccccagca

SEQ ID NO: 871281 - DNA, 17 bp, Homo sapiens
ctgttttcccccagcaa

SEQ ID NO: 871282 - DNA, 12 bp, Homo sapiens
ctgttttcctcc

SEQ ID NO: 871283 - DNA, 16 bp, Homo sapiens
ctgttttcctcccttc

SEQ ID NO: 871284 - DNA, 19 bp, Homo sapiens
ctgttttcctcccttctgc

SEQ ID NO: 871285 - DNA, 20 bp, Homo sapiens
ctgttttcctcccttctgct

SEQ ID NO: 871286 - DNA, 13 bp, Homo sapiens
ctgttttctccct

SEQ ID NO: 871287 - DNA, 14 bp, Homo sapiens
ctgttttctccctc

SEQ ID NO: 871288 - DNA, 15 bp, Homo sapiens
ctgttttctccctct

SEQ ID NO: 871289 - DNA, 17 bp, Homo sapiens
ctgttttctccctctca

SEQ ID NO: 871290 - DNA, 21 bp, Homo sapiens
ctgttttctctcggctcccca

SEQ ID NO: 871291 - DNA, 12 bp, Homo sapiens
ctgttttctgaa

SEQ ID NO: 871292 - DNA, 20 bp, Homo sapiens
ctgttttctgaaacacacga

SEQ ID NO: 871293 - DNA, 18 bp, Homo sapiens
ctgttttgaagctgggct

SEQ ID NO: 871294 - DNA, 14 bp, Homo sapiens
ctgttttgggcctc

SEQ ID NO: 871295 - DNA, 22 bp, Homo sapiens
ctgttttgggcctccatgcccc

SEQ ID NO: 871296 - DNA, 14 bp, Homo sapiens
ctgttttggtcccc

SEQ ID NO: 871297 - DNA, 22 bp, Homo sapiens
ctgttttggtcccctccctcgt

SEQ ID NO: 871298 - DNA, 15 bp, Homo sapiens
ctgttttgtgagaac

SEQ ID NO: 871299 - DNA, 14 bp, Homo sapiens
ctgttttgtgtata

SEQ ID NO: 871300 - DNA, 13 bp, Homo sapiens
ctgttttgttata

SEQ ID NO: 871301 - DNA, 14 bp, Homo sapiens
ctgttttgttgaca

SEQ ID NO: 871302 - DNA, 17 bp, Homo sapiens
ctgttttgttgacattc

SEQ ID NO: 871303 - DNA, 19 bp, Homo sapiens
ctgttttgttgacattctg

SEQ ID NO: 871304 - DNA, 16 bp, Homo sapiens
ctgtttttaagctgtt

SEQ ID NO: 871305 - DNA, 18 bp, Homo sapiens
ctgtttttaagctgtttc

SEQ ID NO: 871306 - DNA, 23 bp, Homo sapiens
ctgtttttaagctgtttccatag

SEQ ID NO: 871307 - DNA, 21 bp, Homo sapiens
ctgtttttagagcttccaaat

SEQ ID NO: 871308 - DNA, 23 bp, Homo sapiens
ctgtttttagagcttccaaatgt

SEQ ID NO: 871309 - DNA, 12 bp, Homo sapiens
ctgtttttattc

SEQ ID NO: 871310 - DNA, 19 bp, Homo sapiens
ctgtttttattccttccat

SEQ ID NO: 871311 - DNA, 17 bp, Homo sapiens
ctgtttttcggacagtt

SEQ ID NO: 871312 - DNA, 20 bp, Homo sapiens
ctgtttttcggacagtttat

SEQ ID NO: 871313 - DNA, 22 bp, Homo sapiens
ctgtttttcggacagtttattt

SEQ ID NO: 871314 - DNA, 21 bp, Homo sapiens
ctgtttttctgggtggcctcg

SEQ ID NO: 871315 - DNA, 14 bp, Homo sapiens
ctgtttttgtagtg

SEQ ID NO: 871316 - DNA, 15 bp, Homo sapiens
ctgtttttgtatctt

SEQ ID NO: 871317 - DNA, 14 bp, Homo sapiens
ctgtttttgttgtg

SEQ ID NO: 871318 - DNA, 18 bp, Homo sapiens
ctgttttttcctgagctt

SEQ ID NO: 871319 - DNA, 14 bp, Homo sapiens
ctgtttttttccca

SEQ ID NO: 871320 - DNA, 17 bp, Homo sapiens
ctgttttttttgcaggg

SEQ ID NO: 871321 - DNA, 14 bp, Homo sapiens
cttaaaaaaataaa

SEQ ID NO: 871322 - DNA, 12 bp, Homo sapiens
cttaaaaaatgt

SEQ ID NO: 871323 - DNA, 13 bp, Homo sapiens
cttaaaaaatgtc

SEQ ID NO: 871324 - DNA, 19 bp, Homo sapiens
cttaaaaactgtgtatcat

SEQ ID NO: 871325 - DNA, 20 bp, Homo sapiens
cttaaaaactgtgtatcatt

SEQ ID NO: 871326 - DNA, 16 bp, Homo sapiens
cttaaaaagtggaaaa

SEQ ID NO: 871327 - DNA, 15 bp, Homo sapiens
cttaaaaatgtaaat

SEQ ID NO: 871328 - DNA, 17 bp, Homo sapiens
cttaaaaatgtaaatat

SEQ ID NO: 871329 - DNA, 12 bp, Homo sapiens
cttaaaaattta

SEQ ID NO: 871330 - DNA, 18 bp, Homo sapiens
cttaaaaccagagaatct

SEQ ID NO: 871331 - DNA, 20 bp, Homo sapiens
cttaaaaccttgaaggtctg

SEQ ID NO: 871332 - DNA, 12 bp, Homo sapiens
cttaaaactttg

SEQ ID NO: 871333 - DNA, 24 bp, Homo sapiens
cttaaaagctatcttcatgtaaat

SEQ ID NO: 871334 - DNA, 16 bp, Homo sapiens
cttaaaagtactttaa

SEQ ID NO: 871335 - DNA, 16 bp, Homo sapiens
cttaaaatacaagact

SEQ ID NO: 871336 - DNA, 18 bp, Homo sapiens
cttaaaatacaagactgc

SEQ ID NO: 871337 - DNA, 20 bp, Homo sapiens
cttaaaatacggtacctggc

SEQ ID NO: 871338 - DNA, 18 bp, Homo sapiens
cttaaaatagaaataagt

SEQ ID NO: 871339 - DNA, 21 bp, Homo sapiens
cttaaaatatatagtgaaaaa

SEQ ID NO: 871340 - DNA, 21 bp, Homo sapiens
cttaaaatatgtgaagttttc

SEQ ID NO: 871341 - DNA, 13 bp, Homo sapiens
cttaaaatatttt

SEQ ID NO: 871342 - DNA, 14 bp, Homo sapiens
cttaaaatatttta

SEQ ID NO: 871343 - DNA, 19 bp, Homo sapiens
cttaaaatgacaaagccat

SEQ ID NO: 871344 - DNA, 12 bp, Homo sapiens
cttaaaatgcat

SEQ ID NO: 871345 - DNA, 19 bp, Homo sapiens
cttaaaatgcattgaaaga

SEQ ID NO: 871346 - DNA, 19 bp, Homo sapiens
cttaaaattaagttgaaaa

SEQ ID NO: 871347 - DNA, 18 bp, Homo sapiens
cttaaaattaccagacaa

SEQ ID NO: 871348 - DNA, 16 bp, Homo sapiens
cttaaacaaagtgact

SEQ ID NO: 871349 - DNA, 19 bp, Homo sapiens
cttaaacactcaccttcta

SEQ ID NO: 871350 - DNA, 16 bp, Homo sapiens
cttaaaccaggaaaaa

SEQ ID NO: 871351 - DNA, 16 bp, Homo sapiens
cttaaacccatacaat

SEQ ID NO: 871352 - DNA, 23 bp, Homo sapiens
cttaaacctgaagatgtctcctc

SEQ ID NO: 871353 - DNA, 15 bp, Homo sapiens
cttaaaccttcagtt

SEQ ID NO: 871354 - DNA, 15 bp, Homo sapiens
cttaaactaaatgtg

SEQ ID NO: 871355 - DNA, 20 bp, Homo sapiens
cttaaactctggacactcta

SEQ ID NO: 871356 - DNA, 12 bp, Homo sapiens
cttaaactgaat

SEQ ID NO: 871357 - DNA, 14 bp, Homo sapiens
cttaaactgtgtgg

SEQ ID NO: 871358 - DNA, 18 bp, Homo sapiens
cttaaagaaaattgcatg

SEQ ID NO: 871359 - DNA, 17 bp, Homo sapiens
cttaaagaaacagcttt

SEQ ID NO: 871360 - DNA, 23 bp, Homo sapiens
cttaaagaaacagctttcaagtg

SEQ ID NO: 871361 - DNA, 21 bp, Homo sapiens
cttaaagaaagtcgaattaat

SEQ ID NO: 871362 - DNA, 20 bp, Homo sapiens
cttaaagaagtatttttaga

SEQ ID NO: 871363 - DNA, 22 bp, Homo sapiens
cttaaagagggacaggctgaag

SEQ ID NO: 871364 - DNA, 20 bp, Homo sapiens
cttaaagcatttcaggccag

SEQ ID NO: 871365 - DNA, 14 bp, Homo sapiens
cttaaagcttccct

SEQ ID NO: 871366 - DNA, 17 bp, Homo sapiens
cttaaaggacaggagga

SEQ ID NO: 871367 - DNA, 23 bp, Homo sapiens
cttaaaggctgtggtagtactcc

SEQ ID NO: 871368 - DNA, 22 bp, Homo sapiens
cttaaagggcccaatgaattat

SEQ ID NO: 871369 - DNA, 20 bp, Homo sapiens
cttaaagtgaaggaaataaa

SEQ ID NO: 871370 - DNA, 23 bp, Homo sapiens
cttaaagtgaaggaaataaaggt

SEQ ID NO: 871371 - DNA, 22 bp, Homo sapiens
cttaaagtgccagtattttaaa

SEQ ID NO: 871372 - DNA, 14 bp, Homo sapiens
cttaaataaaaata

SEQ ID NO: 871373 - DNA, 16 bp, Homo sapiens
cttaaataaaaataat

SEQ ID NO: 871374 - DNA, 20 bp, Homo sapiens
cttaaataatgcttcagata

SEQ ID NO: 871375 - DNA, 19 bp, Homo sapiens
cttaaataatgtgaaactg

SEQ ID NO: 871376 - DNA, 22 bp, Homo sapiens
cttaaatacactgaattgaatc

SEQ ID NO: 871377 - DNA, 14 bp, Homo sapiens
cttaaatacttttt

SEQ ID NO: 871378 - DNA, 15 bp, Homo sapiens
cttaaataggaaagt

SEQ ID NO: 871379 - DNA, 22 bp, Homo sapiens
cttaaataggaaagtttcttca

SEQ ID NO: 871380 - DNA, 12 bp, Homo sapiens
cttaaatatgta

SEQ ID NO: 871381 - DNA, 22 bp, Homo sapiens
cttaaatcatttggttaaatca

SEQ ID NO: 871382 - DNA, 11 bp, Homo sapiens
cttaaatctta

SEQ ID NO: 871383 - DNA, 12 bp, Homo sapiens
cttaaatcttaa

SEQ ID NO: 871384 - DNA, 19 bp, Homo sapiens
cttaaatcttaatgttcct

SEQ ID NO: 871385 - DNA, 17 bp, Homo sapiens
cttaaatgagttactta

SEQ ID NO: 871386 - DNA, 22 bp, Homo sapiens
cttaaatgcaaccatttgaaac

SEQ ID NO: 871387 - DNA, 19 bp, Homo sapiens
cttaaatggaattattttg

SEQ ID NO: 871388 - DNA, 17 bp, Homo sapiens
cttaaattaaacaattt

SEQ ID NO: 871389 - DNA, 20 bp, Homo sapiens
cttaaattaaacaatttatt

SEQ ID NO: 871390 - DNA, 15 bp, Homo sapiens
cttaaattattttat

SEQ ID NO: 871391 - DNA, 12 bp, Homo sapiens
cttaaattcatt

SEQ ID NO: 871392 - DNA, 18 bp, Homo sapiens
cttaaatttcttatgtga

SEQ ID NO: 871393 - DNA, 22 bp, Homo sapiens
cttaaatttcttatgtgacatt

SEQ ID NO: 871394 - DNA, 13 bp, Homo sapiens
cttaaattttaac

SEQ ID NO: 871395 - DNA, 18 bp, Homo sapiens
cttaaattttaatttatt

SEQ ID NO: 871396 - DNA, 15 bp, Homo sapiens
cttaacaaaccaaca

SEQ ID NO: 871397 - DNA, 17 bp, Homo sapiens
cttaacaaaccaacatc

SEQ ID NO: 871398 - DNA, 18 bp, Homo sapiens
cttaacaaactcttcagt

SEQ ID NO: 871399 - DNA, 23 bp, Homo sapiens
cttaacaatttctgtccttcaga

SEQ ID NO: 871400 - DNA, 19 bp, Homo sapiens
cttaacacagccttccttc

SEQ ID NO: 871401 - DNA, 14 bp, Homo sapiens
cttaaccaataatg

SEQ ID NO: 871402 - DNA, 21 bp, Homo sapiens
cttaaccaccgcatatgcatg

SEQ ID NO: 871403 - DNA, 17 bp, Homo sapiens
cttaacccaaggagcac

SEQ ID NO: 871404 - DNA, 14 bp, Homo sapiens
cttaacccctaaga

SEQ ID NO: 871405 - DNA, 17 bp, Homo sapiens
cttaacggaccaaagca

SEQ ID NO: 871406 - DNA, 13 bp, Homo sapiens
cttaactaagact

SEQ ID NO: 871407 - DNA, 14 bp, Homo sapiens
cttaactaagactc

SEQ ID NO: 871408 - DNA, 17 bp, Homo sapiens
cttaactaagactcccg

SEQ ID NO: 871409 - DNA, 20 bp, Homo sapiens
cttaactataaggtgcctca

SEQ ID NO: 871410 - DNA, 21 bp, Homo sapiens
cttaactataaggtgcctcag

SEQ ID NO: 871411 - DNA, 17 bp, Homo sapiens
cttaactcatctgttat

SEQ ID NO: 871412 - DNA, 17 bp, Homo sapiens
cttaactccttccagtg

SEQ ID NO: 871413 - DNA, 17 bp, Homo sapiens
cttaactctcaagctaa

SEQ ID NO: 871414 - DNA, 11 bp, Homo sapiens
cttaactgaag

SEQ ID NO: 871415 - DNA, 18 bp, Homo sapiens
cttaactgtatttcagta

SEQ ID NO: 871416 - DNA, 15 bp, Homo sapiens
cttaacttcttgctt

SEQ ID NO: 871417 - DNA, 18 bp, Homo sapiens
cttaacttcttgcttctt

SEQ ID NO: 871418 - DNA, 21 bp, Homo sapiens
cttaacttcttgcttctttct

SEQ ID NO: 871419 - DNA, 12 bp, Homo sapiens
cttaactttata

SEQ ID NO: 871420 - DNA, 12 bp, Homo sapiens
cttaagaaacta

SEQ ID NO: 871421 - DNA, 11 bp, Homo sapiens
cttaagaacac

SEQ ID NO: 871422 - DNA, 19 bp, Homo sapiens
cttaagaactgcttcatgt

SEQ ID NO: 871423 - DNA, 14 bp, Homo sapiens
cttaagaactgtgt

SEQ ID NO: 871424 - DNA, 16 bp, Homo sapiens
cttaagacactgtgag

SEQ ID NO: 871425 - DNA, 19 bp, Homo sapiens
cttaagacagcatgtgtta

SEQ ID NO: 871426 - DNA, 15 bp, Homo sapiens
cttaagacttaatga

SEQ ID NO: 871427 - DNA, 13 bp, Homo sapiens
cttaagagaatat

SEQ ID NO: 871428 - DNA, 21 bp, Homo sapiens
cttaagatctgactgccaaat

SEQ ID NO: 871429 - DNA, 15 bp, Homo sapiens
cttaagattaatttt

SEQ ID NO: 871430 - DNA, 14 bp, Homo sapiens
cttaagcaaaagaa

SEQ ID NO: 871431 - DNA, 17 bp, Homo sapiens
cttaagcaaaagaaaaa

SEQ ID NO: 871432 - DNA, 12 bp, Homo sapiens
cttaagcaaagg

SEQ ID NO: 871433 - DNA, 17 bp, Homo sapiens
cttaagcaaattttgta

SEQ ID NO: 871434 - DNA, 21 bp, Homo sapiens
cttaagcaaattttgtattat

SEQ ID NO: 871435 - DNA, 18 bp, Homo sapiens
cttaagcactttgaaaat

SEQ ID NO: 871436 - DNA, 19 bp, Homo sapiens
cttaagcagaacaaatgtg

SEQ ID NO: 871437 - DNA, 21 bp, Homo sapiens
cttaagcagcatggaaaaatg

SEQ ID NO: 871438 - DNA, 19 bp, Homo sapiens
cttaagcatccgtgtattt

SEQ ID NO: 871439 - DNA, 20 bp, Homo sapiens
cttaagccctttgctctgga

SEQ ID NO: 871440 - DNA, 21 bp, Homo sapiens
cttaagcctggaaggtggaag

SEQ ID NO: 871441 - DNA, 21 bp, Homo sapiens
cttaaggaacatctctgcttt

SEQ ID NO: 871442 - DNA, 15 bp, Homo sapiens
cttaaggaattttgt

SEQ ID NO: 871443 - DNA, 20 bp, Homo sapiens
cttaaggattgtgatatttt

SEQ ID NO: 871444 - DNA, 21 bp, Homo sapiens
cttaaggcacagtgggagctg

SEQ ID NO: 871445 - DNA, 20 bp, Homo sapiens
cttaagggttgaaggcagtc

SEQ ID NO: 871446 - DNA, 15 bp, Homo sapiens
cttaaggtctaactg

SEQ ID NO: 871447 - DNA, 14 bp, Homo sapiens
cttaagtaccaatg

SEQ ID NO: 871448 - DNA, 15 bp, Homo sapiens
cttaagtaccaatgg

SEQ ID NO: 871449 - DNA, 20 bp, Homo sapiens
cttaagtaccaatgggaagc

SEQ ID NO: 871450 - DNA, 16 bp, Homo sapiens
cttaagtctcgaatgt

SEQ ID NO: 871451 - DNA, 17 bp, Homo sapiens
cttaagtgagcagaaca

SEQ ID NO: 871452 - DNA, 20 bp, Homo sapiens
cttaagtgagcagaacaggt

SEQ ID NO: 871453 - DNA, 14 bp, Homo sapiens
cttaagtgcacttt

SEQ ID NO: 871454 - DNA, 16 bp, Homo sapiens
cttaagtgcacttttt

SEQ ID NO: 871455 - DNA, 16 bp, Homo sapiens
cttaagtgtaaatgaa

SEQ ID NO: 871456 - DNA, 19 bp, Homo sapiens
cttaataaaagaacatgct

SEQ ID NO: 871457 - DNA, 14 bp, Homo sapiens
cttaataaatatgt

SEQ ID NO: 871458 - DNA, 21 bp, Homo sapiens
cttaatacctgggtgattaca

SEQ ID NO: 871459 - DNA, 16 bp, Homo sapiens
cttaatactaccttga

SEQ ID NO: 871460 - DNA, 19 bp, Homo sapiens
cttaatagacttctcttac

SEQ ID NO: 871461 - DNA, 15 bp, Homo sapiens
cttaatagccctccc

SEQ ID NO: 871462 - DNA, 16 bp, Homo sapiens
cttaatagtatttatg

SEQ ID NO: 871463 - DNA, 14 bp, Homo sapiens
cttaatataaattc

SEQ ID NO: 871464 - DNA, 21 bp, Homo sapiens
cttaatataaattcactttca

SEQ ID NO: 871465 - DNA, 19 bp, Homo sapiens
cttaatatatacatttttt

SEQ ID NO: 871466 - DNA, 23 bp, Homo sapiens
cttaatatgtgctgaacattgtt

SEQ ID NO: 871467 - DNA, 14 bp, Homo sapiens
cttaatatgttaac

SEQ ID NO: 871468 - DNA, 15 bp, Homo sapiens
cttaatattgagaat

SEQ ID NO: 871469 - DNA, 16 bp, Homo sapiens
cttaatattgagaatc

SEQ ID NO: 871470 - DNA, 11 bp, Homo sapiens
cttaatatttc

SEQ ID NO: 871471 - DNA, 12 bp, Homo sapiens
cttaatatttct

SEQ ID NO: 871472 - DNA, 17 bp, Homo sapiens
cttaatcactactgtat

SEQ ID NO: 871473 - DNA, 21 bp, Homo sapiens
cttaatcagatagatattcct

SEQ ID NO: 871474 - DNA, 20 bp, Homo sapiens
cttaatcattttcattccta

SEQ ID NO: 871475 - DNA, 18 bp, Homo sapiens
cttaatccagctgatgag

SEQ ID NO: 871476 - DNA, 16 bp, Homo sapiens
cttaatcgatgaatgt

SEQ ID NO: 871477 - DNA, 14 bp, Homo sapiens
cttagttctcactg

SEQ ID NO: 871478 - DNA, 16 bp, Homo sapiens
cttagttctcactgtt

SEQ ID NO: 871479 - DNA, 13 bp, Homo sapiens
cttagttcttgaa

SEQ ID NO: 871480 - DNA, 20 bp, Homo sapiens
cttagttcttgaattgttat

SEQ ID NO: 871481 - DNA, 20 bp, Homo sapiens
cttagttgacaacctagaat

SEQ ID NO: 871482 - DNA, 22 bp, Homo sapiens
cttagttgacaacctagaatgt

SEQ ID NO: 871483 - DNA, 22 bp, Homo sapiens
cttagttgatattcaaggcttt

SEQ ID NO: 871484 - DNA, 13 bp, Homo sapiens
cttagttggctgg

SEQ ID NO: 871485 - DNA, 14 bp, Homo sapiens
cttagttggctgga

SEQ ID NO: 871486 - DNA, 22 bp, Homo sapiens
cttagtttggattcttatgtag

SEQ ID NO: 871487 - DNA, 17 bp, Homo sapiens
cttataaacacattgaa

SEQ ID NO: 871488 - DNA, 20 bp, Homo sapiens
cttataaacacattgaatgc

SEQ ID NO: 871489 - DNA, 24 bp, Homo sapiens
cttataaagtggaagtatgtatat

SEQ ID NO: 871490 - DNA, 17 bp, Homo sapiens
cttataacctagttaaa

SEQ ID NO: 871491 - DNA, 19 bp, Homo sapiens
cttataacctagttaaaga

SEQ ID NO: 871492 - DNA, 13 bp, Homo sapiens
cttataatactct

SEQ ID NO: 871493 - DNA, 21 bp, Homo sapiens
cttataatgtgtgttgtgtga

SEQ ID NO: 871494 - DNA, 21 bp, Homo sapiens
cttataattgttctcagaatc

SEQ ID NO: 871495 - DNA, 13 bp, Homo sapiens
cttataccaaagg

SEQ ID NO: 871496 - DNA, 19 bp, Homo sapiens
cttcagctgcctgaaacag

SEQ ID NO: 871497 - DNA, 23 bp, Homo sapiens
cttcagctgcctgaaacagccat

SEQ ID NO: 871498 - DNA, 21 bp, Homo sapiens
cttcagctttggatgtggtta

SEQ ID NO: 871499 - DNA, 22 bp, Homo sapiens
cttcaggatattggttcttccc

SEQ ID NO: 871500 - DNA, 17 bp, Homo sapiens
cttcaggatcaagtcct

SEQ ID NO: 871501 - DNA, 15 bp, Homo sapiens
cttcaggcctccctc

SEQ ID NO: 871502 - DNA, 14 bp, Homo sapiens
cttcaggctcttct

SEQ ID NO: 871503 - DNA, 18 bp, Homo sapiens
cttcaggctcttctcctt

SEQ ID NO: 871504 - DNA, 16 bp, Homo sapiens
cttcaggcttctgtca

SEQ ID NO: 871505 - DNA, 12 bp, Homo sapiens
cttcagggaggg

SEQ ID NO: 871506 - DNA, 22 bp, Homo sapiens
cttcagggattccctgtcccca

SEQ ID NO: 871507 - DNA, 20 bp, Homo sapiens
cttcagggcagggctctgat

SEQ ID NO: 871508 - DNA, 18 bp, Homo sapiens
cttcagggccagaaggag

SEQ ID NO: 871509 - DNA, 23 bp, Homo sapiens
cttcagggctgagttctgggttt

SEQ ID NO: 871510 - DNA, 23 bp, Homo sapiens
cttcaggggagtcccgtcaggac

SEQ ID NO: 871511 - DNA, 19 bp, Homo sapiens
cttcaggggcacttcattg

SEQ ID NO: 871512 - DNA, 22 bp, Homo sapiens
cttcaggtaaagggcaaataat

SEQ ID NO: 871513 - DNA, 16 bp, Homo sapiens
cttcaggtccgtgggc

SEQ ID NO: 871514 - DNA, 20 bp, Homo sapiens
cttcaggtggatgaggagac

SEQ ID NO: 871515 - DNA, 15 bp, Homo sapiens
cttcaggttcttagt

SEQ ID NO: 871516 - DNA, 15 bp, Homo sapiens
cttcagtaagccgtg

SEQ ID NO: 871517 - DNA, 16 bp, Homo sapiens
cttcagtaagccgtga

SEQ ID NO: 871518 - DNA, 16 bp, Homo sapiens
cttcagtaggatttat

SEQ ID NO: 871519 - DNA, 21 bp, Homo sapiens
cttcagtatgtgtcaactgag

SEQ ID NO: 871520 - DNA, 19 bp, Homo sapiens
cttcagtatgttgtcaaag

SEQ ID NO: 871521 - DNA, 22 bp, Homo sapiens
cttcagtatgttgtcaaagaga

SEQ ID NO: 871522 - DNA, 19 bp, Homo sapiens
cttcagtcctgctccagaa

SEQ ID NO: 871523 - DNA, 20 bp, Homo sapiens
cttcagtgagcccctcccca

SEQ ID NO: 871524 - DNA, 20 bp, Homo sapiens
cttcagtgtatggaaataaa

SEQ ID NO: 871525 - DNA, 15 bp, Homo sapiens
cttcagtgtctctgt

SEQ ID NO: 871526 - DNA, 13 bp, Homo sapiens
cttcagttgtctc

SEQ ID NO: 871527 - DNA, 20 bp, Homo sapiens
cttcagttgtctctgatgca

SEQ ID NO: 871528 - DNA, 18 bp, Homo sapiens
cttcagttgttctttaga

SEQ ID NO: 871529 - DNA, 12 bp, Homo sapiens
cttcataatcca

SEQ ID NO: 871530 - DNA, 12 bp, Homo sapiens
cttcataatttg

SEQ ID NO: 871531 - DNA, 22 bp, Homo sapiens
cttcataccgcctcgtgccagc

SEQ ID NO: 871532 - DNA, 18 bp, Homo sapiens
cttcatagcagattttaa

SEQ ID NO: 871533 - DNA, 14 bp, Homo sapiens
cttcatagctcctt

SEQ ID NO: 871534 - DNA, 16 bp, Homo sapiens
cttcatagctccttgg

SEQ ID NO: 871535 - DNA, 16 bp, Homo sapiens
cttcatagtattggag

SEQ ID NO: 871536 - DNA, 20 bp, Homo sapiens
cttcatatcatactgttttg

SEQ ID NO: 871537 - DNA, 20 bp, Homo sapiens
cttcatattctaaaaccatt

SEQ ID NO: 871538 - DNA, 19 bp, Homo sapiens
cttcatccaacttccaaga

SEQ ID NO: 871539 - DNA, 23 bp, Homo sapiens
cttcatccatttgttttcacact

SEQ ID NO: 871540 - DNA, 17 bp, Homo sapiens
cttcatctccagggagt

SEQ ID NO: 871541 - DNA, 18 bp, Homo sapiens
cttcatctccctgccatc

SEQ ID NO: 871542 - DNA, 13 bp, Homo sapiens
cttcatctccttt

SEQ ID NO: 871543 - DNA, 14 bp, Homo sapiens
cttcatctcctttt

SEQ ID NO: 871544 - DNA, 20 bp, Homo sapiens
cttcatcttcctgtgtcctg

SEQ ID NO: 871545 - DNA, 21 bp, Homo sapiens
cttcatcttcctgtgtcctga

SEQ ID NO: 871546 - DNA, 16 bp, Homo sapiens
cttcatgaaactgtcc

SEQ ID NO: 871547 - DNA, 21 bp, Homo sapiens
cttcatgaatctttcatacat

SEQ ID NO: 871548 - DNA, 13 bp, Homo sapiens
cttcatgcaatga

SEQ ID NO: 871549 - DNA, 17 bp, Homo sapiens
cttcatgcaatgacatc

SEQ ID NO: 871550 - DNA, 13 bp, Homo sapiens
cttcatgcactta

SEQ ID NO: 871551 - DNA, 15 bp, Homo sapiens
cttcatgccagctac

SEQ ID NO: 871552 - DNA, 14 bp, Homo sapiens
cttcatgcctttgt

SEQ ID NO: 871553 - DNA, 17 bp, Homo sapiens
cttcatgcctttgtaag

SEQ ID NO: 871554 - DNA, 20 bp, Homo sapiens
cttcatgcttttgcttgcaa

SEQ ID NO: 871555 - DNA, 18 bp, Homo sapiens
cttcatggaatggacatc

SEQ ID NO: 871556 - DNA, 21 bp, Homo sapiens
cttcatggaattcacaaagta

SEQ ID NO: 871557 - DNA, 13 bp, Homo sapiens
cttcatggatcag

SEQ ID NO: 871558 - DNA, 21 bp, Homo sapiens
cttcatggcagaaggcaaacc

SEQ ID NO: 871559 - DNA, 18 bp, Homo sapiens
cttcatgtgatgtcatga

SEQ ID NO: 871560 - DNA, 14 bp, Homo sapiens
cttcattattctct

SEQ ID NO: 871561 - DNA, 14 bp, Homo sapiens
cttcattattttaa

SEQ ID NO: 871562 - DNA, 16 bp, Homo sapiens
cttcattccagcagct

SEQ ID NO: 871563 - DNA, 18 bp, Homo sapiens
cttcattctaaaccaaaa

SEQ ID NO: 871564 - DNA, 12 bp, Homo sapiens
cttcattctcgt

SEQ ID NO: 871565 - DNA, 20 bp, Homo sapiens
cttcattcttgaaagctgtg

SEQ ID NO: 871566 - DNA, 21 bp, Homo sapiens
cttcattgagagttttgtctt

SEQ ID NO: 871567 - DNA, 16 bp, Homo sapiens
cttcattgtccctctt

SEQ ID NO: 871568 - DNA, 17 bp, Homo sapiens
cttcattgtccctcttc

SEQ ID NO: 871569 - DNA, 20 bp, Homo sapiens
cttcattgtccctcttcact

SEQ ID NO: 871570 - DNA, 12 bp, Homo sapiens
cttcatttaaaa

SEQ ID NO: 871571 - DNA, 16 bp, Homo sapiens
cttcatttaaactaaa

SEQ ID NO: 871572 - DNA, 12 bp, Homo sapiens
cttcatttcaat

SEQ ID NO: 871573 - DNA, 16 bp, Homo sapiens
cttcatttcaatcatt

SEQ ID NO: 871574 - DNA, 17 bp, Homo sapiens
cttcatttcaatcattg

SEQ ID NO: 871575 - DNA, 15 bp, Homo sapiens
cttcatttcattgta

SEQ ID NO: 871576 - DNA, 19 bp, Homo sapiens
cttcatttcattgtatgat

SEQ ID NO: 871577 - DNA, 21 bp, Homo sapiens
cttcatttctctttttatctc

SEQ ID NO: 871578 - DNA, 11 bp, Homo sapiens
cttcatttgta

SEQ ID NO: 871579 - DNA, 15 bp, Homo sapiens
cttcatttgtgccac

SEQ ID NO: 871580 - DNA, 22 bp, Homo sapiens
cttcattttaggaataataaat

SEQ ID NO: 871581 - DNA, 15 bp, Homo sapiens
cttccaaacagtgtg

SEQ ID NO: 871582 - DNA, 22 bp, Homo sapiens
cttccaaagagggatgtttgga

SEQ ID NO: 871583 - DNA, 15 bp, Homo sapiens
cttccaaataaataa

SEQ ID NO: 871584 - DNA, 20 bp, Homo sapiens
cttccaaatcccctaagcag

SEQ ID NO: 871585 - DNA, 19 bp, Homo sapiens
cttccaaatgcaatttgat

SEQ ID NO: 871586 - DNA, 17 bp, Homo sapiens
cttccaaatgtccctcc

SEQ ID NO: 871587 - DNA, 17 bp, Homo sapiens
cttccaacaagcctcaa

SEQ ID NO: 871588 - DNA, 16 bp, Homo sapiens
cttccaagaaaaataa

SEQ ID NO: 871589 - DNA, 16 bp, Homo sapiens
cttccaagactgaaga

SEQ ID NO: 871590 - DNA, 17 bp, Homo sapiens
cttccaaggagaccaag

SEQ ID NO: 871591 - DNA, 20 bp, Homo sapiens
cttccaaggagaccaagtcc

SEQ ID NO: 871592 - DNA, 18 bp, Homo sapiens
cttccaaggccctgcttt

SEQ ID NO: 871593 - DNA, 19 bp, Homo sapiens
cttccaataaagcagcctc

SEQ ID NO: 871594 - DNA, 12 bp, Homo sapiens
cttccacaaaat

SEQ ID NO: 871595 - DNA, 13 bp, Homo sapiens
cttccacaaaatt

SEQ ID NO: 871596 - DNA, 16 bp, Homo sapiens
cttccacaaagaaaat

SEQ ID NO: 871597 - DNA, 17 bp, Homo sapiens
cttccacagttatctta

SEQ ID NO: 871598 - DNA, 14 bp, Homo sapiens
cttccacatgtaca

SEQ ID NO: 871599 - DNA, 16 bp, Homo sapiens
cttccacatgtacata

SEQ ID NO: 871600 - DNA, 23 bp, Homo sapiens
cttccaccaagttggaacatcct

SEQ ID NO: 871601 - DNA, 17 bp, Homo sapiens
cttccaccattgtccta

SEQ ID NO: 871602 - DNA, 22 bp, Homo sapiens
cttccacccattcccccatgtg

SEQ ID NO: 871603 - DNA, 18 bp, Homo sapiens
cttccacccgtctctctg

SEQ ID NO: 871604 - DNA, 20 bp, Homo sapiens
cttccacccttttttctaag

SEQ ID NO: 871605 - DNA, 23 bp, Homo sapiens
cttccacctcacctctttgttct

SEQ ID NO: 871606 - DNA, 14 bp, Homo sapiens
cttccacctcatgg

SEQ ID NO: 871607 - DNA, 14 bp, Homo sapiens
cttccacctccctc

SEQ ID NO: 871608 - DNA, 16 bp, Homo sapiens
cttccacctcctagag

SEQ ID NO: 871609 - DNA, 20 bp, Homo sapiens
cttccacctgtgccctcacc

SEQ ID NO: 871610 - DNA, 21 bp, Homo sapiens
cttccacctgtgccctcacca

SEQ ID NO: 871611 - DNA, 20 bp, Homo sapiens
cttccacgctgtctccagac

SEQ ID NO: 871612 - DNA, 19 bp, Homo sapiens
cttccactcgatgatgctt

SEQ ID NO: 871613 - DNA, 14 bp, Homo sapiens
cttccactgagggc

SEQ ID NO: 871614 - DNA, 15 bp, Homo sapiens
cttccactgagggca

SEQ ID NO: 871615 - DNA, 21 bp, Homo sapiens
cttccacttttttttgtatgt

SEQ ID NO: 871616 - DNA, 20 bp, Homo sapiens
cttccagaagatgccctcca

SEQ ID NO: 871617 - DNA, 13 bp, Homo sapiens
cttccagaatgct

SEQ ID NO: 871618 - DNA, 15 bp, Homo sapiens
cttccagaatgctga

SEQ ID NO: 871619 - DNA, 23 bp, Homo sapiens
cttccagagcccaaggtcaggga

SEQ ID NO: 871620 - DNA, 13 bp, Homo sapiens
cttccagatatcc

SEQ ID NO: 871621 - DNA, 13 bp, Homo sapiens
cttccagatcact

SEQ ID NO: 871622 - DNA, 12 bp, Homo sapiens
cttccagatcct

SEQ ID NO: 871623 - DNA, 13 bp, Homo sapiens
cttccagcctggg

SEQ ID NO: 871624 - DNA, 17 bp, Homo sapiens
cttccagcctgggacac

SEQ ID NO: 871625 - DNA, 19 bp, Homo sapiens
cttccagcctgggacacac

SEQ ID NO: 871626 - DNA, 20 bp, Homo sapiens
cttccagcctgggacacaca

SEQ ID NO: 871627 - DNA, 21 bp, Homo sapiens
cttccagcctgggacacacac

SEQ ID NO: 871628 - DNA, 22 bp, Homo sapiens
cttccagcctgggacacacaca

SEQ ID NO: 871629 - DNA, 13 bp, Homo sapiens
cttccagctgctg

SEQ ID NO: 871630 - DNA, 19 bp, Homo sapiens
cttccaggaaactccacat

SEQ ID NO: 871631 - DNA, 23 bp, Homo sapiens
cttccaggaaactccacatctgc

SEQ ID NO: 871632 - DNA, 17 bp, Homo sapiens
cttccaggaatgctggg

SEQ ID NO: 871633 - DNA, 22 bp, Homo sapiens
cttccaggagccaccttgccac

SEQ ID NO: 871634 - DNA, 22 bp, Homo sapiens
cttccaggataaggagactgag

SEQ ID NO: 871635 - DNA, 18 bp, Homo sapiens
cttccaggatcaggggtt

SEQ ID NO: 871636 - DNA, 17 bp, Homo sapiens
cttccaggcctgaagtc

SEQ ID NO: 871637 - DNA, 10 bp, Homo sapiens
cttccaggct

SEQ ID NO: 871638 - DNA, 12 bp, Homo sapiens
cttccaggctct

SEQ ID NO: 871639 - DNA, 13 bp, Homo sapiens
cttccaggctctt

SEQ ID NO: 871640 - DNA, 21 bp, Homo sapiens
cttccagggcagcggctccac

SEQ ID NO: 871641 - DNA, 15 bp, Homo sapiens
cttccaggggaacct

SEQ ID NO: 871642 - DNA, 20 bp, Homo sapiens
cttccagggggaaggccaag

SEQ ID NO: 871643 - DNA, 20 bp, Homo sapiens
cttccaggtatctccaggat

SEQ ID NO: 871644 - DNA, 21 bp, Homo sapiens
cttccaggtccaaacccttca

SEQ ID NO: 871645 - DNA, 12 bp, Homo sapiens
cttccagtctgg

SEQ ID NO: 871646 - DNA, 21 bp, Homo sapiens
cttccagtcttcctgacactt

SEQ ID NO: 871647 - DNA, 20 bp, Homo sapiens
cttccagtgaacattcccag

SEQ ID NO: 871648 - DNA, 22 bp, Homo sapiens
cttccagtggctggtttctgag

SEQ ID NO: 871649 - DNA, 12 bp, Homo sapiens
cttccagtggga

SEQ ID NO: 871650 - DNA, 23 bp, Homo sapiens
cttccagtggtttgagacactgg

SEQ ID NO: 871651 - DNA, 18 bp, Homo sapiens
cttccagtgtccttagaa

SEQ ID NO: 871652 - DNA, 11 bp, Homo sapiens
cttccataatc

SEQ ID NO: 871653 - DNA, 18 bp, Homo sapiens
cttccataatgctactgt

SEQ ID NO: 871654 - DNA, 17 bp, Homo sapiens
cttccatacacagagga

SEQ ID NO: 871655 - DNA, 22 bp, Homo sapiens
cttccatagcctaatccctggg

SEQ ID NO: 871656 - DNA, 16 bp, Homo sapiens
cttccatatccctgcc

SEQ ID NO: 871657 - DNA, 21 bp, Homo sapiens
cttccatatccctgcccagcc

SEQ ID NO: 871658 - DNA, 16 bp, Homo sapiens
cttccatcagcgggtc

SEQ ID NO: 871659 - DNA, 21 bp, Homo sapiens
cttccatcagcgggtctcctc

SEQ ID NO: 871660 - DNA, 16 bp, Homo sapiens
cttccatcatcactgt

SEQ ID NO: 871661 - DNA, 17 bp, Homo sapiens
cttccatctagcagctg

SEQ ID NO: 871662 - DNA, 20 bp, Homo sapiens
cttccatctagcagctggcc

SEQ ID NO: 871663 - DNA, 21 bp, Homo sapiens
cttccatctagcagctggcct

SEQ ID NO: 871664 - DNA, 22 bp, Homo sapiens
cttccatctagcagctggccta

SEQ ID NO: 871665 - DNA, 17 bp, Homo sapiens
cttccatcttgtggggc

SEQ ID NO: 871666 - DNA, 17 bp, Homo sapiens
cttccatgagaacagca

SEQ ID NO: 871667 - DNA, 14 bp, Homo sapiens
cttccatgattcta

SEQ ID NO: 871668 - DNA, 17 bp, Homo sapiens
cttccatgattctattt

SEQ ID NO: 871669 - DNA, 16 bp, Homo sapiens
cttccatgccctggga

SEQ ID NO: 871670 - DNA, 16 bp, Homo sapiens
cttccatgtcaggcca

SEQ ID NO: 871671 - DNA, 18 bp, Homo sapiens
cttccatgtcaggccagc

SEQ ID NO: 871672 - DNA, 20 bp, Homo sapiens
cttccatgtcgcctctgcat

SEQ ID NO: 871673 - DNA, 14 bp, Homo sapiens
cttccatgtggaga

SEQ ID NO: 871674 - DNA, 12 bp, Homo sapiens
cttccatttata

SEQ ID NO: 871675 - DNA, 14 bp, Homo sapiens
cttccattttcccc

SEQ ID NO: 871676 - DNA, 19 bp, Homo sapiens
cttccattttcccccacta

SEQ ID NO: 871677 - DNA, 14 bp, Homo sapiens
cttccatttttgat

SEQ ID NO: 871678 - DNA, 14 bp, Homo sapiens
cttcccaaacccag

SEQ ID NO: 871679 - DNA, 18 bp, Homo sapiens
cttcccaaacccagtctc

SEQ ID NO: 871680 - DNA, 16 bp, Homo sapiens
cttcccaacagcctta

SEQ ID NO: 871681 - DNA, 18 bp, Homo sapiens
cttcccaacagccttagc

SEQ ID NO: 871682 - DNA, 19 bp, Homo sapiens
cttcccacacggcagcccc

SEQ ID NO: 871683 - DNA, 12 bp, Homo sapiens
cttcccacagga

SEQ ID NO: 871684 - DNA, 14 bp, Homo sapiens
cttcccacaggagg

SEQ ID NO: 871685 - DNA, 22 bp, Homo sapiens
cttcccacaggagggccagcgc

SEQ ID NO: 871686 - DNA, 20 bp, Homo sapiens
cttcccacatgcctgcgcct

SEQ ID NO: 871687 - DNA, 17 bp, Homo sapiens
cttcccacccatcgctg

SEQ ID NO: 871688 - DNA, 13 bp, Homo sapiens
cttcccaccccca

SEQ ID NO: 871689 - DNA, 16 bp, Homo sapiens
cttcccacccccaggc

SEQ ID NO: 871690 - DNA, 14 bp, Homo sapiens
cttcccactggagg

SEQ ID NO: 871691 - DNA, 13 bp, Homo sapiens
cttcccagccctc

SEQ ID NO: 871692 - DNA, 14 bp, Homo sapiens
cttcccagccctca

SEQ ID NO: 871693 - DNA, 19 bp, Homo sapiens
cttcccagcggttcctgtg

SEQ ID NO: 871694 - DNA, 20 bp, Homo sapiens
cttcccagctctccctctgg

SEQ ID NO: 871695 - DNA, 15 bp, Homo sapiens
cttcccagctctgac

SEQ ID NO: 871696 - DNA, 11 bp, Homo sapiens
cttcccagctt

SEQ ID NO: 871697 - DNA, 14 bp, Homo sapiens
cttcccaggacccc

SEQ ID NO: 871698 - DNA, 16 bp, Homo sapiens
cttcccaggcctttgg

SEQ ID NO: 871699 - DNA, 12 bp, Homo sapiens
cttcccagggac

SEQ ID NO: 871700 - DNA, 22 bp, Homo sapiens
cttcccagtataagatttttga

SEQ ID NO: 871701 - DNA, 16 bp, Homo sapiens
cttcccagtgggctgt

SEQ ID NO: 871702 - DNA, 22 bp, Homo sapiens
cttcccataaaatgtaagaaaa

SEQ ID NO: 871703 - DNA, 17 bp, Homo sapiens
cttcccatagtggggcc

SEQ ID NO: 871704 - DNA, 11 bp, Homo sapiens
cttcccatcac

SEQ ID NO: 871705 - DNA, 16 bp, Homo sapiens
cttcccatcactggag

SEQ ID NO: 871706 - DNA, 18 bp, Homo sapiens
cttcccatcactggagca

SEQ ID NO: 871707 - DNA, 12 bp, Homo sapiens
cttcccatctcc

SEQ ID NO: 871708 - DNA, 16 bp, Homo sapiens
cttcccatgactgcac

SEQ ID NO: 871709 - DNA, 15 bp, Homo sapiens
cttcccatgcctgtc

SEQ ID NO: 871710 - DNA, 21 bp, Homo sapiens
cttcccatgcctgtctctgtt

SEQ ID NO: 871711 - DNA, 14 bp, Homo sapiens
cttcccatggccat

SEQ ID NO: 871712 - DNA, 16 bp, Homo sapiens
cttccccaacttccct

SEQ ID NO: 871713 - DNA, 21 bp, Homo sapiens
cttccccaagggccaaaccca

SEQ ID NO: 871714 - DNA, 20 bp, Homo sapiens
cttccccagactcagctcca

SEQ ID NO: 871715 - DNA, 12 bp, Homo sapiens
cttccccagaga

SEQ ID NO: 871716 - DNA, 13 bp, Homo sapiens
cttccccagagag

SEQ ID NO: 871717 - DNA, 13 bp, Homo sapiens
cttccccaggccc

SEQ ID NO: 871718 - DNA, 14 bp, Homo sapiens
cttccccatcagct

SEQ ID NO: 871719 - DNA, 19 bp, Homo sapiens
cttccccatcagctcccaa

SEQ ID NO: 871720 - DNA, 13 bp, Homo sapiens
cttccccatcccg

SEQ ID NO: 871721 - DNA, 14 bp, Homo sapiens
cttccccatcccga

SEQ ID NO: 871722 - DNA, 18 bp, Homo sapiens
cttccccatcttctaaac

SEQ ID NO: 871723 - DNA, 18 bp, Homo sapiens
cttcccccacccctccac

SEQ ID NO: 871724 - DNA, 23 bp, Homo sapiens
cttcccccatcccctttcctccc

SEQ ID NO: 871725 - DNA, 16 bp, Homo sapiens
cttccccccatctctg

SEQ ID NO: 871726 - DNA, 17 bp, Homo sapiens
cttccccccatctctga

SEQ ID NO: 871727 - DNA, 13 bp, Homo sapiens
cttcccccctctc

SEQ ID NO: 871728 - DNA, 19 bp, Homo sapiens
cttcccccctctcctccca

SEQ ID NO: 871729 - DNA, 12 bp, Homo sapiens
cttccccctcca

SEQ ID NO: 871730 - DNA, 15 bp, Homo sapiens
cttccccctccaatc

SEQ ID NO: 871731 - DNA, 18 bp, Homo sapiens
cttccccctgtagactag

SEQ ID NO: 871732 - DNA, 18 bp, Homo sapiens
cttcccccttttttgtcc

SEQ ID NO: 871733 - DNA, 18 bp, Homo sapiens
cttccccgtcccctgcag

SEQ ID NO: 871734 - DNA, 13 bp, Homo sapiens
cttcctccctcat

SEQ ID NO: 871735 - DNA, 15 bp, Homo sapiens
cttcctccctcattc

SEQ ID NO: 871736 - DNA, 17 bp, Homo sapiens
cttcctccgaggccagt

SEQ ID NO: 871737 - DNA, 21 bp, Homo sapiens
cttcctccgaggccagtacct

SEQ ID NO: 871738 - DNA, 13 bp, Homo sapiens
cttcctccgtcca

SEQ ID NO: 871739 - DNA, 18 bp, Homo sapiens
cttcctccgtccacccag

SEQ ID NO: 871740 - DNA, 19 bp, Homo sapiens
cttcctccgtccacccagg

SEQ ID NO: 871741 - DNA, 24 bp, Homo sapiens
cttcctccgtccacccaggctgca

SEQ ID NO: 871742 - DNA, 16 bp, Homo sapiens
cttcctcctacctggg

SEQ ID NO: 871743 - DNA, 19 bp, Homo sapiens
gaaattaaagtatgcaaaa

SEQ ID NO: 871744 - DNA, 15 bp, Homo sapiens
gaaattaagaagaaa

SEQ ID NO: 871745 - DNA, 16 bp, Homo sapiens
gaaattaagaagaaac

SEQ ID NO: 871746 - DNA, 16 bp, Homo sapiens
gaaattaatgctgaga

SEQ ID NO: 871747 - DNA, 17 bp, Homo sapiens
gaaattaatttgtgaat

SEQ ID NO: 871748 - DNA, 19 bp, Homo sapiens
gaaattaatttgtgaattt

SEQ ID NO: 871749 - DNA, 18 bp, Homo sapiens
gaaattacctgtggatat

SEQ ID NO: 871750 - DNA, 18 bp, Homo sapiens
gaaattactacaaaattt

SEQ ID NO: 871751 - DNA, 13 bp, Homo sapiens
gaaattactgtgt

SEQ ID NO: 871752 - DNA, 17 bp, Homo sapiens
gaaattaggttgaaaca

SEQ ID NO: 871753 - DNA, 13 bp, Homo sapiens
gaaattcaggtac

SEQ ID NO: 871754 - DNA, 15 bp, Homo sapiens
gaaattccagcaata

SEQ ID NO: 871755 - DNA, 16 bp, Homo sapiens
gaaattcctccttccc

SEQ ID NO: 871756 - DNA, 16 bp, Homo sapiens
gaaattcctgtagcat

SEQ ID NO: 871757 - DNA, 15 bp, Homo sapiens
gaaattcgtgtgttt

SEQ ID NO: 871758 - DNA, 17 bp, Homo sapiens
gaaattcgtgtgttttt

SEQ ID NO: 871759 - DNA, 15 bp, Homo sapiens
gaaattctccaggat

SEQ ID NO: 871760 - DNA, 22 bp, Homo sapiens
gaaattcttgttatggtagaaa

SEQ ID NO: 871761 - DNA, 18 bp, Homo sapiens
gaaattgaagtgtcttct

SEQ ID NO: 871762 - DNA, 21 bp, Homo sapiens
gaaattgacacaagtggacct

SEQ ID NO: 871763 - DNA, 12 bp, Homo sapiens
gaaattgacaga

SEQ ID NO: 871764 - DNA, 13 bp, Homo sapiens
gaaattgtatatt

SEQ ID NO: 871765 - DNA, 20 bp, Homo sapiens
gaaattgtctagcagagcag

SEQ ID NO: 871766 - DNA, 12 bp, Homo sapiens
gaaattgtttat

SEQ ID NO: 871767 - DNA, 13 bp, Homo sapiens
gaaatttaaaaga

SEQ ID NO: 871768 - DNA, 23 bp, Homo sapiens
gaaatttaaactataagcaagaa

SEQ ID NO: 871769 - DNA, 22 bp, Homo sapiens
gaaatttaaagcaggttcttgt

SEQ ID NO: 871770 - DNA, 23 bp, Homo sapiens
gaaatttaaagcaggttcttgtt

SEQ ID NO: 871771 - DNA, 23 bp, Homo sapiens
gaaatttaattcatgtttcttaa

SEQ ID NO: 871772 - DNA, 19 bp, Homo sapiens
gaaatttatttccatctag

SEQ ID NO: 871773 - DNA, 21 bp, Homo sapiens
gaaatttcagattcccagagc

SEQ ID NO: 871774 - DNA, 15 bp, Homo sapiens
gaaatttcatgattg

SEQ ID NO: 871775 - DNA, 14 bp, Homo sapiens
gaaatttggtaccc

SEQ ID NO: 871776 - DNA, 18 bp, Homo sapiens
gaaatttgttatacttca

SEQ ID NO: 871777 - DNA, 17 bp, Homo sapiens
gaaatttgttgtttgtt

SEQ ID NO: 871778 - DNA, 15 bp, Homo sapiens
gaaatttgtttgtat

SEQ ID NO: 871779 - DNA, 14 bp, Homo sapiens
gaaattttagaaat

SEQ ID NO: 871780 - DNA, 23 bp, Homo sapiens
gaaattttatatgtaaatgtgtt

SEQ ID NO: 871781 - DNA, 18 bp, Homo sapiens
gaaattttctagactttc

SEQ ID NO: 871782 - DNA, 13 bp, Homo sapiens
gaaattttgtaag

SEQ ID NO: 871783 - DNA, 14 bp, Homo sapiens
gaaattttgtaaga

SEQ ID NO: 871784 - DNA, 20 bp, Homo sapiens
gaaattttgtaagaaggcaa

SEQ ID NO: 871785 - DNA, 13 bp, Homo sapiens
gaaatttttaagt

SEQ ID NO: 871786 - DNA, 19 bp, Homo sapiens
gaaatttttacctttatct

SEQ ID NO: 871787 - DNA, 18 bp, Homo sapiens
gaaatttttattaaatta

SEQ ID NO: 871788 - DNA, 13 bp, Homo sapiens
gaaatttttgtaa

SEQ ID NO: 871789 - DNA, 16 bp, Homo sapiens
gaacaaaaagaaatct

SEQ ID NO: 871790 - DNA, 19 bp, Homo sapiens
gaacaaaaagaaatcttgt

SEQ ID NO: 871791 - DNA, 20 bp, Homo sapiens
gaacaaaagattggagctga

SEQ ID NO: 871792 - DNA, 21 bp, Homo sapiens
gaacaaaagttcgaaagaaaa

SEQ ID NO: 871793 - DNA, 18 bp, Homo sapiens
gaacaaacaaaacttaaa

SEQ ID NO: 871794 - DNA, 14 bp, Homo sapiens
gaacaaagacaggc

SEQ ID NO: 871795 - DNA, 16 bp, Homo sapiens
gaacaaagctgttaaa

SEQ ID NO: 871796 - DNA, 18 bp, Homo sapiens
gaacaaagctgttaaact

SEQ ID NO: 871797 - DNA, 19 bp, Homo sapiens
gaacaaagctgttaaactg

SEQ ID NO: 871798 - DNA, 20 bp, Homo sapiens
gaacaaatcacacctctggg

SEQ ID NO: 871799 - DNA, 18 bp, Homo sapiens
gaacaaattagaggagac

SEQ ID NO: 871800 - DNA, 14 bp, Homo sapiens
gaacaaattatttt

SEQ ID NO: 871801 - DNA, 16 bp, Homo sapiens
gaacaacaggcagggg

SEQ ID NO: 871802 - DNA, 15 bp, Homo sapiens
gaacaacagtagttt

SEQ ID NO: 871803 - DNA, 15 bp, Homo sapiens
gaacaactactgtga

SEQ ID NO: 871804 - DNA, 21 bp, Homo sapiens
gaacaactaggcttcagcata

SEQ ID NO: 871805 - DNA, 13 bp, Homo sapiens
gaacaactgatac

SEQ ID NO: 871806 - DNA, 13 bp, Homo sapiens
gaacaagaaatgg

SEQ ID NO: 871807 - DNA, 13 bp, Homo sapiens
gaacaagctggct

SEQ ID NO: 871808 - DNA, 18 bp, Homo sapiens
gaacaagtaatgtattag

SEQ ID NO: 871809 - DNA, 19 bp, Homo sapiens
gaacaagttgtttcattga

SEQ ID NO: 871810 - DNA, 14 bp, Homo sapiens
gaacaatcactatt

SEQ ID NO: 871811 - DNA, 15 bp, Homo sapiens
gaacaatcactattc

SEQ ID NO: 871812 - DNA, 17 bp, Homo sapiens
gaacaatgccagggccc

SEQ ID NO: 871813 - DNA, 21 bp, Homo sapiens
gaacaattttttttaattggc

SEQ ID NO: 871814 - DNA, 22 bp, Homo sapiens
gaacacaaagcggggggagggt

SEQ ID NO: 871815 - DNA, 14 bp, Homo sapiens
gaacacaaatgtct

SEQ ID NO: 871816 - DNA, 14 bp, Homo sapiens
gaacacacacatat

SEQ ID NO: 871817 - DNA, 17 bp, Homo sapiens
gaacacacacatataca

SEQ ID NO: 871818 - DNA, 16 bp, Homo sapiens
gaacacacacgccagc

SEQ ID NO: 871819 - DNA, 20 bp, Homo sapiens
gaacacacacgccagctcct

SEQ ID NO: 871820 - DNA, 21 bp, Homo sapiens
gaacacacacgccagctcctc

SEQ ID NO: 871821 - DNA, 22 bp, Homo sapiens
gaacacactgtgtcctggtgct

SEQ ID NO: 871822 - DNA, 17 bp, Homo sapiens
gaacacaggcaaaatcc

SEQ ID NO: 871823 - DNA, 17 bp, Homo sapiens
gaacacagttctgggca

SEQ ID NO: 871824 - DNA, 16 bp, Homo sapiens
gaacaccattgaaggc

SEQ ID NO: 871825 - DNA, 20 bp, Homo sapiens
gaacaccattgaaggcttaa

SEQ ID NO: 871826 - DNA, 18 bp, Homo sapiens
gaacacctatgcaaagat

SEQ ID NO: 871827 - DNA, 21 bp, Homo sapiens
gaacacctatgcaaagatgaa

SEQ ID NO: 871828 - DNA, 11 bp, Homo sapiens
gaacacctggc

SEQ ID NO: 871829 - DNA, 17 bp, Homo sapiens
gaacacgcgtatttaca

SEQ ID NO: 871830 - DNA, 19 bp, Homo sapiens
gaacactaactcaccagcc

SEQ ID NO: 871831 - DNA, 13 bp, Homo sapiens
gaacactagccag

SEQ ID NO: 871832 - DNA, 16 bp, Homo sapiens
gaacactgcctctgag

SEQ ID NO: 871833 - DNA, 20 bp, Homo sapiens
gaacactgggggaggggaca

SEQ ID NO: 871834 - DNA, 18 bp, Homo sapiens
gaacactgtgaccaggct

SEQ ID NO: 871835 - DNA, 20 bp, Homo sapiens
gaacactgtgaccaggcttt

SEQ ID NO: 871836 - DNA, 23 bp, Homo sapiens
gaacactgtgaccaggcttttgt

SEQ ID NO: 871837 - DNA, 16 bp, Homo sapiens
gaacacttcagacaca

SEQ ID NO: 871838 - DNA, 21 bp, Homo sapiens
gaacacttcagacacaggaaa

SEQ ID NO: 871839 - DNA, 14 bp, Homo sapiens
gaacagaaggatga

SEQ ID NO: 871840 - DNA, 14 bp, Homo sapiens
gaacagaatgtttt

SEQ ID NO: 871841 - DNA, 17 bp, Homo sapiens
gaacagacaacagaagt

SEQ ID NO: 871842 - DNA, 17 bp, Homo sapiens
gaacagacaggagaaat

SEQ ID NO: 871843 - DNA, 18 bp, Homo sapiens
gaacagacaggagaaatg

SEQ ID NO: 871844 - DNA, 23 bp, Homo sapiens
gaacagacctgaggcttatcttt

SEQ ID NO: 871845 - DNA, 20 bp, Homo sapiens
gaacagcagactcagctctg

SEQ ID NO: 871846 - DNA, 18 bp, Homo sapiens
gaacagcatatgatttct

SEQ ID NO: 871847 - DNA, 23 bp, Homo sapiens
gaacagccaaatgcatggtgcag

SEQ ID NO: 871848 - DNA, 18 bp, Homo sapiens
gaacagccgctcctgtct

SEQ ID NO: 871849 - DNA, 21 bp, Homo sapiens
gaacagcgaagtagcttgctc

SEQ ID NO: 871850 - DNA, 16 bp, Homo sapiens
gaacagcgggagacct

SEQ ID NO: 871851 - DNA, 22 bp, Homo sapiens
gaacagcgggagacctgtgcta

SEQ ID NO: 871852 - DNA, 21 bp, Homo sapiens
gaacagctatgggagccccag

SEQ ID NO: 871853 - DNA, 14 bp, Homo sapiens
gaacagctctgaga

SEQ ID NO: 871854 - DNA, 17 bp, Homo sapiens
gaacagctctgagatcc

SEQ ID NO: 871855 - DNA, 14 bp, Homo sapiens
gaacagctggtgcc

SEQ ID NO: 871856 - DNA, 16 bp, Homo sapiens
gaacagctgtgagcca

SEQ ID NO: 871857 - DNA, 19 bp, Homo sapiens
gaacagctgtgagccatgc

SEQ ID NO: 871858 - DNA, 19 bp, Homo sapiens
gaacagctgtgtctgccaa

SEQ ID NO: 871859 - DNA, 13 bp, Homo sapiens
gaacagctgttcc

SEQ ID NO: 871860 - DNA, 14 bp, Homo sapiens
gaacagggcccagg

SEQ ID NO: 871861 - DNA, 15 bp, Homo sapiens
gaacagggcccagga

SEQ ID NO: 871862 - DNA, 15 bp, Homo sapiens
gaacaggtgtttttc

SEQ ID NO: 871863 - DNA, 19 bp, Homo sapiens
gaacagtcacccttctggg

SEQ ID NO: 871864 - DNA, 17 bp, Homo sapiens
gaacagtcatgtatgca

SEQ ID NO: 871865 - DNA, 20 bp, Homo sapiens
gaacagtcatgtatgcaagt

SEQ ID NO: 871866 - DNA, 14 bp, Homo sapiens
gaacagtggctggg

SEQ ID NO: 871867 - DNA, 17 bp, Homo sapiens
gaacagtgtttcccata

SEQ ID NO: 871868 - DNA, 13 bp, Homo sapiens
gaacccataggga

SEQ ID NO: 871869 - DNA, 18 bp, Homo sapiens
gaacccatagggagctga

SEQ ID NO: 871870 - DNA, 20 bp, Homo sapiens
gaacccatggaaaaatgcca

SEQ ID NO: 871871 - DNA, 16 bp, Homo sapiens
gaaccccccaggccct

SEQ ID NO: 871872 - DNA, 20 bp, Homo sapiens
gaaccccggggtgcccacag

SEQ ID NO: 871873 - DNA, 21 bp, Homo sapiens
gaacccctacatgaaacagaa

SEQ ID NO: 871874 - DNA, 19 bp, Homo sapiens
gaacccctagaaaggagag

SEQ ID NO: 871875 - DNA, 20 bp, Homo sapiens
gaacccctagaaaggagaga

SEQ ID NO: 871876 - DNA, 14 bp, Homo sapiens
gaacccctggccag

SEQ ID NO: 871877 - DNA, 15 bp, Homo sapiens
gaacccctggccagc

SEQ ID NO: 871878 - DNA, 13 bp, Homo sapiens
gaacccctgtgtc

SEQ ID NO: 871879 - DNA, 19 bp, Homo sapiens
gaacccctgtgtccctttt

SEQ ID NO: 871880 - DNA, 18 bp, Homo sapiens
gaaccctcttgccatcct

SEQ ID NO: 871881 - DNA, 24 bp, Homo sapiens
gaaccctcttgccatcctgatgga

SEQ ID NO: 871882 - DNA, 16 bp, Homo sapiens
gaaccctggggcctga

SEQ ID NO: 871883 - DNA, 17 bp, Homo sapiens
gaaccctgtgctggtgt

SEQ ID NO: 871884 - DNA, 23 bp, Homo sapiens
gaaccctgtgctggtgtcctgac

SEQ ID NO: 871885 - DNA, 17 bp, Homo sapiens
gaacccttgtgcttggt

SEQ ID NO: 871886 - DNA, 18 bp, Homo sapiens
gaacccttgtgcttggtg

SEQ ID NO: 871887 - DNA, 23 bp, Homo sapiens
gaacccttttggcccccgagctg

SEQ ID NO: 871888 - DNA, 16 bp, Homo sapiens
gaaccgcacagctcag

SEQ ID NO: 871889 - DNA, 20 bp, Homo sapiens
gaaccgcaccccatcccacc

SEQ ID NO: 871890 - DNA, 18 bp, Homo sapiens
gaaccgctcacctagagc

SEQ ID NO: 871891 - DNA, 19 bp, Homo sapiens
gaaccgtggtatgtctgcc

SEQ ID NO: 871892 - DNA, 20 bp, Homo sapiens
gaacctaactccccacccca

SEQ ID NO: 871893 - DNA, 19 bp, Homo sapiens
gaacctaattcaattcaaa

SEQ ID NO: 871894 - DNA, 20 bp, Homo sapiens
gaacctaccagttggccatg

SEQ ID NO: 871895 - DNA, 15 bp, Homo sapiens
gaacctaccttcatt

SEQ ID NO: 871896 - DNA, 17 bp, Homo sapiens
gaacctactgttccttt

SEQ ID NO: 871897 - DNA, 20 bp, Homo sapiens
gaacctagtactctctgctc

SEQ ID NO: 871898 - DNA, 17 bp, Homo sapiens
gaacctattttcatttg

SEQ ID NO: 871899 - DNA, 13 bp, Homo sapiens
gaacctcccagag

SEQ ID NO: 871900 - DNA, 17 bp, Homo sapiens
gaacctcctatatcatt

SEQ ID NO: 871901 - DNA, 16 bp, Homo sapiens
gaacctctcgccatga

SEQ ID NO: 871902 - DNA, 14 bp, Homo sapiens
gaacctctgattta

SEQ ID NO: 871903 - DNA, 12 bp, Homo sapiens
gaacctctgtct

SEQ ID NO: 871904 - DNA, 20 bp, Homo sapiens
gaacctgacatccactgttt

SEQ ID NO: 871905 - DNA, 22 bp, Homo sapiens
gaacctgcacacaggacagcgg

SEQ ID NO: 871906 - DNA, 11 bp, Homo sapiens
gaacctggatc

SEQ ID NO: 871907 - DNA, 17 bp, Homo sapiens
gaacctggatccagcac

SEQ ID NO: 871908 - DNA, 17 bp, Homo sapiens
gaacctgggaggcagag

SEQ ID NO: 871909 - DNA, 17 bp, Homo sapiens
gaacctgggcactccgc

SEQ ID NO: 871910 - DNA, 16 bp, Homo sapiens
gaacctgtcctaagga

SEQ ID NO: 871911 - DNA, 12 bp, Homo sapiens
gaacctgtctcc

SEQ ID NO: 871912 - DNA, 20 bp, Homo sapiens
gaaccttaacctctctaagc

SEQ ID NO: 871913 - DNA, 18 bp, Homo sapiens
gaagaggactgtgtgaga

SEQ ID NO: 871914 - DNA, 17 bp, Homo sapiens
gaagaggacttttttga

SEQ ID NO: 871915 - DNA, 16 bp, Homo sapiens
gaagaggcagattcaa

SEQ ID NO: 871916 - DNA, 18 bp, Homo sapiens
gaagaggcgggccagcca

SEQ ID NO: 871917 - DNA, 22 bp, Homo sapiens
gaagagggaatggatggggaga

SEQ ID NO: 871918 - DNA, 20 bp, Homo sapiens
gaagagggagaagcatgaaa

SEQ ID NO: 871919 - DNA, 20 bp, Homo sapiens
gaagagggagaccaaatgtc

SEQ ID NO: 871920 - DNA, 22 bp, Homo sapiens
gaagagggcccagcccagagcc

SEQ ID NO: 871921 - DNA, 21 bp, Homo sapiens
gaagagggctgagctgagctt

SEQ ID NO: 871922 - DNA, 21 bp, Homo sapiens
gaagaggggaggggcctaggg

SEQ ID NO: 871923 - DNA, 13 bp, Homo sapiens
gaagaggggcagc

SEQ ID NO: 871924 - DNA, 14 bp, Homo sapiens
gaagaggggcagcc

SEQ ID NO: 871925 - DNA, 18 bp, Homo sapiens
gaagaggggcagcccttg

SEQ ID NO: 871926 - DNA, 23 bp, Homo sapiens
gaagagtaagtcaacctgcctga

SEQ ID NO: 871927 - DNA, 17 bp, Homo sapiens
gaagagtctattgtctc

SEQ ID NO: 871928 - DNA, 18 bp, Homo sapiens
gaagagtttaaagagaaa

SEQ ID NO: 871929 - DNA, 21 bp, Homo sapiens
gaagagtttaaagagaaaagg

SEQ ID NO: 871930 - DNA, 15 bp, Homo sapiens
gaagagttttagaga

SEQ ID NO: 871931 - DNA, 15 bp, Homo sapiens
gaagatcccccagaa

SEQ ID NO: 871932 - DNA, 22 bp, Homo sapiens
gaagatcctgcgggtggggctt

SEQ ID NO: 871933 - DNA, 15 bp, Homo sapiens
gaagatctaccccag

SEQ ID NO: 871934 - DNA, 19 bp, Homo sapiens
gaagatctaccccagggag

SEQ ID NO: 871935 - DNA, 20 bp, Homo sapiens
gaagatctaccccagggaga

SEQ ID NO: 871936 - DNA, 17 bp, Homo sapiens
gaagatgaaagaggagg

SEQ ID NO: 871937 - DNA, 15 bp, Homo sapiens
gaagatgaatggtct

SEQ ID NO: 871938 - DNA, 18 bp, Homo sapiens
gaagatgaccggtttgga

SEQ ID NO: 871939 - DNA, 16 bp, Homo sapiens
gaagatgatcagacct

SEQ ID NO: 871940 - DNA, 19 bp, Homo sapiens
gaagatgcccctgctccct

SEQ ID NO: 871941 - DNA, 18 bp, Homo sapiens
gaagatggactctgaaaa

SEQ ID NO: 871942 - DNA, 19 bp, Homo sapiens
gaagatgtttacattttta

SEQ ID NO: 871943 - DNA, 13 bp, Homo sapiens
gaagattatatga

SEQ ID NO: 871944 - DNA, 14 bp, Homo sapiens
gaagcaaagacaaa

SEQ ID NO: 871945 - DNA, 23 bp, Homo sapiens
gaagcaaagacaaaagaaactta

SEQ ID NO: 871946 - DNA, 15 bp, Homo sapiens
gaagcaaagagtgag

SEQ ID NO: 871947 - DNA, 15 bp, Homo sapiens
gaagcaaagggggga

SEQ ID NO: 871948 - DNA, 16 bp, Homo sapiens
gaagcaaaggggggag

SEQ ID NO: 871949 - DNA, 22 bp, Homo sapiens
gaagcaagaggcaagctgaaat

SEQ ID NO: 871950 - DNA, 20 bp, Homo sapiens
gaagcaaggaagatatacat

SEQ ID NO: 871951 - DNA, 15 bp, Homo sapiens
gaagcaataaagctc

SEQ ID NO: 871952 - DNA, 13 bp, Homo sapiens
gaagcaataactc

SEQ ID NO: 871953 - DNA, 18 bp, Homo sapiens
gaagcaataactccaagc

SEQ ID NO: 871954 - DNA, 21 bp, Homo sapiens
gaagcaataactccaagcaga

SEQ ID NO: 871955 - DNA, 18 bp, Homo sapiens
gaagcaatctttgaaata

SEQ ID NO: 871956 - DNA, 13 bp, Homo sapiens
gaagcacaactcc

SEQ ID NO: 871957 - DNA, 14 bp, Homo sapiens
gaagcacacctaca

SEQ ID NO: 871958 - DNA, 17 bp, Homo sapiens
gaagcacagaatatttt

SEQ ID NO: 871959 - DNA, 18 bp, Homo sapiens
gaagcacagcctcgggga

SEQ ID NO: 871960 - DNA, 13 bp, Homo sapiens
gaagcacatgtgt

SEQ ID NO: 871961 - DNA, 14 bp, Homo sapiens
gaagcacatgttta

SEQ ID NO: 871962 - DNA, 22 bp, Homo sapiens
gaagcacctactatgtgctggg

SEQ ID NO: 871963 - DNA, 20 bp, Homo sapiens
gaagcagacttttcagaaga

SEQ ID NO: 871964 - DNA, 15 bp, Homo sapiens
gaagcagagagatgc

SEQ ID NO: 871965 - DNA, 21 bp, Homo sapiens
gaagcagaggtcttcagggct

SEQ ID NO: 871966 - DNA, 16 bp, Homo sapiens
gaagcagcactgtgag

SEQ ID NO: 871967 - DNA, 18 bp, Homo sapiens
gaagcagccccctgtggc

SEQ ID NO: 871968 - DNA, 18 bp, Homo sapiens
gaagcagcctcagagtgg

SEQ ID NO: 871969 - DNA, 23 bp, Homo sapiens
gaagcagctaaaccaaggactga

SEQ ID NO: 871970 - DNA, 15 bp, Homo sapiens
gaagcaggacagaca

SEQ ID NO: 871971 - DNA, 16 bp, Homo sapiens
gaagcaggacctagag

SEQ ID NO: 871972 - DNA, 12 bp, Homo sapiens
gaagcaggaggc

SEQ ID NO: 871973 - DNA, 16 bp, Homo sapiens
gaagcagggagagttg

SEQ ID NO: 871974 - DNA, 19 bp, Homo sapiens
gaagcagtgcctcgaggca

SEQ ID NO: 871975 - DNA, 17 bp, Homo sapiens
gaagcagtgccttccat

SEQ ID NO: 871976 - DNA, 18 bp, Homo sapiens
gaagcagtgccttccata

SEQ ID NO: 871977 - DNA, 15 bp, Homo sapiens
gaagcagttggggcc

SEQ ID NO: 871978 - DNA, 16 bp, Homo sapiens
gaagcagttggggccc

SEQ ID NO: 871979 - DNA, 19 bp, Homo sapiens
gaagcagttggggccctct

SEQ ID NO: 871980 - DNA, 20 bp, Homo sapiens
gaagcagttggggccctctt

SEQ ID NO: 871981 - DNA, 15 bp, Homo sapiens
gaagcatggctgtct

SEQ ID NO: 871982 - DNA, 20 bp, Homo sapiens
gaagcatggctgtctgcaca

SEQ ID NO: 871983 - DNA, 23 bp, Homo sapiens
gaagcatggctgtctgcacagag

SEQ ID NO: 871984 - DNA, 12 bp, Homo sapiens
gaagcatgtttc

SEQ ID NO: 871985 - DNA, 14 bp, Homo sapiens
gaagcatgtttcat

SEQ ID NO: 871986 - DNA, 16 bp, Homo sapiens
gaagcatgtttcatgt

SEQ ID NO: 871987 - DNA, 19 bp, Homo sapiens
gaagcatgtttcatgtttt

SEQ ID NO: 871988 - DNA, 20 bp, Homo sapiens
gaagcattaaaatgcatggt

SEQ ID NO: 871989 - DNA, 18 bp, Homo sapiens
gaagcattaacttctctg

SEQ ID NO: 871990 - DNA, 21 bp, Homo sapiens
gaagcattaacttctctggaa

SEQ ID NO: 871991 - DNA, 17 bp, Homo sapiens
gaagcattcagagagca

SEQ ID NO: 871992 - DNA, 22 bp, Homo sapiens
gaagcatttcaaagccctgcct

SEQ ID NO: 871993 - DNA, 20 bp, Homo sapiens
gaagcatttgtattttgtgt

SEQ ID NO: 871994 - DNA, 22 bp, Homo sapiens
gaagcatttgtattttgtgtga

SEQ ID NO: 871995 - DNA, 10 bp, Homo sapiens
gaagccaaag

SEQ ID NO: 871996 - DNA, 12 bp, Homo sapiens
gaagccaaagaa

SEQ ID NO: 871997 - DNA, 16 bp, Homo sapiens
gaagccaaagaaaaat

SEQ ID NO: 871998 - DNA, 20 bp, Homo sapiens
gaagccaagctccctggagc

SEQ ID NO: 871999 - DNA, 20 bp, Homo sapiens
gaagccaagggaaaggggtg

SEQ ID NO: 872000 - DNA, 19 bp, Homo sapiens
gaagccaagtggggtgctg

SEQ ID NO: 872001 - DNA, 22 bp, Homo sapiens
gaagccaagtggggtgctggga

SEQ ID NO: 872002 - DNA, 18 bp, Homo sapiens
gaagccacgctgtcctct

SEQ ID NO: 872003 - DNA, 15 bp, Homo sapiens
gaagccactgaagct

SEQ ID NO: 872004 - DNA, 15 bp, Homo sapiens
gaagccacttggccc

SEQ ID NO: 872005 - DNA, 21 bp, Homo sapiens
gaagccagaaggtgcaggggc

SEQ ID NO: 872006 - DNA, 21 bp, Homo sapiens
gaagccagagccccaagcagg

SEQ ID NO: 872007 - DNA, 22 bp, Homo sapiens
gaagccagagccccaagcagga

SEQ ID NO: 872008 - DNA, 10 bp, Homo sapiens
gaagccagct

SEQ ID NO: 872009 - DNA, 12 bp, Homo sapiens
gaagccaggagc

SEQ ID NO: 872010 - DNA, 14 bp, Homo sapiens
gaagccaggagcaa

SEQ ID NO: 872011 - DNA, 18 bp, Homo sapiens
gaagccaggagcaaatgt

SEQ ID NO: 872012 - DNA, 17 bp, Homo sapiens
gaagccaggaggcctgc

SEQ ID NO: 872013 - DNA, 20 bp, Homo sapiens
gaagccaggaggcctgcacc

SEQ ID NO: 872014 - DNA, 13 bp, Homo sapiens
gaagccaggtaca

SEQ ID NO: 872015 - DNA, 14 bp, Homo sapiens
gaagccaggtacag

SEQ ID NO: 872016 - DNA, 24 bp, Homo sapiens
gaagccaggtacaggagaggcagc

SEQ ID NO: 872017 - DNA, 12 bp, Homo sapiens
gaagccagtgac

SEQ ID NO: 872018 - DNA, 10 bp, Homo sapiens
gaagccatag

SEQ ID NO: 872019 - DNA, 21 bp, Homo sapiens
gaagccatatatgaccagaag

SEQ ID NO: 872020 - DNA, 20 bp, Homo sapiens
gaagccatattcacacctca

SEQ ID NO: 872021 - DNA, 18 bp, Homo sapiens
gaagccatcacttctccc

SEQ ID NO: 872022 - DNA, 19 bp, Homo sapiens
gaagccatcacttctcccc

SEQ ID NO: 872023 - DNA, 22 bp, Homo sapiens
gaagccatcacttctccccgca

SEQ ID NO: 872024 - DNA, 18 bp, Homo sapiens
gaagccatctgacagcag

SEQ ID NO: 872025 - DNA, 14 bp, Homo sapiens
gaagccatgtgggg

SEQ ID NO: 872026 - DNA, 18 bp, Homo sapiens
gaagcccaataaacctct

SEQ ID NO: 872027 - DNA, 18 bp, Homo sapiens
gaagcccaattgctggag

SEQ ID NO: 872028 - DNA, 19 bp, Homo sapiens
gaagcccaccaatctgccc

SEQ ID NO: 872029 - DNA, 23 bp, Homo sapiens
gaagcccagcccctactgctgtg

SEQ ID NO: 872030 - DNA, 20 bp, Homo sapiens
gaagcccagcgacacagaag

SEQ ID NO: 872031 - DNA, 13 bp, Homo sapiens
gaagcccaggctc

SEQ ID NO: 872032 - DNA, 19 bp, Homo sapiens
gaagcccatcctgaccagc

SEQ ID NO: 872033 - DNA, 16 bp, Homo sapiens
gaagcccatgtcttct

SEQ ID NO: 872034 - DNA, 20 bp, Homo sapiens
gaagcccatgtcttctgctg

SEQ ID NO: 872035 - DNA, 15 bp, Homo sapiens
gaagccccgcacggg

SEQ ID NO: 872036 - DNA, 18 bp, Homo sapiens
gaagccccgcacgggctg

SEQ ID NO: 872037 - DNA, 22 bp, Homo sapiens
gaagccccgcacgggctgtctg

SEQ ID NO: 872038 - DNA, 23 bp, Homo sapiens
gaagccccgcacgggctgtctgg

SEQ ID NO: 872039 - DNA, 17 bp, Homo sapiens
gaagccctccaaaagca

SEQ ID NO: 872040 - DNA, 15 bp, Homo sapiens
gaagccctccttcca

SEQ ID NO: 872041 - DNA, 22 bp, Homo sapiens
gaagccctggatttcagaaaga

SEQ ID NO: 872042 - DNA, 14 bp, Homo sapiens
gaagccgactctgg

SEQ ID NO: 872043 - DNA, 20 bp, Homo sapiens
gaagccgccagtacttgtca

SEQ ID NO: 872044 - DNA, 14 bp, Homo sapiens
gaagccgctgctgg

SEQ ID NO: 872045 - DNA, 19 bp, Homo sapiens
gaagccggtgtccctggat

SEQ ID NO: 872046 - DNA, 21 bp, Homo sapiens
gaagccggtgtccctggatgt

SEQ ID NO: 872047 - DNA, 22 bp, Homo sapiens
gaagccgtctgactccagagtc

SEQ ID NO: 872048 - DNA, 23 bp, Homo sapiens
gaagcctccaagcacagagcctg

SEQ ID NO: 872049 - DNA, 20 bp, Homo sapiens
gaagcctccaagcctgcctc

SEQ ID NO: 872050 - DNA, 21 bp, Homo sapiens
gaagcctccaagcctgcctcc

SEQ ID NO: 872051 - DNA, 19 bp, Homo sapiens
gaagcctctctccttggcc

SEQ ID NO: 872052 - DNA, 13 bp, Homo sapiens
gaagcctctggct

SEQ ID NO: 872053 - DNA, 17 bp, Homo sapiens
gaagcctctggctagag

SEQ ID NO: 872054 - DNA, 18 bp, Homo sapiens
gaagcctgaactgaggcc

SEQ ID NO: 872055 - DNA, 22 bp, Homo sapiens
gaagcctgaactgaggccttgt

SEQ ID NO: 872056 - DNA, 20 bp, Homo sapiens
gaagcctggattccagcagt

SEQ ID NO: 872057 - DNA, 18 bp, Homo sapiens
gaagcctgtgccagcacc

SEQ ID NO: 872058 - DNA, 22 bp, Homo sapiens
gaagccttgcctaaatttaatg

SEQ ID NO: 872059 - DNA, 12 bp, Homo sapiens
gaagccttgctg

SEQ ID NO: 872060 - DNA, 16 bp, Homo sapiens
gaagccttgctgaact

SEQ ID NO: 872061 - DNA, 21 bp, Homo sapiens
gaagccttgctgaactaagtt

SEQ ID NO: 872062 - DNA, 16 bp, Homo sapiens
gaagccttggaaccag

SEQ ID NO: 872063 - DNA, 15 bp, Homo sapiens
gaagcctttcctgta

SEQ ID NO: 872064 - DNA, 13 bp, Homo sapiens
gaagcgactctcc

SEQ ID NO: 872065 - DNA, 23 bp, Homo sapiens
gaagcgcagcagcgggagctagg

SEQ ID NO: 872066 - DNA, 14 bp, Homo sapiens
gaagcgccaggctg

SEQ ID NO: 872067 - DNA, 19 bp, Homo sapiens
gaagcgccaggctggagat

SEQ ID NO: 872068 - DNA, 22 bp, Homo sapiens
gaagcgcctcagttacacagga

SEQ ID NO: 872069 - DNA, 18 bp, Homo sapiens
gaagcgcggctaacttat

SEQ ID NO: 872070 - DNA, 14 bp, Homo sapiens
gaagcggctggcag

SEQ ID NO: 872071 - DNA, 22 bp, Homo sapiens
gaagcggtggataactagccag

SEQ ID NO: 872072 - DNA, 18 bp, Homo sapiens
gaagcgttatgtgcagta

SEQ ID NO: 872073 - DNA, 13 bp, Homo sapiens
gaagcgtttttaa

SEQ ID NO: 872074 - DNA, 14 bp, Homo sapiens
gaagctaaagtcat

SEQ ID NO: 872075 - DNA, 21 bp, Homo sapiens
gaagctaaagtcatccatcct

SEQ ID NO: 872076 - DNA, 13 bp, Homo sapiens
gaagctaattgta

SEQ ID NO: 872077 - DNA, 14 bp, Homo sapiens
gaagctaatttgca

SEQ ID NO: 872078 - DNA, 15 bp, Homo sapiens
gaagctaatttgcat

SEQ ID NO: 872079 - DNA, 16 bp, Homo sapiens
gaagctaatttgcatt

SEQ ID NO: 872080 - DNA, 23 bp, Homo sapiens
gaagctactgtgtgtgtgaatga

SEQ ID NO: 872081 - DNA, 14 bp, Homo sapiens
gaagctagtctttt

SEQ ID NO: 872082 - DNA, 16 bp, Homo sapiens
gaagctagtcttttgc

SEQ ID NO: 872083 - DNA, 19 bp, Homo sapiens
gaagctataaattcctctt

SEQ ID NO: 872084 - DNA, 21 bp, Homo sapiens
gaagctcacactgatgggctg

SEQ ID NO: 872085 - DNA, 15 bp, Homo sapiens
gaagctcagcccacc

SEQ ID NO: 872086 - DNA, 22 bp, Homo sapiens
gaagctcagcccacccccctca

SEQ ID NO: 872087 - DNA, 12 bp, Homo sapiens
gaagctcagctg

SEQ ID NO: 872088 - DNA, 16 bp, Homo sapiens
gaagctccactgtcac

SEQ ID NO: 872089 - DNA, 22 bp, Homo sapiens
gaagctccagatccagtatctt

SEQ ID NO: 872090 - DNA, 12 bp, Homo sapiens
gaagctccttcc

SEQ ID NO: 872091 - DNA, 19 bp, Homo sapiens
gaagctcgcatccagacag

SEQ ID NO: 872092 - DNA, 17 bp, Homo sapiens
gaagctctcttaaaata

SEQ ID NO: 872093 - DNA, 16 bp, Homo sapiens
gaagctctgaagtcac

SEQ ID NO: 872094 - DNA, 12 bp, Homo sapiens
gaagctctggct

SEQ ID NO: 872095 - DNA, 19 bp, Homo sapiens
gaagctctggctgaaccct

SEQ ID NO: 872096 - DNA, 20 bp, Homo sapiens
gaagctcttactctttccta

SEQ ID NO: 872097 - DNA, 13 bp, Homo sapiens
gaagctcttggac

SEQ ID NO: 872098 - DNA, 20 bp, Homo sapiens
gaagctcttggagctgtgag

SEQ ID NO: 872099 - DNA, 16 bp, Homo sapiens
gaagctgaagcccccc

SEQ ID NO: 872100 - DNA, 19 bp, Homo sapiens
gaagctgaagccccccttt

SEQ ID NO: 872101 - DNA, 22 bp, Homo sapiens
gaagctgaagtgcatccaaagg

SEQ ID NO: 872102 - DNA, 12 bp, Homo sapiens
gaagctgaggcc

SEQ ID NO: 872103 - DNA, 18 bp, Homo sapiens
gaagctgaggcgggagaa

SEQ ID NO: 872104 - DNA, 15 bp, Homo sapiens
gaagctgcagatctt

SEQ ID NO: 872105 - DNA, 22 bp, Homo sapiens
gaagctgccaggtgagaaactg

SEQ ID NO: 872106 - DNA, 16 bp, Homo sapiens
gaagctgccctgccca

SEQ ID NO: 872107 - DNA, 22 bp, Homo sapiens
gaagctgctgaccaattgtgct

SEQ ID NO: 872108 - DNA, 12 bp, Homo sapiens
gaagctgctgtg

SEQ ID NO: 872109 - DNA, 13 bp, Homo sapiens
gaagctgctgtgt

SEQ ID NO: 872110 - DNA, 14 bp, Homo sapiens
gaagctggagcagc

SEQ ID NO: 872111 - DNA, 17 bp, Homo sapiens
gaagctggcagaacgga

SEQ ID NO: 872112 - DNA, 23 bp, Homo sapiens
gaagctggccgagggtcctggct

SEQ ID NO: 872113 - DNA, 19 bp, Homo sapiens
gaagctggcctgagagggg

SEQ ID NO: 872114 - DNA, 22 bp, Homo sapiens
gaagctggcctgagaggggaag

SEQ ID NO: 872115 - DNA, 14 bp, Homo sapiens
gaagctggcctgga

SEQ ID NO: 872116 - DNA, 13 bp, Homo sapiens
gaagctgggccca

SEQ ID NO: 872117 - DNA, 14 bp, Homo sapiens
gaagctgggcccaa

SEQ ID NO: 872118 - DNA, 18 bp, Homo sapiens
gaagctgggcccaaaggc

SEQ ID NO: 872119 - DNA, 21 bp, Homo sapiens
gaagctgggcccaaaggccca

SEQ ID NO: 872120 - DNA, 13 bp, Homo sapiens
gaagctgggctgt

SEQ ID NO: 872121 - DNA, 13 bp, Homo sapiens
gaagctgggggaa

SEQ ID NO: 872122 - DNA, 17 bp, Homo sapiens
gaagctgggggaagggt

SEQ ID NO: 872123 - DNA, 19 bp, Homo sapiens
gaagctgggggaagggtgg

SEQ ID NO: 872124 - DNA, 16 bp, Homo sapiens
gaagctgtactcagag

SEQ ID NO: 872125 - DNA, 20 bp, Homo sapiens
gaagctgtactcagagcaga

SEQ ID NO: 872126 - DNA, 23 bp, Homo sapiens
gaagctgtagtagccctttctgt

SEQ ID NO: 872127 - DNA, 17 bp, Homo sapiens
gaagctgtcaggctggg

SEQ ID NO: 872128 - DNA, 23 bp, Homo sapiens
gaagctgtgtccttgcacctgca

SEQ ID NO: 872129 - DNA, 16 bp, Homo sapiens
gaagctgttgtgtgag

SEQ ID NO: 872130 - DNA, 17 bp, Homo sapiens
gaagcttccacaaaatt

SEQ ID NO: 872131 - DNA, 22 bp, Homo sapiens
gaagcttccacaaaattagaaa

SEQ ID NO: 872132 - DNA, 13 bp, Homo sapiens
gaagcttctaatt

SEQ ID NO: 872133 - DNA, 15 bp, Homo sapiens
gaagctttaagcaaa

SEQ ID NO: 872134 - DNA, 14 bp, Homo sapiens
gaaggaaaatattt

SEQ ID NO: 872135 - DNA, 15 bp, Homo sapiens
gaaggaaacaaatgt

SEQ ID NO: 872136 - DNA, 19 bp, Homo sapiens
gaaggaaagaaagaaggaa

SEQ ID NO: 872137 - DNA, 23 bp, Homo sapiens
gaaggaaagcatgtctctgcttc

SEQ ID NO: 872138 - DNA, 14 bp, Homo sapiens
gaaggaaataaagg

SEQ ID NO: 872139 - DNA, 14 bp, Homo sapiens
gaaggaaatgatgg

SEQ ID NO: 872140 - DNA, 18 bp, Homo sapiens
gaaggaaatgatggaatt

SEQ ID NO: 872141 - DNA, 14 bp, Homo sapiens
gaaggaacaaagac

SEQ ID NO: 872142 - DNA, 20 bp, Homo sapiens
gaaggaactctggcttccag

SEQ ID NO: 872143 - DNA, 22 bp, Homo sapiens
gaaggaactctggcttccaggt

SEQ ID NO: 872144 - DNA, 16 bp, Homo sapiens
gaaggaagagaagaca

SEQ ID NO: 872145 - DNA, 15 bp, Homo sapiens
gaaggaaggagggca

SEQ ID NO: 872146 - DNA, 21 bp, Homo sapiens
gaagggttggtgggctggccc

SEQ ID NO: 872147 - DNA, 22 bp, Homo sapiens
gaagggttggtgggctggccca

SEQ ID NO: 872148 - DNA, 14 bp, Homo sapiens
gaagggtttctcta

SEQ ID NO: 872149 - DNA, 21 bp, Homo sapiens
gaagggtttgtggctgggggc

SEQ ID NO: 872150 - DNA, 20 bp, Homo sapiens
gaagggttttccaccctgga

SEQ ID NO: 872151 - DNA, 17 bp, Homo sapiens
gaaggtaaataaaaaga

SEQ ID NO: 872152 - DNA, 17 bp, Homo sapiens
gaaggtcacctgagccc

SEQ ID NO: 872153 - DNA, 21 bp, Homo sapiens
gaaggtccttgcctgaactcc

SEQ ID NO: 872154 - DNA, 17 bp, Homo sapiens
gaaggtctattggccaa

SEQ ID NO: 872155 - DNA, 14 bp, Homo sapiens
gaaggtctccaagg

SEQ ID NO: 872156 - DNA, 17 bp, Homo sapiens
gaaggtgataagggaaa

SEQ ID NO: 872157 - DNA, 18 bp, Homo sapiens
gaaggtgcatctttccct

SEQ ID NO: 872158 - DNA, 18 bp, Homo sapiens
gaaggtgccagaaggaag

SEQ ID NO: 872159 - DNA, 22 bp, Homo sapiens
gaaggtgccccaaaatgcaaga

SEQ ID NO: 872160 - DNA, 13 bp, Homo sapiens
gaaggtgcctggc

SEQ ID NO: 872161 - DNA, 15 bp, Homo sapiens
gaaggtgctgagctt

SEQ ID NO: 872162 - DNA, 22 bp, Homo sapiens
gaaggtgctgagcttagccttg

SEQ ID NO: 872163 - DNA, 14 bp, Homo sapiens
gaaggtggggccct

SEQ ID NO: 872164 - DNA, 17 bp, Homo sapiens
gaaggtggggccctgcc

SEQ ID NO: 872165 - DNA, 17 bp, Homo sapiens
gaaggtggtggggctgc

SEQ ID NO: 872166 - DNA, 18 bp, Homo sapiens
gaaggttagaaaggcagc

SEQ ID NO: 872167 - DNA, 16 bp, Homo sapiens
gaaggttcccaaggac

SEQ ID NO: 872168 - DNA, 15 bp, Homo sapiens
gaaggttgctgtggg

SEQ ID NO: 872169 - DNA, 17 bp, Homo sapiens
gaaggtttcagatgagg

SEQ ID NO: 872170 - DNA, 22 bp, Homo sapiens
gaaggtttgtgttttctctgga

SEQ ID NO: 872171 - DNA, 21 bp, Homo sapiens
gaaggttttttttttaagtgc

SEQ ID NO: 872172 - DNA, 16 bp, Homo sapiens
gaagtaaactttttgt

SEQ ID NO: 872173 - DNA, 20 bp, Homo sapiens
gaagtaaactttttgttctg

SEQ ID NO: 872174 - DNA, 15 bp, Homo sapiens
gaagtaaagcctcaa

SEQ ID NO: 872175 - DNA, 17 bp, Homo sapiens
gaagtaagtggggttgc

SEQ ID NO: 872176 - DNA, 20 bp, Homo sapiens
gaagtaatatgcacacattt

SEQ ID NO: 872177 - DNA, 19 bp, Homo sapiens
gaagtacagtagtttccct

SEQ ID NO: 872178 - DNA, 15 bp, Homo sapiens
gaagtagctagtagc

SEQ ID NO: 872179 - DNA, 21 bp, Homo sapiens
gaagtatacctggctttttaa

SEQ ID NO: 872180 - DNA, 18 bp, Homo sapiens
gaagtatacttttcccct

SEQ ID NO: 872181 - DNA, 19 bp, Homo sapiens
gaagtattttgctggaata

SEQ ID NO: 872182 - DNA, 16 bp, Homo sapiens
gaagtcaaagcaagga

SEQ ID NO: 872183 - DNA, 15 bp, Homo sapiens
gaagtcactgcacag

SEQ ID NO: 872184 - DNA, 14 bp, Homo sapiens
gaagtcagccacac

SEQ ID NO: 872185 - DNA, 20 bp, Homo sapiens
gaagtcagcccgaatgcctg

SEQ ID NO: 872186 - DNA, 18 bp, Homo sapiens
gaagtcatcttgctacca

SEQ ID NO: 872187 - DNA, 15 bp, Homo sapiens
gaagtcatgaagccc

SEQ ID NO: 872188 - DNA, 19 bp, Homo sapiens
gaagtcatgaagcccaagt

SEQ ID NO: 872189 - DNA, 21 bp, Homo sapiens
gaagtcctgggaggatcctga

SEQ ID NO: 872190 - DNA, 15 bp, Homo sapiens
gaagtctaggagctg

SEQ ID NO: 872191 - DNA, 16 bp, Homo sapiens
gaagtctggctttgct

SEQ ID NO: 872192 - DNA, 18 bp, Homo sapiens
gaagtctggctttgctct

SEQ ID NO: 872193 - DNA, 15 bp, Homo sapiens
gaagtcttagatgta

SEQ ID NO: 872194 - DNA, 16 bp, Homo sapiens
gaagtcttttctgtca

SEQ ID NO: 872195 - DNA, 15 bp, Homo sapiens
gaagtctttttcatt

SEQ ID NO: 872196 - DNA, 14 bp, Homo sapiens
gaagtgaacatttc

SEQ ID NO: 872197 - DNA, 17 bp, Homo sapiens
gaagtgaataactgcaa

SEQ ID NO: 872198 - DNA, 13 bp, Homo sapiens
gaagtgagagaaa

SEQ ID NO: 872199 - DNA, 19 bp, Homo sapiens
gaagtgagagctttgctta

SEQ ID NO: 872200 - DNA, 18 bp, Homo sapiens
gaagtgagctttgctgct

SEQ ID NO: 872201 - DNA, 14 bp, Homo sapiens
gaagtgaggcccaa

SEQ ID NO: 872202 - DNA, 15 bp, Homo sapiens
gaagtgaggcccaag

SEQ ID NO: 872203 - DNA, 18 bp, Homo sapiens
gaagtgagtttgtaaata

SEQ ID NO: 872204 - DNA, 19 bp, Homo sapiens
gaagtgagtttgtaaatat

SEQ ID NO: 872205 - DNA, 15 bp, Homo sapiens
gaagtgattctaaga

SEQ ID NO: 872206 - DNA, 23 bp, Homo sapiens
gaagtgatttagttgtggaaaga

SEQ ID NO: 872207 - DNA, 18 bp, Homo sapiens
gaagtgcagtcagcagat

SEQ ID NO: 872208 - DNA, 16 bp, Homo sapiens
gaagtgcatctacttg

SEQ ID NO: 872209 - DNA, 13 bp, Homo sapiens
gaagtgcccctgc

SEQ ID NO: 872210 - DNA, 14 bp, Homo sapiens
gaagtgcccctgct

SEQ ID NO: 872211 - DNA, 14 bp, Homo sapiens
gaagtgcctactgg

SEQ ID NO: 872212 - DNA, 16 bp, Homo sapiens
gaagtgcgtgaatgta

SEQ ID NO: 872213 - DNA, 21 bp, Homo sapiens
gaagtgctctaacttttctta

SEQ ID NO: 872214 - DNA, 18 bp, Homo sapiens
gaagtgctcttggctgac

SEQ ID NO: 872215 - DNA, 22 bp, Homo sapiens
gaagtgctcttggctgacccct

SEQ ID NO: 872216 - DNA, 16 bp, Homo sapiens
gaagtggaccaggaca

SEQ ID NO: 872217 - DNA, 18 bp, Homo sapiens
gaagtggaggttgctgta

SEQ ID NO: 872218 - DNA, 17 bp, Homo sapiens
gaagtggccctccctca

SEQ ID NO: 872219 - DNA, 17 bp, Homo sapiens
gaagtggcctcttggat

SEQ ID NO: 872220 - DNA, 12 bp, Homo sapiens
gaagtggctggt

SEQ ID NO: 872221 - DNA, 15 bp, Homo sapiens
gaagtggctggtaga

SEQ ID NO: 872222 - DNA, 19 bp, Homo sapiens
gaagtggctggtagaaaaa

SEQ ID NO: 872223 - DNA, 20 bp, Homo sapiens
gaagtggctggtagaaaaag

SEQ ID NO: 872224 - DNA, 15 bp, Homo sapiens
gaagtggctggtctg

SEQ ID NO: 872225 - DNA, 17 bp, Homo sapiens
gaagtggctggtctgga

SEQ ID NO: 872226 - DNA, 13 bp, Homo sapiens
gaagtgggagcag

SEQ ID NO: 872227 - DNA, 22 bp, Homo sapiens
gaagtgggagcagcttcttggg

SEQ ID NO: 872228 - DNA, 21 bp, Homo sapiens
gaagtgggccaggacaggccc

SEQ ID NO: 872229 - DNA, 15 bp, Homo sapiens
gaagtggggacagat

SEQ ID NO: 872230 - DNA, 17 bp, Homo sapiens
gaagtggggacagattc

SEQ ID NO: 872231 - DNA, 14 bp, Homo sapiens
gaagtgtaacagct

SEQ ID NO: 872232 - DNA, 18 bp, Homo sapiens
gaagtgtaacagctgagg

SEQ ID NO: 872233 - DNA, 16 bp, Homo sapiens
gaagtgtaggcagaca

SEQ ID NO: 872234 - DNA, 17 bp, Homo sapiens
gaagtgtcaccctgtgg

SEQ ID NO: 872235 - DNA, 15 bp, Homo sapiens
gaagtgtggctggtg

SEQ ID NO: 872236 - DNA, 18 bp, Homo sapiens
gaagtgtggctggtgtcc

SEQ ID NO: 872237 - DNA, 20 bp, Homo sapiens
gaagtgtggctggtgtcccc

SEQ ID NO: 872238 - DNA, 21 bp, Homo sapiens
gaagtgtgtccatcctgacct

SEQ ID NO: 872239 - DNA, 10 bp, Homo sapiens
gaagtgttca

SEQ ID NO: 872240 - DNA, 15 bp, Homo sapiens
gaagtgttgcatgga

SEQ ID NO: 872241 - DNA, 23 bp, Homo sapiens
gaagttacacagaaatgctgctg

SEQ ID NO: 872242 - DNA, 20 bp, Homo sapiens
gaagttactttttgtagaga

SEQ ID NO: 872243 - DNA, 15 bp, Homo sapiens
gaagttagtttgtat

SEQ ID NO: 872244 - DNA, 23 bp, Homo sapiens
gaagttattaacgggcatgtatt

SEQ ID NO: 872245 - DNA, 14 bp, Homo sapiens
gaagttattttcca

SEQ ID NO: 872246 - DNA, 20 bp, Homo sapiens
gaagttcagaaggtgtgtcc

SEQ ID NO: 872247 - DNA, 14 bp, Homo sapiens
gaagttcttcaaga

SEQ ID NO: 872248 - DNA, 17 bp, Homo sapiens
gaagttcttcaagagga

SEQ ID NO: 872249 - DNA, 15 bp, Homo sapiens
gaagttctttgatcc

SEQ ID NO: 872250 - DNA, 21 bp, Homo sapiens
gaagttgacttatagtacatg

SEQ ID NO: 872251 - DNA, 21 bp, Homo sapiens
gaatctggaccccatctgtga

SEQ ID NO: 872252 - DNA, 22 bp, Homo sapiens
gaatctggaccccatctgtgaa

SEQ ID NO: 872253 - DNA, 12 bp, Homo sapiens
gaatctggagac

SEQ ID NO: 872254 - DNA, 12 bp, Homo sapiens
gaatctgtacat

SEQ ID NO: 872255 - DNA, 21 bp, Homo sapiens
gaatctgtacatgttcttgtc

SEQ ID NO: 872256 - DNA, 17 bp, Homo sapiens
gaatctgtgctggccat

SEQ ID NO: 872257 - DNA, 14 bp, Homo sapiens
gaatctgtttctct

SEQ ID NO: 872258 - DNA, 15 bp, Homo sapiens
gaatctgtttctctg

SEQ ID NO: 872259 - DNA, 18 bp, Homo sapiens
gaatctgtttctctgctg

SEQ ID NO: 872260 - DNA, 21 bp, Homo sapiens
gaatcttaatcgatgaatgta

SEQ ID NO: 872261 - DNA, 22 bp, Homo sapiens
gaatcttaatcgatgaatgtaa

SEQ ID NO: 872262 - DNA, 18 bp, Homo sapiens
gaatcttaatgcttgtaa

SEQ ID NO: 872263 - DNA, 17 bp, Homo sapiens
gaatcttccatctgcat

SEQ ID NO: 872264 - DNA, 11 bp, Homo sapiens
gaatcttctca

SEQ ID NO: 872265 - DNA, 14 bp, Homo sapiens
gaatcttctgggta

SEQ ID NO: 872266 - DNA, 17 bp, Homo sapiens
gaatcttgactttctga

SEQ ID NO: 872267 - DNA, 22 bp, Homo sapiens
gaatcttgctgcaggccctccc

SEQ ID NO: 872268 - DNA, 20 bp, Homo sapiens
gaatcttgttttgaaaataa

SEQ ID NO: 872269 - DNA, 17 bp, Homo sapiens
gaatctttattgagaaa

SEQ ID NO: 872270 - DNA, 18 bp, Homo sapiens
gaatctttcatacatata

SEQ ID NO: 872271 - DNA, 20 bp, Homo sapiens
gaatctttccaataaaccag

SEQ ID NO: 872272 - DNA, 15 bp, Homo sapiens
gaatcttttataatg

SEQ ID NO: 872273 - DNA, 17 bp, Homo sapiens
gaatcttttataatgat

SEQ ID NO: 872274 - DNA, 22 bp, Homo sapiens
gaatgaaaaatttaagcattgt

SEQ ID NO: 872275 - DNA, 23 bp, Homo sapiens
gaatgaaaataactgaatttgga

SEQ ID NO: 872276 - DNA, 20 bp, Homo sapiens
gaatgttaagacttgacagt

SEQ ID NO: 872277 - DNA, 22 bp, Homo sapiens
gaatgttaattttttggtacaa

SEQ ID NO: 872278 - DNA, 14 bp, Homo sapiens
gaatgttccctgca

SEQ ID NO: 872279 - DNA, 11 bp, Homo sapiens
gaatgttctga

SEQ ID NO: 872280 - DNA, 15 bp, Homo sapiens
gaatgttctgacatt

SEQ ID NO: 872281 - DNA, 16 bp, Homo sapiens
gaatgttctgacatta

SEQ ID NO: 872282 - DNA, 19 bp, Homo sapiens
gaatgttctgacattaaca

SEQ ID NO: 872283 - DNA, 20 bp, Homo sapiens
gaatgttgcaatgtgaaaaa

SEQ ID NO: 872284 - DNA, 22 bp, Homo sapiens
gaatgtttcatttgcacaagta

SEQ ID NO: 872285 - DNA, 14 bp, Homo sapiens
gaatgtttgtctca

SEQ ID NO: 872286 - DNA, 15 bp, Homo sapiens
gaatgttttaaattc

SEQ ID NO: 872287 - DNA, 18 bp, Homo sapiens
gaatgttttatttatcaa

SEQ ID NO: 872288 - DNA, 19 bp, Homo sapiens
gaatgtttttccctcccca

SEQ ID NO: 872289 - DNA, 21 bp, Homo sapiens
gaatgtttttccctccccaga

SEQ ID NO: 872290 - DNA, 18 bp, Homo sapiens
gaattaaaacaaaacaaa

SEQ ID NO: 872291 - DNA, 15 bp, Homo sapiens
gaattaaaataaaac

SEQ ID NO: 872292 - DNA, 15 bp, Homo sapiens
gaattaaaatggttt

SEQ ID NO: 872293 - DNA, 20 bp, Homo sapiens
gaattaaacccacaagctgc

SEQ ID NO: 872294 - DNA, 22 bp, Homo sapiens
gaattaaacccacaagctgcct

SEQ ID NO: 872295 - DNA, 23 bp, Homo sapiens
gaattaaacccacaagctgcctc

SEQ ID NO: 872296 - DNA, 12 bp, Homo sapiens
gaattaaataaa

SEQ ID NO: 872297 - DNA, 15 bp, Homo sapiens
gaattaaatagtgtg

SEQ ID NO: 872298 - DNA, 21 bp, Homo sapiens
gaattaaattaggaataaata

SEQ ID NO: 872299 - DNA, 20 bp, Homo sapiens
gaattaacacagtgtttcaa

SEQ ID NO: 872300 - DNA, 21 bp, Homo sapiens
gaattaacacagtgtttcaat

SEQ ID NO: 872301 - DNA, 16 bp, Homo sapiens
gaattaaccatttaat

SEQ ID NO: 872302 - DNA, 18 bp, Homo sapiens
gaattaaccatttaataa

SEQ ID NO: 872303 - DNA, 22 bp, Homo sapiens
gaattaaccatttaataaagaa

SEQ ID NO: 872304 - DNA, 16 bp, Homo sapiens
gaattaagaggataca

SEQ ID NO: 872305 - DNA, 17 bp, Homo sapiens
gaattaagatacaaatt

SEQ ID NO: 872306 - DNA, 20 bp, Homo sapiens
gaattaagttatctttaaaa

SEQ ID NO: 872307 - DNA, 17 bp, Homo sapiens
gaattaattcagatgtt

SEQ ID NO: 872308 - DNA, 15 bp, Homo sapiens
gaattaatttctaaa

SEQ ID NO: 872309 - DNA, 21 bp, Homo sapiens
gaattacaaccattgtatttt

SEQ ID NO: 872310 - DNA, 18 bp, Homo sapiens
gaattaccatagagtaat

SEQ ID NO: 872311 - DNA, 22 bp, Homo sapiens
gaattaccttagattagctctg

SEQ ID NO: 872312 - DNA, 15 bp, Homo sapiens
gaattactgtatata

SEQ ID NO: 872313 - DNA, 18 bp, Homo sapiens
gaattactgtatataaac

SEQ ID NO: 872314 - DNA, 16 bp, Homo sapiens
gaattactttcctcct

SEQ ID NO: 872315 - DNA, 18 bp, Homo sapiens
gaattactttcctcctcc

SEQ ID NO: 872316 - DNA, 20 bp, Homo sapiens
gaattagaaaagttaacatt

SEQ ID NO: 872317 - DNA, 15 bp, Homo sapiens
gaattagaaaattag

SEQ ID NO: 872318 - DNA, 16 bp, Homo sapiens
gaattagagggccttg

SEQ ID NO: 872319 - DNA, 18 bp, Homo sapiens
gaattagagggccttgct

SEQ ID NO: 872320 - DNA, 15 bp, Homo sapiens
gaattaggctgtaac

SEQ ID NO: 872321 - DNA, 20 bp, Homo sapiens
gaattataaatgtgtttata

SEQ ID NO: 872322 - DNA, 15 bp, Homo sapiens
gaattataacagtta

SEQ ID NO: 872323 - DNA, 21 bp, Homo sapiens
gaattataacagttatatttt

SEQ ID NO: 872324 - DNA, 13 bp, Homo sapiens
gaattataactgt

SEQ ID NO: 872325 - DNA, 21 bp, Homo sapiens
gaattataactgtaaagatgt

SEQ ID NO: 872326 - DNA, 14 bp, Homo sapiens
gaattatatatttc

SEQ ID NO: 872327 - DNA, 15 bp, Homo sapiens
gaattatcagcaaag

SEQ ID NO: 872328 - DNA, 16 bp, Homo sapiens
gaattatcagcaaaga

SEQ ID NO: 872329 - DNA, 18 bp, Homo sapiens
gaattatcagcaaagaaa

SEQ ID NO: 872330 - DNA, 14 bp, Homo sapiens
gaattatccattac

SEQ ID NO: 872331 - DNA, 16 bp, Homo sapiens
gaattatccattacgt

SEQ ID NO: 872332 - DNA, 22 bp, Homo sapiens
gaattatccattacgtgcattt

SEQ ID NO: 872333 - DNA, 23 bp, Homo sapiens
gaattatccattacgtgcattta

SEQ ID NO: 872334 - DNA, 20 bp, Homo sapiens
gaattatcttggttgaaaat

SEQ ID NO: 872335 - DNA, 20 bp, Homo sapiens
gaattatgtaatatattgta

SEQ ID NO: 872336 - DNA, 23 bp, Homo sapiens
gaattatgtaatatattgtacaa

SEQ ID NO: 872337 - DNA, 15 bp, Homo sapiens
gaattatgttttgac

SEQ ID NO: 872338 - DNA, 20 bp, Homo sapiens
gaattattcaatttatttga

SEQ ID NO: 872339 - DNA, 20 bp, Homo sapiens
gaattattctgattcttttt

SEQ ID NO: 872340 - DNA, 12 bp, Homo sapiens
gaattattgaca

SEQ ID NO: 872341 - DNA, 14 bp, Homo sapiens
gaattatttctgtc

SEQ ID NO: 872342 - DNA, 20 bp, Homo sapiens
gaattattttgaatgtcaca

SEQ ID NO: 872343 - DNA, 15 bp, Homo sapiens
gaattatttttcact

SEQ ID NO: 872344 - DNA, 20 bp, Homo sapiens
gaattcaaaagtgattatct

SEQ ID NO: 872345 - DNA, 18 bp, Homo sapiens
gaattcaaactggggcct

SEQ ID NO: 872346 - DNA, 23 bp, Homo sapiens
gaattcaaactggggcctccaga

SEQ ID NO: 872347 - DNA, 17 bp, Homo sapiens
gaattcaagaaaggaaa

SEQ ID NO: 872348 - DNA, 23 bp, Homo sapiens
gaattcaccagtgttcctgaagc

SEQ ID NO: 872349 - DNA, 16 bp, Homo sapiens
gaattcagattttaaa

SEQ ID NO: 872350 - DNA, 17 bp, Homo sapiens
gaattcagcaccctggg

SEQ ID NO: 872351 - DNA, 16 bp, Homo sapiens
gaattcagcagtttta

SEQ ID NO: 872352 - DNA, 17 bp, Homo sapiens
gaattcagcagttttat

SEQ ID NO: 872353 - DNA, 15 bp, Homo sapiens
gaattccaacttgaa

SEQ ID NO: 872354 - DNA, 13 bp, Homo sapiens
gaattccaaggag

SEQ ID NO: 872355 - DNA, 14 bp, Homo sapiens
gaattcccagactc

SEQ ID NO: 872356 - DNA, 12 bp, Homo sapiens
gaattccctccc

SEQ ID NO: 872357 - DNA, 16 bp, Homo sapiens
gaattcctaaaattat

SEQ ID NO: 872358 - DNA, 13 bp, Homo sapiens
gaattcctctttt

SEQ ID NO: 872359 - DNA, 21 bp, Homo sapiens
gaattcctcttttgcttaaat

SEQ ID NO: 872360 - DNA, 15 bp, Homo sapiens
gaattcctgaagcca

SEQ ID NO: 872361 - DNA, 19 bp, Homo sapiens
gaattccttcgaaaggcct

SEQ ID NO: 872362 - DNA, 15 bp, Homo sapiens
gaattccttctaaga

SEQ ID NO: 872363 - DNA, 22 bp, Homo sapiens
gaattcctttacaactaaataa

SEQ ID NO: 872364 - DNA, 18 bp, Homo sapiens
gaatgtaatcaatgtttc

SEQ ID NO: 872365 - DNA, 16 bp, Homo sapiens
gaatgtaattggaatc

SEQ ID NO: 872366 - DNA, 20 bp, Homo sapiens
gaatgtactatgtctgaaca

SEQ ID NO: 872367 - DNA, 14 bp, Homo sapiens
gaatgtactctgtt

SEQ ID NO: 872368 - DNA, 20 bp, Homo sapiens
gaatgtagctggtttcctca

SEQ ID NO: 872369 - DNA, 18 bp, Homo sapiens
gaatgtagcttccacctc

SEQ ID NO: 872370 - DNA, 21 bp, Homo sapiens
gaatgtatatgttttgtggga

SEQ ID NO: 872371 - DNA, 14 bp, Homo sapiens
gaatgtatctgtga

SEQ ID NO: 872372 - DNA, 17 bp, Homo sapiens
gaatgtatctgtgaagt

SEQ ID NO: 872373 - DNA, 16 bp, Homo sapiens
gaatgtattattctgc

SEQ ID NO: 872374 - DNA, 18 bp, Homo sapiens
gaatgtattattctgcag

SEQ ID NO: 872375 - DNA, 13 bp, Homo sapiens
gaatgtatttatt

SEQ ID NO: 872376 - DNA, 16 bp, Homo sapiens
gaatgtatttatttgg

SEQ ID NO: 872377 - DNA, 23 bp, Homo sapiens
gaatgtatttatttgggagaccg

SEQ ID NO: 872378 - DNA, 13 bp, Homo sapiens
gaatgtatttgat

SEQ ID NO: 872379 - DNA, 22 bp, Homo sapiens
gaatgtcaatgccaggatttct

SEQ ID NO: 872380 - DNA, 16 bp, Homo sapiens
gaatgtcacaaattga

SEQ ID NO: 872381 - DNA, 22 bp, Homo sapiens
gaatgtcacatttgaattcttg

SEQ ID NO: 872382 - DNA, 16 bp, Homo sapiens
gaatgtcagatttctg

SEQ ID NO: 872383 - DNA, 19 bp, Homo sapiens
gaatgtcagatttctggtt

SEQ ID NO: 872384 - DNA, 22 bp, Homo sapiens
gaatgtctttgttggaaaagaa

SEQ ID NO: 872385 - DNA, 16 bp, Homo sapiens
gaatgtgaaaaaggaa

SEQ ID NO: 872386 - DNA, 15 bp, Homo sapiens
gaatgtgaaatttaa

SEQ ID NO: 872387 - DNA, 15 bp, Homo sapiens
gaatgtgccacctgt

SEQ ID NO: 872388 - DNA, 16 bp, Homo sapiens
gaatgtgcccctggcc

SEQ ID NO: 872389 - DNA, 18 bp, Homo sapiens
gaatgtgcccctggccca

SEQ ID NO: 872390 - DNA, 12 bp, Homo sapiens
gaatgtgctggt

SEQ ID NO: 872391 - DNA, 19 bp, Homo sapiens
gaatgtgctggtgaacact

SEQ ID NO: 872392 - DNA, 18 bp, Homo sapiens
gaatgtggataaaactgt

SEQ ID NO: 872393 - DNA, 16 bp, Homo sapiens
gaatgtggtctcagga

SEQ ID NO: 872394 - DNA, 22 bp, Homo sapiens
gaatgtggttacttcctactgt

SEQ ID NO: 872395 - DNA, 17 bp, Homo sapiens
gaatgtgtgtgtgtggc

SEQ ID NO: 872396 - DNA, 11 bp, Homo sapiens
gaattgtcttg

SEQ ID NO: 872397 - DNA, 13 bp, Homo sapiens
gaattgtcttgat

SEQ ID NO: 872398 - DNA, 20 bp, Homo sapiens
gaattgtggctatcctgatt

SEQ ID NO: 872399 - DNA, 22 bp, Homo sapiens
gaattgtgtattgatgcaatat

SEQ ID NO: 872400 - DNA, 18 bp, Homo sapiens
gaattgtgtgttaatgtc

SEQ ID NO: 872401 - DNA, 17 bp, Homo sapiens
gaattgtttttgtacag

SEQ ID NO: 872402 - DNA, 20 bp, Homo sapiens
gaatttaaaattaagtagaa

SEQ ID NO: 872403 - DNA, 13 bp, Homo sapiens
gaatttaaataaa

SEQ ID NO: 872404 - DNA, 13 bp, Homo sapiens
gaatttaaatata

SEQ ID NO: 872405 - DNA, 15 bp, Homo sapiens
gaatttaaatataat

SEQ ID NO: 872406 - DNA, 23 bp, Homo sapiens
gaatttaaatataattctgtaaa

SEQ ID NO: 872407 - DNA, 13 bp, Homo sapiens
gaatttaaggcaa

SEQ ID NO: 872408 - DNA, 15 bp, Homo sapiens
gaatttaaggcaaaa

SEQ ID NO: 872409 - DNA, 16 bp, Homo sapiens
gaatttaggtttttat

SEQ ID NO: 872410 - DNA, 20 bp, Homo sapiens
gaatttatcacacttctgtg

SEQ ID NO: 872411 - DNA, 22 bp, Homo sapiens
gaatttatcacacttctgtgag

SEQ ID NO: 872412 - DNA, 14 bp, Homo sapiens
gaatttatctttac

SEQ ID NO: 872413 - DNA, 23 bp, Homo sapiens
gaatttattcaattcctctggga

SEQ ID NO: 872414 - DNA, 18 bp, Homo sapiens
gaatttcaaaccattgct

SEQ ID NO: 872415 - DNA, 16 bp, Homo sapiens
gaatttcaacttttga

SEQ ID NO: 872416 - DNA, 21 bp, Homo sapiens
gaatttcacctgtaaacctga

SEQ ID NO: 872417 - DNA, 16 bp, Homo sapiens
gaatttcatgtgaatc

SEQ ID NO: 872418 - DNA, 17 bp, Homo sapiens
gaatttccctgtgtgga

SEQ ID NO: 872419 - DNA, 15 bp, Homo sapiens
gaatttctaaagtaa

SEQ ID NO: 872420 - DNA, 23 bp, Homo sapiens
gaatttctaaagtaaaattgaag

SEQ ID NO: 872421 - DNA, 22 bp, Homo sapiens
gaatttctaccagatgtgcttt

SEQ ID NO: 872422 - DNA, 18 bp, Homo sapiens
gaatttcttaacttcttg

SEQ ID NO: 872423 - DNA, 19 bp, Homo sapiens
gaatttcttcactgttgaa

SEQ ID NO: 872424 - DNA, 12 bp, Homo sapiens
gaatttcttggt

SEQ ID NO: 872425 - DNA, 20 bp, Homo sapiens
gaatttctttgtcattcaag

SEQ ID NO: 872426 - DNA, 17 bp, Homo sapiens
gaatttgaatgaaaaat

SEQ ID NO: 872427 - DNA, 13 bp, Homo sapiens
gaatttgagaacc

SEQ ID NO: 872428 - DNA, 23 bp, Homo sapiens
gaatttgatcgttccagttccca

SEQ ID NO: 872429 - DNA, 16 bp, Homo sapiens
gaatttgcaacagtaa

SEQ ID NO: 872430 - DNA, 10 bp, Homo sapiens
gaatttgcat

SEQ ID NO: 872431 - DNA, 14 bp, Homo sapiens
gaatttgcctgctg

SEQ ID NO: 872432 - DNA, 19 bp, Homo sapiens
gaatttggagactctgtgg

SEQ ID NO: 872433 - DNA, 19 bp, Homo sapiens
gaatttggcctgcactaat

SEQ ID NO: 872434 - DNA, 23 bp, Homo sapiens
gaatttgggaggaggaaaagaaa

SEQ ID NO: 872435 - DNA, 21 bp, Homo sapiens
gaatttgtcagcgttctacca

SEQ ID NO: 872436 - DNA, 13 bp, Homo sapiens
gaatttgttatca

SEQ ID NO: 872437 - DNA, 13 bp, Homo sapiens
gaattttaaagta

SEQ ID NO: 872438 - DNA, 15 bp, Homo sapiens
gaattttaagtgctt

SEQ ID NO: 872439 - DNA, 19 bp, Homo sapiens
gaattttaggaacttcaga

SEQ ID NO: 872440 - DNA, 16 bp, Homo sapiens
gaattttatctgtgga

SEQ ID NO: 872441 - DNA, 18 bp, Homo sapiens
gaattttattgacacagt

SEQ ID NO: 872442 - DNA, 17 bp, Homo sapiens
gaattttattttgctga

SEQ ID NO: 872443 - DNA, 15 bp, Homo sapiens
gaattttcaaggcct

SEQ ID NO: 872444 - DNA, 16 bp, Homo sapiens
gaattttcaaggcctt

SEQ ID NO: 872445 - DNA, 23 bp, Homo sapiens
gaattttctccctttatgtatct

SEQ ID NO: 872446 - DNA, 13 bp, Homo sapiens
gaattttctgtgt

SEQ ID NO: 872447 - DNA, 22 bp, Homo sapiens
gaattttgcaaagatttaatct

SEQ ID NO: 872448 - DNA, 20 bp, Homo sapiens
gaattttggggattttcaaa

SEQ ID NO: 872449 - DNA, 16 bp, Homo sapiens
gaattttgttctctgg

SEQ ID NO: 872450 - DNA, 18 bp, Homo sapiens
gaattttgttctctggga

SEQ ID NO: 872451 - DNA, 22 bp, Homo sapiens
gaatttttaaaaaagtgatctt

SEQ ID NO: 872452 - DNA, 18 bp, Homo sapiens
gaatttttaaacaagtat

SEQ ID NO: 872453 - DNA, 12 bp, Homo sapiens
gaatttttaagc

SEQ ID NO: 872454 - DNA, 14 bp, Homo sapiens
gaatttttctctaa

SEQ ID NO: 872455 - DNA, 14 bp, Homo sapiens
gaatttttgcctat

SEQ ID NO: 872456 - DNA, 17 bp, Homo sapiens
gaatttttgtttggact

SEQ ID NO: 872457 - DNA, 22 bp, Homo sapiens
gaatttttgtttggactgtttt

SEQ ID NO: 872458 - DNA, 14 bp, Homo sapiens
gaattttttgaaat

SEQ ID NO: 872459 - DNA, 20 bp, Homo sapiens
gaattttttgaaatgggcat

SEQ ID NO: 872460 - DNA, 16 bp, Homo sapiens
gaatttttttcatctt

SEQ ID NO: 872461 - DNA, 20 bp, Homo sapiens
gaatttttttcatcttctct

SEQ ID NO: 872462 - DNA, 22 bp, Homo sapiens
gacaaaaaaaaaatagagagag

SEQ ID NO: 872463 - DNA, 17 bp, Homo sapiens
gacaaaaaaatttaaaa

SEQ ID NO: 872464 - DNA, 21 bp, Homo sapiens
gacaaaaacaagactgcctcc

SEQ ID NO: 872465 - DNA, 16 bp, Homo sapiens
gacaaaaacagcctca

SEQ ID NO: 872466 - DNA, 15 bp, Homo sapiens
gacaaaaagccttga

SEQ ID NO: 872467 - DNA, 16 bp, Homo sapiens
gacaaaaagtatatta

SEQ ID NO: 872468 - DNA, 17 bp, Homo sapiens
gacaaaacctaacttgc

SEQ ID NO: 872469 - DNA, 18 bp, Homo sapiens
gacaaaacctaacttgcg

SEQ ID NO: 872470 - DNA, 13 bp, Homo sapiens
gacaaaagaaact

SEQ ID NO: 872471 - DNA, 20 bp, Homo sapiens
gacaaaagcagcacaaggaa

SEQ ID NO: 872472 - DNA, 13 bp, Homo sapiens
gacaaaagggcca

SEQ ID NO: 872473 - DNA, 19 bp, Homo sapiens
gacaaaagggccaggtgcg

SEQ ID NO: 872474 - DNA, 13 bp, Homo sapiens
gacaaaatgggag

SEQ ID NO: 872475 - DNA, 19 bp, Homo sapiens
gacaaccttgtcccaagga

SEQ ID NO: 872476 - DNA, 14 bp, Homo sapiens
gacaacgatgaatt

SEQ ID NO: 872477 - DNA, 22 bp, Homo sapiens
gacaactaaaattaggactgta

SEQ ID NO: 872478 - DNA, 12 bp, Homo sapiens
gacaactgtgac

SEQ ID NO: 872479 - DNA, 20 bp, Homo sapiens
gacaactgttttaataaaag

SEQ ID NO: 872480 - DNA, 21 bp, Homo sapiens
gacaactgttttaataaaaga

SEQ ID NO: 872481 - DNA, 16 bp, Homo sapiens
gacaacttagctcagg

SEQ ID NO: 872482 - DNA, 21 bp, Homo sapiens
gacaacttagctcaggtgcct

SEQ ID NO: 872483 - DNA, 18 bp, Homo sapiens
gacaactttgccagcttt

SEQ ID NO: 872484 - DNA, 15 bp, Homo sapiens
gacaagaaatccctg

SEQ ID NO: 872485 - DNA, 16 bp, Homo sapiens
gacaagaaatccctgt

SEQ ID NO: 872486 - DNA, 15 bp, Homo sapiens
gacaagacccccagc

SEQ ID NO: 872487 - DNA, 16 bp, Homo sapiens
gacaagacccccagca

SEQ ID NO: 872488 - DNA, 19 bp, Homo sapiens
gacaagacttcagtatgtt

SEQ ID NO: 872489 - DNA, 22 bp, Homo sapiens
gacaagagcctgatctcttcct

SEQ ID NO: 872490 - DNA, 23 bp, Homo sapiens
gacaagagcctgatctcttcctg

SEQ ID NO: 872491 - DNA, 13 bp, Homo sapiens
gacaagagctgct

SEQ ID NO: 872492 - DNA, 18 bp, Homo sapiens
gacaagatattgtacata

SEQ ID NO: 872493 - DNA, 20 bp, Homo sapiens
gacaagatttcctactttct

SEQ ID NO: 872494 - DNA, 18 bp, Homo sapiens
gacaagcagtgtctgtca

SEQ ID NO: 872495 - DNA, 20 bp, Homo sapiens
gacaagcagtgtctgtcagc

SEQ ID NO: 872496 - DNA, 23 bp, Homo sapiens
gacaagccaacttgtaaatacac

SEQ ID NO: 872497 - DNA, 12 bp, Homo sapiens
gacaagccccag

SEQ ID NO: 872498 - DNA, 15 bp, Homo sapiens
gacaagccccaggca

SEQ ID NO: 872499 - DNA, 11 bp, Homo sapiens
gacaaggaaaa

SEQ ID NO: 872500 - DNA, 12 bp, Homo sapiens
gacaaggaaaat

SEQ ID NO: 872501 - DNA, 14 bp, Homo sapiens
gacaaggaaaatct

SEQ ID NO: 872502 - DNA, 13 bp, Homo sapiens
gacaaggccccag

SEQ ID NO: 872503 - DNA, 22 bp, Homo sapiens
gacaaggttcttcccttttaca

SEQ ID NO: 872504 - DNA, 15 bp, Homo sapiens
gacaagtaatttcag

SEQ ID NO: 872505 - DNA, 19 bp, Homo sapiens
gacaagtgactgtatctgt

SEQ ID NO: 872506 - DNA, 20 bp, Homo sapiens
gacaagtgactgtatctgtg

SEQ ID NO: 872507 - DNA, 15 bp, Homo sapiens
gacaagtggactcag

SEQ ID NO: 872508 - DNA, 15 bp, Homo sapiens
gacaataaaatatta

SEQ ID NO: 872509 - DNA, 20 bp, Homo sapiens
gacaatactccctttaaaga

SEQ ID NO: 872510 - DNA, 21 bp, Homo sapiens
gacaatagggctaaatgttta

SEQ ID NO: 872511 - DNA, 18 bp, Homo sapiens
gacaatatcaatcacatt

SEQ ID NO: 872512 - DNA, 16 bp, Homo sapiens
gacaatcaaagaaaag

SEQ ID NO: 872513 - DNA, 17 bp, Homo sapiens
gacaatcaactctaata

SEQ ID NO: 872514 - DNA, 14 bp, Homo sapiens
gacaatcagtcccc

SEQ ID NO: 872515 - DNA, 17 bp, Homo sapiens
gacaatcagtcccctcc

SEQ ID NO: 872516 - DNA, 18 bp, Homo sapiens
gacaatcagtcccctccc

SEQ ID NO: 872517 - DNA, 19 bp, Homo sapiens
gacaatcagtcccctccca

SEQ ID NO: 872518 - DNA, 19 bp, Homo sapiens
gacaatcatgaaatatgca

SEQ ID NO: 872519 - DNA, 21 bp, Homo sapiens
gacaatcatgaaatatgcatc

SEQ ID NO: 872520 - DNA, 20 bp, Homo sapiens
gacaatgaaatactccagca

SEQ ID NO: 872521 - DNA, 17 bp, Homo sapiens
gacaatgacttactgta

SEQ ID NO: 872522 - DNA, 16 bp, Homo sapiens
gacaatgccaataggt

SEQ ID NO: 872523 - DNA, 17 bp, Homo sapiens
gacaatgccctgctggc

SEQ ID NO: 872524 - DNA, 19 bp, Homo sapiens
gacaatgccctgctggcct

SEQ ID NO: 872525 - DNA, 21 bp, Homo sapiens
gacaatggcagctagactgga

SEQ ID NO: 872526 - DNA, 23 bp, Homo sapiens
gacaattcctagataaaaagatg

SEQ ID NO: 872527 - DNA, 15 bp, Homo sapiens
gacaattgtcttttt

SEQ ID NO: 872528 - DNA, 15 bp, Homo sapiens
gacaatttctggcag

SEQ ID NO: 872529 - DNA, 20 bp, Homo sapiens
gacaatttctggcagatgta

SEQ ID NO: 872530 - DNA, 19 bp, Homo sapiens
gacaatttgatacataata

SEQ ID NO: 872531 - DNA, 22 bp, Homo sapiens
gacaatttgatacataataaaa

SEQ ID NO: 872532 - DNA, 13 bp, Homo sapiens
gacacaaaaaaag

SEQ ID NO: 872533 - DNA, 16 bp, Homo sapiens
gacacaaaaagtagat

SEQ ID NO: 872534 - DNA, 17 bp, Homo sapiens
gacacaaaactccgccc

SEQ ID NO: 872535 - DNA, 21 bp, Homo sapiens
gacacaaaactccgcccccag

SEQ ID NO: 872536 - DNA, 23 bp, Homo sapiens
gacacaaaactccgcccccagcc

SEQ ID NO: 872537 - DNA, 20 bp, Homo sapiens
gacacaaaggtggaataaac

SEQ ID NO: 872538 - DNA, 21 bp, Homo sapiens
gacacaaggcacggccacgtc

SEQ ID NO: 872539 - DNA, 22 bp, Homo sapiens
gacacaagtggaccttaggcct

SEQ ID NO: 872540 - DNA, 15 bp, Homo sapiens
gacacaataggtctt

SEQ ID NO: 872541 - DNA, 21 bp, Homo sapiens
gacacaataggtctttctctc

SEQ ID NO: 872542 - DNA, 22 bp, Homo sapiens
gacacaataggtctttctctca

SEQ ID NO: 872543 - DNA, 23 bp, Homo sapiens
gacacaatggcacctctgccctt

SEQ ID NO: 872544 - DNA, 16 bp, Homo sapiens
gacagcagctcaggca

SEQ ID NO: 872545 - DNA, 20 bp, Homo sapiens
gacagcagctcaggcacact

SEQ ID NO: 872546 - DNA, 14 bp, Homo sapiens
gacagcaggcagcg

SEQ ID NO: 872547 - DNA, 17 bp, Homo sapiens
gacagcaggcagcgcca

SEQ ID NO: 872548 - DNA, 16 bp, Homo sapiens
gacagcaggtgggaaa

SEQ ID NO: 872549 - DNA, 17 bp, Homo sapiens
gacagcatcccttccca

SEQ ID NO: 872550 - DNA, 20 bp, Homo sapiens
gacagcatcccttcccacat

SEQ ID NO: 872551 - DNA, 23 bp, Homo sapiens
gacagcatcccttcccacatgcc

SEQ ID NO: 872552 - DNA, 19 bp, Homo sapiens
gacagcatgccccttggct

SEQ ID NO: 872553 - DNA, 20 bp, Homo sapiens
gacagcatgccccttggctg

SEQ ID NO: 872554 - DNA, 13 bp, Homo sapiens
gacagcatgtgcc

SEQ ID NO: 872555 - DNA, 20 bp, Homo sapiens
gacagcatgtgccctcctga

SEQ ID NO: 872556 - DNA, 21 bp, Homo sapiens
gacagcatgtgccctcctgag

SEQ ID NO: 872557 - DNA, 13 bp, Homo sapiens
gacagccagagct

SEQ ID NO: 872558 - DNA, 15 bp, Homo sapiens
gacagccagagctgg

SEQ ID NO: 872559 - DNA, 13 bp, Homo sapiens
gacagccagcagc

SEQ ID NO: 872560 - DNA, 13 bp, Homo sapiens
gacagcccagagc

SEQ ID NO: 872561 - DNA, 22 bp, Homo sapiens
gacagcccaggatactggcaca

SEQ ID NO: 872562 - DNA, 20 bp, Homo sapiens
gacagccccaagcttctgag

SEQ ID NO: 872563 - DNA, 18 bp, Homo sapiens
gacagcctccccctgtcc

SEQ ID NO: 872564 - DNA, 20 bp, Homo sapiens
gacagccttccccagctcca

SEQ ID NO: 872565 - DNA, 23 bp, Homo sapiens
gacagccttccccagctccagca

SEQ ID NO: 872566 - DNA, 18 bp, Homo sapiens
gacagccttgggcctttc

SEQ ID NO: 872567 - DNA, 18 bp, Homo sapiens
gacagcgatggcaggcct

SEQ ID NO: 872568 - DNA, 20 bp, Homo sapiens
gacagcgatggcaggcctga

SEQ ID NO: 872569 - DNA, 22 bp, Homo sapiens
gacagcgctgtatttacagaca

SEQ ID NO: 872570 - DNA, 13 bp, Homo sapiens
gacagcgggaaaa

SEQ ID NO: 872571 - DNA, 12 bp, Homo sapiens
gacagctcttga

SEQ ID NO: 872572 - DNA, 17 bp, Homo sapiens
gacagctgatacttcat

SEQ ID NO: 872573 - DNA, 14 bp, Homo sapiens
gacagctgctccta

SEQ ID NO: 872574 - DNA, 21 bp, Homo sapiens
gacagctgctcctagagggag

SEQ ID NO: 872575 - DNA, 15 bp, Homo sapiens
gacagctgcttgtgg

SEQ ID NO: 872576 - DNA, 14 bp, Homo sapiens
gacagctgtccctg

SEQ ID NO: 872577 - DNA, 22 bp, Homo sapiens
gacagctgtccctgtcaccaag

SEQ ID NO: 872578 - DNA, 15 bp, Homo sapiens
gacagctgtgctgta

SEQ ID NO: 872579 - DNA, 22 bp, Homo sapiens
gacagcttcctcacacccctgt

SEQ ID NO: 872580 - DNA, 18 bp, Homo sapiens
gacagcttctctgcagta

SEQ ID NO: 872581 - DNA, 21 bp, Homo sapiens
gacagcttgtggcaagtgaat

SEQ ID NO: 872582 - DNA, 12 bp, Homo sapiens
gacagctttgct

SEQ ID NO: 872583 - DNA, 17 bp, Homo sapiens
gacagctttgctccgct

SEQ ID NO: 872584 - DNA, 19 bp, Homo sapiens
gacagctttgctccgctcc

SEQ ID NO: 872585 - DNA, 15 bp, Homo sapiens
gacagctttgctgct

SEQ ID NO: 872586 - DNA, 15 bp, Homo sapiens
gacaggaaaaaccaa

SEQ ID NO: 872587 - DNA, 15 bp, Homo sapiens
gacaggaaagccctc

SEQ ID NO: 872588 - DNA, 16 bp, Homo sapiens
gacaggaaagccctcc

SEQ ID NO: 872589 - DNA, 17 bp, Homo sapiens
gacaggaagaccaaggc

SEQ ID NO: 872590 - DNA, 17 bp, Homo sapiens
gacaggaagctggcaga

SEQ ID NO: 872591 - DNA, 23 bp, Homo sapiens
gacaggacagtgcttcagcctga

SEQ ID NO: 872592 - DNA, 15 bp, Homo sapiens
gacaggaccccagct

SEQ ID NO: 872593 - DNA, 16 bp, Homo sapiens
gacaggaccccagctc

SEQ ID NO: 872594 - DNA, 17 bp, Homo sapiens
gacaggaccccagctct

SEQ ID NO: 872595 - DNA, 18 bp, Homo sapiens
gacaggaccccagctctg

SEQ ID NO: 872596 - DNA, 22 bp, Homo sapiens
gacaggacgctgaccgtggagc

SEQ ID NO: 872597 - DNA, 14 bp, Homo sapiens
gacaggagaagaga

SEQ ID NO: 872598 - DNA, 17 bp, Homo sapiens
gacaggagaagagagga

SEQ ID NO: 872599 - DNA, 13 bp, Homo sapiens
gacagtcctggga

SEQ ID NO: 872600 - DNA, 13 bp, Homo sapiens
gacagtctccctg

SEQ ID NO: 872601 - DNA, 16 bp, Homo sapiens
gacagtctccctgatg

SEQ ID NO: 872602 - DNA, 10 bp, Homo sapiens
gacagtctga

SEQ ID NO: 872603 - DNA, 15 bp, Homo sapiens
gacagtctgttatgc

SEQ ID NO: 872604 - DNA, 16 bp, Homo sapiens
gacagtctgttatgca

SEQ ID NO: 872605 - DNA, 13 bp, Homo sapiens
gacagtcttgtgc

SEQ ID NO: 872606 - DNA, 21 bp, Homo sapiens
gacagtgaagcagcactgtga

SEQ ID NO: 872607 - DNA, 16 bp, Homo sapiens
gacagtgatctccata

SEQ ID NO: 872608 - DNA, 21 bp, Homo sapiens
gacagtgatctccatatgtta

SEQ ID NO: 872609 - DNA, 12 bp, Homo sapiens
gacagtgccatc

SEQ ID NO: 872610 - DNA, 13 bp, Homo sapiens
gacagtgcctctt

SEQ ID NO: 872611 - DNA, 22 bp, Homo sapiens
gacagtgcctgggaatgtatta

SEQ ID NO: 872612 - DNA, 15 bp, Homo sapiens
gacagtgccttctct

SEQ ID NO: 872613 - DNA, 18 bp, Homo sapiens
gacagtgcttcagcctga

SEQ ID NO: 872614 - DNA, 19 bp, Homo sapiens
gacagtgcttcagcctgag

SEQ ID NO: 872615 - DNA, 20 bp, Homo sapiens
gacagtggatatgacccaca

SEQ ID NO: 872616 - DNA, 23 bp, Homo sapiens
gacagtggatatgacccacactg

SEQ ID NO: 872617 - DNA, 13 bp, Homo sapiens
gacagtggcctct

SEQ ID NO: 872618 - DNA, 18 bp, Homo sapiens
gacagtggcctcttgagt

SEQ ID NO: 872619 - DNA, 15 bp, Homo sapiens
gacagtggctctcca

SEQ ID NO: 872620 - DNA, 16 bp, Homo sapiens
gacagtggctctccaa

SEQ ID NO: 872621 - DNA, 15 bp, Homo sapiens
gacagtgggaaatat

SEQ ID NO: 872622 - DNA, 14 bp, Homo sapiens
gacagtggtgggcg

SEQ ID NO: 872623 - DNA, 19 bp, Homo sapiens
gacagtggtgggcggggag

SEQ ID NO: 872624 - DNA, 22 bp, Homo sapiens
gacagtgtatggggctgcagtt

SEQ ID NO: 872625 - DNA, 20 bp, Homo sapiens
gacagtgttccccgatacca

SEQ ID NO: 872626 - DNA, 14 bp, Homo sapiens
gacagttcaagaaa

SEQ ID NO: 872627 - DNA, 15 bp, Homo sapiens
gacagttcatatgta

SEQ ID NO: 872628 - DNA, 14 bp, Homo sapiens
gacagttctgaaga

SEQ ID NO: 872629 - DNA, 18 bp, Homo sapiens
gacagttggcagagaagg

SEQ ID NO: 872630 - DNA, 15 bp, Homo sapiens
gacagtttactttgc

SEQ ID NO: 872631 - DNA, 18 bp, Homo sapiens
gacagtttactttgccaa

SEQ ID NO: 872632 - DNA, 19 bp, Homo sapiens
gacagtttatcctgtctga

SEQ ID NO: 872633 - DNA, 13 bp, Homo sapiens
gacagtttccaaa

SEQ ID NO: 872634 - DNA, 15 bp, Homo sapiens
gacagtttcttttgt

SEQ ID NO: 872635 - DNA, 16 bp, Homo sapiens
gacataaaactttaaa

SEQ ID NO: 872636 - DNA, 18 bp, Homo sapiens
gacataaaactttaaaag

SEQ ID NO: 872637 - DNA, 20 bp, Homo sapiens
gacataaaactttaaaaggc

SEQ ID NO: 872638 - DNA, 19 bp, Homo sapiens
gacataaagttgataaaga

SEQ ID NO: 872639 - DNA, 23 bp, Homo sapiens
gacataatatattctatttttat

SEQ ID NO: 872640 - DNA, 15 bp, Homo sapiens
gacataattgtccag

SEQ ID NO: 872641 - DNA, 21 bp, Homo sapiens
gacatacagagatatacaaat

SEQ ID NO: 872642 - DNA, 19 bp, Homo sapiens
gacatacctaccagtatta

SEQ ID NO: 872643 - DNA, 21 bp, Homo sapiens
gacatacgcttttaatgaaaa

SEQ ID NO: 872644 - DNA, 21 bp, Homo sapiens
gacatagagagggagaagaag

SEQ ID NO: 872645 - DNA, 22 bp, Homo sapiens
gacatagagagggagaagaagt

SEQ ID NO: 872646 - DNA, 20 bp, Homo sapiens
gacatagccgattctctgcc

SEQ ID NO: 872647 - DNA, 17 bp, Homo sapiens
gacatatattttttaaa

SEQ ID NO: 872648 - DNA, 12 bp, Homo sapiens
gacatattcaag

SEQ ID NO: 872649 - DNA, 13 bp, Homo sapiens
gacatcaggaagg

SEQ ID NO: 872650 - DNA, 19 bp, Homo sapiens
gacatcagtggcatggctc

SEQ ID NO: 872651 - DNA, 19 bp, Homo sapiens
gacatcatcattcttgtgg

SEQ ID NO: 872652 - DNA, 20 bp, Homo sapiens
gacatcatcattcttgtggg

SEQ ID NO: 872653 - DNA, 16 bp, Homo sapiens
gacatccataaagaag

SEQ ID NO: 872654 - DNA, 12 bp, Homo sapiens
gacatcccttcc

SEQ ID NO: 872655 - DNA, 22 bp, Homo sapiens
gacatcccttcctggaaacagc

SEQ ID NO: 872656 - DNA, 20 bp, Homo sapiens
gacatccgtcattgctgctg

SEQ ID NO: 872657 - DNA, 15 bp, Homo sapiens
gacatcctcctccca

SEQ ID NO: 872658 - DNA, 18 bp, Homo sapiens
gacatcctcctcccaccc

SEQ ID NO: 872659 - DNA, 16 bp, Homo sapiens
gacatcctcttctgct

SEQ ID NO: 872660 - DNA, 23 bp, Homo sapiens
gacatcctcttctgcttaggaga

SEQ ID NO: 872661 - DNA, 21 bp, Homo sapiens
gacatcctgtataagcactga

SEQ ID NO: 872662 - DNA, 15 bp, Homo sapiens
gacatctcaggggcc

SEQ ID NO: 872663 - DNA, 17 bp, Homo sapiens
gacatctcaggggccag

SEQ ID NO: 872664 - DNA, 20 bp, Homo sapiens
gacatctcaggggccagagg

SEQ ID NO: 872665 - DNA, 22 bp, Homo sapiens
gacatctcaggggccagaggaa

SEQ ID NO: 872666 - DNA, 16 bp, Homo sapiens
gacatctccagtgtgc

SEQ ID NO: 872667 - DNA, 15 bp, Homo sapiens
gacatctctctggct

SEQ ID NO: 872668 - DNA, 19 bp, Homo sapiens
gacatctctctggcttctg

SEQ ID NO: 872669 - DNA, 13 bp, Homo sapiens
gacatctctgcac

SEQ ID NO: 872670 - DNA, 17 bp, Homo sapiens
gacatctctgcaccctg

SEQ ID NO: 872671 - DNA, 17 bp, Homo sapiens
gacatctctggagccag

SEQ ID NO: 872672 - DNA, 16 bp, Homo sapiens
gacatctgcctgtaat

SEQ ID NO: 872673 - DNA, 14 bp, Homo sapiens
gacatctgctgtta

SEQ ID NO: 872674 - DNA, 14 bp, Homo sapiens
gacatctggaatct

SEQ ID NO: 872675 - DNA, 20 bp, Homo sapiens
gacatctggaatctggagac

SEQ ID NO: 872676 - DNA, 12 bp, Homo sapiens
gacatcttaaat

SEQ ID NO: 872677 - DNA, 22 bp, Homo sapiens
gacatgaatactatccatgtaa

SEQ ID NO: 872678 - DNA, 17 bp, Homo sapiens
gacatgaccctctgtcc

SEQ ID NO: 872679 - DNA, 19 bp, Homo sapiens
gacatgaccctctgtcccc

SEQ ID NO: 872680 - DNA, 13 bp, Homo sapiens
gacatgagtctgt

SEQ ID NO: 872681 - DNA, 18 bp, Homo sapiens
gacatgatactgatgcca

SEQ ID NO: 872682 - DNA, 21 bp, Homo sapiens
gacatgatactgatgccatgt

SEQ ID NO: 872683 - DNA, 22 bp, Homo sapiens
gacatgatatagtcagctgcct

SEQ ID NO: 872684 - DNA, 14 bp, Homo sapiens
gacatgatcttctt

SEQ ID NO: 872685 - DNA, 17 bp, Homo sapiens
gacatgatttccttgaa

SEQ ID NO: 872686 - DNA, 20 bp, Homo sapiens
gacatgatttccttgaatgt

SEQ ID NO: 872687 - DNA, 16 bp, Homo sapiens
gacatgccctgtgtgg

SEQ ID NO: 872688 - DNA, 18 bp, Homo sapiens
gacatgcggtagccagca

SEQ ID NO: 872689 - DNA, 16 bp, Homo sapiens
gacatgcgtgtgtcag

SEQ ID NO: 872690 - DNA, 23 bp, Homo sapiens
gacatgcgtgtgtcagggatgag

SEQ ID NO: 872691 - DNA, 17 bp, Homo sapiens
gacatgctcacctctag

SEQ ID NO: 872692 - DNA, 20 bp, Homo sapiens
gacatgctcacctctagcct

SEQ ID NO: 872693 - DNA, 21 bp, Homo sapiens
gacatgctctttttttaagtg

SEQ ID NO: 872694 - DNA, 15 bp, Homo sapiens
gacatgctgccagga

SEQ ID NO: 872695 - DNA, 22 bp, Homo sapiens
gacatgcttttctgccactcca

SEQ ID NO: 872696 - DNA, 13 bp, Homo sapiens
gacatggaccagc

SEQ ID NO: 872697 - DNA, 17 bp, Homo sapiens
gacatggacccggagct

SEQ ID NO: 872698 - DNA, 22 bp, Homo sapiens
gacatggagactcctgccctgt

SEQ ID NO: 872699 - DNA, 16 bp, Homo sapiens
gacatggcacaggccc

SEQ ID NO: 872700 - DNA, 20 bp, Homo sapiens
gacatggggaaggcagaggc

SEQ ID NO: 872701 - DNA, 23 bp, Homo sapiens
gacatggggaaggcagaggctgg

SEQ ID NO: 872702 - DNA, 16 bp, Homo sapiens
gacattcacctgcccc

SEQ ID NO: 872703 - DNA, 13 bp, Homo sapiens
gacattcactgct

SEQ ID NO: 872704 - DNA, 14 bp, Homo sapiens
gacattcactgctg

SEQ ID NO: 872705 - DNA, 18 bp, Homo sapiens
gacattcactgctgattt

SEQ ID NO: 872706 - DNA, 12 bp, Homo sapiens
gacattcactgg

SEQ ID NO: 872707 - DNA, 21 bp, Homo sapiens
gacattccttctcccatctct

SEQ ID NO: 872708 - DNA, 13 bp, Homo sapiens
gacattctcacat

SEQ ID NO: 872709 - DNA, 14 bp, Homo sapiens
gacattctgaatgc

SEQ ID NO: 872710 - DNA, 20 bp, Homo sapiens
gacattctgaatgcttctaa

SEQ ID NO: 872711 - DNA, 22 bp, Homo sapiens
gacattctgaatgcttctaagt

SEQ ID NO: 872712 - DNA, 14 bp, Homo sapiens
gacattgcgtttga

SEQ ID NO: 872713 - DNA, 19 bp, Homo sapiens
gacattgctctatgtctgc

SEQ ID NO: 872714 - DNA, 15 bp, Homo sapiens
gacattgctctctgg

SEQ ID NO: 872715 - DNA, 21 bp, Homo sapiens
gacattgtctcctatatattt

SEQ ID NO: 872716 - DNA, 14 bp, Homo sapiens
gacatttagaactt

SEQ ID NO: 872717 - DNA, 14 bp, Homo sapiens
gacatttagaagaa

SEQ ID NO: 872718 - DNA, 14 bp, Homo sapiens
gacatttatatatt

SEQ ID NO: 872719 - DNA, 11 bp, Homo sapiens
gacatttatgt

SEQ ID NO: 872720 - DNA, 20 bp, Homo sapiens
gacatttatgtctcatgtaa

SEQ ID NO: 872721 - DNA, 23 bp, Homo sapiens
gacatttatgtctcatgtaattt

SEQ ID NO: 872722 - DNA, 12 bp, Homo sapiens
gacatttcatct

SEQ ID NO: 872723 - DNA, 22 bp, Homo sapiens
gacatttctaacatatgtatta

SEQ ID NO: 872724 - DNA, 21 bp, Homo sapiens
gacatttgctgaactcagcac

SEQ ID NO: 872725 - DNA, 23 bp, Homo sapiens
gacatttgggagacatgtgacat

SEQ ID NO: 872726 - DNA, 20 bp, Homo sapiens
gacattttaaaaaatggtca

SEQ ID NO: 872727 - DNA, 13 bp, Homo sapiens
gacattttacatt

SEQ ID NO: 872728 - DNA, 15 bp, Homo sapiens
gacattttacattaa

SEQ ID NO: 872729 - DNA, 21 bp, Homo sapiens
gacattttacattaaattttt

SEQ ID NO: 872730 - DNA, 21 bp, Homo sapiens
gacattttaggaatcaccaat

SEQ ID NO: 872731 - DNA, 12 bp, Homo sapiens
gacattttctgg

SEQ ID NO: 872732 - DNA, 15 bp, Homo sapiens
gacattttcttcaga

SEQ ID NO: 872733 - DNA, 20 bp, Homo sapiens
gacattttctttcatgggca

SEQ ID NO: 872734 - DNA, 18 bp, Homo sapiens
gacattttggggttttat

SEQ ID NO: 872735 - DNA, 18 bp, Homo sapiens
gacatttttccggagaag

SEQ ID NO: 872736 - DNA, 15 bp, Homo sapiens
gacattttttcagtc

SEQ ID NO: 872737 - DNA, 18 bp, Homo sapiens
gaccaaaaaacctcactg

SEQ ID NO: 872738 - DNA, 19 bp, Homo sapiens
gaccaaaaaacctcactgg

SEQ ID NO: 872739 - DNA, 14 bp, Homo sapiens
gaccaaaagttaca

SEQ ID NO: 872740 - DNA, 22 bp, Homo sapiens
gaccaaaattactaataaattg

SEQ ID NO: 872741 - DNA, 16 bp, Homo sapiens
gaccaaaccagccttc

SEQ ID NO: 872742 - DNA, 19 bp, Homo sapiens
gaccaaactacttcatttt

SEQ ID NO: 872743 - DNA, 21 bp, Homo sapiens
gaccaaactacttcattttct

SEQ ID NO: 872744 - DNA, 14 bp, Homo sapiens
gaccaaagggggag

SEQ ID NO: 872745 - DNA, 13 bp, Homo sapiens
gaccaaagtccct

SEQ ID NO: 872746 - DNA, 19 bp, Homo sapiens
gaccaaatgtagttttgta

SEQ ID NO: 872747 - DNA, 14 bp, Homo sapiens
gaccaaattgcttc

SEQ ID NO: 872748 - DNA, 17 bp, Homo sapiens
gaccaaattgcttctag

SEQ ID NO: 872749 - DNA, 21 bp, Homo sapiens
gaccaacatggagaaaccctg

SEQ ID NO: 872750 - DNA, 14 bp, Homo sapiens
gaccaaccctggga

SEQ ID NO: 872751 - DNA, 18 bp, Homo sapiens
gaccaaccctgggaccta

SEQ ID NO: 872752 - DNA, 20 bp, Homo sapiens
gaccaaccctggggaaggag

SEQ ID NO: 872753 - DNA, 18 bp, Homo sapiens
gaccaaccctgtttcctg

SEQ ID NO: 872754 - DNA, 13 bp, Homo sapiens
gaccaacctgctc

SEQ ID NO: 872755 - DNA, 14 bp, Homo sapiens
gaccaacctgctct

SEQ ID NO: 872756 - DNA, 18 bp, Homo sapiens
gaccaacctgctctgtcc

SEQ ID NO: 872757 - DNA, 20 bp, Homo sapiens
gaccaacctgctctgtcccc

SEQ ID NO: 872758 - DNA, 20 bp, Homo sapiens
gaccaacgttactcagggct

SEQ ID NO: 872759 - DNA, 16 bp, Homo sapiens
gaccaactggcttctg

SEQ ID NO: 872760 - DNA, 18 bp, Homo sapiens
gaccaactggcttctgtg

SEQ ID NO: 872761 - DNA, 19 bp, Homo sapiens
gaccaactggcttctgtgc

SEQ ID NO: 872762 - DNA, 12 bp, Homo sapiens
gaccaactgtgt

SEQ ID NO: 872763 - DNA, 17 bp, Homo sapiens
gaccaagcgaccaagga

SEQ ID NO: 872764 - DNA, 18 bp, Homo sapiens
gaccaagcgaccaaggat

SEQ ID NO: 872765 - DNA, 13 bp, Homo sapiens
gaccaaggacccc

SEQ ID NO: 872766 - DNA, 16 bp, Homo sapiens
gaccaaggacccctca

SEQ ID NO: 872767 - DNA, 17 bp, Homo sapiens
gaccaaggacccctcac

SEQ ID NO: 872768 - DNA, 19 bp, Homo sapiens
gaccaaggacccctcacct

SEQ ID NO: 872769 - DNA, 19 bp, Homo sapiens
gaccaaggcaaggcaggtg

SEQ ID NO: 872770 - DNA, 20 bp, Homo sapiens
gaccaaggcctcggcagaac

SEQ ID NO: 872771 - DNA, 17 bp, Homo sapiens
gaccaagtataaacttt

SEQ ID NO: 872772 - DNA, 12 bp, Homo sapiens
gaccaataaaga

SEQ ID NO: 872773 - DNA, 12 bp, Homo sapiens
gaccaatatata

SEQ ID NO: 872774 - DNA, 18 bp, Homo sapiens
gaccaatattcaaatgcg

SEQ ID NO: 872775 - DNA, 17 bp, Homo sapiens
gaccaatattgtacagt

SEQ ID NO: 872776 - DNA, 21 bp, Homo sapiens
gaccaatattgtacagttttt

SEQ ID NO: 872777 - DNA, 17 bp, Homo sapiens
gaccaatccccagccta

SEQ ID NO: 872778 - DNA, 13 bp, Homo sapiens
gaccaattcaacc

SEQ ID NO: 872779 - DNA, 19 bp, Homo sapiens
gaccaatttatgggagaat

SEQ ID NO: 872780 - DNA, 18 bp, Homo sapiens
gaccacaaaacttttcta

SEQ ID NO: 872781 - DNA, 23 bp, Homo sapiens
gaccacaccactaaccatcccca

SEQ ID NO: 872782 - DNA, 17 bp, Homo sapiens
gaccacacctccctgaa

SEQ ID NO: 872783 - DNA, 20 bp, Homo sapiens
gaccacacctccctgaacca

SEQ ID NO: 872784 - DNA, 18 bp, Homo sapiens
gaccacaccttggccttc

SEQ ID NO: 872785 - DNA, 20 bp, Homo sapiens
gaccacacttcctgtccaga

SEQ ID NO: 872786 - DNA, 23 bp, Homo sapiens
gaccacacttcctgtccagagag

SEQ ID NO: 872787 - DNA, 20 bp, Homo sapiens
gaccacagcccgctctctgg

SEQ ID NO: 872788 - DNA, 17 bp, Homo sapiens
gaccacataagaaggca

SEQ ID NO: 872789 - DNA, 24 bp, Homo sapiens
gaccacatagtgtgagaacttcca

SEQ ID NO: 872790 - DNA, 12 bp, Homo sapiens
gaccacatctgt

SEQ ID NO: 872791 - DNA, 16 bp, Homo sapiens
gaccacatctgtcctc

SEQ ID NO: 872792 - DNA, 19 bp, Homo sapiens
gaccacatctgtcctcacc

SEQ ID NO: 872793 - DNA, 21 bp, Homo sapiens
gaccacatctgtcctcaccct

SEQ ID NO: 872794 - DNA, 22 bp, Homo sapiens
gaccacatctgtcctcaccctg

SEQ ID NO: 872795 - DNA, 18 bp, Homo sapiens
gaccacattttatattta

SEQ ID NO: 872796 - DNA, 12 bp, Homo sapiens
gaccaccaaagt

SEQ ID NO: 872797 - DNA, 18 bp, Homo sapiens
gaccaccagggtcccagg

SEQ ID NO: 872798 - DNA, 20 bp, Homo sapiens
gaccaccagggtcccaggaa

SEQ ID NO: 872799 - DNA, 22 bp, Homo sapiens
gaccaccagggtcccaggaagc

SEQ ID NO: 872800 - DNA, 15 bp, Homo sapiens
gaccaccctcccctc

SEQ ID NO: 872801 - DNA, 18 bp, Homo sapiens
gaccaccctcccctctct

SEQ ID NO: 872802 - DNA, 15 bp, Homo sapiens
gaccaccctgagccg

SEQ ID NO: 872803 - DNA, 19 bp, Homo sapiens
gaccaccgcccctggccgc

SEQ ID NO: 872804 - DNA, 14 bp, Homo sapiens
gaccacctgcccaa

SEQ ID NO: 872805 - DNA, 16 bp, Homo sapiens
gaccaccttctgtccc

SEQ ID NO: 872806 - DNA, 24 bp, Homo sapiens
gaccaccttctgtccccagccctg

SEQ ID NO: 872807 - DNA, 21 bp, Homo sapiens
gaccacgcacctccacgccac

SEQ ID NO: 872808 - DNA, 22 bp, Homo sapiens
gaccacgcccgtcctgcctgtg

SEQ ID NO: 872809 - DNA, 14 bp, Homo sapiens
gaccacgccgccct

SEQ ID NO: 872810 - DNA, 18 bp, Homo sapiens
gaccacgccgccctccat

SEQ ID NO: 872811 - DNA, 20 bp, Homo sapiens
gaccacgccgccctccatcc

SEQ ID NO: 872812 - DNA, 17 bp, Homo sapiens
gaccacgtgctaccccc

SEQ ID NO: 872813 - DNA, 12 bp, Homo sapiens
gaccactacagt

SEQ ID NO: 872814 - DNA, 15 bp, Homo sapiens
gaccactccagagaa

SEQ ID NO: 872815 - DNA, 16 bp, Homo sapiens
gaccactcgaggcctg

SEQ ID NO: 872816 - DNA, 17 bp, Homo sapiens
gaccactcgaggcctgc

SEQ ID NO: 872817 - DNA, 14 bp, Homo sapiens
gaccactgggcctg

SEQ ID NO: 872818 - DNA, 22 bp, Homo sapiens
gaccactgtctccacccacctt

SEQ ID NO: 872819 - DNA, 15 bp, Homo sapiens
gaccacttccagggg

SEQ ID NO: 872820 - DNA, 23 bp, Homo sapiens
gaccacttccaggggaacctgcc

SEQ ID NO: 872821 - DNA, 17 bp, Homo sapiens
gaccacttggaaataaa

SEQ ID NO: 872822 - DNA, 16 bp, Homo sapiens
gaccagaaatcaaaaa

SEQ ID NO: 872823 - DNA, 12 bp, Homo sapiens
gaccagaattcc

SEQ ID NO: 872824 - DNA, 19 bp, Homo sapiens
gaccagacttttgcttacc

SEQ ID NO: 872825 - DNA, 21 bp, Homo sapiens
gaccagagccccacacggagg

SEQ ID NO: 872826 - DNA, 21 bp, Homo sapiens
gaccagataaatagaactatc

SEQ ID NO: 872827 - DNA, 15 bp, Homo sapiens
gaccagatctttctc

SEQ ID NO: 872828 - DNA, 16 bp, Homo sapiens
gaccagatctttctct

SEQ ID NO: 872829 - DNA, 19 bp, Homo sapiens
gaccagatctttctcttcc

SEQ ID NO: 872830 - DNA, 17 bp, Homo sapiens
gaccagcactcagcctc

SEQ ID NO: 872831 - DNA, 20 bp, Homo sapiens
gaccagcagacagagccagg

SEQ ID NO: 872832 - DNA, 23 bp, Homo sapiens
gaccagcagacagagccaggaga

SEQ ID NO: 872833 - DNA, 16 bp, Homo sapiens
gaccagcatctggtct

SEQ ID NO: 872834 - DNA, 12 bp, Homo sapiens
gaccagccagca

SEQ ID NO: 872835 - DNA, 18 bp, Homo sapiens
gaccagccagcagcagcc

SEQ ID NO: 872836 - DNA, 21 bp, Homo sapiens
gaccagcccattggccgagct

SEQ ID NO: 872837 - DNA, 13 bp, Homo sapiens
gaccagcctggcc

SEQ ID NO: 872838 - DNA, 12 bp, Homo sapiens
gaccagcctggg

SEQ ID NO: 872839 - DNA, 17 bp, Homo sapiens
gaccagcctgggcagca

SEQ ID NO: 872840 - DNA, 20 bp, Homo sapiens
gaccagcctgtaccttgctg

SEQ ID NO: 872841 - DNA, 10 bp, Homo sapiens
gaccagcgga

SEQ ID NO: 872842 - DNA, 11 bp, Homo sapiens
gaccagctggg

SEQ ID NO: 872843 - DNA, 13 bp, Homo sapiens
gaccagctggggc

SEQ ID NO: 872844 - DNA, 19 bp, Homo sapiens
gaccaggactccctcctca

SEQ ID NO: 872845 - DNA, 21 bp, Homo sapiens
gaccaggactccctcctcacc

SEQ ID NO: 872846 - DNA, 21 bp, Homo sapiens
gaccaggatcccaagcctcct

SEQ ID NO: 872847 - DNA, 23 bp, Homo sapiens
gaccaggcatcctccacaatagc

SEQ ID NO: 872848 - DNA, 13 bp, Homo sapiens
gaccaggcctgga

SEQ ID NO: 872849 - DNA, 14 bp, Homo sapiens
gaccaggcctggag

SEQ ID NO: 872850 - DNA, 14 bp, Homo sapiens
gaccaggctgtgtc

SEQ ID NO: 872851 - DNA, 16 bp, Homo sapiens
gaccaggcttggcctt

SEQ ID NO: 872852 - DNA, 22 bp, Homo sapiens
gaccagggagcctttggttctg

SEQ ID NO: 872853 - DNA, 13 bp, Homo sapiens
gaccagggatgct

SEQ ID NO: 872854 - DNA, 18 bp, Homo sapiens
gaccagggatgctgggct

SEQ ID NO: 872855 - DNA, 19 bp, Homo sapiens
gaccagggatgctgggctg

SEQ ID NO: 872856 - DNA, 20 bp, Homo sapiens
gaccagggatgctgggctgg

SEQ ID NO: 872857 - DNA, 16 bp, Homo sapiens
gaccagggccctgggc

SEQ ID NO: 872858 - DNA, 21 bp, Homo sapiens
gaccaggggcccaccctctgc

SEQ ID NO: 872859 - DNA, 23 bp, Homo sapiens
gaccaggggcccaccctctgccc

SEQ ID NO: 872860 - DNA, 15 bp, Homo sapiens
gacctgactattgaa

SEQ ID NO: 872861 - DNA, 24 bp, Homo sapiens
gacctgagactcacactctctgca

SEQ ID NO: 872862 - DNA, 12 bp, Homo sapiens
gacctgagcccg

SEQ ID NO: 872863 - DNA, 13 bp, Homo sapiens
gacctgagcggca

SEQ ID NO: 872864 - DNA, 19 bp, Homo sapiens
gacctgagcggcaccctgg

SEQ ID NO: 872865 - DNA, 22 bp, Homo sapiens
gacctgagcggcaccctggtct

SEQ ID NO: 872866 - DNA, 16 bp, Homo sapiens
gacctgaggagacatc

SEQ ID NO: 872867 - DNA, 13 bp, Homo sapiens
gacctgaggctgt

SEQ ID NO: 872868 - DNA, 19 bp, Homo sapiens
gacctgagtattttttata

SEQ ID NO: 872869 - DNA, 17 bp, Homo sapiens
gacctgagtcggcccca

SEQ ID NO: 872870 - DNA, 22 bp, Homo sapiens
gacctgatcattacatggctgt

SEQ ID NO: 872871 - DNA, 23 bp, Homo sapiens
gacctgatcattacatggctgtg

SEQ ID NO: 872872 - DNA, 21 bp, Homo sapiens
gacctgatttcagaagagact

SEQ ID NO: 872873 - DNA, 16 bp, Homo sapiens
gacctgcactggggag

SEQ ID NO: 872874 - DNA, 13 bp, Homo sapiens
gacctgcaggcca

SEQ ID NO: 872875 - DNA, 14 bp, Homo sapiens
gacctgcagtgagg

SEQ ID NO: 872876 - DNA, 20 bp, Homo sapiens
gacctgcagtgaggggccct

SEQ ID NO: 872877 - DNA, 16 bp, Homo sapiens
gacctgccaggcaggg

SEQ ID NO: 872878 - DNA, 22 bp, Homo sapiens
gacctgccccggacctacctcc

SEQ ID NO: 872879 - DNA, 13 bp, Homo sapiens
gacctgcctagca

SEQ ID NO: 872880 - DNA, 13 bp, Homo sapiens
gacctgcctcctg

SEQ ID NO: 872881 - DNA, 14 bp, Homo sapiens
gacctgcctcctgc

SEQ ID NO: 872882 - DNA, 16 bp, Homo sapiens
gacctgcctcctgcct

SEQ ID NO: 872883 - DNA, 15 bp, Homo sapiens
gacctgcgggtcctc

SEQ ID NO: 872884 - DNA, 18 bp, Homo sapiens
gacctgcgggtcctcagc

SEQ ID NO: 872885 - DNA, 23 bp, Homo sapiens
gacctgctcatcatattccaacc

SEQ ID NO: 872886 - DNA, 17 bp, Homo sapiens
gacctgctccgccagga

SEQ ID NO: 872887 - DNA, 18 bp, Homo sapiens
gacctgctccgccaggaa

SEQ ID NO: 872888 - DNA, 22 bp, Homo sapiens
gacctggaactgtagggccagg

SEQ ID NO: 872889 - DNA, 12 bp, Homo sapiens
gacctggagccc

SEQ ID NO: 872890 - DNA, 14 bp, Homo sapiens
gacctggagcccct

SEQ ID NO: 872891 - DNA, 15 bp, Homo sapiens
gacctggagcccctg

SEQ ID NO: 872892 - DNA, 14 bp, Homo sapiens
gacctggcgtgctc

SEQ ID NO: 872893 - DNA, 15 bp, Homo sapiens
gacctgggcccacag

SEQ ID NO: 872894 - DNA, 19 bp, Homo sapiens
gacctgggcccacagagcc

SEQ ID NO: 872895 - DNA, 14 bp, Homo sapiens
gacctggggcacag

SEQ ID NO: 872896 - DNA, 15 bp, Homo sapiens
gacctggggcacagt

SEQ ID NO: 872897 - DNA, 17 bp, Homo sapiens
gacctgggtatcccctg

SEQ ID NO: 872898 - DNA, 20 bp, Homo sapiens
gacctggtacactctgattt

SEQ ID NO: 872899 - DNA, 16 bp, Homo sapiens
gacctggtgtgcggag

SEQ ID NO: 872900 - DNA, 20 bp, Homo sapiens
gacctggtgtgcggaggcag

SEQ ID NO: 872901 - DNA, 17 bp, Homo sapiens
gacctgtaacttttgta

SEQ ID NO: 872902 - DNA, 17 bp, Homo sapiens
gacctgtcatgcccccc

SEQ ID NO: 872903 - DNA, 19 bp, Homo sapiens
gacctgtcatgcccccctc

SEQ ID NO: 872904 - DNA, 11 bp, Homo sapiens
gacctgtccag

SEQ ID NO: 872905 - DNA, 14 bp, Homo sapiens
gacctgtcccccac

SEQ ID NO: 872906 - DNA, 19 bp, Homo sapiens
gacctgtctataagagaat

SEQ ID NO: 872907 - DNA, 12 bp, Homo sapiens
gacctgtgacca

SEQ ID NO: 872908 - DNA, 19 bp, Homo sapiens
gacctgtgctagttttaca

SEQ ID NO: 872909 - DNA, 13 bp, Homo sapiens
gacctgttggcct

SEQ ID NO: 872910 - DNA, 15 bp, Homo sapiens
gacctgttggcctgt

SEQ ID NO: 872911 - DNA, 23 bp, Homo sapiens
gacctgttggcctgtgggcctca

SEQ ID NO: 872912 - DNA, 14 bp, Homo sapiens
gacctgtttctctt

SEQ ID NO: 872913 - DNA, 17 bp, Homo sapiens
gaccttaagacactgtg

SEQ ID NO: 872914 - DNA, 13 bp, Homo sapiens
gaccttagaaatc

SEQ ID NO: 872915 - DNA, 23 bp, Homo sapiens
gaccttagaaatcattgtagaaa

SEQ ID NO: 872916 - DNA, 17 bp, Homo sapiens
gaccttagcgttctgga

SEQ ID NO: 872917 - DNA, 23 bp, Homo sapiens
gaccttagcttattgatcccaca

SEQ ID NO: 872918 - DNA, 12 bp, Homo sapiens
gaccttatctgt

SEQ ID NO: 872919 - DNA, 21 bp, Homo sapiens
gaccttatctgtgcgtgaaac

SEQ ID NO: 872920 - DNA, 22 bp, Homo sapiens
gaccttccataatgctactgtc

SEQ ID NO: 872921 - DNA, 19 bp, Homo sapiens
gaccttccccaaaggatgg

SEQ ID NO: 872922 - DNA, 12 bp, Homo sapiens
gaccttcctcat

SEQ ID NO: 872923 - DNA, 18 bp, Homo sapiens
gaccttcgggctgtgccc

SEQ ID NO: 872924 - DNA, 20 bp, Homo sapiens
gaccttctagtgagcctggg

SEQ ID NO: 872925 - DNA, 23 bp, Homo sapiens
gaccttctagtgagcctgggcca

SEQ ID NO: 872926 - DNA, 18 bp, Homo sapiens
gaccttctccaaatgaga

SEQ ID NO: 872927 - DNA, 18 bp, Homo sapiens
gaccttctggtatcttgt

SEQ ID NO: 872928 - DNA, 16 bp, Homo sapiens
gaccttgacagagcag

SEQ ID NO: 872929 - DNA, 22 bp, Homo sapiens
gaccttgagggtgggccagcat

SEQ ID NO: 872930 - DNA, 23 bp, Homo sapiens
gaccttgagggtgggccagcata

SEQ ID NO: 872931 - DNA, 15 bp, Homo sapiens
gaccttggcctctcc

SEQ ID NO: 872932 - DNA, 16 bp, Homo sapiens
gaccttggcctctcct

SEQ ID NO: 872933 - DNA, 22 bp, Homo sapiens
gacctttaattcaggtatgtaa

SEQ ID NO: 872934 - DNA, 12 bp, Homo sapiens
gacctttatcca

SEQ ID NO: 872935 - DNA, 13 bp, Homo sapiens
gacctttccacca

SEQ ID NO: 872936 - DNA, 13 bp, Homo sapiens
gacctttgacctc

SEQ ID NO: 872937 - DNA, 18 bp, Homo sapiens
gacctttgggtctacaag

SEQ ID NO: 872938 - DNA, 22 bp, Homo sapiens
gaccttttcaacttggcttcct

SEQ ID NO: 872939 - DNA, 18 bp, Homo sapiens
gaccttttttttttttcc

SEQ ID NO: 872940 - DNA, 21 bp, Homo sapiens
gacgaacatccaaccttccca

SEQ ID NO: 872941 - DNA, 14 bp, Homo sapiens
gacgaatatgaatg

SEQ ID NO: 872942 - DNA, 17 bp, Homo sapiens
gacgaatatgaatgtca

SEQ ID NO: 872943 - DNA, 21 bp, Homo sapiens
gacgaatatgaatgtcacatt

SEQ ID NO: 872944 - DNA, 20 bp, Homo sapiens
gacgaatttggccgatggca

SEQ ID NO: 872945 - DNA, 21 bp, Homo sapiens
gacgacaagtgctgaacagtg

SEQ ID NO: 872946 - DNA, 22 bp, Homo sapiens
gacgagcatccccctcctctcc

SEQ ID NO: 872947 - DNA, 15 bp, Homo sapiens
gacgagttgatttcc

SEQ ID NO: 872948 - DNA, 15 bp, Homo sapiens
gacgatgggtgttgc

SEQ ID NO: 872949 - DNA, 18 bp, Homo sapiens
gacgcacgctcgctgcca

SEQ ID NO: 872950 - DNA, 20 bp, Homo sapiens
gacgcagccggagggaggca

SEQ ID NO: 872951 - DNA, 13 bp, Homo sapiens
gacgcaggaatgg

SEQ ID NO: 872952 - DNA, 13 bp, Homo sapiens
gacgcaggccctg

SEQ ID NO: 872953 - DNA, 16 bp, Homo sapiens
gacgcagtccgcccag

SEQ ID NO: 872954 - DNA, 16 bp, Homo sapiens
gacgcatagactgagg

SEQ ID NO: 872955 - DNA, 18 bp, Homo sapiens
gacgcatctcaaaacaga

SEQ ID NO: 872956 - DNA, 22 bp, Homo sapiens
gacgcatgccctcaatcccagc

SEQ ID NO: 872957 - DNA, 18 bp, Homo sapiens
gacgccactccctgggac

SEQ ID NO: 872958 - DNA, 22 bp, Homo sapiens
gacgccatgtgatggacactcc

SEQ ID NO: 872959 - DNA, 11 bp, Homo sapiens
gacgcccacct

SEQ ID NO: 872960 - DNA, 22 bp, Homo sapiens
gacgcccagctccgcctgctgg

SEQ ID NO: 872961 - DNA, 23 bp, Homo sapiens
gacgccctatttctatgtcattt

SEQ ID NO: 872962 - DNA, 15 bp, Homo sapiens
gacgcctgagacagc

SEQ ID NO: 872963 - DNA, 17 bp, Homo sapiens
gacgcctgagacagcac

SEQ ID NO: 872964 - DNA, 17 bp, Homo sapiens
gaccctggtgacctcct

SEQ ID NO: 872965 - DNA, 18 bp, Homo sapiens
gaccctggtgacctcctg

SEQ ID NO: 872966 - DNA, 20 bp, Homo sapiens
gaccctggtgggctgttcag

SEQ ID NO: 872967 - DNA, 17 bp, Homo sapiens
gaccctgtccggcccag

SEQ ID NO: 872968 - DNA, 21 bp, Homo sapiens
gaccctgtccggcccagtgcc

SEQ ID NO: 872969 - DNA, 15 bp, Homo sapiens
gaccctgtcctgcag

SEQ ID NO: 872970 - DNA, 20 bp, Homo sapiens
gaccctgtcttctgggcaca

SEQ ID NO: 872971 - DNA, 22 bp, Homo sapiens
gaccctgtgacatggtgcctga

SEQ ID NO: 872972 - DNA, 14 bp, Homo sapiens
gaccctgtggaagc

SEQ ID NO: 872973 - DNA, 13 bp, Homo sapiens
gaccctgtttctg

SEQ ID NO: 872974 - DNA, 21 bp, Homo sapiens
gacccttattacacggaaaac

SEQ ID NO: 872975 - DNA, 20 bp, Homo sapiens
gacccttattgctgtcctgg

SEQ ID NO: 872976 - DNA, 16 bp, Homo sapiens
gacccttcagggccag

SEQ ID NO: 872977 - DNA, 21 bp, Homo sapiens
gacccttctccaaaggctctg

SEQ ID NO: 872978 - DNA, 17 bp, Homo sapiens
gacccttgacacctgct

SEQ ID NO: 872979 - DNA, 18 bp, Homo sapiens
gacccttgcctgcctcct

SEQ ID NO: 872980 - DNA, 18 bp, Homo sapiens
gacccttggcctccattt

SEQ ID NO: 872981 - DNA, 13 bp, Homo sapiens
gaccctttcctcc

SEQ ID NO: 872982 - DNA, 23 bp, Homo sapiens
gaccctttcctcccccagcgtca

SEQ ID NO: 872983 - DNA, 20 bp, Homo sapiens
gaccctttccttccttccct

SEQ ID NO: 872984 - DNA, 14 bp, Homo sapiens
gacccttttctcag

SEQ ID NO: 872985 - DNA, 16 bp, Homo sapiens
gacccttttctcagga

SEQ ID NO: 872986 - DNA, 23 bp, Homo sapiens
gaccgaaatctgtattctgtttg

SEQ ID NO: 872987 - DNA, 22 bp, Homo sapiens
gaccgatgtgtctcccagaact

SEQ ID NO: 872988 - DNA, 16 bp, Homo sapiens
gaccgcagagggaagc

SEQ ID NO: 872989 - DNA, 15 bp, Homo sapiens
gaccgccccagggct

SEQ ID NO: 872990 - DNA, 12 bp, Homo sapiens
gaccgccccctc

SEQ ID NO: 872991 - DNA, 17 bp, Homo sapiens
gaccgccgatcccaggt

SEQ ID NO: 872992 - DNA, 18 bp, Homo sapiens
gaccgccgatcccaggtg

SEQ ID NO: 872993 - DNA, 12 bp, Homo sapiens
gaccgcgcaggc

SEQ ID NO: 872994 - DNA, 20 bp, Homo sapiens
gaccgcgtagagagccgggc

SEQ ID NO: 872995 - DNA, 16 bp, Homo sapiens
gaccgctgataagcat

SEQ ID NO: 872996 - DNA, 14 bp, Homo sapiens
gaccgcttcacccc

SEQ ID NO: 872997 - DNA, 17 bp, Homo sapiens
gaccgcttcacccctgc

SEQ ID NO: 872998 - DNA, 19 bp, Homo sapiens
gaccgcttcacccctgcac

SEQ ID NO: 872999 - DNA, 20 bp, Homo sapiens
gaccgcttgtggggacccag

SEQ ID NO: 873000 - DNA, 19 bp, Homo sapiens
gaccggcggaccccagcca

SEQ ID NO: 873001 - DNA, 15 bp, Homo sapiens
gaccgggcccccctg

SEQ ID NO: 873002 - DNA, 16 bp, Homo sapiens
gaccgggcccccctga

SEQ ID NO: 873003 - DNA, 15 bp, Homo sapiens
gaccgggggctgctg

SEQ ID NO: 873004 - DNA, 19 bp, Homo sapiens
gaccgggggctgctgggcg

SEQ ID NO: 873005 - DNA, 14 bp, Homo sapiens
gaccgggtgggcct

SEQ ID NO: 873006 - DNA, 15 bp, Homo sapiens
gaccgggtgggcctg

SEQ ID NO: 873007 - DNA, 15 bp, Homo sapiens
gaccggtgctgcagg

SEQ ID NO: 873008 - DNA, 18 bp, Homo sapiens
gaccgtacaaactcagat

SEQ ID NO: 873009 - DNA, 21 bp, Homo sapiens
gaccgtgatttggaagagagg

SEQ ID NO: 873010 - DNA, 20 bp, Homo sapiens
gaccgtgccccacctcccca

SEQ ID NO: 873011 - DNA, 14 bp, Homo sapiens
gaccgtgcgagctg

SEQ ID NO: 873012 - DNA, 15 bp, Homo sapiens
gaccgtgcgagctgc

SEQ ID NO: 873013 - DNA, 16 bp, Homo sapiens
gaccgtgcgagctgcc

SEQ ID NO: 873014 - DNA, 12 bp, Homo sapiens
gaccgtgtacaa

SEQ ID NO: 873015 - DNA, 14 bp, Homo sapiens
gaccgtgtacaata

SEQ ID NO: 873016 - DNA, 16 bp, Homo sapiens
gaccgtgtcccaagga

SEQ ID NO: 873017 - DNA, 20 bp, Homo sapiens
gaccgtgtcccaaggagctg

SEQ ID NO: 873018 - DNA, 22 bp, Homo sapiens
gaccgttcagtgtcccaggcag

SEQ ID NO: 873019 - DNA, 18 bp, Homo sapiens
gaccgttttcatcctggc

SEQ ID NO: 873020 - DNA, 22 bp, Homo sapiens
gaccgttttcatcctggcctcc

SEQ ID NO: 873021 - DNA, 17 bp, Homo sapiens
gacctaaattagataaa

SEQ ID NO: 873022 - DNA, 14 bp, Homo sapiens
gacctacattccct

SEQ ID NO: 873023 - DNA, 17 bp, Homo sapiens
gacctacattccctctc

SEQ ID NO: 873024 - DNA, 19 bp, Homo sapiens
gacctacattccctctcct

SEQ ID NO: 873025 - DNA, 13 bp, Homo sapiens
gacctacctccct

SEQ ID NO: 873026 - DNA, 16 bp, Homo sapiens
gacctacctccctccc

SEQ ID NO: 873027 - DNA, 19 bp, Homo sapiens
gacctacctgcagtgggaa

SEQ ID NO: 873028 - DNA, 21 bp, Homo sapiens
gacctacgttcctggccccct

SEQ ID NO: 873029 - DNA, 21 bp, Homo sapiens
gacctactaggagaggggggc

SEQ ID NO: 873030 - DNA, 14 bp, Homo sapiens
gacctagctctttg

SEQ ID NO: 873031 - DNA, 14 bp, Homo sapiens
gacctaggcaagtt

SEQ ID NO: 873032 - DNA, 17 bp, Homo sapiens
gacctagggaggacctt

SEQ ID NO: 873033 - DNA, 22 bp, Homo sapiens
gacctagggggacggggctgac

SEQ ID NO: 873034 - DNA, 21 bp, Homo sapiens
gacctatgtcctaaggacaca

SEQ ID NO: 873035 - DNA, 21 bp, Homo sapiens
gacctattcaccctccacttc

SEQ ID NO: 873036 - DNA, 13 bp, Homo sapiens
gacctcaacctgt

SEQ ID NO: 873037 - DNA, 13 bp, Homo sapiens
gacctcaagccat

SEQ ID NO: 873038 - DNA, 15 bp, Homo sapiens
gacctcactgtcagg

SEQ ID NO: 873039 - DNA, 16 bp, Homo sapiens
gacctcactgtgacct

SEQ ID NO: 873040 - DNA, 15 bp, Homo sapiens
gacctcactttatta

SEQ ID NO: 873041 - DNA, 13 bp, Homo sapiens
gacctcagccttc

SEQ ID NO: 873042 - DNA, 14 bp, Homo sapiens
gacctcagccttcc

SEQ ID NO: 873043 - DNA, 15 bp, Homo sapiens
gacctcaggagggca

SEQ ID NO: 873044 - DNA, 20 bp, Homo sapiens
gacctcaggagggcaggctg

SEQ ID NO: 873045 - DNA, 19 bp, Homo sapiens
gacctcaggggcacctccg

SEQ ID NO: 873046 - DNA, 19 bp, Homo sapiens
gacctcaggtgagaagcag

SEQ ID NO: 873047 - DNA, 21 bp, Homo sapiens
gacctcagttttatcattttc

SEQ ID NO: 873048 - DNA, 10 bp, Homo sapiens
gacctcatca

SEQ ID NO: 873049 - DNA, 15 bp, Homo sapiens
gacctcatctgtgga

SEQ ID NO: 873050 - DNA, 20 bp, Homo sapiens
gacctcatctgtggagctgc

SEQ ID NO: 873051 - DNA, 18 bp, Homo sapiens
gacctcatgatctgccca

SEQ ID NO: 873052 - DNA, 12 bp, Homo sapiens
gacctcatgccc

SEQ ID NO: 873053 - DNA, 19 bp, Homo sapiens
gacctccaataaagtgcct

SEQ ID NO: 873054 - DNA, 20 bp, Homo sapiens
gacctccacacccgtgagaa

SEQ ID NO: 873055 - DNA, 22 bp, Homo sapiens
gacctccaggggctcctgggtt

SEQ ID NO: 873056 - DNA, 17 bp, Homo sapiens
gacctccatccctgctc

SEQ ID NO: 873057 - DNA, 15 bp, Homo sapiens
gacctcccagcccta

SEQ ID NO: 873058 - DNA, 22 bp, Homo sapiens
gacctcccagccctatggatgt

SEQ ID NO: 873059 - DNA, 19 bp, Homo sapiens
gacctcccaggacaagcac

SEQ ID NO: 873060 - DNA, 14 bp, Homo sapiens
gacctccccctcac

SEQ ID NO: 873061 - DNA, 15 bp, Homo sapiens
gacctccccctcact

SEQ ID NO: 873062 - DNA, 17 bp, Homo sapiens
gacctcccctccccagc

SEQ ID NO: 873063 - DNA, 14 bp, Homo sapiens
gacctcccttccga

SEQ ID NO: 873064 - DNA, 21 bp, Homo sapiens
gacctcccttccgaccctctg

SEQ ID NO: 873065 - DNA, 16 bp, Homo sapiens
gacctccgcccctgcc

SEQ ID NO: 873066 - DNA, 18 bp, Homo sapiens
gacctccgcccctgcccc

SEQ ID NO: 873067 - DNA, 17 bp, Homo sapiens
gacctcctaacaagtag

SEQ ID NO: 873068 - DNA, 14 bp, Homo sapiens
gacctcctccctca

SEQ ID NO: 873069 - DNA, 13 bp, Homo sapiens
gacctcctgacaa

SEQ ID NO: 873070 - DNA, 13 bp, Homo sapiens
gacctcctgtcac

SEQ ID NO: 873071 - DNA, 14 bp, Homo sapiens
gacctcctgtcact

SEQ ID NO: 873072 - DNA, 22 bp, Homo sapiens
gacctcctgtcactcactgagg

SEQ ID NO: 873073 - DNA, 21 bp, Homo sapiens
gacctcggtgaccactcttct

SEQ ID NO: 873074 - DNA, 18 bp, Homo sapiens
gaccctgctcacaggcag

SEQ ID NO: 873075 - DNA, 12 bp, Homo sapiens
gaccctgctgac

SEQ ID NO: 873076 - DNA, 14 bp, Homo sapiens
gaccctgcttcacc

SEQ ID NO: 873077 - DNA, 17 bp, Homo sapiens
gaccctgcttcaccctc

SEQ ID NO: 873078 - DNA, 23 bp, Homo sapiens
gaccctggaattcagcaccctgg

SEQ ID NO: 873079 - DNA, 17 bp, Homo sapiens
gaccctgggagagaagt

SEQ ID NO: 873080 - DNA, 18 bp, Homo sapiens
gaccctgggtgggctctg

SEQ ID NO: 873081 - DNA, 17 bp, Homo sapiens
gacttcacataagctca

SEQ ID NO: 873082 - DNA, 21 bp, Homo sapiens
gacttcacataagctcagaat

SEQ ID NO: 873083 - DNA, 17 bp, Homo sapiens
gacttcactgtatataa

SEQ ID NO: 873084 - DNA, 20 bp, Homo sapiens
gacttcactgtatataaaca

SEQ ID NO: 873085 - DNA, 12 bp, Homo sapiens
gacttcagattg

SEQ ID NO: 873086 - DNA, 17 bp, Homo sapiens
gacttcagctgcctgaa

SEQ ID NO: 873087 - DNA, 21 bp, Homo sapiens
gacttcagctgcctgaaacag

SEQ ID NO: 873088 - DNA, 24 bp, Homo sapiens
gacttcaggtggagagcactagaa

SEQ ID NO: 873089 - DNA, 17 bp, Homo sapiens
gacttcagtatgttgtc

SEQ ID NO: 873090 - DNA, 19 bp, Homo sapiens
gacttcagtatgttgtcaa

SEQ ID NO: 873091 - DNA, 20 bp, Homo sapiens
gacttcagtatgttgtcaaa

SEQ ID NO: 873092 - DNA, 19 bp, Homo sapiens
gacttcagtgaaattttca

SEQ ID NO: 873093 - DNA, 23 bp, Homo sapiens
gacttcagtgtgtgtatttgtgt

SEQ ID NO: 873094 - DNA, 21 bp, Homo sapiens
gacttcatcaaacatgggttt

SEQ ID NO: 873095 - DNA, 12 bp, Homo sapiens
gacttcatttgt

SEQ ID NO: 873096 - DNA, 17 bp, Homo sapiens
gacttcatttgtgccac

SEQ ID NO: 873097 - DNA, 19 bp, Homo sapiens
gacttcatttgtgccacac

SEQ ID NO: 873098 - DNA, 19 bp, Homo sapiens
gacttcccaacagccttag

SEQ ID NO: 873099 - DNA, 12 bp, Homo sapiens
gacttcccagct

SEQ ID NO: 873100 - DNA, 20 bp, Homo sapiens
gacttccccaaacccagaaa

SEQ ID NO: 873101 - DNA, 17 bp, Homo sapiens
gacttccccatcccgaa

SEQ ID NO: 873102 - DNA, 17 bp, Homo sapiens
gacttcccctgggcaag

SEQ ID NO: 873103 - DNA, 15 bp, Homo sapiens
gacttccctggtcac

SEQ ID NO: 873104 - DNA, 16 bp, Homo sapiens
gacttccgctccctgg

SEQ ID NO: 873105 - DNA, 12 bp, Homo sapiens
gacttcctctgg

SEQ ID NO: 873106 - DNA, 22 bp, Homo sapiens
gacttcctggtgaggcccagcc

SEQ ID NO: 873107 - DNA, 14 bp, Homo sapiens
gacttccttactaa

SEQ ID NO: 873108 - DNA, 15 bp, Homo sapiens
gacttccttgagaca

SEQ ID NO: 873109 - DNA, 16 bp, Homo sapiens
gacttccttgagacac

SEQ ID NO: 873110 - DNA, 16 bp, Homo sapiens
gacttccttgctctcc

SEQ ID NO: 873111 - DNA, 16 bp, Homo sapiens
gacttcgactcaggat

SEQ ID NO: 873112 - DNA, 19 bp, Homo sapiens
gacttctattttttaaaga

SEQ ID NO: 873113 - DNA, 14 bp, Homo sapiens
gacttctcccccgc

SEQ ID NO: 873114 - DNA, 16 bp, Homo sapiens
gacttctcccccgccc

SEQ ID NO: 873115 - DNA, 16 bp, Homo sapiens
gacttctcccctgccc

SEQ ID NO: 873116 - DNA, 22 bp, Homo sapiens
gacttctctgaatcagaaaagc

SEQ ID NO: 873117 - DNA, 13 bp, Homo sapiens
gacttctggaagg

SEQ ID NO: 873118 - DNA, 17 bp, Homo sapiens
gacttctggaaggctgg

SEQ ID NO: 873119 - DNA, 12 bp, Homo sapiens
gacttctggagg

SEQ ID NO: 873120 - DNA, 20 bp, Homo sapiens
gacttcttacccaaagcaca

SEQ ID NO: 873121 - DNA, 23 bp, Homo sapiens
gacttcttggttttctctctgga

SEQ ID NO: 873122 - DNA, 21 bp, Homo sapiens
gacttctttcaaattgagaga

SEQ ID NO: 873123 - DNA, 22 bp, Homo sapiens
gacttcttttgagttaggttaa

SEQ ID NO: 873124 - DNA, 21 bp, Homo sapiens
gacttgaaaccagaagaagtg

SEQ ID NO: 873125 - DNA, 16 bp, Homo sapiens
gacttgaaagcatcca

SEQ ID NO: 873126 - DNA, 20 bp, Homo sapiens
gacttgaaccacaagtgaat

SEQ ID NO: 873127 - DNA, 20 bp, Homo sapiens
gacttgaagcacagagggct

SEQ ID NO: 873128 - DNA, 23 bp, Homo sapiens
gacttgacaacatcccacagtgg

SEQ ID NO: 873129 - DNA, 14 bp, Homo sapiens
gacttgagccactc

SEQ ID NO: 873130 - DNA, 15 bp, Homo sapiens
gacttgattgtactt

SEQ ID NO: 873131 - DNA, 11 bp, Homo sapiens
gacttgcctcc

SEQ ID NO: 873132 - DNA, 14 bp, Homo sapiens
gacttgctaaagca

SEQ ID NO: 873133 - DNA, 17 bp, Homo sapiens
gacttgctgtccaggca

SEQ ID NO: 873134 - DNA, 18 bp, Homo sapiens
gacttgctgtccaggcag

SEQ ID NO: 873135 - DNA, 21 bp, Homo sapiens
gacttgctgtgtgaccctggg

SEQ ID NO: 873136 - DNA, 18 bp, Homo sapiens
gacttggaagaggaggag

SEQ ID NO: 873137 - DNA, 15 bp, Homo sapiens
gacttggacatctct

SEQ ID NO: 873138 - DNA, 14 bp, Homo sapiens
gactctgccgctgt

SEQ ID NO: 873139 - DNA, 22 bp, Homo sapiens
gactctgcctcctggtttcctt

SEQ ID NO: 873140 - DNA, 21 bp, Homo sapiens
gactctgcgggaggctggggc

SEQ ID NO: 873141 - DNA, 19 bp, Homo sapiens
gactctgctgctcatggga

SEQ ID NO: 873142 - DNA, 13 bp, Homo sapiens
gactctgcttaaa

SEQ ID NO: 873143 - DNA, 19 bp, Homo sapiens
gactctgcttaaacaaagc

SEQ ID NO: 873144 - DNA, 17 bp, Homo sapiens
gactctggactttctct

SEQ ID NO: 873145 - DNA, 16 bp, Homo sapiens
gactctggcaaagctt

SEQ ID NO: 873146 - DNA, 20 bp, Homo sapiens
gactctggcacagtgatgcc

SEQ ID NO: 873147 - DNA, 21 bp, Homo sapiens
gactctgggctatggacacag

SEQ ID NO: 873148 - DNA, 19 bp, Homo sapiens
gactctgggtccctcggag

SEQ ID NO: 873149 - DNA, 20 bp, Homo sapiens
gactctgggtccctcggagc

SEQ ID NO: 873150 - DNA, 16 bp, Homo sapiens
gactctgggttcgttg

SEQ ID NO: 873151 - DNA, 22 bp, Homo sapiens
gactctgtcaatttccctgact

SEQ ID NO: 873152 - DNA, 20 bp, Homo sapiens
gactcttcccctccctccca

SEQ ID NO: 873153 - DNA, 16 bp, Homo sapiens
gactcttcctgcaaag

SEQ ID NO: 873154 - DNA, 11 bp, Homo sapiens
gactcttgcct

SEQ ID NO: 873155 - DNA, 16 bp, Homo sapiens
gactcttgctctttct

SEQ ID NO: 873156 - DNA, 19 bp, Homo sapiens
gactcttggagcctctttt

SEQ ID NO: 873157 - DNA, 21 bp, Homo sapiens
gactctttaataaattgctta

SEQ ID NO: 873158 - DNA, 16 bp, Homo sapiens
gactctttatttttct

SEQ ID NO: 873159 - DNA, 18 bp, Homo sapiens
gactctttatttttctct

SEQ ID NO: 873160 - DNA, 22 bp, Homo sapiens
gactctttatttttctctttct

SEQ ID NO: 873161 - DNA, 14 bp, Homo sapiens
gactctttcaaaga

SEQ ID NO: 873162 - DNA, 13 bp, Homo sapiens
gactctttgaaat

SEQ ID NO: 873163 - DNA, 14 bp, Homo sapiens
gactctttgaaatg

SEQ ID NO: 873164 - DNA, 19 bp, Homo sapiens
gactctttttagggccagg

SEQ ID NO: 873165 - DNA, 15 bp, Homo sapiens
gactgaaaatattgt

SEQ ID NO: 873166 - DNA, 21 bp, Homo sapiens
gactgaaagaagaacagctgt

SEQ ID NO: 873167 - DNA, 13 bp, Homo sapiens
gactgaagaagat

SEQ ID NO: 873168 - DNA, 21 bp, Homo sapiens
gactgaagactgcacaggtga

SEQ ID NO: 873169 - DNA, 15 bp, Homo sapiens
gactgaaggggcaca

SEQ ID NO: 873170 - DNA, 18 bp, Homo sapiens
gactgaagtcagtgtaga

SEQ ID NO: 873171 - DNA, 12 bp, Homo sapiens
gactgaatagaa

SEQ ID NO: 873172 - DNA, 15 bp, Homo sapiens
gactgaatgtgccta

SEQ ID NO: 873173 - DNA, 12 bp, Homo sapiens
gactgaatgttt

SEQ ID NO: 873174 - DNA, 18 bp, Homo sapiens
gactgaattgtccccagt

SEQ ID NO: 873175 - DNA, 14 bp, Homo sapiens
gactgaatttcttt

SEQ ID NO: 873176 - DNA, 17 bp, Homo sapiens
gactgaatttgggcctc

SEQ ID NO: 873177 - DNA, 13 bp, Homo sapiens
gactgacactact

SEQ ID NO: 873178 - DNA, 18 bp, Homo sapiens
gagaccaaggcgggagca

SEQ ID NO: 873179 - DNA, 18 bp, Homo sapiens
gagaccaagtcctggcta

SEQ ID NO: 873180 - DNA, 19 bp, Homo sapiens
gagaccaagtcctggctac

SEQ ID NO: 873181 - DNA, 13 bp, Homo sapiens
gagaccagcctgg

SEQ ID NO: 873182 - DNA, 17 bp, Homo sapiens
gagaccaggctgtgtcc

SEQ ID NO: 873183 - DNA, 12 bp, Homo sapiens
gagaccagggct

SEQ ID NO: 873184 - DNA, 23 bp, Homo sapiens
gagaccagttgaataaaagtgca

SEQ ID NO: 873185 - DNA, 12 bp, Homo sapiens
gagaccatcctg

SEQ ID NO: 873186 - DNA, 14 bp, Homo sapiens
gagaccatcctggc

SEQ ID NO: 873187 - DNA, 17 bp, Homo sapiens
gagacccaacagcagtg

SEQ ID NO: 873188 - DNA, 20 bp, Homo sapiens
gagaccccagtcgtgatgtg

SEQ ID NO: 873189 - DNA, 23 bp, Homo sapiens
gagacccccacacctcagttccc

SEQ ID NO: 873190 - DNA, 13 bp, Homo sapiens
gagacccccaggc

SEQ ID NO: 873191 - DNA, 16 bp, Homo sapiens
gagacccccaggcaga

SEQ ID NO: 873192 - DNA, 16 bp, Homo sapiens
gagacccccaggcctg

SEQ ID NO: 873193 - DNA, 15 bp, Homo sapiens
gagaccccgcactgc

SEQ ID NO: 873194 - DNA, 16 bp, Homo sapiens
gagaccccgcactgca

SEQ ID NO: 873195 - DNA, 17 bp, Homo sapiens
gagaccccgcactgcag

SEQ ID NO: 873196 - DNA, 18 bp, Homo sapiens
gagaccccgcactgcaga

SEQ ID NO: 873197 - DNA, 19 bp, Homo sapiens
gagaccccgcactgcagac

SEQ ID NO: 873198 - DNA, 13 bp, Homo sapiens
gagacccctgtct

SEQ ID NO: 873199 - DNA, 22 bp, Homo sapiens
gagaccccttgttgcactgccc

SEQ ID NO: 873200 - DNA, 17 bp, Homo sapiens
gagaccctcgcagacct

SEQ ID NO: 873201 - DNA, 23 bp, Homo sapiens
gagaccctcgcccaactccacca

SEQ ID NO: 873202 - DNA, 22 bp, Homo sapiens
gagaccctgcaaacagaacagg

SEQ ID NO: 873203 - DNA, 23 bp, Homo sapiens
gagaccctgcaagaccacggagg

SEQ ID NO: 873204 - DNA, 19 bp, Homo sapiens
gagaccctgccacagccag

SEQ ID NO: 873205 - DNA, 13 bp, Homo sapiens
gagaccctggaat

SEQ ID NO: 873206 - DNA, 18 bp, Homo sapiens
gagaccctggaattcagc

SEQ ID NO: 873207 - DNA, 22 bp, Homo sapiens
gagaccctggaattcagcaccc

SEQ ID NO: 873208 - DNA, 18 bp, Homo sapiens
gagaccctgggagagaag

SEQ ID NO: 873209 - DNA, 14 bp, Homo sapiens
gagaccgagtgaac

SEQ ID NO: 873210 - DNA, 13 bp, Homo sapiens
gagaccgcagagg

SEQ ID NO: 873211 - DNA, 17 bp, Homo sapiens
gagaccgcttcacccct

SEQ ID NO: 873212 - DNA, 19 bp, Homo sapiens
gagaccgcttcacccctgc

SEQ ID NO: 873213 - DNA, 15 bp, Homo sapiens
gagacctacaggctg

SEQ ID NO: 873214 - DNA, 11 bp, Homo sapiens
gagacctcagc

SEQ ID NO: 873215 - DNA, 16 bp, Homo sapiens
gagacctcatcctgct

SEQ ID NO: 873216 - DNA, 20 bp, Homo sapiens
gagacctcatcctgctcttt

SEQ ID NO: 873217 - DNA, 15 bp, Homo sapiens
gagacctgacccaac

SEQ ID NO: 873218 - DNA, 16 bp, Homo sapiens
gagacctggaaccaga

SEQ ID NO: 873219 - DNA, 19 bp, Homo sapiens
gagacctggcactggatgc

SEQ ID NO: 873220 - DNA, 17 bp, Homo sapiens
gagaccttggctgctca

SEQ ID NO: 873221 - DNA, 15 bp, Homo sapiens
gagacggccctgctg

SEQ ID NO: 873222 - DNA, 17 bp, Homo sapiens
gagacggccctgctggg

SEQ ID NO: 873223 - DNA, 23 bp, Homo sapiens
gagacgggactgcggaggaagga

SEQ ID NO: 873224 - DNA, 18 bp, Homo sapiens
gagacggggtctccctgt

SEQ ID NO: 873225 - DNA, 14 bp, Homo sapiens
gagactaagccctg

SEQ ID NO: 873226 - DNA, 16 bp, Homo sapiens
gagactaagccctgtc

SEQ ID NO: 873227 - DNA, 17 bp, Homo sapiens
gagactcacctctgcct

SEQ ID NO: 873228 - DNA, 15 bp, Homo sapiens
gagactcagagggag

SEQ ID NO: 873229 - DNA, 17 bp, Homo sapiens
gagactcagggccccag

SEQ ID NO: 873230 - DNA, 13 bp, Homo sapiens
gagactccccaat

SEQ ID NO: 873231 - DNA, 17 bp, Homo sapiens
gagactcctgccctgtt

SEQ ID NO: 873232 - DNA, 15 bp, Homo sapiens
gagactctattttaa

SEQ ID NO: 873233 - DNA, 23 bp, Homo sapiens
gagactctgtggggccttggttc

SEQ ID NO: 873234 - DNA, 18 bp, Homo sapiens
gagactgaaagcagcagc

SEQ ID NO: 873235 - DNA, 21 bp, Homo sapiens
gagactgaaagcagcagctag

SEQ ID NO: 873236 - DNA, 21 bp, Homo sapiens
gagactgagatcactgactct

SEQ ID NO: 873237 - DNA, 17 bp, Homo sapiens
gagactgagcagccgcc

SEQ ID NO: 873238 - DNA, 22 bp, Homo sapiens
gagactgaggcttagagagagg

SEQ ID NO: 873239 - DNA, 23 bp, Homo sapiens
gagactgatcatccaggcctcag

SEQ ID NO: 873240 - DNA, 21 bp, Homo sapiens
gagactgatccctggccactg

SEQ ID NO: 873241 - DNA, 12 bp, Homo sapiens
gagactgatggg

SEQ ID NO: 873242 - DNA, 18 bp, Homo sapiens
gagactgatggggtcgct

SEQ ID NO: 873243 - DNA, 20 bp, Homo sapiens
gagactgcaggtgggctggg

SEQ ID NO: 873244 - DNA, 13 bp, Homo sapiens
gagactgcccttc

SEQ ID NO: 873245 - DNA, 14 bp, Homo sapiens
gagactgcttccca

SEQ ID NO: 873246 - DNA, 22 bp, Homo sapiens
gagactgcttcccatcctaccc

SEQ ID NO: 873247 - DNA, 12 bp, Homo sapiens
gagactggagca

SEQ ID NO: 873248 - DNA, 16 bp, Homo sapiens
gagactggagcatctg

SEQ ID NO: 873249 - DNA, 17 bp, Homo sapiens
gagactggcacttagcc

SEQ ID NO: 873250 - DNA, 19 bp, Homo sapiens
gagactggcgtgaacccag

SEQ ID NO: 873251 - DNA, 22 bp, Homo sapiens
gagactggcgtgaacccaggag

SEQ ID NO: 873252 - DNA, 17 bp, Homo sapiens
gagactgggctctggct

SEQ ID NO: 873253 - DNA, 19 bp, Homo sapiens
gagactgggctctggctct

SEQ ID NO: 873254 - DNA, 13 bp, Homo sapiens
gagactgggctga

SEQ ID NO: 873255 - DNA, 19 bp, Homo sapiens
gagactggttagtgatgca

SEQ ID NO: 873256 - DNA, 15 bp, Homo sapiens
gagactgtcaggaag

SEQ ID NO: 873257 - DNA, 17 bp, Homo sapiens
gagactgtcggagaggc

SEQ ID NO: 873258 - DNA, 23 bp, Homo sapiens
gagactgtcggagaggctgtctg

SEQ ID NO: 873259 - DNA, 12 bp, Homo sapiens
gagactgtgctg

SEQ ID NO: 873260 - DNA, 11 bp, Homo sapiens
gagactgtggt

SEQ ID NO: 873261 - DNA, 23 bp, Homo sapiens
gagactgtggtaggggcagggag

SEQ ID NO: 873262 - DNA, 15 bp, Homo sapiens
gagacttactgggtg

SEQ ID NO: 873263 - DNA, 21 bp, Homo sapiens
gagacttagggcaccaggggt

SEQ ID NO: 873264 - DNA, 19 bp, Homo sapiens
gagacttggaagaggagga

SEQ ID NO: 873265 - DNA, 22 bp, Homo sapiens
gagacttggccataaagataat

SEQ ID NO: 873266 - DNA, 21 bp, Homo sapiens
gagactttccattacaagtat

SEQ ID NO: 873267 - DNA, 13 bp, Homo sapiens
gagactttcttct

SEQ ID NO: 873268 - DNA, 20 bp, Homo sapiens
gagactttgctgttactgct

SEQ ID NO: 873269 - DNA, 18 bp, Homo sapiens
gagagaaaaagtgcccct

SEQ ID NO: 873270 - DNA, 17 bp, Homo sapiens
gagagaaaatatatgta

SEQ ID NO: 873271 - DNA, 12 bp, Homo sapiens
gagagaaagaga

SEQ ID NO: 873272 - DNA, 13 bp, Homo sapiens
gattattcattta

SEQ ID NO: 873273 - DNA, 14 bp, Homo sapiens
gattattcatttaa

SEQ ID NO: 873274 - DNA, 16 bp, Homo sapiens
gattattcatttaaaa

SEQ ID NO: 873275 - DNA, 21 bp, Homo sapiens
gattattcatttaaaatgatt

SEQ ID NO: 873276 - DNA, 22 bp, Homo sapiens
gattattcatttaaaatgatta

SEQ ID NO: 873277 - DNA, 16 bp, Homo sapiens
gattatttcatatact

SEQ ID NO: 873278 - DNA, 19 bp, Homo sapiens
gattatttcatatactata

SEQ ID NO: 873279 - DNA, 13 bp, Homo sapiens
gattatttgcatg

SEQ ID NO: 873280 - DNA, 21 bp, Homo sapiens
gattatttgggagggaaaagg

SEQ ID NO: 873281 - DNA, 15 bp, Homo sapiens
gattcaaaatattta

SEQ ID NO: 873282 - DNA, 19 bp, Homo sapiens
gattcaaaccaaagctgcc

SEQ ID NO: 873283 - DNA, 22 bp, Homo sapiens
gattcaaaccaaagctgcctgt

SEQ ID NO: 873284 - DNA, 15 bp, Homo sapiens
gattcaaagtgttgt

SEQ ID NO: 873285 - DNA, 22 bp, Homo sapiens
gattcaaagtgttgtgttcctg

SEQ ID NO: 873286 - DNA, 15 bp, Homo sapiens
gattcaaatgtttta

SEQ ID NO: 873287 - DNA, 14 bp, Homo sapiens
gattcaaatttatt

SEQ ID NO: 873288 - DNA, 12 bp, Homo sapiens
gattcaacctga

SEQ ID NO: 873289 - DNA, 22 bp, Homo sapiens
gattcaacctgatacatttaca

SEQ ID NO: 873290 - DNA, 14 bp, Homo sapiens
gattcaatctgtaa

SEQ ID NO: 873291 - DNA, 18 bp, Homo sapiens
gattcaatctgtaaactg

SEQ ID NO: 873292 - DNA, 19 bp, Homo sapiens
gattcaatctgtaaactgt

SEQ ID NO: 873293 - DNA, 20 bp, Homo sapiens
gattcaatctgtaaactgtg

SEQ ID NO: 873294 - DNA, 21 bp, Homo sapiens
gattcaatctgtaaactgtgt

SEQ ID NO: 873295 - DNA, 19 bp, Homo sapiens
gattcacctcctaaaacaa

SEQ ID NO: 873296 - DNA, 16 bp, Homo sapiens
gattcacctgtaaaac

SEQ ID NO: 873297 - DNA, 12 bp, Homo sapiens
gattcagaaatt

SEQ ID NO: 873298 - DNA, 18 bp, Homo sapiens
gattcagattgttatcta

SEQ ID NO: 873299 - DNA, 12 bp, Homo sapiens
gattcagcaaaa

SEQ ID NO: 873300 - DNA, 12 bp, Homo sapiens
gattcagccttc

SEQ ID NO: 873301 - DNA, 15 bp, Homo sapiens
gattcagctcattat

SEQ ID NO: 873302 - DNA, 20 bp, Homo sapiens
gattcagctcattatgaaaa

SEQ ID NO: 873303 - DNA, 21 bp, Homo sapiens
gattcagctcattatgaaaaa

SEQ ID NO: 873304 - DNA, 15 bp, Homo sapiens
gattcagctctgcaa

SEQ ID NO: 873305 - DNA, 13 bp, Homo sapiens
gattcaggccagc

SEQ ID NO: 873306 - DNA, 20 bp, Homo sapiens
gattcaggccagcccagcca

SEQ ID NO: 873307 - DNA, 21 bp, Homo sapiens
gattcataaagtaatgatgaa

SEQ ID NO: 873308 - DNA, 18 bp, Homo sapiens
gattcatatttacttctt

SEQ ID NO: 873309 - DNA, 21 bp, Homo sapiens
gattcatgccaattagcaatt

SEQ ID NO: 873310 - DNA, 15 bp, Homo sapiens
gattcattctcataa

SEQ ID NO: 873311 - DNA, 20 bp, Homo sapiens
gattcattctcataattcct

SEQ ID NO: 873312 - DNA, 21 bp, Homo sapiens
gattcatttcctgcccttcct

SEQ ID NO: 873313 - DNA, 15 bp, Homo sapiens
gattccacaggacac

SEQ ID NO: 873314 - DNA, 20 bp, Homo sapiens
gattccactacacctggctg

SEQ ID NO: 873315 - DNA, 22 bp, Homo sapiens
gattccagagagtggctcctcc

SEQ ID NO: 873316 - DNA, 18 bp, Homo sapiens
gattccagcagtgaatgc

SEQ ID NO: 873317 - DNA, 15 bp, Homo sapiens
gattccagcccacat

SEQ ID NO: 873318 - DNA, 23 bp, Homo sapiens
gattcccactgccgctgcccgct

SEQ ID NO: 873319 - DNA, 13 bp, Homo sapiens
gattcccagagac

SEQ ID NO: 873320 - DNA, 13 bp, Homo sapiens
gattcccagagca

SEQ ID NO: 873321 - DNA, 17 bp, Homo sapiens
gattccccctgccctgt

SEQ ID NO: 873322 - DNA, 18 bp, Homo sapiens
gattccccctgccctgtg

SEQ ID NO: 873323 - DNA, 19 bp, Homo sapiens
gattccccctgccctgtgc

SEQ ID NO: 873324 - DNA, 15 bp, Homo sapiens
gattcccctgtgtca

SEQ ID NO: 873325 - DNA, 15 bp, Homo sapiens
gattccctgatttaa

SEQ ID NO: 873326 - DNA, 13 bp, Homo sapiens
gattccctgtccc

SEQ ID NO: 873327 - DNA, 19 bp, Homo sapiens
gattccctgtccccaacag

SEQ ID NO: 873328 - DNA, 22 bp, Homo sapiens
gattcctaagccacttgaaatg

SEQ ID NO: 873329 - DNA, 19 bp, Homo sapiens
gattcctacccctcttcca

SEQ ID NO: 873330 - DNA, 23 bp, Homo sapiens
gattcctatgatggatggcagac

SEQ ID NO: 873331 - DNA, 22 bp, Homo sapiens
gattcctcgcgacatcttctca

SEQ ID NO: 873332 - DNA, 19 bp, Homo sapiens
gattcctcttgcctctctc

SEQ ID NO: 873333 - DNA, 18 bp, Homo sapiens
gattcctgagctggcctg

SEQ ID NO: 873334 - DNA, 12 bp, Homo sapiens
gattccttttga

SEQ ID NO: 873335 - DNA, 18 bp, Homo sapiens
gattcgcccaaagccaga

SEQ ID NO: 873336 - DNA, 13 bp, Homo sapiens
gattctaaagctc

SEQ ID NO: 873337 - DNA, 16 bp, Homo sapiens
gattctaaagctcaat

SEQ ID NO: 873338 - DNA, 18 bp, Homo sapiens
gattctactcttgtcatt

SEQ ID NO: 873339 - DNA, 18 bp, Homo sapiens
gattctactttaagcact

SEQ ID NO: 873340 - DNA, 22 bp, Homo sapiens
gattctactttaagcactacat

SEQ ID NO: 873341 - DNA, 16 bp, Homo sapiens
gattctagtacataat

SEQ ID NO: 873342 - DNA, 21 bp, Homo sapiens
gattctatattattatatata

SEQ ID NO: 873343 - DNA, 17 bp, Homo sapiens
gattctatttaattgaa

SEQ ID NO: 873344 - DNA, 20 bp, Homo sapiens
gattctatttaattgaaact

SEQ ID NO: 873345 - DNA, 20 bp, Homo sapiens
gattctatttatatgtacat

SEQ ID NO: 873346 - DNA, 11 bp, Homo sapiens
gattctcagat

SEQ ID NO: 873347 - DNA, 22 bp, Homo sapiens
gattctcagggctggagcctgg

SEQ ID NO: 873348 - DNA, 23 bp, Homo sapiens
gattctcagggctggagcctggg

SEQ ID NO: 873349 - DNA, 18 bp, Homo sapiens
gattctcctgcctcagcc

SEQ ID NO: 873350 - DNA, 14 bp, Homo sapiens
gattctcctgtgct

SEQ ID NO: 873351 - DNA, 16 bp, Homo sapiens
gattctcgactgcttt

SEQ ID NO: 873352 - DNA, 13 bp, Homo sapiens
gattctctattgg

SEQ ID NO: 873353 - DNA, 15 bp, Homo sapiens
gattctctattggct

SEQ ID NO: 873354 - DNA, 12 bp, Homo sapiens
gattctctgtgg

SEQ ID NO: 873355 - DNA, 22 bp, Homo sapiens
gattctctttaactgtgtgacc

SEQ ID NO: 873356 - DNA, 21 bp, Homo sapiens
gattctgaaatttttttccta

SEQ ID NO: 873357 - DNA, 19 bp, Homo sapiens
gattctgacatttatattt

SEQ ID NO: 873358 - DNA, 15 bp, Homo sapiens
gattctgatgcatac

SEQ ID NO: 873359 - DNA, 16 bp, Homo sapiens
gattctgatttcagtt

SEQ ID NO: 873360 - DNA, 20 bp, Homo sapiens
gattctgatttcagtttttc

SEQ ID NO: 873361 - DNA, 18 bp, Homo sapiens
gattctgcagtaaatctt

SEQ ID NO: 873362 - DNA, 18 bp, Homo sapiens
gattctggatctcctgct

SEQ ID NO: 873363 - DNA, 22 bp, Homo sapiens
gattctgggaggcaagaaaagg

SEQ ID NO: 873364 - DNA, 18 bp, Homo sapiens
gattctgggtttgcccag

SEQ ID NO: 873365 - DNA, 18 bp, Homo sapiens
gattctgtgcctccagga

SEQ ID NO: 873366 - DNA, 15 bp, Homo sapiens
gattctgtggaacaa

SEQ ID NO: 873367 - DNA, 22 bp, Homo sapiens
gattctgtgtgttttcataata

SEQ ID NO: 873368 - DNA, 19 bp, Homo sapiens
gattctgtttattcttcca

SEQ ID NO: 873369 - DNA, 23 bp, Homo sapiens
gattctgtttattcttccagaat

SEQ ID NO: 873370 - DNA, 19 bp, Homo sapiens
gattcttgtaaatcttttt

SEQ ID NO: 873371 - DNA, 22 bp, Homo sapiens
gattctttccatttgcatttgt

SEQ ID NO: 873372 - DNA, 23 bp, Homo sapiens
gattctttccccagaggctccca

SEQ ID NO: 873373 - DNA, 19 bp, Homo sapiens
gattcttttaaattagaaa

SEQ ID NO: 873374 - DNA, 20 bp, Homo sapiens
gattcttttaaattagaaaa

SEQ ID NO: 873375 - DNA, 17 bp, Homo sapiens
gattgaaaataatgctg

SEQ ID NO: 873376 - DNA, 19 bp, Homo sapiens
gattgaaaatgtccaggaa

SEQ ID NO: 873377 - DNA, 15 bp, Homo sapiens
gattgaactccaaga

SEQ ID NO: 873378 - DNA, 14 bp, Homo sapiens
gattgaagaatctg

SEQ ID NO: 873379 - DNA, 16 bp, Homo sapiens
gattgacagctttgct

SEQ ID NO: 873380 - DNA, 18 bp, Homo sapiens
gattgacctgctccgctg

SEQ ID NO: 873381 - DNA, 23 bp, Homo sapiens
gattgacgggactgttggtattg

SEQ ID NO: 873382 - DNA, 13 bp, Homo sapiens
gattgagaaagat

SEQ ID NO: 873383 - DNA, 13 bp, Homo sapiens
gattgagaactga

SEQ ID NO: 873384 - DNA, 13 bp, Homo sapiens
gattgccacagct

SEQ ID NO: 873385 - DNA, 16 bp, Homo sapiens
gattgcctttaatatt

SEQ ID NO: 873386 - DNA, 17 bp, Homo sapiens
gattgcctttaatattt

SEQ ID NO: 873387 - DNA, 19 bp, Homo sapiens
gattgctctggagcagcca

SEQ ID NO: 873388 - DNA, 16 bp, Homo sapiens
gattgctgccccatca

SEQ ID NO: 873389 - DNA, 17 bp, Homo sapiens
gattgctggaaaccaag

SEQ ID NO: 873390 - DNA, 16 bp, Homo sapiens
gattgcttgagcccag

SEQ ID NO: 873391 - DNA, 21 bp, Homo sapiens
gattgctttgctgcacagcag

SEQ ID NO: 873392 - DNA, 22 bp, Homo sapiens
gattggacaggagatcagcagc

SEQ ID NO: 873393 - DNA, 14 bp, Homo sapiens
gattggaccaggcc

SEQ ID NO: 873394 - DNA, 18 bp, Homo sapiens
gattggagctgaagacct

SEQ ID NO: 873395 - DNA, 11 bp, Homo sapiens
gattggattat

SEQ ID NO: 873396 - DNA, 14 bp, Homo sapiens
gattggattattca

SEQ ID NO: 873397 - DNA, 17 bp, Homo sapiens
gattggattattcattt

SEQ ID NO: 873398 - DNA, 15 bp, Homo sapiens
gattggatttgctgt

SEQ ID NO: 873399 - DNA, 18 bp, Homo sapiens
gattggcacccctttcta

SEQ ID NO: 873400 - DNA, 11 bp, Homo sapiens
gattggcctgt

SEQ ID NO: 873401 - DNA, 20 bp, Homo sapiens
gattggcctgtagagttgct

SEQ ID NO: 873402 - DNA, 22 bp, Homo sapiens
gattggctcacccaagcaaggc

SEQ ID NO: 873403 - DNA, 20 bp, Homo sapiens
gattggcttaaagtgaagga

SEQ ID NO: 873404 - DNA, 16 bp, Homo sapiens
gattggctttaaacac

SEQ ID NO: 873405 - DNA, 11 bp, Homo sapiens
gattggctttg

SEQ ID NO: 873406 - DNA, 14 bp, Homo sapiens
gattgggggctggt

SEQ ID NO: 873407 - DNA, 18 bp, Homo sapiens
gattgggggctggtgcca

SEQ ID NO: 873408 - DNA, 16 bp, Homo sapiens
gattggggggaaagag

SEQ ID NO: 873409 - DNA, 19 bp, Homo sapiens
gattggtgacgatgggtgt

SEQ ID NO: 873410 - DNA, 18 bp, Homo sapiens
gattggttaaaatgtgat

SEQ ID NO: 873411 - DNA, 12 bp, Homo sapiens
gattgtaaaata

SEQ ID NO: 873412 - DNA, 23 bp, Homo sapiens
gattgtaatatgtaaatggtatg

SEQ ID NO: 873413 - DNA, 21 bp, Homo sapiens
gattgtcaccatgatcactta

SEQ ID NO: 873414 - DNA, 22 bp, Homo sapiens
gattgtcagccacctccctctg

SEQ ID NO: 873415 - DNA, 16 bp, Homo sapiens
gattgtccttttgcaa

SEQ ID NO: 873416 - DNA, 17 bp, Homo sapiens
gattgtccttttgcaaa

SEQ ID NO: 873417 - DNA, 22 bp, Homo sapiens
gattgtgaattccttaaagttt

SEQ ID NO: 873418 - DNA, 19 bp, Homo sapiens
gattgtgggcatgagctgc

SEQ ID NO: 873419 - DNA, 22 bp, Homo sapiens
gattgtggggtgcagctgggtg

SEQ ID NO: 873420 - DNA, 20 bp, Homo sapiens
gattgtgttcctgaagaaaa

SEQ ID NO: 873421 - DNA, 21 bp, Homo sapiens
gattgttaggagtggttctca

SEQ ID NO: 873422 - DNA, 23 bp, Homo sapiens
gattgttaggagtggttctcatt

SEQ ID NO: 873423 - DNA, 14 bp, Homo sapiens
gattgttattaaat

SEQ ID NO: 873424 - DNA, 16 bp, Homo sapiens
gattgttattaaatgt

SEQ ID NO: 873425 - DNA, 13 bp, Homo sapiens
gattgttcatcat

SEQ ID NO: 873426 - DNA, 18 bp, Homo sapiens
gattgtttcctcttccaa

SEQ ID NO: 873427 - DNA, 20 bp, Homo sapiens
gattgttttattttggaatt

SEQ ID NO: 873428 - DNA, 22 bp, Homo sapiens
gattgttttttaaaaatggata

SEQ ID NO: 873429 - DNA, 20 bp, Homo sapiens
gatttaaaaatgccaaaact

SEQ ID NO: 873430 - DNA, 11 bp, Homo sapiens
gatttaaaatt

SEQ ID NO: 873431 - DNA, 15 bp, Homo sapiens
gatttaacagaaatg

SEQ ID NO: 873432 - DNA, 18 bp, Homo sapiens
gatttaacagaaatgtac

SEQ ID NO: 873433 - DNA, 17 bp, Homo sapiens
gatttaacagtcattta

SEQ ID NO: 873434 - DNA, 18 bp, Homo sapiens
gatttaacattatctagt

SEQ ID NO: 873435 - DNA, 22 bp, Homo sapiens
gatttaagtgaatacattaacg

SEQ ID NO: 873436 - DNA, 20 bp, Homo sapiens
gatttaagttacaatgtttt

SEQ ID NO: 873437 - DNA, 14 bp, Homo sapiens
gatttaatatgcaa

SEQ ID NO: 873438 - DNA, 15 bp, Homo sapiens
gatttaatgttttct

SEQ ID NO: 873439 - DNA, 12 bp, Homo sapiens
gatttacattca

SEQ ID NO: 873440 - DNA, 13 bp, Homo sapiens
gatttacattcaa

SEQ ID NO: 873441 - DNA, 16 bp, Homo sapiens
gatttaccttttctgt

SEQ ID NO: 873442 - DNA, 16 bp, Homo sapiens
gatttagtttcagtag

SEQ ID NO: 873443 - DNA, 19 bp, Homo sapiens
gatttatagtatgtgactt

SEQ ID NO: 873444 - DNA, 14 bp, Homo sapiens
gatttatatataag

SEQ ID NO: 873445 - DNA, 12 bp, Homo sapiens
gatttatcttta

SEQ ID NO: 873446 - DNA, 16 bp, Homo sapiens
gatttatgtattttga

SEQ ID NO: 873447 - DNA, 17 bp, Homo sapiens
gatttatgtattttgaa

SEQ ID NO: 873448 - DNA, 13 bp, Homo sapiens
gatttatttgctt

SEQ ID NO: 873449 - DNA, 16 bp, Homo sapiens
gatttatttgcttctt

SEQ ID NO: 873450 - DNA, 20 bp, Homo sapiens
gatttcactaggactcagaa

SEQ ID NO: 873451 - DNA, 22 bp, Homo sapiens
gatttcaggatactctgtcaga

SEQ ID NO: 873452 - DNA, 17 bp, Homo sapiens
gatttcagtaatgtctt

SEQ ID NO: 873453 - DNA, 19 bp, Homo sapiens
gatttcagtaatgtcttca

SEQ ID NO: 873454 - DNA, 13 bp, Homo sapiens
gatttcagtagaa

SEQ ID NO: 873455 - DNA, 23 bp, Homo sapiens
gatttcagtagaattttagtcct

SEQ ID NO: 873456 - DNA, 15 bp, Homo sapiens
gatttcagtttttca

SEQ ID NO: 873457 - DNA, 16 bp, Homo sapiens
gatttcagtttttcat

SEQ ID NO: 873458 - DNA, 18 bp, Homo sapiens
gatttcagtttttcattt

SEQ ID NO: 873459 - DNA, 12 bp, Homo sapiens
gatttcataatt

SEQ ID NO: 873460 - DNA, 15 bp, Homo sapiens
gatttcatactgtaa

SEQ ID NO: 873461 - DNA, 16 bp, Homo sapiens
gatttcatccttgaat

SEQ ID NO: 873462 - DNA, 18 bp, Homo sapiens
gatttcatcttctggaat

SEQ ID NO: 873463 - DNA, 12 bp, Homo sapiens
gatttcattaca

SEQ ID NO: 873464 - DNA, 16 bp, Homo sapiens
gatttcattatcacat

SEQ ID NO: 873465 - DNA, 14 bp, Homo sapiens
gatttccaagcctc

SEQ ID NO: 873466 - DNA, 19 bp, Homo sapiens
gatttccagtgagtgtaaa

SEQ ID NO: 873467 - DNA, 17 bp, Homo sapiens
gatttccatcttaatgt

SEQ ID NO: 873468 - DNA, 17 bp, Homo sapiens
gatttccattgtgtggc

SEQ ID NO: 873469 - DNA, 19 bp, Homo sapiens
gatttccattgtgtggcct

SEQ ID NO: 873470 - DNA, 14 bp, Homo sapiens
gatttccatttctg

SEQ ID NO: 873471 - DNA, 15 bp, Homo sapiens
gatttccatttctga

SEQ ID NO: 873472 - DNA, 13 bp, Homo sapiens
gatttccattttt

SEQ ID NO: 873473 - DNA, 11 bp, Homo sapiens
gatttccctgc

SEQ ID NO: 873474 - DNA, 15 bp, Homo sapiens
gatttccgttaaaat

SEQ ID NO: 873475 - DNA, 15 bp, Homo sapiens
gatttcctaaacata

SEQ ID NO: 873476 - DNA, 13 bp, Homo sapiens
gatttcctaatac

SEQ ID NO: 873477 - DNA, 22 bp, Homo sapiens
gatttcctgctttgggaagccg

SEQ ID NO: 873478 - DNA, 23 bp, Homo sapiens
gatttcctggagtgccctgcagg

SEQ ID NO: 873479 - DNA, 15 bp, Homo sapiens
gatttccttcaatgt

SEQ ID NO: 873480 - DNA, 13 bp, Homo sapiens
gatttccttgaat

SEQ ID NO: 873481 - DNA, 17 bp, Homo sapiens
gatttccttgaatgtgg

SEQ ID NO: 873482 - DNA, 17 bp, Homo sapiens
gatttctagtgtatact

SEQ ID NO: 873483 - DNA, 21 bp, Homo sapiens
gatttctcacactctaactgt

SEQ ID NO: 873484 - DNA, 19 bp, Homo sapiens
gatttctgtctactaagtg

SEQ ID NO: 873485 - DNA, 20 bp, Homo sapiens
gatttctgtctactaagtga

SEQ ID NO: 873486 - DNA, 19 bp, Homo sapiens
gatttctgtttagataata

SEQ ID NO: 873487 - DNA, 19 bp, Homo sapiens
gatttcttcgctgctctag

SEQ ID NO: 873488 - DNA, 11 bp, Homo sapiens
gatttctttcc

SEQ ID NO: 873489 - DNA, 17 bp, Homo sapiens
gatttctttccagaggg

SEQ ID NO: 873490 - DNA, 23 bp, Homo sapiens
gatttctttctttgcaccaaaga

SEQ ID NO: 873491 - DNA, 16 bp, Homo sapiens
gatttgaagcaaagca

SEQ ID NO: 873492 - DNA, 15 bp, Homo sapiens
gatttgatctttgtt

SEQ ID NO: 873493 - DNA, 17 bp, Homo sapiens
gcaaaatagtattgctg

SEQ ID NO: 873494 - DNA, 12 bp, Homo sapiens
gcaaaatgagtt

SEQ ID NO: 873495 - DNA, 21 bp, Homo sapiens
gcaaaatggaagcaaagacaa

SEQ ID NO: 873496 - DNA, 23 bp, Homo sapiens
gcaaaattagtacctcaaagtaa

SEQ ID NO: 873497 - DNA, 15 bp, Homo sapiens
gcaaaattcctgtgt

SEQ ID NO: 873498 - DNA, 15 bp, Homo sapiens
gcaaaatttgatgcc

SEQ ID NO: 873499 - DNA, 20 bp, Homo sapiens
gcaaaatttgatgccaggac

SEQ ID NO: 873500 - DNA, 22 bp, Homo sapiens
gcaaaattttacagtaataata

SEQ ID NO: 873501 - DNA, 16 bp, Homo sapiens
gcaaaattttatagct

SEQ ID NO: 873502 - DNA, 13 bp, Homo sapiens
gcaaacaacctga

SEQ ID NO: 873503 - DNA, 22 bp, Homo sapiens
gcaaacaatcccaatctttcta

SEQ ID NO: 873504 - DNA, 22 bp, Homo sapiens
gcaaacaattttaatgatggtg

SEQ ID NO: 873505 - DNA, 17 bp, Homo sapiens
gcaaacacacaaaggta

SEQ ID NO: 873506 - DNA, 17 bp, Homo sapiens
gcaaacactccaccctc

SEQ ID NO: 873507 - DNA, 13 bp, Homo sapiens
gcaaacagaacag

SEQ ID NO: 873508 - DNA, 21 bp, Homo sapiens
gcaaacaggatcagttaacta

SEQ ID NO: 873509 - DNA, 12 bp, Homo sapiens
gcaaacatcaaa

SEQ ID NO: 873510 - DNA, 23 bp, Homo sapiens
gcaaacatcaaataaatttctgg

SEQ ID NO: 873511 - DNA, 18 bp, Homo sapiens
gcaaaccaatacagaatt

SEQ ID NO: 873512 - DNA, 16 bp, Homo sapiens
gcaaaccatttttaaa

SEQ ID NO: 873513 - DNA, 17 bp, Homo sapiens
gcaaacccagaggtgga

SEQ ID NO: 873514 - DNA, 22 bp, Homo sapiens
gcaaaccctcccagaaacatct

SEQ ID NO: 873515 - DNA, 19 bp, Homo sapiens
gcaaatgtttatttaaaag

SEQ ID NO: 873516 - DNA, 20 bp, Homo sapiens
gcaaatgtttatttaaaaga

SEQ ID NO: 873517 - DNA, 20 bp, Homo sapiens
gcaaattaaaacatatttca

SEQ ID NO: 873518 - DNA, 21 bp, Homo sapiens
gcaaattaaaacatatttcat

SEQ ID NO: 873519 - DNA, 19 bp, Homo sapiens
gcaaattaactgtatgtgt

SEQ ID NO: 873520 - DNA, 23 bp, Homo sapiens
gcaaattaatgtataatttgagg

SEQ ID NO: 873521 - DNA, 12 bp, Homo sapiens
gcaaattctttt

SEQ ID NO: 873522 - DNA, 16 bp, Homo sapiens
gcaaattcttttgaat

SEQ ID NO: 873523 - DNA, 20 bp, Homo sapiens
gcaaattgctagtcagggtg

SEQ ID NO: 873524 - DNA, 21 bp, Homo sapiens
gcaaattgctagtcagggtga

SEQ ID NO: 873525 - DNA, 16 bp, Homo sapiens
gcaaattgtatcttat

SEQ ID NO: 873526 - DNA, 17 bp, Homo sapiens
gcaaattgtatcttatt

SEQ ID NO: 873527 - DNA, 18 bp, Homo sapiens
gcaaatttctataaattt

SEQ ID NO: 873528 - DNA, 22 bp, Homo sapiens
gcaaatttctataaatttaaga

SEQ ID NO: 873529 - DNA, 13 bp, Homo sapiens
gcaaattttaaaa

SEQ ID NO: 873530 - DNA, 15 bp, Homo sapiens
gcaaattttgcattt

SEQ ID NO: 873531 - DNA, 15 bp, Homo sapiens
gcaacaacaattggt

SEQ ID NO: 873532 - DNA, 22 bp, Homo sapiens
gcaacaacaattggtaaaactc

SEQ ID NO: 873533 - DNA, 22 bp, Homo sapiens
gcaacaagaccaccacttcgaa

SEQ ID NO: 873534 - DNA, 20 bp, Homo sapiens
gcaacaaggtcctctgtcag

SEQ ID NO: 873535 - DNA, 14 bp, Homo sapiens
gcaacaatttatga

SEQ ID NO: 873536 - DNA, 12 bp, Homo sapiens
gcaacacacaga

SEQ ID NO: 873537 - DNA, 14 bp, Homo sapiens
gcaacactgcagga

SEQ ID NO: 873538 - DNA, 16 bp, Homo sapiens
gcaacactgcaggaca

SEQ ID NO: 873539 - DNA, 16 bp, Homo sapiens
gcaacactgctgtcca

SEQ ID NO: 873540 - DNA, 11 bp, Homo sapiens
gcaacactgga

SEQ ID NO: 873541 - DNA, 17 bp, Homo sapiens
gcaacagaaaaatggag

SEQ ID NO: 873542 - DNA, 16 bp, Homo sapiens
gcaacagaagcaaaaa

SEQ ID NO: 873543 - DNA, 15 bp, Homo sapiens
gcaacagactctcac

SEQ ID NO: 873544 - DNA, 14 bp, Homo sapiens
gcaacagagtgaga

SEQ ID NO: 873545 - DNA, 15 bp, Homo sapiens
gcaacagatcagtaa

SEQ ID NO: 873546 - DNA, 20 bp, Homo sapiens
gcaacaggggaggaaaaaag

SEQ ID NO: 873547 - DNA, 13 bp, Homo sapiens
gcaacaggtttta

SEQ ID NO: 873548 - DNA, 16 bp, Homo sapiens
gcaacatctctgaatc

SEQ ID NO: 873549 - DNA, 17 bp, Homo sapiens
gcaacatctctgaatcc

SEQ ID NO: 873550 - DNA, 18 bp, Homo sapiens
gcaacatgaagaatgcat

SEQ ID NO: 873551 - DNA, 19 bp, Homo sapiens
gcaacatgaagaatgcatt

SEQ ID NO: 873552 - DNA, 15 bp, Homo sapiens
gcaacatttctgtat

SEQ ID NO: 873553 - DNA, 22 bp, Homo sapiens
gcaacatttctgtatactgtaa

SEQ ID NO: 873554 - DNA, 16 bp, Homo sapiens
gcaaccaactgcccca

SEQ ID NO: 873555 - DNA, 18 bp, Homo sapiens
gcaaccaactgccccagg

SEQ ID NO: 873556 - DNA, 15 bp, Homo sapiens
gcaaccacatgtccc

SEQ ID NO: 873557 - DNA, 13 bp, Homo sapiens
gcaaccaggcagc

SEQ ID NO: 873558 - DNA, 20 bp, Homo sapiens
gcaaccccagttctgctcct

SEQ ID NO: 873559 - DNA, 21 bp, Homo sapiens
gcaaccccagttctgctcctc

SEQ ID NO: 873560 - DNA, 22 bp, Homo sapiens
gcaaccccagttctgctcctct

SEQ ID NO: 873561 - DNA, 16 bp, Homo sapiens
gcaaccccctcggagc

SEQ ID NO: 873562 - DNA, 14 bp, Homo sapiens
gcaacccctgtacc

SEQ ID NO: 873563 - DNA, 15 bp, Homo sapiens
gcaacccgctggagc

SEQ ID NO: 873564 - DNA, 12 bp, Homo sapiens
gcaaccctccta

SEQ ID NO: 873565 - DNA, 12 bp, Homo sapiens
gcaaccctgcct

SEQ ID NO: 873566 - DNA, 16 bp, Homo sapiens
gcaacctcttggcctg

SEQ ID NO: 873567 - DNA, 23 bp, Homo sapiens
gcaacctcttggcctgatcagac

SEQ ID NO: 873568 - DNA, 13 bp, Homo sapiens
gcaacctgtggct

SEQ ID NO: 873569 - DNA, 22 bp, Homo sapiens
gcaacctgtggctcaggggagc

SEQ ID NO: 873570 - DNA, 14 bp, Homo sapiens
gcaacgaagaaaaa

SEQ ID NO: 873571 - DNA, 13 bp, Homo sapiens
gcaacgcccctcc

SEQ ID NO: 873572 - DNA, 15 bp, Homo sapiens
gcaacgtagcctggg

SEQ ID NO: 873573 - DNA, 16 bp, Homo sapiens
gcaactaaggacaaat

SEQ ID NO: 873574 - DNA, 14 bp, Homo sapiens
gcaactagccaagg

SEQ ID NO: 873575 - DNA, 19 bp, Homo sapiens
gcaactccgtgtgcctggg

SEQ ID NO: 873576 - DNA, 12 bp, Homo sapiens
gcaactgaataa

SEQ ID NO: 873577 - DNA, 13 bp, Homo sapiens
gcaactgaataaa

SEQ ID NO: 873578 - DNA, 18 bp, Homo sapiens
gcaactgaataaatacct

SEQ ID NO: 873579 - DNA, 17 bp, Homo sapiens
gcaactgagatgtcaga

SEQ ID NO: 873580 - DNA, 21 bp, Homo sapiens
gcaactgaggcagacagcagc

SEQ ID NO: 873581 - DNA, 17 bp, Homo sapiens
gcaactgcccttccagg

SEQ ID NO: 873582 - DNA, 18 bp, Homo sapiens
gcaactgctcagctctgg

SEQ ID NO: 873583 - DNA, 15 bp, Homo sapiens
gcaactggccagcca

SEQ ID NO: 873584 - DNA, 21 bp, Homo sapiens
gcaactgttatgaaataaaga

SEQ ID NO: 873585 - DNA, 16 bp, Homo sapiens
gcaacttagaatagtt

SEQ ID NO: 873586 - DNA, 23 bp, Homo sapiens
gcaacttcagttttatttttgcc

SEQ ID NO: 873587 - DNA, 23 bp, Homo sapiens
gcaacttcatttgacacaaagct

SEQ ID NO: 873588 - DNA, 18 bp, Homo sapiens
gcaacttctatcctttct

SEQ ID NO: 873589 - DNA, 18 bp, Homo sapiens
gcaacttcttctccatcc

SEQ ID NO: 873590 - DNA, 13 bp, Homo sapiens
gcaacttgtgaac

SEQ ID NO: 873591 - DNA, 20 bp, Homo sapiens
gcaacttttgtgtaatgaaa

SEQ ID NO: 873592 - DNA, 14 bp, Homo sapiens
gcaagaaaaccaca

SEQ ID NO: 873593 - DNA, 11 bp, Homo sapiens
gcaagaaacag

SEQ ID NO: 873594 - DNA, 20 bp, Homo sapiens
gcaagaaagagggtcccagg

SEQ ID NO: 873595 - DNA, 14 bp, Homo sapiens
gcaagaagaaaatg

SEQ ID NO: 873596 - DNA, 15 bp, Homo sapiens
gcaagaagaaaatgt

SEQ ID NO: 873597 - DNA, 20 bp, Homo sapiens
gcaagaaggcaaaaatagtt

SEQ ID NO: 873598 - DNA, 12 bp, Homo sapiens
gcaagaattaaa

SEQ ID NO: 873599 - DNA, 17 bp, Homo sapiens
gcaagaattaaaactga

SEQ ID NO: 873600 - DNA, 17 bp, Homo sapiens
gcaagaattgaagcagg

SEQ ID NO: 873601 - DNA, 16 bp, Homo sapiens
gcaagacagaaaagtg

SEQ ID NO: 873602 - DNA, 19 bp, Homo sapiens
gcaagacagagacgcagga

SEQ ID NO: 873603 - DNA, 12 bp, Homo sapiens
gcaagaccacgg

SEQ ID NO: 873604 - DNA, 15 bp, Homo sapiens
gcaagaccagtcact

SEQ ID NO: 873605 - DNA, 15 bp, Homo sapiens
gcaagaccagttgaa

SEQ ID NO: 873606 - DNA, 18 bp, Homo sapiens
gcaagacctcatctgtgg

SEQ ID NO: 873607 - DNA, 15 bp, Homo sapiens
gcaagactgcaaact

SEQ ID NO: 873608 - DNA, 21 bp, Homo sapiens
gcaagactgcaaactttttta

SEQ ID NO: 873609 - DNA, 18 bp, Homo sapiens
gcaagactgttgctcaaa

SEQ ID NO: 873610 - DNA, 19 bp, Homo sapiens
gcaagagactgggagccac

SEQ ID NO: 873611 - DNA, 23 bp, Homo sapiens
gcaagagccttggtgtccacctg

SEQ ID NO: 873612 - DNA, 18 bp, Homo sapiens
gcaagaggcaagctgaaa

SEQ ID NO: 873613 - DNA, 19 bp, Homo sapiens
gcaagaggcaagctgaaat

SEQ ID NO: 873614 - DNA, 14 bp, Homo sapiens
gcaagagggagggg

SEQ ID NO: 873615 - DNA, 20 bp, Homo sapiens
gcaagagggggtggaggggt

SEQ ID NO: 873616 - DNA, 20 bp, Homo sapiens
gcaagagtaagcagtgttac

SEQ ID NO: 873617 - DNA, 15 bp, Homo sapiens
gcaagatatttttga

SEQ ID NO: 873618 - DNA, 17 bp, Homo sapiens
gcaagatgaattttatc

SEQ ID NO: 873619 - DNA, 13 bp, Homo sapiens
gcaagatgagctg

SEQ ID NO: 873620 - DNA, 14 bp, Homo sapiens
gcaagatgagctgt

SEQ ID NO: 873621 - DNA, 21 bp, Homo sapiens
gcaagatggacacgagccaca

SEQ ID NO: 873622 - DNA, 16 bp, Homo sapiens
gcaataatttgtacaa

SEQ ID NO: 873623 - DNA, 15 bp, Homo sapiens
gcaatacaactttac

SEQ ID NO: 873624 - DNA, 18 bp, Homo sapiens
gcaatacaactttaccat

SEQ ID NO: 873625 - DNA, 15 bp, Homo sapiens
gcaatactcatcaga

SEQ ID NO: 873626 - DNA, 11 bp, Homo sapiens
gcaatagagac

SEQ ID NO: 873627 - DNA, 20 bp, Homo sapiens
gcaatagattactgatgtga

SEQ ID NO: 873628 - DNA, 19 bp, Homo sapiens
gcaataggtgagagaatgt

SEQ ID NO: 873629 - DNA, 16 bp, Homo sapiens
gcaatagttttttact

SEQ ID NO: 873630 - DNA, 13 bp, Homo sapiens
gcaatataagcat

SEQ ID NO: 873631 - DNA, 17 bp, Homo sapiens
gcaatataagcataaaa

SEQ ID NO: 873632 - DNA, 13 bp, Homo sapiens
gcaatattgcctg

SEQ ID NO: 873633 - DNA, 22 bp, Homo sapiens
gcaatattgtatatttttatct

SEQ ID NO: 873634 - DNA, 17 bp, Homo sapiens
gcaatcaaatctgcttt

SEQ ID NO: 873635 - DNA, 19 bp, Homo sapiens
gcaatcaaggttataattt

SEQ ID NO: 873636 - DNA, 14 bp, Homo sapiens
gcaatcaatacagc

SEQ ID NO: 873637 - DNA, 19 bp, Homo sapiens
gcaatcagacaccctctcc

SEQ ID NO: 873638 - DNA, 22 bp, Homo sapiens
gcaatcaggattttaaacatgt

SEQ ID NO: 873639 - DNA, 15 bp, Homo sapiens
gcaatccacctgcct

SEQ ID NO: 873640 - DNA, 18 bp, Homo sapiens
gcaatccacctgccttgg

SEQ ID NO: 873641 - DNA, 13 bp, Homo sapiens
gcaatccatgtta

SEQ ID NO: 873642 - DNA, 19 bp, Homo sapiens
gcaatcccaccaaatcatc

SEQ ID NO: 873643 - DNA, 20 bp, Homo sapiens
gcaatcctcctacctcagcc

SEQ ID NO: 873644 - DNA, 14 bp, Homo sapiens
gcaatcctcctgcc

SEQ ID NO: 873645 - DNA, 21 bp, Homo sapiens
gcaatcctcctgcctcagcct

SEQ ID NO: 873646 - DNA, 23 bp, Homo sapiens
gcaatctccccttgatttaaaca

SEQ ID NO: 873647 - DNA, 17 bp, Homo sapiens
gcaatctcttcattatt

SEQ ID NO: 873648 - DNA, 13 bp, Homo sapiens
gcaatctgaccct

SEQ ID NO: 873649 - DNA, 19 bp, Homo sapiens
gcaatcttggctcactgca

SEQ ID NO: 873650 - DNA, 16 bp, Homo sapiens
gcaatgaaaggtacta

SEQ ID NO: 873651 - DNA, 19 bp, Homo sapiens
gcaatgacaggtaaattaa

SEQ ID NO: 873652 - DNA, 16 bp, Homo sapiens
gcaatgacatcttcaa

SEQ ID NO: 873653 - DNA, 17 bp, Homo sapiens
gcaatgatgaatgagaa

SEQ ID NO: 873654 - DNA, 21 bp, Homo sapiens
gcaatgcctagacttcccaac

SEQ ID NO: 873655 - DNA, 18 bp, Homo sapiens
gcaatgcttaaactaaat

SEQ ID NO: 873656 - DNA, 17 bp, Homo sapiens
gcaatggccagagcctc

SEQ ID NO: 873657 - DNA, 20 bp, Homo sapiens
gcaatgggagctgaggccac

SEQ ID NO: 873658 - DNA, 23 bp, Homo sapiens
gcaatggtaactgcacctgggca

SEQ ID NO: 873659 - DNA, 19 bp, Homo sapiens
gcaatggtgcaatcacagc

SEQ ID NO: 873660 - DNA, 23 bp, Homo sapiens
gcaatggtgtcagtatccaggct

SEQ ID NO: 873661 - DNA, 20 bp, Homo sapiens
gcaatggtgttgccctgagt

SEQ ID NO: 873662 - DNA, 23 bp, Homo sapiens
gcaatgtaaatattttaaagaat

SEQ ID NO: 873663 - DNA, 17 bp, Homo sapiens
gcaatgtaagcatactt

SEQ ID NO: 873664 - DNA, 21 bp, Homo sapiens
gcaatgtcacaacctctctga

SEQ ID NO: 873665 - DNA, 14 bp, Homo sapiens
gcaatgtctgtgct

SEQ ID NO: 873666 - DNA, 17 bp, Homo sapiens
gcaatgtcttaaataaa

SEQ ID NO: 873667 - DNA, 22 bp, Homo sapiens
gcaatgtcttaaataaaactat

SEQ ID NO: 873668 - DNA, 17 bp, Homo sapiens
gcaatgtgaaaaatctg

SEQ ID NO: 873669 - DNA, 14 bp, Homo sapiens
gcaatgtgctactg

SEQ ID NO: 873670 - DNA, 19 bp, Homo sapiens
gcaatgtggagcagcagcc

SEQ ID NO: 873671 - DNA, 17 bp, Homo sapiens
gcaatgtgggatctcag

SEQ ID NO: 873672 - DNA, 22 bp, Homo sapiens
gcaatgtggtgacacctccccc

SEQ ID NO: 873673 - DNA, 14 bp, Homo sapiens
gcaattatgaaaat

SEQ ID NO: 873674 - DNA, 17 bp, Homo sapiens
gcaattatttaaagaaa

SEQ ID NO: 873675 - DNA, 21 bp, Homo sapiens
gcaattcatgtaacagttgtg

SEQ ID NO: 873676 - DNA, 14 bp, Homo sapiens
gcaattcccctctg

SEQ ID NO: 873677 - DNA, 21 bp, Homo sapiens
gcaattcccctctgctgctgt

SEQ ID NO: 873678 - DNA, 18 bp, Homo sapiens
gcaattctctttctttta

SEQ ID NO: 873679 - DNA, 15 bp, Homo sapiens
gcaattgcttaggat

SEQ ID NO: 873680 - DNA, 14 bp, Homo sapiens
gcaatttacctggt

SEQ ID NO: 873681 - DNA, 15 bp, Homo sapiens
gcaccgaatattgag

SEQ ID NO: 873682 - DNA, 21 bp, Homo sapiens
gcaccgaccacggggccgaca

SEQ ID NO: 873683 - DNA, 19 bp, Homo sapiens
gcaccgacccgaggcccag

SEQ ID NO: 873684 - DNA, 20 bp, Homo sapiens
gcaccgacccgaggcccaga

SEQ ID NO: 873685 - DNA, 16 bp, Homo sapiens
gcaccgccgcagaagc

SEQ ID NO: 873686 - DNA, 19 bp, Homo sapiens
gcaccgccgcagaagcagc

SEQ ID NO: 873687 - DNA, 13 bp, Homo sapiens
gcaccgcctgccc

SEQ ID NO: 873688 - DNA, 20 bp, Homo sapiens
gcaccgcctgccctcccgca

SEQ ID NO: 873689 - DNA, 22 bp, Homo sapiens
gcaccgcttttgttctcgcaaa

SEQ ID NO: 873690 - DNA, 16 bp, Homo sapiens
gcaccggcgctgcagg

SEQ ID NO: 873691 - DNA, 15 bp, Homo sapiens
gcaccgggctggctg

SEQ ID NO: 873692 - DNA, 21 bp, Homo sapiens
gcaccgtcatggcttaatgtt

SEQ ID NO: 873693 - DNA, 16 bp, Homo sapiens
gcaccgtcccgccagt

SEQ ID NO: 873694 - DNA, 21 bp, Homo sapiens
gcaccgtcctcagcagtccac

SEQ ID NO: 873695 - DNA, 15 bp, Homo sapiens
gcaccgtctcactgt

SEQ ID NO: 873696 - DNA, 23 bp, Homo sapiens
gcacctaaaccaccagtgcccaa

SEQ ID NO: 873697 - DNA, 14 bp, Homo sapiens
gcacctaaagaaaa

SEQ ID NO: 873698 - DNA, 17 bp, Homo sapiens
gcacctaaagaaaaaca

SEQ ID NO: 873699 - DNA, 19 bp, Homo sapiens
gcacctaccatcagggaca

SEQ ID NO: 873700 - DNA, 17 bp, Homo sapiens
gcacctactatgtgctg

SEQ ID NO: 873701 - DNA, 19 bp, Homo sapiens
gcacctactatgtgctggg

SEQ ID NO: 873702 - DNA, 22 bp, Homo sapiens
gcacctactatgtgctgggtgc

SEQ ID NO: 873703 - DNA, 16 bp, Homo sapiens
gcacctagtccagtga

SEQ ID NO: 873704 - DNA, 21 bp, Homo sapiens
gcacctatagtcccagctact

SEQ ID NO: 873705 - DNA, 16 bp, Homo sapiens
gcacctatctcagcca

SEQ ID NO: 873706 - DNA, 17 bp, Homo sapiens
gcacctatctcagccat

SEQ ID NO: 873707 - DNA, 18 bp, Homo sapiens
gcacctatctcagccata

SEQ ID NO: 873708 - DNA, 23 bp, Homo sapiens
gcacctcaaggtcatcaaacatt

SEQ ID NO: 873709 - DNA, 21 bp, Homo sapiens
gcacctcagaaagtcaccagg

SEQ ID NO: 873710 - DNA, 23 bp, Homo sapiens
gcacctcagcctcccaagtagct

SEQ ID NO: 873711 - DNA, 15 bp, Homo sapiens
gcacctccaggcagg

SEQ ID NO: 873712 - DNA, 20 bp, Homo sapiens
gcacctccaggcaggccagg

SEQ ID NO: 873713 - DNA, 13 bp, Homo sapiens
gcacctccaggcc

SEQ ID NO: 873714 - DNA, 14 bp, Homo sapiens
gcacctccccaaag

SEQ ID NO: 873715 - DNA, 23 bp, Homo sapiens
gcacctccccccactgcaggccc

SEQ ID NO: 873716 - DNA, 14 bp, Homo sapiens
gcacctccccgctg

SEQ ID NO: 873717 - DNA, 22 bp, Homo sapiens
gcacctccctccccagctccgg

SEQ ID NO: 873718 - DNA, 16 bp, Homo sapiens
gcacctccggctgcct

SEQ ID NO: 873719 - DNA, 20 bp, Homo sapiens
gcacctcctaccctcccacc

SEQ ID NO: 873720 - DNA, 13 bp, Homo sapiens
gcacctcctgaga

SEQ ID NO: 873721 - DNA, 16 bp, Homo sapiens
gcacctcctgagaagg

SEQ ID NO: 873722 - DNA, 14 bp, Homo sapiens
gcacctcggggaca

SEQ ID NO: 873723 - DNA, 23 bp, Homo sapiens
gcacctcggggacaccagagctg

SEQ ID NO: 873724 - DNA, 15 bp, Homo sapiens
gcacctctgttcatt

SEQ ID NO: 873725 - DNA, 14 bp, Homo sapiens
gcacctcttccttg

SEQ ID NO: 873726 - DNA, 15 bp, Homo sapiens
gcacctgaaattaat

SEQ ID NO: 873727 - DNA, 18 bp, Homo sapiens
gcacctgaaccccatggg

SEQ ID NO: 873728 - DNA, 17 bp, Homo sapiens
gcacctgacctgctgaa

SEQ ID NO: 873729 - DNA, 16 bp, Homo sapiens
gcacctgacttggctg

SEQ ID NO: 873730 - DNA, 22 bp, Homo sapiens
gcacctgcatccgtagttccct

SEQ ID NO: 873731 - DNA, 15 bp, Homo sapiens
gcacctgccccctgg

SEQ ID NO: 873732 - DNA, 17 bp, Homo sapiens
gcacctgccccctggtg

SEQ ID NO: 873733 - DNA, 18 bp, Homo sapiens
gcacctgcctcagctacc

SEQ ID NO: 873734 - DNA, 16 bp, Homo sapiens
gcacctgcctcaggac

SEQ ID NO: 873735 - DNA, 22 bp, Homo sapiens
gcacctgcctgccgctgcagga

SEQ ID NO: 873736 - DNA, 18 bp, Homo sapiens
gcacctgcgcacaggtgg

SEQ ID NO: 873737 - DNA, 17 bp, Homo sapiens
gcacctgctgcgtcccc

SEQ ID NO: 873738 - DNA, 15 bp, Homo sapiens
gcacctgctggaaac

SEQ ID NO: 873739 - DNA, 20 bp, Homo sapiens
gcacctgcttcatgctcagc

SEQ ID NO: 873740 - DNA, 18 bp, Homo sapiens
gcacctggaatatataac

SEQ ID NO: 873741 - DNA, 22 bp, Homo sapiens
gcacctggaatatataaccagt

SEQ ID NO: 873742 - DNA, 14 bp, Homo sapiens
gcacctggaccccc

SEQ ID NO: 873743 - DNA, 17 bp, Homo sapiens
gcacctggaccccctgc

SEQ ID NO: 873744 - DNA, 20 bp, Homo sapiens
gcacctggaccccctgcccg

SEQ ID NO: 873745 - DNA, 23 bp, Homo sapiens
gcacctggaccccctgcccgcca

SEQ ID NO: 873746 - DNA, 11 bp, Homo sapiens
gcacctggcct

SEQ ID NO: 873747 - DNA, 15 bp, Homo sapiens
gcacctggcctgggc

SEQ ID NO: 873748 - DNA, 15 bp, Homo sapiens
gcacctgggcagctc

SEQ ID NO: 873749 - DNA, 21 bp, Homo sapiens
gcacctgggccccactggaca

SEQ ID NO: 873750 - DNA, 22 bp, Homo sapiens
gcacctggtttctgttctgttg

SEQ ID NO: 873751 - DNA, 19 bp, Homo sapiens
gcacctgtagtcccagcta

SEQ ID NO: 873752 - DNA, 15 bp, Homo sapiens
gcacctgtccccacc

SEQ ID NO: 873753 - DNA, 19 bp, Homo sapiens
gcacctgtcggtggctgcc

SEQ ID NO: 873754 - DNA, 12 bp, Homo sapiens
gcacctgtttcc

SEQ ID NO: 873755 - DNA, 18 bp, Homo sapiens
gcaccttaccaactttct

SEQ ID NO: 873756 - DNA, 21 bp, Homo sapiens
gcaccttaccaactttctgta

SEQ ID NO: 873757 - DNA, 18 bp, Homo sapiens
gcaccttcaagcgctcca

SEQ ID NO: 873758 - DNA, 15 bp, Homo sapiens
gcaccttcagggctg

SEQ ID NO: 873759 - DNA, 20 bp, Homo sapiens
gcaccttcagggctgagttc

SEQ ID NO: 873760 - DNA, 13 bp, Homo sapiens
gcaccttccccct

SEQ ID NO: 873761 - DNA, 15 bp, Homo sapiens
gcaccttcctcctcc

SEQ ID NO: 873762 - DNA, 18 bp, Homo sapiens
gcaccttcctcctccccg

SEQ ID NO: 873763 - DNA, 19 bp, Homo sapiens
gcaccttcttggcgctgga

SEQ ID NO: 873764 - DNA, 15 bp, Homo sapiens
gcaccttctttctgg

SEQ ID NO: 873765 - DNA, 21 bp, Homo sapiens
gcaccttctttctggactggc

SEQ ID NO: 873766 - DNA, 18 bp, Homo sapiens
gcaccttggcccaggagc

SEQ ID NO: 873767 - DNA, 13 bp, Homo sapiens
gcacctttctagt

SEQ ID NO: 873768 - DNA, 18 bp, Homo sapiens
gcacctttctctgagaag

SEQ ID NO: 873769 - DNA, 21 bp, Homo sapiens
gcacctttctctgagaagagg

SEQ ID NO: 873770 - DNA, 21 bp, Homo sapiens
gcacctttgtctggatgcaca

SEQ ID NO: 873771 - DNA, 20 bp, Homo sapiens
gcaccttttataccagagac

SEQ ID NO: 873772 - DNA, 22 bp, Homo sapiens
gcaccttttataccagagacct

SEQ ID NO: 873773 - DNA, 15 bp, Homo sapiens
gcacgaaatgttatt

SEQ ID NO: 873774 - DNA, 17 bp, Homo sapiens
gcacgaacccacctgct

SEQ ID NO: 873775 - DNA, 16 bp, Homo sapiens
gcacgacgccctctcc

SEQ ID NO: 873776 - DNA, 20 bp, Homo sapiens
gcacgacgccctctccccac

SEQ ID NO: 873777 - DNA, 12 bp, Homo sapiens
gcacgatttctg

SEQ ID NO: 873778 - DNA, 13 bp, Homo sapiens
gcacgatttctgt

SEQ ID NO: 873779 - DNA, 15 bp, Homo sapiens
gcacgatttctgttt

SEQ ID NO: 873780 - DNA, 13 bp, Homo sapiens
gcacgcacacaca

SEQ ID NO: 873781 - DNA, 22 bp, Homo sapiens
gcacgcacacacacatacagag

SEQ ID NO: 873782 - DNA, 20 bp, Homo sapiens
gcacgcacctgtagtcccag

SEQ ID NO: 873783 - DNA, 14 bp, Homo sapiens
gcacgcaggaccag

SEQ ID NO: 873784 - DNA, 18 bp, Homo sapiens
gcacgcccatgtgtgagt

SEQ ID NO: 873785 - DNA, 15 bp, Homo sapiens
gcagaggtggccaga

SEQ ID NO: 873786 - DNA, 23 bp, Homo sapiens
gcagaggtggccagagctgggag

SEQ ID NO: 873787 - DNA, 18 bp, Homo sapiens
gcagaggtttgctgacag

SEQ ID NO: 873788 - DNA, 16 bp, Homo sapiens
gcagaggttttaatgt

SEQ ID NO: 873789 - DNA, 20 bp, Homo sapiens
gcagaggttttaatgtctgt

SEQ ID NO: 873790 - DNA, 22 bp, Homo sapiens
gcagagtcctgcacagttttct

SEQ ID NO: 873791 - DNA, 14 bp, Homo sapiens
gcagagtctgggcc

SEQ ID NO: 873792 - DNA, 15 bp, Homo sapiens
gcagagtctgggcct

SEQ ID NO: 873793 - DNA, 13 bp, Homo sapiens
gcagagtctgtct

SEQ ID NO: 873794 - DNA, 14 bp, Homo sapiens
gcagagtctgtctc

SEQ ID NO: 873795 - DNA, 17 bp, Homo sapiens
gcagagtgagcaagggg

SEQ ID NO: 873796 - DNA, 12 bp, Homo sapiens
gcagagtgagga

SEQ ID NO: 873797 - DNA, 18 bp, Homo sapiens
gcagagtggcctagagca

SEQ ID NO: 873798 - DNA, 13 bp, Homo sapiens
gcagagtgggact

SEQ ID NO: 873799 - DNA, 13 bp, Homo sapiens
gcagagttaaatc

SEQ ID NO: 873800 - DNA, 21 bp, Homo sapiens
gcagagttacagttctgtggt

SEQ ID NO: 873801 - DNA, 18 bp, Homo sapiens
gcagagttctcctggagg

SEQ ID NO: 873802 - DNA, 13 bp, Homo sapiens
gcagagttgtaaa

SEQ ID NO: 873803 - DNA, 17 bp, Homo sapiens
gcagagttgtaaatata

SEQ ID NO: 873804 - DNA, 20 bp, Homo sapiens
gcagagttgtaaatatataa

SEQ ID NO: 873805 - DNA, 14 bp, Homo sapiens
gcagataaaatatt

SEQ ID NO: 873806 - DNA, 17 bp, Homo sapiens
gcagataatcagcctct

SEQ ID NO: 873807 - DNA, 16 bp, Homo sapiens
gcagataattctggac

SEQ ID NO: 873808 - DNA, 14 bp, Homo sapiens
gcagatagcccagg

SEQ ID NO: 873809 - DNA, 19 bp, Homo sapiens
gcagatagcccaggagcaa

SEQ ID NO: 873810 - DNA, 18 bp, Homo sapiens
gcagatatctgcatgtgt

SEQ ID NO: 873811 - DNA, 13 bp, Homo sapiens
gcagatctgtgcc

SEQ ID NO: 873812 - DNA, 17 bp, Homo sapiens
gcagatctgtgcctggg

SEQ ID NO: 873813 - DNA, 14 bp, Homo sapiens
gcagatcttttctt

SEQ ID NO: 873814 - DNA, 15 bp, Homo sapiens
gcagatcttttcttt

SEQ ID NO: 873815 - DNA, 18 bp, Homo sapiens
gcagatgaggggccactg

SEQ ID NO: 873816 - DNA, 16 bp, Homo sapiens
gcagatgataaaagga

SEQ ID NO: 873817 - DNA, 19 bp, Homo sapiens
gcagatgcaatgactcagg

SEQ ID NO: 873818 - DNA, 14 bp, Homo sapiens
gcagatgccaccct

SEQ ID NO: 873819 - DNA, 16 bp, Homo sapiens
gcagatgccaccctag

SEQ ID NO: 873820 - DNA, 17 bp, Homo sapiens
gcagatgccaccctagc

SEQ ID NO: 873821 - DNA, 13 bp, Homo sapiens
gcagatgccagtg

SEQ ID NO: 873822 - DNA, 23 bp, Homo sapiens
gcagatgctgctgaagagaggtg

SEQ ID NO: 873823 - DNA, 23 bp, Homo sapiens
gcagatgctgtcactggcagagc

SEQ ID NO: 873824 - DNA, 24 bp, Homo sapiens
gcagatgctgtcactggcagagca

SEQ ID NO: 873825 - DNA, 13 bp, Homo sapiens
gcagatggagacc

SEQ ID NO: 873826 - DNA, 17 bp, Homo sapiens
gcagatgtcttccctgg

SEQ ID NO: 873827 - DNA, 20 bp, Homo sapiens
gcagatgtcttccctgggct

SEQ ID NO: 873828 - DNA, 18 bp, Homo sapiens
gcagatgttttgggggaa

SEQ ID NO: 873829 - DNA, 19 bp, Homo sapiens
gcagattcatttttctttc

SEQ ID NO: 873830 - DNA, 14 bp, Homo sapiens
gcagattcctgggc

SEQ ID NO: 873831 - DNA, 16 bp, Homo sapiens
gcagattcctgggcct

SEQ ID NO: 873832 - DNA, 17 bp, Homo sapiens
gcagattcctgggcctg

SEQ ID NO: 873833 - DNA, 17 bp, Homo sapiens
gcagattgaaaaggaca

SEQ ID NO: 873834 - DNA, 20 bp, Homo sapiens
gcagatttagtgaaagctag

SEQ ID NO: 873835 - DNA, 17 bp, Homo sapiens
gcagattttacaaaaga

SEQ ID NO: 873836 - DNA, 20 bp, Homo sapiens
gcagattttacaaaagatgt

SEQ ID NO: 873837 - DNA, 16 bp, Homo sapiens
gcagcaacaataaata

SEQ ID NO: 873838 - DNA, 18 bp, Homo sapiens
gcagcaagggacctgctc

SEQ ID NO: 873839 - DNA, 16 bp, Homo sapiens
gcagcaatttaaatgt

SEQ ID NO: 873840 - DNA, 20 bp, Homo sapiens
gcagcacaaacattgctgcc

SEQ ID NO: 873841 - DNA, 23 bp, Homo sapiens
gcagcacaaacattgctgccttt

SEQ ID NO: 873842 - DNA, 14 bp, Homo sapiens
gcagcacaaggaat

SEQ ID NO: 873843 - DNA, 23 bp, Homo sapiens
gcagcacaaggaatttccctgtg

SEQ ID NO: 873844 - DNA, 18 bp, Homo sapiens
gcagcacaattctgtccc

SEQ ID NO: 873845 - DNA, 20 bp, Homo sapiens
gcagcacagcccagggcctg

SEQ ID NO: 873846 - DNA, 16 bp, Homo sapiens
gcagcacagtgtgtga

SEQ ID NO: 873847 - DNA, 16 bp, Homo sapiens
gcagcacatttccgct

SEQ ID NO: 873848 - DNA, 15 bp, Homo sapiens
gcagcaccacactgg

SEQ ID NO: 873849 - DNA, 17 bp, Homo sapiens
gcagcaccaccacacag

SEQ ID NO: 873850 - DNA, 19 bp, Homo sapiens
gcagcaccctataaatcaa

SEQ ID NO: 873851 - DNA, 12 bp, Homo sapiens
gcagcaccctcc

SEQ ID NO: 873852 - DNA, 13 bp, Homo sapiens
gcagcaccctccc

SEQ ID NO: 873853 - DNA, 14 bp, Homo sapiens
gcagcacctccagg

SEQ ID NO: 873854 - DNA, 17 bp, Homo sapiens
gcagcacctccaggcct

SEQ ID NO: 873855 - DNA, 17 bp, Homo sapiens
gcagcacctttctctga

SEQ ID NO: 873856 - DNA, 20 bp, Homo sapiens
gcagcacgcaggcggggcag

SEQ ID NO: 873857 - DNA, 21 bp, Homo sapiens
gcagcacggcccggcccctca

SEQ ID NO: 873858 - DNA, 19 bp, Homo sapiens
gcagcactcacacaggacc

SEQ ID NO: 873859 - DNA, 12 bp, Homo sapiens
gcagcactcccc

SEQ ID NO: 873860 - DNA, 13 bp, Homo sapiens
gcagcactcccca

SEQ ID NO: 873861 - DNA, 20 bp, Homo sapiens
gcagcactccccagagctgt

SEQ ID NO: 873862 - DNA, 19 bp, Homo sapiens
gcagcactcccgctgcaca

SEQ ID NO: 873863 - DNA, 23 bp, Homo sapiens
gcagcactcccgctgcacacaga

SEQ ID NO: 873864 - DNA, 21 bp, Homo sapiens
gcagcactccgcatcacctca

SEQ ID NO: 873865 - DNA, 19 bp, Homo sapiens
gcagcactgggaagctgga

SEQ ID NO: 873866 - DNA, 13 bp, Homo sapiens
gcagcagacacat

SEQ ID NO: 873867 - DNA, 21 bp, Homo sapiens
gcagcagagagagaggacaga

SEQ ID NO: 873868 - DNA, 22 bp, Homo sapiens
gcagcagagagccctgggtgac

SEQ ID NO: 873869 - DNA, 15 bp, Homo sapiens
gcagcagaggagctg

SEQ ID NO: 873870 - DNA, 13 bp, Homo sapiens
gcagcagcagccc

SEQ ID NO: 873871 - DNA, 21 bp, Homo sapiens
gcagcagcatcccagccttga

SEQ ID NO: 873872 - DNA, 11 bp, Homo sapiens
gcagcagccac

SEQ ID NO: 873873 - DNA, 12 bp, Homo sapiens
gcagcagccagc

SEQ ID NO: 873874 - DNA, 13 bp, Homo sapiens
gcagcagccagca

SEQ ID NO: 873875 - DNA, 14 bp, Homo sapiens
gcagcagccatcat

SEQ ID NO: 873876 - DNA, 11 bp, Homo sapiens
gcagcagccct

SEQ ID NO: 873877 - DNA, 22 bp, Homo sapiens
gcagcagcgctcggcccggagc

SEQ ID NO: 873878 - DNA, 23 bp, Homo sapiens
gcagcagcgctcggcccggagca

SEQ ID NO: 873879 - DNA, 18 bp, Homo sapiens
gcagcagctgggacccct

SEQ ID NO: 873880 - DNA, 22 bp, Homo sapiens
gcagcagctgggacccctccca

SEQ ID NO: 873881 - DNA, 17 bp, Homo sapiens
gcagcaggatgggctga

SEQ ID NO: 873882 - DNA, 20 bp, Homo sapiens
gcagcagggagggcttctgc

SEQ ID NO: 873883 - DNA, 15 bp, Homo sapiens
gcagcagggatgccc

SEQ ID NO: 873884 - DNA, 21 bp, Homo sapiens
gcagcagggcaggaaggggaa

SEQ ID NO: 873885 - DNA, 17 bp, Homo sapiens
gcagcagggctaccctg

SEQ ID NO: 873886 - DNA, 15 bp, Homo sapiens
gcagcagggctgggc

SEQ ID NO: 873887 - DNA, 21 bp, Homo sapiens
gcagcaggtgattggaccagg

SEQ ID NO: 873888 - DNA, 13 bp, Homo sapiens
gcagcagtagctt

SEQ ID NO: 873889 - DNA, 19 bp, Homo sapiens
gcagcagtgtgaggccagg

SEQ ID NO: 873890 - DNA, 20 bp, Homo sapiens
gcagcagtgtgaggccaggg

SEQ ID NO: 873891 - DNA, 23 bp, Homo sapiens
gcagcagtgtgaggccagggcag

SEQ ID NO: 873892 - DNA, 15 bp, Homo sapiens
gcagcatcccagcct

SEQ ID NO: 873893 - DNA, 21 bp, Homo sapiens
gcagcatcttcaaacatgtac

SEQ ID NO: 873894 - DNA, 17 bp, Homo sapiens
gcagcatgacctgtgac

SEQ ID NO: 873895 - DNA, 20 bp, Homo sapiens
gcagcatgcttgggctgacc

SEQ ID NO: 873896 - DNA, 14 bp, Homo sapiens
gcagcatggaaaaa

SEQ ID NO: 873897 - DNA, 15 bp, Homo sapiens
gcagcatggaaaaat

SEQ ID NO: 873898 - DNA, 23 bp, Homo sapiens
gcagcatggaaaaatggttgatg

SEQ ID NO: 873899 - DNA, 20 bp, Homo sapiens
gcagcatgttgctgaggagt

SEQ ID NO: 873900 - DNA, 18 bp, Homo sapiens
gcagcattcccaccaaca

SEQ ID NO: 873901 - DNA, 23 bp, Homo sapiens
gcagcattctggaggggagagct

SEQ ID NO: 873902 - DNA, 15 bp, Homo sapiens
gcagcattgactggt

SEQ ID NO: 873903 - DNA, 13 bp, Homo sapiens
gcagccaaagaca

SEQ ID NO: 873904 - DNA, 15 bp, Homo sapiens
gcagccaaggccgcc

SEQ ID NO: 873905 - DNA, 22 bp, Homo sapiens
gcagccaaggccgccagcgtgt

SEQ ID NO: 873906 - DNA, 17 bp, Homo sapiens
gcagccaagtagcctct

SEQ ID NO: 873907 - DNA, 20 bp, Homo sapiens
gcagccaagtagcctctcct

SEQ ID NO: 873908 - DNA, 17 bp, Homo sapiens
gcagccacacttccttt

SEQ ID NO: 873909 - DNA, 18 bp, Homo sapiens
gcagccacacttccttta

SEQ ID NO: 873910 - DNA, 13 bp, Homo sapiens
gcagccacaggac

SEQ ID NO: 873911 - DNA, 22 bp, Homo sapiens
gcagccacaggactgagccctc

SEQ ID NO: 873912 - DNA, 19 bp, Homo sapiens
gcagccaccagtggaccta

SEQ ID NO: 873913 - DNA, 11 bp, Homo sapiens
gcagccaccca

SEQ ID NO: 873914 - DNA, 22 bp, Homo sapiens
gcagccacccaagcctgctggc

SEQ ID NO: 873915 - DNA, 22 bp, Homo sapiens
gcagccactgcacaggaggagg

SEQ ID NO: 873916 - DNA, 19 bp, Homo sapiens
gcagccagaccagcaggct

SEQ ID NO: 873917 - DNA, 11 bp, Homo sapiens
gcagccagagc

SEQ ID NO: 873918 - DNA, 12 bp, Homo sapiens
gcagccagagct

SEQ ID NO: 873919 - DNA, 13 bp, Homo sapiens
gcagccagagctg

SEQ ID NO: 873920 - DNA, 12 bp, Homo sapiens
gcagccagcaga

SEQ ID NO: 873921 - DNA, 20 bp, Homo sapiens
gcagccagccggtgcctggc

SEQ ID NO: 873922 - DNA, 15 bp, Homo sapiens
gcagccagctctcag

SEQ ID NO: 873923 - DNA, 16 bp, Homo sapiens
gcagccagctctcagc

SEQ ID NO: 873924 - DNA, 18 bp, Homo sapiens
gcagccaggacccgcctg

SEQ ID NO: 873925 - DNA, 17 bp, Homo sapiens
gcagccaggagggacct

SEQ ID NO: 873926 - DNA, 21 bp, Homo sapiens
gcagccaggagtgcccccggg

SEQ ID NO: 873927 - DNA, 13 bp, Homo sapiens
gcagccaggctgc

SEQ ID NO: 873928 - DNA, 14 bp, Homo sapiens
gcagccaggctgcc

SEQ ID NO: 873929 - DNA, 23 bp, Homo sapiens
gcagccagggcttacctgtacac

SEQ ID NO: 873930 - DNA, 23 bp, Homo sapiens
gcagccatcccgcttagcctgcc

SEQ ID NO: 873931 - DNA, 13 bp, Homo sapiens
gcagccatgcctc

SEQ ID NO: 873932 - DNA, 16 bp, Homo sapiens
gcagccatgcctcatg

SEQ ID NO: 873933 - DNA, 18 bp, Homo sapiens
gcagccatgcctcatgcc

SEQ ID NO: 873934 - DNA, 18 bp, Homo sapiens
gcagcccaccagacgtca

SEQ ID NO: 873935 - DNA, 13 bp, Homo sapiens
gcagcccaccagg

SEQ ID NO: 873936 - DNA, 15 bp, Homo sapiens
gcagcccaccaggag

SEQ ID NO: 873937 - DNA, 13 bp, Homo sapiens
gcagcccagagac

SEQ ID NO: 873938 - DNA, 20 bp, Homo sapiens
gcagcccagcttcctggtgt

SEQ ID NO: 873939 - DNA, 15 bp, Homo sapiens
gcagcccaggcggtt

SEQ ID NO: 873940 - DNA, 16 bp, Homo sapiens
gcagccccagggcctg

SEQ ID NO: 873941 - DNA, 14 bp, Homo sapiens
gcagccccccagca

SEQ ID NO: 873942 - DNA, 15 bp, Homo sapiens
gcagccccccagcac

SEQ ID NO: 873943 - DNA, 14 bp, Homo sapiens
gcagcccccccctc

SEQ ID NO: 873944 - DNA, 19 bp, Homo sapiens
gcagcccccccctcaaggg

SEQ ID NO: 873945 - DNA, 18 bp, Homo sapiens
gcagcccccgcgccctcc

SEQ ID NO: 873946 - DNA, 20 bp, Homo sapiens
gcagcccccgcgccctccct

SEQ ID NO: 873947 - DNA, 12 bp, Homo sapiens
gcagccccctcc

SEQ ID NO: 873948 - DNA, 13 bp, Homo sapiens
gcagccccctcca

SEQ ID NO: 873949 - DNA, 19 bp, Homo sapiens
gcagccccctccacaccag

SEQ ID NO: 873950 - DNA, 18 bp, Homo sapiens
gcagccccgttttgggga

SEQ ID NO: 873951 - DNA, 17 bp, Homo sapiens
gcagcccctcgaggcct

SEQ ID NO: 873952 - DNA, 19 bp, Homo sapiens
gcagcccctcgaggcctac

SEQ ID NO: 873953 - DNA, 20 bp, Homo sapiens
gcagcccctcgaggcctaca

SEQ ID NO: 873954 - DNA, 22 bp, Homo sapiens
gcagcccctcgaggcctacaga

SEQ ID NO: 873955 - DNA, 14 bp, Homo sapiens
gcagcccctgggcc

SEQ ID NO: 873956 - DNA, 16 bp, Homo sapiens
gcagcccctgggccct

SEQ ID NO: 873957 - DNA, 15 bp, Homo sapiens
gcagcccgcctgccg

SEQ ID NO: 873958 - DNA, 16 bp, Homo sapiens
gcagcccgcctgccgt

SEQ ID NO: 873959 - DNA, 19 bp, Homo sapiens
gcagcccgcctgccgtgca

SEQ ID NO: 873960 - DNA, 15 bp, Homo sapiens
gcagcccgccttggc

SEQ ID NO: 873961 - DNA, 18 bp, Homo sapiens
gcagcccgctaggctcgc

SEQ ID NO: 873962 - DNA, 20 bp, Homo sapiens
gcagcccggctgctgcttgg

SEQ ID NO: 873963 - DNA, 15 bp, Homo sapiens
gcagcccgtgaagca

SEQ ID NO: 873964 - DNA, 22 bp, Homo sapiens
gcagcccgtgaagcagtgcctc

SEQ ID NO: 873965 - DNA, 20 bp, Homo sapiens
gcagcccgtgtggccccttc

SEQ ID NO: 873966 - DNA, 12 bp, Homo sapiens
gcagccctccat

SEQ ID NO: 873967 - DNA, 24 bp, Homo sapiens
gcagccctccatggtcctgtctgt

SEQ ID NO: 873968 - DNA, 15 bp, Homo sapiens
gcagccctcgggacc

SEQ ID NO: 873969 - DNA, 16 bp, Homo sapiens
gcagccctgccccaca

SEQ ID NO: 873970 - DNA, 22 bp, Homo sapiens
gcagccctgccccacacctcct

SEQ ID NO: 873971 - DNA, 21 bp, Homo sapiens
gcagcccttcctcctgaagcc

SEQ ID NO: 873972 - DNA, 14 bp, Homo sapiens
gcagcccttgggca

SEQ ID NO: 873973 - DNA, 21 bp, Homo sapiens
gcagcccttgtgtgtgccctg

SEQ ID NO: 873974 - DNA, 14 bp, Homo sapiens
gcagccgccagctg

SEQ ID NO: 873975 - DNA, 14 bp, Homo sapiens
gcagccgccgccgc

SEQ ID NO: 873976 - DNA, 17 bp, Homo sapiens
gcagccgccgggcaggc

SEQ ID NO: 873977 - DNA, 16 bp, Homo sapiens
gcagccgctaggagag

SEQ ID NO: 873978 - DNA, 20 bp, Homo sapiens
gcagccggaggaggagatgt

SEQ ID NO: 873979 - DNA, 15 bp, Homo sapiens
gcagccggagggagg

SEQ ID NO: 873980 - DNA, 19 bp, Homo sapiens
gcagccggcacagggtctg

SEQ ID NO: 873981 - DNA, 16 bp, Homo sapiens
gcagccgtcccaggcc

SEQ ID NO: 873982 - DNA, 23 bp, Homo sapiens
gcagccgtcccaggccaccccca

SEQ ID NO: 873983 - DNA, 17 bp, Homo sapiens
gcagccgtgccttcagc

SEQ ID NO: 873984 - DNA, 16 bp, Homo sapiens
gcagccgttttcctca

SEQ ID NO: 873985 - DNA, 16 bp, Homo sapiens
gcagcctccagagcca

SEQ ID NO: 873986 - DNA, 21 bp, Homo sapiens
gcagcctcccatccagggccc

SEQ ID NO: 873987 - DNA, 14 bp, Homo sapiens
gcagcctccctctg

SEQ ID NO: 873988 - DNA, 14 bp, Homo sapiens
gcagcctcctttgt

SEQ ID NO: 873989 - DNA, 15 bp, Homo sapiens
gcagcctcgaggctg

SEQ ID NO: 873990 - DNA, 18 bp, Homo sapiens
gcagcctcgaggctggtg

SEQ ID NO: 873991 - DNA, 19 bp, Homo sapiens
gcagcctcgaggctggtgg

SEQ ID NO: 873992 - DNA, 22 bp, Homo sapiens
gcagcctcgcacaggccctagc

SEQ ID NO: 873993 - DNA, 15 bp, Homo sapiens
gcagcctctctgcta

SEQ ID NO: 873994 - DNA, 23 bp, Homo sapiens
gcagcctctctggctggtcttca

SEQ ID NO: 873995 - DNA, 15 bp, Homo sapiens
gcagcctctggacag

SEQ ID NO: 873996 - DNA, 22 bp, Homo sapiens
gcagcctctggacagccagtga

SEQ ID NO: 873997 - DNA, 14 bp, Homo sapiens
gcagcctgaacact

SEQ ID NO: 873998 - DNA, 16 bp, Homo sapiens
gcagcctgaagcctgg

SEQ ID NO: 873999 - DNA, 14 bp, Homo sapiens
gcagcctgatggcc

SEQ ID NO: 874000 - DNA, 17 bp, Homo sapiens
gcagcctgatggccaag

SEQ ID NO: 874001 - DNA, 19 bp, Homo sapiens
gcagcctgatggccaaggg

SEQ ID NO: 874002 - DNA, 23 bp, Homo sapiens
gcagcctgatggccaagggggtg

SEQ ID NO: 874003 - DNA, 16 bp, Homo sapiens
gcagcctgcaggacct

SEQ ID NO: 874004 - DNA, 16 bp, Homo sapiens
gcagcctgctctagtg

SEQ ID NO: 874005 - DNA, 15 bp, Homo sapiens
gcagcctgctctgga

SEQ ID NO: 874006 - DNA, 13 bp, Homo sapiens
gcagcctgctggg

SEQ ID NO: 874007 - DNA, 14 bp, Homo sapiens
gcagcctgctgggg

SEQ ID NO: 874008 - DNA, 16 bp, Homo sapiens
gcagcctgctggggct

SEQ ID NO: 874009 - DNA, 18 bp, Homo sapiens
gcagcctgctttggcctt

SEQ ID NO: 874010 - DNA, 19 bp, Homo sapiens
gcagcctgctttggccttt

SEQ ID NO: 874011 - DNA, 20 bp, Homo sapiens
gcagcctgctttggcctttc

SEQ ID NO: 874012 - DNA, 18 bp, Homo sapiens
gcagcctggacatagaga

SEQ ID NO: 874013 - DNA, 16 bp, Homo sapiens
gcagcctgggtctgga

SEQ ID NO: 874014 - DNA, 17 bp, Homo sapiens
gcagcctgtatgtggtg

SEQ ID NO: 874015 - DNA, 21 bp, Homo sapiens
gcagcctgtatgtggtgtggg

SEQ ID NO: 874016 - DNA, 22 bp, Homo sapiens
gcagcctgtgagggagtgcaga

SEQ ID NO: 874017 - DNA, 14 bp, Homo sapiens
gcagcctgtgcctg

SEQ ID NO: 874018 - DNA, 13 bp, Homo sapiens
gcagcctgtggct

SEQ ID NO: 874019 - DNA, 21 bp, Homo sapiens
gcagcctgttttcactcagct

SEQ ID NO: 874020 - DNA, 16 bp, Homo sapiens
gcagccttcccctccc

SEQ ID NO: 874021 - DNA, 18 bp, Homo sapiens
gcagccttcccctccctg

SEQ ID NO: 874022 - DNA, 19 bp, Homo sapiens
gcagccttgggggggctgc

SEQ ID NO: 874023 - DNA, 22 bp, Homo sapiens
gcagcgagctatgatcgcgcca

SEQ ID NO: 874024 - DNA, 14 bp, Homo sapiens
gcagcgagggcgga

SEQ ID NO: 874025 - DNA, 24 bp, Homo sapiens
gcagcgagttgtggaaagcctctg

SEQ ID NO: 874026 - DNA, 22 bp, Homo sapiens
gcagcgcagccgccgggcaggc

SEQ ID NO: 874027 - DNA, 20 bp, Homo sapiens
gcagcgcccaggcctgctgg

SEQ ID NO: 874028 - DNA, 22 bp, Homo sapiens
gcagcgcccaggcctgctggca

SEQ ID NO: 874029 - DNA, 23 bp, Homo sapiens
gcagcgcccaggcctgctggcat

SEQ ID NO: 874030 - DNA, 19 bp, Homo sapiens
gcagcgcccccatctgtct

SEQ ID NO: 874031 - DNA, 23 bp, Homo sapiens
gcagcgcccccatctgtcttcag

SEQ ID NO: 874032 - DNA, 18 bp, Homo sapiens
gcagcgccgtgtcctctc

SEQ ID NO: 874033 - DNA, 12 bp, Homo sapiens
gcagcgcctccc

SEQ ID NO: 874034 - DNA, 21 bp, Homo sapiens
gcagcggattgctctggagca

SEQ ID NO: 874035 - DNA, 13 bp, Homo sapiens
gcagcggctctgg

SEQ ID NO: 874036 - DNA, 23 bp, Homo sapiens
gcagcggctctggtcctcggagc

SEQ ID NO: 874037 - DNA, 22 bp, Homo sapiens
gcagcggggtggggggggagag

SEQ ID NO: 874038 - DNA, 20 bp, Homo sapiens
gcagcgtgtgggtcccgcac

SEQ ID NO: 874039 - DNA, 15 bp, Homo sapiens
gcagctaactccgag

SEQ ID NO: 874040 - DNA, 19 bp, Homo sapiens
gcagctaactccgagagca

SEQ ID NO: 874041 - DNA, 15 bp, Homo sapiens
gcagctactggaatg

SEQ ID NO: 874042 - DNA, 14 bp, Homo sapiens
gcaggagtgccagg

SEQ ID NO: 874043 - DNA, 17 bp, Homo sapiens
gcaggagtgccaggacc

SEQ ID NO: 874044 - DNA, 18 bp, Homo sapiens
gcaggagtgccaggacca

SEQ ID NO: 874045 - DNA, 22 bp, Homo sapiens
gcaggagtgccaggaccagcct

SEQ ID NO: 874046 - DNA, 12 bp, Homo sapiens
gcaggagtggaa

SEQ ID NO: 874047 - DNA, 24 bp, Homo sapiens
gcaggagtggaaggtgaggcgttc

SEQ ID NO: 874048 - DNA, 15 bp, Homo sapiens
gcaggagtggtgcag

SEQ ID NO: 874049 - DNA, 19 bp, Homo sapiens
gcaggagtggtgcagacag

SEQ ID NO: 874050 - DNA, 15 bp, Homo sapiens
gcaggagtgtcctgc

SEQ ID NO: 874051 - DNA, 19 bp, Homo sapiens
gcaggatccgctgccacca

SEQ ID NO: 874052 - DNA, 20 bp, Homo sapiens
gcaggatcgaagggttttta

SEQ ID NO: 874053 - DNA, 19 bp, Homo sapiens
gcaggatctcaagccagcc

SEQ ID NO: 874054 - DNA, 17 bp, Homo sapiens
gcaggatggcctttcct

SEQ ID NO: 874055 - DNA, 23 bp, Homo sapiens
gcaggatggcctttccttccctc

SEQ ID NO: 874056 - DNA, 15 bp, Homo sapiens
gcaggattcccttct

SEQ ID NO: 874057 - DNA, 14 bp, Homo sapiens
gcaggattgaaaat

SEQ ID NO: 874058 - DNA, 22 bp, Homo sapiens
gcaggattgaaaatgtccagga

SEQ ID NO: 874059 - DNA, 21 bp, Homo sapiens
gcaggattggcaactcttcag

SEQ ID NO: 874060 - DNA, 20 bp, Homo sapiens
gcaggcaaaaaagggacagc

SEQ ID NO: 874061 - DNA, 19 bp, Homo sapiens
gcaggcacacagcagcccc

SEQ ID NO: 874062 - DNA, 16 bp, Homo sapiens
gcaggcacagaggagg

SEQ ID NO: 874063 - DNA, 19 bp, Homo sapiens
gcaggcaccaacaactcag

SEQ ID NO: 874064 - DNA, 14 bp, Homo sapiens
gcaggcaccgccac

SEQ ID NO: 874065 - DNA, 19 bp, Homo sapiens
gcaggcaccgggctggctg

SEQ ID NO: 874066 - DNA, 12 bp, Homo sapiens
gcaggcacctgt

SEQ ID NO: 874067 - DNA, 16 bp, Homo sapiens
gcaggcacggcccgca

SEQ ID NO: 874068 - DNA, 10 bp, Homo sapiens
gcaggcagac

SEQ ID NO: 874069 - DNA, 13 bp, Homo sapiens
gcaggcagacacg

SEQ ID NO: 874070 - DNA, 23 bp, Homo sapiens
gcaggcagacacggatctgagaa

SEQ ID NO: 874071 - DNA, 16 bp, Homo sapiens
gcaggcagccttgacc

SEQ ID NO: 874072 - DNA, 18 bp, Homo sapiens
gcaggcagcgcagggctg

SEQ ID NO: 874073 - DNA, 23 bp, Homo sapiens
gcaggcagcgcagggctggcacg

SEQ ID NO: 874074 - DNA, 17 bp, Homo sapiens
gcaggcaggcggctcct

SEQ ID NO: 874075 - DNA, 16 bp, Homo sapiens
gcaggcagggagaagg

SEQ ID NO: 874076 - DNA, 16 bp, Homo sapiens
gcaggcatgtcctgga

SEQ ID NO: 874077 - DNA, 16 bp, Homo sapiens
gcaggcattgaggaag

SEQ ID NO: 874078 - DNA, 18 bp, Homo sapiens
gcaggcattgaggaagag

SEQ ID NO: 874079 - DNA, 20 bp, Homo sapiens
gcaggccaagtcaggccctt

SEQ ID NO: 874080 - DNA, 17 bp, Homo sapiens
gcaggccacccgggctg

SEQ ID NO: 874081 - DNA, 15 bp, Homo sapiens
gcaggccactagtga

SEQ ID NO: 874082 - DNA, 17 bp, Homo sapiens
gcaggccactagtgaca

SEQ ID NO: 874083 - DNA, 20 bp, Homo sapiens
gcaggccagcttcgtgctgg

SEQ ID NO: 874084 - DNA, 23 bp, Homo sapiens
gcaggccagcttcgtgctggagg

SEQ ID NO: 874085 - DNA, 19 bp, Homo sapiens
gcaggccaggctgcctcgg

SEQ ID NO: 874086 - DNA, 17 bp, Homo sapiens
gcaggcccactccccag

SEQ ID NO: 874087 - DNA, 16 bp, Homo sapiens
gcaggcccagcatgca

SEQ ID NO: 874088 - DNA, 22 bp, Homo sapiens
gcaggcccagcatgcaggtggt

SEQ ID NO: 874089 - DNA, 12 bp, Homo sapiens
gcaggccctggc

SEQ ID NO: 874090 - DNA, 16 bp, Homo sapiens
gcaggccctggcctcc

SEQ ID NO: 874091 - DNA, 20 bp, Homo sapiens
gcaggcctccaacgcccctg

SEQ ID NO: 874092 - DNA, 21 bp, Homo sapiens
gcaggcctccaacgcccctgt

SEQ ID NO: 874093 - DNA, 14 bp, Homo sapiens
gcaggcctccctga

SEQ ID NO: 874094 - DNA, 21 bp, Homo sapiens
gcaggcctccctgaaacactg

SEQ ID NO: 874095 - DNA, 23 bp, Homo sapiens
gcaggcctcgaaaaccatcacat

SEQ ID NO: 874096 - DNA, 21 bp, Homo sapiens
gcaggcctgacccacggggca

SEQ ID NO: 874097 - DNA, 14 bp, Homo sapiens
gcaggcctgagaat

SEQ ID NO: 874098 - DNA, 13 bp, Homo sapiens
gcaggcctgggac

SEQ ID NO: 874099 - DNA, 18 bp, Homo sapiens
gcaggcctgggacccagc

SEQ ID NO: 874100 - DNA, 20 bp, Homo sapiens
gcaggcctgggacccagcta

SEQ ID NO: 874101 - DNA, 17 bp, Homo sapiens
gcaggccttgctggggt

SEQ ID NO: 874102 - DNA, 14 bp, Homo sapiens
gcaggcgcagaggt

SEQ ID NO: 874103 - DNA, 22 bp, Homo sapiens
gcaggcgcatgagtatctgtgg

SEQ ID NO: 874104 - DNA, 18 bp, Homo sapiens
gcaggcggctcctcctca

SEQ ID NO: 874105 - DNA, 23 bp, Homo sapiens
gcaggcggtccccatccccacca

SEQ ID NO: 874106 - DNA, 14 bp, Homo sapiens
gcaggcggtgggca

SEQ ID NO: 874107 - DNA, 15 bp, Homo sapiens
gcaggcggtgggcac

SEQ ID NO: 874108 - DNA, 23 bp, Homo sapiens
gcaggcggtgggcacccaccctg

SEQ ID NO: 874109 - DNA, 14 bp, Homo sapiens
gcaggcgtgtggca

SEQ ID NO: 874110 - DNA, 16 bp, Homo sapiens
gcaggcgtgtggcagc

SEQ ID NO: 874111 - DNA, 20 bp, Homo sapiens
gcaggcgtgtggcagccaca

SEQ ID NO: 874112 - DNA, 23 bp, Homo sapiens
gcaggcgtgtggcagccacacgc

SEQ ID NO: 874113 - DNA, 15 bp, Homo sapiens
gcaggctcactgcca

SEQ ID NO: 874114 - DNA, 17 bp, Homo sapiens
gcaggctcactgccagg

SEQ ID NO: 874115 - DNA, 19 bp, Homo sapiens
gcaggctcactgccaggcc

SEQ ID NO: 874116 - DNA, 15 bp, Homo sapiens
gcaggctcctggctg

SEQ ID NO: 874117 - DNA, 22 bp, Homo sapiens
gcaggctcctggctgtgcccag

SEQ ID NO: 874118 - DNA, 14 bp, Homo sapiens
gcaggctctctcct

SEQ ID NO: 874119 - DNA, 12 bp, Homo sapiens
gcaggctctggg

SEQ ID NO: 874120 - DNA, 15 bp, Homo sapiens
gcaggctctgggctc

SEQ ID NO: 874121 - DNA, 23 bp, Homo sapiens
gcaggctctgggctcagggctgg

SEQ ID NO: 874122 - DNA, 19 bp, Homo sapiens
gcagtggcgcattctaggc

SEQ ID NO: 874123 - DNA, 16 bp, Homo sapiens
gcagtggctctcagag

SEQ ID NO: 874124 - DNA, 18 bp, Homo sapiens
gcagtggctggtccaggg

SEQ ID NO: 874125 - DNA, 15 bp, Homo sapiens
gcagtggctggtgcc

SEQ ID NO: 874126 - DNA, 20 bp, Homo sapiens
gcagtggctggtgcccatga

SEQ ID NO: 874127 - DNA, 16 bp, Homo sapiens
gcagtggcttctttcc

SEQ ID NO: 874128 - DNA, 15 bp, Homo sapiens
gcagtggcttttcat

SEQ ID NO: 874129 - DNA, 21 bp, Homo sapiens
gcagtgggacagggcatggcc

SEQ ID NO: 874130 - DNA, 12 bp, Homo sapiens
gcagtgggcagg

SEQ ID NO: 874131 - DNA, 14 bp, Homo sapiens
gcagtgggcaggtg

SEQ ID NO: 874132 - DNA, 13 bp, Homo sapiens
gcagtgggcctgc

SEQ ID NO: 874133 - DNA, 19 bp, Homo sapiens
gcagtgggcctgctgaggc

SEQ ID NO: 874134 - DNA, 23 bp, Homo sapiens
gcagtggtggttttctgttcttt

SEQ ID NO: 874135 - DNA, 24 bp, Homo sapiens
gcagtggttttggcaaacgctaaa

SEQ ID NO: 874136 - DNA, 23 bp, Homo sapiens
gcagtgtctgtaaaagagcctag

SEQ ID NO: 874137 - DNA, 22 bp, Homo sapiens
gcagtgtgaatagcctggccac

SEQ ID NO: 874138 - DNA, 20 bp, Homo sapiens
gcagtgtgacctcctgtgac

SEQ ID NO: 874139 - DNA, 11 bp, Homo sapiens
gcagtgtgcag

SEQ ID NO: 874140 - DNA, 16 bp, Homo sapiens
gcagtgtgcagggtgg

SEQ ID NO: 874141 - DNA, 12 bp, Homo sapiens
gcagtgtggaga

SEQ ID NO: 874142 - DNA, 20 bp, Homo sapiens
gcagtgtggttatgttccca

SEQ ID NO: 874143 - DNA, 21 bp, Homo sapiens
gcagtgttcctatttggggct

SEQ ID NO: 874144 - DNA, 11 bp, Homo sapiens
gcagttatatt

SEQ ID NO: 874145 - DNA, 17 bp, Homo sapiens
gcagttcagcaccaccc

SEQ ID NO: 874146 - DNA, 17 bp, Homo sapiens
gcagttcattgcagaca

SEQ ID NO: 874147 - DNA, 13 bp, Homo sapiens
gcagttctcccag

SEQ ID NO: 874148 - DNA, 14 bp, Homo sapiens
gcagttctcccagg

SEQ ID NO: 874149 - DNA, 16 bp, Homo sapiens
gcagttctcccaggga

SEQ ID NO: 874150 - DNA, 19 bp, Homo sapiens
gcagttctcccagggagtg

SEQ ID NO: 874151 - DNA, 15 bp, Homo sapiens
gcagttgaacagagg

SEQ ID NO: 874152 - DNA, 20 bp, Homo sapiens
gcagttgacatccaaatcta

SEQ ID NO: 874153 - DNA, 19 bp, Homo sapiens
gcagttggactctcaggga

SEQ ID NO: 874154 - DNA, 19 bp, Homo sapiens
gcagttggccaagcagaaa

SEQ ID NO: 874155 - DNA, 16 bp, Homo sapiens
gcagttggggccctct

SEQ ID NO: 874156 - DNA, 22 bp, Homo sapiens
gcagttggggccctcttgccag

SEQ ID NO: 874157 - DNA, 13 bp, Homo sapiens
gcagttgtgtcag

SEQ ID NO: 874158 - DNA, 16 bp, Homo sapiens
gcagtttatcattcaa

SEQ ID NO: 874159 - DNA, 22 bp, Homo sapiens
gcagtttcatgtatgtatataa

SEQ ID NO: 874160 - DNA, 14 bp, Homo sapiens
gcagtttcctggaa

SEQ ID NO: 874161 - DNA, 17 bp, Homo sapiens
gcagtttcttcatctca

SEQ ID NO: 874162 - DNA, 21 bp, Homo sapiens
gcagtttgcctggtgcagtgg

SEQ ID NO: 874163 - DNA, 15 bp, Homo sapiens
gcagtttggccctgg

SEQ ID NO: 874164 - DNA, 16 bp, Homo sapiens
gcagtttggccctgga

SEQ ID NO: 874165 - DNA, 22 bp, Homo sapiens
gcagtttggccctggagccagg

SEQ ID NO: 874166 - DNA, 23 bp, Homo sapiens
gcagtttgggagacatggaccag

SEQ ID NO: 874167 - DNA, 14 bp, Homo sapiens
gcagtttgggaggt

SEQ ID NO: 874168 - DNA, 17 bp, Homo sapiens
gcagttttcaagtcaaa

SEQ ID NO: 874169 - DNA, 20 bp, Homo sapiens
gcagttttttttttcttgtc

SEQ ID NO: 874170 - DNA, 15 bp, Homo sapiens
gcataaaaaaatgat

SEQ ID NO: 874171 - DNA, 16 bp, Homo sapiens
gcataaaaacatttta

SEQ ID NO: 874172 - DNA, 13 bp, Homo sapiens
gcataaagtaaat

SEQ ID NO: 874173 - DNA, 19 bp, Homo sapiens
gcataaataaaactgaatc

SEQ ID NO: 874174 - DNA, 15 bp, Homo sapiens
gcataaattaaaatg

SEQ ID NO: 874175 - DNA, 17 bp, Homo sapiens
gcataaattaatcagcc

SEQ ID NO: 874176 - DNA, 17 bp, Homo sapiens
gcataacaattcctcta

SEQ ID NO: 874177 - DNA, 18 bp, Homo sapiens
gcataagattaaaggaag

SEQ ID NO: 874178 - DNA, 15 bp, Homo sapiens
gcataagtcctctag

SEQ ID NO: 874179 - DNA, 17 bp, Homo sapiens
gcataatttaaaaatat

SEQ ID NO: 874180 - DNA, 11 bp, Homo sapiens
gcatacaaaat

SEQ ID NO: 874181 - DNA, 16 bp, Homo sapiens
gcatacaaaatattta

SEQ ID NO: 874182 - DNA, 21 bp, Homo sapiens
gcatacaaaatatttaagtga

SEQ ID NO: 874183 - DNA, 16 bp, Homo sapiens
gcatacaacagagggg

SEQ ID NO: 874184 - DNA, 15 bp, Homo sapiens
gcatacaataaaaga

SEQ ID NO: 874185 - DNA, 17 bp, Homo sapiens
gcatacaataaaagagc

SEQ ID NO: 874186 - DNA, 18 bp, Homo sapiens
gcatacaataaaagagct

SEQ ID NO: 874187 - DNA, 21 bp, Homo sapiens
gcatacaataaaagagcttta

SEQ ID NO: 874188 - DNA, 18 bp, Homo sapiens
gcatacacacatgccctc

SEQ ID NO: 874189 - DNA, 22 bp, Homo sapiens
gcatacacacatgccctcctgg

SEQ ID NO: 874190 - DNA, 16 bp, Homo sapiens
gcatacactgtagttt

SEQ ID NO: 874191 - DNA, 16 bp, Homo sapiens
gcatacattttctggt

SEQ ID NO: 874192 - DNA, 20 bp, Homo sapiens
gcatacgagagcagaggtct

SEQ ID NO: 874193 - DNA, 14 bp, Homo sapiens
gcatacgtacacat

SEQ ID NO: 874194 - DNA, 17 bp, Homo sapiens
gcatacgtacacatttt

SEQ ID NO: 874195 - DNA, 13 bp, Homo sapiens
gcatactgaaaat

SEQ ID NO: 874196 - DNA, 23 bp, Homo sapiens
gcatactgagccaagtataattt

SEQ ID NO: 874197 - DNA, 12 bp, Homo sapiens
gcatactgtgta

SEQ ID NO: 874198 - DNA, 14 bp, Homo sapiens
gcatactgtgtatg

SEQ ID NO: 874199 - DNA, 17 bp, Homo sapiens
gcatactgtgtatgttt

SEQ ID NO: 874200 - DNA, 19 bp, Homo sapiens
gcatactgtgtatgtttta

SEQ ID NO: 874201 - DNA, 16 bp, Homo sapiens
gcatactttctctcta

SEQ ID NO: 874202 - DNA, 19 bp, Homo sapiens
gcatactttgacaaggaaa

SEQ ID NO: 874203 - DNA, 15 bp, Homo sapiens
gcatactttgtaaat

SEQ ID NO: 874204 - DNA, 23 bp, Homo sapiens
gcatagaaggaagtgtgtttgcc

SEQ ID NO: 874205 - DNA, 15 bp, Homo sapiens
gcatagactgaggta

SEQ ID NO: 874206 - DNA, 14 bp, Homo sapiens
gcatagaggttttg

SEQ ID NO: 874207 - DNA, 15 bp, Homo sapiens
gcatagaggttttgt

SEQ ID NO: 874208 - DNA, 16 bp, Homo sapiens
gcatagcaagacacat

SEQ ID NO: 874209 - DNA, 18 bp, Homo sapiens
gcatagcccatgttaagt

SEQ ID NO: 874210 - DNA, 22 bp, Homo sapiens
gcatagcctgcctgatccctga

SEQ ID NO: 874211 - DNA, 15 bp, Homo sapiens
gcatagctacaattt

SEQ ID NO: 874212 - DNA, 22 bp, Homo sapiens
gcatagctactaaaatcagtga

SEQ ID NO: 874213 - DNA, 21 bp, Homo sapiens
gcataggagtttggaggaagt

SEQ ID NO: 874214 - DNA, 23 bp, Homo sapiens
gcataggcctgggtgctggctgc

SEQ ID NO: 874215 - DNA, 14 bp, Homo sapiens
gcataggggggagg

SEQ ID NO: 874216 - DNA, 15 bp, Homo sapiens
gcataggggggaggg

SEQ ID NO: 874217 - DNA, 16 bp, Homo sapiens
gcatataacttatatt

SEQ ID NO: 874218 - DNA, 23 bp, Homo sapiens
gcatataacttatattgtaagaa

SEQ ID NO: 874219 - DNA, 21 bp, Homo sapiens
gcatataattttcacttctgt

SEQ ID NO: 874220 - DNA, 13 bp, Homo sapiens
gcatatcataatg

SEQ ID NO: 874221 - DNA, 20 bp, Homo sapiens
gcatatcattaaacaaataa

SEQ ID NO: 874222 - DNA, 23 bp, Homo sapiens
gcatatctggtatatgtcattat

SEQ ID NO: 874223 - DNA, 14 bp, Homo sapiens
gcatatgcatgcca

SEQ ID NO: 874224 - DNA, 15 bp, Homo sapiens
gcatatgcatgccag

SEQ ID NO: 874225 - DNA, 14 bp, Homo sapiens
gcatatgttgaata

SEQ ID NO: 874226 - DNA, 17 bp, Homo sapiens
gcatatgttgaatactt

SEQ ID NO: 874227 - DNA, 18 bp, Homo sapiens
gcatatgttgaatacttt

SEQ ID NO: 874228 - DNA, 21 bp, Homo sapiens
gcatatgtttccccatctctg

SEQ ID NO: 874229 - DNA, 12 bp, Homo sapiens
gcatattggaaa

SEQ ID NO: 874230 - DNA, 23 bp, Homo sapiens
gcatatttatagcaatccatgtt

SEQ ID NO: 874231 - DNA, 23 bp, Homo sapiens
gcatatttatccaaaatgtgtat

SEQ ID NO: 874232 - DNA, 21 bp, Homo sapiens
gcatatttctgtatatttgtc

SEQ ID NO: 874233 - DNA, 22 bp, Homo sapiens
gcatatttctgtatatttgtca

SEQ ID NO: 874234 - DNA, 19 bp, Homo sapiens
gcatatttgttactttact

SEQ ID NO: 874235 - DNA, 23 bp, Homo sapiens
gcatattttcttacttttattat

SEQ ID NO: 874236 - DNA, 19 bp, Homo sapiens
gcatatttttctaaagaaa

SEQ ID NO: 874237 - DNA, 12 bp, Homo sapiens
gcatcaagccac

SEQ ID NO: 874238 - DNA, 18 bp, Homo sapiens
gcatcacacttatatttt

SEQ ID NO: 874239 - DNA, 20 bp, Homo sapiens
gcatcacacttatattttat

SEQ ID NO: 874240 - DNA, 21 bp, Homo sapiens
gcatcacagggcagagccggg

SEQ ID NO: 874241 - DNA, 14 bp, Homo sapiens
gcatcacctcaggc

SEQ ID NO: 874242 - DNA, 23 bp, Homo sapiens
gcatcacggatggtgcatgggct

SEQ ID NO: 874243 - DNA, 13 bp, Homo sapiens
gcatcactgcctt

SEQ ID NO: 874244 - DNA, 20 bp, Homo sapiens
gcatcactgccttggcccct

SEQ ID NO: 874245 - DNA, 18 bp, Homo sapiens
gcatcactgggtgttgat

SEQ ID NO: 874246 - DNA, 22 bp, Homo sapiens
gcatcactgggtgttgatctta

SEQ ID NO: 874247 - DNA, 21 bp, Homo sapiens
gcatcagaaggttcacccagc

SEQ ID NO: 874248 - DNA, 12 bp, Homo sapiens
gcatcaggcact

SEQ ID NO: 874249 - DNA, 13 bp, Homo sapiens
gcatcaggcactg

SEQ ID NO: 874250 - DNA, 18 bp, Homo sapiens
gcatcaggcactggtggc

SEQ ID NO: 874251 - DNA, 19 bp, Homo sapiens
gcatcaggcactggtggca

SEQ ID NO: 874252 - DNA, 20 bp, Homo sapiens
gcatcagggcctttctcctc

SEQ ID NO: 874253 - DNA, 21 bp, Homo sapiens
gcatcagggggaagaagcaga

SEQ ID NO: 874254 - DNA, 12 bp, Homo sapiens
gcatcagggtta

SEQ ID NO: 874255 - DNA, 19 bp, Homo sapiens
gcatcaggtctgggcaagt

SEQ ID NO: 874256 - DNA, 17 bp, Homo sapiens
gcatcatagtagttttt

SEQ ID NO: 874257 - DNA, 20 bp, Homo sapiens
gcatcattttaacaggtgcc

SEQ ID NO: 874258 - DNA, 20 bp, Homo sapiens
gcatcattttgcattcaaat

SEQ ID NO: 874259 - DNA, 20 bp, Homo sapiens
gcatccacccagtgctgcca

SEQ ID NO: 874260 - DNA, 22 bp, Homo sapiens
gcatccacccagtgctgccatg

SEQ ID NO: 874261 - DNA, 15 bp, Homo sapiens
gcatccagcctgtgt

SEQ ID NO: 874262 - DNA, 17 bp, Homo sapiens
gcatccatgtgtggact

SEQ ID NO: 874263 - DNA, 12 bp, Homo sapiens
gcatccattcct

SEQ ID NO: 874264 - DNA, 19 bp, Homo sapiens
gcatccatttgaacacatt

SEQ ID NO: 874265 - DNA, 15 bp, Homo sapiens
gcatccatttgaata

SEQ ID NO: 874266 - DNA, 13 bp, Homo sapiens
gcatcccagcctt

SEQ ID NO: 874267 - DNA, 12 bp, Homo sapiens
gcatcccagctt

SEQ ID NO: 874268 - DNA, 15 bp, Homo sapiens
gcatcccagcttgcc

SEQ ID NO: 874269 - DNA, 17 bp, Homo sapiens
gcatcccagcttgcccc

SEQ ID NO: 874270 - DNA, 19 bp, Homo sapiens
gcatcccagcttgcccccg

SEQ ID NO: 874271 - DNA, 14 bp, Homo sapiens
gcatcccaggggac

SEQ ID NO: 874272 - DNA, 15 bp, Homo sapiens
gcatcccatctctcc

SEQ ID NO: 874273 - DNA, 23 bp, Homo sapiens
gcatcccatctctcccacttcct

SEQ ID NO: 874274 - DNA, 12 bp, Homo sapiens
gcatcccccaaa

SEQ ID NO: 874275 - DNA, 16 bp, Homo sapiens
gcatcccccctgctca

SEQ ID NO: 874276 - DNA, 20 bp, Homo sapiens
gcatccccctcctctccctg

SEQ ID NO: 874277 - DNA, 20 bp, Homo sapiens
gcatccccttggctgtgagg

SEQ ID NO: 874278 - DNA, 13 bp, Homo sapiens
gcatcccggagga

SEQ ID NO: 874279 - DNA, 16 bp, Homo sapiens
gcatcccggaggaaat

SEQ ID NO: 874280 - DNA, 18 bp, Homo sapiens
gcatcccggaggaaatct

SEQ ID NO: 874281 - DNA, 16 bp, Homo sapiens
gcatccctggagcagg

SEQ ID NO: 874282 - DNA, 20 bp, Homo sapiens
gcatcccttcccacatgcct

SEQ ID NO: 874283 - DNA, 22 bp, Homo sapiens
gcatcccttcccacatgcctgc

SEQ ID NO: 874284 - DNA, 21 bp, Homo sapiens
gcatcccttcgcctgcagcct

SEQ ID NO: 874285 - DNA, 22 bp, Homo sapiens
gcatccctttttcataaattat

SEQ ID NO: 874286 - DNA, 14 bp, Homo sapiens
gcatccgaaggtgt

SEQ ID NO: 874287 - DNA, 19 bp, Homo sapiens
gcatccggccaaatgcaaa

SEQ ID NO: 874288 - DNA, 15 bp, Homo sapiens
gcatccgtcctgggc

SEQ ID NO: 874289 - DNA, 20 bp, Homo sapiens
gcatcctgcagggcttctcc

SEQ ID NO: 874290 - DNA, 12 bp, Homo sapiens
gcatcctgctgg

SEQ ID NO: 874291 - DNA, 14 bp, Homo sapiens
gcatcctgtgaagt

SEQ ID NO: 874292 - DNA, 17 bp, Homo sapiens
gcatcctgtgaagtcct

SEQ ID NO: 874293 - DNA, 16 bp, Homo sapiens
gcatccttgcctgtct

SEQ ID NO: 874294 - DNA, 20 bp, Homo sapiens
gcatccttgcctgtctaaag

SEQ ID NO: 874295 - DNA, 23 bp, Homo sapiens
gcatccttgcctgtctaaagcct

SEQ ID NO: 874296 - DNA, 15 bp, Homo sapiens
gcatccttgtaatac

SEQ ID NO: 874297 - DNA, 13 bp, Homo sapiens
gcatccttgtctt

SEQ ID NO: 874298 - DNA, 18 bp, Homo sapiens
gcatccttgtcttttgag

SEQ ID NO: 874299 - DNA, 13 bp, Homo sapiens
gcatcgcaatgta

SEQ ID NO: 874300 - DNA, 18 bp, Homo sapiens
gcatcgcaccattctgac

SEQ ID NO: 874301 - DNA, 20 bp, Homo sapiens
gcatcgcaccattctgactc

SEQ ID NO: 874302 - DNA, 21 bp, Homo sapiens
gcatcgcaggagtctctgcca

SEQ ID NO: 874303 - DNA, 19 bp, Homo sapiens
gcatcgcatccgtcctggg

SEQ ID NO: 874304 - DNA, 17 bp, Homo sapiens
gcatcggagggagtccc

SEQ ID NO: 874305 - DNA, 20 bp, Homo sapiens
gccaagccctaagcctgtcc

SEQ ID NO: 874306 - DNA, 22 bp, Homo sapiens
gccaagccctccccatcccatg

SEQ ID NO: 874307 - DNA, 12 bp, Homo sapiens
gccaagcctgct

SEQ ID NO: 874308 - DNA, 15 bp, Homo sapiens
gccaagcctgctgtg

SEQ ID NO: 874309 - DNA, 13 bp, Homo sapiens
gccaagccttctg

SEQ ID NO: 874310 - DNA, 19 bp, Homo sapiens
gccaagcgggggcgtggct

SEQ ID NO: 874311 - DNA, 19 bp, Homo sapiens
gccaagctccctggagccc

SEQ ID NO: 874312 - DNA, 22 bp, Homo sapiens
gccaagcttcctgtgccctcac

SEQ ID NO: 874313 - DNA, 16 bp, Homo sapiens
gccaagctttaaatta

SEQ ID NO: 874314 - DNA, 20 bp, Homo sapiens
gccaaggagctgctatagcc

SEQ ID NO: 874315 - DNA, 15 bp, Homo sapiens
gccaaggaggcctgg

SEQ ID NO: 874316 - DNA, 20 bp, Homo sapiens
gccaaggagggtgagtgcaa

SEQ ID NO: 874317 - DNA, 14 bp, Homo sapiens
gccaaggcagaggc

SEQ ID NO: 874318 - DNA, 19 bp, Homo sapiens
gccaaggcagctcttctgg

SEQ ID NO: 874319 - DNA, 22 bp, Homo sapiens
gccaaggcagctcttctggagt

SEQ ID NO: 874320 - DNA, 15 bp, Homo sapiens
gccaaggcaggtaga

SEQ ID NO: 874321 - DNA, 10 bp, Homo sapiens
gccaaggcca

SEQ ID NO: 874322 - DNA, 12 bp, Homo sapiens
gccaaggccacc

SEQ ID NO: 874323 - DNA, 21 bp, Homo sapiens
gccaaggccagagtggcctgg

SEQ ID NO: 874324 - DNA, 23 bp, Homo sapiens
gccaaggcccaactaacagtcaa

SEQ ID NO: 874325 - DNA, 16 bp, Homo sapiens
gccaaggccgccagcg

SEQ ID NO: 874326 - DNA, 18 bp, Homo sapiens
gccaaggctctcccctct

SEQ ID NO: 874327 - DNA, 12 bp, Homo sapiens
gccaagggaaag

SEQ ID NO: 874328 - DNA, 18 bp, Homo sapiens
gccaagggaaaggggtgc

SEQ ID NO: 874329 - DNA, 15 bp, Homo sapiens
gccaagggccccagg

SEQ ID NO: 874330 - DNA, 22 bp, Homo sapiens
gccaaggggagtcaccttccct

SEQ ID NO: 874331 - DNA, 23 bp, Homo sapiens
gccaaggggctgcgctagcagcc

SEQ ID NO: 874332 - DNA, 18 bp, Homo sapiens
gccaagggggtgactgga

SEQ ID NO: 874333 - DNA, 19 bp, Homo sapiens
gccaagggggtgactggaa

SEQ ID NO: 874334 - DNA, 23 bp, Homo sapiens
gccaaggggtgggcctgtgaatc

SEQ ID NO: 874335 - DNA, 16 bp, Homo sapiens
gccaaggtcctgctca

SEQ ID NO: 874336 - DNA, 20 bp, Homo sapiens
gccaaggtgcatatagaaaa

SEQ ID NO: 874337 - DNA, 21 bp, Homo sapiens
gccaaggtgcatatagaaaac

SEQ ID NO: 874338 - DNA, 19 bp, Homo sapiens
gccaaggtggagggaagga

SEQ ID NO: 874339 - DNA, 16 bp, Homo sapiens
gccaaggtgggctgag

SEQ ID NO: 874340 - DNA, 21 bp, Homo sapiens
gccaaggtgggctgagccctg

SEQ ID NO: 874341 - DNA, 23 bp, Homo sapiens
gccaaggtgtttccatttctcaa

SEQ ID NO: 874342 - DNA, 20 bp, Homo sapiens
gccaaggttttataaggctg

SEQ ID NO: 874343 - DNA, 16 bp, Homo sapiens
gccaagtataattttt

SEQ ID NO: 874344 - DNA, 22 bp, Homo sapiens
gccaagtataattttttgtaat

SEQ ID NO: 874345 - DNA, 21 bp, Homo sapiens
gccaagtcatggagaatctgc

SEQ ID NO: 874346 - DNA, 16 bp, Homo sapiens
gccaagtccactgtcc

SEQ ID NO: 874347 - DNA, 17 bp, Homo sapiens
gccaagtccactgtcct

SEQ ID NO: 874348 - DNA, 12 bp, Homo sapiens
gccaagtccaga

SEQ ID NO: 874349 - DNA, 14 bp, Homo sapiens
gccaagtgcctgct

SEQ ID NO: 874350 - DNA, 16 bp, Homo sapiens
gccaagtgcctgctta

SEQ ID NO: 874351 - DNA, 17 bp, Homo sapiens
gccaagtgcctgcttag

SEQ ID NO: 874352 - DNA, 13 bp, Homo sapiens
gccaagtggccac

SEQ ID NO: 874353 - DNA, 19 bp, Homo sapiens
gccaagtggggtgctggga

SEQ ID NO: 874354 - DNA, 17 bp, Homo sapiens
gccaagtgtcttttaaa

SEQ ID NO: 874355 - DNA, 15 bp, Homo sapiens
gccaagttcctctag

SEQ ID NO: 874356 - DNA, 18 bp, Homo sapiens
gccaataccctactgtgg

SEQ ID NO: 874357 - DNA, 23 bp, Homo sapiens
gccaatatgtattgtaaacatgt

SEQ ID NO: 874358 - DNA, 18 bp, Homo sapiens
gccaatattaaatctgct

SEQ ID NO: 874359 - DNA, 13 bp, Homo sapiens
gccaatcccctcc

SEQ ID NO: 874360 - DNA, 19 bp, Homo sapiens
gccaatcccctccttgggc

SEQ ID NO: 874361 - DNA, 13 bp, Homo sapiens
gccaatccctggc

SEQ ID NO: 874362 - DNA, 18 bp, Homo sapiens
gccaatcggctacccctc

SEQ ID NO: 874363 - DNA, 22 bp, Homo sapiens
gccaatgaggtctgaaatggag

SEQ ID NO: 874364 - DNA, 15 bp, Homo sapiens
gccaatgatgtgacc

SEQ ID NO: 874365 - DNA, 13 bp, Homo sapiens
gccaatggaaacc

SEQ ID NO: 874366 - DNA, 19 bp, Homo sapiens
gccaatggagactgtctca

SEQ ID NO: 874367 - DNA, 21 bp, Homo sapiens
gccaatggagactgtctcaag

SEQ ID NO: 874368 - DNA, 21 bp, Homo sapiens
gccaatggaggggggtgctgg

SEQ ID NO: 874369 - DNA, 18 bp, Homo sapiens
gccaatgtcgaaacctac

SEQ ID NO: 874370 - DNA, 16 bp, Homo sapiens
gccaatgtgggctgcc

SEQ ID NO: 874371 - DNA, 13 bp, Homo sapiens
gccaatttcctct

SEQ ID NO: 874372 - DNA, 22 bp, Homo sapiens
gccaatttcctctccactgctg

SEQ ID NO: 874373 - DNA, 17 bp, Homo sapiens
gccacaactgctgtggc

SEQ ID NO: 874374 - DNA, 18 bp, Homo sapiens
gccacaactgctgtggcc

SEQ ID NO: 874375 - DNA, 19 bp, Homo sapiens
gccacaactgctgtggccc

SEQ ID NO: 874376 - DNA, 21 bp, Homo sapiens
gccacaactgctgtggccccc

SEQ ID NO: 874377 - DNA, 16 bp, Homo sapiens
gccacaagaaatttga

SEQ ID NO: 874378 - DNA, 15 bp, Homo sapiens
gccacaagctgcact

SEQ ID NO: 874379 - DNA, 22 bp, Homo sapiens
gccacaagctgcactgtgaacc

SEQ ID NO: 874380 - DNA, 16 bp, Homo sapiens
gccacaaggctggcca

SEQ ID NO: 874381 - DNA, 20 bp, Homo sapiens
gccacaaggtggtgcttctg

SEQ ID NO: 874382 - DNA, 23 bp, Homo sapiens
gccacaaggtggtgcttctgcca

SEQ ID NO: 874383 - DNA, 17 bp, Homo sapiens
gccacacccagcggccc

SEQ ID NO: 874384 - DNA, 18 bp, Homo sapiens
gccacacccaggaaggga

SEQ ID NO: 874385 - DNA, 13 bp, Homo sapiens
gccacaccctccc

SEQ ID NO: 874386 - DNA, 16 bp, Homo sapiens
gccacaccctcccccg

SEQ ID NO: 874387 - DNA, 22 bp, Homo sapiens
gccacaccctcccccgccactc

SEQ ID NO: 874388 - DNA, 22 bp, Homo sapiens
gccacacctgagcgctgtggac

SEQ ID NO: 874389 - DNA, 14 bp, Homo sapiens
gccacacctggcct

SEQ ID NO: 874390 - DNA, 20 bp, Homo sapiens
gccacacctggccttaaaga

SEQ ID NO: 874391 - DNA, 16 bp, Homo sapiens
gccacacgcatgggca

SEQ ID NO: 874392 - DNA, 19 bp, Homo sapiens
gccacacgcatgggcattg

SEQ ID NO: 874393 - DNA, 18 bp, Homo sapiens
gccacactattaccatga

SEQ ID NO: 874394 - DNA, 15 bp, Homo sapiens
gccacactcagtccc

SEQ ID NO: 874395 - DNA, 13 bp, Homo sapiens
gccacactgatgg

SEQ ID NO: 874396 - DNA, 13 bp, Homo sapiens
gccacactgggcc

SEQ ID NO: 874397 - DNA, 14 bp, Homo sapiens
gccacactgggcct

SEQ ID NO: 874398 - DNA, 15 bp, Homo sapiens
gccacacttccttta

SEQ ID NO: 874399 - DNA, 20 bp, Homo sapiens
gccacagaaagctccttcca

SEQ ID NO: 874400 - DNA, 18 bp, Homo sapiens
gccacagaagccaggagc

SEQ ID NO: 874401 - DNA, 21 bp, Homo sapiens
gccacagagaagtttgtagcc

SEQ ID NO: 874402 - DNA, 16 bp, Homo sapiens
gccacagccagaggag

SEQ ID NO: 874403 - DNA, 18 bp, Homo sapiens
gccacagcccccttgccc

SEQ ID NO: 874404 - DNA, 18 bp, Homo sapiens
gccacagcctgctggcag

SEQ ID NO: 874405 - DNA, 20 bp, Homo sapiens
gccacagcctgctggcaggg

SEQ ID NO: 874406 - DNA, 21 bp, Homo sapiens
gccacagcctgctggcagggc

SEQ ID NO: 874407 - DNA, 22 bp, Homo sapiens
gccacagcctgctggcagggcc

SEQ ID NO: 874408 - DNA, 23 bp, Homo sapiens
gccacagcctgctggcagggcca

SEQ ID NO: 874409 - DNA, 15 bp, Homo sapiens
gccacagcgtgctgg

SEQ ID NO: 874410 - DNA, 17 bp, Homo sapiens
gccacagcgtgctggcg

SEQ ID NO: 874411 - DNA, 22 bp, Homo sapiens
gccacagcgtgctggcgacact

SEQ ID NO: 874412 - DNA, 15 bp, Homo sapiens
gccacagctgctgga

SEQ ID NO: 874413 - DNA, 19 bp, Homo sapiens
gccacagctgctgttctca

SEQ ID NO: 874414 - DNA, 22 bp, Homo sapiens
gccacagcttcttcatctttaa

SEQ ID NO: 874415 - DNA, 16 bp, Homo sapiens
gccacagcttttgcaa

SEQ ID NO: 874416 - DNA, 19 bp, Homo sapiens
gccacaggaacggccctgc

SEQ ID NO: 874417 - DNA, 21 bp, Homo sapiens
gccacaggaaggaggggagag

SEQ ID NO: 874418 - DNA, 16 bp, Homo sapiens
gccacaggactgagcc

SEQ ID NO: 874419 - DNA, 21 bp, Homo sapiens
gccacaggactgagccctctc

SEQ ID NO: 874420 - DNA, 13 bp, Homo sapiens
gccacaggagaca

SEQ ID NO: 874421 - DNA, 18 bp, Homo sapiens
gccacaggcaggtcacag

SEQ ID NO: 874422 - DNA, 19 bp, Homo sapiens
gccacaggcaggtcacaga

SEQ ID NO: 874423 - DNA, 12 bp, Homo sapiens
gccacaggctag

SEQ ID NO: 874424 - DNA, 15 bp, Homo sapiens
gccacagtagaactg

SEQ ID NO: 874425 - DNA, 16 bp, Homo sapiens
gccacagtcactggat

SEQ ID NO: 874426 - DNA, 17 bp, Homo sapiens
gccacgtatagtcctag

SEQ ID NO: 874427 - DNA, 20 bp, Homo sapiens
gccacgtcatgtctctaaac

SEQ ID NO: 874428 - DNA, 16 bp, Homo sapiens
gccacgtcccagcatc

SEQ ID NO: 874429 - DNA, 14 bp, Homo sapiens
gccacgtcccgctg

SEQ ID NO: 874430 - DNA, 18 bp, Homo sapiens
gccacgtcccgctgcctc

SEQ ID NO: 874431 - DNA, 20 bp, Homo sapiens
gccacgtcccgctgcctcct

SEQ ID NO: 874432 - DNA, 20 bp, Homo sapiens
gccacgtgtgctgtggccag

SEQ ID NO: 874433 - DNA, 21 bp, Homo sapiens
gccacgtgtgctgtggccagg

SEQ ID NO: 874434 - DNA, 15 bp, Homo sapiens
gccacgttccacagt

SEQ ID NO: 874435 - DNA, 16 bp, Homo sapiens
gccacgttccttactg

SEQ ID NO: 874436 - DNA, 22 bp, Homo sapiens
gccacgttccttactgcagaat

SEQ ID NO: 874437 - DNA, 15 bp, Homo sapiens
gccactaaagcttca

SEQ ID NO: 874438 - DNA, 17 bp, Homo sapiens
gccactaaagcttcaga

SEQ ID NO: 874439 - DNA, 20 bp, Homo sapiens
gccactaaagcttcagactc

SEQ ID NO: 874440 - DNA, 23 bp, Homo sapiens
gccactaaagcttcagactcaag

SEQ ID NO: 874441 - DNA, 19 bp, Homo sapiens
gccactaaccttgcctggt

SEQ ID NO: 874442 - DNA, 23 bp, Homo sapiens
gccactaaccttgcctggtacag

SEQ ID NO: 874443 - DNA, 15 bp, Homo sapiens
gccactaagcagagg

SEQ ID NO: 874444 - DNA, 18 bp, Homo sapiens
gccactaggtgtccccaa

SEQ ID NO: 874445 - DNA, 13 bp, Homo sapiens
gccactcaccctt

SEQ ID NO: 874446 - DNA, 18 bp, Homo sapiens
gccactcacccttcctgg

SEQ ID NO: 874447 - DNA, 23 bp, Homo sapiens
gccactcacccttcctggcccag

SEQ ID NO: 874448 - DNA, 18 bp, Homo sapiens
gccactcactaggccccc

SEQ ID NO: 874449 - DNA, 21 bp, Homo sapiens
gccactcagaggcccccagtg

SEQ ID NO: 874450 - DNA, 20 bp, Homo sapiens
gccactcagccatttccccc

SEQ ID NO: 874451 - DNA, 22 bp, Homo sapiens
gccactcagccatttccccctc

SEQ ID NO: 874452 - DNA, 16 bp, Homo sapiens
gccactcatttcatct

SEQ ID NO: 874453 - DNA, 13 bp, Homo sapiens
gccactccaagcc

SEQ ID NO: 874454 - DNA, 22 bp, Homo sapiens
gccactccaagccccctggcag

SEQ ID NO: 874455 - DNA, 22 bp, Homo sapiens
gccactccagacccctggcttt

SEQ ID NO: 874456 - DNA, 18 bp, Homo sapiens
gccactcccgggccaaga

SEQ ID NO: 874457 - DNA, 15 bp, Homo sapiens
gccactccctcccag

SEQ ID NO: 874458 - DNA, 15 bp, Homo sapiens
gccactccctgagct

SEQ ID NO: 874459 - DNA, 19 bp, Homo sapiens
gccactccctgagctttgg

SEQ ID NO: 874460 - DNA, 15 bp, Homo sapiens
gccactcctctgact

SEQ ID NO: 874461 - DNA, 21 bp, Homo sapiens
gccactcctctgactcagggc

SEQ ID NO: 874462 - DNA, 22 bp, Homo sapiens
gccactcgcagtcgcaggatcc

SEQ ID NO: 874463 - DNA, 23 bp, Homo sapiens
gccactctcccctccctcttcct

SEQ ID NO: 874464 - DNA, 13 bp, Homo sapiens
gccactcttccaa

SEQ ID NO: 874465 - DNA, 20 bp, Homo sapiens
gccactgaaaagctttcctg

SEQ ID NO: 874466 - DNA, 17 bp, Homo sapiens
gccactgcacctgacct

SEQ ID NO: 874467 - DNA, 15 bp, Homo sapiens
gccactgcactccgg

SEQ ID NO: 874468 - DNA, 19 bp, Homo sapiens
gccactgccaagcttcctg

SEQ ID NO: 874469 - DNA, 22 bp, Homo sapiens
gccactgccaagcttcctgtgc

SEQ ID NO: 874470 - DNA, 23 bp, Homo sapiens
gccactgccaggcacctggcctg

SEQ ID NO: 874471 - DNA, 23 bp, Homo sapiens
gccactgccccccgaggctgcta

SEQ ID NO: 874472 - DNA, 16 bp, Homo sapiens
gccactgcccgagctg

SEQ ID NO: 874473 - DNA, 16 bp, Homo sapiens
gccactgcctctccct

SEQ ID NO: 874474 - DNA, 17 bp, Homo sapiens
gccactgcctcttcctc

SEQ ID NO: 874475 - DNA, 23 bp, Homo sapiens
gccactgcctttcagaagtgatt

SEQ ID NO: 874476 - DNA, 18 bp, Homo sapiens
gccactgcgccactgcca

SEQ ID NO: 874477 - DNA, 18 bp, Homo sapiens
gccactgcgcccagcctg

SEQ ID NO: 874478 - DNA, 23 bp, Homo sapiens
gccactgctccctaagccagcct

SEQ ID NO: 874479 - DNA, 15 bp, Homo sapiens
gccactgctccgtgg

SEQ ID NO: 874480 - DNA, 20 bp, Homo sapiens
gccactggcatcgcagcttc

SEQ ID NO: 874481 - DNA, 12 bp, Homo sapiens
gccactgggcac

SEQ ID NO: 874482 - DNA, 16 bp, Homo sapiens
gccactgggcacctgc

SEQ ID NO: 874483 - DNA, 15 bp, Homo sapiens
gccactgggctctgg

SEQ ID NO: 874484 - DNA, 23 bp, Homo sapiens
gccactgggctctggacctcagg

SEQ ID NO: 874485 - DNA, 23 bp, Homo sapiens
gccactggggactttatttattt

SEQ ID NO: 874486 - DNA, 18 bp, Homo sapiens
gccactgggtctcactcc

SEQ ID NO: 874487 - DNA, 14 bp, Homo sapiens
gccactgtccctgt

SEQ ID NO: 874488 - DNA, 19 bp, Homo sapiens
gccactgtgctccagcctg

SEQ ID NO: 874489 - DNA, 12 bp, Homo sapiens
gccactgtgctt

SEQ ID NO: 874490 - DNA, 14 bp, Homo sapiens
gccactgtggccag

SEQ ID NO: 874491 - DNA, 12 bp, Homo sapiens
gccactgtgtct

SEQ ID NO: 874492 - DNA, 21 bp, Homo sapiens
gccactgtgtctctgtttcct

SEQ ID NO: 874493 - DNA, 12 bp, Homo sapiens
gccactgtgtgc

SEQ ID NO: 874494 - DNA, 14 bp, Homo sapiens
gccactgtgtgcct

SEQ ID NO: 874495 - DNA, 16 bp, Homo sapiens
gccactgttgttttgg

SEQ ID NO: 874496 - DNA, 18 bp, Homo sapiens
gccacttaatgtatgtta

SEQ ID NO: 874497 - DNA, 19 bp, Homo sapiens
gccacttcattccagcagc

SEQ ID NO: 874498 - DNA, 13 bp, Homo sapiens
gccacttctcccc

SEQ ID NO: 874499 - DNA, 22 bp, Homo sapiens
gccacttctgcgggctccctcc

SEQ ID NO: 874500 - DNA, 23 bp, Homo sapiens
gccacttctgcgggctccctcct

SEQ ID NO: 874501 - DNA, 15 bp, Homo sapiens
gccacttctggcttc

SEQ ID NO: 874502 - DNA, 20 bp, Homo sapiens
gccacttctggcttcagccc

SEQ ID NO: 874503 - DNA, 20 bp, Homo sapiens
gccacttcttaaaggcctgg

SEQ ID NO: 874504 - DNA, 21 bp, Homo sapiens
gccacttcttaaaggcctgga

SEQ ID NO: 874505 - DNA, 21 bp, Homo sapiens
gccacttgatgacccccaacc

SEQ ID NO: 874506 - DNA, 13 bp, Homo sapiens
gccacttggagtg

SEQ ID NO: 874507 - DNA, 19 bp, Homo sapiens
gccacttggcccagaaagc

SEQ ID NO: 874508 - DNA, 22 bp, Homo sapiens
gccactttacccacctagaaca

SEQ ID NO: 874509 - DNA, 19 bp, Homo sapiens
gccactttcagagccccca

SEQ ID NO: 874510 - DNA, 14 bp, Homo sapiens
gccactttgcacga

SEQ ID NO: 874511 - DNA, 15 bp, Homo sapiens
gccactttggcttct

SEQ ID NO: 874512 - DNA, 16 bp, Homo sapiens
gccactttggcttctc

SEQ ID NO: 874513 - DNA, 20 bp, Homo sapiens
gccactttggcttctcctgt

SEQ ID NO: 874514 - DNA, 20 bp, Homo sapiens
gccacttttgaagtcttccc

SEQ ID NO: 874515 - DNA, 10 bp, Homo sapiens
gccagaaaaa

SEQ ID NO: 874516 - DNA, 21 bp, Homo sapiens
gccagaaaaaaaaaataaaac

SEQ ID NO: 874517 - DNA, 12 bp, Homo sapiens
gccagaaataaa

SEQ ID NO: 874518 - DNA, 16 bp, Homo sapiens
gccagaaatgggcagt

SEQ ID NO: 874519 - DNA, 20 bp, Homo sapiens
gccagaacgtggctctgctg

SEQ ID NO: 874520 - DNA, 19 bp, Homo sapiens
gccagaaggaatcttctca

SEQ ID NO: 874521 - DNA, 21 bp, Homo sapiens
gccagaaggagggcagagcca

SEQ ID NO: 874522 - DNA, 18 bp, Homo sapiens
gccagaagggggccatga

SEQ ID NO: 874523 - DNA, 23 bp, Homo sapiens
gccagaatactgggttcttagtt

SEQ ID NO: 874524 - DNA, 21 bp, Homo sapiens
gccagacaaataggagtgagt

SEQ ID NO: 874525 - DNA, 13 bp, Homo sapiens
gccagacactctg

SEQ ID NO: 874526 - DNA, 19 bp, Homo sapiens
gccagacactctgctctgc

SEQ ID NO: 874527 - DNA, 20 bp, Homo sapiens
gccagacactgcgccccgcc

SEQ ID NO: 874528 - DNA, 17 bp, Homo sapiens
gccagaccatggacact

SEQ ID NO: 874529 - DNA, 18 bp, Homo sapiens
gccagaccccgtggctct

SEQ ID NO: 874530 - DNA, 19 bp, Homo sapiens
gccagaccccgtggctctg

SEQ ID NO: 874531 - DNA, 22 bp, Homo sapiens
gccagccctccctgtcctcctc

SEQ ID NO: 874532 - DNA, 11 bp, Homo sapiens
gccagccctgg

SEQ ID NO: 874533 - DNA, 15 bp, Homo sapiens
gccagccctggccca

SEQ ID NO: 874534 - DNA, 17 bp, Homo sapiens
gccagccctggcccacc

SEQ ID NO: 874535 - DNA, 21 bp, Homo sapiens
gccagcccttccctggccccg

SEQ ID NO: 874536 - DNA, 15 bp, Homo sapiens
gccagccgaccctcc

SEQ ID NO: 874537 - DNA, 20 bp, Homo sapiens
gccagccgaccctcctggcc

SEQ ID NO: 874538 - DNA, 17 bp, Homo sapiens
gccagccgccctgggct

SEQ ID NO: 874539 - DNA, 15 bp, Homo sapiens
gccagccggtgcctg

SEQ ID NO: 874540 - DNA, 17 bp, Homo sapiens
gccagccggtgcctggc

SEQ ID NO: 874541 - DNA, 18 bp, Homo sapiens
gccagccgtgatgctcag

SEQ ID NO: 874542 - DNA, 13 bp, Homo sapiens
gccagcctcagaa

SEQ ID NO: 874543 - DNA, 16 bp, Homo sapiens
gccagcctcagtgcca

SEQ ID NO: 874544 - DNA, 23 bp, Homo sapiens
gccagcctcagtgccacttgaca

SEQ ID NO: 874545 - DNA, 20 bp, Homo sapiens
gccagcctccgagagggaga

SEQ ID NO: 874546 - DNA, 17 bp, Homo sapiens
gccagcctcctctggac

SEQ ID NO: 874547 - DNA, 13 bp, Homo sapiens
gccagcctccttg

SEQ ID NO: 874548 - DNA, 14 bp, Homo sapiens
gccagcctccttgc

SEQ ID NO: 874549 - DNA, 13 bp, Homo sapiens
gccagcctgagcg

SEQ ID NO: 874550 - DNA, 15 bp, Homo sapiens
gccagcctggctctg

SEQ ID NO: 874551 - DNA, 19 bp, Homo sapiens
gccagcctggcttctggag

SEQ ID NO: 874552 - DNA, 20 bp, Homo sapiens
gccagcctggcttctggagc

SEQ ID NO: 874553 - DNA, 12 bp, Homo sapiens
gccagcctggga

SEQ ID NO: 874554 - DNA, 13 bp, Homo sapiens
gccagcctgggac

SEQ ID NO: 874555 - DNA, 12 bp, Homo sapiens
gccagccttccc

SEQ ID NO: 874556 - DNA, 17 bp, Homo sapiens
gccagccttcctctgca

SEQ ID NO: 874557 - DNA, 17 bp, Homo sapiens
gccagccttgagccctg

SEQ ID NO: 874558 - DNA, 19 bp, Homo sapiens
gccagccttgagccctggc

SEQ ID NO: 874559 - DNA, 20 bp, Homo sapiens
gccagccttgagccctggct

SEQ ID NO: 874560 - DNA, 22 bp, Homo sapiens
gccagccttgagccctggctgt

SEQ ID NO: 874561 - DNA, 21 bp, Homo sapiens
gccagcgacctctctgcctct

SEQ ID NO: 874562 - DNA, 14 bp, Homo sapiens
gccagcgccagggc

SEQ ID NO: 874563 - DNA, 22 bp, Homo sapiens
gccagcgccagggcccaggcca

SEQ ID NO: 874564 - DNA, 17 bp, Homo sapiens
gccagcgcctccctcca

SEQ ID NO: 874565 - DNA, 21 bp, Homo sapiens
gccagcgcctccctccacccc

SEQ ID NO: 874566 - DNA, 14 bp, Homo sapiens
gccagcggggctgc

SEQ ID NO: 874567 - DNA, 17 bp, Homo sapiens
gccagcggggctgctca

SEQ ID NO: 874568 - DNA, 14 bp, Homo sapiens
gccagcggtgacca

SEQ ID NO: 874569 - DNA, 15 bp, Homo sapiens
gccagcggtgaccag

SEQ ID NO: 874570 - DNA, 21 bp, Homo sapiens
gccagcggtgaccagcctgtc

SEQ ID NO: 874571 - DNA, 22 bp, Homo sapiens
gccagcggtgaccagcctgtca

SEQ ID NO: 874572 - DNA, 19 bp, Homo sapiens
gccagcgtcctcctctgtg

SEQ ID NO: 874573 - DNA, 17 bp, Homo sapiens
gccagcgtgtggagcag

SEQ ID NO: 874574 - DNA, 21 bp, Homo sapiens
gccagctccagtgccgctcct

SEQ ID NO: 874575 - DNA, 22 bp, Homo sapiens
gccagctccagtgccgctcctg

SEQ ID NO: 874576 - DNA, 13 bp, Homo sapiens
gccagctccctct

SEQ ID NO: 874577 - DNA, 14 bp, Homo sapiens
gccagctcctctct

SEQ ID NO: 874578 - DNA, 10 bp, Homo sapiens
gccagctctc

SEQ ID NO: 874579 - DNA, 12 bp, Homo sapiens
gccagctctgag

SEQ ID NO: 874580 - DNA, 20 bp, Homo sapiens
gccagctctgaggggaggca

SEQ ID NO: 874581 - DNA, 13 bp, Homo sapiens
gccagctctgtat

SEQ ID NO: 874582 - DNA, 12 bp, Homo sapiens
gccagctgcagg

SEQ ID NO: 874583 - DNA, 14 bp, Homo sapiens
gccagctgcagggc

SEQ ID NO: 874584 - DNA, 17 bp, Homo sapiens
gccagctgcagggcacg

SEQ ID NO: 874585 - DNA, 21 bp, Homo sapiens
gccagctgccctatgggcctg

SEQ ID NO: 874586 - DNA, 13 bp, Homo sapiens
gccagctgctttt

SEQ ID NO: 874587 - DNA, 16 bp, Homo sapiens
gccagctggcctttgt

SEQ ID NO: 874588 - DNA, 11 bp, Homo sapiens
gccagctgggg

SEQ ID NO: 874589 - DNA, 16 bp, Homo sapiens
gccagctggggagatg

SEQ ID NO: 874590 - DNA, 21 bp, Homo sapiens
gccagctggggagatgggggc

SEQ ID NO: 874591 - DNA, 14 bp, Homo sapiens
gccagctgtgcact

SEQ ID NO: 874592 - DNA, 20 bp, Homo sapiens
gccagcttcgtgctggagga

SEQ ID NO: 874593 - DNA, 13 bp, Homo sapiens
gccagcttctctc

SEQ ID NO: 874594 - DNA, 19 bp, Homo sapiens
gccagcttctctctccagg

SEQ ID NO: 874595 - DNA, 11 bp, Homo sapiens
gccagcttggc

SEQ ID NO: 874596 - DNA, 14 bp, Homo sapiens
gccagcttttcaaa

SEQ ID NO: 874597 - DNA, 18 bp, Homo sapiens
gccaggaaacaagggaag

SEQ ID NO: 874598 - DNA, 22 bp, Homo sapiens
gccaggaacctgtcctaaggaa

SEQ ID NO: 874599 - DNA, 18 bp, Homo sapiens
gccaggacagcagcactc

SEQ ID NO: 874600 - DNA, 23 bp, Homo sapiens
gccaggacagcagcactcccgct

SEQ ID NO: 874601 - DNA, 22 bp, Homo sapiens
gccaggaccagtcaacctgggc

SEQ ID NO: 874602 - DNA, 14 bp, Homo sapiens
gccaggaccccagg

SEQ ID NO: 874603 - DNA, 17 bp, Homo sapiens
gccaggaccccaggtca

SEQ ID NO: 874604 - DNA, 24 bp, Homo sapiens
gccaggaccccaggtcaggggctc

SEQ ID NO: 874605 - DNA, 17 bp, Homo sapiens
gccaggacccgccagcc

SEQ ID NO: 874606 - DNA, 17 bp, Homo sapiens
gccaggactccccaggc

SEQ ID NO: 874607 - DNA, 11 bp, Homo sapiens
gccaggactgt

SEQ ID NO: 874608 - DNA, 12 bp, Homo sapiens
gccaggagaagc

SEQ ID NO: 874609 - DNA, 13 bp, Homo sapiens
gccaggagcagat

SEQ ID NO: 874610 - DNA, 22 bp, Homo sapiens
gccaggagctcttcaggcctcc

SEQ ID NO: 874611 - DNA, 17 bp, Homo sapiens
gccaggaggcggcagct

SEQ ID NO: 874612 - DNA, 20 bp, Homo sapiens
gccaggaggcggcagctctt

SEQ ID NO: 874613 - DNA, 23 bp, Homo sapiens
gccaggaggttggtgactgaaac

SEQ ID NO: 874614 - DNA, 17 bp, Homo sapiens
gccaggagtctgtgctc

SEQ ID NO: 874615 - DNA, 19 bp, Homo sapiens
gccaggagtttgagaccag

SEQ ID NO: 874616 - DNA, 20 bp, Homo sapiens
gccaggatccccctctttgc

SEQ ID NO: 874617 - DNA, 17 bp, Homo sapiens
gccaggcacacacagcc

SEQ ID NO: 874618 - DNA, 13 bp, Homo sapiens
gccaggcacctgg

SEQ ID NO: 874619 - DNA, 14 bp, Homo sapiens
gccaggcacctggc

SEQ ID NO: 874620 - DNA, 16 bp, Homo sapiens
gccaggcacctggcct

SEQ ID NO: 874621 - DNA, 18 bp, Homo sapiens
gccaggcacctggcctgc

SEQ ID NO: 874622 - DNA, 22 bp, Homo sapiens
gccaggcactctcatcacccca

SEQ ID NO: 874623 - DNA, 16 bp, Homo sapiens
gccaggcactgccctt

SEQ ID NO: 874624 - DNA, 22 bp, Homo sapiens
gccaggcactgcccttttcagg

SEQ ID NO: 874625 - DNA, 19 bp, Homo sapiens
gccaggcactgccttctcc

SEQ ID NO: 874626 - DNA, 11 bp, Homo sapiens
gccaggcagaa

SEQ ID NO: 874627 - DNA, 19 bp, Homo sapiens
gccaggcagaatggctgca

SEQ ID NO: 874628 - DNA, 22 bp, Homo sapiens
gccaggcagaatggctgcacgt

SEQ ID NO: 874629 - DNA, 22 bp, Homo sapiens
gccaggcagagctgagggccct

SEQ ID NO: 874630 - DNA, 23 bp, Homo sapiens
gccaggcagagctgagggccctg

SEQ ID NO: 874631 - DNA, 14 bp, Homo sapiens
gccaggcaggggtg

SEQ ID NO: 874632 - DNA, 22 bp, Homo sapiens
gccaggcaggggtgggagagcc

SEQ ID NO: 874633 - DNA, 17 bp, Homo sapiens
gccaggcaggtccacag

SEQ ID NO: 874634 - DNA, 16 bp, Homo sapiens
gccaggccaccaggat

SEQ ID NO: 874635 - DNA, 19 bp, Homo sapiens
gccaggccaccaggatggc

SEQ ID NO: 874636 - DNA, 17 bp, Homo sapiens
gccaggcccaggccagc

SEQ ID NO: 874637 - DNA, 22 bp, Homo sapiens
gccaggcccatctcaggtgcca

SEQ ID NO: 874638 - DNA, 16 bp, Homo sapiens
gccaggcccggggctg

SEQ ID NO: 874639 - DNA, 21 bp, Homo sapiens
gccaggcctctctcacctctc

SEQ ID NO: 874640 - DNA, 17 bp, Homo sapiens
gccaggcctcttggcag

SEQ ID NO: 874641 - DNA, 13 bp, Homo sapiens
gccaggcctggct

SEQ ID NO: 874642 - DNA, 21 bp, Homo sapiens
gccaggcctgggtctgtgtct

SEQ ID NO: 874643 - DNA, 15 bp, Homo sapiens
gccaggcgagcctga

SEQ ID NO: 874644 - DNA, 17 bp, Homo sapiens
gccaggcgcatgtctgc

SEQ ID NO: 874645 - DNA, 18 bp, Homo sapiens
gccaggcgcatgtctgca

SEQ ID NO: 874646 - DNA, 23 bp, Homo sapiens
gccaggcggacaaagttcagtgt

SEQ ID NO: 874647 - DNA, 14 bp, Homo sapiens
gccaggcggccctg

SEQ ID NO: 874648 - DNA, 15 bp, Homo sapiens
gccaggcgttggtgc

SEQ ID NO: 874649 - DNA, 15 bp, Homo sapiens
gccaggctaattttt

SEQ ID NO: 874650 - DNA, 20 bp, Homo sapiens
gccaggctatggttgccacc

SEQ ID NO: 874651 - DNA, 20 bp, Homo sapiens
gccaggctccctttctcttc

SEQ ID NO: 874652 - DNA, 15 bp, Homo sapiens
gccaggctgtaagca

SEQ ID NO: 874653 - DNA, 21 bp, Homo sapiens
gccaggctgtaagcattctga

SEQ ID NO: 874654 - DNA, 14 bp, Homo sapiens
gccaggcttgcctg

SEQ ID NO: 874655 - DNA, 16 bp, Homo sapiens
gccaggcttgcctggg

SEQ ID NO: 874656 - DNA, 17 bp, Homo sapiens
gccagggacccaaagca

SEQ ID NO: 874657 - DNA, 11 bp, Homo sapiens
gccagggagct

SEQ ID NO: 874658 - DNA, 19 bp, Homo sapiens
gccagggagcttgccacac

SEQ ID NO: 874659 - DNA, 21 bp, Homo sapiens
gccagggagcttgccacactc

SEQ ID NO: 874660 - DNA, 11 bp, Homo sapiens
gccagggaggc

SEQ ID NO: 874661 - DNA, 20 bp, Homo sapiens
gccagggaggcagagcggga

SEQ ID NO: 874662 - DNA, 23 bp, Homo sapiens
gccagggaggcagagcgggaggg

SEQ ID NO: 874663 - DNA, 15 bp, Homo sapiens
gccagggaggcgcag

SEQ ID NO: 874664 - DNA, 17 bp, Homo sapiens
gccagggaggcgcaggg

SEQ ID NO: 874665 - DNA, 19 bp, Homo sapiens
gccagggaggcgcagggac

SEQ ID NO: 874666 - DNA, 13 bp, Homo sapiens
gccagggcaatgc

SEQ ID NO: 874667 - DNA, 22 bp, Homo sapiens
gccagggcaatgccatcagccc

SEQ ID NO: 874668 - DNA, 18 bp, Homo sapiens
gccagggcagaggaatgt

SEQ ID NO: 874669 - DNA, 15 bp, Homo sapiens
gccagggcagagtga

SEQ ID NO: 874670 - DNA, 21 bp, Homo sapiens
gccagggcagagtgagaccca

SEQ ID NO: 874671 - DNA, 15 bp, Homo sapiens
gccagggcagatgtg

SEQ ID NO: 874672 - DNA, 11 bp, Homo sapiens
gccagggcagc

SEQ ID NO: 874673 - DNA, 21 bp, Homo sapiens
gccagggcagggtctgggctg

SEQ ID NO: 874674 - DNA, 22 bp, Homo sapiens
gccagggccacgctccagctgc

SEQ ID NO: 874675 - DNA, 10 bp, Homo sapiens
gccagggccc

SEQ ID NO: 874676 - DNA, 14 bp, Homo sapiens
gccagggcccagag

SEQ ID NO: 874677 - DNA, 18 bp, Homo sapiens
gccagggcccagagccct

SEQ ID NO: 874678 - DNA, 23 bp, Homo sapiens
gccagggcccagagcccttgact

SEQ ID NO: 874679 - DNA, 19 bp, Homo sapiens
gccagggcccaggccatgt

SEQ ID NO: 874680 - DNA, 22 bp, Homo sapiens
gccagggcccctcaccctgcct

SEQ ID NO: 874681 - DNA, 17 bp, Homo sapiens
gccagggccctgcagag

SEQ ID NO: 874682 - DNA, 17 bp, Homo sapiens
gccagggcctctccaac

SEQ ID NO: 874683 - DNA, 10 bp, Homo sapiens
gccagggctg

SEQ ID NO: 874684 - DNA, 14 bp, Homo sapiens
gccagggctgcccc

SEQ ID NO: 874685 - DNA, 15 bp, Homo sapiens
gccagggctgcccct

SEQ ID NO: 874686 - DNA, 19 bp, Homo sapiens
gccagggctgccctgagaa

SEQ ID NO: 874687 - DNA, 11 bp, Homo sapiens
gccagggctgg

SEQ ID NO: 874688 - DNA, 15 bp, Homo sapiens
gccagggctggagaa

SEQ ID NO: 874689 - DNA, 19 bp, Homo sapiens
gccagggctggggacagag

SEQ ID NO: 874690 - DNA, 15 bp, Homo sapiens
gccagggctgtcctt

SEQ ID NO: 874691 - DNA, 12 bp, Homo sapiens
gccagggcttcc

SEQ ID NO: 874692 - DNA, 13 bp, Homo sapiens
gccaggggcgagg

SEQ ID NO: 874693 - DNA, 21 bp, Homo sapiens
gccaggggtctccctggagtg

SEQ ID NO: 874694 - DNA, 18 bp, Homo sapiens
gccaggggtgggagcatc

SEQ ID NO: 874695 - DNA, 18 bp, Homo sapiens
gccagggtctgtgtgaat

SEQ ID NO: 874696 - DNA, 20 bp, Homo sapiens
gccagggtctgtgtgaatgt

SEQ ID NO: 874697 - DNA, 21 bp, Homo sapiens
gccagggtctgtgtgaatgtg

SEQ ID NO: 874698 - DNA, 15 bp, Homo sapiens
gccagggtgagagct

SEQ ID NO: 874699 - DNA, 23 bp, Homo sapiens
gccagggtgagagctgctctgga

SEQ ID NO: 874700 - DNA, 16 bp, Homo sapiens
gccagggtgagcaggg

SEQ ID NO: 874701 - DNA, 15 bp, Homo sapiens
gccagggtgggctgg

SEQ ID NO: 874702 - DNA, 19 bp, Homo sapiens
gccagggtgggctggggac

SEQ ID NO: 874703 - DNA, 22 bp, Homo sapiens
gccagggtgtgactcgggagct

SEQ ID NO: 874704 - DNA, 20 bp, Homo sapiens
gccagggtgtggccctgcca

SEQ ID NO: 874705 - DNA, 23 bp, Homo sapiens
gccagggtgtggccctgccatct

SEQ ID NO: 874706 - DNA, 16 bp, Homo sapiens
gccaggtaatgaggga

SEQ ID NO: 874707 - DNA, 22 bp, Homo sapiens
gccaggtacaggagaggcagca

SEQ ID NO: 874708 - DNA, 14 bp, Homo sapiens
gccaggtactgcat

SEQ ID NO: 874709 - DNA, 16 bp, Homo sapiens
gccaggtatggctctg

SEQ ID NO: 874710 - DNA, 21 bp, Homo sapiens
gccaggtcaccctttgctgtg

SEQ ID NO: 874711 - DNA, 20 bp, Homo sapiens
gccaggtgaggtccaccggc

SEQ ID NO: 874712 - DNA, 23 bp, Homo sapiens
gccaggtgaggtccaccggcccc

SEQ ID NO: 874713 - DNA, 14 bp, Homo sapiens
gccaggtgcagacc

SEQ ID NO: 874714 - DNA, 14 bp, Homo sapiens
gccaggtgcagtgg

SEQ ID NO: 874715 - DNA, 21 bp, Homo sapiens
gccaggtgggcggacaaaagg

SEQ ID NO: 874716 - DNA, 22 bp, Homo sapiens
gccaggtttctgcccacattgg

SEQ ID NO: 874717 - DNA, 21 bp, Homo sapiens
gccagtaaaaaaaaaaaatgg

SEQ ID NO: 874718 - DNA, 12 bp, Homo sapiens
gccagtaaatgg

SEQ ID NO: 874719 - DNA, 19 bp, Homo sapiens
gccagtaacgcgtcttcct

SEQ ID NO: 874720 - DNA, 23 bp, Homo sapiens
gccagtatctatatatgtgtatg

SEQ ID NO: 874721 - DNA, 15 bp, Homo sapiens
gccagtattttaaaa

SEQ ID NO: 874722 - DNA, 17 bp, Homo sapiens
gccagtattttaaaata

SEQ ID NO: 874723 - DNA, 14 bp, Homo sapiens
gccagtccaggctg

SEQ ID NO: 874724 - DNA, 11 bp, Homo sapiens
gccagtcccag

SEQ ID NO: 874725 - DNA, 16 bp, Homo sapiens
gccagtcccaggggca

SEQ ID NO: 874726 - DNA, 16 bp, Homo sapiens
gccagtccccatttct

SEQ ID NO: 874727 - DNA, 17 bp, Homo sapiens
gccagtcctcctgggag

SEQ ID NO: 874728 - DNA, 19 bp, Homo sapiens
gccagtcctcctgggagcc

SEQ ID NO: 874729 - DNA, 16 bp, Homo sapiens
gccagtcctgcctggc

SEQ ID NO: 874730 - DNA, 19 bp, Homo sapiens
gccagtcctgcctggccag

SEQ ID NO: 874731 - DNA, 15 bp, Homo sapiens
gccagtcctgctacc

SEQ ID NO: 874732 - DNA, 22 bp, Homo sapiens
gccagtcctgctacctcccttg

SEQ ID NO: 874733 - DNA, 18 bp, Homo sapiens
gccagtcctggtcctggc

SEQ ID NO: 874734 - DNA, 20 bp, Homo sapiens
gccagtcctggtcctggctg

SEQ ID NO: 874735 - DNA, 21 bp, Homo sapiens
gccagtctcagagaccagcac

SEQ ID NO: 874736 - DNA, 22 bp, Homo sapiens
gccagtctcagagaccagcact

SEQ ID NO: 874737 - DNA, 23 bp, Homo sapiens
gccagtctcagagaccagcactc

SEQ ID NO: 874738 - DNA, 13 bp, Homo sapiens
gccagtctcccag

SEQ ID NO: 874739 - DNA, 16 bp, Homo sapiens
gccagtctgggctgcc

SEQ ID NO: 874740 - DNA, 12 bp, Homo sapiens
gccagtctgtgg

SEQ ID NO: 874741 - DNA, 17 bp, Homo sapiens
gccagtcttgcctaggc

SEQ ID NO: 874742 - DNA, 23 bp, Homo sapiens
gccagtcttgcctaggccaaatg

SEQ ID NO: 874743 - DNA, 16 bp, Homo sapiens
gccagtgaagtccttc

SEQ ID NO: 874744 - DNA, 18 bp, Homo sapiens
gccagtgaagtccttcag

SEQ ID NO: 874745 - DNA, 21 bp, Homo sapiens
gccagtgaagtccttcagtga

SEQ ID NO: 874746 - DNA, 14 bp, Homo sapiens
gccagtgaatctgt

SEQ ID NO: 874747 - DNA, 14 bp, Homo sapiens
gccagtgacagaca

SEQ ID NO: 874748 - DNA, 23 bp, Homo sapiens
gccagtgacctttgacctcggtg

SEQ ID NO: 874749 - DNA, 16 bp, Homo sapiens
gccagtgagaagctga

SEQ ID NO: 874750 - DNA, 15 bp, Homo sapiens
gccagtgagggcagt

SEQ ID NO: 874751 - DNA, 20 bp, Homo sapiens
gccagtgagggctgggccca

SEQ ID NO: 874752 - DNA, 13 bp, Homo sapiens
gccagtgatgatg

SEQ ID NO: 874753 - DNA, 15 bp, Homo sapiens
gccagtgatgatgtt

SEQ ID NO: 874754 - DNA, 17 bp, Homo sapiens
gccagtgatgatgtttt

SEQ ID NO: 874755 - DNA, 13 bp, Homo sapiens
gccagtgcagcca

SEQ ID NO: 874756 - DNA, 18 bp, Homo sapiens
gccagtgcagccactggc

SEQ ID NO: 874757 - DNA, 14 bp, Homo sapiens
gccagtgccagggt

SEQ ID NO: 874758 - DNA, 23 bp, Homo sapiens
gccagtgccagggtgggctgggg

SEQ ID NO: 874759 - DNA, 15 bp, Homo sapiens
gccagtgccttacct

SEQ ID NO: 874760 - DNA, 23 bp, Homo sapiens
gccagtgccttacctcctgccca

SEQ ID NO: 874761 - DNA, 16 bp, Homo sapiens
gccagtgctccaggca

SEQ ID NO: 874762 - DNA, 14 bp, Homo sapiens
gccagtgctgcttc

SEQ ID NO: 874763 - DNA, 16 bp, Homo sapiens
gccagtgctgcttctt

SEQ ID NO: 874764 - DNA, 16 bp, Homo sapiens
gccagtggaagaaaca

SEQ ID NO: 874765 - DNA, 18 bp, Homo sapiens
gccagtggagctggtctg

SEQ ID NO: 874766 - DNA, 21 bp, Homo sapiens
gccagtggcccccgggcctgc

SEQ ID NO: 874767 - DNA, 22 bp, Homo sapiens
gccagtggcccccgggcctgca

SEQ ID NO: 874768 - DNA, 21 bp, Homo sapiens
gccagtggccttccccagcat

SEQ ID NO: 874769 - DNA, 13 bp, Homo sapiens
gccagtgggcctg

SEQ ID NO: 874770 - DNA, 15 bp, Homo sapiens
gccagtggggcctgt

SEQ ID NO: 874771 - DNA, 17 bp, Homo sapiens
gccagtggggcctgtgg

SEQ ID NO: 874772 - DNA, 18 bp, Homo sapiens
gccagtggggcctgtgga

SEQ ID NO: 874773 - DNA, 21 bp, Homo sapiens
gccagtggggcctgtggaatg

SEQ ID NO: 874774 - DNA, 20 bp, Homo sapiens
gccagtggtgatgtaaaaat

SEQ ID NO: 874775 - DNA, 22 bp, Homo sapiens
gccagttcaaagtgtatattta

SEQ ID NO: 874776 - DNA, 21 bp, Homo sapiens
gccctgctggggatccccgcc

SEQ ID NO: 874777 - DNA, 18 bp, Homo sapiens
gccctgctttgggctgcc

SEQ ID NO: 874778 - DNA, 19 bp, Homo sapiens
gccctgctttgggctgccc

SEQ ID NO: 874779 - DNA, 21 bp, Homo sapiens
gccctgctttgggctgccctg

SEQ ID NO: 874780 - DNA, 12 bp, Homo sapiens
gccctgcttttt

SEQ ID NO: 874781 - DNA, 18 bp, Homo sapiens
gccctggacacccctgct

SEQ ID NO: 874782 - DNA, 18 bp, Homo sapiens
gccctggacagatggccc

SEQ ID NO: 874783 - DNA, 18 bp, Homo sapiens
gccctggaccttgggcct

SEQ ID NO: 874784 - DNA, 13 bp, Homo sapiens
gccctggagccag

SEQ ID NO: 874785 - DNA, 17 bp, Homo sapiens
gccctggagccagggca

SEQ ID NO: 874786 - DNA, 23 bp, Homo sapiens
gccctggagccagggcagaggaa

SEQ ID NO: 874787 - DNA, 15 bp, Homo sapiens
gccctggaggtggct

SEQ ID NO: 874788 - DNA, 18 bp, Homo sapiens
gccctggatttcagaaag

SEQ ID NO: 874789 - DNA, 19 bp, Homo sapiens
gccctggcagcagcaggtg

SEQ ID NO: 874790 - DNA, 19 bp, Homo sapiens
gccctggcaggatgaccct

SEQ ID NO: 874791 - DNA, 14 bp, Homo sapiens
gccctggccaggac

SEQ ID NO: 874792 - DNA, 15 bp, Homo sapiens
gccctggcccacccc

SEQ ID NO: 874793 - DNA, 22 bp, Homo sapiens
gccctggcccaccccccagcct

SEQ ID NO: 874794 - DNA, 15 bp, Homo sapiens
gccctggcccctgtg

SEQ ID NO: 874795 - DNA, 16 bp, Homo sapiens
gccctggcccctgtgg

SEQ ID NO: 874796 - DNA, 12 bp, Homo sapiens
gccctggccctg

SEQ ID NO: 874797 - DNA, 13 bp, Homo sapiens
gccctggccctga

SEQ ID NO: 874798 - DNA, 12 bp, Homo sapiens
gccctggcctcc

SEQ ID NO: 874799 - DNA, 19 bp, Homo sapiens
gccctggcctcccctgcca

SEQ ID NO: 874800 - DNA, 13 bp, Homo sapiens
gccctggcctgct

SEQ ID NO: 874801 - DNA, 16 bp, Homo sapiens
gccctggcctgctggg

SEQ ID NO: 874802 - DNA, 19 bp, Homo sapiens
gccctggctccagtgaaac

SEQ ID NO: 874803 - DNA, 16 bp, Homo sapiens
gccctggctccttgca

SEQ ID NO: 874804 - DNA, 17 bp, Homo sapiens
gccctggctctgcccct

SEQ ID NO: 874805 - DNA, 18 bp, Homo sapiens
gccctggctctgcccctc

SEQ ID NO: 874806 - DNA, 20 bp, Homo sapiens
gccctggctctgcccctcag

SEQ ID NO: 874807 - DNA, 22 bp, Homo sapiens
gccctggctctgcccctcaggg

SEQ ID NO: 874808 - DNA, 23 bp, Homo sapiens
gccctggctctgcccctcagggg

SEQ ID NO: 874809 - DNA, 10 bp, Homo sapiens
gccctggctg

SEQ ID NO: 874810 - DNA, 15 bp, Homo sapiens
gccctggctgctgcc

SEQ ID NO: 874811 - DNA, 16 bp, Homo sapiens
gccctggctgctgccc

SEQ ID NO: 874812 - DNA, 17 bp, Homo sapiens
gccctggctgctgcccc

SEQ ID NO: 874813 - DNA, 15 bp, Homo sapiens
gccctgggaaccact

SEQ ID NO: 874814 - DNA, 22 bp, Homo sapiens
gccctgggaaccactcccacca

SEQ ID NO: 874815 - DNA, 23 bp, Homo sapiens
gccctgggagaatcgctcctgca

SEQ ID NO: 874816 - DNA, 17 bp, Homo sapiens
gccctgggatcactgtg

SEQ ID NO: 874817 - DNA, 18 bp, Homo sapiens
gccctgggatgcctcacc

SEQ ID NO: 874818 - DNA, 18 bp, Homo sapiens
gccctgggcacccacctc

SEQ ID NO: 874819 - DNA, 19 bp, Homo sapiens
gccctgggcacccacctcc

SEQ ID NO: 874820 - DNA, 15 bp, Homo sapiens
gccctgggccaggca

SEQ ID NO: 874821 - DNA, 16 bp, Homo sapiens
gccctgggccaggcag

SEQ ID NO: 874822 - DNA, 15 bp, Homo sapiens
gccctgggcctcagt

SEQ ID NO: 874823 - DNA, 23 bp, Homo sapiens
gccctgggcctcagttcaacctg

SEQ ID NO: 874824 - DNA, 15 bp, Homo sapiens
gccctgggctgatgg

SEQ ID NO: 874825 - DNA, 18 bp, Homo sapiens
gccctgggctggaatcag

SEQ ID NO: 874826 - DNA, 15 bp, Homo sapiens
gccctgggcttggct

SEQ ID NO: 874827 - DNA, 18 bp, Homo sapiens
gccctgggcttggctctt

SEQ ID NO: 874828 - DNA, 15 bp, Homo sapiens
gccctggggcgggca

SEQ ID NO: 874829 - DNA, 22 bp, Homo sapiens
gccctgggggattcctgagctg

SEQ ID NO: 874830 - DNA, 17 bp, Homo sapiens
gccctgggggtctgggc

SEQ ID NO: 874831 - DNA, 22 bp, Homo sapiens
gccctgggggtctgggcgtcca

SEQ ID NO: 874832 - DNA, 17 bp, Homo sapiens
gccctggggtgtgtctc

SEQ ID NO: 874833 - DNA, 16 bp, Homo sapiens
gccctggtccagggaa

SEQ ID NO: 874834 - DNA, 23 bp, Homo sapiens
gccctggtccagggaagctggcc

SEQ ID NO: 874835 - DNA, 16 bp, Homo sapiens
gccctggtgctcctgc

SEQ ID NO: 874836 - DNA, 15 bp, Homo sapiens
gccctggtgctgcca

SEQ ID NO: 874837 - DNA, 17 bp, Homo sapiens
gccctgtacccacccca

SEQ ID NO: 874838 - DNA, 19 bp, Homo sapiens
gccctgtacccaccccagc

SEQ ID NO: 874839 - DNA, 22 bp, Homo sapiens
gccctgtacccaccccagcaca

SEQ ID NO: 874840 - DNA, 14 bp, Homo sapiens
gccctgtcagtgca

SEQ ID NO: 874841 - DNA, 11 bp, Homo sapiens
gccctgtccaa

SEQ ID NO: 874842 - DNA, 15 bp, Homo sapiens
gccctgtccaaaagc

SEQ ID NO: 874843 - DNA, 18 bp, Homo sapiens
gccctgtccagcccccag

SEQ ID NO: 874844 - DNA, 13 bp, Homo sapiens
gccctgtcccagg

SEQ ID NO: 874845 - DNA, 22 bp, Homo sapiens
gccctgtcccaggccggcccag

SEQ ID NO: 874846 - DNA, 23 bp, Homo sapiens
gccctgtcccaggccggcccaga

SEQ ID NO: 874847 - DNA, 22 bp, Homo sapiens
gccctgtcctggtggtattttc

SEQ ID NO: 874848 - DNA, 16 bp, Homo sapiens
gccctgtgcagacctt

SEQ ID NO: 874849 - DNA, 12 bp, Homo sapiens
gccctgtgccgc

SEQ ID NO: 874850 - DNA, 19 bp, Homo sapiens
gccctgtgccgcactctgg

SEQ ID NO: 874851 - DNA, 15 bp, Homo sapiens
gccctgtgcctgggc

SEQ ID NO: 874852 - DNA, 20 bp, Homo sapiens
gccctgtggagtccagctct

SEQ ID NO: 874853 - DNA, 23 bp, Homo sapiens
gccctgtggagtccagctctact

SEQ ID NO: 874854 - DNA, 13 bp, Homo sapiens
gccctgtggccgc

SEQ ID NO: 874855 - DNA, 17 bp, Homo sapiens
gccctgtggccgccacc

SEQ ID NO: 874856 - DNA, 22 bp, Homo sapiens
gccctgtgtctgtcacaggctg

SEQ ID NO: 874857 - DNA, 20 bp, Homo sapiens
gccctgttcagctactccca

SEQ ID NO: 874858 - DNA, 13 bp, Homo sapiens
gccctgttccctg

SEQ ID NO: 874859 - DNA, 20 bp, Homo sapiens
gccctgttgacacaggtctt

SEQ ID NO: 874860 - DNA, 21 bp, Homo sapiens
gccctgttgacacaggtcttt

SEQ ID NO: 874861 - DNA, 18 bp, Homo sapiens
gcccttagtcccccaact

SEQ ID NO: 874862 - DNA, 20 bp, Homo sapiens
gcccttagtcccccaactct

SEQ ID NO: 874863 - DNA, 19 bp, Homo sapiens
gcccttatgcccggcgccg

SEQ ID NO: 874864 - DNA, 17 bp, Homo sapiens
gcccttcactgccatga

SEQ ID NO: 874865 - DNA, 19 bp, Homo sapiens
gcccttcagacgagatcct

SEQ ID NO: 874866 - DNA, 15 bp, Homo sapiens
gcccttcagattgtt

SEQ ID NO: 874867 - DNA, 16 bp, Homo sapiens
gcccttcagtctgctc

SEQ ID NO: 874868 - DNA, 18 bp, Homo sapiens
gcccttcagtctgctcca

SEQ ID NO: 874869 - DNA, 13 bp, Homo sapiens
gcccttccagcct

SEQ ID NO: 874870 - DNA, 16 bp, Homo sapiens
gcccttccagcctggg

SEQ ID NO: 874871 - DNA, 17 bp, Homo sapiens
gcccttccagcctggga

SEQ ID NO: 874872 - DNA, 18 bp, Homo sapiens
gcccttccagcctgggac

SEQ ID NO: 874873 - DNA, 20 bp, Homo sapiens
gcccttccagcctgggacac

SEQ ID NO: 874874 - DNA, 23 bp, Homo sapiens
gcccttccagcctgggacacaca

SEQ ID NO: 874875 - DNA, 15 bp, Homo sapiens
gcctcccctgccacc

SEQ ID NO: 874876 - DNA, 15 bp, Homo sapiens
gcctcccctgccagg

SEQ ID NO: 874877 - DNA, 20 bp, Homo sapiens
gcctcccctgctgaaggtgg

SEQ ID NO: 874878 - DNA, 13 bp, Homo sapiens
gcctcccctgggc

SEQ ID NO: 874879 - DNA, 14 bp, Homo sapiens
gcctcccctgggca

SEQ ID NO: 874880 - DNA, 21 bp, Homo sapiens
gcctcccctgtctctaaggag

SEQ ID NO: 874881 - DNA, 16 bp, Homo sapiens
gcctccccttcttccc

SEQ ID NO: 874882 - DNA, 20 bp, Homo sapiens
gcctccccttcttcccgccc

SEQ ID NO: 874883 - DNA, 20 bp, Homo sapiens
gcctcccgagtagctgggat

SEQ ID NO: 874884 - DNA, 18 bp, Homo sapiens
gcctcccggggcccagga

SEQ ID NO: 874885 - DNA, 20 bp, Homo sapiens
gcctccctcaccctgagccc

SEQ ID NO: 874886 - DNA, 19 bp, Homo sapiens
gcctccctcagcccccagg

SEQ ID NO: 874887 - DNA, 16 bp, Homo sapiens
gcctccctcctgcccc

SEQ ID NO: 874888 - DNA, 24 bp, Homo sapiens
gcctccctctcagaggcctgctgc

SEQ ID NO: 874889 - DNA, 22 bp, Homo sapiens
gcctccctctctcttctgctcc

SEQ ID NO: 874890 - DNA, 23 bp, Homo sapiens
gcctccctctctcttctgctcca

SEQ ID NO: 874891 - DNA, 23 bp, Homo sapiens
gcctccctctcttccgggagctg

SEQ ID NO: 874892 - DNA, 11 bp, Homo sapiens
gcctccctgaa

SEQ ID NO: 874893 - DNA, 12 bp, Homo sapiens
gcctccctgagc

SEQ ID NO: 874894 - DNA, 13 bp, Homo sapiens
gcctccctgagcc

SEQ ID NO: 874895 - DNA, 18 bp, Homo sapiens
gcctccctgcagccacca

SEQ ID NO: 874896 - DNA, 18 bp, Homo sapiens
gcctccctgggccacctc

SEQ ID NO: 874897 - DNA, 14 bp, Homo sapiens
gcctccctgtctcc

SEQ ID NO: 874898 - DNA, 23 bp, Homo sapiens
gcctccctgtctccagctgcctg

SEQ ID NO: 874899 - DNA, 14 bp, Homo sapiens
gcctccctgttcac

SEQ ID NO: 874900 - DNA, 13 bp, Homo sapiens
gcctcccttgact

SEQ ID NO: 874901 - DNA, 15 bp, Homo sapiens
gcctcccttgggctg

SEQ ID NO: 874902 - DNA, 14 bp, Homo sapiens
gcctccgaggctcc

SEQ ID NO: 874903 - DNA, 17 bp, Homo sapiens
gcctccgcagtgtctcc

SEQ ID NO: 874904 - DNA, 17 bp, Homo sapiens
gcctccgcctgctgtgt

SEQ ID NO: 874905 - DNA, 23 bp, Homo sapiens
gcctccgcttatcctgctagcag

SEQ ID NO: 874906 - DNA, 21 bp, Homo sapiens
gcctccgggcgtgtgaagaac

SEQ ID NO: 874907 - DNA, 15 bp, Homo sapiens
gcctccgtcttccca

SEQ ID NO: 874908 - DNA, 22 bp, Homo sapiens
gcctccgtggaacattctggat

SEQ ID NO: 874909 - DNA, 23 bp, Homo sapiens
gcctccgtttatgggccttgctt

SEQ ID NO: 874910 - DNA, 22 bp, Homo sapiens
gcctcctaaggctccccacccc

SEQ ID NO: 874911 - DNA, 17 bp, Homo sapiens
gcctcctagagtgcagg

SEQ ID NO: 874912 - DNA, 15 bp, Homo sapiens
gcctcctagcccctt

SEQ ID NO: 874913 - DNA, 14 bp, Homo sapiens
gcctcctaggctgg

SEQ ID NO: 874914 - DNA, 18 bp, Homo sapiens
gcctcctaggctggaagc

SEQ ID NO: 874915 - DNA, 17 bp, Homo sapiens
gcctcctaggggaaggg

SEQ ID NO: 874916 - DNA, 19 bp, Homo sapiens
gcctcctaggggaaggggg

SEQ ID NO: 874917 - DNA, 14 bp, Homo sapiens
gcctcctcaccccc

SEQ ID NO: 874918 - DNA, 21 bp, Homo sapiens
gcctcctcacccccagctttg

SEQ ID NO: 874919 - DNA, 12 bp, Homo sapiens
gcctcctcagga

SEQ ID NO: 874920 - DNA, 12 bp, Homo sapiens
gcctcctcatca

SEQ ID NO: 874921 - DNA, 13 bp, Homo sapiens
gcctcctccagcc

SEQ ID NO: 874922 - DNA, 15 bp, Homo sapiens
gcctcctcccactgg

SEQ ID NO: 874923 - DNA, 16 bp, Homo sapiens
gcctcctcccactggg

SEQ ID NO: 874924 - DNA, 18 bp, Homo sapiens
gcctcctcccactgggac

SEQ ID NO: 874925 - DNA, 17 bp, Homo sapiens
gcctcctcccatccagc

SEQ ID NO: 874926 - DNA, 13 bp, Homo sapiens
gcctcctccctcc

SEQ ID NO: 874927 - DNA, 15 bp, Homo sapiens
gcctcctcgttcctt

SEQ ID NO: 874928 - DNA, 21 bp, Homo sapiens
gcctcctctcataaaagagac

SEQ ID NO: 874929 - DNA, 14 bp, Homo sapiens
gcctcctctcctcc

SEQ ID NO: 874930 - DNA, 17 bp, Homo sapiens
gcctcctctggacggca

SEQ ID NO: 874931 - DNA, 20 bp, Homo sapiens
gcctcctctggacggcaggc

SEQ ID NO: 874932 - DNA, 15 bp, Homo sapiens
gcctcctgagcctgt

SEQ ID NO: 874933 - DNA, 12 bp, Homo sapiens
gcctcctgcagt

SEQ ID NO: 874934 - DNA, 20 bp, Homo sapiens
gcctcctgcagtttgggaga

SEQ ID NO: 874935 - DNA, 12 bp, Homo sapiens
gcctcctgccac

SEQ ID NO: 874936 - DNA, 22 bp, Homo sapiens
gcctcctgccaccccttcctcc

SEQ ID NO: 874937 - DNA, 16 bp, Homo sapiens
gcctcctgccccctgc

SEQ ID NO: 874938 - DNA, 24 bp, Homo sapiens
gcctcctgccccctgccagtgaag

SEQ ID NO: 874939 - DNA, 14 bp, Homo sapiens
gcctcctgctctct

SEQ ID NO: 874940 - DNA, 20 bp, Homo sapiens
gcctcctggaatcagtattt

SEQ ID NO: 874941 - DNA, 18 bp, Homo sapiens
gcctcctggaggaccaga

SEQ ID NO: 874942 - DNA, 21 bp, Homo sapiens
gcctcctggaggaccagattg

SEQ ID NO: 874943 - DNA, 21 bp, Homo sapiens
gcctcctggctgtctgaggct

SEQ ID NO: 874944 - DNA, 21 bp, Homo sapiens
gcctcctgggggacctttgta

SEQ ID NO: 874945 - DNA, 13 bp, Homo sapiens
gcctcctgtacct

SEQ ID NO: 874946 - DNA, 16 bp, Homo sapiens
gcctcctgtacctcag

SEQ ID NO: 874947 - DNA, 18 bp, Homo sapiens
gcctcctgtacctcagtg

SEQ ID NO: 874948 - DNA, 19 bp, Homo sapiens
gcctcctgtacctcagtgg

SEQ ID NO: 874949 - DNA, 15 bp, Homo sapiens
gcctcctgtgcctgg

SEQ ID NO: 874950 - DNA, 13 bp, Homo sapiens
gcctcctgtgggg

SEQ ID NO: 874951 - DNA, 14 bp, Homo sapiens
gcctcctgtgggga

SEQ ID NO: 874952 - DNA, 18 bp, Homo sapiens
gcctcctgtggggaaagg

SEQ ID NO: 874953 - DNA, 13 bp, Homo sapiens
gcctcctgtgtaa

SEQ ID NO: 874954 - DNA, 13 bp, Homo sapiens
gcctcctgttctg

SEQ ID NO: 874955 - DNA, 18 bp, Homo sapiens
gcctcctgttctgcccac

SEQ ID NO: 874956 - DNA, 19 bp, Homo sapiens
gcctcctgttttctccctc

SEQ ID NO: 874957 - DNA, 19 bp, Homo sapiens
gcctccttagaaaaaaaat

SEQ ID NO: 874958 - DNA, 16 bp, Homo sapiens
gcctccttccacctcc

SEQ ID NO: 874959 - DNA, 17 bp, Homo sapiens
gcctccttccacctccc

SEQ ID NO: 874960 - DNA, 18 bp, Homo sapiens
gcctccttccacctccct

SEQ ID NO: 874961 - DNA, 19 bp, Homo sapiens
gcctccttccacctccctc

SEQ ID NO: 874962 - DNA, 15 bp, Homo sapiens
gcctccttcccatgc

SEQ ID NO: 874963 - DNA, 15 bp, Homo sapiens
gcctccttgctgacc

SEQ ID NO: 874964 - DNA, 21 bp, Homo sapiens
gcctccttttgctgtttggat

SEQ ID NO: 874965 - DNA, 21 bp, Homo sapiens
gcctcgacacccccccaaccc

SEQ ID NO: 874966 - DNA, 22 bp, Homo sapiens
gcctcgacacgtgggctcccct

SEQ ID NO: 874967 - DNA, 15 bp, Homo sapiens
gcctgggacccagct

SEQ ID NO: 874968 - DNA, 16 bp, Homo sapiens
gcctgggacccagcta

SEQ ID NO: 874969 - DNA, 18 bp, Homo sapiens
gcctgggacccagctact

SEQ ID NO: 874970 - DNA, 15 bp, Homo sapiens
gcctgggactcccag

SEQ ID NO: 874971 - DNA, 13 bp, Homo sapiens
gcctgggagccag

SEQ ID NO: 874972 - DNA, 14 bp, Homo sapiens
gcctgggagcccag

SEQ ID NO: 874973 - DNA, 16 bp, Homo sapiens
gcctgggagcccagag

SEQ ID NO: 874974 - DNA, 19 bp, Homo sapiens
gcctgggaggaagatgttt

SEQ ID NO: 874975 - DNA, 22 bp, Homo sapiens
gcctgggaggtcaaggctgcag

SEQ ID NO: 874976 - DNA, 18 bp, Homo sapiens
gcctgggatgggctccca

SEQ ID NO: 874977 - DNA, 19 bp, Homo sapiens
gcctgggcaacagagcaag

SEQ ID NO: 874978 - DNA, 22 bp, Homo sapiens
gcctgggcaacatagtgagacc

SEQ ID NO: 874979 - DNA, 12 bp, Homo sapiens
gcctgggcaaga

SEQ ID NO: 874980 - DNA, 13 bp, Homo sapiens
gcctgggcagcat

SEQ ID NO: 874981 - DNA, 20 bp, Homo sapiens
gcctgggcagccaggctgcc

SEQ ID NO: 874982 - DNA, 15 bp, Homo sapiens
gcctgggcagcccca

SEQ ID NO: 874983 - DNA, 16 bp, Homo sapiens
gcctgggcagccccac

SEQ ID NO: 874984 - DNA, 17 bp, Homo sapiens
gcctgggcagccccaca

SEQ ID NO: 874985 - DNA, 12 bp, Homo sapiens
gcctgggcagga

SEQ ID NO: 874986 - DNA, 16 bp, Homo sapiens
gcctgggcaggaccct

SEQ ID NO: 874987 - DNA, 22 bp, Homo sapiens
gcctgggcaggaccctgctgac

SEQ ID NO: 874988 - DNA, 21 bp, Homo sapiens
gcctgggccacacctgagcgc

SEQ ID NO: 874989 - DNA, 11 bp, Homo sapiens
gcctgggccag

SEQ ID NO: 874990 - DNA, 16 bp, Homo sapiens
gcctgggcccatctcc

SEQ ID NO: 874991 - DNA, 13 bp, Homo sapiens
gcctgggcccctc

SEQ ID NO: 874992 - DNA, 15 bp, Homo sapiens
gcctgggcccctccc

SEQ ID NO: 874993 - DNA, 22 bp, Homo sapiens
gcctgggcccctcccctcagag

SEQ ID NO: 874994 - DNA, 17 bp, Homo sapiens
gcctgggccgctgccac

SEQ ID NO: 874995 - DNA, 20 bp, Homo sapiens
gcctgggccggcgagggggc

SEQ ID NO: 874996 - DNA, 15 bp, Homo sapiens
gcctgggccgtggca

SEQ ID NO: 874997 - DNA, 18 bp, Homo sapiens
gcctgggccgtggcacag

SEQ ID NO: 874998 - DNA, 21 bp, Homo sapiens
gcctgggccgtggcacagctg

SEQ ID NO: 874999 - DNA, 13 bp, Homo sapiens
gcctgggcctgct

SEQ ID NO: 875000 - DNA, 17 bp, Homo sapiens
gcctgggcctgcttttc

SEQ ID NO: 875001 - DNA, 13 bp, Homo sapiens
gcctgggcctgtg

SEQ ID NO: 875002 - DNA, 21 bp, Homo sapiens
gcctgggcctgtgcagcagcc

SEQ ID NO: 875003 - DNA, 22 bp, Homo sapiens
gcctgggcctgtgcagcagccc

SEQ ID NO: 875004 - DNA, 12 bp, Homo sapiens
gcctgggctcac

SEQ ID NO: 875005 - DNA, 16 bp, Homo sapiens
gcctgggctctggaag

SEQ ID NO: 875006 - DNA, 19 bp, Homo sapiens
gcctgggctgggcagcctt

SEQ ID NO: 875007 - DNA, 15 bp, Homo sapiens
gcctgggcttggccc

SEQ ID NO: 875008 - DNA, 20 bp, Homo sapiens
gcctgggcttggcccgcggc

SEQ ID NO: 875009 - DNA, 15 bp, Homo sapiens
gcctggggaggccct

SEQ ID NO: 875010 - DNA, 21 bp, Homo sapiens
gcctggggatgtaaccaagct

SEQ ID NO: 875011 - DNA, 22 bp, Homo sapiens
gcctggggatgtaaccaagctg

SEQ ID NO: 875012 - DNA, 16 bp, Homo sapiens
gcctggggcggtgtgt

SEQ ID NO: 875013 - DNA, 14 bp, Homo sapiens
gcctggggctccct

SEQ ID NO: 875014 - DNA, 15 bp, Homo sapiens
gcctggggctccctc

SEQ ID NO: 875015 - DNA, 23 bp, Homo sapiens
gcctggggctccgaaattccaag

SEQ ID NO: 875016 - DNA, 13 bp, Homo sapiens
gcctggggctctc

SEQ ID NO: 875017 - DNA, 16 bp, Homo sapiens
gcctggggctctctga

SEQ ID NO: 875018 - DNA, 18 bp, Homo sapiens
gcctggggctctctgacc

SEQ ID NO: 875019 - DNA, 21 bp, Homo sapiens
gcctgggggacccctggctct

SEQ ID NO: 875020 - DNA, 22 bp, Homo sapiens
gcctgggggacccctggctctg

SEQ ID NO: 875021 - DNA, 18 bp, Homo sapiens
gcctgggggcagtgactg

SEQ ID NO: 875022 - DNA, 21 bp, Homo sapiens
gcctgggggcagtgactggca

SEQ ID NO: 875023 - DNA, 22 bp, Homo sapiens
gcctgggggcagtgactggcag

SEQ ID NO: 875024 - DNA, 23 bp, Homo sapiens
gcctgggggcagtgactggcagg

SEQ ID NO: 875025 - DNA, 20 bp, Homo sapiens
gcctggggtgtcctacagtg

SEQ ID NO: 875026 - DNA, 21 bp, Homo sapiens
gcctggggtgtcctacagtga

SEQ ID NO: 875027 - DNA, 13 bp, Homo sapiens
gcctgggtctgga

SEQ ID NO: 875028 - DNA, 19 bp, Homo sapiens
gcctgggtctgtgtctctt

SEQ ID NO: 875029 - DNA, 16 bp, Homo sapiens
gcctgggtgacagagc

SEQ ID NO: 875030 - DNA, 21 bp, Homo sapiens
gcctgggtgagaatcctgcct

SEQ ID NO: 875031 - DNA, 22 bp, Homo sapiens
gcctgggtgagaatcctgcctc

SEQ ID NO: 875032 - DNA, 17 bp, Homo sapiens
gcctgggtgctggctgc

SEQ ID NO: 875033 - DNA, 19 bp, Homo sapiens
gcctgggtggggctgctcc

SEQ ID NO: 875034 - DNA, 23 bp, Homo sapiens
gcctgggtggggctgctcctcca

SEQ ID NO: 875035 - DNA, 19 bp, Homo sapiens
gccttagggcactgggctg

SEQ ID NO: 875036 - DNA, 21 bp, Homo sapiens
gccttagtagtcaaaaacaaa

SEQ ID NO: 875037 - DNA, 22 bp, Homo sapiens
gccttagtctcagtttgtgtgt

SEQ ID NO: 875038 - DNA, 14 bp, Homo sapiens
gccttagtgggcca

SEQ ID NO: 875039 - DNA, 16 bp, Homo sapiens
gccttagtgggccagg

SEQ ID NO: 875040 - DNA, 17 bp, Homo sapiens
gccttagtgggccaggg

SEQ ID NO: 875041 - DNA, 20 bp, Homo sapiens
gccttatcaagtgtcttcca

SEQ ID NO: 875042 - DNA, 22 bp, Homo sapiens
gccttatcttgcaccccaaagc

SEQ ID NO: 875043 - DNA, 14 bp, Homo sapiens
gccttatttcccta

SEQ ID NO: 875044 - DNA, 15 bp, Homo sapiens
gccttatttgtctgt

SEQ ID NO: 875045 - DNA, 21 bp, Homo sapiens
gccttatttttgtatgccttt

SEQ ID NO: 875046 - DNA, 16 bp, Homo sapiens
gccttcaaggactgtt

SEQ ID NO: 875047 - DNA, 22 bp, Homo sapiens
gccttcacaatctgtcagttct

SEQ ID NO: 875048 - DNA, 18 bp, Homo sapiens
gccttcagacacatgcta

SEQ ID NO: 875049 - DNA, 22 bp, Homo sapiens
gccttcagacacatgctatgtt

SEQ ID NO: 875050 - DNA, 16 bp, Homo sapiens
gccttcagctctacag

SEQ ID NO: 875051 - DNA, 14 bp, Homo sapiens
gccttcaggcttct

SEQ ID NO: 875052 - DNA, 15 bp, Homo sapiens
gccttcagtttattt

SEQ ID NO: 875053 - DNA, 19 bp, Homo sapiens
gccttcagtttatttccac

SEQ ID NO: 875054 - DNA, 21 bp, Homo sapiens
gccttcataggcggtcatgtg

SEQ ID NO: 875055 - DNA, 14 bp, Homo sapiens
gccttccacctcac

SEQ ID NO: 875056 - DNA, 14 bp, Homo sapiens
gccttccataatta

SEQ ID NO: 875057 - DNA, 21 bp, Homo sapiens
gccttccataattatgacagt

SEQ ID NO: 875058 - DNA, 16 bp, Homo sapiens
gccttccatgacctcc

SEQ ID NO: 875059 - DNA, 18 bp, Homo sapiens
gccttccatgacctcccc

SEQ ID NO: 875060 - DNA, 18 bp, Homo sapiens
gccttccatttcccctct

SEQ ID NO: 875061 - DNA, 15 bp, Homo sapiens
gccttcccatggcca

SEQ ID NO: 875062 - DNA, 17 bp, Homo sapiens
gccttccccaccaagtc

SEQ ID NO: 875063 - DNA, 18 bp, Homo sapiens
gccttccccctcccaggg

SEQ ID NO: 875064 - DNA, 18 bp, Homo sapiens
gccttccccttgcccagg

SEQ ID NO: 875065 - DNA, 20 bp, Homo sapiens
gccttccccttttgcctggc

SEQ ID NO: 875066 - DNA, 22 bp, Homo sapiens
gccttccccttttgcctggctg

SEQ ID NO: 875067 - DNA, 24 bp, Homo sapiens
gccttccctagctttagaccctgg

SEQ ID NO: 875068 - DNA, 16 bp, Homo sapiens
gccttccctcactctt

SEQ ID NO: 875069 - DNA, 18 bp, Homo sapiens
gccttccctcactcttcc

SEQ ID NO: 875070 - DNA, 19 bp, Homo sapiens
gccttccctcactcttcct

SEQ ID NO: 875071 - DNA, 21 bp, Homo sapiens
gccttccctcactcttcctca

SEQ ID NO: 875072 - DNA, 13 bp, Homo sapiens
gccttccctcctg

SEQ ID NO: 875073 - DNA, 16 bp, Homo sapiens
gccttcctcatcccct

SEQ ID NO: 875074 - DNA, 17 bp, Homo sapiens
gccttcctccacatcct

SEQ ID NO: 875075 - DNA, 18 bp, Homo sapiens
gccttcctccacatcctt

SEQ ID NO: 875076 - DNA, 15 bp, Homo sapiens
gccttcctcctccac

SEQ ID NO: 875077 - DNA, 17 bp, Homo sapiens
gccttcctcctgggccc

SEQ ID NO: 875078 - DNA, 22 bp, Homo sapiens
gccttcctcctgggccctctct

SEQ ID NO: 875079 - DNA, 15 bp, Homo sapiens
gccttcctcgtgcag

SEQ ID NO: 875080 - DNA, 12 bp, Homo sapiens
gccttcctctct

SEQ ID NO: 875081 - DNA, 16 bp, Homo sapiens
gccttcctctctccag

SEQ ID NO: 875082 - DNA, 19 bp, Homo sapiens
gccttcctctctctaccag

SEQ ID NO: 875083 - DNA, 15 bp, Homo sapiens
gccttcctctctgga

SEQ ID NO: 875084 - DNA, 16 bp, Homo sapiens
gccttcctgacctcca

SEQ ID NO: 875085 - DNA, 19 bp, Homo sapiens
gccttcctgtttttcacat

SEQ ID NO: 875086 - DNA, 12 bp, Homo sapiens
gccttccttctg

SEQ ID NO: 875087 - DNA, 14 bp, Homo sapiens
gccttccttctgct

SEQ ID NO: 875088 - DNA, 13 bp, Homo sapiens
gccttcctttctc

SEQ ID NO: 875089 - DNA, 22 bp, Homo sapiens
gccttcgcaccttgctgtgtga

SEQ ID NO: 875090 - DNA, 14 bp, Homo sapiens
gccttcgctccatg

SEQ ID NO: 875091 - DNA, 19 bp, Homo sapiens
gccttcgtgcccccccttc

SEQ ID NO: 875092 - DNA, 17 bp, Homo sapiens
gccttcgtgtgctgctg

SEQ ID NO: 875093 - DNA, 20 bp, Homo sapiens
gccttcgtgtgctgctgctg

SEQ ID NO: 875094 - DNA, 15 bp, Homo sapiens
gccttctcagaagca

SEQ ID NO: 875095 - DNA, 23 bp, Homo sapiens
gccttctccatatctccatggcc

SEQ ID NO: 875096 - DNA, 15 bp, Homo sapiens
gccttctcccacatg

SEQ ID NO: 875097 - DNA, 20 bp, Homo sapiens
gccttctcccctctcccagg

SEQ ID NO: 875098 - DNA, 17 bp, Homo sapiens
gcgcgccaccgtgcctg

SEQ ID NO: 875099 - DNA, 13 bp, Homo sapiens
gcgcgctcctgac

SEQ ID NO: 875100 - DNA, 16 bp, Homo sapiens
gcgcggcggctctgcc

SEQ ID NO: 875101 - DNA, 16 bp, Homo sapiens
gcgcgggaggcaccag

SEQ ID NO: 875102 - DNA, 18 bp, Homo sapiens
gcgcgggcagccacccaa

SEQ ID NO: 875103 - DNA, 17 bp, Homo sapiens
gcgcggggagcccgtcg

SEQ ID NO: 875104 - DNA, 20 bp, Homo sapiens
gcgcggtggcgggcacctgt

SEQ ID NO: 875105 - DNA, 14 bp, Homo sapiens
gcgcgtctcccatc

SEQ ID NO: 875106 - DNA, 16 bp, Homo sapiens
gcgctagcagcccttg

SEQ ID NO: 875107 - DNA, 16 bp, Homo sapiens
gcgctcaggacccagg

SEQ ID NO: 875108 - DNA, 19 bp, Homo sapiens
gcgctcaggacccaggccc

SEQ ID NO: 875109 - DNA, 20 bp, Homo sapiens
gcgctcaggacccaggccct

SEQ ID NO: 875110 - DNA, 15 bp, Homo sapiens
gcgctcagtaaacgg

SEQ ID NO: 875111 - DNA, 19 bp, Homo sapiens
gcgctcatgttgagccagt

SEQ ID NO: 875112 - DNA, 11 bp, Homo sapiens
gcgctccaggg

SEQ ID NO: 875113 - DNA, 19 bp, Homo sapiens
gcgctcccgcatttctcat

SEQ ID NO: 875114 - DNA, 15 bp, Homo sapiens
gcgctcgccacgctc

SEQ ID NO: 875115 - DNA, 14 bp, Homo sapiens
gcgctcgcccagca

SEQ ID NO: 875116 - DNA, 21 bp, Homo sapiens
gcgctctcagctttccctgcc

SEQ ID NO: 875117 - DNA, 16 bp, Homo sapiens
gcgctctccaccaccc

SEQ ID NO: 875118 - DNA, 13 bp, Homo sapiens
gcgctctggacag

SEQ ID NO: 875119 - DNA, 17 bp, Homo sapiens
gcgctcttggtccctgg

SEQ ID NO: 875120 - DNA, 17 bp, Homo sapiens
gcgctgccgcaccccag

SEQ ID NO: 875121 - DNA, 19 bp, Homo sapiens
gcgctgccgcaccccagag

SEQ ID NO: 875122 - DNA, 19 bp, Homo sapiens
gcgctgcgcggactcgccc

SEQ ID NO: 875123 - DNA, 11 bp, Homo sapiens
gcgctggccca

SEQ ID NO: 875124 - DNA, 12 bp, Homo sapiens
gcgctggcccag

SEQ ID NO: 875125 - DNA, 17 bp, Homo sapiens
gcgctggcccagccggc

SEQ ID NO: 875126 - DNA, 19 bp, Homo sapiens
gcgctggcccagccggcct

SEQ ID NO: 875127 - DNA, 14 bp, Homo sapiens
gcgctggctccctg

SEQ ID NO: 875128 - DNA, 17 bp, Homo sapiens
gcgctgggcgctcccgg

SEQ ID NO: 875129 - DNA, 15 bp, Homo sapiens
gcgctgggtgcctgc

SEQ ID NO: 875130 - DNA, 21 bp, Homo sapiens
gcgctgggtgcctgcagcgcc

SEQ ID NO: 875131 - DNA, 22 bp, Homo sapiens
gcgctggtgcattctgtttcct

SEQ ID NO: 875132 - DNA, 18 bp, Homo sapiens
gcgctgtatttacagaca

SEQ ID NO: 875133 - DNA, 13 bp, Homo sapiens
gcgctgtcctgcg

SEQ ID NO: 875134 - DNA, 13 bp, Homo sapiens
gcgctgtggactg

SEQ ID NO: 875135 - DNA, 19 bp, Homo sapiens
gcgctgtggactgtcctga

SEQ ID NO: 875136 - DNA, 22 bp, Homo sapiens
gcgctgtttttgttgtgtgtgc

SEQ ID NO: 875137 - DNA, 13 bp, Homo sapiens
gcgcttcccaact

SEQ ID NO: 875138 - DNA, 14 bp, Homo sapiens
gcgcttcccagcac

SEQ ID NO: 875139 - DNA, 12 bp, Homo sapiens
gcgcttccctgg

SEQ ID NO: 875140 - DNA, 18 bp, Homo sapiens
gcgcttcgcttggtgagt

SEQ ID NO: 875141 - DNA, 15 bp, Homo sapiens
gcgctttctggaaaa

SEQ ID NO: 875142 - DNA, 13 bp, Homo sapiens
gcggaaacaggtg

SEQ ID NO: 875143 - DNA, 17 bp, Homo sapiens
gcggacaaaagggccag

SEQ ID NO: 875144 - DNA, 19 bp, Homo sapiens
gcggacaccgtggcctggg

SEQ ID NO: 875145 - DNA, 21 bp, Homo sapiens
gcggacaccgtggcctgggct

SEQ ID NO: 875146 - DNA, 19 bp, Homo sapiens
gcggacccttcccagccct

SEQ ID NO: 875147 - DNA, 18 bp, Homo sapiens
gcggagacctcctgacaa

SEQ ID NO: 875148 - DNA, 19 bp, Homo sapiens
gcggagagggctagccctg

SEQ ID NO: 875149 - DNA, 19 bp, Homo sapiens
gcggagcccagcctgggag

SEQ ID NO: 875150 - DNA, 12 bp, Homo sapiens
gcggagctggcc

SEQ ID NO: 875151 - DNA, 17 bp, Homo sapiens
gcggagctggggtctgg

SEQ ID NO: 875152 - DNA, 16 bp, Homo sapiens
gcggagcttgcagtga

SEQ ID NO: 875153 - DNA, 18 bp, Homo sapiens
gcggaggaggctggtgac

SEQ ID NO: 875154 - DNA, 14 bp, Homo sapiens
gcggaggctgtgtg

SEQ ID NO: 875155 - DNA, 20 bp, Homo sapiens
gcggaggggtttgggagtca

SEQ ID NO: 875156 - DNA, 16 bp, Homo sapiens
gcggaggttgcaggga

SEQ ID NO: 875157 - DNA, 14 bp, Homo sapiens
gcggagtgaagagg

SEQ ID NO: 875158 - DNA, 22 bp, Homo sapiens
gcggagtgaagaggggcagccc

SEQ ID NO: 875159 - DNA, 21 bp, Homo sapiens
gcggattgctctggagcagcc

SEQ ID NO: 875160 - DNA, 15 bp, Homo sapiens
gcggcaaaagcccat

SEQ ID NO: 875161 - DNA, 15 bp, Homo sapiens
gcggcaccctggtct

SEQ ID NO: 875162 - DNA, 18 bp, Homo sapiens
gcggcacgccaacagccc

SEQ ID NO: 875163 - DNA, 17 bp, Homo sapiens
gcggcagcagccatcat

SEQ ID NO: 875164 - DNA, 14 bp, Homo sapiens
gcggcaggagggag

SEQ ID NO: 875165 - DNA, 13 bp, Homo sapiens
gcggcagggaaga

SEQ ID NO: 875166 - DNA, 15 bp, Homo sapiens
gcggcaggggcctgg

SEQ ID NO: 875167 - DNA, 15 bp, Homo sapiens
gcggcagtgggcctg

SEQ ID NO: 875168 - DNA, 21 bp, Homo sapiens
gcggcatgaaccctcttgcca

SEQ ID NO: 875169 - DNA, 15 bp, Homo sapiens
gcggccactgcgcca

SEQ ID NO: 875170 - DNA, 10 bp, Homo sapiens
gcggccaggg

SEQ ID NO: 875171 - DNA, 15 bp, Homo sapiens
gcggccagggaccca

SEQ ID NO: 875172 - DNA, 20 bp, Homo sapiens
gcggccagggacccaaagca

SEQ ID NO: 875173 - DNA, 14 bp, Homo sapiens
gcggccagggcggc

SEQ ID NO: 875174 - DNA, 22 bp, Homo sapiens
gcggcccaagcccgacttgctg

SEQ ID NO: 875175 - DNA, 20 bp, Homo sapiens
gcggccccccgcacagccac

SEQ ID NO: 875176 - DNA, 15 bp, Homo sapiens
gcggcccctcccaca

SEQ ID NO: 875177 - DNA, 14 bp, Homo sapiens
gcggccctgtcatc

SEQ ID NO: 875178 - DNA, 15 bp, Homo sapiens
gcggccgatgggagt

SEQ ID NO: 875179 - DNA, 15 bp, Homo sapiens
gcggccgcattccct

SEQ ID NO: 875180 - DNA, 21 bp, Homo sapiens
gcggccgccccccgcccctcg

SEQ ID NO: 875181 - DNA, 22 bp, Homo sapiens
gcggccggccgagctgcctggc

SEQ ID NO: 875182 - DNA, 22 bp, Homo sapiens
gcggcctccggcgtcttgccca

SEQ ID NO: 875183 - DNA, 13 bp, Homo sapiens
gcggcctgcagtg

SEQ ID NO: 875184 - DNA, 17 bp, Homo sapiens
gcggcctggacccctgg

SEQ ID NO: 875185 - DNA, 18 bp, Homo sapiens
gcggcctggggggaacgg

SEQ ID NO: 875186 - DNA, 21 bp, Homo sapiens
gcggcctgtgggtttgggtgc

SEQ ID NO: 875187 - DNA, 18 bp, Homo sapiens
gcggccttgaagacagag

SEQ ID NO: 875188 - DNA, 14 bp, Homo sapiens
gcggcgggcggctg

SEQ ID NO: 875189 - DNA, 16 bp, Homo sapiens
gcggcggtcccagctc

SEQ ID NO: 875190 - DNA, 22 bp, Homo sapiens
gcggcggtggactgcgctggac

SEQ ID NO: 875191 - DNA, 21 bp, Homo sapiens
gcggctactcagcagccctcc

SEQ ID NO: 875192 - DNA, 14 bp, Homo sapiens
gcggctactctgga

SEQ ID NO: 875193 - DNA, 18 bp, Homo sapiens
gcggctcagccttgcaca

SEQ ID NO: 875194 - DNA, 19 bp, Homo sapiens
gcggctccagccccagaca

SEQ ID NO: 875195 - DNA, 13 bp, Homo sapiens
gcggctctgagca

SEQ ID NO: 875196 - DNA, 16 bp, Homo sapiens
gcggctctgcccacct

SEQ ID NO: 875197 - DNA, 19 bp, Homo sapiens
gcggctctgcccacctctc

SEQ ID NO: 875198 - DNA, 21 bp, Homo sapiens
gcggctctgcccacctctctt

SEQ ID NO: 875199 - DNA, 15 bp, Homo sapiens
gcggctgaactgaga

SEQ ID NO: 875200 - DNA, 12 bp, Homo sapiens
gcggctgagagc

SEQ ID NO: 875201 - DNA, 18 bp, Homo sapiens
gcggctgagagccccagc

SEQ ID NO: 875202 - DNA, 21 bp, Homo sapiens
gcggctgagagccccagctga

SEQ ID NO: 875203 - DNA, 23 bp, Homo sapiens
gcggctgagagccccagctgaca

SEQ ID NO: 875204 - DNA, 20 bp, Homo sapiens
gcggctgcacaacagccctg

SEQ ID NO: 875205 - DNA, 15 bp, Homo sapiens
gcggctggcagccca

SEQ ID NO: 875206 - DNA, 14 bp, Homo sapiens
gcggctgttccccc

SEQ ID NO: 875207 - DNA, 17 bp, Homo sapiens
gcggcttagccaagccc

SEQ ID NO: 875208 - DNA, 15 bp, Homo sapiens
gcggcttcctgtcca

SEQ ID NO: 875209 - DNA, 17 bp, Homo sapiens
gcggcttcctgtccact

SEQ ID NO: 875210 - DNA, 14 bp, Homo sapiens
gcggctttctctgc

SEQ ID NO: 875211 - DNA, 16 bp, Homo sapiens
gcggctttctctgcct

SEQ ID NO: 875212 - DNA, 22 bp, Homo sapiens
gcggctttctctgcctctgggc

SEQ ID NO: 875213 - DNA, 16 bp, Homo sapiens
gcgggacagagtagcc

SEQ ID NO: 875214 - DNA, 13 bp, Homo sapiens
gcgggacagccaa

SEQ ID NO: 875215 - DNA, 13 bp, Homo sapiens
gcgggagacccct

SEQ ID NO: 875216 - DNA, 17 bp, Homo sapiens
gcgggagacctgtgcta

SEQ ID NO: 875217 - DNA, 21 bp, Homo sapiens
gcgggatgggctcgctgaacc

SEQ ID NO: 875218 - DNA, 15 bp, Homo sapiens
gcgggatggtcctgg

SEQ ID NO: 875219 - DNA, 16 bp, Homo sapiens
gcgggatggtcctggg

SEQ ID NO: 875220 - DNA, 17 bp, Homo sapiens
gcgggatggtcctgggg

SEQ ID NO: 875221 - DNA, 23 bp, Homo sapiens
gcgggcactgggtacccaagtga

SEQ ID NO: 875222 - DNA, 10 bp, Homo sapiens
gcgggcagcc

SEQ ID NO: 875223 - DNA, 17 bp, Homo sapiens
gcgggcagccaggctgg

SEQ ID NO: 875224 - DNA, 21 bp, Homo sapiens
gcgggcagccccgttttgggg

SEQ ID NO: 875225 - DNA, 14 bp, Homo sapiens
gcgggcagggccgc

SEQ ID NO: 875226 - DNA, 15 bp, Homo sapiens
gcgggccaaggactg

SEQ ID NO: 875227 - DNA, 19 bp, Homo sapiens
gcgggccagccaggcgggc

SEQ ID NO: 875228 - DNA, 21 bp, Homo sapiens
gcgggccagccaggcgggctc

SEQ ID NO: 875229 - DNA, 19 bp, Homo sapiens
gcgggccagggtgggaaga

SEQ ID NO: 875230 - DNA, 14 bp, Homo sapiens
gcgggctcaaggaa

SEQ ID NO: 875231 - DNA, 11 bp, Homo sapiens
gcgggctcaga

SEQ ID NO: 875232 - DNA, 16 bp, Homo sapiens
gcgggctcagagcttt

SEQ ID NO: 875233 - DNA, 16 bp, Homo sapiens
gcgggctccctcctct

SEQ ID NO: 875234 - DNA, 17 bp, Homo sapiens
gcgggctccctcctctg

SEQ ID NO: 875235 - DNA, 19 bp, Homo sapiens
gcgggctccctcctctggc

SEQ ID NO: 875236 - DNA, 20 bp, Homo sapiens
gcgggctccctcctctggca

SEQ ID NO: 875237 - DNA, 21 bp, Homo sapiens
gcgggctccctcctctggcag

SEQ ID NO: 875238 - DNA, 13 bp, Homo sapiens
gcgggctcgccca

SEQ ID NO: 875239 - DNA, 17 bp, Homo sapiens
gcgggctgaggccagag

SEQ ID NO: 875240 - DNA, 18 bp, Homo sapiens
gcgggctgaggccagagt

SEQ ID NO: 875241 - DNA, 12 bp, Homo sapiens
gcgggctttgtt

SEQ ID NO: 875242 - DNA, 20 bp, Homo sapiens
gcggggactgctggctcacg

SEQ ID NO: 875243 - DNA, 15 bp, Homo sapiens
gcggggaggaggaac

SEQ ID NO: 875244 - DNA, 23 bp, Homo sapiens
gcggggatcagagcgcacaggga

SEQ ID NO: 875245 - DNA, 21 bp, Homo sapiens
gcggggcagtatgtgatggac

SEQ ID NO: 875246 - DNA, 17 bp, Homo sapiens
gcgggggcggaggagga

SEQ ID NO: 875247 - DNA, 22 bp, Homo sapiens
gcggggttagagccaagctgca

SEQ ID NO: 875248 - DNA, 22 bp, Homo sapiens
gcgggtaaaaaacctgggttag

SEQ ID NO: 875249 - DNA, 15 bp, Homo sapiens
gcgggtcctcagctg

SEQ ID NO: 875250 - DNA, 16 bp, Homo sapiens
gcgggtctcctcccag

SEQ ID NO: 875251 - DNA, 21 bp, Homo sapiens
gcgggtctcctcccagcggcc

SEQ ID NO: 875252 - DNA, 22 bp, Homo sapiens
gcgggtgaacaaagcagccacg

SEQ ID NO: 875253 - DNA, 20 bp, Homo sapiens
gcgggtggatcacaaggtca

SEQ ID NO: 875254 - DNA, 17 bp, Homo sapiens
gcgggttccgcaggcag

SEQ ID NO: 875255 - DNA, 23 bp, Homo sapiens
gcgggttctagacgcccctccca

SEQ ID NO: 875256 - DNA, 21 bp, Homo sapiens
gcggtagccagcacacagggc

SEQ ID NO: 875257 - DNA, 23 bp, Homo sapiens
gcggtagccagcacacagggcag

SEQ ID NO: 875258 - DNA, 18 bp, Homo sapiens
gcggtcatgtgtgcatgt

SEQ ID NO: 875259 - DNA, 19 bp, Homo sapiens
gcggtcatgtgtgcatgtg

SEQ ID NO: 875260 - DNA, 16 bp, Homo sapiens
gcggtccccatcccca

SEQ ID NO: 875261 - DNA, 17 bp, Homo sapiens
gcggtccctgcagaagc

SEQ ID NO: 875262 - DNA, 16 bp, Homo sapiens
gcggtcgcggctggga

SEQ ID NO: 875263 - DNA, 14 bp, Homo sapiens
gcggtggaggaagg

SEQ ID NO: 875264 - DNA, 17 bp, Homo sapiens
gcggtggctgccccggc

SEQ ID NO: 875265 - DNA, 13 bp, Homo sapiens
gcggtgggtgctg

SEQ ID NO: 875266 - DNA, 15 bp, Homo sapiens
gcgtaatgggcctgc

SEQ ID NO: 875267 - DNA, 15 bp, Homo sapiens
gcgtaatttaatggg

SEQ ID NO: 875268 - DNA, 15 bp, Homo sapiens
gcgtacacagagaag

SEQ ID NO: 875269 - DNA, 19 bp, Homo sapiens
gcgtatgcagtgtagattt

SEQ ID NO: 875270 - DNA, 21 bp, Homo sapiens
gcgtatgtctgttaccatgtc

SEQ ID NO: 875271 - DNA, 22 bp, Homo sapiens
gcgtatttagactgtggccata

SEQ ID NO: 875272 - DNA, 14 bp, Homo sapiens
gcgtcagctgctcc

SEQ ID NO: 875273 - DNA, 22 bp, Homo sapiens
gcgtcagctgctccctggcatt

SEQ ID NO: 875274 - DNA, 20 bp, Homo sapiens
gcgtcaggggtgcacagtcc

SEQ ID NO: 875275 - DNA, 15 bp, Homo sapiens
gcgtccaccaggcct

SEQ ID NO: 875276 - DNA, 17 bp, Homo sapiens
gcgtccaccaggcctca

SEQ ID NO: 875277 - DNA, 18 bp, Homo sapiens
gcgtccaccaggcctcac

SEQ ID NO: 875278 - DNA, 16 bp, Homo sapiens
gcgtccagctcagccc

SEQ ID NO: 875279 - DNA, 18 bp, Homo sapiens
gcgtccagctcagccctg

SEQ ID NO: 875280 - DNA, 19 bp, Homo sapiens
gcgtccagctcagccctgg

SEQ ID NO: 875281 - DNA, 17 bp, Homo sapiens
gcgtccccactcccttg

SEQ ID NO: 875282 - DNA, 18 bp, Homo sapiens
gcgtccccctgccggccg

SEQ ID NO: 875283 - DNA, 19 bp, Homo sapiens
gcgtcccctgctactcctg

SEQ ID NO: 875284 - DNA, 20 bp, Homo sapiens
gcgtccgcgcgccagcacag

SEQ ID NO: 875285 - DNA, 22 bp, Homo sapiens
gcgtcctccatcttccaggatg

SEQ ID NO: 875286 - DNA, 15 bp, Homo sapiens
gcgtcctcctctgtg

SEQ ID NO: 875287 - DNA, 16 bp, Homo sapiens
gcgtcctcctctgtga

SEQ ID NO: 875288 - DNA, 15 bp, Homo sapiens
gcgtcctgcagagga

SEQ ID NO: 875289 - DNA, 18 bp, Homo sapiens
gcgtcctgcagaggacca

SEQ ID NO: 875290 - DNA, 13 bp, Homo sapiens
gcgtcctgccctg

SEQ ID NO: 875291 - DNA, 16 bp, Homo sapiens
gcgtcgccctcccagg

SEQ ID NO: 875292 - DNA, 17 bp, Homo sapiens
gcgtcgccctcccaggc

SEQ ID NO: 875293 - DNA, 12 bp, Homo sapiens
gcgtcggccaga

SEQ ID NO: 875294 - DNA, 15 bp, Homo sapiens
gcgtcggtcctggtg

SEQ ID NO: 875295 - DNA, 13 bp, Homo sapiens
gcgtctccagtca

SEQ ID NO: 875296 - DNA, 14 bp, Homo sapiens
gcgtctccatatgt

SEQ ID NO: 875297 - DNA, 11 bp, Homo sapiens
gcgtctccccc

SEQ ID NO: 875298 - DNA, 13 bp, Homo sapiens
gcgtctcccccag

SEQ ID NO: 875299 - DNA, 14 bp, Homo sapiens
gcgtctcccccaga

SEQ ID NO: 875300 - DNA, 16 bp, Homo sapiens
gcgtctcccccagagt

SEQ ID NO: 875301 - DNA, 20 bp, Homo sapiens
gcgtctcctgtttttctggg

SEQ ID NO: 875302 - DNA, 22 bp, Homo sapiens
gcgtctctctttctccctcacc

SEQ ID NO: 875303 - DNA, 15 bp, Homo sapiens
gcgtctgactccctc

SEQ ID NO: 875304 - DNA, 17 bp, Homo sapiens
gcgtctgccccaccctc

SEQ ID NO: 875305 - DNA, 22 bp, Homo sapiens
gcgtctgcgttaggcagggcag

SEQ ID NO: 875306 - DNA, 18 bp, Homo sapiens
gcgtctgtcttcaagggc

SEQ ID NO: 875307 - DNA, 16 bp, Homo sapiens
gcgtctgttccccctt

SEQ ID NO: 875308 - DNA, 17 bp, Homo sapiens
gcgtcttcatctccctg

SEQ ID NO: 875309 - DNA, 13 bp, Homo sapiens
gcgtcttcctgag

SEQ ID NO: 875310 - DNA, 15 bp, Homo sapiens
gcgtgacaatatact

SEQ ID NO: 875311 - DNA, 16 bp, Homo sapiens
gcgtgactcacccaag

SEQ ID NO: 875312 - DNA, 21 bp, Homo sapiens
gcgtgagccactgctcgtggc

SEQ ID NO: 875313 - DNA, 19 bp, Homo sapiens
gcgtgataaaactgggttg

SEQ ID NO: 875314 - DNA, 15 bp, Homo sapiens
gcgtgatcaaagcca

SEQ ID NO: 875315 - DNA, 23 bp, Homo sapiens
gcgtgccagtcaagaagaaaaag

SEQ ID NO: 875316 - DNA, 17 bp, Homo sapiens
gcgtgcccccctcctcc

SEQ ID NO: 875317 - DNA, 21 bp, Homo sapiens
gcgtgcccccctcctccagta

SEQ ID NO: 875318 - DNA, 16 bp, Homo sapiens
gcgtgcccggggcagc

SEQ ID NO: 875319 - DNA, 17 bp, Homo sapiens
gcgtgcccggggcagca

SEQ ID NO: 875320 - DNA, 15 bp, Homo sapiens
gcgtgccctggaggc

SEQ ID NO: 875321 - DNA, 16 bp, Homo sapiens
gcgtgccgcctgctcc

SEQ ID NO: 875322 - DNA, 18 bp, Homo sapiens
gcgtgccgcctgctcctc

SEQ ID NO: 875323 - DNA, 20 bp, Homo sapiens
gcgtgccgtgtgagtgtgac

SEQ ID NO: 875324 - DNA, 20 bp, Homo sapiens
gctatttattttcctaaaga

SEQ ID NO: 875325 - DNA, 15 bp, Homo sapiens
gctatttcatctatt

SEQ ID NO: 875326 - DNA, 13 bp, Homo sapiens
gctatttctctcc

SEQ ID NO: 875327 - DNA, 19 bp, Homo sapiens
gctatttgaagaaaaaaat

SEQ ID NO: 875328 - DNA, 23 bp, Homo sapiens
gctatttgaagaaaaaaatgtac

SEQ ID NO: 875329 - DNA, 19 bp, Homo sapiens
gctatttgtaaatctgcca

SEQ ID NO: 875330 - DNA, 18 bp, Homo sapiens
gctatttgtatttctctt

SEQ ID NO: 875331 - DNA, 22 bp, Homo sapiens
gctatttgtttacatgcagatt

SEQ ID NO: 875332 - DNA, 17 bp, Homo sapiens
gctattttaagccatct

SEQ ID NO: 875333 - DNA, 19 bp, Homo sapiens
gctattttatttgtattca

SEQ ID NO: 875334 - DNA, 14 bp, Homo sapiens
gctattttccttgc

SEQ ID NO: 875335 - DNA, 18 bp, Homo sapiens
gctattttctaaagactt

SEQ ID NO: 875336 - DNA, 14 bp, Homo sapiens
gctcaaaaggaaac

SEQ ID NO: 875337 - DNA, 19 bp, Homo sapiens
gctcaaaaggaaaccaagt

SEQ ID NO: 875338 - DNA, 15 bp, Homo sapiens
gctcaaaatctttcc

SEQ ID NO: 875339 - DNA, 14 bp, Homo sapiens
gctcaaataaaaat

SEQ ID NO: 875340 - DNA, 18 bp, Homo sapiens
gctcaaatctattcagac

SEQ ID NO: 875341 - DNA, 20 bp, Homo sapiens
gctcaacccccctcccagac

SEQ ID NO: 875342 - DNA, 19 bp, Homo sapiens
gctcaagcaatcctcctgc

SEQ ID NO: 875343 - DNA, 24 bp, Homo sapiens
gctcaagcaatcctcctgcctcag

SEQ ID NO: 875344 - DNA, 21 bp, Homo sapiens
gctcaagcagcgaccgccccc

SEQ ID NO: 875345 - DNA, 23 bp, Homo sapiens
gctcaagcagcgaccgccccctc

SEQ ID NO: 875346 - DNA, 19 bp, Homo sapiens
gctcaagcaggaagttcaa

SEQ ID NO: 875347 - DNA, 15 bp, Homo sapiens
gctcaagcagttctc

SEQ ID NO: 875348 - DNA, 18 bp, Homo sapiens
gctcaagcgattctcctg

SEQ ID NO: 875349 - DNA, 13 bp, Homo sapiens
gctcaaggaaagg

SEQ ID NO: 875350 - DNA, 22 bp, Homo sapiens
gctcaaggccacaggcacacag

SEQ ID NO: 875351 - DNA, 20 bp, Homo sapiens
gctcaagtcttccctgatca

SEQ ID NO: 875352 - DNA, 22 bp, Homo sapiens
gctcaagtgatcctcacgcctt

SEQ ID NO: 875353 - DNA, 16 bp, Homo sapiens
gctcaagtgatcttcc

SEQ ID NO: 875354 - DNA, 12 bp, Homo sapiens
gctcaagttcat

SEQ ID NO: 875355 - DNA, 14 bp, Homo sapiens
gctcaagtttaaaa

SEQ ID NO: 875356 - DNA, 23 bp, Homo sapiens
gctcaatagattgctcaaatcag

SEQ ID NO: 875357 - DNA, 16 bp, Homo sapiens
gctcaatagcttgaag

SEQ ID NO: 875358 - DNA, 22 bp, Homo sapiens
gctcaatattcctgaatgaaat

SEQ ID NO: 875359 - DNA, 21 bp, Homo sapiens
gctcaatgcattgtcttgtgg

SEQ ID NO: 875360 - DNA, 14 bp, Homo sapiens
gctcaatttcagca

SEQ ID NO: 875361 - DNA, 14 bp, Homo sapiens
gctcacactccagt

SEQ ID NO: 875362 - DNA, 14 bp, Homo sapiens
gctcacactcctgg

SEQ ID NO: 875363 - DNA, 15 bp, Homo sapiens
gctcacactcctggg

SEQ ID NO: 875364 - DNA, 17 bp, Homo sapiens
gctcacactcctgggct

SEQ ID NO: 875365 - DNA, 19 bp, Homo sapiens
gctcacactgatgggctgg

SEQ ID NO: 875366 - DNA, 22 bp, Homo sapiens
gctcacactgatgggctggggc

SEQ ID NO: 875367 - DNA, 22 bp, Homo sapiens
gctcacagaacccttggagcca

SEQ ID NO: 875368 - DNA, 13 bp, Homo sapiens
gctcacagggcag

SEQ ID NO: 875369 - DNA, 20 bp, Homo sapiens
gctcacagtacagcatgtgc

SEQ ID NO: 875370 - DNA, 13 bp, Homo sapiens
gctcacagttcct

SEQ ID NO: 875371 - DNA, 17 bp, Homo sapiens
gctcacagttcctcgcc

SEQ ID NO: 875372 - DNA, 22 bp, Homo sapiens
gctcacagttcctcgccctggg

SEQ ID NO: 875373 - DNA, 23 bp, Homo sapiens
gctcacagttcctcgccctgggt

SEQ ID NO: 875374 - DNA, 20 bp, Homo sapiens
gctcaccagccctgcagccc

SEQ ID NO: 875375 - DNA, 14 bp, Homo sapiens
gctcacccctgggc

SEQ ID NO: 875376 - DNA, 18 bp, Homo sapiens
gctcacccctgggcaggc

SEQ ID NO: 875377 - DNA, 19 bp, Homo sapiens
gctcacccctgggcaggcg

SEQ ID NO: 875378 - DNA, 14 bp, Homo sapiens
gctcaccctgcccg

SEQ ID NO: 875379 - DNA, 15 bp, Homo sapiens
gctcaccctgcccgc

SEQ ID NO: 875380 - DNA, 17 bp, Homo sapiens
gctcaccctgcccgctc

SEQ ID NO: 875381 - DNA, 19 bp, Homo sapiens
gctcaccctgcccgctccc

SEQ ID NO: 875382 - DNA, 22 bp, Homo sapiens
gctcaccctgcccgctcccaac

SEQ ID NO: 875383 - DNA, 15 bp, Homo sapiens
gctcaccgcccatca

SEQ ID NO: 875384 - DNA, 16 bp, Homo sapiens
gctcaccgcccatcag

SEQ ID NO: 875385 - DNA, 17 bp, Homo sapiens
gctcaccgcccatcagg

SEQ ID NO: 875386 - DNA, 17 bp, Homo sapiens
gctcaccgctggccctt

SEQ ID NO: 875387 - DNA, 19 bp, Homo sapiens
gctcacctagagccagacc

SEQ ID NO: 875388 - DNA, 18 bp, Homo sapiens
gctcacgccccgctgtgt

SEQ ID NO: 875389 - DNA, 21 bp, Homo sapiens
gctcacgccccgctgtgtcct

SEQ ID NO: 875390 - DNA, 21 bp, Homo sapiens
gctcacgcctatgatcccagc

SEQ ID NO: 875391 - DNA, 22 bp, Homo sapiens
gctcacgcctgtaatcccagca

SEQ ID NO: 875392 - DNA, 18 bp, Homo sapiens
gctcacgcgttctgggag

SEQ ID NO: 875393 - DNA, 22 bp, Homo sapiens
gctcacgctcccccgcagtccc

SEQ ID NO: 875394 - DNA, 15 bp, Homo sapiens
gctcacggggcctcc

SEQ ID NO: 875395 - DNA, 20 bp, Homo sapiens
gctcacgtcctgagaaagct

SEQ ID NO: 875396 - DNA, 17 bp, Homo sapiens
gctcacgtgtgtgactc

SEQ ID NO: 875397 - DNA, 12 bp, Homo sapiens
gctcactactga

SEQ ID NO: 875398 - DNA, 18 bp, Homo sapiens
gctcactcactcactcca

SEQ ID NO: 875399 - DNA, 20 bp, Homo sapiens
gctcactcactcactccaag

SEQ ID NO: 875400 - DNA, 21 bp, Homo sapiens
gctcactcactcactccaaga

SEQ ID NO: 875401 - DNA, 23 bp, Homo sapiens
gctcactcatcaatggggccagt

SEQ ID NO: 875402 - DNA, 13 bp, Homo sapiens
gctcactgcaaat

SEQ ID NO: 875403 - DNA, 14 bp, Homo sapiens
gctcactgcagcct

SEQ ID NO: 875404 - DNA, 17 bp, Homo sapiens
gctcactgcagcctcat

SEQ ID NO: 875405 - DNA, 21 bp, Homo sapiens
gctcactgcagcgcgctcctg

SEQ ID NO: 875406 - DNA, 15 bp, Homo sapiens
gctcactgccaggcc

SEQ ID NO: 875407 - DNA, 15 bp, Homo sapiens
gctcactggctggga

SEQ ID NO: 875408 - DNA, 21 bp, Homo sapiens
gctcactggctgggagtcctt

SEQ ID NO: 875409 - DNA, 15 bp, Homo sapiens
gctcactgtgctggg

SEQ ID NO: 875410 - DNA, 18 bp, Homo sapiens
gctcactgtggtgtctgt

SEQ ID NO: 875411 - DNA, 23 bp, Homo sapiens
gctcacttctgggcttcatctgg

SEQ ID NO: 875412 - DNA, 20 bp, Homo sapiens
gctcacttttcatccttccc

SEQ ID NO: 875413 - DNA, 23 bp, Homo sapiens
gctcacttttcatccttccccaa

SEQ ID NO: 875414 - DNA, 16 bp, Homo sapiens
gctcagaacccagggc

SEQ ID NO: 875415 - DNA, 18 bp, Homo sapiens
gctcagaacccagggctc

SEQ ID NO: 875416 - DNA, 19 bp, Homo sapiens
gctcagaacttgctgctgt

SEQ ID NO: 875417 - DNA, 15 bp, Homo sapiens
gctcagaataaggca

SEQ ID NO: 875418 - DNA, 22 bp, Homo sapiens
gctcagaatccaagtgaacact

SEQ ID NO: 875419 - DNA, 13 bp, Homo sapiens
gctcagactctgg

SEQ ID NO: 875420 - DNA, 17 bp, Homo sapiens
gctcagagatgaaacta

SEQ ID NO: 875421 - DNA, 11 bp, Homo sapiens
gctcagagctt

SEQ ID NO: 875422 - DNA, 17 bp, Homo sapiens
gctcagagctttaaaag

SEQ ID NO: 875423 - DNA, 20 bp, Homo sapiens
gctcagagctttgtcacttg

SEQ ID NO: 875424 - DNA, 23 bp, Homo sapiens
gctcagagctttgtcacttgcca

SEQ ID NO: 875425 - DNA, 15 bp, Homo sapiens
gctcagagtgaccct

SEQ ID NO: 875426 - DNA, 18 bp, Homo sapiens
gctcagagtgaccctcag

SEQ ID NO: 875427 - DNA, 20 bp, Homo sapiens
gctcagagtgaccctcagct

SEQ ID NO: 875428 - DNA, 19 bp, Homo sapiens
gctcagatagaatgacagt

SEQ ID NO: 875429 - DNA, 23 bp, Homo sapiens
gctcagcaaaagatgcttctcac

SEQ ID NO: 875430 - DNA, 20 bp, Homo sapiens
gctcagcaatagggtgcagt

SEQ ID NO: 875431 - DNA, 15 bp, Homo sapiens
gctcagcagccagtc

SEQ ID NO: 875432 - DNA, 18 bp, Homo sapiens
gctcagcagccagtctca

SEQ ID NO: 875433 - DNA, 21 bp, Homo sapiens
gctcagcagccagtctcagag

SEQ ID NO: 875434 - DNA, 14 bp, Homo sapiens
gctcagcccacccc

SEQ ID NO: 875435 - DNA, 17 bp, Homo sapiens
gctcagcccacccccct

SEQ ID NO: 875436 - DNA, 16 bp, Homo sapiens
gctcagcccaccctcc

SEQ ID NO: 875437 - DNA, 20 bp, Homo sapiens
gctcagccccgagctgtccc

SEQ ID NO: 875438 - DNA, 12 bp, Homo sapiens
gctcagcccgct

SEQ ID NO: 875439 - DNA, 20 bp, Homo sapiens
gctcagccctgactggtgct

SEQ ID NO: 875440 - DNA, 16 bp, Homo sapiens
gctcagccctggcctg

SEQ ID NO: 875441 - DNA, 19 bp, Homo sapiens
gctcagccctggcctggct

SEQ ID NO: 875442 - DNA, 15 bp, Homo sapiens
gctcagcctcccgag

SEQ ID NO: 875443 - DNA, 15 bp, Homo sapiens
gctcagcctggtggg

SEQ ID NO: 875444 - DNA, 17 bp, Homo sapiens
gctcagcctggtgggcc

SEQ ID NO: 875445 - DNA, 18 bp, Homo sapiens
gctcccaaaacattttaa

SEQ ID NO: 875446 - DNA, 19 bp, Homo sapiens
gctcccaacccccctcctg

SEQ ID NO: 875447 - DNA, 19 bp, Homo sapiens
gctcccaacgagcctcctc

SEQ ID NO: 875448 - DNA, 21 bp, Homo sapiens
gctcccaacgagcctcctcag

SEQ ID NO: 875449 - DNA, 14 bp, Homo sapiens
gctcccaatcagct

SEQ ID NO: 875450 - DNA, 23 bp, Homo sapiens
gctcccacacttgtgccagcccg

SEQ ID NO: 875451 - DNA, 13 bp, Homo sapiens
gctcccacagaac

SEQ ID NO: 875452 - DNA, 15 bp, Homo sapiens
gctcccacagcttcc

SEQ ID NO: 875453 - DNA, 22 bp, Homo sapiens
gctcccacagcttcctgagggc

SEQ ID NO: 875454 - DNA, 16 bp, Homo sapiens
gctcccacaggccctt

SEQ ID NO: 875455 - DNA, 14 bp, Homo sapiens
gctcccaccccaga

SEQ ID NO: 875456 - DNA, 17 bp, Homo sapiens
gctcccaccccagaaat

SEQ ID NO: 875457 - DNA, 20 bp, Homo sapiens
gctcccaccccagaaatcac

SEQ ID NO: 875458 - DNA, 21 bp, Homo sapiens
gctcccaccccagaaatcact

SEQ ID NO: 875459 - DNA, 22 bp, Homo sapiens
gctcccaccccagaaatcactg

SEQ ID NO: 875460 - DNA, 14 bp, Homo sapiens
gctcccaccgcccc

SEQ ID NO: 875461 - DNA, 21 bp, Homo sapiens
gctcccaccgcccccacccct

SEQ ID NO: 875462 - DNA, 22 bp, Homo sapiens
gctcccacctagtgccccagac

SEQ ID NO: 875463 - DNA, 12 bp, Homo sapiens
gctcccacctcc

SEQ ID NO: 875464 - DNA, 22 bp, Homo sapiens
gctcccacctcccttcccacct

SEQ ID NO: 875465 - DNA, 12 bp, Homo sapiens
gctcccagggca

SEQ ID NO: 875466 - DNA, 18 bp, Homo sapiens
gctcccaggggtctccct

SEQ ID NO: 875467 - DNA, 19 bp, Homo sapiens
gctcccaggggtctccctg

SEQ ID NO: 875468 - DNA, 21 bp, Homo sapiens
gctcccaggggtctccctggc

SEQ ID NO: 875469 - DNA, 22 bp, Homo sapiens
gctcccaggggtctccctggct

SEQ ID NO: 875470 - DNA, 22 bp, Homo sapiens
gctcccagggtggaggaaggtg

SEQ ID NO: 875471 - DNA, 18 bp, Homo sapiens
gctcccatcctcacccag

SEQ ID NO: 875472 - DNA, 21 bp, Homo sapiens
gctcccattcactcttccaga

SEQ ID NO: 875473 - DNA, 16 bp, Homo sapiens
gctcccattcctccct

SEQ ID NO: 875474 - DNA, 20 bp, Homo sapiens
gctccccaactccctgccat

SEQ ID NO: 875475 - DNA, 22 bp, Homo sapiens
gctccccacagctttgcacccc

SEQ ID NO: 875476 - DNA, 15 bp, Homo sapiens
gctccccacctggac

SEQ ID NO: 875477 - DNA, 23 bp, Homo sapiens
gctccccacctggacacacactc

SEQ ID NO: 875478 - DNA, 18 bp, Homo sapiens
gctccccagaactggctg

SEQ ID NO: 875479 - DNA, 20 bp, Homo sapiens
gctccccagaactggctggg

SEQ ID NO: 875480 - DNA, 22 bp, Homo sapiens
gctccccagaactggctgggcc

SEQ ID NO: 875481 - DNA, 13 bp, Homo sapiens
gctccccagccca

SEQ ID NO: 875482 - DNA, 14 bp, Homo sapiens
gctccccatgtgtc

SEQ ID NO: 875483 - DNA, 15 bp, Homo sapiens
gctcccccaccccct

SEQ ID NO: 875484 - DNA, 14 bp, Homo sapiens
gctcccccatcctc

SEQ ID NO: 875485 - DNA, 17 bp, Homo sapiens
gctcccccatcctcccc

SEQ ID NO: 875486 - DNA, 18 bp, Homo sapiens
gctccccccgcccaccca

SEQ ID NO: 875487 - DNA, 14 bp, Homo sapiens
gctccccctcccca

SEQ ID NO: 875488 - DNA, 20 bp, Homo sapiens
gctccccctccccaggctgg

SEQ ID NO: 875489 - DNA, 13 bp, Homo sapiens
gctccccctctgc

SEQ ID NO: 875490 - DNA, 17 bp, Homo sapiens
gctccccctctgcttct

SEQ ID NO: 875491 - DNA, 17 bp, Homo sapiens
gctccccgagggctcag

SEQ ID NO: 875492 - DNA, 19 bp, Homo sapiens
gctcccctaaagcctcaaa

SEQ ID NO: 875493 - DNA, 17 bp, Homo sapiens
gctcccctccacagctg

SEQ ID NO: 875494 - DNA, 22 bp, Homo sapiens
gctcccctccatccccatcggc

SEQ ID NO: 875495 - DNA, 18 bp, Homo sapiens
gctcccctcccaggggag

SEQ ID NO: 875496 - DNA, 19 bp, Homo sapiens
gctcccctctatttagcat

SEQ ID NO: 875497 - DNA, 16 bp, Homo sapiens
gctcccctctcctccg

SEQ ID NO: 875498 - DNA, 19 bp, Homo sapiens
gctcccctctcctccgcca

SEQ ID NO: 875499 - DNA, 12 bp, Homo sapiens
gctcccctctgc

SEQ ID NO: 875500 - DNA, 13 bp, Homo sapiens
gctcccctctgga

SEQ ID NO: 875501 - DNA, 15 bp, Homo sapiens
gctcccctctggaat

SEQ ID NO: 875502 - DNA, 18 bp, Homo sapiens
gctcccctctggaatctt

SEQ ID NO: 875503 - DNA, 19 bp, Homo sapiens
gctcccctctggaatcttc

SEQ ID NO: 875504 - DNA, 21 bp, Homo sapiens
gctcccctctggaatcttccc

SEQ ID NO: 875505 - DNA, 12 bp, Homo sapiens
gctcccctcttc

SEQ ID NO: 875506 - DNA, 14 bp, Homo sapiens
gctcccctgccaca

SEQ ID NO: 875507 - DNA, 15 bp, Homo sapiens
gctcccctgccacac

SEQ ID NO: 875508 - DNA, 17 bp, Homo sapiens
gctcccctgccacactg

SEQ ID NO: 875509 - DNA, 18 bp, Homo sapiens
gctcccctgccacactga

SEQ ID NO: 875510 - DNA, 15 bp, Homo sapiens
gctcccctgccacgc

SEQ ID NO: 875511 - DNA, 14 bp, Homo sapiens
gctcccgagctact

SEQ ID NO: 875512 - DNA, 19 bp, Homo sapiens
gctcccgagctactctctt

SEQ ID NO: 875513 - DNA, 20 bp, Homo sapiens
gctcccgagctactctcttg

SEQ ID NO: 875514 - DNA, 16 bp, Homo sapiens
gctcccgggggcccca

SEQ ID NO: 875515 - DNA, 18 bp, Homo sapiens
gctccctaagccagcctg

SEQ ID NO: 875516 - DNA, 19 bp, Homo sapiens
gctccctaagccagcctgg

SEQ ID NO: 875517 - DNA, 20 bp, Homo sapiens
gctccctacattccccagag

SEQ ID NO: 875518 - DNA, 14 bp, Homo sapiens
gctccctagactgc

SEQ ID NO: 875519 - DNA, 20 bp, Homo sapiens
gctccctcccatcctccagc

SEQ ID NO: 875520 - DNA, 17 bp, Homo sapiens
gctccctcccctgccct

SEQ ID NO: 875521 - DNA, 21 bp, Homo sapiens
gctccctcccgtagtctcctg

SEQ ID NO: 875522 - DNA, 14 bp, Homo sapiens
gctccctcctccag

SEQ ID NO: 875523 - DNA, 13 bp, Homo sapiens
gctccctcctctg

SEQ ID NO: 875524 - DNA, 19 bp, Homo sapiens
gctccctcctctggcaggc

SEQ ID NO: 875525 - DNA, 12 bp, Homo sapiens
gctccctcctgc

SEQ ID NO: 875526 - DNA, 11 bp, Homo sapiens
gctccctgcac

SEQ ID NO: 875527 - DNA, 21 bp, Homo sapiens
gctccctgcaccgccgcagaa

SEQ ID NO: 875528 - DNA, 19 bp, Homo sapiens
gctccctggagccctgttg

SEQ ID NO: 875529 - DNA, 16 bp, Homo sapiens
gctccctgtagctctg

SEQ ID NO: 875530 - DNA, 17 bp, Homo sapiens
gctccctgtagctctgc

SEQ ID NO: 875531 - DNA, 16 bp, Homo sapiens
gctccctgtggggcag

SEQ ID NO: 875532 - DNA, 15 bp, Homo sapiens
gctcccttctctgta

SEQ ID NO: 875533 - DNA, 20 bp, Homo sapiens
gctcccttgggaaggacaca

SEQ ID NO: 875534 - DNA, 21 bp, Homo sapiens
gctcccttgggaaggacacag

SEQ ID NO: 875535 - DNA, 13 bp, Homo sapiens
gctccctttctca

SEQ ID NO: 875536 - DNA, 14 bp, Homo sapiens
gctccctttctcag

SEQ ID NO: 875537 - DNA, 17 bp, Homo sapiens
gctccctttctcaggag

SEQ ID NO: 875538 - DNA, 20 bp, Homo sapiens
gctccgaaattccaaggccc

SEQ ID NO: 875539 - DNA, 13 bp, Homo sapiens
gctccgacctctc

SEQ ID NO: 875540 - DNA, 16 bp, Homo sapiens
gctccgacctctctca

SEQ ID NO: 875541 - DNA, 16 bp, Homo sapiens
gctccgaggacccagg

SEQ ID NO: 875542 - DNA, 14 bp, Homo sapiens
gctccgaggactgg

SEQ ID NO: 875543 - DNA, 16 bp, Homo sapiens
gctccgagggcggcca

SEQ ID NO: 875544 - DNA, 13 bp, Homo sapiens
gctccgcaggggt

SEQ ID NO: 875545 - DNA, 14 bp, Homo sapiens
gctccgccaggaaa

SEQ ID NO: 875546 - DNA, 12 bp, Homo sapiens
gctccgccctta

SEQ ID NO: 875547 - DNA, 16 bp, Homo sapiens
gctccgcccttagtcc

SEQ ID NO: 875548 - DNA, 20 bp, Homo sapiens
gctccgcccttagtccccca

SEQ ID NO: 875549 - DNA, 13 bp, Homo sapiens
gctccgctcccac

SEQ ID NO: 875550 - DNA, 14 bp, Homo sapiens
gctccgctgctcct

SEQ ID NO: 875551 - DNA, 18 bp, Homo sapiens
gctccgggtcactgctgt

SEQ ID NO: 875552 - DNA, 19 bp, Homo sapiens
gctccgggtcactgctgta

SEQ ID NO: 875553 - DNA, 13 bp, Homo sapiens
gctccgtctctgt

SEQ ID NO: 875554 - DNA, 16 bp, Homo sapiens
gctccgtctctgtcct

SEQ ID NO: 875555 - DNA, 15 bp, Homo sapiens
gctccgtgcctccac

SEQ ID NO: 875556 - DNA, 15 bp, Homo sapiens
gctcctaagcttcaa

SEQ ID NO: 875557 - DNA, 15 bp, Homo sapiens
gctcctaccagcaaa

SEQ ID NO: 875558 - DNA, 14 bp, Homo sapiens
gctcctatctgtgt

SEQ ID NO: 875559 - DNA, 14 bp, Homo sapiens
gctcctattgaaag

SEQ ID NO: 875560 - DNA, 18 bp, Homo sapiens
gctcctcaactcacctaa

SEQ ID NO: 875561 - DNA, 14 bp, Homo sapiens
gctctctgcagcca

SEQ ID NO: 875562 - DNA, 18 bp, Homo sapiens
gctctctgcagccagccc

SEQ ID NO: 875563 - DNA, 21 bp, Homo sapiens
gctctctgcagccagcccagc

SEQ ID NO: 875564 - DNA, 20 bp, Homo sapiens
gctctctgcatctactccca

SEQ ID NO: 875565 - DNA, 14 bp, Homo sapiens
gctctctgccctgt

SEQ ID NO: 875566 - DNA, 13 bp, Homo sapiens
gctctctgctcat

SEQ ID NO: 875567 - DNA, 15 bp, Homo sapiens
gctctctgctcatgg

SEQ ID NO: 875568 - DNA, 17 bp, Homo sapiens
gctctctggaggtactg

SEQ ID NO: 875569 - DNA, 14 bp, Homo sapiens
gctctcttcaggag

SEQ ID NO: 875570 - DNA, 16 bp, Homo sapiens
gctctcttcaggaggc

SEQ ID NO: 875571 - DNA, 19 bp, Homo sapiens
gctctcttcctgcccctct

SEQ ID NO: 875572 - DNA, 20 bp, Homo sapiens
gctctcttcctgcccctctt

SEQ ID NO: 875573 - DNA, 22 bp, Homo sapiens
gctctcttgtgacgtgcactgt

SEQ ID NO: 875574 - DNA, 15 bp, Homo sapiens
gctctgaaagccagc

SEQ ID NO: 875575 - DNA, 17 bp, Homo sapiens
gctctgaaatctccttt

SEQ ID NO: 875576 - DNA, 13 bp, Homo sapiens
gctctgaacacac

SEQ ID NO: 875577 - DNA, 21 bp, Homo sapiens
gctctgaacttccaagctcca

SEQ ID NO: 875578 - DNA, 23 bp, Homo sapiens
gctctgaagtcacatcacaggac

SEQ ID NO: 875579 - DNA, 18 bp, Homo sapiens
gctctgaatctgtacatg

SEQ ID NO: 875580 - DNA, 19 bp, Homo sapiens
gctctgaatgggagccaga

SEQ ID NO: 875581 - DNA, 14 bp, Homo sapiens
gctctgacatccct

SEQ ID NO: 875582 - DNA, 17 bp, Homo sapiens
gctctgacatcccttcc

SEQ ID NO: 875583 - DNA, 18 bp, Homo sapiens
gctctgacatcccttcct

SEQ ID NO: 875584 - DNA, 21 bp, Homo sapiens
gctctgacatcccttcctgga

SEQ ID NO: 875585 - DNA, 22 bp, Homo sapiens
gctctgacatcccttcctggaa

SEQ ID NO: 875586 - DNA, 15 bp, Homo sapiens
gctctgaccctgggc

SEQ ID NO: 875587 - DNA, 9 bp, Homo sapiens
gctctgaga

SEQ ID NO: 875588 - DNA, 14 bp, Homo sapiens
gctctgagaatcac

SEQ ID NO: 875589 - DNA, 17 bp, Homo sapiens
gctctgagatcctggag

SEQ ID NO: 875590 - DNA, 13 bp, Homo sapiens
gctctgagcacag

SEQ ID NO: 875591 - DNA, 20 bp, Homo sapiens
gctctgagcacaggtgacag

SEQ ID NO: 875592 - DNA, 15 bp, Homo sapiens
gctctgagcaggggc

SEQ ID NO: 875593 - DNA, 17 bp, Homo sapiens
gctctgagcaggggcag

SEQ ID NO: 875594 - DNA, 14 bp, Homo sapiens
gctctgaggcaacc

SEQ ID NO: 875595 - DNA, 14 bp, Homo sapiens
gctctgaggggcac

SEQ ID NO: 875596 - DNA, 21 bp, Homo sapiens
gctctgaggtcaataaagcag

SEQ ID NO: 875597 - DNA, 22 bp, Homo sapiens
gctctgatccctctacagagct

SEQ ID NO: 875598 - DNA, 23 bp, Homo sapiens
gctctgatccctctacagagctt

SEQ ID NO: 875599 - DNA, 22 bp, Homo sapiens
gctctgattggaatttctggcc

SEQ ID NO: 875600 - DNA, 23 bp, Homo sapiens
gctctgcaagaattgaagcagga

SEQ ID NO: 875601 - DNA, 23 bp, Homo sapiens
gctctgcaatgggcactgggatg

SEQ ID NO: 875602 - DNA, 17 bp, Homo sapiens
gctctgcaattcccctc

SEQ ID NO: 875603 - DNA, 14 bp, Homo sapiens
gctctgcacagatg

SEQ ID NO: 875604 - DNA, 15 bp, Homo sapiens
gctctgcacagatgg

SEQ ID NO: 875605 - DNA, 18 bp, Homo sapiens
gctctgcacagatggatt

SEQ ID NO: 875606 - DNA, 15 bp, Homo sapiens
gctctgcacccctct

SEQ ID NO: 875607 - DNA, 13 bp, Homo sapiens
gctctgcaggcca

SEQ ID NO: 875608 - DNA, 14 bp, Homo sapiens
gctctgcaggccac

SEQ ID NO: 875609 - DNA, 17 bp, Homo sapiens
gctctgccaatgtgggc

SEQ ID NO: 875610 - DNA, 22 bp, Homo sapiens
gctctgccaccctacctgttca

SEQ ID NO: 875611 - DNA, 18 bp, Homo sapiens
gctctgcccacctctctt

SEQ ID NO: 875612 - DNA, 18 bp, Homo sapiens
gctctgcccacctggggt

SEQ ID NO: 875613 - DNA, 15 bp, Homo sapiens
gctctgccccaagcc

SEQ ID NO: 875614 - DNA, 16 bp, Homo sapiens
gctctgccccaagccc

SEQ ID NO: 875615 - DNA, 19 bp, Homo sapiens
gctctgccccaagccccca

SEQ ID NO: 875616 - DNA, 22 bp, Homo sapiens
gctctgccccaccttgccaggg

SEQ ID NO: 875617 - DNA, 16 bp, Homo sapiens
gctctgccccaggccc

SEQ ID NO: 875618 - DNA, 22 bp, Homo sapiens
gctctgccccaggccctactac

SEQ ID NO: 875619 - DNA, 17 bp, Homo sapiens
gctctgccccctccccc

SEQ ID NO: 875620 - DNA, 22 bp, Homo sapiens
gctctgcccctcagggggccag

SEQ ID NO: 875621 - DNA, 18 bp, Homo sapiens
gctctgccgtctctggag

SEQ ID NO: 875622 - DNA, 13 bp, Homo sapiens
gctctgcctcaga

SEQ ID NO: 875623 - DNA, 24 bp, Homo sapiens
gctctgcctcagacgttgcctgag

SEQ ID NO: 875624 - DNA, 13 bp, Homo sapiens
gctctgcctcccg

SEQ ID NO: 875625 - DNA, 13 bp, Homo sapiens
gctctgcctgtgg

SEQ ID NO: 875626 - DNA, 21 bp, Homo sapiens
gctctgcgtcggtcctggtgc

SEQ ID NO: 875627 - DNA, 17 bp, Homo sapiens
gctctgctgctctgacc

SEQ ID NO: 875628 - DNA, 19 bp, Homo sapiens
gctctgctggcctggccgg

SEQ ID NO: 875629 - DNA, 20 bp, Homo sapiens
gctctgctgtgagccgccag

SEQ ID NO: 875630 - DNA, 16 bp, Homo sapiens
gctctggacagatgga

SEQ ID NO: 875631 - DNA, 21 bp, Homo sapiens
gctctggacagcagaagcctc

SEQ ID NO: 875632 - DNA, 16 bp, Homo sapiens
gctctggaccagcctg

SEQ ID NO: 875633 - DNA, 17 bp, Homo sapiens
gctctggaccagcctgt

SEQ ID NO: 875634 - DNA, 14 bp, Homo sapiens
gctctggacctcag

SEQ ID NO: 875635 - DNA, 14 bp, Homo sapiens
gctctggagcagcc

SEQ ID NO: 875636 - DNA, 15 bp, Homo sapiens
gctctggagccagag

SEQ ID NO: 875637 - DNA, 14 bp, Homo sapiens
gctctggcacagtg

SEQ ID NO: 875638 - DNA, 20 bp, Homo sapiens
gctctggcggcttcctgtcc

SEQ ID NO: 875639 - DNA, 23 bp, Homo sapiens
gctctggcggcttcctgtccact

SEQ ID NO: 875640 - DNA, 17 bp, Homo sapiens
gctctggctccagagga

SEQ ID NO: 875641 - DNA, 16 bp, Homo sapiens
gctctggcttgcccca

SEQ ID NO: 875642 - DNA, 20 bp, Homo sapiens
gctctggcttgccccaggac

SEQ ID NO: 875643 - DNA, 16 bp, Homo sapiens
gctctgggagagccag

SEQ ID NO: 875644 - DNA, 17 bp, Homo sapiens
gctctgggagagccagc

SEQ ID NO: 875645 - DNA, 14 bp, Homo sapiens
gctctgggcacagt

SEQ ID NO: 875646 - DNA, 17 bp, Homo sapiens
gctctgggcacagtgct

SEQ ID NO: 875647 - DNA, 20 bp, Homo sapiens
gctctgggcacagtgctgcc

SEQ ID NO: 875648 - DNA, 14 bp, Homo sapiens
gctctgggcctctt

SEQ ID NO: 875649 - DNA, 11 bp, Homo sapiens
gctctgggctc

SEQ ID NO: 875650 - DNA, 14 bp, Homo sapiens
gctctgggctcagg

SEQ ID NO: 875651 - DNA, 17 bp, Homo sapiens
gctctgggctcagggct

SEQ ID NO: 875652 - DNA, 18 bp, Homo sapiens
gctctgggctcagggctg

SEQ ID NO: 875653 - DNA, 11 bp, Homo sapiens
gctctggggac

SEQ ID NO: 875654 - DNA, 20 bp, Homo sapiens
gctctggggacagcttcctc

SEQ ID NO: 875655 - DNA, 20 bp, Homo sapiens
gctctggggatttctgggat

SEQ ID NO: 875656 - DNA, 17 bp, Homo sapiens
gctctgggggtcccttg

SEQ ID NO: 875657 - DNA, 18 bp, Homo sapiens
gctctgggtgaggtaggc

SEQ ID NO: 875658 - DNA, 22 bp, Homo sapiens
gctctggtggcttaagtgagca

SEQ ID NO: 875659 - DNA, 18 bp, Homo sapiens
gctctgtatcaggaccca

SEQ ID NO: 875660 - DNA, 22 bp, Homo sapiens
gctctgtatcaggacccagagg

SEQ ID NO: 875661 - DNA, 16 bp, Homo sapiens
gctctgtcactgagca

SEQ ID NO: 875662 - DNA, 17 bp, Homo sapiens
gctctgtcccccaggct

SEQ ID NO: 875663 - DNA, 19 bp, Homo sapiens
gctctgtcccccaggctgg

SEQ ID NO: 875664 - DNA, 22 bp, Homo sapiens
gctctgtcctacctccactctc

SEQ ID NO: 875665 - DNA, 15 bp, Homo sapiens
gctctgtctcccagg

SEQ ID NO: 875666 - DNA, 17 bp, Homo sapiens
gctctgtctcccaggct

SEQ ID NO: 875667 - DNA, 19 bp, Homo sapiens
gctctgtgcagtcactgga

SEQ ID NO: 875668 - DNA, 15 bp, Homo sapiens
gctctgtgccagaaa

SEQ ID NO: 875669 - DNA, 14 bp, Homo sapiens
gctctgtggcctgt

SEQ ID NO: 875670 - DNA, 22 bp, Homo sapiens
gctctgtggcctgtgtccagca

SEQ ID NO: 875671 - DNA, 17 bp, Homo sapiens
gctctgtgggtctctgg

SEQ ID NO: 875672 - DNA, 18 bp, Homo sapiens
gctctgtgggtctctgga

SEQ ID NO: 875673 - DNA, 19 bp, Homo sapiens
gctctgttatcagctgggc

SEQ ID NO: 875674 - DNA, 23 bp, Homo sapiens
gctctgtttgatgctatttatgc

SEQ ID NO: 875675 - DNA, 20 bp, Homo sapiens
gctcttaaaatatcttcctt

SEQ ID NO: 875676 - DNA, 13 bp, Homo sapiens
gctcttaaatgta

SEQ ID NO: 875677 - DNA, 12 bp, Homo sapiens
gctcttaatgtt

SEQ ID NO: 875678 - DNA, 19 bp, Homo sapiens
gctcttaattgttcatttt

SEQ ID NO: 875679 - DNA, 17 bp, Homo sapiens
gctcttagcagcttcca

SEQ ID NO: 875680 - DNA, 18 bp, Homo sapiens
gctcttagcagcttccag

SEQ ID NO: 875681 - DNA, 21 bp, Homo sapiens
gctcttatgtggattaaacga

SEQ ID NO: 875682 - DNA, 18 bp, Homo sapiens
gctcttcaacatgacatc

SEQ ID NO: 875683 - DNA, 20 bp, Homo sapiens
gctcttcccctagacctccc

SEQ ID NO: 875684 - DNA, 23 bp, Homo sapiens
gctcttcccctagacctccccct

SEQ ID NO: 875685 - DNA, 20 bp, Homo sapiens
gctcttccgaaaaccaggcc

SEQ ID NO: 875686 - DNA, 18 bp, Homo sapiens
gctcttcctggacctgag

SEQ ID NO: 875687 - DNA, 19 bp, Homo sapiens
gctcttccttgaatcttct

SEQ ID NO: 875688 - DNA, 13 bp, Homo sapiens
gctcttctcaggg

SEQ ID NO: 875689 - DNA, 13 bp, Homo sapiens
gctcttctccttt

SEQ ID NO: 875690 - DNA, 21 bp, Homo sapiens
gctcttctcctttcacaacct

SEQ ID NO: 875691 - DNA, 23 bp, Homo sapiens
gctcttctcctttcacaaccttc

SEQ ID NO: 875692 - DNA, 20 bp, Homo sapiens
gctcttctgggcagagcctg

SEQ ID NO: 875693 - DNA, 18 bp, Homo sapiens
gctcttgaacctgtgctc

SEQ ID NO: 875694 - DNA, 23 bp, Homo sapiens
gctcttgatacccccctctgtct

SEQ ID NO: 875695 - DNA, 18 bp, Homo sapiens
gctcttgcccttccctgt

SEQ ID NO: 875696 - DNA, 12 bp, Homo sapiens
gctcttggaaga

SEQ ID NO: 875697 - DNA, 18 bp, Homo sapiens
gctcttggacaacagctc

SEQ ID NO: 875698 - DNA, 20 bp, Homo sapiens
gctcttggacaacagctctc

SEQ ID NO: 875699 - DNA, 17 bp, Homo sapiens
gctcttggagctgtgag

SEQ ID NO: 875700 - DNA, 17 bp, Homo sapiens
gctcttggcattttcct

SEQ ID NO: 875701 - DNA, 21 bp, Homo sapiens
gctcttggcattttcctcgcc

SEQ ID NO: 875702 - DNA, 13 bp, Homo sapiens
gctcttggctgac

SEQ ID NO: 875703 - DNA, 16 bp, Homo sapiens
gctcttggctgacccc

SEQ ID NO: 875704 - DNA, 22 bp, Homo sapiens
gctcttggggttcataggggca

SEQ ID NO: 875705 - DNA, 15 bp, Homo sapiens
gctcttggtacctgt

SEQ ID NO: 875706 - DNA, 14 bp, Homo sapiens
gctcttggtccctg

SEQ ID NO: 875707 - DNA, 16 bp, Homo sapiens
gctcttggtccctggt

SEQ ID NO: 875708 - DNA, 17 bp, Homo sapiens
gctcttggtccctggtc

SEQ ID NO: 875709 - DNA, 16 bp, Homo sapiens
gctcttgtttcactcc

SEQ ID NO: 875710 - DNA, 22 bp, Homo sapiens
gctcttgtttcactccaccatc

SEQ ID NO: 875711 - DNA, 21 bp, Homo sapiens
gctctttatgaatgaaaaaac

SEQ ID NO: 875712 - DNA, 14 bp, Homo sapiens
gctctttcagagag

SEQ ID NO: 875713 - DNA, 13 bp, Homo sapiens
gctctttcagggg

SEQ ID NO: 875714 - DNA, 12 bp, Homo sapiens
gctctttccaaa

SEQ ID NO: 875715 - DNA, 16 bp, Homo sapiens
gctctttccaaattaa

SEQ ID NO: 875716 - DNA, 20 bp, Homo sapiens
gctctttccaaattaaaaca

SEQ ID NO: 875717 - DNA, 15 bp, Homo sapiens
gctctttccttgctc

SEQ ID NO: 875718 - DNA, 16 bp, Homo sapiens
gctctttccttgctca

SEQ ID NO: 875719 - DNA, 22 bp, Homo sapiens
gctctttctacatgactgggcc

SEQ ID NO: 875720 - DNA, 16 bp, Homo sapiens
gctctttctctgccag

SEQ ID NO: 875721 - DNA, 13 bp, Homo sapiens
gctctttctgggc

SEQ ID NO: 875722 - DNA, 14 bp, Homo sapiens
gctctttctgggcc

SEQ ID NO: 875723 - DNA, 12 bp, Homo sapiens
gctctttgagaa

SEQ ID NO: 875724 - DNA, 18 bp, Homo sapiens
gctctttggtagaaaagg

SEQ ID NO: 875725 - DNA, 15 bp, Homo sapiens
gctcttttgtgatga

SEQ ID NO: 875726 - DNA, 17 bp, Homo sapiens
gctctttttttaaaagg

SEQ ID NO: 875727 - DNA, 20 bp, Homo sapiens
gctgaaaaatcacatcctgg

SEQ ID NO: 875728 - DNA, 20 bp, Homo sapiens
gctgaaaactaatgtactgt

SEQ ID NO: 875729 - DNA, 22 bp, Homo sapiens
gctgcacctgccagcctggctt

SEQ ID NO: 875730 - DNA, 17 bp, Homo sapiens
gctgcacctttttgcat

SEQ ID NO: 875731 - DNA, 18 bp, Homo sapiens
gctgcacctttttgcatg

SEQ ID NO: 875732 - DNA, 15 bp, Homo sapiens
gctgcacgctcccct

SEQ ID NO: 875733 - DNA, 22 bp, Homo sapiens
gctgcacgctcccctccatccc

SEQ ID NO: 875734 - DNA, 24 bp, Homo sapiens
gctgcacgggatgcgtgggaggca

SEQ ID NO: 875735 - DNA, 18 bp, Homo sapiens
gctgcactaggacttggt

SEQ ID NO: 875736 - DNA, 12 bp, Homo sapiens
gctgcactcttg

SEQ ID NO: 875737 - DNA, 14 bp, Homo sapiens
gctgcactgcagtg

SEQ ID NO: 875738 - DNA, 15 bp, Homo sapiens
gctgcactgcagtga

SEQ ID NO: 875739 - DNA, 21 bp, Homo sapiens
gctgcactggagccacaggca

SEQ ID NO: 875740 - DNA, 17 bp, Homo sapiens
gctgcagaaggccaaga

SEQ ID NO: 875741 - DNA, 22 bp, Homo sapiens
gctgcagaccatgccagaccca

SEQ ID NO: 875742 - DNA, 14 bp, Homo sapiens
gctgcagagcccgg

SEQ ID NO: 875743 - DNA, 22 bp, Homo sapiens
gctgcagaggccagaggccccc

SEQ ID NO: 875744 - DNA, 15 bp, Homo sapiens
gctgcagagggagac

SEQ ID NO: 875745 - DNA, 17 bp, Homo sapiens
gctgcagcagggcagga

SEQ ID NO: 875746 - DNA, 12 bp, Homo sapiens
gctgcagcatgt

SEQ ID NO: 875747 - DNA, 14 bp, Homo sapiens
gctgcagccatccc

SEQ ID NO: 875748 - DNA, 22 bp, Homo sapiens
gctgcagccatcccgcttagcc

SEQ ID NO: 875749 - DNA, 22 bp, Homo sapiens
gctgcagcccgccttggctttc

SEQ ID NO: 875750 - DNA, 16 bp, Homo sapiens
gctgcagcctctgcct

SEQ ID NO: 875751 - DNA, 17 bp, Homo sapiens
gctgcagcctctgcctc

SEQ ID NO: 875752 - DNA, 21 bp, Homo sapiens
gctgcagcctgcgccaccgcc

SEQ ID NO: 875753 - DNA, 21 bp, Homo sapiens
gctgcagctgggccccatgct

SEQ ID NO: 875754 - DNA, 15 bp, Homo sapiens
gctgcaggagggcac

SEQ ID NO: 875755 - DNA, 16 bp, Homo sapiens
gctgcaggagggcact

SEQ ID NO: 875756 - DNA, 20 bp, Homo sapiens
gctgcaggcaggcggctcct

SEQ ID NO: 875757 - DNA, 14 bp, Homo sapiens
gctgcaggccctcc

SEQ ID NO: 875758 - DNA, 14 bp, Homo sapiens
gctgcagggcacgg

SEQ ID NO: 875759 - DNA, 16 bp, Homo sapiens
gctgcagggcacgggg

SEQ ID NO: 875760 - DNA, 18 bp, Homo sapiens
gctgcagggcacggggac

SEQ ID NO: 875761 - DNA, 19 bp, Homo sapiens
gctgcagggctcccatggg

SEQ ID NO: 875762 - DNA, 22 bp, Homo sapiens
gctgcaggtacttcctcctgat

SEQ ID NO: 875763 - DNA, 12 bp, Homo sapiens
gctgcaggtgct

SEQ ID NO: 875764 - DNA, 16 bp, Homo sapiens
gctgcaggtgctgctg

SEQ ID NO: 875765 - DNA, 21 bp, Homo sapiens
gctgcagtcacattgatgtaa

SEQ ID NO: 875766 - DNA, 21 bp, Homo sapiens
gctgcagttttgctatctggg

SEQ ID NO: 875767 - DNA, 16 bp, Homo sapiens
gctgcatactttgaca

SEQ ID NO: 875768 - DNA, 21 bp, Homo sapiens
gctgcatgaaaaacattccac

SEQ ID NO: 875769 - DNA, 13 bp, Homo sapiens
gctgcatgaccta

SEQ ID NO: 875770 - DNA, 21 bp, Homo sapiens
gctgcatgacctaccaggaca

SEQ ID NO: 875771 - DNA, 19 bp, Homo sapiens
gctgcatgatgtttgccca

SEQ ID NO: 875772 - DNA, 17 bp, Homo sapiens
gctgcatggagcctgga

SEQ ID NO: 875773 - DNA, 15 bp, Homo sapiens
gctgccaaaaccaca

SEQ ID NO: 875774 - DNA, 22 bp, Homo sapiens
gctgccaaaaccacatgggctg

SEQ ID NO: 875775 - DNA, 23 bp, Homo sapiens
gctgccaaaaccacatgggctgg

SEQ ID NO: 875776 - DNA, 15 bp, Homo sapiens
gctgccaaattttgg

SEQ ID NO: 875777 - DNA, 17 bp, Homo sapiens
gctgccaaattttggcc

SEQ ID NO: 875778 - DNA, 20 bp, Homo sapiens
gctgccaagagtgaagggaa

SEQ ID NO: 875779 - DNA, 17 bp, Homo sapiens
gctgccaaggccagagt

SEQ ID NO: 875780 - DNA, 19 bp, Homo sapiens
gctgccaaggtggagggaa

SEQ ID NO: 875781 - DNA, 21 bp, Homo sapiens
gctgccacaaccagccaggca

SEQ ID NO: 875782 - DNA, 15 bp, Homo sapiens
gctgccacacttcag

SEQ ID NO: 875783 - DNA, 23 bp, Homo sapiens
gctgccacacttcaggctcttct

SEQ ID NO: 875784 - DNA, 15 bp, Homo sapiens
gctgccacagagaag

SEQ ID NO: 875785 - DNA, 23 bp, Homo sapiens
gctgccacattgatttttctata

SEQ ID NO: 875786 - DNA, 21 bp, Homo sapiens
gctgccacccacctccctgcc

SEQ ID NO: 875787 - DNA, 16 bp, Homo sapiens
gctgccacccctcttc

SEQ ID NO: 875788 - DNA, 11 bp, Homo sapiens
gctgccactgg

SEQ ID NO: 875789 - DNA, 18 bp, Homo sapiens
gctgccactgggcacctg

SEQ ID NO: 875790 - DNA, 14 bp, Homo sapiens
gctgccagcacaga

SEQ ID NO: 875791 - DNA, 18 bp, Homo sapiens
gctgccagcacagagcgt

SEQ ID NO: 875792 - DNA, 13 bp, Homo sapiens
gctgccagcctga

SEQ ID NO: 875793 - DNA, 20 bp, Homo sapiens
gctgccagccttgagccctg

SEQ ID NO: 875794 - DNA, 18 bp, Homo sapiens
gctgccagctctgtatca

SEQ ID NO: 875795 - DNA, 10 bp, Homo sapiens
gctgccaggc

SEQ ID NO: 875796 - DNA, 16 bp, Homo sapiens
gctgccaggcggccct

SEQ ID NO: 875797 - DNA, 14 bp, Homo sapiens
gctgccataattct

SEQ ID NO: 875798 - DNA, 17 bp, Homo sapiens
gctgccatcaccgctgg

SEQ ID NO: 875799 - DNA, 21 bp, Homo sapiens
gctgccatcaccgctgggtgg

SEQ ID NO: 875800 - DNA, 21 bp, Homo sapiens
gctgccatccttgctgcagct

SEQ ID NO: 875801 - DNA, 17 bp, Homo sapiens
gctgccatgccactgcc

SEQ ID NO: 875802 - DNA, 19 bp, Homo sapiens
gctgccatgccactgccag

SEQ ID NO: 875803 - DNA, 20 bp, Homo sapiens
gctgccatgccactgccagg

SEQ ID NO: 875804 - DNA, 21 bp, Homo sapiens
gctgccatgccactgccaggc

SEQ ID NO: 875805 - DNA, 23 bp, Homo sapiens
gctgccatgccactgccaggcac

SEQ ID NO: 875806 - DNA, 22 bp, Homo sapiens
gctgccatggcgtgtccctctc

SEQ ID NO: 875807 - DNA, 13 bp, Homo sapiens
gctgccatgtgaa

SEQ ID NO: 875808 - DNA, 21 bp, Homo sapiens
gctgccattggtccacccttt

SEQ ID NO: 875809 - DNA, 14 bp, Homo sapiens
gctgcccagagttg

SEQ ID NO: 875810 - DNA, 17 bp, Homo sapiens
gctgcccagagttgctg

SEQ ID NO: 875811 - DNA, 16 bp, Homo sapiens
gctgcccaggagacag

SEQ ID NO: 875812 - DNA, 16 bp, Homo sapiens
gctgccccaacctgct

SEQ ID NO: 875813 - DNA, 15 bp, Homo sapiens
gctgccccacctgcc

SEQ ID NO: 875814 - DNA, 16 bp, Homo sapiens
gctgccccacctgccg

SEQ ID NO: 875815 - DNA, 15 bp, Homo sapiens
gctgccccagctgac

SEQ ID NO: 875816 - DNA, 14 bp, Homo sapiens
gctgccccaggccg

SEQ ID NO: 875817 - DNA, 22 bp, Homo sapiens
gctgccccaggccggagcccag

SEQ ID NO: 875818 - DNA, 17 bp, Homo sapiens
gctgcccccttccccag

SEQ ID NO: 875819 - DNA, 19 bp, Homo sapiens
gctgcccccttccccagcc

SEQ ID NO: 875820 - DNA, 21 bp, Homo sapiens
gctgcccccttccccagccct

SEQ ID NO: 875821 - DNA, 13 bp, Homo sapiens
gctgccccggccc

SEQ ID NO: 875822 - DNA, 15 bp, Homo sapiens
gctgccccggcccct

SEQ ID NO: 875823 - DNA, 23 bp, Homo sapiens
gctgccccggcccctccccctga

SEQ ID NO: 875824 - DNA, 21 bp, Homo sapiens
gctgcccctccccgtccctgt

SEQ ID NO: 875825 - DNA, 15 bp, Homo sapiens
gctgcccctcgcaca

SEQ ID NO: 875826 - DNA, 18 bp, Homo sapiens
gctgccctgtaccccagc

SEQ ID NO: 875827 - DNA, 21 bp, Homo sapiens
gctgcccttatgcccggcgcc

SEQ ID NO: 875828 - DNA, 16 bp, Homo sapiens
gctgccgaccagagcc

SEQ ID NO: 875829 - DNA, 18 bp, Homo sapiens
gctgccgacttggagact

SEQ ID NO: 875830 - DNA, 21 bp, Homo sapiens
gctgccgagacagaccctctg

SEQ ID NO: 875831 - DNA, 18 bp, Homo sapiens
gctgccgcaccccagagt

SEQ ID NO: 875832 - DNA, 14 bp, Homo sapiens
gctgccgctgcacc

SEQ ID NO: 875833 - DNA, 16 bp, Homo sapiens
gctgccgctgcaccac

SEQ ID NO: 875834 - DNA, 15 bp, Homo sapiens
gctgccgggcctgat

SEQ ID NO: 875835 - DNA, 22 bp, Homo sapiens
gctgccgtggggccgccgcctc

SEQ ID NO: 875836 - DNA, 22 bp, Homo sapiens
gctgcctagccctccccccagc

SEQ ID NO: 875837 - DNA, 12 bp, Homo sapiens
gctgcctcagcc

SEQ ID NO: 875838 - DNA, 19 bp, Homo sapiens
gctgcctcagccagtggca

SEQ ID NO: 875839 - DNA, 21 bp, Homo sapiens
gctgcctcccctctccttcct

SEQ ID NO: 875840 - DNA, 21 bp, Homo sapiens
gctgcctcccttgtggcagca

SEQ ID NO: 875841 - DNA, 15 bp, Homo sapiens
gctgcctcctgctct

SEQ ID NO: 875842 - DNA, 15 bp, Homo sapiens
gctgcctcggactcc

SEQ ID NO: 875843 - DNA, 18 bp, Homo sapiens
gctgcctcggactccatg

SEQ ID NO: 875844 - DNA, 23 bp, Homo sapiens
gctgcctctacacaggggccctg

SEQ ID NO: 875845 - DNA, 16 bp, Homo sapiens
gctgcctctcccatca

SEQ ID NO: 875846 - DNA, 13 bp, Homo sapiens
gctgcctctgctc

SEQ ID NO: 875847 - DNA, 14 bp, Homo sapiens
gctgcctctgctcc

SEQ ID NO: 875848 - DNA, 17 bp, Homo sapiens
gctgcctctgctccctc

SEQ ID NO: 875849 - DNA, 13 bp, Homo sapiens
gctgcctcttctg

SEQ ID NO: 875850 - DNA, 23 bp, Homo sapiens
gctgcctcttggcttctcagccc

SEQ ID NO: 875851 - DNA, 19 bp, Homo sapiens
gctgcctgacactgagccc

SEQ ID NO: 875852 - DNA, 16 bp, Homo sapiens
gctgcctgcagcacat

SEQ ID NO: 875853 - DNA, 13 bp, Homo sapiens
gctgcctgccccc

SEQ ID NO: 875854 - DNA, 11 bp, Homo sapiens
gctgcctgcct

SEQ ID NO: 875855 - DNA, 14 bp, Homo sapiens
gctgcctgcctgtc

SEQ ID NO: 875856 - DNA, 13 bp, Homo sapiens
gctgcctgctgag

SEQ ID NO: 875857 - DNA, 17 bp, Homo sapiens
gctgcctggcacagacc

SEQ ID NO: 875858 - DNA, 20 bp, Homo sapiens
gctgcctggcacagaccagg

SEQ ID NO: 875859 - DNA, 22 bp, Homo sapiens
gctgcctggcacagaccaggcc

SEQ ID NO: 875860 - DNA, 15 bp, Homo sapiens
gctgcctggccatgc

SEQ ID NO: 875861 - DNA, 19 bp, Homo sapiens
gctgcctggccatgctgtc

SEQ ID NO: 875862 - DNA, 13 bp, Homo sapiens
gctgcctgggagc

SEQ ID NO: 875863 - DNA, 17 bp, Homo sapiens
gctgcctgggagccagg

SEQ ID NO: 875864 - DNA, 12 bp, Homo sapiens
gctgcctgggcc

SEQ ID NO: 875865 - DNA, 19 bp, Homo sapiens
gctgcctgtagttaggaaa

SEQ ID NO: 875866 - DNA, 15 bp, Homo sapiens
gctgcctgtgccatg

SEQ ID NO: 875867 - DNA, 16 bp, Homo sapiens
gctgcctgtgccatgc

SEQ ID NO: 875868 - DNA, 17 bp, Homo sapiens
gctgcctgtgccatgcc

SEQ ID NO: 875869 - DNA, 18 bp, Homo sapiens
gctgcctgtgccatgccc

SEQ ID NO: 875870 - DNA, 22 bp, Homo sapiens
gctgccttaatgacattcccct

SEQ ID NO: 875871 - DNA, 15 bp, Homo sapiens
gctgccttagaacct

SEQ ID NO: 875872 - DNA, 12 bp, Homo sapiens
gctgccttcagg

SEQ ID NO: 875873 - DNA, 15 bp, Homo sapiens
gctgccttcagggag

SEQ ID NO: 875874 - DNA, 12 bp, Homo sapiens
gctgccttccct

SEQ ID NO: 875875 - DNA, 13 bp, Homo sapiens
gctgccttcccta

SEQ ID NO: 875876 - DNA, 12 bp, Homo sapiens
gctgccttgagc

SEQ ID NO: 875877 - DNA, 21 bp, Homo sapiens
gctgccttggctcagacatgt

SEQ ID NO: 875878 - DNA, 17 bp, Homo sapiens
gctgcctttgtccccac

SEQ ID NO: 875879 - DNA, 18 bp, Homo sapiens
gctgcctttgtccccaca

SEQ ID NO: 875880 - DNA, 13 bp, Homo sapiens
gctgcctttgtgg

SEQ ID NO: 875881 - DNA, 20 bp, Homo sapiens
gctgcctttgtggtgggcgc

SEQ ID NO: 875882 - DNA, 22 bp, Homo sapiens
gctgcctttgtggtgggcgctg

SEQ ID NO: 875883 - DNA, 21 bp, Homo sapiens
gctgccttttgtttctagaat

SEQ ID NO: 875884 - DNA, 14 bp, Homo sapiens
gctgcgcactgtgt

SEQ ID NO: 875885 - DNA, 17 bp, Homo sapiens
gctgcgcccccagcttc

SEQ ID NO: 875886 - DNA, 23 bp, Homo sapiens
gctgcgccggacagagtggggag

SEQ ID NO: 875887 - DNA, 14 bp, Homo sapiens
gctgcgcctgcagg

SEQ ID NO: 875888 - DNA, 16 bp, Homo sapiens
gctgcgctaaccccca

SEQ ID NO: 875889 - DNA, 22 bp, Homo sapiens
gctgcgctaacccccagcccac

SEQ ID NO: 875890 - DNA, 15 bp, Homo sapiens
gctgcgcttgctttt

SEQ ID NO: 875891 - DNA, 17 bp, Homo sapiens
gctgcgggtctgaagga

SEQ ID NO: 875892 - DNA, 18 bp, Homo sapiens
gctgcgtccccactccct

SEQ ID NO: 875893 - DNA, 14 bp, Homo sapiens
gctgcgtccctccg

SEQ ID NO: 875894 - DNA, 16 bp, Homo sapiens
gctgctaacctggaaa

SEQ ID NO: 875895 - DNA, 16 bp, Homo sapiens
gctgctaccagcgcca

SEQ ID NO: 875896 - DNA, 20 bp, Homo sapiens
gctgctaccgccctgggctg

SEQ ID NO: 875897 - DNA, 22 bp, Homo sapiens
gctgctaccgttgacttccagg

SEQ ID NO: 875898 - DNA, 21 bp, Homo sapiens
gctgctagattttaatttatt

SEQ ID NO: 875899 - DNA, 16 bp, Homo sapiens
gctgctatagcctggg

SEQ ID NO: 875900 - DNA, 17 bp, Homo sapiens
gctgctatagcctgggg

SEQ ID NO: 875901 - DNA, 14 bp, Homo sapiens
gctgctatgaaaat

SEQ ID NO: 875902 - DNA, 15 bp, Homo sapiens
gctgctattgctgtc

SEQ ID NO: 875903 - DNA, 20 bp, Homo sapiens
gctgctattgctgtctggtg

SEQ ID NO: 875904 - DNA, 18 bp, Homo sapiens
gctgctatttattttcct

SEQ ID NO: 875905 - DNA, 21 bp, Homo sapiens
gctgctcagggaaaagcagct

SEQ ID NO: 875906 - DNA, 21 bp, Homo sapiens
gctgctcattacagttctttc

SEQ ID NO: 875907 - DNA, 14 bp, Homo sapiens
gctgctccaggcct

SEQ ID NO: 875908 - DNA, 22 bp, Homo sapiens
gctgctccaggcctgcagcagg

SEQ ID NO: 875909 - DNA, 12 bp, Homo sapiens
gctgctcccaca

SEQ ID NO: 875910 - DNA, 19 bp, Homo sapiens
gctgctcccacacttgtgc

SEQ ID NO: 875911 - DNA, 13 bp, Homo sapiens
gctgctccccacc

SEQ ID NO: 875912 - DNA, 16 bp, Homo sapiens
gctgctcccctgccac

SEQ ID NO: 875913 - DNA, 17 bp, Homo sapiens
gctgctcccctgccacg

SEQ ID NO: 875914 - DNA, 20 bp, Homo sapiens
gctgctccgaggacccagga

SEQ ID NO: 875915 - DNA, 19 bp, Homo sapiens
gctgctcctagagggaggg

SEQ ID NO: 875916 - DNA, 21 bp, Homo sapiens
gctgctcctagagggaggggc

SEQ ID NO: 875917 - DNA, 13 bp, Homo sapiens
gctgctcctcatg

SEQ ID NO: 875918 - DNA, 12 bp, Homo sapiens
gctgctcctcca

SEQ ID NO: 875919 - DNA, 22 bp, Homo sapiens
gctgctcggcttgatcacagct

SEQ ID NO: 875920 - DNA, 15 bp, Homo sapiens
gctgctctagctggc

SEQ ID NO: 875921 - DNA, 16 bp, Homo sapiens
gctgctctagctggca

SEQ ID NO: 875922 - DNA, 23 bp, Homo sapiens
gctgctctattgtagcatttctt

SEQ ID NO: 875923 - DNA, 13 bp, Homo sapiens
gctgctctcagcc

SEQ ID NO: 875924 - DNA, 21 bp, Homo sapiens
gctgctctgaccttccagagc

SEQ ID NO: 875925 - DNA, 14 bp, Homo sapiens
gctgctctgagcca

SEQ ID NO: 875926 - DNA, 13 bp, Homo sapiens
ggcatgtggcctg

SEQ ID NO: 875927 - DNA, 15 bp, Homo sapiens
ggcatgtggcctgtg

SEQ ID NO: 875928 - DNA, 17 bp, Homo sapiens
ggcatgtggcctgtggc

SEQ ID NO: 875929 - DNA, 19 bp, Homo sapiens
ggcatgtggcctgtggcct

SEQ ID NO: 875930 - DNA, 21 bp, Homo sapiens
ggcatgtggcctttatctcaa

SEQ ID NO: 875931 - DNA, 19 bp, Homo sapiens
ggcatgtgtgcctgtggca

SEQ ID NO: 875932 - DNA, 14 bp, Homo sapiens
ggcatgttcctctg

SEQ ID NO: 875933 - DNA, 16 bp, Homo sapiens
ggcattaacacaaagg

SEQ ID NO: 875934 - DNA, 17 bp, Homo sapiens
ggcattagaattattta

SEQ ID NO: 875935 - DNA, 19 bp, Homo sapiens
ggcattattaggtcttaaa

SEQ ID NO: 875936 - DNA, 13 bp, Homo sapiens
ggcattcctgctt

SEQ ID NO: 875937 - DNA, 12 bp, Homo sapiens
ggcattccttct

SEQ ID NO: 875938 - DNA, 17 bp, Homo sapiens
ggcattgcactgcttat

SEQ ID NO: 875939 - DNA, 22 bp, Homo sapiens
ggcattgcaggaccttgggcac

SEQ ID NO: 875940 - DNA, 12 bp, Homo sapiens
ggcattgctttc

SEQ ID NO: 875941 - DNA, 17 bp, Homo sapiens
ggcattgggctgacacc

SEQ ID NO: 875942 - DNA, 18 bp, Homo sapiens
ggcattgggctgacacct

SEQ ID NO: 875943 - DNA, 13 bp, Homo sapiens
ggcattgggttct

SEQ ID NO: 875944 - DNA, 19 bp, Homo sapiens
ggcattgtatctgtctttc

SEQ ID NO: 875945 - DNA, 15 bp, Homo sapiens
ggcattgttagttta

SEQ ID NO: 875946 - DNA, 17 bp, Homo sapiens
ggcatttaacttacatt

SEQ ID NO: 875947 - DNA, 15 bp, Homo sapiens
ggcatttattttata

SEQ ID NO: 875948 - DNA, 19 bp, Homo sapiens
ggcatttcacgaactgttc

SEQ ID NO: 875949 - DNA, 14 bp, Homo sapiens
ggcatttgctgaat

SEQ ID NO: 875950 - DNA, 16 bp, Homo sapiens
ggcatttgctggttat

SEQ ID NO: 875951 - DNA, 20 bp, Homo sapiens
ggcatttggtctcaggcagc

SEQ ID NO: 875952 - DNA, 14 bp, Homo sapiens
ggcatttggtgaga

SEQ ID NO: 875953 - DNA, 17 bp, Homo sapiens
ggcatttgtttctttct

SEQ ID NO: 875954 - DNA, 14 bp, Homo sapiens
ggcattttaagtaa

SEQ ID NO: 875955 - DNA, 20 bp, Homo sapiens
ggcattttcctcctctgcct

SEQ ID NO: 875956 - DNA, 21 bp, Homo sapiens
ggcattttcctcgcctaggcc

SEQ ID NO: 875957 - DNA, 19 bp, Homo sapiens
ggccaaaaccaatgctgat

SEQ ID NO: 875958 - DNA, 17 bp, Homo sapiens
ggccaaaagcagtaaat

SEQ ID NO: 875959 - DNA, 19 bp, Homo sapiens
ggccaaaataccaaatgcc

SEQ ID NO: 875960 - DNA, 19 bp, Homo sapiens
ggccaaacatcagacctgt

SEQ ID NO: 875961 - DNA, 21 bp, Homo sapiens
ggccaaacccacttctggcct

SEQ ID NO: 875962 - DNA, 15 bp, Homo sapiens
ggccaaacccttgct

SEQ ID NO: 875963 - DNA, 17 bp, Homo sapiens
ggccaaagaaccaaaga

SEQ ID NO: 875964 - DNA, 22 bp, Homo sapiens
ggccaaagaaccaaagaagaaa

SEQ ID NO: 875965 - DNA, 15 bp, Homo sapiens
ggccaaagataaaag

SEQ ID NO: 875966 - DNA, 14 bp, Homo sapiens
ggccaaagccccat

SEQ ID NO: 875967 - DNA, 15 bp, Homo sapiens
ggccaaagccccatg

SEQ ID NO: 875968 - DNA, 24 bp, Homo sapiens
ggccaaatatgcactttccctaga

SEQ ID NO: 875969 - DNA, 22 bp, Homo sapiens
ggccaaatccgctctcttcctg

SEQ ID NO: 875970 - DNA, 12 bp, Homo sapiens
ggccaaatgcaa

SEQ ID NO: 875971 - DNA, 19 bp, Homo sapiens
ggccaaatgcacaagctca

SEQ ID NO: 875972 - DNA, 22 bp, Homo sapiens
ggccaaatgcacaagctcagaa

SEQ ID NO: 875973 - DNA, 16 bp, Homo sapiens
gctggcagggccaggg

SEQ ID NO: 875974 - DNA, 22 bp, Homo sapiens
gctggcatcaggtctgggcaag

SEQ ID NO: 875975 - DNA, 23 bp, Homo sapiens
gctggcatgtttcactcctgctt

SEQ ID NO: 875976 - DNA, 20 bp, Homo sapiens
gctggccaaagagcctttcc

SEQ ID NO: 875977 - DNA, 24 bp, Homo sapiens
gctggccaaggtgtccagggtcct

SEQ ID NO: 875978 - DNA, 17 bp, Homo sapiens
gctggccagcaaggcag

SEQ ID NO: 875979 - DNA, 20 bp, Homo sapiens
gctggccagcaaggcaggtt

SEQ ID NO: 875980 - DNA, 21 bp, Homo sapiens
gctggccagcaaggcaggttg

SEQ ID NO: 875981 - DNA, 14 bp, Homo sapiens
gctggccagcaccc

SEQ ID NO: 875982 - DNA, 17 bp, Homo sapiens
gctggccagcaccctct

SEQ ID NO: 875983 - DNA, 18 bp, Homo sapiens
gctggccagcaccctctc

SEQ ID NO: 875984 - DNA, 21 bp, Homo sapiens
gctggccatgaatctctgcct

SEQ ID NO: 875985 - DNA, 23 bp, Homo sapiens
gctggccatgaatctctgcctct

SEQ ID NO: 875986 - DNA, 23 bp, Homo sapiens
gctggccatggacgaatatgaat

SEQ ID NO: 875987 - DNA, 11 bp, Homo sapiens
gctggcccagc

SEQ ID NO: 875988 - DNA, 14 bp, Homo sapiens
gctggcccagccaa

SEQ ID NO: 875989 - DNA, 23 bp, Homo sapiens
gctggcccagccaactgccccgg

SEQ ID NO: 875990 - DNA, 13 bp, Homo sapiens
gctggcccagccg

SEQ ID NO: 875991 - DNA, 12 bp, Homo sapiens
gctggccccagc

SEQ ID NO: 875992 - DNA, 17 bp, Homo sapiens
gctggccccagccctgc

SEQ ID NO: 875993 - DNA, 18 bp, Homo sapiens
gctggccccagccctgct

SEQ ID NO: 875994 - DNA, 19 bp, Homo sapiens
gctggccccagccctgctg

SEQ ID NO: 875995 - DNA, 21 bp, Homo sapiens
gctggccccagccctgctggg

SEQ ID NO: 875996 - DNA, 13 bp, Homo sapiens
gctggcccccagg

SEQ ID NO: 875997 - DNA, 14 bp, Homo sapiens
gctggcccctcacc

SEQ ID NO: 875998 - DNA, 19 bp, Homo sapiens
gctggcccctcacctgggc

SEQ ID NO: 875999 - DNA, 17 bp, Homo sapiens
gctggcccgtgacagac

SEQ ID NO: 876000 - DNA, 11 bp, Homo sapiens
gctggccctgt

SEQ ID NO: 876001 - DNA, 16 bp, Homo sapiens
gctggccctgtgcaga

SEQ ID NO: 876002 - DNA, 14 bp, Homo sapiens
gctggcccttagag

SEQ ID NO: 876003 - DNA, 22 bp, Homo sapiens
gctggcccttagagaccccgag

SEQ ID NO: 876004 - DNA, 22 bp, Homo sapiens
gctggccggagcaaactctgct

SEQ ID NO: 876005 - DNA, 17 bp, Homo sapiens
gctggccgggagcctga

SEQ ID NO: 876006 - DNA, 14 bp, Homo sapiens
gctggcctccccca

SEQ ID NO: 876007 - DNA, 19 bp, Homo sapiens
gctggcctctctagcacaa

SEQ ID NO: 876008 - DNA, 13 bp, Homo sapiens
gctggcctgactg

SEQ ID NO: 876009 - DNA, 14 bp, Homo sapiens
gctggcctggacag

SEQ ID NO: 876010 - DNA, 13 bp, Homo sapiens
gctggcctggagg

SEQ ID NO: 876011 - DNA, 19 bp, Homo sapiens
gctggcctggaggctcagc

SEQ ID NO: 876012 - DNA, 14 bp, Homo sapiens
gctggcctggatct

SEQ ID NO: 876013 - DNA, 14 bp, Homo sapiens
gctggcctggccgg

SEQ ID NO: 876014 - DNA, 21 bp, Homo sapiens
gctggcctggggtccctctga

SEQ ID NO: 876015 - DNA, 15 bp, Homo sapiens
gctggccttcctgcc

SEQ ID NO: 876016 - DNA, 12 bp, Homo sapiens
gctggccttggt

SEQ ID NO: 876017 - DNA, 19 bp, Homo sapiens
gctggccttggtatgtgcc

SEQ ID NO: 876018 - DNA, 21 bp, Homo sapiens
gctggccttggtatgtgccag

SEQ ID NO: 876019 - DNA, 19 bp, Homo sapiens
gctggcctttgtaagtgca

SEQ ID NO: 876020 - DNA, 20 bp, Homo sapiens
gctggcgacacactccgtcc

SEQ ID NO: 876021 - DNA, 16 bp, Homo sapiens
gctggcgacactcagg

SEQ ID NO: 876022 - DNA, 21 bp, Homo sapiens
gctggcgacactcagggcagc

SEQ ID NO: 876023 - DNA, 22 bp, Homo sapiens
gctggcgacactcagggcagct

SEQ ID NO: 876024 - DNA, 13 bp, Homo sapiens
gctggcgcagcca

SEQ ID NO: 876025 - DNA, 15 bp, Homo sapiens
gctggcggcgcagag

SEQ ID NO: 876026 - DNA, 16 bp, Homo sapiens
gctggcggctactcag

SEQ ID NO: 876027 - DNA, 20 bp, Homo sapiens
gctggcggctactcagcagc

SEQ ID NO: 876028 - DNA, 21 bp, Homo sapiens
gctggcggctactcagcagcc

SEQ ID NO: 876029 - DNA, 18 bp, Homo sapiens
gctggctagtcctttctg

SEQ ID NO: 876030 - DNA, 23 bp, Homo sapiens
gctggctcacagtacagcatgtg

SEQ ID NO: 876031 - DNA, 23 bp, Homo sapiens
gctggctccagatgcagggcagt

SEQ ID NO: 876032 - DNA, 16 bp, Homo sapiens
gctggctcccagggtg

SEQ ID NO: 876033 - DNA, 20 bp, Homo sapiens
gctggctcccagggtggagg

SEQ ID NO: 876034 - DNA, 19 bp, Homo sapiens
gctggctccctgggcagtg

SEQ ID NO: 876035 - DNA, 14 bp, Homo sapiens
gctggctcctgatc

SEQ ID NO: 876036 - DNA, 21 bp, Homo sapiens
gctggctctaccttcctgtcc

SEQ ID NO: 876037 - DNA, 13 bp, Homo sapiens
gctggctctccac

SEQ ID NO: 876038 - DNA, 12 bp, Homo sapiens
gctggctctgag

SEQ ID NO: 876039 - DNA, 15 bp, Homo sapiens
gctggctctgagaat

SEQ ID NO: 876040 - DNA, 17 bp, Homo sapiens
gctggctctgagaatca

SEQ ID NO: 876041 - DNA, 13 bp, Homo sapiens
gctggctctgagc

SEQ ID NO: 876042 - DNA, 19 bp, Homo sapiens
gctggctctgtgagggtgc

SEQ ID NO: 876043 - DNA, 17 bp, Homo sapiens
gctggctgacctgggcc

SEQ ID NO: 876044 - DNA, 18 bp, Homo sapiens
gctggctgacctgggccc

SEQ ID NO: 876045 - DNA, 13 bp, Homo sapiens
gctggctgagctg

SEQ ID NO: 876046 - DNA, 12 bp, Homo sapiens
gctggctgagtg

SEQ ID NO: 876047 - DNA, 13 bp, Homo sapiens
gctggctgagtgg

SEQ ID NO: 876048 - DNA, 14 bp, Homo sapiens
gctggctgcggccc

SEQ ID NO: 876049 - DNA, 17 bp, Homo sapiens
gctggctgcggccccct

SEQ ID NO: 876050 - DNA, 21 bp, Homo sapiens
gctggctgcttgcagccagga

SEQ ID NO: 876051 - DNA, 12 bp, Homo sapiens
gctggctggcct

SEQ ID NO: 876052 - DNA, 14 bp, Homo sapiens
gctggctggcctca

SEQ ID NO: 876053 - DNA, 16 bp, Homo sapiens
gctggctgggcatgga

SEQ ID NO: 876054 - DNA, 19 bp, Homo sapiens
gctggctgtacctgttcct

SEQ ID NO: 876055 - DNA, 16 bp, Homo sapiens
gctggctgtgcctgct

SEQ ID NO: 876056 - DNA, 19 bp, Homo sapiens
gctggctgtgcctgcttct

SEQ ID NO: 876057 - DNA, 12 bp, Homo sapiens
gctggcttcagg

SEQ ID NO: 876058 - DNA, 14 bp, Homo sapiens
gctggcttctgtga

SEQ ID NO: 876059 - DNA, 17 bp, Homo sapiens
gctggcttttcacccca

SEQ ID NO: 876060 - DNA, 22 bp, Homo sapiens
gctggcttttcaccccagagga

SEQ ID NO: 876061 - DNA, 15 bp, Homo sapiens
gctgggaaatgcaga

SEQ ID NO: 876062 - DNA, 16 bp, Homo sapiens
gctgggaaatgcagaa

SEQ ID NO: 876063 - DNA, 23 bp, Homo sapiens
gctgggaacatgacccagcctga

SEQ ID NO: 876064 - DNA, 14 bp, Homo sapiens
gctgggaagagctc

SEQ ID NO: 876065 - DNA, 16 bp, Homo sapiens
gctgggaagagctccc

SEQ ID NO: 876066 - DNA, 22 bp, Homo sapiens
gctgggaagctgtactcagagc

SEQ ID NO: 876067 - DNA, 23 bp, Homo sapiens
gctgggaagctgtactcagagca

SEQ ID NO: 876068 - DNA, 16 bp, Homo sapiens
gctgggaatggggaca

SEQ ID NO: 876069 - DNA, 18 bp, Homo sapiens
gctgggaatggggacacg

SEQ ID NO: 876070 - DNA, 15 bp, Homo sapiens
gctgggacctaatgc

SEQ ID NO: 876071 - DNA, 18 bp, Homo sapiens
gctgggacctaatgctgg

SEQ ID NO: 876072 - DNA, 17 bp, Homo sapiens
gctgggacgtggctcag

SEQ ID NO: 876073 - DNA, 16 bp, Homo sapiens
gctgggactcagcctt

SEQ ID NO: 876074 - DNA, 19 bp, Homo sapiens
gctgggactcagccttcag

SEQ ID NO: 876075 - DNA, 22 bp, Homo sapiens
gctgggactcagccttcagaca

SEQ ID NO: 876076 - DNA, 23 bp, Homo sapiens
gctgggactcagccttcagacag

SEQ ID NO: 876077 - DNA, 17 bp, Homo sapiens
gctgggacttcttaccc

SEQ ID NO: 876078 - DNA, 22 bp, Homo sapiens
gctgggacttcttacccaaagc

SEQ ID NO: 876079 - DNA, 14 bp, Homo sapiens
gctgggagacaaag

SEQ ID NO: 876080 - DNA, 16 bp, Homo sapiens
gctgggagccaggctc

SEQ ID NO: 876081 - DNA, 16 bp, Homo sapiens
gctgggagcctcgccc

SEQ ID NO: 876082 - DNA, 21 bp, Homo sapiens
gctgggagcctcgcccctcca

SEQ ID NO: 876083 - DNA, 13 bp, Homo sapiens
ggccatgctgagg

SEQ ID NO: 876084 - DNA, 14 bp, Homo sapiens
ggccatgctgtccc

SEQ ID NO: 876085 - DNA, 16 bp, Homo sapiens
ggccatggctttcatc

SEQ ID NO: 876086 - DNA, 18 bp, Homo sapiens
ggccatggtggagggcac

SEQ ID NO: 876087 - DNA, 23 bp, Homo sapiens
ggccatggtggagggcacttcag

SEQ ID NO: 876088 - DNA, 19 bp, Homo sapiens
ggccatgtcacctggctgc

SEQ ID NO: 876089 - DNA, 16 bp, Homo sapiens
ggccatgtcagacaca

SEQ ID NO: 876090 - DNA, 17 bp, Homo sapiens
ggccatgtcagacacag

SEQ ID NO: 876091 - DNA, 15 bp, Homo sapiens
ggccatgtccaaaga

SEQ ID NO: 876092 - DNA, 21 bp, Homo sapiens
ggccatgtgagccaccgctgc

SEQ ID NO: 876093 - DNA, 14 bp, Homo sapiens
ggccattctgccgc

SEQ ID NO: 876094 - DNA, 23 bp, Homo sapiens
ggccattgggtttggggccatgg

SEQ ID NO: 876095 - DNA, 17 bp, Homo sapiens
ggccattgtgaaccaat

SEQ ID NO: 876096 - DNA, 20 bp, Homo sapiens
ggccatttagattaggaagg

SEQ ID NO: 876097 - DNA, 18 bp, Homo sapiens
ggccatttgcaataacag

SEQ ID NO: 876098 - DNA, 21 bp, Homo sapiens
ggccatttgcaataacagctg

SEQ ID NO: 876099 - DNA, 22 bp, Homo sapiens
ggccatttgctagttctgctgc

SEQ ID NO: 876100 - DNA, 15 bp, Homo sapiens
ggcccaaatgatgga

SEQ ID NO: 876101 - DNA, 14 bp, Homo sapiens
ggcccaacattaaa

SEQ ID NO: 876102 - DNA, 20 bp, Homo sapiens
ggcccaaccaccagatgaga

SEQ ID NO: 876103 - DNA, 20 bp, Homo sapiens
ggcccaagagcagagtctgg

SEQ ID NO: 876104 - DNA, 13 bp, Homo sapiens
ggcccaaggagct

SEQ ID NO: 876105 - DNA, 14 bp, Homo sapiens
ggcccaagggatgg

SEQ ID NO: 876106 - DNA, 17 bp, Homo sapiens
ggcccaaggtcccctcc

SEQ ID NO: 876107 - DNA, 21 bp, Homo sapiens
ggcccaaggtcccctccacat

SEQ ID NO: 876108 - DNA, 15 bp, Homo sapiens
ggcccaagtcattgt

SEQ ID NO: 876109 - DNA, 17 bp, Homo sapiens
ggcccaagtcattgttt

SEQ ID NO: 876110 - DNA, 22 bp, Homo sapiens
ggcccaagtccctgttttctga

SEQ ID NO: 876111 - DNA, 15 bp, Homo sapiens
ggcccaagttgcagt

SEQ ID NO: 876112 - DNA, 20 bp, Homo sapiens
ggcccaagttgcagtgagca

SEQ ID NO: 876113 - DNA, 21 bp, Homo sapiens
ggcccaagttgcagtgagcag

SEQ ID NO: 876114 - DNA, 16 bp, Homo sapiens
ggcccacactgaggct

SEQ ID NO: 876115 - DNA, 15 bp, Homo sapiens
ggcccacagagcctg

SEQ ID NO: 876116 - DNA, 17 bp, Homo sapiens
ggcccacagctcccacc

SEQ ID NO: 876117 - DNA, 20 bp, Homo sapiens
ggcccaccagggactgcagc

SEQ ID NO: 876118 - DNA, 15 bp, Homo sapiens
ggcccaccagggtcc

SEQ ID NO: 876119 - DNA, 14 bp, Homo sapiens
ggcccaccatcacc

SEQ ID NO: 876120 - DNA, 18 bp, Homo sapiens
ggcccaccccccagcctc

SEQ ID NO: 876121 - DNA, 19 bp, Homo sapiens
ggcccaccctctgcccagg

SEQ ID NO: 876122 - DNA, 17 bp, Homo sapiens
ggcccaccctgcctgca

SEQ ID NO: 876123 - DNA, 20 bp, Homo sapiens
ggcccaccggatgctgtgcc

SEQ ID NO: 876124 - DNA, 12 bp, Homo sapiens
ggcccacctggc

SEQ ID NO: 876125 - DNA, 16 bp, Homo sapiens
ggcccacctggccacc

SEQ ID NO: 876126 - DNA, 14 bp, Homo sapiens
ggcccaccttggac

SEQ ID NO: 876127 - DNA, 17 bp, Homo sapiens
ggcccaccttggaccct

SEQ ID NO: 876128 - DNA, 22 bp, Homo sapiens
ggcccaccttggaccctggtga

SEQ ID NO: 876129 - DNA, 16 bp, Homo sapiens
ggcccacgaggagcag

SEQ ID NO: 876130 - DNA, 18 bp, Homo sapiens
ggcccacgaggagcagca

SEQ ID NO: 876131 - DNA, 22 bp, Homo sapiens
ggcccacgcctgtaatcccagc

SEQ ID NO: 876132 - DNA, 18 bp, Homo sapiens
ggcccacgtgtatagtat

SEQ ID NO: 876133 - DNA, 20 bp, Homo sapiens
ggcccactagagggcccatc

SEQ ID NO: 876134 - DNA, 23 bp, Homo sapiens
ggcccactagagggcccatcagg

SEQ ID NO: 876135 - DNA, 14 bp, Homo sapiens
ggcccactccccag

SEQ ID NO: 876136 - DNA, 13 bp, Homo sapiens
ggcccactgctcg

SEQ ID NO: 876137 - DNA, 13 bp, Homo sapiens
ggcccactgtgcc

SEQ ID NO: 876138 - DNA, 17 bp, Homo sapiens
ggcccagaaagcctctc

SEQ ID NO: 876139 - DNA, 12 bp, Homo sapiens
ggcccagaactg

SEQ ID NO: 876140 - DNA, 17 bp, Homo sapiens
ggcccagaactgccccc

SEQ ID NO: 876141 - DNA, 17 bp, Homo sapiens
ggcccagacccagcccg

SEQ ID NO: 876142 - DNA, 18 bp, Homo sapiens
ggcccagagaccccttcc

SEQ ID NO: 876143 - DNA, 22 bp, Homo sapiens
ggcccagagaccccttcctttc

SEQ ID NO: 876144 - DNA, 23 bp, Homo sapiens
ggcccagagaccccttcctttcc

SEQ ID NO: 876145 - DNA, 16 bp, Homo sapiens
ggcccagagcaggaag

SEQ ID NO: 876146 - DNA, 11 bp, Homo sapiens
ggcccagagcc

SEQ ID NO: 876147 - DNA, 15 bp, Homo sapiens
ggcccagagcccttg

SEQ ID NO: 876148 - DNA, 17 bp, Homo sapiens
ggcccagagcccttgac

SEQ ID NO: 876149 - DNA, 20 bp, Homo sapiens
ggcccagagtgaaccgtcct

SEQ ID NO: 876150 - DNA, 22 bp, Homo sapiens
ggcccagatctggtcccttgca

SEQ ID NO: 876151 - DNA, 14 bp, Homo sapiens
ggcccagcaggcag

SEQ ID NO: 876152 - DNA, 13 bp, Homo sapiens
ggcccagcatgca

SEQ ID NO: 876153 - DNA, 18 bp, Homo sapiens
ggccccaccccctgggca

SEQ ID NO: 876154 - DNA, 20 bp, Homo sapiens
ggccccaccccctgggcaga

SEQ ID NO: 876155 - DNA, 19 bp, Homo sapiens
ggccccacctcggcacaca

SEQ ID NO: 876156 - DNA, 23 bp, Homo sapiens
ggccccacctcggcacacactgt

SEQ ID NO: 876157 - DNA, 14 bp, Homo sapiens
ggccccacgccctc

SEQ ID NO: 876158 - DNA, 23 bp, Homo sapiens
ggccccactcccttgctggcccc

SEQ ID NO: 876159 - DNA, 15 bp, Homo sapiens
ggccccactggacaa

SEQ ID NO: 876160 - DNA, 17 bp, Homo sapiens
ggccccactggacaaca

SEQ ID NO: 876161 - DNA, 21 bp, Homo sapiens
ggccccactggacaacactga

SEQ ID NO: 876162 - DNA, 19 bp, Homo sapiens
ggccccagaaggcagggaa

SEQ ID NO: 876163 - DNA, 12 bp, Homo sapiens
ggccccagagac

SEQ ID NO: 876164 - DNA, 14 bp, Homo sapiens
ggccccagagactc

SEQ ID NO: 876165 - DNA, 18 bp, Homo sapiens
ggccccagagactcagag

SEQ ID NO: 876166 - DNA, 15 bp, Homo sapiens
ggccccagatctgcc

SEQ ID NO: 876167 - DNA, 20 bp, Homo sapiens
ggccccagatgatcccagtc

SEQ ID NO: 876168 - DNA, 15 bp, Homo sapiens
ggccccagcacagct

SEQ ID NO: 876169 - DNA, 11 bp, Homo sapiens
ggccccagcca

SEQ ID NO: 876170 - DNA, 13 bp, Homo sapiens
ggccccagccaga

SEQ ID NO: 876171 - DNA, 13 bp, Homo sapiens
ggccccagccctg

SEQ ID NO: 876172 - DNA, 18 bp, Homo sapiens
ggccccagccctgctggg

SEQ ID NO: 876173 - DNA, 21 bp, Homo sapiens
ggccccagccctgctggggat

SEQ ID NO: 876174 - DNA, 13 bp, Homo sapiens
ggccccagcctcc

SEQ ID NO: 876175 - DNA, 22 bp, Homo sapiens
ggccccagcctgggccatctct

SEQ ID NO: 876176 - DNA, 16 bp, Homo sapiens
ggccccaggacctggc

SEQ ID NO: 876177 - DNA, 19 bp, Homo sapiens
ggccccaggccccagacag

SEQ ID NO: 876178 - DNA, 17 bp, Homo sapiens
ggccccagggacagagg

SEQ ID NO: 876179 - DNA, 18 bp, Homo sapiens
ggccccagggacagaggc

SEQ ID NO: 876180 - DNA, 15 bp, Homo sapiens
ggccccaggggcagc

SEQ ID NO: 876181 - DNA, 16 bp, Homo sapiens
ggccccaggggcagca

SEQ ID NO: 876182 - DNA, 19 bp, Homo sapiens
ggccccagtgcggttcctc

SEQ ID NO: 876183 - DNA, 23 bp, Homo sapiens
ggccccagtgcggttcctcatct

SEQ ID NO: 876184 - DNA, 15 bp, Homo sapiens
ggccccatcagctgc

SEQ ID NO: 876185 - DNA, 20 bp, Homo sapiens
ggccccatcctcatccctga

SEQ ID NO: 876186 - DNA, 22 bp, Homo sapiens
ggccccatcgccccaccgcagc

SEQ ID NO: 876187 - DNA, 22 bp, Homo sapiens
ggccccatcttgatctttgagc

SEQ ID NO: 876188 - DNA, 13 bp, Homo sapiens
ggccccatgctct

SEQ ID NO: 876189 - DNA, 18 bp, Homo sapiens
ggccccatgctctgcccc

SEQ ID NO: 876190 - DNA, 16 bp, Homo sapiens
ggcccccaacctcagg

SEQ ID NO: 876191 - DNA, 20 bp, Homo sapiens
ggcccccaagttttttaatt

SEQ ID NO: 876192 - DNA, 13 bp, Homo sapiens
ggcccccaataaa

SEQ ID NO: 876193 - DNA, 23 bp, Homo sapiens
ggcccccaataaaggcagctgcc

SEQ ID NO: 876194 - DNA, 23 bp, Homo sapiens
ggcccccagcccagggctcctgc

SEQ ID NO: 876195 - DNA, 15 bp, Homo sapiens
ggcccccagccctgg

SEQ ID NO: 876196 - DNA, 15 bp, Homo sapiens
ggcccccagcctggc

SEQ ID NO: 876197 - DNA, 12 bp, Homo sapiens
ggcccccagtgg

SEQ ID NO: 876198 - DNA, 22 bp, Homo sapiens
ggcccccagtggggacagggag

SEQ ID NO: 876199 - DNA, 19 bp, Homo sapiens
ggccccccaaatcccaggg

SEQ ID NO: 876200 - DNA, 13 bp, Homo sapiens
ggccccccactcc

SEQ ID NO: 876201 - DNA, 21 bp, Homo sapiens
ggccccccctcttttggcctt

SEQ ID NO: 876202 - DNA, 22 bp, Homo sapiens
ggccccccctcttttggccttg

SEQ ID NO: 876203 - DNA, 19 bp, Homo sapiens
ggccccccgcacagccacc

SEQ ID NO: 876204 - DNA, 21 bp, Homo sapiens
ggccccccgcacagccacccg

SEQ ID NO: 876205 - DNA, 23 bp, Homo sapiens
ggccccccgcgctcgcccagcag

SEQ ID NO: 876206 - DNA, 14 bp, Homo sapiens
ggcccccctctcgg

SEQ ID NO: 876207 - DNA, 19 bp, Homo sapiens
ggcccccgccccctcccta

SEQ ID NO: 876208 - DNA, 13 bp, Homo sapiens
ggcccccgccccg

SEQ ID NO: 876209 - DNA, 21 bp, Homo sapiens
ggcccccggctttcctccgga

SEQ ID NO: 876210 - DNA, 22 bp, Homo sapiens
ggcccccggctttcctccggag

SEQ ID NO: 876211 - DNA, 14 bp, Homo sapiens
ggcccccgggcctg

SEQ ID NO: 876212 - DNA, 15 bp, Homo sapiens
ggccccctcattcag

SEQ ID NO: 876213 - DNA, 22 bp, Homo sapiens
ggccccctcattcagagactgc

SEQ ID NO: 876214 - DNA, 15 bp, Homo sapiens
ggccccctccatcgg

SEQ ID NO: 876215 - DNA, 17 bp, Homo sapiens
ggccccctttcccgggc

SEQ ID NO: 876216 - DNA, 14 bp, Homo sapiens
ggccccgccagggc

SEQ ID NO: 876217 - DNA, 18 bp, Homo sapiens
ggccccggccccagccag

SEQ ID NO: 876218 - DNA, 17 bp, Homo sapiens
ggcctccttcttccact

SEQ ID NO: 876219 - DNA, 23 bp, Homo sapiens
ggcctccttcttccacttctcca

SEQ ID NO: 876220 - DNA, 20 bp, Homo sapiens
ggcctcgcacttgcagagga

SEQ ID NO: 876221 - DNA, 19 bp, Homo sapiens
ggcctcgcctccccaccct

SEQ ID NO: 876222 - DNA, 13 bp, Homo sapiens
ggcctcggagcct

SEQ ID NO: 876223 - DNA, 13 bp, Homo sapiens
ggcctcggcagaa

SEQ ID NO: 876224 - DNA, 15 bp, Homo sapiens
ggcctcgtgcgcccg

SEQ ID NO: 876225 - DNA, 15 bp, Homo sapiens
ggcctctcagaccca

SEQ ID NO: 876226 - DNA, 23 bp, Homo sapiens
ggcctctccaaccactgtgccac

SEQ ID NO: 876227 - DNA, 17 bp, Homo sapiens
ggcctctcctgccctct

SEQ ID NO: 876228 - DNA, 20 bp, Homo sapiens
ggcctctctctctctcctca

SEQ ID NO: 876229 - DNA, 15 bp, Homo sapiens
ggcctctctctgctc

SEQ ID NO: 876230 - DNA, 18 bp, Homo sapiens
ggcctctctcttcccagc

SEQ ID NO: 876231 - DNA, 13 bp, Homo sapiens
ggcgctgcctcag

SEQ ID NO: 876232 - DNA, 14 bp, Homo sapiens
ggcgctgctgggag

SEQ ID NO: 876233 - DNA, 15 bp, Homo sapiens
ggcgctgctgggagc

SEQ ID NO: 876234 - DNA, 14 bp, Homo sapiens
ggcgctgcttccag

SEQ ID NO: 876235 - DNA, 15 bp, Homo sapiens
ggcgctgcttccagg

SEQ ID NO: 876236 - DNA, 16 bp, Homo sapiens
ggcgctggagagtcaa

SEQ ID NO: 876237 - DNA, 11 bp, Homo sapiens
ggcgctggccc

SEQ ID NO: 876238 - DNA, 14 bp, Homo sapiens
ggcgctggcccagc

SEQ ID NO: 876239 - DNA, 15 bp, Homo sapiens
ggcgctggcccagcc

SEQ ID NO: 876240 - DNA, 18 bp, Homo sapiens
ggcgctggcccagccggc

SEQ ID NO: 876241 - DNA, 20 bp, Homo sapiens
ggcgctggcccagccggcct

SEQ ID NO: 876242 - DNA, 20 bp, Homo sapiens
ggcgctgtgcggcctcacca

SEQ ID NO: 876243 - DNA, 21 bp, Homo sapiens
ggcggagagtacagtgagcca

SEQ ID NO: 876244 - DNA, 17 bp, Homo sapiens
ggcggagctggccccgc

SEQ ID NO: 876245 - DNA, 20 bp, Homo sapiens
ggcggagcttgcagtgagcc

SEQ ID NO: 876246 - DNA, 12 bp, Homo sapiens
ggcggaggctgt

SEQ ID NO: 876247 - DNA, 22 bp, Homo sapiens
ggcggatcatgaggtcaggagt

SEQ ID NO: 876248 - DNA, 16 bp, Homo sapiens
ggcggatccgcgggga

SEQ ID NO: 876249 - DNA, 12 bp, Homo sapiens
ggcggcagcagc

SEQ ID NO: 876250 - DNA, 18 bp, Homo sapiens
ggcggcaggggcctggag

SEQ ID NO: 876251 - DNA, 14 bp, Homo sapiens
ggcggccagggacc

SEQ ID NO: 876252 - DNA, 12 bp, Homo sapiens
ggcggccagggc

SEQ ID NO: 876253 - DNA, 13 bp, Homo sapiens
ggcggccagggcg

SEQ ID NO: 876254 - DNA, 14 bp, Homo sapiens
ggcggccagggcgg

SEQ ID NO: 876255 - DNA, 18 bp, Homo sapiens
ggcggcccaagcccgact

SEQ ID NO: 876256 - DNA, 19 bp, Homo sapiens
ggcggcccgtggacacccc

SEQ ID NO: 876257 - DNA, 15 bp, Homo sapiens
ggcggcctgcagtgg

SEQ ID NO: 876258 - DNA, 15 bp, Homo sapiens
ggcggctcctcctca

SEQ ID NO: 876259 - DNA, 19 bp, Homo sapiens
ggcggctctgagcaggggc

SEQ ID NO: 876260 - DNA, 23 bp, Homo sapiens
ggcggctgagagccccagctgac

SEQ ID NO: 876261 - DNA, 15 bp, Homo sapiens
ggcggctgcacaaca

SEQ ID NO: 876262 - DNA, 22 bp, Homo sapiens
ggcggctgcacaacagccctgc

SEQ ID NO: 876263 - DNA, 18 bp, Homo sapiens
ggcggcttcctgtccact

SEQ ID NO: 876264 - DNA, 15 bp, Homo sapiens
ggcgggatcctccac

SEQ ID NO: 876265 - DNA, 11 bp, Homo sapiens
ggcgggccagg

SEQ ID NO: 876266 - DNA, 22 bp, Homo sapiens
ggcgggccagggtgggaagaga

SEQ ID NO: 876267 - DNA, 18 bp, Homo sapiens
ggcgggcccagaccggct

SEQ ID NO: 876268 - DNA, 13 bp, Homo sapiens
ggcgggctcagag

SEQ ID NO: 876269 - DNA, 14 bp, Homo sapiens
ggcgggctcagagc

SEQ ID NO: 876270 - DNA, 12 bp, Homo sapiens
ggcggggcagga

SEQ ID NO: 876271 - DNA, 18 bp, Homo sapiens
ggcgggggcggaggagga

SEQ ID NO: 876272 - DNA, 13 bp, Homo sapiens
ggcggggtggggt

SEQ ID NO: 876273 - DNA, 16 bp, Homo sapiens
ggcgggtgatggccag

SEQ ID NO: 876274 - DNA, 20 bp, Homo sapiens
ggcgggtggatcacgaggtc

SEQ ID NO: 876275 - DNA, 14 bp, Homo sapiens
ggcggtcccagctc

SEQ ID NO: 876276 - DNA, 15 bp, Homo sapiens
ggcggtcccagctcc

SEQ ID NO: 876277 - DNA, 13 bp, Homo sapiens
ggcggtggctgcc

SEQ ID NO: 876278 - DNA, 14 bp, Homo sapiens
ggcggtggctgccc

SEQ ID NO: 876279 - DNA, 21 bp, Homo sapiens
ggcgtccgcgcgccagcacag

SEQ ID NO: 876280 - DNA, 12 bp, Homo sapiens
ggcgtctccccc

SEQ ID NO: 876281 - DNA, 17 bp, Homo sapiens
ggcgtctcccccagagt

SEQ ID NO: 876282 - DNA, 20 bp, Homo sapiens
ggcgtctgactccctcccca

SEQ ID NO: 876283 - DNA, 21 bp, Homo sapiens
ggcgtctgttcccccttcaca

SEQ ID NO: 876284 - DNA, 12 bp, Homo sapiens
ggcgtctgttct

SEQ ID NO: 876285 - DNA, 19 bp, Homo sapiens
ggcgtcttcatctccctgc

SEQ ID NO: 876286 - DNA, 20 bp, Homo sapiens
ggcgtcttcatctccctgcc

SEQ ID NO: 876287 - DNA, 17 bp, Homo sapiens
ggcgtgactcacccaag

SEQ ID NO: 876288 - DNA, 12 bp, Homo sapiens
ggcgtgatctcg

SEQ ID NO: 876289 - DNA, 18 bp, Homo sapiens
ggcgtgcccccctcctcc

SEQ ID NO: 876290 - DNA, 15 bp, Homo sapiens
ggcgtgccctggagg

SEQ ID NO: 876291 - DNA, 19 bp, Homo sapiens
ggcgtggagccagggagcg

SEQ ID NO: 876292 - DNA, 15 bp, Homo sapiens
ggcgtggaggagagg

SEQ ID NO: 876293 - DNA, 16 bp, Homo sapiens
ggctcccctctgcttc

SEQ ID NO: 876294 - DNA, 16 bp, Homo sapiens
ggctcccgggggcccc

SEQ ID NO: 876295 - DNA, 11 bp, Homo sapiens
ggctccctcct

SEQ ID NO: 876296 - DNA, 15 bp, Homo sapiens
ggctccctcctccag

SEQ ID NO: 876297 - DNA, 16 bp, Homo sapiens
ggctccctcctccagg

SEQ ID NO: 876298 - DNA, 18 bp, Homo sapiens
ggctccctcctctggcag

SEQ ID NO: 876299 - DNA, 20 bp, Homo sapiens
ggctccctcctctggcaggc

SEQ ID NO: 876300 - DNA, 15 bp, Homo sapiens
ggctccctcctggag

SEQ ID NO: 876301 - DNA, 17 bp, Homo sapiens
ggctccctctctggttt

SEQ ID NO: 876302 - DNA, 18 bp, Homo sapiens
ggctccgagggcggccag

SEQ ID NO: 876303 - DNA, 19 bp, Homo sapiens
ggctccgagggcggccagg

SEQ ID NO: 876304 - DNA, 20 bp, Homo sapiens
ggctccgagggcggccaggg

SEQ ID NO: 876305 - DNA, 15 bp, Homo sapiens
ggctccggcccacag

SEQ ID NO: 876306 - DNA, 12 bp, Homo sapiens
ggctcctcagag

SEQ ID NO: 876307 - DNA, 14 bp, Homo sapiens
ggctcctcagagcg

SEQ ID NO: 876308 - DNA, 23 bp, Homo sapiens
ggctcctccagggtggcagcaac

SEQ ID NO: 876309 - DNA, 17 bp, Homo sapiens
ggctcctcccggtgccc

SEQ ID NO: 876310 - DNA, 20 bp, Homo sapiens
ggctcctccgtctgaccctc

SEQ ID NO: 876311 - DNA, 22 bp, Homo sapiens
ggctcctccgtctgaccctctg

SEQ ID NO: 876312 - DNA, 23 bp, Homo sapiens
ggctcctcctcacccacctctgg

SEQ ID NO: 876313 - DNA, 15 bp, Homo sapiens
ggctcctcgccccca

SEQ ID NO: 876314 - DNA, 17 bp, Homo sapiens
ggctcctcgcccccacc

SEQ ID NO: 876315 - DNA, 11 bp, Homo sapiens
ggctcctgatc

SEQ ID NO: 876316 - DNA, 12 bp, Homo sapiens
ggctcctgccag

SEQ ID NO: 876317 - DNA, 17 bp, Homo sapiens
ggctcctggaaccaatc

SEQ ID NO: 876318 - DNA, 13 bp, Homo sapiens
ggctcctggctgc

SEQ ID NO: 876319 - DNA, 16 bp, Homo sapiens
ggctcctggctgccag

SEQ ID NO: 876320 - DNA, 17 bp, Homo sapiens
ggctcctggctgtgccc

SEQ ID NO: 876321 - DNA, 22 bp, Homo sapiens
ggctcctggctgtgcccagcag

SEQ ID NO: 876322 - DNA, 12 bp, Homo sapiens
ggctcctgggtt

SEQ ID NO: 876323 - DNA, 14 bp, Homo sapiens
ggctcctgttttgc

SEQ ID NO: 876324 - DNA, 21 bp, Homo sapiens
ggctccttcactgaacatgcc

SEQ ID NO: 876325 - DNA, 14 bp, Homo sapiens
ggctccttcccctg

SEQ ID NO: 876326 - DNA, 15 bp, Homo sapiens
ggctccttcccctgc

SEQ ID NO: 876327 - DNA, 19 bp, Homo sapiens
ggctccttgcagcagggct

SEQ ID NO: 876328 - DNA, 13 bp, Homo sapiens
ggctcctttctcc

SEQ ID NO: 876329 - DNA, 20 bp, Homo sapiens
ggctcctttctccagccagc

SEQ ID NO: 876330 - DNA, 21 bp, Homo sapiens
ggctcctttctccagccagca

SEQ ID NO: 876331 - DNA, 22 bp, Homo sapiens
ggctcgattttgtatctgcagg

SEQ ID NO: 876332 - DNA, 13 bp, Homo sapiens
ggctcgcactgcc

SEQ ID NO: 876333 - DNA, 16 bp, Homo sapiens
ggctcgccatgccggg

SEQ ID NO: 876334 - DNA, 17 bp, Homo sapiens
ggctcgccatgccgggg

SEQ ID NO: 876335 - DNA, 18 bp, Homo sapiens
ggctcgccccacccaggg

SEQ ID NO: 876336 - DNA, 23 bp, Homo sapiens
ggctcgctccctgtagctctgcc

SEQ ID NO: 876337 - DNA, 12 bp, Homo sapiens
ggctcggggagg

SEQ ID NO: 876338 - DNA, 17 bp, Homo sapiens
ggctcggggaggcagag

SEQ ID NO: 876339 - DNA, 16 bp, Homo sapiens
ggctcggtggcccagg

SEQ ID NO: 876340 - DNA, 18 bp, Homo sapiens
ggctcgtcagccacctgg

SEQ ID NO: 876341 - DNA, 19 bp, Homo sapiens
ggctctaattcacagtgct

SEQ ID NO: 876342 - DNA, 23 bp, Homo sapiens
ggctctaccttcctgtccctgag

SEQ ID NO: 876343 - DNA, 16 bp, Homo sapiens
ggctctatgcctgcac

SEQ ID NO: 876344 - DNA, 19 bp, Homo sapiens
ggctctccaagtgccagag

SEQ ID NO: 876345 - DNA, 12 bp, Homo sapiens
ggctctccacct

SEQ ID NO: 876346 - DNA, 13 bp, Homo sapiens
ggctctccacctc

SEQ ID NO: 876347 - DNA, 21 bp, Homo sapiens
ggctctccaccttgttacaca

SEQ ID NO: 876348 - DNA, 12 bp, Homo sapiens
ggctctcccacc

SEQ ID NO: 876349 - DNA, 17 bp, Homo sapiens
ggctctcccaccccgcc

SEQ ID NO: 876350 - DNA, 14 bp, Homo sapiens
ggctctcggaaatg

SEQ ID NO: 876351 - DNA, 20 bp, Homo sapiens
ggctctctcacccagcctgg

SEQ ID NO: 876352 - DNA, 12 bp, Homo sapiens
ggctctctccag

SEQ ID NO: 876353 - DNA, 13 bp, Homo sapiens
ggctctctccagg

SEQ ID NO: 876354 - DNA, 18 bp, Homo sapiens
ggctctctctagctcccc

SEQ ID NO: 876355 - DNA, 14 bp, Homo sapiens
ggctctctcttcct

SEQ ID NO: 876356 - DNA, 12 bp, Homo sapiens
ggctctctgacc

SEQ ID NO: 876357 - DNA, 23 bp, Homo sapiens
ggctctctgacgtcaacccaagc

SEQ ID NO: 876358 - DNA, 23 bp, Homo sapiens
ggctctgaacacacacgccagct

SEQ ID NO: 876359 - DNA, 13 bp, Homo sapiens
ggctctgagcagg

SEQ ID NO: 876360 - DNA, 22 bp, Homo sapiens
ggctctgagcaggggcaggcgc

SEQ ID NO: 876361 - DNA, 15 bp, Homo sapiens
ggctctgaggggcac

SEQ ID NO: 876362 - DNA, 20 bp, Homo sapiens
ggctctgcaatgggcactgg

SEQ ID NO: 876363 - DNA, 21 bp, Homo sapiens
ggctctgccaatgtgggctgc

SEQ ID NO: 876364 - DNA, 12 bp, Homo sapiens
ggctctgcccac

SEQ ID NO: 876365 - DNA, 14 bp, Homo sapiens
ggctctgcccacct

SEQ ID NO: 876366 - DNA, 14 bp, Homo sapiens
ggctctgccccctc

SEQ ID NO: 876367 - DNA, 15 bp, Homo sapiens
ggctctgccccctcc

SEQ ID NO: 876368 - DNA, 20 bp, Homo sapiens
ggctctgccccctcccccat

SEQ ID NO: 876369 - DNA, 13 bp, Homo sapiens
ggctctgccccgc

SEQ ID NO: 876370 - DNA, 14 bp, Homo sapiens
ggctctgccccgca

SEQ ID NO: 876371 - DNA, 14 bp, Homo sapiens
ggctctgcccctca

SEQ ID NO: 876372 - DNA, 12 bp, Homo sapiens
ggctctggacct

SEQ ID NO: 876373 - DNA, 16 bp, Homo sapiens
ggctctggacctcagg

SEQ ID NO: 876374 - DNA, 13 bp, Homo sapiens
ggctctggccacc

SEQ ID NO: 876375 - DNA, 21 bp, Homo sapiens
ggctctggccaccctggcccg

SEQ ID NO: 876376 - DNA, 12 bp, Homo sapiens
ggctctgggaga

SEQ ID NO: 876377 - DNA, 19 bp, Homo sapiens
ggctctgggagagccagct

SEQ ID NO: 876378 - DNA, 20 bp, Homo sapiens
ggctctgggagagccagctt

SEQ ID NO: 876379 - DNA, 14 bp, Homo sapiens
ggctctgggctcag

SEQ ID NO: 876380 - DNA, 18 bp, Homo sapiens
ggctctgggctcagggct

SEQ ID NO: 876381 - DNA, 19 bp, Homo sapiens
ggctctgggggacccaggt

SEQ ID NO: 876382 - DNA, 23 bp, Homo sapiens
ggctctgggggacccaggtggga

SEQ ID NO: 876383 - DNA, 14 bp, Homo sapiens
ggctctgtcactcc

SEQ ID NO: 876384 - DNA, 18 bp, Homo sapiens
ggctctgtcactccaggc

SEQ ID NO: 876385 - DNA, 19 bp, Homo sapiens
ggctctgttatcagctggg

SEQ ID NO: 876386 - DNA, 23 bp, Homo sapiens
ggctctgttcggcctttgggtgt

SEQ ID NO: 876387 - DNA, 14 bp, Homo sapiens
ggctcttaagcagc

SEQ ID NO: 876388 - DNA, 22 bp, Homo sapiens
ggctcttaagcagcatggaaaa

SEQ ID NO: 876389 - DNA, 18 bp, Homo sapiens
ggctcttagcagcttcca

SEQ ID NO: 876390 - DNA, 19 bp, Homo sapiens
ggctcttagcagcttccag

SEQ ID NO: 876391 - DNA, 16 bp, Homo sapiens
ggctcttcatctgcct

SEQ ID NO: 876392 - DNA, 19 bp, Homo sapiens
ggctcttcatctgcctgcg

SEQ ID NO: 876393 - DNA, 21 bp, Homo sapiens
ggctcttcatctgcctgcgct

SEQ ID NO: 876394 - DNA, 15 bp, Homo sapiens
ggctcttcctggacc

SEQ ID NO: 876395 - DNA, 16 bp, Homo sapiens
ggctcttcctggacct

SEQ ID NO: 876396 - DNA, 15 bp, Homo sapiens
ggctcttgactactt

SEQ ID NO: 876397 - DNA, 15 bp, Homo sapiens
ggctcttggcttcca

SEQ ID NO: 876398 - DNA, 15 bp, Homo sapiens
ggctctttcagagag

SEQ ID NO: 876399 - DNA, 15 bp, Homo sapiens
ggctctttccttgct

SEQ ID NO: 876400 - DNA, 16 bp, Homo sapiens
ggctctttctctctgc

SEQ ID NO: 876401 - DNA, 20 bp, Homo sapiens
ggctgaaagaggccaatgcc

SEQ ID NO: 876402 - DNA, 16 bp, Homo sapiens
ggctgaaattctcctg

SEQ ID NO: 876403 - DNA, 21 bp, Homo sapiens
ggctgaaattctcctggaggt

SEQ ID NO: 876404 - DNA, 16 bp, Homo sapiens
ggctgaaccctgtgct

SEQ ID NO: 876405 - DNA, 19 bp, Homo sapiens
ggctgaaccctgtgctggt

SEQ ID NO: 876406 - DNA, 21 bp, Homo sapiens
ggctgaaccctgtgctggtgt

SEQ ID NO: 876407 - DNA, 15 bp, Homo sapiens
ggctgaacggggaga

SEQ ID NO: 876408 - DNA, 18 bp, Homo sapiens
ggctgaactacaagtgta

SEQ ID NO: 876409 - DNA, 14 bp, Homo sapiens
ggctgaactgagaa

SEQ ID NO: 876410 - DNA, 19 bp, Homo sapiens
ggctgaactgagaaggcag

SEQ ID NO: 876411 - DNA, 13 bp, Homo sapiens
ggctgaagagagg

SEQ ID NO: 876412 - DNA, 13 bp, Homo sapiens
ggctgaagctgga

SEQ ID NO: 876413 - DNA, 14 bp, Homo sapiens
ggctgaagctggag

SEQ ID NO: 876414 - DNA, 15 bp, Homo sapiens
ggctgaagctggagc

SEQ ID NO: 876415 - DNA, 16 bp, Homo sapiens
ggctgaagctggagca

SEQ ID NO: 876416 - DNA, 17 bp, Homo sapiens
ggctgaagctggagcag

SEQ ID NO: 876417 - DNA, 16 bp, Homo sapiens
ggctgaatagcagaag

SEQ ID NO: 876418 - DNA, 23 bp, Homo sapiens
ggctgacacagaggctggcactg

SEQ ID NO: 876419 - DNA, 18 bp, Homo sapiens
ggctgaccacagcacagc

SEQ ID NO: 876420 - DNA, 19 bp, Homo sapiens
ggctgaccacagcacagcc

SEQ ID NO: 876421 - DNA, 15 bp, Homo sapiens
ggctgaccatgctca

SEQ ID NO: 876422 - DNA, 15 bp, Homo sapiens
ggctgacccagcatc

SEQ ID NO: 876423 - DNA, 17 bp, Homo sapiens
ggctgacccagcatctc

SEQ ID NO: 876424 - DNA, 18 bp, Homo sapiens
ggctgacccagcatctcc

SEQ ID NO: 876425 - DNA, 21 bp, Homo sapiens
ggctgacccagcatctcccag

SEQ ID NO: 876426 - DNA, 23 bp, Homo sapiens
ggctgacccagcatctcccagca

SEQ ID NO: 876427 - DNA, 17 bp, Homo sapiens
ggctgacccagtccctg

SEQ ID NO: 876428 - DNA, 19 bp, Homo sapiens
ggctgacccagtccctggg

SEQ ID NO: 876429 - DNA, 22 bp, Homo sapiens
ggctgacccagtccctggggga

SEQ ID NO: 876430 - DNA, 22 bp, Homo sapiens
ggctgaccccaaagagcctgga

SEQ ID NO: 876431 - DNA, 12 bp, Homo sapiens
ggctgacccctc

SEQ ID NO: 876432 - DNA, 14 bp, Homo sapiens
ggctgacccctctg

SEQ ID NO: 876433 - DNA, 15 bp, Homo sapiens
ggctgacccctctgg

SEQ ID NO: 876434 - DNA, 22 bp, Homo sapiens
ggctgacccctctggtgtgtgg

SEQ ID NO: 876435 - DNA, 21 bp, Homo sapiens
ggctgacctgggcccacagag

SEQ ID NO: 876436 - DNA, 23 bp, Homo sapiens
ggctgacgtgtgagggaggacag

SEQ ID NO: 876437 - DNA, 24 bp, Homo sapiens
ggctgactagaagggccagtcctg

SEQ ID NO: 876438 - DNA, 13 bp, Homo sapiens
ggctgactggggc

SEQ ID NO: 876439 - DNA, 16 bp, Homo sapiens
ggctgactggggctgg

SEQ ID NO: 876440 - DNA, 19 bp, Homo sapiens
ggctgacttctctgaatca

SEQ ID NO: 876441 - DNA, 15 bp, Homo sapiens
ggctgagacaggaga

SEQ ID NO: 876442 - DNA, 18 bp, Homo sapiens
ggctgagacaggagaatc

SEQ ID NO: 876443 - DNA, 13 bp, Homo sapiens
ggctgagactgga

SEQ ID NO: 876444 - DNA, 14 bp, Homo sapiens
ggctgagagcccca

SEQ ID NO: 876445 - DNA, 17 bp, Homo sapiens
ggctgagagccccagct

SEQ ID NO: 876446 - DNA, 15 bp, Homo sapiens
ggctgagatatgaac

SEQ ID NO: 876447 - DNA, 13 bp, Homo sapiens
ggctgagcccctg

SEQ ID NO: 876448 - DNA, 18 bp, Homo sapiens
ggctgagcccctggtctt

SEQ ID NO: 876449 - DNA, 21 bp, Homo sapiens
ggctgagccctgtacccaccc

SEQ ID NO: 876450 - DNA, 22 bp, Homo sapiens
ggctgagcctcgtgtccagact

SEQ ID NO: 876451 - DNA, 15 bp, Homo sapiens
ggctgagcgtggaag

SEQ ID NO: 876452 - DNA, 15 bp, Homo sapiens
ggctgagctgagctt

SEQ ID NO: 876453 - DNA, 13 bp, Homo sapiens
ggctgagctgggg

SEQ ID NO: 876454 - DNA, 14 bp, Homo sapiens
ggctgaggagcagc

SEQ ID NO: 876455 - DNA, 14 bp, Homo sapiens
ggctgaggcagaag

SEQ ID NO: 876456 - DNA, 23 bp, Homo sapiens
ggctgaggcaggagaatggtgtg

SEQ ID NO: 876457 - DNA, 13 bp, Homo sapiens
ggctgaggccacc

SEQ ID NO: 876458 - DNA, 13 bp, Homo sapiens
ggctgaggccaga

SEQ ID NO: 876459 - DNA, 14 bp, Homo sapiens
ggctgaggccagag

SEQ ID NO: 876460 - DNA, 14 bp, Homo sapiens
ggctgaggcctgga

SEQ ID NO: 876461 - DNA, 15 bp, Homo sapiens
ggctgagggacagga

SEQ ID NO: 876462 - DNA, 15 bp, Homo sapiens
ggctgagggagcctg

SEQ ID NO: 876463 - DNA, 13 bp, Homo sapiens
ggctgagggcctg

SEQ ID NO: 876464 - DNA, 16 bp, Homo sapiens
ggctgagggcctgctg

SEQ ID NO: 876465 - DNA, 14 bp, Homo sapiens
ggctgaggggcctg

SEQ ID NO: 876466 - DNA, 19 bp, Homo sapiens
ggctgaggggcctgcgccc

SEQ ID NO: 876467 - DNA, 23 bp, Homo sapiens
ggctgagggtgcccttttccagc

SEQ ID NO: 876468 - DNA, 13 bp, Homo sapiens
ggctgaggtggga

SEQ ID NO: 876469 - DNA, 14 bp, Homo sapiens
ggctgaggttcctc

SEQ ID NO: 876470 - DNA, 18 bp, Homo sapiens
ggctgaggttcctctgcc

SEQ ID NO: 876471 - DNA, 20 bp, Homo sapiens
ggctgaggttcctctgcctg

SEQ ID NO: 876472 - DNA, 13 bp, Homo sapiens
ggctgagtgcagc

SEQ ID NO: 876473 - DNA, 20 bp, Homo sapiens
ggctgagtggaatgcaggga

SEQ ID NO: 876474 - DNA, 17 bp, Homo sapiens
ggctgagtggggagcag

SEQ ID NO: 876475 - DNA, 19 bp, Homo sapiens
ggctgatttggagtgagcc

SEQ ID NO: 876476 - DNA, 18 bp, Homo sapiens
ggctgcaaaactggaagc

SEQ ID NO: 876477 - DNA, 17 bp, Homo sapiens
ggctgcacaacagccct

SEQ ID NO: 876478 - DNA, 15 bp, Homo sapiens
ggctgcacaggctga

SEQ ID NO: 876479 - DNA, 21 bp, Homo sapiens
ggctgcacattgcctgttctg

SEQ ID NO: 876480 - DNA, 17 bp, Homo sapiens
ggctgcacccctgggcc

SEQ ID NO: 876481 - DNA, 19 bp, Homo sapiens
ggctgcacccctgggccag

SEQ ID NO: 876482 - DNA, 13 bp, Homo sapiens
ggctgcacctcct

SEQ ID NO: 876483 - DNA, 15 bp, Homo sapiens
ggctgcacgctcccc

SEQ ID NO: 876484 - DNA, 17 bp, Homo sapiens
ggctgcacgctcccctc

SEQ ID NO: 876485 - DNA, 13 bp, Homo sapiens
ggctgcactgcag

SEQ ID NO: 876486 - DNA, 12 bp, Homo sapiens
ggctgcagagcc

SEQ ID NO: 876487 - DNA, 18 bp, Homo sapiens
ggctgcagagcccggccc

SEQ ID NO: 876488 - DNA, 18 bp, Homo sapiens
ggctgcagagctgaccca

SEQ ID NO: 876489 - DNA, 13 bp, Homo sapiens
ggctgcagaggcc

SEQ ID NO: 876490 - DNA, 21 bp, Homo sapiens
ggctgcctcggactccatggc

SEQ ID NO: 876491 - DNA, 11 bp, Homo sapiens
ggctgcctgcc

SEQ ID NO: 876492 - DNA, 12 bp, Homo sapiens
ggctgcctgccc

SEQ ID NO: 876493 - DNA, 15 bp, Homo sapiens
ggctgcctgcccctg

SEQ ID NO: 876494 - DNA, 13 bp, Homo sapiens
ggctgcctgccgc

SEQ ID NO: 876495 - DNA, 16 bp, Homo sapiens
ggctgcctgccgccca

SEQ ID NO: 876496 - DNA, 15 bp, Homo sapiens
ggctgccttgctgtt

SEQ ID NO: 876497 - DNA, 19 bp, Homo sapiens
ggctgcctttgatcacagg

SEQ ID NO: 876498 - DNA, 20 bp, Homo sapiens
ggctgcctttgatcacagga

SEQ ID NO: 876499 - DNA, 14 bp, Homo sapiens
ggctgcgcactgtg

SEQ ID NO: 876500 - DNA, 21 bp, Homo sapiens
ggctgcgcccccagcttctct

SEQ ID NO: 876501 - DNA, 14 bp, Homo sapiens
ggctgcgctagcag

SEQ ID NO: 876502 - DNA, 20 bp, Homo sapiens
ggctgcgctagcagcccttg

SEQ ID NO: 876503 - DNA, 22 bp, Homo sapiens
ggctgcgctagcagcccttgtg

SEQ ID NO: 876504 - DNA, 12 bp, Homo sapiens
ggctgcggcccc

SEQ ID NO: 876505 - DNA, 20 bp, Homo sapiens
ggctgctccagtgggcaggg

SEQ ID NO: 876506 - DNA, 15 bp, Homo sapiens
ggctgctcctccagg

SEQ ID NO: 876507 - DNA, 23 bp, Homo sapiens
ggctgctcggcttgatcacagct

SEQ ID NO: 876508 - DNA, 15 bp, Homo sapiens
ggctgctgcaggccg

SEQ ID NO: 876509 - DNA, 14 bp, Homo sapiens
ggctgctgcttctg

SEQ ID NO: 876510 - DNA, 12 bp, Homo sapiens
ggctgctggcca

SEQ ID NO: 876511 - DNA, 12 bp, Homo sapiens
ggctgctgggcg

SEQ ID NO: 876512 - DNA, 20 bp, Homo sapiens
ggctgctgggcgtctgttct

SEQ ID NO: 876513 - DNA, 14 bp, Homo sapiens
ggctgcttagaatc

SEQ ID NO: 876514 - DNA, 14 bp, Homo sapiens
ggctgcttcaaaga

SEQ ID NO: 876515 - DNA, 13 bp, Homo sapiens
ggctgcttcctcc

SEQ ID NO: 876516 - DNA, 15 bp, Homo sapiens
ggctgcttcctcctg

SEQ ID NO: 876517 - DNA, 16 bp, Homo sapiens
ggctgcttcctcctgg

SEQ ID NO: 876518 - DNA, 24 bp, Homo sapiens
ggctgcttctctacagaggtgaaa

SEQ ID NO: 876519 - DNA, 14 bp, Homo sapiens
ggctgcttgcagcc

SEQ ID NO: 876520 - DNA, 15 bp, Homo sapiens
ggctgcttgcagcca

SEQ ID NO: 876521 - DNA, 20 bp, Homo sapiens
ggctgcttttcttaagtgcc

SEQ ID NO: 876522 - DNA, 10 bp, Homo sapiens
ggctggaaga

SEQ ID NO: 876523 - DNA, 15 bp, Homo sapiens
ggctggaatctcatg

SEQ ID NO: 876524 - DNA, 17 bp, Homo sapiens
ggctggaatgagggagg

SEQ ID NO: 876525 - DNA, 18 bp, Homo sapiens
ggctggaatgagggaggc

SEQ ID NO: 876526 - DNA, 19 bp, Homo sapiens
ggctggaatgggagacctg

SEQ ID NO: 876527 - DNA, 15 bp, Homo sapiens
ggctggacgtggtgg

SEQ ID NO: 876528 - DNA, 12 bp, Homo sapiens
ggctggactgga

SEQ ID NO: 876529 - DNA, 14 bp, Homo sapiens
ggctggactggagg

SEQ ID NO: 876530 - DNA, 20 bp, Homo sapiens
ggctggagataacagcctct

SEQ ID NO: 876531 - DNA, 15 bp, Homo sapiens
ggctggagcctgggg

SEQ ID NO: 876532 - DNA, 16 bp, Homo sapiens
ggctggagcctggggt

SEQ ID NO: 876533 - DNA, 18 bp, Homo sapiens
ggctggagcggggatctg

SEQ ID NO: 876534 - DNA, 13 bp, Homo sapiens
ggctggagctggc

SEQ ID NO: 876535 - DNA, 19 bp, Homo sapiens
ggctggaggcagggccttg

SEQ ID NO: 876536 - DNA, 17 bp, Homo sapiens
ggctggagtaatcagat

SEQ ID NO: 876537 - DNA, 18 bp, Homo sapiens
ggctggagtcctctccag

SEQ ID NO: 876538 - DNA, 17 bp, Homo sapiens
ggctggagtgcagtggc

SEQ ID NO: 876539 - DNA, 20 bp, Homo sapiens
ggctggagtgcggtggcgca

SEQ ID NO: 876540 - DNA, 19 bp, Homo sapiens
ggctggagtggagtggcgt

SEQ ID NO: 876541 - DNA, 14 bp, Homo sapiens
ggctggatggacag

SEQ ID NO: 876542 - DNA, 18 bp, Homo sapiens
ggctggatggacagacac

SEQ ID NO: 876543 - DNA, 15 bp, Homo sapiens
ggctggatgtggtgg

SEQ ID NO: 876544 - DNA, 18 bp, Homo sapiens
ggctggatgtggtggcat

SEQ ID NO: 876545 - DNA, 19 bp, Homo sapiens
ggctggcaagataaacact

SEQ ID NO: 876546 - DNA, 15 bp, Homo sapiens
ggctggcaagcaggg

SEQ ID NO: 876547 - DNA, 13 bp, Homo sapiens
ggctggcacagga

SEQ ID NO: 876548 - DNA, 15 bp, Homo sapiens
ggctggcacaggaca

SEQ ID NO: 876549 - DNA, 19 bp, Homo sapiens
ggctggcacgtgacaggct

SEQ ID NO: 876550 - DNA, 18 bp, Homo sapiens
ggctggcagctctccagt

SEQ ID NO: 876551 - DNA, 17 bp, Homo sapiens
ggctggcagctgagagc

SEQ ID NO: 876552 - DNA, 14 bp, Homo sapiens
ggctggcaggtatg

SEQ ID NO: 876553 - DNA, 12 bp, Homo sapiens
ggctggccagca

SEQ ID NO: 876554 - DNA, 14 bp, Homo sapiens
ggctggccagcaag

SEQ ID NO: 876555 - DNA, 20 bp, Homo sapiens
ggctggccagtccaggctgc

SEQ ID NO: 876556 - DNA, 12 bp, Homo sapiens
ggctggccctgt

SEQ ID NO: 876557 - DNA, 14 bp, Homo sapiens
ggctggcctgagca

SEQ ID NO: 876558 - DNA, 15 bp, Homo sapiens
ggctggcctggaggc

SEQ ID NO: 876559 - DNA, 21 bp, Homo sapiens
ggctggcctggaggctcagcc

SEQ ID NO: 876560 - DNA, 13 bp, Homo sapiens
ggctggccttcct

SEQ ID NO: 876561 - DNA, 13 bp, Homo sapiens
ggctggcctttca

SEQ ID NO: 876562 - DNA, 17 bp, Homo sapiens
ggctggcgcagccaagg

SEQ ID NO: 876563 - DNA, 14 bp, Homo sapiens
ggctggctcccagg

SEQ ID NO: 876564 - DNA, 16 bp, Homo sapiens
ggctggctcccagggt

SEQ ID NO: 876565 - DNA, 15 bp, Homo sapiens
ggctggctcctgatc

SEQ ID NO: 876566 - DNA, 16 bp, Homo sapiens
ggctggctgcttgcag

SEQ ID NO: 876567 - DNA, 21 bp, Homo sapiens
ggctgggaacatgacccagcc

SEQ ID NO: 876568 - DNA, 21 bp, Homo sapiens
ggctgggaatggaggggcaga

SEQ ID NO: 876569 - DNA, 23 bp, Homo sapiens
ggctgggacttcttacccaaagc

SEQ ID NO: 876570 - DNA, 17 bp, Homo sapiens
ggctgggagcctcgccc

SEQ ID NO: 876571 - DNA, 17 bp, Homo sapiens
ggctgggaggaggaaga

SEQ ID NO: 876572 - DNA, 14 bp, Homo sapiens
ggctgggagtccct

SEQ ID NO: 876573 - DNA, 15 bp, Homo sapiens
ggctgggagtcccta

SEQ ID NO: 876574 - DNA, 22 bp, Homo sapiens
ggctgggcaccgtgtcctcctc

SEQ ID NO: 876575 - DNA, 23 bp, Homo sapiens
ggctgggcaccgtgtcctcctct

SEQ ID NO: 876576 - DNA, 11 bp, Homo sapiens
ggctgggccat

SEQ ID NO: 876577 - DNA, 18 bp, Homo sapiens
ggcttatgagatctaatg

SEQ ID NO: 876578 - DNA, 23 bp, Homo sapiens
ggcttatgatgagccatattaat

SEQ ID NO: 876579 - DNA, 14 bp, Homo sapiens
ggcttatgtcatca

SEQ ID NO: 876580 - DNA, 21 bp, Homo sapiens
ggcttatgtcatcagtaaagt

SEQ ID NO: 876581 - DNA, 21 bp, Homo sapiens
ggcttcaagttgtaaaaatga

SEQ ID NO: 876582 - DNA, 16 bp, Homo sapiens
ggcttcaccagtctgt

SEQ ID NO: 876583 - DNA, 20 bp, Homo sapiens
ggcttcacggaagagccttg

SEQ ID NO: 876584 - DNA, 13 bp, Homo sapiens
ggcttcagcactt

SEQ ID NO: 876585 - DNA, 16 bp, Homo sapiens
ggcttcatgccagcta

SEQ ID NO: 876586 - DNA, 11 bp, Homo sapiens
ggcttcatttc

SEQ ID NO: 876587 - DNA, 13 bp, Homo sapiens
ggcttccagagag

SEQ ID NO: 876588 - DNA, 20 bp, Homo sapiens
ggcttccagagagtcctctg

SEQ ID NO: 876589 - DNA, 18 bp, Homo sapiens
ggcttccaggctcttcct

SEQ ID NO: 876590 - DNA, 21 bp, Homo sapiens
ggcttccaggtatctccagga

SEQ ID NO: 876591 - DNA, 18 bp, Homo sapiens
ggcttccatttgtgtgtg

SEQ ID NO: 876592 - DNA, 19 bp, Homo sapiens
ggcttcccaggctgggctc

SEQ ID NO: 876593 - DNA, 16 bp, Homo sapiens
ggcttcccgctcagcc

SEQ ID NO: 876594 - DNA, 17 bp, Homo sapiens
ggcttcccgctcagccc

SEQ ID NO: 876595 - DNA, 18 bp, Homo sapiens
ggcttcccgctcagccct

SEQ ID NO: 876596 - DNA, 18 bp, Homo sapiens
ggcttccctaaactgcag

SEQ ID NO: 876597 - DNA, 19 bp, Homo sapiens
ggcttcctccgtccaccca

SEQ ID NO: 876598 - DNA, 20 bp, Homo sapiens
ggcttcctccgtccacccag

SEQ ID NO: 876599 - DNA, 23 bp, Homo sapiens
ggcttcctccgtccacccaggct

SEQ ID NO: 876600 - DNA, 22 bp, Homo sapiens
ggcttcctcttccgggcagaaa

SEQ ID NO: 876601 - DNA, 17 bp, Homo sapiens
ggcttcctgagaaagcc

SEQ ID NO: 876602 - DNA, 23 bp, Homo sapiens
ggcttcggagggccgcagggccc

SEQ ID NO: 876603 - DNA, 21 bp, Homo sapiens
ggcttcgttttcagtcttctg

SEQ ID NO: 876604 - DNA, 13 bp, Homo sapiens
ggcttctcagccc

SEQ ID NO: 876605 - DNA, 15 bp, Homo sapiens
ggcttctcagcccct

SEQ ID NO: 876606 - DNA, 16 bp, Homo sapiens
ggcttctccgccagcc

SEQ ID NO: 876607 - DNA, 12 bp, Homo sapiens
ggcttctccttc

SEQ ID NO: 876608 - DNA, 13 bp, Homo sapiens
ggcttctctccac

SEQ ID NO: 876609 - DNA, 15 bp, Homo sapiens
ggcttctctccacag

SEQ ID NO: 876610 - DNA, 18 bp, Homo sapiens
ggcttctctccacagtgt

SEQ ID NO: 876611 - DNA, 13 bp, Homo sapiens
ggcttctctgtct

SEQ ID NO: 876612 - DNA, 21 bp, Homo sapiens
ggcttctgagtttatattctg

SEQ ID NO: 876613 - DNA, 15 bp, Homo sapiens
ggcttctgcaccctc

SEQ ID NO: 876614 - DNA, 18 bp, Homo sapiens
ggcttctgcaccctccac

SEQ ID NO: 876615 - DNA, 17 bp, Homo sapiens
ggcttctgggacctgtg

SEQ ID NO: 876616 - DNA, 13 bp, Homo sapiens
ggcttctgtgcac

SEQ ID NO: 876617 - DNA, 19 bp, Homo sapiens
ggcttctgttctctgctga

SEQ ID NO: 876618 - DNA, 15 bp, Homo sapiens
ggcttcttaaaaact

SEQ ID NO: 876619 - DNA, 17 bp, Homo sapiens
ggcttcttaaaaactgt

SEQ ID NO: 876620 - DNA, 20 bp, Homo sapiens
ggcttcttcagatcagtgct

SEQ ID NO: 876621 - DNA, 18 bp, Homo sapiens
ggcttcttggaccttggc

SEQ ID NO: 876622 - DNA, 13 bp, Homo sapiens
ggcttgaagccaa

SEQ ID NO: 876623 - DNA, 17 bp, Homo sapiens
ggcttgactcaggattt

SEQ ID NO: 876624 - DNA, 14 bp, Homo sapiens
ggcttgactggatg

SEQ ID NO: 876625 - DNA, 17 bp, Homo sapiens
ggcttgaggtgaatttc

SEQ ID NO: 876626 - DNA, 17 bp, Homo sapiens
ggcttgatcacagctcc

SEQ ID NO: 876627 - DNA, 23 bp, Homo sapiens
ggcttgcaagtatgttttagcat

SEQ ID NO: 876628 - DNA, 14 bp, Homo sapiens
ggcttgccacaccc

SEQ ID NO: 876629 - DNA, 17 bp, Homo sapiens
ggcttgccccactctgc

SEQ ID NO: 876630 - DNA, 23 bp, Homo sapiens
ggcttgccccaggactctggcac

SEQ ID NO: 876631 - DNA, 16 bp, Homo sapiens
ggcttgcctgggctgg

SEQ ID NO: 876632 - DNA, 14 bp, Homo sapiens
ggcttgctccaggg

SEQ ID NO: 876633 - DNA, 17 bp, Homo sapiens
ggcttggacttcctggg

SEQ ID NO: 876634 - DNA, 12 bp, Homo sapiens
ggcttggaggaa

SEQ ID NO: 876635 - DNA, 15 bp, Homo sapiens
ggcttggatcctggg

SEQ ID NO: 876636 - DNA, 19 bp, Homo sapiens
ggcttggcatctgtgtgcg

SEQ ID NO: 876637 - DNA, 14 bp, Homo sapiens
ggcttggcctgctg

SEQ ID NO: 876638 - DNA, 15 bp, Homo sapiens
ggcttggcctggaga

SEQ ID NO: 876639 - DNA, 22 bp, Homo sapiens
ggcttgggacatggcacaggcc

SEQ ID NO: 876640 - DNA, 12 bp, Homo sapiens
ggcttgggattt

SEQ ID NO: 876641 - DNA, 23 bp, Homo sapiens
ggcttggggaaaatggccatgca

SEQ ID NO: 876642 - DNA, 22 bp, Homo sapiens
ggcttggggctcacacacctgt

SEQ ID NO: 876643 - DNA, 18 bp, Homo sapiens
ggcttgtaactccaccaa

SEQ ID NO: 876644 - DNA, 17 bp, Homo sapiens
ggcttgtcagagctggg

SEQ ID NO: 876645 - DNA, 15 bp, Homo sapiens
ggcttgtgggctggt

SEQ ID NO: 876646 - DNA, 24 bp, Homo sapiens
ggctttaaagctgagagaccctgg

SEQ ID NO: 876647 - DNA, 16 bp, Homo sapiens
ggctttaagctccagc

SEQ ID NO: 876648 - DNA, 23 bp, Homo sapiens
ggctttcatcctgtgtcccctga

SEQ ID NO: 876649 - DNA, 13 bp, Homo sapiens
ggctttcccagga

SEQ ID NO: 876650 - DNA, 14 bp, Homo sapiens
ggctttcggggagg

SEQ ID NO: 876651 - DNA, 24 bp, Homo sapiens
ggctttctccggggtctgtgctgt

SEQ ID NO: 876652 - DNA, 14 bp, Homo sapiens
ggctttctcctgga

SEQ ID NO: 876653 - DNA, 20 bp, Homo sapiens
ggctttctctgcctctgggc

SEQ ID NO: 876654 - DNA, 23 bp, Homo sapiens
ggctttctctgcctctgggcagc

SEQ ID NO: 876655 - DNA, 21 bp, Homo sapiens
ggctttgaaacctcagggctg

SEQ ID NO: 876656 - DNA, 22 bp, Homo sapiens
ggctttgaaacctcagggctgt

SEQ ID NO: 876657 - DNA, 13 bp, Homo sapiens
ggctttgcaggct

SEQ ID NO: 876658 - DNA, 16 bp, Homo sapiens
ggctttgcaggctctg

SEQ ID NO: 876659 - DNA, 17 bp, Homo sapiens
ggctttgcaggctctgg

SEQ ID NO: 876660 - DNA, 19 bp, Homo sapiens
ggctttgcaggctctgggc

SEQ ID NO: 876661 - DNA, 20 bp, Homo sapiens
ggctttgcatagctttcaca

SEQ ID NO: 876662 - DNA, 21 bp, Homo sapiens
ggctttgcatagctttcacaa

SEQ ID NO: 876663 - DNA, 22 bp, Homo sapiens
ggctttgccatgggcctgctgc

SEQ ID NO: 876664 - DNA, 15 bp, Homo sapiens
ggctttgcccacccc

SEQ ID NO: 876665 - DNA, 23 bp, Homo sapiens
ggctttgcccacccctcactccc

SEQ ID NO: 876666 - DNA, 12 bp, Homo sapiens
ggctttgggccc

SEQ ID NO: 876667 - DNA, 13 bp, Homo sapiens
ggctttgggccca

SEQ ID NO: 876668 - DNA, 16 bp, Homo sapiens
ggctttgggcccaaga

SEQ ID NO: 876669 - DNA, 21 bp, Homo sapiens
ggctttgggcccaagaactgc

SEQ ID NO: 876670 - DNA, 21 bp, Homo sapiens
ggctttgggtggctcactact

SEQ ID NO: 876671 - DNA, 14 bp, Homo sapiens
ggctttgttgctgg

SEQ ID NO: 876672 - DNA, 13 bp, Homo sapiens
ggcttttcacccc

SEQ ID NO: 876673 - DNA, 14 bp, Homo sapiens
ggcttttcactgct

SEQ ID NO: 876674 - DNA, 15 bp, Homo sapiens
ggcttttcactgctg

SEQ ID NO: 876675 - DNA, 12 bp, Homo sapiens
ggcttttccttg

SEQ ID NO: 876676 - DNA, 14 bp, Homo sapiens
ggcttttgttctga

SEQ ID NO: 876677 - DNA, 18 bp, Homo sapiens
ggcttttgttctgagggg

SEQ ID NO: 876678 - DNA, 17 bp, Homo sapiens
ggctttttgccatctgt

SEQ ID NO: 876679 - DNA, 17 bp, Homo sapiens
ggctttttgttcagaat

SEQ ID NO: 876680 - DNA, 19 bp, Homo sapiens
ggcttttttaaaaaagcaa

SEQ ID NO: 876681 - DNA, 16 bp, Homo sapiens
gggaaaaaaaaaaaag

SEQ ID NO: 876682 - DNA, 22 bp, Homo sapiens
gggaaaactgccaatatagaaa

SEQ ID NO: 876683 - DNA, 17 bp, Homo sapiens
gggaaaagaccagggct

SEQ ID NO: 876684 - DNA, 23 bp, Homo sapiens
gggaaaagcatttttcaatatat

SEQ ID NO: 876685 - DNA, 17 bp, Homo sapiens
gggaaaattatttgcat

SEQ ID NO: 876686 - DNA, 14 bp, Homo sapiens
gggaaaccttggag

SEQ ID NO: 876687 - DNA, 17 bp, Homo sapiens
gggaaaccttggagagg

SEQ ID NO: 876688 - DNA, 13 bp, Homo sapiens
gggaaagaagaaa

SEQ ID NO: 876689 - DNA, 12 bp, Homo sapiens
gggaaagagaca

SEQ ID NO: 876690 - DNA, 15 bp, Homo sapiens
gggagcaactctcca

SEQ ID NO: 876691 - DNA, 20 bp, Homo sapiens
gggagcacaggtgtctgcct

SEQ ID NO: 876692 - DNA, 11 bp, Homo sapiens
gggagcactgg

SEQ ID NO: 876693 - DNA, 14 bp, Homo sapiens
gggagcactgttca

SEQ ID NO: 876694 - DNA, 14 bp, Homo sapiens
gggagcagagagag

SEQ ID NO: 876695 - DNA, 18 bp, Homo sapiens
gggagcagcttcttgggc

SEQ ID NO: 876696 - DNA, 20 bp, Homo sapiens
gggagcaggaggccaataaa

SEQ ID NO: 876697 - DNA, 19 bp, Homo sapiens
gggagcagttttcccctgg

SEQ ID NO: 876698 - DNA, 22 bp, Homo sapiens
gggagcagttttcccctggcct

SEQ ID NO: 876699 - DNA, 22 bp, Homo sapiens
gggagccaaaatctcaagaaat

SEQ ID NO: 876700 - DNA, 13 bp, Homo sapiens
gggagccagctgc

SEQ ID NO: 876701 - DNA, 14 bp, Homo sapiens
gggagccagctgct

SEQ ID NO: 876702 - DNA, 17 bp, Homo sapiens
gggagccagctgcttga

SEQ ID NO: 876703 - DNA, 23 bp, Homo sapiens
gggggcatctgagtccagctccc

SEQ ID NO: 876704 - DNA, 13 bp, Homo sapiens
gggggccaggcct

SEQ ID NO: 876705 - DNA, 14 bp, Homo sapiens
gggggccatgagct

SEQ ID NO: 876706 - DNA, 23 bp, Homo sapiens
gggggcccgacaggtgggcctgg

SEQ ID NO: 876707 - DNA, 20 bp, Homo sapiens
gggggccttgcggaagccat

SEQ ID NO: 876708 - DNA, 14 bp, Homo sapiens
gggggcgccctctc

SEQ ID NO: 876709 - DNA, 13 bp, Homo sapiens
gggggcgcctgga

SEQ ID NO: 876710 - DNA, 12 bp, Homo sapiens
gggggcgctcag

SEQ ID NO: 876711 - DNA, 13 bp, Homo sapiens
gggggctgctggg

SEQ ID NO: 876712 - DNA, 13 bp, Homo sapiens
gggggctgtggcc

SEQ ID NO: 876713 - DNA, 14 bp, Homo sapiens
gggggcttcttcct

SEQ ID NO: 876714 - DNA, 19 bp, Homo sapiens
gggggctttcggggagggc

SEQ ID NO: 876715 - DNA, 12 bp, Homo sapiens
gggggctttctg

SEQ ID NO: 876716 - DNA, 16 bp, Homo sapiens
ggggggcggtgtcagg

SEQ ID NO: 876717 - DNA, 14 bp, Homo sapiens
gggggtagagctga

SEQ ID NO: 876718 - DNA, 15 bp, Homo sapiens
gggggtagagctgat

SEQ ID NO: 876719 - DNA, 18 bp, Homo sapiens
gggggtcccagtgggagg

SEQ ID NO: 876720 - DNA, 22 bp, Homo sapiens
gggggtcccagtgggaggggca

SEQ ID NO: 876721 - DNA, 12 bp, Homo sapiens
gggggtgactgg

SEQ ID NO: 876722 - DNA, 22 bp, Homo sapiens
gggggtgcaaagactctgagcc

SEQ ID NO: 876723 - DNA, 13 bp, Homo sapiens
gggggtgctggcc

SEQ ID NO: 876724 - DNA, 13 bp, Homo sapiens
gggggtggaggct

SEQ ID NO: 876725 - DNA, 12 bp, Homo sapiens
gggggtggcagg

SEQ ID NO: 876726 - DNA, 15 bp, Homo sapiens
gggggtgtcagaagc

SEQ ID NO: 876727 - DNA, 15 bp, Homo sapiens
gggggttctggcagg

SEQ ID NO: 876728 - DNA, 18 bp, Homo sapiens
gggggttctggcaggacc

SEQ ID NO: 876729 - DNA, 19 bp, Homo sapiens
gggggttctggcaggacct

SEQ ID NO: 876730 - DNA, 19 bp, Homo sapiens
gggggttgcagtggagagg

SEQ ID NO: 876731 - DNA, 17 bp, Homo sapiens
gggggtttcacctgggc

SEQ ID NO: 876732 - DNA, 18 bp, Homo sapiens
ggggtaagccagagcctg

SEQ ID NO: 876733 - DNA, 14 bp, Homo sapiens
ggggtacaggcagt

SEQ ID NO: 876734 - DNA, 19 bp, Homo sapiens
ggggtacaggtttggggag

SEQ ID NO: 876735 - DNA, 19 bp, Homo sapiens
ggggtagaccttgagggtg

SEQ ID NO: 876736 - DNA, 15 bp, Homo sapiens
ggggtagcagctgga

SEQ ID NO: 876737 - DNA, 19 bp, Homo sapiens
ggggtagccccgccccagc

SEQ ID NO: 876738 - DNA, 22 bp, Homo sapiens
ggggtagctagcgtgtgccagg

SEQ ID NO: 876739 - DNA, 19 bp, Homo sapiens
ggggtaggagagcactgcc

SEQ ID NO: 876740 - DNA, 20 bp, Homo sapiens
ggggtaggagagcactgcct

SEQ ID NO: 876741 - DNA, 22 bp, Homo sapiens
ggggtatacagcattgactcag

SEQ ID NO: 876742 - DNA, 20 bp, Homo sapiens
ggggtataggtctcatctct

SEQ ID NO: 876743 - DNA, 14 bp, Homo sapiens
ggggtatgaagagc

SEQ ID NO: 876744 - DNA, 22 bp, Homo sapiens
ggggtatgtgtgtgtgggtgtg

SEQ ID NO: 876745 - DNA, 22 bp, Homo sapiens
ggggtatttaccacagcagctg

SEQ ID NO: 876746 - DNA, 12 bp, Homo sapiens
ggggtcagaaga

SEQ ID NO: 876747 - DNA, 23 bp, Homo sapiens
ggggtcagaagaagtgggagcag

SEQ ID NO: 876748 - DNA, 13 bp, Homo sapiens
ggggtcagcccca

SEQ ID NO: 876749 - DNA, 14 bp, Homo sapiens
ggggtcagccccaa

SEQ ID NO: 876750 - DNA, 23 bp, Homo sapiens
ggggtcagccccaagggctgggg

SEQ ID NO: 876751 - DNA, 20 bp, Homo sapiens
ggggtcaggaacagtggctg

SEQ ID NO: 876752 - DNA, 13 bp, Homo sapiens
ggggtcagtgctg

SEQ ID NO: 876753 - DNA, 18 bp, Homo sapiens
ggggtcatgccctcctct

SEQ ID NO: 876754 - DNA, 12 bp, Homo sapiens
ggggtccaccag

SEQ ID NO: 876755 - DNA, 22 bp, Homo sapiens
ggggtccaccagtgtgtggggg

SEQ ID NO: 876756 - DNA, 14 bp, Homo sapiens
ggggtccaggcccg

SEQ ID NO: 876757 - DNA, 17 bp, Homo sapiens
ggggtccagggagcagg

SEQ ID NO: 876758 - DNA, 14 bp, Homo sapiens
ggggtcctagccca

SEQ ID NO: 876759 - DNA, 14 bp, Homo sapiens
ggggtcctgcaggg

SEQ ID NO: 876760 - DNA, 11 bp, Homo sapiens
ggggtcctggc

SEQ ID NO: 876761 - DNA, 13 bp, Homo sapiens
ggggtcggaagcc

SEQ ID NO: 876762 - DNA, 17 bp, Homo sapiens
ggggtcggacggggcag

SEQ ID NO: 876763 - DNA, 20 bp, Homo sapiens
ggggtctccctctcctgcct

SEQ ID NO: 876764 - DNA, 12 bp, Homo sapiens
ggggtctgggag

SEQ ID NO: 876765 - DNA, 20 bp, Homo sapiens
ggggtctgggagggggtgag

SEQ ID NO: 876766 - DNA, 22 bp, Homo sapiens
ggggtctgggcgtccagctcag

SEQ ID NO: 876767 - DNA, 18 bp, Homo sapiens
ggggtctgtatatacatt

SEQ ID NO: 876768 - DNA, 14 bp, Homo sapiens
ggggtctgtgctgt

SEQ ID NO: 876769 - DNA, 20 bp, Homo sapiens
ggggtgaacagctggtgcca

SEQ ID NO: 876770 - DNA, 21 bp, Homo sapiens
ggggtgacagtcatcatcagg

SEQ ID NO: 876771 - DNA, 18 bp, Homo sapiens
ggggtgacgcctgccctc

SEQ ID NO: 876772 - DNA, 19 bp, Homo sapiens
ggggtgagaggcaggaatg

SEQ ID NO: 876773 - DNA, 16 bp, Homo sapiens
ggggtgagcctgactg

SEQ ID NO: 876774 - DNA, 17 bp, Homo sapiens
ggggtgatttcagagag

SEQ ID NO: 876775 - DNA, 20 bp, Homo sapiens
ggggtgcaaagactctgagc

SEQ ID NO: 876776 - DNA, 16 bp, Homo sapiens
ggggtgcagctgggtg

SEQ ID NO: 876777 - DNA, 20 bp, Homo sapiens
ggggtgccccctcctctccc

SEQ ID NO: 876778 - DNA, 23 bp, Homo sapiens
ggggtgccccctcctctcccatc

SEQ ID NO: 876779 - DNA, 22 bp, Homo sapiens
ggggtgcggcggtcccagctcc

SEQ ID NO: 876780 - DNA, 15 bp, Homo sapiens
gggtagatttctctt

SEQ ID NO: 876781 - DNA, 16 bp, Homo sapiens
gggtagatttctcttg

SEQ ID NO: 876782 - DNA, 20 bp, Homo sapiens
gggtagctagcgtgtgccag

SEQ ID NO: 876783 - DNA, 15 bp, Homo sapiens
gggtaggagagcact

SEQ ID NO: 876784 - DNA, 23 bp, Homo sapiens
gggtatatttttgataccttcaa

SEQ ID NO: 876785 - DNA, 16 bp, Homo sapiens
gggtatcccctgcctc

SEQ ID NO: 876786 - DNA, 22 bp, Homo sapiens
gggtatgtttaatctgttatgt

SEQ ID NO: 876787 - DNA, 17 bp, Homo sapiens
gggtcaaaagagccctg

SEQ ID NO: 876788 - DNA, 19 bp, Homo sapiens
gggtcaaaagagccctggc

SEQ ID NO: 876789 - DNA, 21 bp, Homo sapiens
gggtcaaagacagaatggtgg

SEQ ID NO: 876790 - DNA, 19 bp, Homo sapiens
gggtcaagaaacagccagc

SEQ ID NO: 876791 - DNA, 19 bp, Homo sapiens
gggtcaaggacagggctga

SEQ ID NO: 876792 - DNA, 15 bp, Homo sapiens
gggtcaccctgtgac

SEQ ID NO: 876793 - DNA, 20 bp, Homo sapiens
gggtcacggtggcagtaggg

SEQ ID NO: 876794 - DNA, 19 bp, Homo sapiens
gggtcagaagaagtgggag

SEQ ID NO: 876795 - DNA, 23 bp, Homo sapiens
gggtcagaagaagtgggagcagc

SEQ ID NO: 876796 - DNA, 19 bp, Homo sapiens
gggtcagacgcctgaggaa

SEQ ID NO: 876797 - DNA, 19 bp, Homo sapiens
gggtcagccagggccaggg

SEQ ID NO: 876798 - DNA, 20 bp, Homo sapiens
gggtcagccccaagggctgg

SEQ ID NO: 876799 - DNA, 21 bp, Homo sapiens
gggtcaggaacagtggctggg

SEQ ID NO: 876800 - DNA, 12 bp, Homo sapiens
gggtcaggctcc

SEQ ID NO: 876801 - DNA, 16 bp, Homo sapiens
gggtcaggtgtcaggc

SEQ ID NO: 876802 - DNA, 14 bp, Homo sapiens
gggtcatagaaatt

SEQ ID NO: 876803 - DNA, 15 bp, Homo sapiens
gggtcatcagggagg

SEQ ID NO: 876804 - DNA, 16 bp, Homo sapiens
gggtcatgccctcctc

SEQ ID NO: 876805 - DNA, 20 bp, Homo sapiens
gggtcatgtttgcaggggtg

SEQ ID NO: 876806 - DNA, 21 bp, Homo sapiens
gggtcatgtttgcaggggtga

SEQ ID NO: 876807 - DNA, 11 bp, Homo sapiens
gggtccaggcc

SEQ ID NO: 876808 - DNA, 14 bp, Homo sapiens
gggtccaggcccgt

SEQ ID NO: 876809 - DNA, 13 bp, Homo sapiens
gggtccagggctg

SEQ ID NO: 876810 - DNA, 19 bp, Homo sapiens
gggtccagtggatgccaca

SEQ ID NO: 876811 - DNA, 12 bp, Homo sapiens
gggtccatgggc

SEQ ID NO: 876812 - DNA, 15 bp, Homo sapiens
gggtcccagggctgc

SEQ ID NO: 876813 - DNA, 16 bp, Homo sapiens
gggtcccagtgggagg

SEQ ID NO: 876814 - DNA, 17 bp, Homo sapiens
gggtcccagtgggaggg

SEQ ID NO: 876815 - DNA, 22 bp, Homo sapiens
gggtcccagtgggaggggcagg

SEQ ID NO: 876816 - DNA, 15 bp, Homo sapiens
gggtcccctgccacc

SEQ ID NO: 876817 - DNA, 13 bp, Homo sapiens
gggtccctccacc

SEQ ID NO: 876818 - DNA, 16 bp, Homo sapiens
gggtccctgctcccct

SEQ ID NO: 876819 - DNA, 20 bp, Homo sapiens
gggtccctgctcccctttgg

SEQ ID NO: 876820 - DNA, 17 bp, Homo sapiens
gggtccgcaccagctgc

SEQ ID NO: 876821 - DNA, 18 bp, Homo sapiens
gggtccgcaccagctgct

SEQ ID NO: 876822 - DNA, 22 bp, Homo sapiens
gggtccgcaccagctgctctgc

SEQ ID NO: 876823 - DNA, 20 bp, Homo sapiens
gggtcctaattaccagtctt

SEQ ID NO: 876824 - DNA, 16 bp, Homo sapiens
gggtcctagcccttcc

SEQ ID NO: 876825 - DNA, 18 bp, Homo sapiens
gggtcctagcccttccct

SEQ ID NO: 876826 - DNA, 22 bp, Homo sapiens
gggtcctcacctggttgaccca

SEQ ID NO: 876827 - DNA, 18 bp, Homo sapiens
gggtcctctagcccactc

SEQ ID NO: 876828 - DNA, 23 bp, Homo sapiens
gggtcctgcagcctgcaggacct

SEQ ID NO: 876829 - DNA, 13 bp, Homo sapiens
gggtcctgccctc

SEQ ID NO: 876830 - DNA, 18 bp, Homo sapiens
gggtcctgccctccggag

SEQ ID NO: 876831 - DNA, 13 bp, Homo sapiens
gggtcctggctcc

SEQ ID NO: 876832 - DNA, 23 bp, Homo sapiens
gggtcctgggcaggtgggagctg

SEQ ID NO: 876833 - DNA, 20 bp, Homo sapiens
gggtccttgatgccagaggg

SEQ ID NO: 876834 - DNA, 21 bp, Homo sapiens
gggtccttgatgccagagggc

SEQ ID NO: 876835 - DNA, 23 bp, Homo sapiens
gggtccttgatgccagagggcca

SEQ ID NO: 876836 - DNA, 23 bp, Homo sapiens
gggtcggaacccaagcttagaac

SEQ ID NO: 876837 - DNA, 19 bp, Homo sapiens
gggtcggaagcctgtcctc

SEQ ID NO: 876838 - DNA, 13 bp, Homo sapiens
gggtcggctcctg

SEQ ID NO: 876839 - DNA, 14 bp, Homo sapiens
gggtcggctgacca

SEQ ID NO: 876840 - DNA, 22 bp, Homo sapiens
gggtctaaggagcgctagtgcc

SEQ ID NO: 876841 - DNA, 17 bp, Homo sapiens
gggtctcccctcctgca

SEQ ID NO: 876842 - DNA, 18 bp, Homo sapiens
ttgaaagattttattgta

SEQ ID NO: 876843 - DNA, 21 bp, Homo sapiens
ttgaaaggcattctctgaaga

SEQ ID NO: 876844 - DNA, 14 bp, Homo sapiens
ttgaaagtttaaca

SEQ ID NO: 876845 - DNA, 21 bp, Homo sapiens
ttgaaataagaattcagacat

SEQ ID NO: 876846 - DNA, 20 bp, Homo sapiens
ttgaaataaggagggacatg

SEQ ID NO: 876847 - DNA, 15 bp, Homo sapiens
ttgaaataataaatc

SEQ ID NO: 876848 - DNA, 18 bp, Homo sapiens
ttgaaatatataatattc

SEQ ID NO: 876849 - DNA, 16 bp, Homo sapiens
ttgaaatatgcatact

SEQ ID NO: 876850 - DNA, 21 bp, Homo sapiens
ttgaaatatggtcttttggtt

SEQ ID NO: 876851 - DNA, 18 bp, Homo sapiens
ttgaaatattcagaaatt

SEQ ID NO: 876852 - DNA, 19 bp, Homo sapiens
ttgaaatcaatgcaagagt

SEQ ID NO: 876853 - DNA, 15 bp, Homo sapiens
ttgaaatcagcatga

SEQ ID NO: 876854 - DNA, 15 bp, Homo sapiens
ttgaaatggcattta

SEQ ID NO: 876855 - DNA, 13 bp, Homo sapiens
ttgaaatgggcat

SEQ ID NO: 876856 - DNA, 17 bp, Homo sapiens
ttgaaatgtaaggctgt

SEQ ID NO: 876857 - DNA, 20 bp, Homo sapiens
ttgaaatgtaaggctgtgta

SEQ ID NO: 876858 - DNA, 21 bp, Homo sapiens
ttgaaatgtaaggctgtgtaa

SEQ ID NO: 876859 - DNA, 21 bp, Homo sapiens
ttgaaatgtataattaactta

SEQ ID NO: 876860 - DNA, 19 bp, Homo sapiens
ttgaaatgtgtttctgtat

SEQ ID NO: 876861 - DNA, 13 bp, Homo sapiens
ttgaaattctatt

SEQ ID NO: 876862 - DNA, 15 bp, Homo sapiens
ttgaaattgtacata

SEQ ID NO: 876863 - DNA, 16 bp, Homo sapiens
ttgaaattgtagtgca

SEQ ID NO: 876864 - DNA, 16 bp, Homo sapiens
ttgaaatttactgtga

SEQ ID NO: 876865 - DNA, 22 bp, Homo sapiens
ttgaacacaattgatacttcag

SEQ ID NO: 876866 - DNA, 11 bp, Homo sapiens
ttgaacactgg

SEQ ID NO: 876867 - DNA, 23 bp, Homo sapiens
ttgaacagctgtgagccatgcct

SEQ ID NO: 876868 - DNA, 22 bp, Homo sapiens
ttgaacattaatccacatgttt

SEQ ID NO: 876869 - DNA, 15 bp, Homo sapiens
ttgaaccaacatctt

SEQ ID NO: 876870 - DNA, 21 bp, Homo sapiens
ttgaaccacgtgaaactgctg

SEQ ID NO: 876871 - DNA, 12 bp, Homo sapiens
ttgaacccagga

SEQ ID NO: 876872 - DNA, 20 bp, Homo sapiens
ttgaaccccctccctgtccc

SEQ ID NO: 876873 - DNA, 22 bp, Homo sapiens
ttgaacgcccccccccacccct

SEQ ID NO: 876874 - DNA, 18 bp, Homo sapiens
ttgaactatgaacactgt

SEQ ID NO: 876875 - DNA, 19 bp, Homo sapiens
ttgaactatgaacactgtc

SEQ ID NO: 876876 - DNA, 15 bp, Homo sapiens
ttgaactctggtggc

SEQ ID NO: 876877 - DNA, 14 bp, Homo sapiens
ttgaactgtaaact

SEQ ID NO: 876878 - DNA, 19 bp, Homo sapiens
ttgaactgttagatgctga

SEQ ID NO: 876879 - DNA, 21 bp, Homo sapiens
ttgaacttagatgttaaatgt

SEQ ID NO: 876880 - DNA, 22 bp, Homo sapiens
ttgaacttagatgttaaatgtt

SEQ ID NO: 876881 - DNA, 16 bp, Homo sapiens
ttgaacttgattgcct

SEQ ID NO: 876882 - DNA, 13 bp, Homo sapiens
ttgaactttagtt

SEQ ID NO: 876883 - DNA, 13 bp, Homo sapiens
ttgaactttgacc

SEQ ID NO: 876884 - DNA, 19 bp, Homo sapiens
ttgaacttttgtactgaat

SEQ ID NO: 876885 - DNA, 21 bp, Homo sapiens
ttgaagaaaagaaaaaacaac

SEQ ID NO: 876886 - DNA, 16 bp, Homo sapiens
ttgaagaactgcaggc

SEQ ID NO: 876887 - DNA, 22 bp, Homo sapiens
ttgaagaagaaccagcccagcc

SEQ ID NO: 876888 - DNA, 22 bp, Homo sapiens
ttgaagaagagaaaatttgaaa

SEQ ID NO: 876889 - DNA, 15 bp, Homo sapiens
ttgaagaatgttaag

SEQ ID NO: 876890 - DNA, 21 bp, Homo sapiens
ttgaagaatgttaagacttga

SEQ ID NO: 876891 - DNA, 19 bp, Homo sapiens
ttgaagacacagcctcccc

SEQ ID NO: 876892 - DNA, 20 bp, Homo sapiens
ttgaagacacagcctccccc

SEQ ID NO: 876893 - DNA, 14 bp, Homo sapiens
ttgaagacgtggac

SEQ ID NO: 876894 - DNA, 20 bp, Homo sapiens
ttgaagacttcaaaatattg

SEQ ID NO: 876895 - DNA, 21 bp, Homo sapiens
ttgaagacttcctctctaccc

SEQ ID NO: 876896 - DNA, 22 bp, Homo sapiens
ttgaagacttcctctctacccc

SEQ ID NO: 876897 - DNA, 20 bp, Homo sapiens
ttgaagatcgttagtatcta

SEQ ID NO: 876898 - DNA, 22 bp, Homo sapiens
ttgaagattaggagaaacacat

SEQ ID NO: 876899 - DNA, 14 bp, Homo sapiens
ttgaagcaaatgtg

SEQ ID NO: 876900 - DNA, 20 bp, Homo sapiens
ttgaagcaactacaacttct

SEQ ID NO: 876901 - DNA, 13 bp, Homo sapiens
ttgaagcaataac

SEQ ID NO: 876902 - DNA, 18 bp, Homo sapiens
ttgaagcagtcttgctct

SEQ ID NO: 876903 - DNA, 19 bp, Homo sapiens
ttgaagcatagctacaatt

SEQ ID NO: 876904 - DNA, 11 bp, Homo sapiens
ttgaagccaaa

SEQ ID NO: 876905 - DNA, 21 bp, Homo sapiens
ttgaagccactgaagctggga

SEQ ID NO: 876906 - DNA, 17 bp, Homo sapiens
ttgaagccatgtctaca

SEQ ID NO: 876907 - DNA, 15 bp, Homo sapiens
ttgaagccttttgtt

SEQ ID NO: 876908 - DNA, 14 bp, Homo sapiens
ttgaagctaagatt

SEQ ID NO: 876909 - DNA, 20 bp, Homo sapiens
ttgaagctgggctgtctctc

SEQ ID NO: 876910 - DNA, 24 bp, Homo sapiens
ttgaagcttgcaccttttcatgta

SEQ ID NO: 876911 - DNA, 21 bp, Homo sapiens
ttgaaggaaatgagtggccag

SEQ ID NO: 876912 - DNA, 18 bp, Homo sapiens
ttgaaggaggtgagggat

SEQ ID NO: 876913 - DNA, 17 bp, Homo sapiens
ttgaaggattgcatcct

SEQ ID NO: 876914 - DNA, 19 bp, Homo sapiens
ttgaaggattgcatcctgc

SEQ ID NO: 876915 - DNA, 14 bp, Homo sapiens
ttgaaggcagtctg

SEQ ID NO: 876916 - DNA, 18 bp, Homo sapiens
ttgaagggtaaagaagtt

SEQ ID NO: 876917 - DNA, 21 bp, Homo sapiens
ttgaagtaaattaaacatttt

SEQ ID NO: 876918 - DNA, 21 bp, Homo sapiens
ttgaagtacagcataagggaa

SEQ ID NO: 876919 - DNA, 16 bp, Homo sapiens
ttgaagtagctctttt

SEQ ID NO: 876920 - DNA, 14 bp, Homo sapiens
ttgaagtatattct

SEQ ID NO: 876921 - DNA, 18 bp, Homo sapiens
ttgaagtattttgctgga

SEQ ID NO: 876922 - DNA, 18 bp, Homo sapiens
ttgaagtcttccctcaga

SEQ ID NO: 876923 - DNA, 18 bp, Homo sapiens
ttgaagtgtaggcagaca

SEQ ID NO: 876924 - DNA, 20 bp, Homo sapiens
ttgaagtgtaggcagacaca

SEQ ID NO: 876925 - DNA, 22 bp, Homo sapiens
ttgaagtgtaggcagacacagg

SEQ ID NO: 876926 - DNA, 22 bp, Homo sapiens
ttgaagtgtcttctgttcccaa

SEQ ID NO: 876927 - DNA, 21 bp, Homo sapiens
ttgaagtgttctgagctgtat

SEQ ID NO: 876928 - DNA, 22 bp, Homo sapiens
ttgaagttgggtgtttccagaa

SEQ ID NO: 876929 - DNA, 23 bp, Homo sapiens
ttgaagttgggtgtttccagaat

SEQ ID NO: 876930 - DNA, 11 bp, Homo sapiens
ttgaagttgtt

SEQ ID NO: 876931 - DNA, 19 bp, Homo sapiens
ttgaagtttcaagttttaa

SEQ ID NO: 876932 - DNA, 22 bp, Homo sapiens
ttgaagtttcaagttttaaagt

SEQ ID NO: 876933 - DNA, 12 bp, Homo sapiens
ttgaagtttgaa

SEQ ID NO: 876934 - DNA, 14 bp, Homo sapiens
ttgaataaaaagtg

SEQ ID NO: 876935 - DNA, 19 bp, Homo sapiens
ttgaataaaaagtgaactt

SEQ ID NO: 876936 - DNA, 21 bp, Homo sapiens
ttgaataaaaagtgaactttt

SEQ ID NO: 876937 - DNA, 20 bp, Homo sapiens
ttgaataaaaatatgtacaa

SEQ ID NO: 876938 - DNA, 23 bp, Homo sapiens
ttgaataatgacagatggtgaag

SEQ ID NO: 876939 - DNA, 13 bp, Homo sapiens
ttgaatacttttt

SEQ ID NO: 876940 - DNA, 17 bp, Homo sapiens
ttgaataggtagtatca

SEQ ID NO: 876941 - DNA, 15 bp, Homo sapiens
ttgaatagtattgtg

SEQ ID NO: 876942 - DNA, 20 bp, Homo sapiens
ttgaatataatatatttgtg

SEQ ID NO: 876943 - DNA, 20 bp, Homo sapiens
ttgaatatacagagccttga

SEQ ID NO: 876944 - DNA, 11 bp, Homo sapiens
ttgaatatatc

SEQ ID NO: 876945 - DNA, 13 bp, Homo sapiens
ttgaatatatgat

SEQ ID NO: 876946 - DNA, 12 bp, Homo sapiens
ttgaatattttt

SEQ ID NO: 876947 - DNA, 15 bp, Homo sapiens
ttgaatcaaagtgat

SEQ ID NO: 876948 - DNA, 17 bp, Homo sapiens
ttgaatcagtataaaca

SEQ ID NO: 876949 - DNA, 17 bp, Homo sapiens
ttgaatccatgcttggg

SEQ ID NO: 876950 - DNA, 15 bp, Homo sapiens
ttgaatctatttaag

SEQ ID NO: 876951 - DNA, 14 bp, Homo sapiens
ttgaatctctgtat

SEQ ID NO: 876952 - DNA, 16 bp, Homo sapiens
ttgaatctctgtatat

SEQ ID NO: 876953 - DNA, 23 bp, Homo sapiens
ttgaatctgattggacattttct

SEQ ID NO: 876954 - DNA, 24 bp, Homo sapiens
ttgaatctgattggacattttctt

SEQ ID NO: 876955 - DNA, 15 bp, Homo sapiens
ttgaatcttctccct

SEQ ID NO: 876956 - DNA, 21 bp, Homo sapiens
ttgaatgaaaaatttaagcat

SEQ ID NO: 876957 - DNA, 18 bp, Homo sapiens
ttgaatgagacctggaac

SEQ ID NO: 876958 - DNA, 15 bp, Homo sapiens
ttgaatgctttttga

SEQ ID NO: 876959 - DNA, 17 bp, Homo sapiens
ttgaatgctttttgaat

SEQ ID NO: 876960 - DNA, 20 bp, Homo sapiens
ttgaatgctttttgaatgtt

SEQ ID NO: 876961 - DNA, 22 bp, Homo sapiens
ttgaatggagattctgattcag

SEQ ID NO: 876962 - DNA, 14 bp, Homo sapiens
ttgaatgtattttg

SEQ ID NO: 876963 - DNA, 12 bp, Homo sapiens
ttgaatgtcttt

SEQ ID NO: 876964 - DNA, 16 bp, Homo sapiens
ttgaatgtcttttgaa

SEQ ID NO: 876965 - DNA, 17 bp, Homo sapiens
ttgaatgtcttttgaat

SEQ ID NO: 876966 - DNA, 15 bp, Homo sapiens
ttctggctcacagga

SEQ ID NO: 876967 - DNA, 11 bp, Homo sapiens
ttctggctgcc

SEQ ID NO: 876968 - DNA, 15 bp, Homo sapiens
ttctggctgtttgag

SEQ ID NO: 876969 - DNA, 14 bp, Homo sapiens
ttctgggaaattga

SEQ ID NO: 876970 - DNA, 14 bp, Homo sapiens
ttctgggagggcag

SEQ ID NO: 876971 - DNA, 11 bp, Homo sapiens
ttctgggcaga

SEQ ID NO: 876972 - DNA, 16 bp, Homo sapiens
ttctgggcagagcctg

SEQ ID NO: 876973 - DNA, 20 bp, Homo sapiens
ttctgggcagagcctgtccc

SEQ ID NO: 876974 - DNA, 15 bp, Homo sapiens
ttctgggctggggcc

SEQ ID NO: 876975 - DNA, 16 bp, Homo sapiens
ttctgggcttcatctg

SEQ ID NO: 876976 - DNA, 19 bp, Homo sapiens
ttctgggctttctcctgga

SEQ ID NO: 876977 - DNA, 20 bp, Homo sapiens
ttctgggctttctcctggag

SEQ ID NO: 876978 - DNA, 22 bp, Homo sapiens
ttctgggctttctcctggagat

SEQ ID NO: 876979 - DNA, 23 bp, Homo sapiens
ttctggggaattactttcctcct

SEQ ID NO: 876980 - DNA, 20 bp, Homo sapiens
ttctggggcaggctgggcca

SEQ ID NO: 876981 - DNA, 21 bp, Homo sapiens
ttctggggcccctttttactc

SEQ ID NO: 876982 - DNA, 19 bp, Homo sapiens
ttctggggggatatttcct

SEQ ID NO: 876983 - DNA, 23 bp, Homo sapiens
ttctgggtagtcccctgttgatt

SEQ ID NO: 876984 - DNA, 16 bp, Homo sapiens
ttctgggtcttttgct

SEQ ID NO: 876985 - DNA, 17 bp, Homo sapiens
ttctgggtcttttgcta

SEQ ID NO: 876986 - DNA, 17 bp, Homo sapiens
ttctgggtgttgaccac

SEQ ID NO: 876987 - DNA, 20 bp, Homo sapiens
ttctgggtttgcccagtcct

SEQ ID NO: 876988 - DNA, 17 bp, Homo sapiens
ttctgggttttctgaaa

SEQ ID NO: 876989 - DNA, 18 bp, Homo sapiens
ttctggtactctcctaga

SEQ ID NO: 876990 - DNA, 13 bp, Homo sapiens
ttctggtaggaag

SEQ ID NO: 876991 - DNA, 15 bp, Homo sapiens
ttctggtatcttgtt

SEQ ID NO: 876992 - DNA, 15 bp, Homo sapiens
ttctggtattcacag

SEQ ID NO: 876993 - DNA, 14 bp, Homo sapiens
ttctggtccctctt

SEQ ID NO: 876994 - DNA, 19 bp, Homo sapiens
ttctggtccctcttctctc

SEQ ID NO: 876995 - DNA, 14 bp, Homo sapiens
ttctggtccttttt

SEQ ID NO: 876996 - DNA, 18 bp, Homo sapiens
ttctggttccaaaccagt

SEQ ID NO: 876997 - DNA, 17 bp, Homo sapiens
ttctggttccagggtcc

SEQ ID NO: 876998 - DNA, 14 bp, Homo sapiens
ttctggttccattt

SEQ ID NO: 876999 - DNA, 21 bp, Homo sapiens
ttcttaaattttgtaggattt

SEQ ID NO: 877000 - DNA, 17 bp, Homo sapiens
ttcttaacaaactcttc

SEQ ID NO: 877001 - DNA, 21 bp, Homo sapiens
ttcttaacacagccttccttc

SEQ ID NO: 877002 - DNA, 14 bp, Homo sapiens
ttcttaacatgctt

SEQ ID NO: 877003 - DNA, 20 bp, Homo sapiens
ttcttaaccctttccagagt

SEQ ID NO: 877004 - DNA, 19 bp, Homo sapiens
ttcttaagcactttgaaaa

SEQ ID NO: 877005 - DNA, 22 bp, Homo sapiens
ttcttaagccctttgctctgga

SEQ ID NO: 877006 - DNA, 23 bp, Homo sapiens
ttcttaagccctttgctctggag

SEQ ID NO: 877007 - DNA, 20 bp, Homo sapiens
ttcttaattattataaaaat

SEQ ID NO: 877008 - DNA, 21 bp, Homo sapiens
ttcttacaaaaagaaatgtca

SEQ ID NO: 877009 - DNA, 16 bp, Homo sapiens
ttcttacaagcttaaa

SEQ ID NO: 877010 - DNA, 20 bp, Homo sapiens
ttcttacaattgcactgctg

SEQ ID NO: 877011 - DNA, 21 bp, Homo sapiens
ttcttacaattgcactgctgt

SEQ ID NO: 877012 - DNA, 13 bp, Homo sapiens
ttcttacacttct

SEQ ID NO: 877013 - DNA, 21 bp, Homo sapiens
ttcttacagcacatcacctct

SEQ ID NO: 877014 - DNA, 14 bp, Homo sapiens
ttcttacccaaagc

SEQ ID NO: 877015 - DNA, 18 bp, Homo sapiens
ttcttactaaacattttg

SEQ ID NO: 877016 - DNA, 22 bp, Homo sapiens
ttcttactattaagcagtaaaa

SEQ ID NO: 877017 - DNA, 14 bp, Homo sapiens
ttcttacttttatt

SEQ ID NO: 877018 - DNA, 23 bp, Homo sapiens
ttcttacttttcctggacttaaa

SEQ ID NO: 877019 - DNA, 15 bp, Homo sapiens
ttcttagaacagtgg

SEQ ID NO: 877020 - DNA, 22 bp, Homo sapiens
ttcttagaacagtggaaactat

SEQ ID NO: 877021 - DNA, 21 bp, Homo sapiens
ttcttagactacatttagaga

SEQ ID NO: 877022 - DNA, 19 bp, Homo sapiens
ttcttagagtgtagctgta

SEQ ID NO: 877023 - DNA, 21 bp, Homo sapiens
ttcttaggagcaagaagaaaa

SEQ ID NO: 877024 - DNA, 17 bp, Homo sapiens
ttcttagggaaggatac

SEQ ID NO: 877025 - DNA, 24 bp, Homo sapiens
ttcttagtccagttgtgttgacac

SEQ ID NO: 877026 - DNA, 18 bp, Homo sapiens
ttcttagtgacacacact

SEQ ID NO: 877027 - DNA, 19 bp, Homo sapiens
tgcagcactttaaccctct

SEQ ID NO: 877028 - DNA, 12 bp, Homo sapiens
tgcagcagagga

SEQ ID NO: 877029 - DNA, 16 bp, Homo sapiens
tgcagcagaggagctg

SEQ ID NO: 877030 - DNA, 15 bp, Homo sapiens
tgcagcagcccagct

SEQ ID NO: 877031 - DNA, 13 bp, Homo sapiens
tgcagcaggagtg

SEQ ID NO: 877032 - DNA, 20 bp, Homo sapiens
tgcagcaggagtggtgcaga

SEQ ID NO: 877033 - DNA, 16 bp, Homo sapiens
tgcagcagggatgccc

SEQ ID NO: 877034 - DNA, 20 bp, Homo sapiens
tgcagcagggcaggaagggg

SEQ ID NO: 877035 - DNA, 12 bp, Homo sapiens
tgcagcagggct

SEQ ID NO: 877036 - DNA, 16 bp, Homo sapiens
tgcagcagggctgggc

SEQ ID NO: 877037 - DNA, 22 bp, Homo sapiens
tgcagcaggtggtaatgataaa

SEQ ID NO: 877038 - DNA, 19 bp, Homo sapiens
tgcagcatgagactttctg

SEQ ID NO: 877039 - DNA, 17 bp, Homo sapiens
tgcagcatgttgctgag

SEQ ID NO: 877040 - DNA, 21 bp, Homo sapiens
tgcagcatgttgctgaggagt

SEQ ID NO: 877041 - DNA, 18 bp, Homo sapiens
tgcagccaaaggggagcc

SEQ ID NO: 877042 - DNA, 16 bp, Homo sapiens
tgcagccaccacatcc

SEQ ID NO: 877043 - DNA, 18 bp, Homo sapiens
tgcagccacgattggaga

SEQ ID NO: 877044 - DNA, 15 bp, Homo sapiens
tgcagccagcccagc

SEQ ID NO: 877045 - DNA, 22 bp, Homo sapiens
tgcagccagcccagcccagctg

SEQ ID NO: 877046 - DNA, 23 bp, Homo sapiens
tgcagccagcccagcccagctgg

SEQ ID NO: 877047 - DNA, 14 bp, Homo sapiens
tgcagccatcccgc

SEQ ID NO: 877048 - DNA, 13 bp, Homo sapiens
tgcagcccaaaac

SEQ ID NO: 877049 - DNA, 14 bp, Homo sapiens
tgcagcccaccagg

SEQ ID NO: 877050 - DNA, 17 bp, Homo sapiens
tgcagcccaccaggagc

SEQ ID NO: 877051 - DNA, 12 bp, Homo sapiens
tgcagccccagg

SEQ ID NO: 877052 - DNA, 16 bp, Homo sapiens
tgcagcccctgggccc

SEQ ID NO: 877053 - DNA, 22 bp, Homo sapiens
tgcagcccggcgccaccatcct

SEQ ID NO: 877054 - DNA, 19 bp, Homo sapiens
tgcagcccgtgtggcccct

SEQ ID NO: 877055 - DNA, 21 bp, Homo sapiens
tgcagcccgtgtggccccttc

SEQ ID NO: 877056 - DNA, 23 bp, Homo sapiens
tgcagcccgtgtggccccttcac

SEQ ID NO: 877057 - DNA, 17 bp, Homo sapiens
tgcagccctcgggaccc

SEQ ID NO: 877058 - DNA, 12 bp, Homo sapiens
tgcagcccttgg

SEQ ID NO: 877059 - DNA, 15 bp, Homo sapiens
tgcagcccttgggca

SEQ ID NO: 877060 - DNA, 18 bp, Homo sapiens
tgcagcccttgggcagtt

SEQ ID NO: 877061 - DNA, 20 bp, Homo sapiens
tgcagcctcaacctcctggg

SEQ ID NO: 877062 - DNA, 14 bp, Homo sapiens
tgcagcctctctgg

SEQ ID NO: 877063 - DNA, 16 bp, Homo sapiens
tgcagcctctctggct

SEQ ID NO: 877064 - DNA, 18 bp, Homo sapiens
tgcagcctgcaggacctc

SEQ ID NO: 877065 - DNA, 13 bp, Homo sapiens
tgcagcctgctgg

SEQ ID NO: 877066 - DNA, 12 bp, Homo sapiens
tgcagcctgggc

SEQ ID NO: 877067 - DNA, 15 bp, Homo sapiens
tgcagcctgggtctg

SEQ ID NO: 877068 - DNA, 14 bp, Homo sapiens
tgcagcctgtggct

SEQ ID NO: 877069 - DNA, 17 bp, Homo sapiens
tgcagcctgtggcttgg

SEQ ID NO: 877070 - DNA, 13 bp, Homo sapiens
tgcagccttcccc

SEQ ID NO: 877071 - DNA, 20 bp, Homo sapiens
tgcagccttgcgctgtccca

SEQ ID NO: 877072 - DNA, 21 bp, Homo sapiens
tgcagccttgcgctgtcccag

SEQ ID NO: 877073 - DNA, 22 bp, Homo sapiens
tgcagccttgcgctgtcccagg

SEQ ID NO: 877074 - DNA, 15 bp, Homo sapiens
tgcagccttggggca

SEQ ID NO: 877075 - DNA, 13 bp, Homo sapiens
tgcagccttttct

SEQ ID NO: 877076 - DNA, 21 bp, Homo sapiens
tgcagccttttctggtccctc

SEQ ID NO: 877077 - DNA, 22 bp, Homo sapiens
tgcagcgggcaaagagctcccg

SEQ ID NO: 877078 - DNA, 15 bp, Homo sapiens
tgcagctactggaat

SEQ ID NO: 877079 - DNA, 13 bp, Homo sapiens
tgcagctatctgg

SEQ ID NO: 877080 - DNA, 20 bp, Homo sapiens
tgcagctcctcagcggctcc

SEQ ID NO: 877081 - DNA, 20 bp, Homo sapiens
tgcagctgacctctgttgtc

SEQ ID NO: 877082 - DNA, 21 bp, Homo sapiens
tgcagctgacctctgttgtcc

SEQ ID NO: 877083 - DNA, 22 bp, Homo sapiens
tgcagctgattttaacaataac

SEQ ID NO: 877084 - DNA, 15 bp, Homo sapiens
tgcagctgcctgggg

SEQ ID NO: 877085 - DNA, 16 bp, Homo sapiens
tgcagctgcctggggc

SEQ ID NO: 877086 - DNA, 19 bp, Homo sapiens
tgcagctgcctggggccca

SEQ ID NO: 877087 - DNA, 12 bp, Homo sapiens
tgcagctggaca

SEQ ID NO: 877088 - DNA, 15 bp, Homo sapiens
tgcagctggacagag

SEQ ID NO: 877089 - DNA, 13 bp, Homo sapiens
tgcagctgggccc

SEQ ID NO: 877090 - DNA, 20 bp, Homo sapiens
tgcagctgggccccatgctc

SEQ ID NO: 877091 - DNA, 16 bp, Homo sapiens
tgcagctgggtggggc

SEQ ID NO: 877092 - DNA, 12 bp, Homo sapiens
tgcagctgtgag

SEQ ID NO: 877093 - DNA, 20 bp, Homo sapiens
tgcagctgtgagtgcgtgtg

SEQ ID NO: 877094 - DNA, 17 bp, Homo sapiens
tgcagctgttgagaaaa

SEQ ID NO: 877095 - DNA, 15 bp, Homo sapiens
tgcagctgttttgtt

SEQ ID NO: 877096 - DNA, 21 bp, Homo sapiens
tgcagctgttttgttgacatt

SEQ ID NO: 877097 - DNA, 15 bp, Homo sapiens
tgcagcttcgaggac

SEQ ID NO: 877098 - DNA, 16 bp, Homo sapiens
tgcagcttcgaggaca

SEQ ID NO: 877099 - DNA, 13 bp, Homo sapiens
tgcagctttatgt

SEQ ID NO: 877100 - DNA, 12 bp, Homo sapiens
tgcaggaaacat

SEQ ID NO: 877101 - DNA, 16 bp, Homo sapiens
tgcaggaacgagcact

SEQ ID NO: 877102 - DNA, 18 bp, Homo sapiens
tgcaggaacgagcactgg

SEQ ID NO: 877103 - DNA, 18 bp, Homo sapiens
tgcaggaagaggcccact

SEQ ID NO: 877104 - DNA, 16 bp, Homo sapiens
tgcaggaataaggcct

SEQ ID NO: 877105 - DNA, 12 bp, Homo sapiens
tgcaggacagct

SEQ ID NO: 877106 - DNA, 14 bp, Homo sapiens
tgcaggacagctct

SEQ ID NO: 877107 - DNA, 17 bp, Homo sapiens
tgcaggacagtcaaggt

SEQ ID NO: 877108 - DNA, 14 bp, Homo sapiens
tgcaggacctcagg

SEQ ID NO: 877109 - DNA, 15 bp, Homo sapiens
tgcaggacctcaggt

SEQ ID NO: 877110 - DNA, 13 bp, Homo sapiens
tgcaggacttgag

SEQ ID NO: 877111 - DNA, 18 bp, Homo sapiens
tgcaggacttgagaagac

SEQ ID NO: 877112 - DNA, 14 bp, Homo sapiens
tgcaggagcctccc

SEQ ID NO: 877113 - DNA, 13 bp, Homo sapiens
tgcaggaggctca

SEQ ID NO: 877114 - DNA, 16 bp, Homo sapiens
tgcaggagggcactgg

SEQ ID NO: 877115 - DNA, 16 bp, Homo sapiens
tgcaggaggtggagaa

SEQ ID NO: 877116 - DNA, 19 bp, Homo sapiens
tgcaggatgattgtacaga

SEQ ID NO: 877117 - DNA, 18 bp, Homo sapiens
tgcaggatggtgtctctt

SEQ ID NO: 877118 - DNA, 17 bp, Homo sapiens
tgcaggattcccttctg

SEQ ID NO: 877119 - DNA, 19 bp, Homo sapiens
tgcaggattcccttctggg

SEQ ID NO: 877120 - DNA, 14 bp, Homo sapiens
tgcaggcagacacg

SEQ ID NO: 877121 - DNA, 14 bp, Homo sapiens
tgcaggcagcacag

SEQ ID NO: 877122 - DNA, 14 bp, Homo sapiens
tgcaggcaggaaca

SEQ ID NO: 877123 - DNA, 17 bp, Homo sapiens
tgcaggcaggcggctcc

SEQ ID NO: 877124 - DNA, 23 bp, Homo sapiens
tgcaggcaggcggctcctcctca

SEQ ID NO: 877125 - DNA, 10 bp, Homo sapiens
tgcaggcccc

SEQ ID NO: 877126 - DNA, 15 bp, Homo sapiens
tgcaggccctccctc

SEQ ID NO: 877127 - DNA, 16 bp, Homo sapiens
tgcaggccctccctct

SEQ ID NO: 877128 - DNA, 15 bp, Homo sapiens
tgcaggccctggcct

SEQ ID NO: 877129 - DNA, 16 bp, Homo sapiens
tgcaggccctggcctc

SEQ ID NO: 877130 - DNA, 17 bp, Homo sapiens
tgcaggcggccctcagt

SEQ ID NO: 877131 - DNA, 18 bp, Homo sapiens
tgcaggcggccctcagtg

SEQ ID NO: 877132 - DNA, 11 bp, Homo sapiens
tgcaggctctg

SEQ ID NO: 877133 - DNA, 12 bp, Homo sapiens
tgcaggctctgg

SEQ ID NO: 877134 - DNA, 21 bp, Homo sapiens
tgcaggctggcaccgccttct

SEQ ID NO: 877135 - DNA, 23 bp, Homo sapiens
tgcaggctggcaccgccttctct

SEQ ID NO: 877136 - DNA, 13 bp, Homo sapiens
tgcaggctgggga

SEQ ID NO: 877137 - DNA, 22 bp, Homo sapiens
tgcagggaaaattatttgcata

SEQ ID NO: 877138 - DNA, 15 bp, Homo sapiens
tgcagggaagagggc

SEQ ID NO: 877139 - DNA, 17 bp, Homo sapiens
tgcagggaagagggcag

SEQ ID NO: 877140 - DNA, 13 bp, Homo sapiens
tgcagggagcact

SEQ ID NO: 877141 - DNA, 14 bp, Homo sapiens
tgcagggagccgag

SEQ ID NO: 877142 - DNA, 12 bp, Homo sapiens
tgcagggaggcc

SEQ ID NO: 877143 - DNA, 13 bp, Homo sapiens
tgcagggaggcca

SEQ ID NO: 877144 - DNA, 18 bp, Homo sapiens
tgcagggaggccacgtcc

SEQ ID NO: 877145 - DNA, 19 bp, Homo sapiens
tgcagggatattgccttat

SEQ ID NO: 877146 - DNA, 21 bp, Homo sapiens
tgcagggatattgccttattt

SEQ ID NO: 877147 - DNA, 12 bp, Homo sapiens
tgcagggcacgg

SEQ ID NO: 877148 - DNA, 20 bp, Homo sapiens
tgcagggcacggggacctgg

SEQ ID NO: 877149 - DNA, 23 bp, Homo sapiens
tgcagggcacggggacctggata

SEQ ID NO: 877150 - DNA, 18 bp, Homo sapiens
tgcagggcgcccctggga

SEQ ID NO: 877151 - DNA, 14 bp, Homo sapiens
tgcagggctcccat

SEQ ID NO: 877152 - DNA, 14 bp, Homo sapiens
tgcagggctggtct

SEQ ID NO: 877153 - DNA, 13 bp, Homo sapiens
tgtgacatttatg

SEQ ID NO: 877154 - DNA, 15 bp, Homo sapiens
tgtgacattttacat

SEQ ID NO: 877155 - DNA, 15 bp, Homo sapiens
tgtgaccaaaatacc

SEQ ID NO: 877156 - DNA, 14 bp, Homo sapiens
tgtgaccaactgtg

SEQ ID NO: 877157 - DNA, 15 bp, Homo sapiens
tgtgaccaactgtgt

SEQ ID NO: 877158 - DNA, 16 bp, Homo sapiens
tgtgaccaatgtcttg

SEQ ID NO: 877159 - DNA, 19 bp, Homo sapiens
tgtgaccaccttctgtccc

SEQ ID NO: 877160 - DNA, 14 bp, Homo sapiens
tgtgaccagcactg

SEQ ID NO: 877161 - DNA, 13 bp, Homo sapiens
tgtgaccattctg

SEQ ID NO: 877162 - DNA, 15 bp, Homo sapiens
tgtgaccattctgcc

SEQ ID NO: 877163 - DNA, 16 bp, Homo sapiens
tgtgacccccagctcc

SEQ ID NO: 877164 - DNA, 11 bp, Homo sapiens
tgtgaccctcc

SEQ ID NO: 877165 - DNA, 15 bp, Homo sapiens
tgtgaccctctcact

SEQ ID NO: 877166 - DNA, 14 bp, Homo sapiens
tgtgaccctctgaa

SEQ ID NO: 877167 - DNA, 15 bp, Homo sapiens
tgtgacctgatttca

SEQ ID NO: 877168 - DNA, 20 bp, Homo sapiens
tgtgacctgatttcagaaga

SEQ ID NO: 877169 - DNA, 23 bp, Homo sapiens
tgtgacctgatttcagaagagac

SEQ ID NO: 877170 - DNA, 17 bp, Homo sapiens
tgtgacgcagacagagg

SEQ ID NO: 877171 - DNA, 19 bp, Homo sapiens
tgtgactagcgcctggcct

SEQ ID NO: 877172 - DNA, 21 bp, Homo sapiens
tgtgactctttcctaaagcca

SEQ ID NO: 877173 - DNA, 23 bp, Homo sapiens
tgtgactctttcctaaagccaaa

SEQ ID NO: 877174 - DNA, 21 bp, Homo sapiens
tgtgactgaagaagatgagcc

SEQ ID NO: 877175 - DNA, 15 bp, Homo sapiens
tgtgactgaatttct

SEQ ID NO: 877176 - DNA, 12 bp, Homo sapiens
tgtgactggatc

SEQ ID NO: 877177 - DNA, 13 bp, Homo sapiens
tgtgactggtcag

SEQ ID NO: 877178 - DNA, 14 bp, Homo sapiens
tgtgacttacaatt

SEQ ID NO: 877179 - DNA, 19 bp, Homo sapiens
tgtgacttcagctctgttt

SEQ ID NO: 877180 - DNA, 19 bp, Homo sapiens
tgtgacttctcccctgccc

SEQ ID NO: 877181 - DNA, 19 bp, Homo sapiens
tgtgacttttctgattaat

SEQ ID NO: 877182 - DNA, 13 bp, Homo sapiens
tgtgagaagccag

SEQ ID NO: 877183 - DNA, 14 bp, Homo sapiens
tgtgagaatcaaaa

SEQ ID NO: 877184 - DNA, 18 bp, Homo sapiens
tgtgagacagtgggaaat

SEQ ID NO: 877185 - DNA, 19 bp, Homo sapiens
tgtgagacagtgggaaata

SEQ ID NO: 877186 - DNA, 13 bp, Homo sapiens
tgtgagagaaagt

SEQ ID NO: 877187 - DNA, 14 bp, Homo sapiens
tgtgagagagactg

SEQ ID NO: 877188 - DNA, 13 bp, Homo sapiens
tgtgagagcccat

SEQ ID NO: 877189 - DNA, 17 bp, Homo sapiens
tgtgagagcgaggctga

SEQ ID NO: 877190 - DNA, 15 bp, Homo sapiens
tgtgagagtgtgagc

SEQ ID NO: 877191 - DNA, 21 bp, Homo sapiens
tgtgagagttgtctctgttgg

SEQ ID NO: 877192 - DNA, 18 bp, Homo sapiens
tgtgagatgtgtatcagt

SEQ ID NO: 877193 - DNA, 21 bp, Homo sapiens
tgtgagattactttgtcccgc

SEQ ID NO: 877194 - DNA, 12 bp, Homo sapiens
tgtgagatttcc

SEQ ID NO: 877195 - DNA, 14 bp, Homo sapiens
tgtgagcaagaagt

SEQ ID NO: 877196 - DNA, 20 bp, Homo sapiens
tgtgagcagggcttgctcct

SEQ ID NO: 877197 - DNA, 14 bp, Homo sapiens
tgtgagcagtgagt

SEQ ID NO: 877198 - DNA, 12 bp, Homo sapiens
tgtgagcagtgg

SEQ ID NO: 877199 - DNA, 17 bp, Homo sapiens
tgtgagcatcctgcaag

SEQ ID NO: 877200 - DNA, 17 bp, Homo sapiens
tgtgagccatgcctccc

SEQ ID NO: 877201 - DNA, 18 bp, Homo sapiens
tgtgagccatgcctccct

SEQ ID NO: 877202 - DNA, 14 bp, Homo sapiens
tgtgagcccagctg

SEQ ID NO: 877203 - DNA, 15 bp, Homo sapiens
tgtgagcccagctgg

SEQ ID NO: 877204 - DNA, 14 bp, Homo sapiens
tgtgagcccctggt

SEQ ID NO: 877205 - DNA, 12 bp, Homo sapiens
tgtgagccctct

SEQ ID NO: 877206 - DNA, 14 bp, Homo sapiens
tgtgagcctatgat

SEQ ID NO: 877207 - DNA, 21 bp, Homo sapiens
tgtgagcctatgatattcccc

SEQ ID NO: 877208 - DNA, 21 bp, Homo sapiens
tgtgagcgcttctgcagcctc

SEQ ID NO: 877209 - DNA, 22 bp, Homo sapiens
tgtgagcgcttctgcagcctcg

SEQ ID NO: 877210 - DNA, 19 bp, Homo sapiens
tgtgagcgtggccttggga

SEQ ID NO: 877211 - DNA, 14 bp, Homo sapiens
tgtgagctctggtt

SEQ ID NO: 877212 - DNA, 11 bp, Homo sapiens
tgtgagctgga

SEQ ID NO: 877213 - DNA, 17 bp, Homo sapiens
tgtgagctgtaaaaatg

SEQ ID NO: 877214 - DNA, 17 bp, Homo sapiens
tgtgaggaggaaaagga

SEQ ID NO: 877215 - DNA, 13 bp, Homo sapiens
tgtgaggcagggg

SEQ ID NO: 877216 - DNA, 13 bp, Homo sapiens
tgtgaggcccctg

SEQ ID NO: 877217 - DNA, 14 bp, Homo sapiens
tgtgaggcctggcc

SEQ ID NO: 877218 - DNA, 18 bp, Homo sapiens
tgtgaggcctggccaggc

SEQ ID NO: 877219 - DNA, 16 bp, Homo sapiens
tgtgaggctgtgtctc

SEQ ID NO: 877220 - DNA, 17 bp, Homo sapiens
tgtgaggcttctaataa

SEQ ID NO: 877221 - DNA, 14 bp, Homo sapiens
tgtgagggagggga

SEQ ID NO: 877222 - DNA, 17 bp, Homo sapiens
tgtgagggtcctgcagc

SEQ ID NO: 877223 - DNA, 15 bp, Homo sapiens
tgtgagtaagagctg

SEQ ID NO: 877224 - DNA, 18 bp, Homo sapiens
tgtgagtcctgttgaaga

SEQ ID NO: 877225 - DNA, 21 bp, Homo sapiens
tgtgagtctccccttgcagcc

SEQ ID NO: 877226 - DNA, 23 bp, Homo sapiens
tgtgagtctccccttgcagcctg

SEQ ID NO: 877227 - DNA, 16 bp, Homo sapiens
tgtgagtgagactgag

SEQ ID NO: 877228 - DNA, 17 bp, Homo sapiens
tgtgagtgccttttgca

SEQ ID NO: 877229 - DNA, 18 bp, Homo sapiens
tgtgagtggataatcagg

SEQ ID NO: 877230 - DNA, 15 bp, Homo sapiens
tgtgagtggcagcca

SEQ ID NO: 877231 - DNA, 20 bp, Homo sapiens
tgtgagtgtgaatataaatg

SEQ ID NO: 877232 - DNA, 19 bp, Homo sapiens
tgtgagtgtgagtgtgaga

SEQ ID NO: 877233 - DNA, 14 bp, Homo sapiens
tgtgagtgtgatgg

SEQ ID NO: 877234 - DNA, 20 bp, Homo sapiens
tgtgagtgtgtccaagtgtg

SEQ ID NO: 877235 - DNA, 14 bp, Homo sapiens
tgtgagtgtgtgca

SEQ ID NO: 877236 - DNA, 15 bp, Homo sapiens
tgtgagtgtgtgtgc

SEQ ID NO: 877237 - DNA, 16 bp, Homo sapiens
tgtgagttctccctgt

SEQ ID NO: 877238 - DNA, 16 bp, Homo sapiens
tgtgatatggcggcct

SEQ ID NO: 877239 - DNA, 19 bp, Homo sapiens
tgtgatattaaatttcaaa

SEQ ID NO: 877240 - DNA, 12 bp, Homo sapiens
tgtgatcaactg

SEQ ID NO: 877241 - DNA, 13 bp, Homo sapiens
tgtgatccagccc

SEQ ID NO: 877242 - DNA, 14 bp, Homo sapiens
tgtgatctgggcat

SEQ ID NO: 877243 - DNA, 15 bp, Homo sapiens
tgtgatctgtgtaca

SEQ ID NO: 877244 - DNA, 19 bp, Homo sapiens
tgtgatctgtgtacaattt

SEQ ID NO: 877245 - DNA, 18 bp, Homo sapiens
tgtgatgaacatattcat

SEQ ID NO: 877246 - DNA, 22 bp, Homo sapiens
tgtgatgaacatattcatgaaa

SEQ ID NO: 877247 - DNA, 14 bp, Homo sapiens
tgtgatgaatactg

SEQ ID NO: 877248 - DNA, 16 bp, Homo sapiens
tgtgatgaatactgta

SEQ ID NO: 877249 - DNA, 19 bp, Homo sapiens
tgtgatgaatcaacaagat

SEQ ID NO: 877250 - DNA, 19 bp, Homo sapiens
tgtgatgccaaagatgttt

SEQ ID NO: 877251 - DNA, 12 bp, Homo sapiens
tgcactccagcc

SEQ ID NO: 877252 - DNA, 20 bp, Homo sapiens
tgcactccagcctgggcaac

SEQ ID NO: 877253 - DNA, 23 bp, Homo sapiens
tgcactccagcttgggtgataaa

SEQ ID NO: 877254 - DNA, 16 bp, Homo sapiens
tgcactccatggccac

SEQ ID NO: 877255 - DNA, 17 bp, Homo sapiens
tgcactccatggccacc

SEQ ID NO: 877256 - DNA, 18 bp, Homo sapiens
tgcactccatggccaccc

SEQ ID NO: 877257 - DNA, 19 bp, Homo sapiens
tgcactcccacctgacaca

SEQ ID NO: 877258 - DNA, 14 bp, Homo sapiens
tgcactcccgacct

SEQ ID NO: 877259 - DNA, 18 bp, Homo sapiens
tgcactccctggccttgc

SEQ ID NO: 877260 - DNA, 19 bp, Homo sapiens
tgcactcctttatctgtaa

SEQ ID NO: 877261 - DNA, 12 bp, Homo sapiens
tgcactcgccat

SEQ ID NO: 877262 - DNA, 17 bp, Homo sapiens
tgcactctaaactgcaa

SEQ ID NO: 877263 - DNA, 16 bp, Homo sapiens
tgcactctagcctggc

SEQ ID NO: 877264 - DNA, 20 bp, Homo sapiens
tgcactcttgaactgggcga

SEQ ID NO: 877265 - DNA, 22 bp, Homo sapiens
tgcactctttaacacattcttt

SEQ ID NO: 877266 - DNA, 20 bp, Homo sapiens
tgcactgaaaacttagccag

SEQ ID NO: 877267 - DNA, 16 bp, Homo sapiens
tgcactgaaacctgag

SEQ ID NO: 877268 - DNA, 20 bp, Homo sapiens
tgcactgaacaggttctctt

SEQ ID NO: 877269 - DNA, 23 bp, Homo sapiens
tgcactgacctgctccgccagga

SEQ ID NO: 877270 - DNA, 17 bp, Homo sapiens
tgcactgacctgtaggt

SEQ ID NO: 877271 - DNA, 19 bp, Homo sapiens
tgcactgagggccacacta

SEQ ID NO: 877272 - DNA, 14 bp, Homo sapiens
tgcactgatgttgt

SEQ ID NO: 877273 - DNA, 21 bp, Homo sapiens
tgcactgatgttgtgttttta

SEQ ID NO: 877274 - DNA, 17 bp, Homo sapiens
tgcactggagccacagg

SEQ ID NO: 877275 - DNA, 22 bp, Homo sapiens
tgcactggagccacaggcaggg

SEQ ID NO: 877276 - DNA, 17 bp, Homo sapiens
tgcactggccttctgat

SEQ ID NO: 877277 - DNA, 16 bp, Homo sapiens
tgcactgggaaggaaa

SEQ ID NO: 877278 - DNA, 17 bp, Homo sapiens
tgcactgggcaggttcc

SEQ ID NO: 877279 - DNA, 22 bp, Homo sapiens
tgcactgggcaggttcctgggg

SEQ ID NO: 877280 - DNA, 16 bp, Homo sapiens
tgcactgtaaatatcc

SEQ ID NO: 877281 - DNA, 21 bp, Homo sapiens
tgcactgtaagacgtatgtaa

SEQ ID NO: 877282 - DNA, 15 bp, Homo sapiens
tgcactgtatgctgg

SEQ ID NO: 877283 - DNA, 17 bp, Homo sapiens
tgcactgtattgctcct

SEQ ID NO: 877284 - DNA, 19 bp, Homo sapiens
tgcactgtcactttgctct

SEQ ID NO: 877285 - DNA, 19 bp, Homo sapiens
tgcactgtcgataatcaga

SEQ ID NO: 877286 - DNA, 12 bp, Homo sapiens
tgcactgtgaac

SEQ ID NO: 877287 - DNA, 12 bp, Homo sapiens
tgcactgtgccc

SEQ ID NO: 877288 - DNA, 15 bp, Homo sapiens
tgcactgtggtttca

SEQ ID NO: 877289 - DNA, 23 bp, Homo sapiens
tgcactgttccccctgtgcagcc

SEQ ID NO: 877290 - DNA, 12 bp, Homo sapiens
tgcactgttttt

SEQ ID NO: 877291 - DNA, 14 bp, Homo sapiens
tgcacttagtagtt

SEQ ID NO: 877292 - DNA, 21 bp, Homo sapiens
tgcactttaattgaagaactg

SEQ ID NO: 877293 - DNA, 21 bp, Homo sapiens
tgcactttagacatttttgtg

SEQ ID NO: 877294 - DNA, 22 bp, Homo sapiens
tgcactttcccccttcccgcct

SEQ ID NO: 877295 - DNA, 17 bp, Homo sapiens
tgcactttccctagaaa

SEQ ID NO: 877296 - DNA, 17 bp, Homo sapiens
tgtgatgccacacagag

SEQ ID NO: 877297 - DNA, 14 bp, Homo sapiens
tgtgatgctgtgtg

SEQ ID NO: 877298 - DNA, 18 bp, Homo sapiens
tgtgatgctgtgtgccca

SEQ ID NO: 877299 - DNA, 18 bp, Homo sapiens
tgtgatggacactccagg

SEQ ID NO: 877300 - DNA, 17 bp, Homo sapiens
tgtgatggatggcacaa

SEQ ID NO: 877301 - DNA, 20 bp, Homo sapiens
tgtgatggatggcacaatga

SEQ ID NO: 877302 - DNA, 18 bp, Homo sapiens
tgtgatgtaccagtttgt

SEQ ID NO: 877303 - DNA, 22 bp, Homo sapiens
tgtgatgtaccagtttgtccat

SEQ ID NO: 877304 - DNA, 20 bp, Homo sapiens
tgtgatgtcatgaaactgta

SEQ ID NO: 877305 - DNA, 22 bp, Homo sapiens
tgtgatgtttggattgatatcg

SEQ ID NO: 877306 - DNA, 22 bp, Homo sapiens
tgtgattaacatctacaatcag

SEQ ID NO: 877307 - DNA, 14 bp, Homo sapiens
tgtgattaacttat

SEQ ID NO: 877308 - DNA, 16 bp, Homo sapiens
tgtgattaacttgctt

SEQ ID NO: 877309 - DNA, 16 bp, Homo sapiens
tgtgattagacagaac

SEQ ID NO: 877310 - DNA, 19 bp, Homo sapiens
tgtgattagatcacatctt

SEQ ID NO: 877311 - DNA, 16 bp, Homo sapiens
tgtgattcaatctgta

SEQ ID NO: 877312 - DNA, 21 bp, Homo sapiens
tgtgattcactgccttcctct

SEQ ID NO: 877313 - DNA, 16 bp, Homo sapiens
tgtgattctaatgtct

SEQ ID NO: 877314 - DNA, 19 bp, Homo sapiens
tgtgattcttctaaagcac

SEQ ID NO: 877315 - DNA, 14 bp, Homo sapiens
tgtgattgacagaa

SEQ ID NO: 877316 - DNA, 16 bp, Homo sapiens
tgtgattgacagaacc

SEQ ID NO: 877317 - DNA, 23 bp, Homo sapiens
tgtgattgacagctttgctgctg

SEQ ID NO: 877318 - DNA, 14 bp, Homo sapiens
tgtgattggcctgt

SEQ ID NO: 877319 - DNA, 15 bp, Homo sapiens
tgtgattggcctgta

SEQ ID NO: 877320 - DNA, 17 bp, Homo sapiens
tgtgattggcctgtaga

SEQ ID NO: 877321 - DNA, 18 bp, Homo sapiens
tgtgattggtaactagga

SEQ ID NO: 877322 - DNA, 18 bp, Homo sapiens
tgtgccccagctgccagg

SEQ ID NO: 877323 - DNA, 14 bp, Homo sapiens
tgtgccccatgcct

SEQ ID NO: 877324 - DNA, 16 bp, Homo sapiens
tgtgccccatgtccaa

SEQ ID NO: 877325 - DNA, 22 bp, Homo sapiens
tgtgcccccagcctcagcccaa

SEQ ID NO: 877326 - DNA, 14 bp, Homo sapiens
tgtgccccctctac

SEQ ID NO: 877327 - DNA, 14 bp, Homo sapiens
tgtgccccctctgg

SEQ ID NO: 877328 - DNA, 17 bp, Homo sapiens
tgtgcccctggcccatc

SEQ ID NO: 877329 - DNA, 19 bp, Homo sapiens
tgtgcccgcatgtgtgcct

SEQ ID NO: 877330 - DNA, 12 bp, Homo sapiens
tgtgccctcctg

SEQ ID NO: 877331 - DNA, 13 bp, Homo sapiens
tgtgccctgggcc

SEQ ID NO: 877332 - DNA, 17 bp, Homo sapiens
tgtgccctgggccaggc

SEQ ID NO: 877333 - DNA, 19 bp, Homo sapiens
tgtgccctgggccaggcag

SEQ ID NO: 877334 - DNA, 19 bp, Homo sapiens
tgtgcctcaggccagggct

SEQ ID NO: 877335 - DNA, 14 bp, Homo sapiens
tgtgcctcccccca

SEQ ID NO: 877336 - DNA, 15 bp, Homo sapiens
tgtgcctccccccag

SEQ ID NO: 877337 - DNA, 18 bp, Homo sapiens
tgtgcctccccccagacc

SEQ ID NO: 877338 - DNA, 17 bp, Homo sapiens
tgtgcctcccttttctc

SEQ ID NO: 877339 - DNA, 15 bp, Homo sapiens
tgtgcctcctagagt

SEQ ID NO: 877340 - DNA, 21 bp, Homo sapiens
tgtgcctcgcatcctatgctt

SEQ ID NO: 877341 - DNA, 21 bp, Homo sapiens
tgtggagcaaaaggcagctca

SEQ ID NO: 877342 - DNA, 16 bp, Homo sapiens
tgtggagcccgcaccc

SEQ ID NO: 877343 - DNA, 18 bp, Homo sapiens
tgtggagcccgcaccccc

SEQ ID NO: 877344 - DNA, 19 bp, Homo sapiens
tgtggagccgaggcctacc

SEQ ID NO: 877345 - DNA, 16 bp, Homo sapiens
tgtggagctcagcccc

SEQ ID NO: 877346 - DNA, 18 bp, Homo sapiens
tgtggaggaagagccacc

SEQ ID NO: 877347 - DNA, 19 bp, Homo sapiens
tgtggaggaagagccacct

SEQ ID NO: 877348 - DNA, 19 bp, Homo sapiens
tgtggagggagtgttcaaa

SEQ ID NO: 877349 - DNA, 22 bp, Homo sapiens
tgtggagttcaccttggaaggg

SEQ ID NO: 877350 - DNA, 19 bp, Homo sapiens
tgtggatgaccacataaga

SEQ ID NO: 877351 - DNA, 14 bp, Homo sapiens
tgtggatgataaaa

SEQ ID NO: 877352 - DNA, 16 bp, Homo sapiens
tgtggatgctccaggg

SEQ ID NO: 877353 - DNA, 15 bp, Homo sapiens
tgtggatgtcttcct

SEQ ID NO: 877354 - DNA, 13 bp, Homo sapiens
tgtggatgtgttc

SEQ ID NO: 877355 - DNA, 18 bp, Homo sapiens
tgtggattataaaaaatg

SEQ ID NO: 877356 - DNA, 20 bp, Homo sapiens
tgtggatttaacagaaatgt

SEQ ID NO: 877357 - DNA, 22 bp, Homo sapiens
tgtggatttaacagaaatgtac

SEQ ID NO: 877358 - DNA, 22 bp, Homo sapiens
tgtggatttgattcattttcct

SEQ ID NO: 877359 - DNA, 23 bp, Homo sapiens
tgtggatttgattcattttcctg

SEQ ID NO: 877360 - DNA, 19 bp, Homo sapiens
tgtggcaaaatatggtttg

SEQ ID NO: 877361 - DNA, 18 bp, Homo sapiens
tgtggcacagatgcccac

SEQ ID NO: 877362 - DNA, 15 bp, Homo sapiens
tgtggcagagttaca

SEQ ID NO: 877363 - DNA, 13 bp, Homo sapiens
tgtggcagcccat

SEQ ID NO: 877364 - DNA, 22 bp, Homo sapiens
tgtggcagccgtcccaggccac

SEQ ID NO: 877365 - DNA, 16 bp, Homo sapiens
tgtggcagtggttttg

SEQ ID NO: 877366 - DNA, 21 bp, Homo sapiens
tgtggcatctttgccttgggc

SEQ ID NO: 877367 - DNA, 15 bp, Homo sapiens
tgtggcattgaaatg

SEQ ID NO: 877368 - DNA, 16 bp, Homo sapiens
tgtggcatttccaaac

SEQ ID NO: 877369 - DNA, 18 bp, Homo sapiens
tgtggccaaccaggaccc

SEQ ID NO: 877370 - DNA, 15 bp, Homo sapiens
tgtggccaaggagct

SEQ ID NO: 877371 - DNA, 17 bp, Homo sapiens
tgtggccaaggagctgc

SEQ ID NO: 877372 - DNA, 18 bp, Homo sapiens
tgtggccaagttcttagt

SEQ ID NO: 877373 - DNA, 13 bp, Homo sapiens
tgtggccagagct

SEQ ID NO: 877374 - DNA, 19 bp, Homo sapiens
tgtggccagagctggaagg

SEQ ID NO: 877375 - DNA, 21 bp, Homo sapiens
tgtggccatcactcagcccct

SEQ ID NO: 877376 - DNA, 22 bp, Homo sapiens
tgtggccatcactcagccccta

SEQ ID NO: 877377 - DNA, 14 bp, Homo sapiens
tgtggccatggcct

SEQ ID NO: 877378 - DNA, 13 bp, Homo sapiens
tgtggccccctgt

SEQ ID NO: 877379 - DNA, 12 bp, Homo sapiens
tgtggccccttc

SEQ ID NO: 877380 - DNA, 19 bp, Homo sapiens
tgtggccccttttactttt

SEQ ID NO: 877381 - DNA, 17 bp, Homo sapiens
tgtggcccgaggaagct

SEQ ID NO: 877382 - DNA, 14 bp, Homo sapiens
tgtggccctgccat

SEQ ID NO: 877383 - DNA, 21 bp, Homo sapiens
tgtggccctgccatcttccca

SEQ ID NO: 877384 - DNA, 22 bp, Homo sapiens
tgtggccctgccatcttcccag

SEQ ID NO: 877385 - DNA, 20 bp, Homo sapiens
tgtggcccttctgtccacca

SEQ ID NO: 877386 - DNA, 18 bp, Homo sapiens
tgtggccgttatctggaa

SEQ ID NO: 877387 - DNA, 12 bp, Homo sapiens
tgtggcctcagc

SEQ ID NO: 877388 - DNA, 17 bp, Homo sapiens
tgtggcctcagccctca

SEQ ID NO: 877389 - DNA, 18 bp, Homo sapiens
tgtggcctccctggctcc

SEQ ID NO: 877390 - DNA, 19 bp, Homo sapiens
tgtggcctccctggctcct

SEQ ID NO: 877391 - DNA, 23 bp, Homo sapiens
tgtggcctccgtcctgtcactga

SEQ ID NO: 877392 - DNA, 17 bp, Homo sapiens
tgtggcctgcccagcct

SEQ ID NO: 877393 - DNA, 17 bp, Homo sapiens
tgtggcctgtggcctgt

SEQ ID NO: 877394 - DNA, 21 bp, Homo sapiens
tgtggccttgcccgccagcct

SEQ ID NO: 877395 - DNA, 19 bp, Homo sapiens
tgtggcctttatctcaacg

SEQ ID NO: 877396 - DNA, 19 bp, Homo sapiens
tgtggccttttttataact

SEQ ID NO: 877397 - DNA, 15 bp, Homo sapiens
tgtggcgtctccctc

SEQ ID NO: 877398 - DNA, 17 bp, Homo sapiens
tgtggctaaaaaagctg

SEQ ID NO: 877399 - DNA, 16 bp, Homo sapiens
tgtggctagtgacaaa

SEQ ID NO: 877400 - DNA, 19 bp, Homo sapiens
tgtggctcaggggagcaag

SEQ ID NO: 877401 - DNA, 18 bp, Homo sapiens
tgtggctcctatctgtgt

SEQ ID NO: 877402 - DNA, 19 bp, Homo sapiens
tgtggctcctatctgtgtt

SEQ ID NO: 877403 - DNA, 20 bp, Homo sapiens
tgtggctcctatctgtgttt

SEQ ID NO: 877404 - DNA, 15 bp, Homo sapiens
tgtggctccttccca

SEQ ID NO: 877405 - DNA, 15 bp, Homo sapiens
tgtggctgggggcag

SEQ ID NO: 877406 - DNA, 12 bp, Homo sapiens
tgtggctggtgt

SEQ ID NO: 877407 - DNA, 16 bp, Homo sapiens
tgtggctggtgtcccc

SEQ ID NO: 877408 - DNA, 19 bp, Homo sapiens
tgtggctggtgtccccttc

SEQ ID NO: 877409 - DNA, 11 bp, Homo sapiens
tgtggctttcc

SEQ ID NO: 877410 - DNA, 17 bp, Homo sapiens
tgtggctttctttcttt

SEQ ID NO: 877411 - DNA, 20 bp, Homo sapiens
tgtggctttttgttcagaat

SEQ ID NO: 877412 - DNA, 15 bp, Homo sapiens
tgtgggaaaaaaatg

SEQ ID NO: 877413 - DNA, 19 bp, Homo sapiens
tgtgggaagaaacaaaccc

SEQ ID NO: 877414 - DNA, 23 bp, Homo sapiens
tgtgggaagaccaaaggaaggaa

SEQ ID NO: 877415 - DNA, 11 bp, Homo sapiens
tgtgggaagat

SEQ ID NO: 877416 - DNA, 22 bp, Homo sapiens
tgtgggaagatgaactttgtca

SEQ ID NO: 877417 - DNA, 14 bp, Homo sapiens
tgtgggagacagca

SEQ ID NO: 877418 - DNA, 15 bp, Homo sapiens
tgtgggagacagcag

SEQ ID NO: 877419 - DNA, 19 bp, Homo sapiens
tgtgggagacagcagcctg

SEQ ID NO: 877420 - DNA, 13 bp, Homo sapiens
tgtgggagtagaa

SEQ ID NO: 877421 - DNA, 14 bp, Homo sapiens
tgtgggagtgaggg

SEQ ID NO: 877422 - DNA, 14 bp, Homo sapiens
tgtgggcaaaggca

SEQ ID NO: 877423 - DNA, 18 bp, Homo sapiens
tgtgggcaaaggcagggc

SEQ ID NO: 877424 - DNA, 16 bp, Homo sapiens
tgtgggcactggccca

SEQ ID NO: 877425 - DNA, 17 bp, Homo sapiens
tgtgggcactggcccag

SEQ ID NO: 877426 - DNA, 23 bp, Homo sapiens
tgtgggcactggcccaggttcat

SEQ ID NO: 877427 - DNA, 21 bp, Homo sapiens
tgtgggcagcttagggccctg

SEQ ID NO: 877428 - DNA, 11 bp, Homo sapiens
tgtgggcaggg

SEQ ID NO: 877429 - DNA, 12 bp, Homo sapiens
tgtgggcagggt

SEQ ID NO: 877430 - DNA, 19 bp, Homo sapiens
tgtgggcctcaaggacttg

SEQ ID NO: 877431 - DNA, 19 bp, Homo sapiens
tgtgggcctcacctgcccc

SEQ ID NO: 877432 - DNA, 19 bp, Homo sapiens
tgtgggctccaggcctgta

SEQ ID NO: 877433 - DNA, 22 bp, Homo sapiens
tgtgggctggtgccccacagct

SEQ ID NO: 877434 - DNA, 13 bp, Homo sapiens
tgtgggcttcctg

SEQ ID NO: 877435 - DNA, 16 bp, Homo sapiens
tgtgggcttcctgctg

SEQ ID NO: 877436 - DNA, 21 bp, Homo sapiens
tgtgggcttcctgctgggact

SEQ ID NO: 877437 - DNA, 16 bp, Homo sapiens
tgtgggcttgaccagg

SEQ ID NO: 877438 - DNA, 13 bp, Homo sapiens
tgtggggaaaggg

SEQ ID NO: 877439 - DNA, 14 bp, Homo sapiens
tgtggggacacagc

SEQ ID NO: 877440 - DNA, 21 bp, Homo sapiens
tgtggggacacagcagtgagt

SEQ ID NO: 877441 - DNA, 17 bp, Homo sapiens
tgtggggacccaggctc

SEQ ID NO: 877442 - DNA, 13 bp, Homo sapiens
tgtggggaggctg

SEQ ID NO: 877443 - DNA, 15 bp, Homo sapiens
tgtggggaggctgca

SEQ ID NO: 877444 - DNA, 16 bp, Homo sapiens
tgtggggatttctccc

SEQ ID NO: 877445 - DNA, 22 bp, Homo sapiens
tgtggggccaggaccatggccg

SEQ ID NO: 877446 - DNA, 12 bp, Homo sapiens
tgtggggccttg

SEQ ID NO: 877447 - DNA, 13 bp, Homo sapiens
tgtggggcgtgga

SEQ ID NO: 877448 - DNA, 12 bp, Homo sapiens
tgtgtctgccaa

SEQ ID NO: 877449 - DNA, 18 bp, Homo sapiens
tgtgtctgccaaacacat

SEQ ID NO: 877450 - DNA, 13 bp, Homo sapiens
tgtgtctgctgag

SEQ ID NO: 877451 - DNA, 18 bp, Homo sapiens
tgtgtctgggagagcctg

SEQ ID NO: 877452 - DNA, 21 bp, Homo sapiens
tgtgtctgtaggtgtctctgg

SEQ ID NO: 877453 - DNA, 24 bp, Homo sapiens
tgtgtctgtatttcatgtggctgt

SEQ ID NO: 877454 - DNA, 12 bp, Homo sapiens
tgtgtctgtcac

SEQ ID NO: 877455 - DNA, 17 bp, Homo sapiens
tgtgtctgtcacaggct

SEQ ID NO: 877456 - DNA, 12 bp, Homo sapiens
tgtgtctgtctt

SEQ ID NO: 877457 - DNA, 14 bp, Homo sapiens
tgtgtctttagata

SEQ ID NO: 877458 - DNA, 20 bp, Homo sapiens
tgtgtctttggaggtgctgc

SEQ ID NO: 877459 - DNA, 19 bp, Homo sapiens
tgtgtctttgtctggccac

SEQ ID NO: 877460 - DNA, 23 bp, Homo sapiens
tgtgtgaaacaatgttgtccaac

SEQ ID NO: 877461 - DNA, 17 bp, Homo sapiens
tgtgtgaaactttcatt

SEQ ID NO: 877462 - DNA, 21 bp, Homo sapiens
tgtgtgaagccgccagttcat

SEQ ID NO: 877463 - DNA, 12 bp, Homo sapiens
tgtgtgaatgtg

SEQ ID NO: 877464 - DNA, 18 bp, Homo sapiens
tgtgtgaattctgcaact

SEQ ID NO: 877465 - DNA, 15 bp, Homo sapiens
tgtgtgacaattctg

SEQ ID NO: 877466 - DNA, 13 bp, Homo sapiens
tgtgtgacactga

SEQ ID NO: 877467 - DNA, 19 bp, Homo sapiens
tgtgtgaccaactgtgttg

SEQ ID NO: 877468 - DNA, 16 bp, Homo sapiens
tgtgtgagactactaa

SEQ ID NO: 877469 - DNA, 17 bp, Homo sapiens
tgtgtgagcaagcattt

SEQ ID NO: 877470 - DNA, 18 bp, Homo sapiens
tgtgtgagcatcctgcaa

SEQ ID NO: 877471 - DNA, 13 bp, Homo sapiens
tgtgtgagcgtgg

SEQ ID NO: 877472 - DNA, 20 bp, Homo sapiens
tgtgtgaggagctgctggct

SEQ ID NO: 877473 - DNA, 18 bp, Homo sapiens
tgtgtgagtttgctggtt

SEQ ID NO: 877474 - DNA, 12 bp, Homo sapiens
tgtgtgataaat

SEQ ID NO: 877475 - DNA, 15 bp, Homo sapiens
tgtgtgatccagccc

SEQ ID NO: 877476 - DNA, 18 bp, Homo sapiens
tgtgtgatccagccctgg

SEQ ID NO: 877477 - DNA, 15 bp, Homo sapiens
tgtgtgattaaaagg

SEQ ID NO: 877478 - DNA, 15 bp, Homo sapiens
tgtgtgattgacagc

SEQ ID NO: 877479 - DNA, 18 bp, Homo sapiens
tgtgtgcaactaactgac

SEQ ID NO: 877480 - DNA, 14 bp, Homo sapiens
tgtgtgcacaccca

SEQ ID NO: 877481 - DNA, 17 bp, Homo sapiens
tgtgtgcaccttaccaa

SEQ ID NO: 877482 - DNA, 19 bp, Homo sapiens
tgtgtgcactttttttcta

SEQ ID NO: 877483 - DNA, 13 bp, Homo sapiens
tgtgtgcagtgaa

SEQ ID NO: 877484 - DNA, 12 bp, Homo sapiens
tgtgtgcatgtg

SEQ ID NO: 877485 - DNA, 15 bp, Homo sapiens
tgtgtgcattggggt

SEQ ID NO: 877486 - DNA, 15 bp, Homo sapiens
tgtgtgccctgggcc

SEQ ID NO: 877487 - DNA, 21 bp, Homo sapiens
tgtgtgccctgggccaggcag

SEQ ID NO: 877488 - DNA, 22 bp, Homo sapiens
tgtgtgccctgggccaggcagg

SEQ ID NO: 877489 - DNA, 20 bp, Homo sapiens
tgtgtgcctggccgcagggc

SEQ ID NO: 877490 - DNA, 14 bp, Homo sapiens
tgtgtgcttacagt

SEQ ID NO: 877491 - DNA, 20 bp, Homo sapiens
tgtgtgctttttttgtgtgt

SEQ ID NO: 877492 - DNA, 22 bp, Homo sapiens
tgtgtggaaaaaaaaaaaaact

SEQ ID NO: 877493 - DNA, 19 bp, Homo sapiens
tgtgtggacggcgctgcct

SEQ ID NO: 877494 - DNA, 16 bp, Homo sapiens
tgtgtggactgtgatg

SEQ ID NO: 877495 - DNA, 12 bp, Homo sapiens
tgtgtggcaggg

SEQ ID NO: 877496 - DNA, 19 bp, Homo sapiens
tgtgtggcagggggccccg

SEQ ID NO: 877497 - DNA, 11 bp, Homo sapiens
tgtgtggcctc

SEQ ID NO: 877498 - DNA, 14 bp, Homo sapiens
tgtgtggcctgcct

SEQ ID NO: 877499 - DNA, 15 bp, Homo sapiens
tgtgtggctcctggt

SEQ ID NO: 877500 - DNA, 22 bp, Homo sapiens
tgtgtgggggagattctgggtt

SEQ ID NO: 877501 - DNA, 20 bp, Homo sapiens
tgtgtgggtaaatgctttta

SEQ ID NO: 877502 - DNA, 21 bp, Homo sapiens
tgtgtgggtaaatgcttttaa

SEQ ID NO: 877503 - DNA, 16 bp, Homo sapiens
tgtgtggtagaaacaa

SEQ ID NO: 877504 - DNA, 21 bp, Homo sapiens
tgtgtggtggattctccctgg

SEQ ID NO: 877505 - DNA, 14 bp, Homo sapiens
tgtgtggttggaaa

SEQ ID NO: 877506 - DNA, 16 bp, Homo sapiens
tgtgtgtaatctgtta

SEQ ID NO: 877507 - DNA, 14 bp, Homo sapiens
tgtgtgtatatgta

SEQ ID NO: 877508 - DNA, 17 bp, Homo sapiens
tgtgtgtatatgtattt

SEQ ID NO: 877509 - DNA, 12 bp, Homo sapiens
tgtgtgtatgtg

SEQ ID NO: 877510 - DNA, 14 bp, Homo sapiens
tgtgtgtatgtgta

SEQ ID NO: 877511 - DNA, 13 bp, Homo sapiens
tgtgtgtatttgc

SEQ ID NO: 877512 - DNA, 14 bp, Homo sapiens
tgtgtgtatttgct

SEQ ID NO: 877513 - DNA, 16 bp, Homo sapiens
tgtgtgtatttgtatt

SEQ ID NO: 877514 - DNA, 14 bp, Homo sapiens
tgtgtgtcaggccc

SEQ ID NO: 877515 - DNA, 17 bp, Homo sapiens
tgtgtgtcagttttcat

SEQ ID NO: 877516 - DNA, 21 bp, Homo sapiens
tgtgtgtctgtctttgtggga

SEQ ID NO: 877517 - DNA, 16 bp, Homo sapiens
tgtgtgtcttaattat

SEQ ID NO: 877518 - DNA, 13 bp, Homo sapiens
tgtgtgtgcatgt

SEQ ID NO: 877519 - DNA, 13 bp, Homo sapiens
tgtgtgtgccctg

SEQ ID NO: 877520 - DNA, 24 bp, Homo sapiens
tgtgtgtgccctgggccaggcagg

SEQ ID NO: 877521 - DNA, 12 bp, Homo sapiens
tgtgtgtgctga

SEQ ID NO: 877522 - DNA, 11 bp, Homo sapiens
tgtgtgtgtat

SEQ ID NO: 877523 - DNA, 13 bp, Homo sapiens
tgtgtgtgtatgt

SEQ ID NO: 877524 - DNA, 14 bp, Homo sapiens
tgtgtgtgtatgtt

SEQ ID NO: 877525 - DNA, 14 bp, Homo sapiens
tgtgtgtgtcagct

SEQ ID NO: 877526 - DNA, 16 bp, Homo sapiens
tgtgtgtgtgtatgtg

SEQ ID NO: 877527 - DNA, 12 bp, Homo sapiens
tgtgtgtgtgtg

SEQ ID NO: 877528 - DNA, 14 bp, Homo sapiens
tgtgtgttcacctt

SEQ ID NO: 877529 - DNA, 18 bp, Homo sapiens
tgtgtgttgtcttgaaag

SEQ ID NO: 877530 - DNA, 16 bp, Homo sapiens
tgtgtgttgtgtccat

SEQ ID NO: 877531 - DNA, 15 bp, Homo sapiens
tgtgtgtttaaataa

SEQ ID NO: 877532 - DNA, 22 bp, Homo sapiens
tgtgtgtttaaataaagtatca

SEQ ID NO: 877533 - DNA, 23 bp, Homo sapiens
tgtgtgtttaacattcacagccc

SEQ ID NO: 877534 - DNA, 15 bp, Homo sapiens
tgtgtgttttcccaa

SEQ ID NO: 877535 - DNA, 17 bp, Homo sapiens
tgtgttaaacatgctaa

SEQ ID NO: 877536 - DNA, 19 bp, Homo sapiens
tgtgttaatcttaatgtat

SEQ ID NO: 877537 - DNA, 12 bp, Homo sapiens
tgtgttaatgtc

SEQ ID NO: 877538 - DNA, 19 bp, Homo sapiens
tgtgttaccctcctgtaaa

SEQ ID NO: 877539 - DNA, 17 bp, Homo sapiens
tgtgttagttcccaaca

SEQ ID NO: 877540 - DNA, 22 bp, Homo sapiens
tgtgttatagacggtgctcact

SEQ ID NO: 877541 - DNA, 22 bp, Homo sapiens
tgtgttcaccttcaaaatgttc

SEQ ID NO: 877542 - DNA, 18 bp, Homo sapiens
tgtgttcattaatgttta

SEQ ID NO: 877543 - DNA, 14 bp, Homo sapiens
tgtgttcatttcat

SEQ ID NO: 877544 - DNA, 15 bp, Homo sapiens
tgtgttccaaccact

SEQ ID NO: 877545 - DNA, 14 bp, Homo sapiens
tgtgttcccagagg

SEQ ID NO: 877546 - DNA, 17 bp, Homo sapiens
tgtgttcccatttcagc

SEQ ID NO: 877547 - DNA, 19 bp, Homo sapiens
tgtgttcctccattttctt

SEQ ID NO: 877548 - DNA, 15 bp, Homo sapiens
tgtgttcctggcaat

SEQ ID NO: 877549 - DNA, 16 bp, Homo sapiens
tgtgttcctggcaata

SEQ ID NO: 877550 - DNA, 18 bp, Homo sapiens
tgtgttcctggcccactc

SEQ ID NO: 877551 - DNA, 19 bp, Homo sapiens
tgtgttcctggctgatgat

SEQ ID NO: 877552 - DNA, 16 bp, Homo sapiens
tgtgttctctaggcct

SEQ ID NO: 877553 - DNA, 17 bp, Homo sapiens
tgtgttctgattagaaa

SEQ ID NO: 877554 - DNA, 13 bp, Homo sapiens
tgtgttctgggct

SEQ ID NO: 877555 - DNA, 14 bp, Homo sapiens
tgtgttctgggctg

SEQ ID NO: 877556 - DNA, 23 bp, Homo sapiens
tgtgttctgttgaaggtgccatt

SEQ ID NO: 877557 - DNA, 14 bp, Homo sapiens
tgtgttcttttctc

SEQ ID NO: 877558 - DNA, 23 bp, Homo sapiens
tgtgttgacacatatgaacacag

SEQ ID NO: 877559 - DNA, 17 bp, Homo sapiens
tgtgttgacactgtttt

SEQ ID NO: 877560 - DNA, 23 bp, Homo sapiens
tgtgttgactgctgctccccacc

SEQ ID NO: 877561 - DNA, 21 bp, Homo sapiens
tgtgttgagtgaagtttggag

SEQ ID NO: 877562 - DNA, 16 bp, Homo sapiens
tgtgttgcactgaaca

SEQ ID NO: 877563 - DNA, 17 bp, Homo sapiens
tgtgttgcactgaacag

SEQ ID NO: 877564 - DNA, 22 bp, Homo sapiens
tgttctgctttatcttttcata

SEQ ID NO: 877565 - DNA, 17 bp, Homo sapiens
tgttctggtatttcccc

SEQ ID NO: 877566 - DNA, 20 bp, Homo sapiens
tgttctggtatttcccctgt

SEQ ID NO: 877567 - DNA, 23 bp, Homo sapiens
tgttctgtggttcctctgctcac

SEQ ID NO: 877568 - DNA, 14 bp, Homo sapiens
tgttctgtgtccct

SEQ ID NO: 877569 - DNA, 18 bp, Homo sapiens
tgttctgttaactgaata

SEQ ID NO: 877570 - DNA, 22 bp, Homo sapiens
tgttctgttaactgaataccac

SEQ ID NO: 877571 - DNA, 15 bp, Homo sapiens
tgttctgttctgggg

SEQ ID NO: 877572 - DNA, 21 bp, Homo sapiens
tgttctgtttggcacttgtat

SEQ ID NO: 877573 - DNA, 17 bp, Homo sapiens
tgttctgtttgttaaaa

SEQ ID NO: 877574 - DNA, 20 bp, Homo sapiens
tgttctgtttgttaaaactg

SEQ ID NO: 877575 - DNA, 14 bp, Homo sapiens
tgttcttagagtgt

SEQ ID NO: 877576 - DNA, 14 bp, Homo sapiens
tgttcttcgtatat

SEQ ID NO: 877577 - DNA, 13 bp, Homo sapiens
tgttcttcttggg

SEQ ID NO: 877578 - DNA, 14 bp, Homo sapiens
tgttcttcttggga

SEQ ID NO: 877579 - DNA, 13 bp, Homo sapiens
tgttcttgaagca

SEQ ID NO: 877580 - DNA, 19 bp, Homo sapiens
tgttcttggtttgtaaatt

SEQ ID NO: 877581 - DNA, 22 bp, Homo sapiens
tgttcttggtttgtaaattaac

SEQ ID NO: 877582 - DNA, 22 bp, Homo sapiens
tgttctttcctgccctgtccaa

SEQ ID NO: 877583 - DNA, 22 bp, Homo sapiens
tgttctttggaaagtacactct

SEQ ID NO: 877584 - DNA, 12 bp, Homo sapiens
tgttcttttgca

SEQ ID NO: 877585 - DNA, 17 bp, Homo sapiens
tgttctttttattgaat

SEQ ID NO: 877586 - DNA, 12 bp, Homo sapiens
tgttgaaaaaat

SEQ ID NO: 877587 - DNA, 22 bp, Homo sapiens
tgttgaaagctgaaaagcatac

SEQ ID NO: 877588 - DNA, 24 bp, Homo sapiens
tgttgaaaggtaatttgagagaaa

SEQ ID NO: 877589 - DNA, 14 bp, Homo sapiens
tgttgaaatatgca

SEQ ID NO: 877590 - DNA, 14 bp, Homo sapiens
tgttgaaattatgt

SEQ ID NO: 877591 - DNA, 12 bp, Homo sapiens
tgttgaactttt

SEQ ID NO: 877592 - DNA, 14 bp, Homo sapiens
tgttgaagtttgaa

SEQ ID NO: 877593 - DNA, 22 bp, Homo sapiens
tgttgacaaaattttctcattt

SEQ ID NO: 877594 - DNA, 18 bp, Homo sapiens
tgttgacaactgtgactg

SEQ ID NO: 877595 - DNA, 19 bp, Homo sapiens
tgttgacacaccagttttg

SEQ ID NO: 877596 - DNA, 16 bp, Homo sapiens
tgttgacacaggtctt

SEQ ID NO: 877597 - DNA, 12 bp, Homo sapiens
tgttgacataca

SEQ ID NO: 877598 - DNA, 16 bp, Homo sapiens
tgttgacatatttaat

SEQ ID NO: 877599 - DNA, 19 bp, Homo sapiens
tgttgacatatttaatgtt

SEQ ID NO: 877600 - DNA, 20 bp, Homo sapiens
tgttgacatatttaatgttt

SEQ ID NO: 877601 - DNA, 12 bp, Homo sapiens
tgttgacattag

SEQ ID NO: 877602 - DNA, 14 bp, Homo sapiens
tgttgacattctga

SEQ ID NO: 877603 - DNA, 16 bp, Homo sapiens
tgttgacattctgaat

SEQ ID NO: 877604 - DNA, 22 bp, Homo sapiens
tgttgacattttctttttaaat

SEQ ID NO: 877605 - DNA, 17 bp, Homo sapiens
tgttgacctgtgcacct

SEQ ID NO: 877606 - DNA, 13 bp, Homo sapiens
tgttgacttattt

SEQ ID NO: 877607 - DNA, 14 bp, Homo sapiens
tgttgagaaaacga

SEQ ID NO: 877608 - DNA, 22 bp, Homo sapiens
tgttgagaatcccaaatttgat

SEQ ID NO: 877609 - DNA, 23 bp, Homo sapiens
tgttgagaatcccaaatttgatt

SEQ ID NO: 877610 - DNA, 15 bp, Homo sapiens
tgttgagagtgtgac

SEQ ID NO: 877611 - DNA, 17 bp, Homo sapiens
tgttgagccaggcctgg

SEQ ID NO: 877612 - DNA, 21 bp, Homo sapiens
tgttgagccatgctacagtta

SEQ ID NO: 877613 - DNA, 17 bp, Homo sapiens
tgttgagccccagtgct

SEQ ID NO: 877614 - DNA, 23 bp, Homo sapiens
tgttgagccccagtgctggaagg

SEQ ID NO: 877615 - DNA, 21 bp, Homo sapiens
tgttgagctggtaacatcgtt

SEQ ID NO: 877616 - DNA, 23 bp, Homo sapiens
tgttgaggtggtctgaatgttct

SEQ ID NO: 877617 - DNA, 14 bp, Homo sapiens
tgttgagtgttcat

SEQ ID NO: 877618 - DNA, 14 bp, Homo sapiens
tgttgataatttca

SEQ ID NO: 877619 - DNA, 18 bp, Homo sapiens
tgttgataatttcaggga

SEQ ID NO: 877620 - DNA, 17 bp, Homo sapiens
tgttgatacaaaccact

SEQ ID NO: 877621 - DNA, 18 bp, Homo sapiens
tgttgatattgtttgctg

SEQ ID NO: 877622 - DNA, 19 bp, Homo sapiens
tgttgatcatgtacttttt

SEQ ID NO: 877623 - DNA, 22 bp, Homo sapiens
tgttgatcccacttcactgtga

SEQ ID NO: 877624 - DNA, 17 bp, Homo sapiens
tgttgatggcaaaaaaa

SEQ ID NO: 877625 - DNA, 17 bp, Homo sapiens
tgttgatgtatctgagt

SEQ ID NO: 877626 - DNA, 20 bp, Homo sapiens
tgttgattaatttctgccat

SEQ ID NO: 877627 - DNA, 12 bp, Homo sapiens
tgttgattgtta

SEQ ID NO: 877628 - DNA, 17 bp, Homo sapiens
tgttgcaagatgtgaat

SEQ ID NO: 877629 - DNA, 18 bp, Homo sapiens
tgttgcaagatgtgaatt

SEQ ID NO: 877630 - DNA, 19 bp, Homo sapiens
tgttgcaagatgtgaatta

SEQ ID NO: 877631 - DNA, 17 bp, Homo sapiens
tgttgcaagtactgctg

SEQ ID NO: 877632 - DNA, 17 bp, Homo sapiens
tgttgcaccatctgctt

SEQ ID NO: 877633 - DNA, 16 bp, Homo sapiens
tgttgcactgccccct

SEQ ID NO: 877634 - DNA, 22 bp, Homo sapiens
tgttgccaaatatgtcctgggg

SEQ ID NO: 877635 - DNA, 23 bp, Homo sapiens
tgttgccaaatatgtcctggggt

SEQ ID NO: 877636 - DNA, 20 bp, Homo sapiens
tgttgccaactaagccctcg

SEQ ID NO: 877637 - DNA, 14 bp, Homo sapiens
tgttgccaagctgg

SEQ ID NO: 877638 - DNA, 15 bp, Homo sapiens
tgttgccatttctct

SEQ ID NO: 877639 - DNA, 19 bp, Homo sapiens
tgttgccatttctctgctt

SEQ ID NO: 877640 - DNA, 15 bp, Homo sapiens
tgttgcccaagctgg

SEQ ID NO: 877641 - DNA, 21 bp, Homo sapiens
tgttgcccaggctggagtgca

SEQ ID NO: 877642 - DNA, 17 bp, Homo sapiens
tgttgcccctttctctt

SEQ ID NO: 877643 - DNA, 19 bp, Homo sapiens
tgttgcctcctcccatcca

SEQ ID NO: 877644 - DNA, 22 bp, Homo sapiens
tgttgccttgaaccacttccct

SEQ ID NO: 877645 - DNA, 15 bp, Homo sapiens
tgttgcgctcccgca

SEQ ID NO: 877646 - DNA, 16 bp, Homo sapiens
tgttgcgttcaaagag

SEQ ID NO: 877647 - DNA, 15 bp, Homo sapiens
tgttgctagggagag

SEQ ID NO: 877648 - DNA, 21 bp, Homo sapiens
tgttgctagggagagggaaga

SEQ ID NO: 877649 - DNA, 16 bp, Homo sapiens
tgttgctatacatgtt

SEQ ID NO: 877650 - DNA, 19 bp, Homo sapiens
tgttgctcaaaaaatgagc

SEQ ID NO: 877651 - DNA, 14 bp, Homo sapiens
tgttgctcagaagt

SEQ ID NO: 877652 - DNA, 13 bp, Homo sapiens
tgttgctgaattt

SEQ ID NO: 877653 - DNA, 21 bp, Homo sapiens
tgttgctggaggggctgtcct

SEQ ID NO: 877654 - DNA, 16 bp, Homo sapiens
tgttgctgttgatgtt

SEQ ID NO: 877655 - DNA, 11 bp, Homo sapiens
tgttgctgttt

SEQ ID NO: 877656 - DNA, 22 bp, Homo sapiens
tgttgcttttcaaatgtttgaa

SEQ ID NO: 877657 - DNA, 21 bp, Homo sapiens
tgttggaaaagaatacagaaa

SEQ ID NO: 877658 - DNA, 22 bp, Homo sapiens
tgttggaaaatgtgtctctgct

SEQ ID NO: 877659 - DNA, 13 bp, Homo sapiens
tgttggaaatgtg

SEQ ID NO: 877660 - DNA, 18 bp, Homo sapiens
tgttggacagacactgtt

SEQ ID NO: 877661 - DNA, 22 bp, Homo sapiens
tgttggacagacactgttgcaa

SEQ ID NO: 877662 - DNA, 16 bp, Homo sapiens
tgttggacagctgctt

SEQ ID NO: 877663 - DNA, 18 bp, Homo sapiens
tgttggacagctgcttgt

SEQ ID NO: 877664 - DNA, 13 bp, Homo sapiens
tgttggacccgct

SEQ ID NO: 877665 - DNA, 18 bp, Homo sapiens
tgttggacccgctctgga

SEQ ID NO: 877666 - DNA, 19 bp, Homo sapiens
tgttggacccgctctggac

SEQ ID NO: 877667 - DNA, 14 bp, Homo sapiens
tgttggaggacccc

SEQ ID NO: 877668 - DNA, 16 bp, Homo sapiens
tgttggagtgtttcta

SEQ ID NO: 877669 - DNA, 19 bp, Homo sapiens
tgttggataaatcagtggt

SEQ ID NO: 877670 - DNA, 23 bp, Homo sapiens
tgttggatttataaatgctattt

SEQ ID NO: 877671 - DNA, 15 bp, Homo sapiens
tgttggcactcacag

SEQ ID NO: 877672 - DNA, 21 bp, Homo sapiens
tgttggcactcacagacctgg

SEQ ID NO: 877673 - DNA, 22 bp, Homo sapiens
tgttggcactcacagacctgga

SEQ ID NO: 877674 - DNA, 12 bp, Homo sapiens
tgttggcaggct

SEQ ID NO: 877675 - DNA, 18 bp, Homo sapiens
tgttggcccttccagtgg

SEQ ID NO: 877676 - DNA, 20 bp, Homo sapiens
tgttggcctccggcctcccc

SEQ ID NO: 877677 - DNA, 15 bp, Homo sapiens
tgttggcctctgcaa

SEQ ID NO: 877678 - DNA, 15 bp, Homo sapiens
tgttggctaatgaag

SEQ ID NO: 877679 - DNA, 20 bp, Homo sapiens
tgttggcttggggcaacaga

SEQ ID NO: 877680 - DNA, 22 bp, Homo sapiens
tgttggcttggggcaacagatt

SEQ ID NO: 877681 - DNA, 19 bp, Homo sapiens
tgttgggactgctaaataa

SEQ ID NO: 877682 - DNA, 18 bp, Homo sapiens
tgttgggattcctgaccc

SEQ ID NO: 877683 - DNA, 17 bp, Homo sapiens
tgttggtcagaggagtg

SEQ ID NO: 877684 - DNA, 14 bp, Homo sapiens
tgttggtccactgt

SEQ ID NO: 877685 - DNA, 14 bp, Homo sapiens
tgtttgtgagaagc

SEQ ID NO: 877686 - DNA, 13 bp, Homo sapiens
tgtttgtgattga

SEQ ID NO: 877687 - DNA, 14 bp, Homo sapiens
tgtttgtgctgtgg

SEQ ID NO: 877688 - DNA, 15 bp, Homo sapiens
tgtttgtgctgtggt

SEQ ID NO: 877689 - DNA, 13 bp, Homo sapiens
tgtttgtggcctc

SEQ ID NO: 877690 - DNA, 12 bp, Homo sapiens
tgtttgtgggac

SEQ ID NO: 877691 - DNA, 14 bp, Homo sapiens
ttaaaatctgattt

SEQ ID NO: 877692 - DNA, 17 bp, Homo sapiens
ttaaaatctgatttaat

SEQ ID NO: 877693 - DNA, 20 bp, Homo sapiens
ttaaaatctgatttaatgtt

SEQ ID NO: 877694 - DNA, 17 bp, Homo sapiens
ttaaaatctggaaatct

SEQ ID NO: 877695 - DNA, 21 bp, Homo sapiens
ttaaaatctggaaatctgttt

SEQ ID NO: 877696 - DNA, 17 bp, Homo sapiens
ttaaaatgaataattta

SEQ ID NO: 877697 - DNA, 20 bp, Homo sapiens
ttaaaatgaataatttatta

SEQ ID NO: 877698 - DNA, 21 bp, Homo sapiens
ttaaaatgaataatttattat

SEQ ID NO: 877699 - DNA, 16 bp, Homo sapiens
ttaaaatgattgtaaa

SEQ ID NO: 877700 - DNA, 13 bp, Homo sapiens
ttaaaatggtttt

SEQ ID NO: 877701 - DNA, 18 bp, Homo sapiens
ttaaaatggtttttgttt

SEQ ID NO: 877702 - DNA, 21 bp, Homo sapiens
ttaaaatgtcccagtgtcagt

SEQ ID NO: 877703 - DNA, 12 bp, Homo sapiens
ttaaataaaact

SEQ ID NO: 877704 - DNA, 13 bp, Homo sapiens
ttaaataaaacta

SEQ ID NO: 877705 - DNA, 11 bp, Homo sapiens
ttaaataaaag

SEQ ID NO: 877706 - DNA, 13 bp, Homo sapiens
ttaaataaaagtg

SEQ ID NO: 877707 - DNA, 12 bp, Homo sapiens
ttaaataaaata

SEQ ID NO: 877708 - DNA, 15 bp, Homo sapiens
ttaaataaaataacc

SEQ ID NO: 877709 - DNA, 20 bp, Homo sapiens
ttaaataaaattgaaagtaa

SEQ ID NO: 877710 - DNA, 17 bp, Homo sapiens
ttaaataaaatttaatt

SEQ ID NO: 877711 - DNA, 17 bp, Homo sapiens
ttaaataaagtatcatg

SEQ ID NO: 877712 - DNA, 19 bp, Homo sapiens
ttaaataaagtatcatgca

SEQ ID NO: 877713 - DNA, 15 bp, Homo sapiens
ttaaataaatcataa

SEQ ID NO: 877714 - DNA, 17 bp, Homo sapiens
ttaaataaatttgactt

SEQ ID NO: 877715 - DNA, 22 bp, Homo sapiens
ttaaataaatttgacttttctg

SEQ ID NO: 877716 - DNA, 23 bp, Homo sapiens
ttaaataacctctggcccttgga

SEQ ID NO: 877717 - DNA, 15 bp, Homo sapiens
ttaaataatatggct

SEQ ID NO: 877718 - DNA, 18 bp, Homo sapiens
ttaaataatgcttcagat

SEQ ID NO: 877719 - DNA, 13 bp, Homo sapiens
ttaaataatgtga

SEQ ID NO: 877720 - DNA, 15 bp, Homo sapiens
ttaaataatgtgaaa

SEQ ID NO: 877721 - DNA, 20 bp, Homo sapiens
ttaaataatgtgaaactgga

SEQ ID NO: 877722 - DNA, 22 bp, Homo sapiens
ttaaataatgtgaaactggatt

SEQ ID NO: 877723 - DNA, 15 bp, Homo sapiens
ttaaataatttccta

SEQ ID NO: 877724 - DNA, 18 bp, Homo sapiens
ttaaatacaaaacttcca

SEQ ID NO: 877725 - DNA, 19 bp, Homo sapiens
ttaaatacactgaattgaa

SEQ ID NO: 877726 - DNA, 21 bp, Homo sapiens
ttaaatacactgaattgaatc

SEQ ID NO: 877727 - DNA, 16 bp, Homo sapiens
ttaaatacagataatt

SEQ ID NO: 877728 - DNA, 18 bp, Homo sapiens
ttaaatacagataattca

SEQ ID NO: 877729 - DNA, 19 bp, Homo sapiens
ttaaatacaggaaacagtt

SEQ ID NO: 877730 - DNA, 20 bp, Homo sapiens
ttaaatacaggaaacagttg

SEQ ID NO: 877731 - DNA, 23 bp, Homo sapiens
ttaaatacatatggatgttactc

SEQ ID NO: 877732 - DNA, 16 bp, Homo sapiens
ttaaatactgtgcaga

SEQ ID NO: 877733 - DNA, 19 bp, Homo sapiens
ttaaatactgtgcagaata

SEQ ID NO: 877734 - DNA, 20 bp, Homo sapiens
ttaaatactgtgcagaataa

SEQ ID NO: 877735 - DNA, 22 bp, Homo sapiens
ttaaatactttttcagttgttt

SEQ ID NO: 877736 - DNA, 18 bp, Homo sapiens
ttaaatagagtttgctat

SEQ ID NO: 877737 - DNA, 19 bp, Homo sapiens
ttaaatagcctaaatgatg

SEQ ID NO: 877738 - DNA, 12 bp, Homo sapiens
ttaaatataaag

SEQ ID NO: 877739 - DNA, 19 bp, Homo sapiens
ttaaatataaatgtttgtc

SEQ ID NO: 877740 - DNA, 15 bp, Homo sapiens
ttaaatataatatgc

SEQ ID NO: 877741 - DNA, 16 bp, Homo sapiens
ttaaatatatattttg

SEQ ID NO: 877742 - DNA, 16 bp, Homo sapiens
ttaaatatatctagaa

SEQ ID NO: 877743 - DNA, 13 bp, Homo sapiens
ttaaatatgtata

SEQ ID NO: 877744 - DNA, 15 bp, Homo sapiens
ttaaatatttgaaga

SEQ ID NO: 877745 - DNA, 22 bp, Homo sapiens
ttaaatatttgtgactctttcc

SEQ ID NO: 877746 - DNA, 18 bp, Homo sapiens
ttaaatattttctatttt

SEQ ID NO: 877747 - DNA, 20 bp, Homo sapiens
ttaaatcaaggaaaggctca

SEQ ID NO: 877748 - DNA, 12 bp, Homo sapiens
ttaaatcatgta

SEQ ID NO: 877749 - DNA, 13 bp, Homo sapiens
ttaaatcatgtat

SEQ ID NO: 877750 - DNA, 14 bp, Homo sapiens
ttaaatcatgtatg

SEQ ID NO: 877751 - DNA, 15 bp, Homo sapiens
ttaaatcatgtatgt

SEQ ID NO: 877752 - DNA, 20 bp, Homo sapiens
ttaaatcatgtatgttatga

SEQ ID NO: 877753 - DNA, 21 bp, Homo sapiens
ttaaatcatgtatgttatgat

SEQ ID NO: 877754 - DNA, 23 bp, Homo sapiens
ttaaatcattagagcttaaattg

SEQ ID NO: 877755 - DNA, 14 bp, Homo sapiens
ttaaatccaataaa

SEQ ID NO: 877756 - DNA, 12 bp, Homo sapiens
ttaaatctagac

SEQ ID NO: 877757 - DNA, 15 bp, Homo sapiens
ttaaatctagacatt

SEQ ID NO: 877758 - DNA, 19 bp, Homo sapiens
ttaaatctagacattcttt

SEQ ID NO: 877759 - DNA, 22 bp, Homo sapiens
ttaaatcttaaacaatgtataa

SEQ ID NO: 877760 - DNA, 24 bp, Homo sapiens
ttaaatcttaaacaatgtataaag

SEQ ID NO: 877761 - DNA, 14 bp, Homo sapiens
ttaaatcttaatgt

SEQ ID NO: 877762 - DNA, 15 bp, Homo sapiens
ttaaatcttaatgtt

SEQ ID NO: 877763 - DNA, 14 bp, Homo sapiens
ttaaatgaaattgt

SEQ ID NO: 877764 - DNA, 23 bp, Homo sapiens
ttaaatgaaattgtaaaacctgt

SEQ ID NO: 877765 - DNA, 16 bp, Homo sapiens
ttaaatgaacttatgt

SEQ ID NO: 877766 - DNA, 14 bp, Homo sapiens
ttaaatgacagtga

SEQ ID NO: 877767 - DNA, 21 bp, Homo sapiens
ttaaatgagggtttctgatct

SEQ ID NO: 877768 - DNA, 16 bp, Homo sapiens
ttaaatgatatttagg

SEQ ID NO: 877769 - DNA, 15 bp, Homo sapiens
ttaaatgatcatgaa

SEQ ID NO: 877770 - DNA, 17 bp, Homo sapiens
ttaaatgcaacagtttt

SEQ ID NO: 877771 - DNA, 22 bp, Homo sapiens
ttaaatgcaaccagaattgtcc

SEQ ID NO: 877772 - DNA, 20 bp, Homo sapiens
ttaaatgcaaccatttgaaa

SEQ ID NO: 877773 - DNA, 11 bp, Homo sapiens
ttaaatgcacc

SEQ ID NO: 877774 - DNA, 18 bp, Homo sapiens
ttaaatgcacctggaata

SEQ ID NO: 877775 - DNA, 14 bp, Homo sapiens
ttaaatgcatgtct

SEQ ID NO: 877776 - DNA, 17 bp, Homo sapiens
ttaaatgcatgtcttaa

SEQ ID NO: 877777 - DNA, 19 bp, Homo sapiens
ttaaatgcatgtcttaaat

SEQ ID NO: 877778 - DNA, 13 bp, Homo sapiens
ttaaatgccaaaa

SEQ ID NO: 877779 - DNA, 20 bp, Homo sapiens
ttaaatgccctttgatgttt

SEQ ID NO: 877780 - DNA, 13 bp, Homo sapiens
ttaaatgctcata

SEQ ID NO: 877781 - DNA, 22 bp, Homo sapiens
ttaaatgctcattttctggttt

SEQ ID NO: 877782 - DNA, 17 bp, Homo sapiens
ttaaatgtaaagatatt

SEQ ID NO: 877783 - DNA, 16 bp, Homo sapiens
ttaaatgtacagacat

SEQ ID NO: 877784 - DNA, 21 bp, Homo sapiens
ttaaatgtagcttcagtcatt

SEQ ID NO: 877785 - DNA, 16 bp, Homo sapiens
ttaaatgtatttaatt

SEQ ID NO: 877786 - DNA, 22 bp, Homo sapiens
ttaaatgtctgacacattaatg

SEQ ID NO: 877787 - DNA, 11 bp, Homo sapiens
ttaaatgtgaa

SEQ ID NO: 877788 - DNA, 18 bp, Homo sapiens
ttaaatgtgtacaatgta

SEQ ID NO: 877789 - DNA, 16 bp, Homo sapiens
ttaaatgttatgacta

SEQ ID NO: 877790 - DNA, 13 bp, Homo sapiens
ttaaatgttatta

SEQ ID NO: 877791 - DNA, 22 bp, Homo sapiens
ttaaattaatatctttctgcac

SEQ ID NO: 877792 - DNA, 16 bp, Homo sapiens
ttaaattacaatttta

SEQ ID NO: 877793 - DNA, 18 bp, Homo sapiens
ttaaattacaattttatc

SEQ ID NO: 877794 - DNA, 17 bp, Homo sapiens
ttaaattagaaaatatt

SEQ ID NO: 877795 - DNA, 17 bp, Homo sapiens
ttaaattagtttgtgaa

SEQ ID NO: 877796 - DNA, 23 bp, Homo sapiens
ttaaattatgttttaaacacatg

SEQ ID NO: 877797 - DNA, 21 bp, Homo sapiens
ttaaattccactgaaaattta

SEQ ID NO: 877798 - DNA, 22 bp, Homo sapiens
ttaaattcccgttttgtcactt

SEQ ID NO: 877799 - DNA, 19 bp, Homo sapiens
ttaaattgcttttgttgtg

SEQ ID NO: 877800 - DNA, 15 bp, Homo sapiens
ttaaattgtgtttta

SEQ ID NO: 877801 - DNA, 19 bp, Homo sapiens
ttaaatttcttatgtgaca

SEQ ID NO: 877802 - DNA, 15 bp, Homo sapiens
ttaaatttgaatctg

SEQ ID NO: 877803 - DNA, 19 bp, Homo sapiens
ttaaatttgttgacaaaat

SEQ ID NO: 877804 - DNA, 15 bp, Homo sapiens
ttaaattttgtaatg

SEQ ID NO: 877805 - DNA, 16 bp, Homo sapiens
ttaaattttgtaatga

SEQ ID NO: 877806 - DNA, 17 bp, Homo sapiens
ttaaatttttagccatt

SEQ ID NO: 877807 - DNA, 18 bp, Homo sapiens
ttaaatttttgtcatttt

SEQ ID NO: 877808 - DNA, 16 bp, Homo sapiens
ttaaattttttgttga

SEQ ID NO: 877809 - DNA, 22 bp, Homo sapiens
ttaataaaactgcacagtgctg

SEQ ID NO: 877810 - DNA, 23 bp, Homo sapiens
ttaataaaactgcacagtgctgt

SEQ ID NO: 877811 - DNA, 18 bp, Homo sapiens
ttaataaaactgcgagga

SEQ ID NO: 877812 - DNA, 14 bp, Homo sapiens
ttaataaaagaaca

SEQ ID NO: 877813 - DNA, 15 bp, Homo sapiens
ttaataaaagaacat

SEQ ID NO: 877814 - DNA, 18 bp, Homo sapiens
ttaataaaataaactaga

SEQ ID NO: 877815 - DNA, 16 bp, Homo sapiens
ttaataaagaaatatt

SEQ ID NO: 877816 - DNA, 19 bp, Homo sapiens
ttaataaagaaatatttac

SEQ ID NO: 877817 - DNA, 22 bp, Homo sapiens
ttaataaagaaatatttaccta

SEQ ID NO: 877818 - DNA, 22 bp, Homo sapiens
ttaataaatatgtaatataaat

SEQ ID NO: 877819 - DNA, 18 bp, Homo sapiens
ttaataaattggtaatat

SEQ ID NO: 877820 - DNA, 17 bp, Homo sapiens
ttaataacatacaatga

SEQ ID NO: 877821 - DNA, 21 bp, Homo sapiens
ttaataacctgccagtcccag

SEQ ID NO: 877822 - DNA, 18 bp, Homo sapiens
ttaataagatatttagta

SEQ ID NO: 877823 - DNA, 22 bp, Homo sapiens
ttaataatgtattgtaatcttt

SEQ ID NO: 877824 - DNA, 19 bp, Homo sapiens
ttaatacaagtaatattat

SEQ ID NO: 877825 - DNA, 21 bp, Homo sapiens
ttaatacaagtaatattatta

SEQ ID NO: 877826 - DNA, 21 bp, Homo sapiens
ttaatacatgcaacagaagtg

SEQ ID NO: 877827 - DNA, 22 bp, Homo sapiens
ttaatactcaaatgagtaacat

SEQ ID NO: 877828 - DNA, 19 bp, Homo sapiens
ttaatagaatataattatc

SEQ ID NO: 877829 - DNA, 12 bp, Homo sapiens
ttaatagacttc

SEQ ID NO: 877830 - DNA, 15 bp, Homo sapiens
ttaatagacttctct

SEQ ID NO: 877831 - DNA, 14 bp, Homo sapiens
ttaatagattattt

SEQ ID NO: 877832 - DNA, 16 bp, Homo sapiens
ttaatagcaaagaatt

SEQ ID NO: 877833 - DNA, 18 bp, Homo sapiens
ttaatagcaaagaattga

SEQ ID NO: 877834 - DNA, 13 bp, Homo sapiens
ttaatagccctcc

SEQ ID NO: 877835 - DNA, 18 bp, Homo sapiens
ttaatagcttttgattag

SEQ ID NO: 877836 - DNA, 23 bp, Homo sapiens
ttaatagtcaccttcatgattat

SEQ ID NO: 877837 - DNA, 19 bp, Homo sapiens
ttaatagtcattccaaata

SEQ ID NO: 877838 - DNA, 19 bp, Homo sapiens
ttaatagtttgtctatttt

SEQ ID NO: 877839 - DNA, 22 bp, Homo sapiens
ttaatataaagtagtcctgtga

SEQ ID NO: 877840 - DNA, 23 bp, Homo sapiens
ttaatataaagtagtcctgtgaa

SEQ ID NO: 877841 - DNA, 19 bp, Homo sapiens
ttaatataccccaaattgt

SEQ ID NO: 877842 - DNA, 19 bp, Homo sapiens
ttaatatatcccagaaatt

SEQ ID NO: 877843 - DNA, 15 bp, Homo sapiens
ttaatatatgtatta

SEQ ID NO: 877844 - DNA, 18 bp, Homo sapiens
ttaatatattaaaattcc

SEQ ID NO: 877845 - DNA, 17 bp, Homo sapiens
ttaatatattgaataaa

SEQ ID NO: 877846 - DNA, 15 bp, Homo sapiens
ttaatatcactcatt

SEQ ID NO: 877847 - DNA, 16 bp, Homo sapiens
ttaatatcactcatta

SEQ ID NO: 877848 - DNA, 19 bp, Homo sapiens
ttaatatccctacatgtat

SEQ ID NO: 877849 - DNA, 20 bp, Homo sapiens
ttaatatccctacatgtatt

SEQ ID NO: 877850 - DNA, 14 bp, Homo sapiens
ttaatatctttctg

SEQ ID NO: 877851 - DNA, 14 bp, Homo sapiens
ttaatatgaaaact

SEQ ID NO: 877852 - DNA, 16 bp, Homo sapiens
ttaatatgaaaactta

SEQ ID NO: 877853 - DNA, 21 bp, Homo sapiens
ttaatatgagcttcaatataa

SEQ ID NO: 877854 - DNA, 20 bp, Homo sapiens
ttaatatgcttaaaataagc

SEQ ID NO: 877855 - DNA, 21 bp, Homo sapiens
ttaatatgtgctgaacattgt

SEQ ID NO: 877856 - DNA, 17 bp, Homo sapiens
ttaatattaacttttaa

SEQ ID NO: 877857 - DNA, 15 bp, Homo sapiens
ttaatattactgtct

SEQ ID NO: 877858 - DNA, 13 bp, Homo sapiens
ttaatattattat

SEQ ID NO: 877859 - DNA, 23 bp, Homo sapiens
ttaatattcttttgtttccatgg

SEQ ID NO: 877860 - DNA, 18 bp, Homo sapiens
ttaatattgatatgctta

SEQ ID NO: 877861 - DNA, 21 bp, Homo sapiens
ttaatatttaaacagcagtgt

SEQ ID NO: 877862 - DNA, 22 bp, Homo sapiens
ttaatatttaaacagcagtgtt

SEQ ID NO: 877863 - DNA, 16 bp, Homo sapiens
ttaatatttaacatta

SEQ ID NO: 877864 - DNA, 17 bp, Homo sapiens
ttaatatttaacattat

SEQ ID NO: 877865 - DNA, 19 bp, Homo sapiens
ttaatatttgctgacagct

SEQ ID NO: 877866 - DNA, 16 bp, Homo sapiens
ttaatattttgtaata

SEQ ID NO: 877867 - DNA, 17 bp, Homo sapiens
ttaatattttgtatttt

SEQ ID NO: 877868 - DNA, 22 bp, Homo sapiens
ttaatcaagtacctatattgat

SEQ ID NO: 877869 - DNA, 17 bp, Homo sapiens
ttaatcactattgttcc

SEQ ID NO: 877870 - DNA, 17 bp, Homo sapiens
ttaatcagccccagagt

SEQ ID NO: 877871 - DNA, 13 bp, Homo sapiens
ttaatcagtgaag

SEQ ID NO: 877872 - DNA, 21 bp, Homo sapiens
ttaatcatacaaactctcacc

SEQ ID NO: 877873 - DNA, 22 bp, Homo sapiens
ttaatcattaggtgtgactgaa

SEQ ID NO: 877874 - DNA, 22 bp, Homo sapiens
ttaatcattatccttctaagag

SEQ ID NO: 877875 - DNA, 15 bp, Homo sapiens
ttaatcattttcatt

SEQ ID NO: 877876 - DNA, 21 bp, Homo sapiens
ttaatcccagtacgatttgca

SEQ ID NO: 877877 - DNA, 13 bp, Homo sapiens
ttaatcccctgca

SEQ ID NO: 877878 - DNA, 24 bp, Homo sapiens
ttaatcccctgcactaggcaggta

SEQ ID NO: 877879 - DNA, 22 bp, Homo sapiens
ttaatcctttgttttctgacta

SEQ ID NO: 877880 - DNA, 16 bp, Homo sapiens
ttaatcgatgaatgta

SEQ ID NO: 877881 - DNA, 16 bp, Homo sapiens
ttaatctaaaatgatt

SEQ ID NO: 877882 - DNA, 15 bp, Homo sapiens
ttaatctactttttg

SEQ ID NO: 877883 - DNA, 19 bp, Homo sapiens
ttaatctactttttgtatt

SEQ ID NO: 877884 - DNA, 15 bp, Homo sapiens
ttaatctcccagccc

SEQ ID NO: 877885 - DNA, 12 bp, Homo sapiens
ttaatctctgtg

SEQ ID NO: 877886 - DNA, 18 bp, Homo sapiens
ttaatctgtgtgtatatt

SEQ ID NO: 877887 - DNA, 19 bp, Homo sapiens
ttaatcttagtgtatgatt

SEQ ID NO: 877888 - DNA, 17 bp, Homo sapiens
ttaatcttcagttttat

SEQ ID NO: 877889 - DNA, 12 bp, Homo sapiens
ttaatcttgctt

SEQ ID NO: 877890 - DNA, 15 bp, Homo sapiens
ttaatcttgctttct

SEQ ID NO: 877891 - DNA, 23 bp, Homo sapiens
ttaatctttctttacctgagacc

SEQ ID NO: 877892 - DNA, 20 bp, Homo sapiens
ttaatcttttcttatttttg

SEQ ID NO: 877893 - DNA, 14 bp, Homo sapiens
ttaatgaaaaggaa

SEQ ID NO: 877894 - DNA, 15 bp, Homo sapiens
ttaatgaaaatgtca

SEQ ID NO: 877895 - DNA, 16 bp, Homo sapiens
ttaatgaaaatgtcag

SEQ ID NO: 877896 - DNA, 19 bp, Homo sapiens
ttaatgaaagactgtacaa

SEQ ID NO: 877897 - DNA, 23 bp, Homo sapiens
ttaatgaaagactgtacaaagta

SEQ ID NO: 877898 - DNA, 21 bp, Homo sapiens
ttaatgaaagggtttgtaata

SEQ ID NO: 877899 - DNA, 19 bp, Homo sapiens
ttaatgaaatgataaagac

SEQ ID NO: 877900 - DNA, 21 bp, Homo sapiens
ttaatgaaatgataaagactt

SEQ ID NO: 877901 - DNA, 23 bp, Homo sapiens
ttaatgaaatgataaagactttt

SEQ ID NO: 877902 - DNA, 14 bp, Homo sapiens
ttaatgaacaaatg

SEQ ID NO: 877903 - DNA, 21 bp, Homo sapiens
ttaatgaatattgatgttaac

SEQ ID NO: 877904 - DNA, 16 bp, Homo sapiens
ttaatgacaacactta

SEQ ID NO: 877905 - DNA, 19 bp, Homo sapiens
ttaatgactctttctgaag

SEQ ID NO: 877906 - DNA, 15 bp, Homo sapiens
ttaatgagaagatat

SEQ ID NO: 877907 - DNA, 21 bp, Homo sapiens
ttaatgagactttaaaagcat

SEQ ID NO: 877908 - DNA, 23 bp, Homo sapiens
ttaatgagactttaaaagcattt

SEQ ID NO: 877909 - DNA, 16 bp, Homo sapiens
ttaatgagccatcact

SEQ ID NO: 877910 - DNA, 20 bp, Homo sapiens
ttaatgatggtgttaaagct

SEQ ID NO: 877911 - DNA, 22 bp, Homo sapiens
ttaatgatggtgttaaagctgt

SEQ ID NO: 877912 - DNA, 12 bp, Homo sapiens
ttaatgcacttt

SEQ ID NO: 877913 - DNA, 22 bp, Homo sapiens
ttaatgcagttgcttactaaag

SEQ ID NO: 877914 - DNA, 20 bp, Homo sapiens
ttaatgcatgttaggaaaat

SEQ ID NO: 877915 - DNA, 21 bp, Homo sapiens
ttaatgcctgctttttggaaa

SEQ ID NO: 877916 - DNA, 18 bp, Homo sapiens
ttaatgcctttaaagtat

SEQ ID NO: 877917 - DNA, 13 bp, Homo sapiens
ttaatgcttcatt

SEQ ID NO: 877918 - DNA, 15 bp, Homo sapiens
ttaatgcttcattca

SEQ ID NO: 877919 - DNA, 19 bp, Homo sapiens
ttaatgcttccagggattt

SEQ ID NO: 877920 - DNA, 20 bp, Homo sapiens
ttaatggaagtgtatttatt

SEQ ID NO: 877921 - DNA, 19 bp, Homo sapiens
ttaatggacatgagataat

SEQ ID NO: 877922 - DNA, 15 bp, Homo sapiens
ttaatggactgtgaa

SEQ ID NO: 877923 - DNA, 22 bp, Homo sapiens
ttaatggactgtgaatttcaaa

SEQ ID NO: 877924 - DNA, 21 bp, Homo sapiens
ttaatggcatttctctttaaa

SEQ ID NO: 877925 - DNA, 16 bp, Homo sapiens
ttaatggcctggaggg

SEQ ID NO: 877926 - DNA, 19 bp, Homo sapiens
ttaatggctagtactgtat

SEQ ID NO: 877927 - DNA, 16 bp, Homo sapiens
ttaatggctgataatt

SEQ ID NO: 877928 - DNA, 19 bp, Homo sapiens
ttaatgggggtagcagctg

SEQ ID NO: 877929 - DNA, 20 bp, Homo sapiens
ttaatgtaaagaacttaaat

SEQ ID NO: 877930 - DNA, 21 bp, Homo sapiens
ttaattcacagaatagcacaa

SEQ ID NO: 877931 - DNA, 16 bp, Homo sapiens
ttaattcaccaaagta

SEQ ID NO: 877932 - DNA, 16 bp, Homo sapiens
ttaattcacctcagcc

SEQ ID NO: 877933 - DNA, 22 bp, Homo sapiens
ttaattcagcactgatttcaca

SEQ ID NO: 877934 - DNA, 13 bp, Homo sapiens
ttaattcagtaca

SEQ ID NO: 877935 - DNA, 13 bp, Homo sapiens
ttaattcatgttt

SEQ ID NO: 877936 - DNA, 14 bp, Homo sapiens
ttaattcatgtttc

SEQ ID NO: 877937 - DNA, 13 bp, Homo sapiens
ttaattcatttgg

SEQ ID NO: 877938 - DNA, 23 bp, Homo sapiens
ttaattccatgtcagataagtgt

SEQ ID NO: 877939 - DNA, 22 bp, Homo sapiens
ttaattccctgctaaatgccat

SEQ ID NO: 877940 - DNA, 15 bp, Homo sapiens
ttaattcctatgaag

SEQ ID NO: 877941 - DNA, 15 bp, Homo sapiens
ttaattctccttccc

SEQ ID NO: 877942 - DNA, 16 bp, Homo sapiens
ttaattcttcacctgt

SEQ ID NO: 877943 - DNA, 15 bp, Homo sapiens
ttaattcttcacctt

SEQ ID NO: 877944 - DNA, 21 bp, Homo sapiens
ttaattcttcacctttgtaag

SEQ ID NO: 877945 - DNA, 22 bp, Homo sapiens
ttaattcttcacctttgtaaga

SEQ ID NO: 877946 - DNA, 21 bp, Homo sapiens
ttaattgacttatttatataa

SEQ ID NO: 877947 - DNA, 22 bp, Homo sapiens
ttaattgattattctgattcca

SEQ ID NO: 877948 - DNA, 14 bp, Homo sapiens
ttaattgctttgaa

SEQ ID NO: 877949 - DNA, 16 bp, Homo sapiens
ttaattgctttgaagc

SEQ ID NO: 877950 - DNA, 13 bp, Homo sapiens
ttaattggccatg

SEQ ID NO: 877951 - DNA, 18 bp, Homo sapiens
ttaattgggccagctttt

SEQ ID NO: 877952 - DNA, 16 bp, Homo sapiens
ttaattgtcctgtgtc

SEQ ID NO: 877953 - DNA, 14 bp, Homo sapiens
ttaatttaaagcca

SEQ ID NO: 877954 - DNA, 13 bp, Homo sapiens
ttaatttaaatga

SEQ ID NO: 877955 - DNA, 23 bp, Homo sapiens
ttaatttaaatgatttaaattta

SEQ ID NO: 877956 - DNA, 16 bp, Homo sapiens
ttaatttaattgcttt

SEQ ID NO: 877957 - DNA, 23 bp, Homo sapiens
ttaatttacaaaaatataaaata

SEQ ID NO: 877958 - DNA, 15 bp, Homo sapiens
ttaatttagaaaact

SEQ ID NO: 877959 - DNA, 16 bp, Homo sapiens
ttaatttagaaaactt

SEQ ID NO: 877960 - DNA, 20 bp, Homo sapiens
ttaatttagagcgtttggtt

SEQ ID NO: 877961 - DNA, 21 bp, Homo sapiens
ttaatttagagcgtttggtta

SEQ ID NO: 877962 - DNA, 17 bp, Homo sapiens
ttaatttagtaaatgtt

SEQ ID NO: 877963 - DNA, 18 bp, Homo sapiens
ttaatttataatgtattt

SEQ ID NO: 877964 - DNA, 20 bp, Homo sapiens
ttaatttataatgtatttga

SEQ ID NO: 877965 - DNA, 15 bp, Homo sapiens
ttaatttatgagttt

SEQ ID NO: 877966 - DNA, 18 bp, Homo sapiens
ttaatttatgagtttttg

SEQ ID NO: 877967 - DNA, 19 bp, Homo sapiens
ttaatttattattgaaatt

SEQ ID NO: 877968 - DNA, 13 bp, Homo sapiens
ttaatttatttca

SEQ ID NO: 877969 - DNA, 16 bp, Homo sapiens
ttaatttattttgctc

SEQ ID NO: 877970 - DNA, 13 bp, Homo sapiens
ttaatttcaggaa

SEQ ID NO: 877971 - DNA, 19 bp, Homo sapiens
ttaatttcaggaaaatgta

SEQ ID NO: 877972 - DNA, 21 bp, Homo sapiens
ttaatttccaggaaaaaataa

SEQ ID NO: 877973 - DNA, 16 bp, Homo sapiens
ttaatttcctttttga

SEQ ID NO: 877974 - DNA, 21 bp, Homo sapiens
ttaatttctaagaagttactt

SEQ ID NO: 877975 - DNA, 18 bp, Homo sapiens
ttaatttctgcctttccc

SEQ ID NO: 877976 - DNA, 13 bp, Homo sapiens
ttaatttgaaata

SEQ ID NO: 877977 - DNA, 14 bp, Homo sapiens
ttaatttgcacagt

SEQ ID NO: 877978 - DNA, 21 bp, Homo sapiens
ttaatttggataataaaaatt

SEQ ID NO: 877979 - DNA, 12 bp, Homo sapiens
ttaatttgtatg

SEQ ID NO: 877980 - DNA, 13 bp, Homo sapiens
ttaatttgtgaat

SEQ ID NO: 877981 - DNA, 18 bp, Homo sapiens
ttaatttgttttgtttta

SEQ ID NO: 877982 - DNA, 13 bp, Homo sapiens
ttaattttaccaa

SEQ ID NO: 877983 - DNA, 20 bp, Homo sapiens
ttaattttaccaagagtaac

SEQ ID NO: 877984 - DNA, 15 bp, Homo sapiens
ttaattttagttttt

SEQ ID NO: 877985 - DNA, 12 bp, Homo sapiens
ttaattttcact

SEQ ID NO: 877986 - DNA, 13 bp, Homo sapiens
ttaattttcagta

SEQ ID NO: 877987 - DNA, 13 bp, Homo sapiens
ttaattttcctgg

SEQ ID NO: 877988 - DNA, 19 bp, Homo sapiens
ttaattttgaagtgctgtt

SEQ ID NO: 877989 - DNA, 21 bp, Homo sapiens
ttaattttgatatacattgtg

SEQ ID NO: 877990 - DNA, 14 bp, Homo sapiens
ttaattttgtgcat

SEQ ID NO: 877991 - DNA, 22 bp, Homo sapiens
ttaattttgtgcattctttggt

SEQ ID NO: 877992 - DNA, 17 bp, Homo sapiens
ttaatttttaatgatga

SEQ ID NO: 877993 - DNA, 18 bp, Homo sapiens
ttaatttttccaactact

SEQ ID NO: 877994 - DNA, 18 bp, Homo sapiens
ttaatttttcctgcatgt

SEQ ID NO: 877995 - DNA, 15 bp, Homo sapiens
ttaatttttgctttt

SEQ ID NO: 877996 - DNA, 20 bp, Homo sapiens
ttaattttttggtacaaaaa

SEQ ID NO: 877997 - DNA, 18 bp, Homo sapiens
ttaattttttttaatgta

SEQ ID NO: 877998 - DNA, 18 bp, Homo sapiens
ttacaaaaagaaatgtca

SEQ ID NO: 877999 - DNA, 19 bp, Homo sapiens
ttacaaaaagaaatgtcaa

SEQ ID NO: 878000 - DNA, 17 bp, Homo sapiens
ttacaaaacaaactcat

SEQ ID NO: 878001 - DNA, 18 bp, Homo sapiens
ttacaaaacaaactcatt

SEQ ID NO: 878002 - DNA, 16 bp, Homo sapiens
ttacaaaactgctttg

SEQ ID NO: 878003 - DNA, 14 bp, Homo sapiens
ttacaaaatgccaa

SEQ ID NO: 878004 - DNA, 13 bp, Homo sapiens
ttacaaactgcaa

SEQ ID NO: 878005 - DNA, 21 bp, Homo sapiens
ttacaaactgcaatagagact

SEQ ID NO: 878006 - DNA, 14 bp, Homo sapiens
ttacaaagcagtta

SEQ ID NO: 878007 - DNA, 13 bp, Homo sapiens
ttacaaagtgtgt

SEQ ID NO: 878008 - DNA, 14 bp, Homo sapiens
ttacaaagttatat

SEQ ID NO: 878009 - DNA, 15 bp, Homo sapiens
ttacaaataaacagt

SEQ ID NO: 878010 - DNA, 19 bp, Homo sapiens
ttacaaataaacagttgtt

SEQ ID NO: 878011 - DNA, 16 bp, Homo sapiens
ttacaaatattgtcat

SEQ ID NO: 878012 - DNA, 16 bp, Homo sapiens
ttacaaattttcactg

SEQ ID NO: 878013 - DNA, 20 bp, Homo sapiens
ttacaactaaataacacaga

SEQ ID NO: 878014 - DNA, 22 bp, Homo sapiens
ttacaactgcctcgaaacacag

SEQ ID NO: 878015 - DNA, 13 bp, Homo sapiens
ttacaagaagaac

SEQ ID NO: 878016 - DNA, 20 bp, Homo sapiens
ttacaagaagtttattctca

SEQ ID NO: 878017 - DNA, 17 bp, Homo sapiens
ttacaagcttaaagctt

SEQ ID NO: 878018 - DNA, 18 bp, Homo sapiens
ttattgctggtgcaaaga

SEQ ID NO: 878019 - DNA, 12 bp, Homo sapiens
ttattgctgttg

SEQ ID NO: 878020 - DNA, 13 bp, Homo sapiens
ttattgcttttat

SEQ ID NO: 878021 - DNA, 17 bp, Homo sapiens
ttattggaaatgtactt

SEQ ID NO: 878022 - DNA, 19 bp, Homo sapiens
ttattggaagtgttcaaga

SEQ ID NO: 878023 - DNA, 20 bp, Homo sapiens
ttattggcctgctaatagct

SEQ ID NO: 878024 - DNA, 21 bp, Homo sapiens
ttattggtaaattctggtata

SEQ ID NO: 878025 - DNA, 22 bp, Homo sapiens
ttattggttggtgtgaagaaag

SEQ ID NO: 878026 - DNA, 15 bp, Homo sapiens
ttattggttttgcag

SEQ ID NO: 878027 - DNA, 18 bp, Homo sapiens
ttattggttttgcagaag

SEQ ID NO: 878028 - DNA, 22 bp, Homo sapiens
ttattggtttttttgtatagac

SEQ ID NO: 878029 - DNA, 18 bp, Homo sapiens
ttattgtacagactgttt

SEQ ID NO: 878030 - DNA, 19 bp, Homo sapiens
ttattgtacagctgtttaa

SEQ ID NO: 878031 - DNA, 17 bp, Homo sapiens
ttattgtacctctctta

SEQ ID NO: 878032 - DNA, 21 bp, Homo sapiens
ttattgtataaactatcagtt

SEQ ID NO: 878033 - DNA, 22 bp, Homo sapiens
ttattgtataaactatcagttt

SEQ ID NO: 878034 - DNA, 15 bp, Homo sapiens
ttattgtctgtaaat

SEQ ID NO: 878035 - DNA, 19 bp, Homo sapiens
ttattgtgacttcactgta

SEQ ID NO: 878036 - DNA, 17 bp, Homo sapiens
ttattgtgattacgtgt

SEQ ID NO: 878037 - DNA, 22 bp, Homo sapiens
ttattgtgctgggtcccagcct

SEQ ID NO: 878038 - DNA, 15 bp, Homo sapiens
ttattgttaaattac

SEQ ID NO: 878039 - DNA, 13 bp, Homo sapiens
ttattgtttgaaa

SEQ ID NO: 878040 - DNA, 12 bp, Homo sapiens
ttatttaaatgc

SEQ ID NO: 878041 - DNA, 12 bp, Homo sapiens
ttatttaaatta

SEQ ID NO: 878042 - DNA, 14 bp, Homo sapiens
ttatttaaatttta

SEQ ID NO: 878043 - DNA, 16 bp, Homo sapiens
ttatttaacaaaaaat

SEQ ID NO: 878044 - DNA, 13 bp, Homo sapiens
ttatttaacagct

SEQ ID NO: 878045 - DNA, 13 bp, Homo sapiens
ttatttaagattt

SEQ ID NO: 878046 - DNA, 24 bp, Homo sapiens
ttatttaagtatggaatattcatt

SEQ ID NO: 878047 - DNA, 14 bp, Homo sapiens
ttatttaataacaa

SEQ ID NO: 878048 - DNA, 22 bp, Homo sapiens
ttatttaatgaaagactgtaca

SEQ ID NO: 878049 - DNA, 16 bp, Homo sapiens
ttatttaatgttatgt

SEQ ID NO: 878050 - DNA, 20 bp, Homo sapiens
ttatttaatgtttgatttag

SEQ ID NO: 878051 - DNA, 14 bp, Homo sapiens
ttatttaatttgta

SEQ ID NO: 878052 - DNA, 18 bp, Homo sapiens
ttatttaatttgtatgct

SEQ ID NO: 878053 - DNA, 14 bp, Homo sapiens
ttatttacaaatgt

SEQ ID NO: 878054 - DNA, 17 bp, Homo sapiens
ttatttacaagaagaac

SEQ ID NO: 878055 - DNA, 15 bp, Homo sapiens
ttatttacatttaat

SEQ ID NO: 878056 - DNA, 13 bp, Homo sapiens
ttatttacatttt

SEQ ID NO: 878057 - DNA, 22 bp, Homo sapiens
ttatttaccgttgcttgaaatt

SEQ ID NO: 878058 - DNA, 21 bp, Homo sapiens
ttatttactgagcttctctgt

SEQ ID NO: 878059 - DNA, 12 bp, Homo sapiens
ttatttactttt

SEQ ID NO: 878060 - DNA, 15 bp, Homo sapiens
ttatttagaatatgt

SEQ ID NO: 878061 - DNA, 14 bp, Homo sapiens
ttatttagacaaga

SEQ ID NO: 878062 - DNA, 18 bp, Homo sapiens
ttatttagactcatctta

SEQ ID NO: 878063 - DNA, 15 bp, Homo sapiens
ttatttaggaaacac

SEQ ID NO: 878064 - DNA, 16 bp, Homo sapiens
ttatttagttccttga

SEQ ID NO: 878065 - DNA, 21 bp, Homo sapiens
ttatttatatggggaatatat

SEQ ID NO: 878066 - DNA, 14 bp, Homo sapiens
ttatttatcaaaat

SEQ ID NO: 878067 - DNA, 16 bp, Homo sapiens
ttatttatcaaaatgt

SEQ ID NO: 878068 - DNA, 18 bp, Homo sapiens
ttatttatcaaaatgtag

SEQ ID NO: 878069 - DNA, 18 bp, Homo sapiens
ttatttatcaatttttcc

SEQ ID NO: 878070 - DNA, 15 bp, Homo sapiens
ttatttatctgagca

SEQ ID NO: 878071 - DNA, 12 bp, Homo sapiens
ttatttatgaat

SEQ ID NO: 878072 - DNA, 19 bp, Homo sapiens
ttatttatgacctgaaata

SEQ ID NO: 878073 - DNA, 20 bp, Homo sapiens
ttatttatgcctctgtattt

SEQ ID NO: 878074 - DNA, 21 bp, Homo sapiens
ttatttatgcgtaatttaatg

SEQ ID NO: 878075 - DNA, 15 bp, Homo sapiens
ttatttatggaatta

SEQ ID NO: 878076 - DNA, 14 bp, Homo sapiens
ttatttattaagat

SEQ ID NO: 878077 - DNA, 17 bp, Homo sapiens
ttatttattactgtccc

SEQ ID NO: 878078 - DNA, 14 bp, Homo sapiens
ttatttatttaata

SEQ ID NO: 878079 - DNA, 15 bp, Homo sapiens
ttatttatttatgga

SEQ ID NO: 878080 - DNA, 18 bp, Homo sapiens
ttatttcactaaatgtaa

SEQ ID NO: 878081 - DNA, 21 bp, Homo sapiens
ttatttcactttagatgctga

SEQ ID NO: 878082 - DNA, 15 bp, Homo sapiens
ttatttcagatgttt

SEQ ID NO: 878083 - DNA, 20 bp, Homo sapiens
ttatttcatatactataatt

SEQ ID NO: 878084 - DNA, 21 bp, Homo sapiens
ttatttcatatactataattg

SEQ ID NO: 878085 - DNA, 14 bp, Homo sapiens
ttatttcatccagt

SEQ ID NO: 878086 - DNA, 19 bp, Homo sapiens
ttatttcatgattagaaat

SEQ ID NO: 878087 - DNA, 20 bp, Homo sapiens
ttatttccagtgttctatga

SEQ ID NO: 878088 - DNA, 14 bp, Homo sapiens
ttatttctaaaata

SEQ ID NO: 878089 - DNA, 17 bp, Homo sapiens
ttatttctaagtattta

SEQ ID NO: 878090 - DNA, 22 bp, Homo sapiens
ttatttctagaagcacatgtgt

SEQ ID NO: 878091 - DNA, 18 bp, Homo sapiens
ttatttctctctcctggt

SEQ ID NO: 878092 - DNA, 16 bp, Homo sapiens
ttatttctctgatttg

SEQ ID NO: 878093 - DNA, 21 bp, Homo sapiens
ttatttctctggcaaactttt

SEQ ID NO: 878094 - DNA, 19 bp, Homo sapiens
ttatttctgatttcataat

SEQ ID NO: 878095 - DNA, 12 bp, Homo sapiens
ttatttctgcat

SEQ ID NO: 878096 - DNA, 13 bp, Homo sapiens
ttatttctgcata

SEQ ID NO: 878097 - DNA, 20 bp, Homo sapiens
ttatttctgcatatgttgaa

SEQ ID NO: 878098 - DNA, 16 bp, Homo sapiens
ttatttctgctctgga

SEQ ID NO: 878099 - DNA, 14 bp, Homo sapiens
ttatttttaaagat

SEQ ID NO: 878100 - DNA, 13 bp, Homo sapiens
ttatttttaagaa

SEQ ID NO: 878101 - DNA, 17 bp, Homo sapiens
ttatttttaatttaaaa

SEQ ID NO: 878102 - DNA, 22 bp, Homo sapiens
ttatttttacgtagaagctctt

SEQ ID NO: 878103 - DNA, 13 bp, Homo sapiens
ttatttttataat

SEQ ID NO: 878104 - DNA, 15 bp, Homo sapiens
ttatttttataatta

SEQ ID NO: 878105 - DNA, 15 bp, Homo sapiens
ttatttttattactt

SEQ ID NO: 878106 - DNA, 17 bp, Homo sapiens
ttatttttattactttt

SEQ ID NO: 878107 - DNA, 14 bp, Homo sapiens
ttatttttcaagga

SEQ ID NO: 878108 - DNA, 10 bp, Homo sapiens
ttatttttct

SEQ ID NO: 878109 - DNA, 21 bp, Homo sapiens
ttatttttctcttgtaccata

SEQ ID NO: 878110 - DNA, 12 bp, Homo sapiens
ttatttttctgt

SEQ ID NO: 878111 - DNA, 14 bp, Homo sapiens
ttatttttctgtta

SEQ ID NO: 878112 - DNA, 14 bp, Homo sapiens
ttatttttgcaaaa

SEQ ID NO: 878113 - DNA, 23 bp, Homo sapiens
ttatttttggcgtggctgactta

SEQ ID NO: 878114 - DNA, 15 bp, Homo sapiens
ttatttttgtatgcc

SEQ ID NO: 878115 - DNA, 17 bp, Homo sapiens
ttattttttaaatgtaa

SEQ ID NO: 878116 - DNA, 19 bp, Homo sapiens
ttattttttagtgatgaga

SEQ ID NO: 878117 - DNA, 21 bp, Homo sapiens
ttattttttgggccattaccc

SEQ ID NO: 878118 - DNA, 17 bp, Homo sapiens
ttcaaaaagtgtttatt

SEQ ID NO: 878119 - DNA, 15 bp, Homo sapiens
ttcaaaaatataact

SEQ ID NO: 878120 - DNA, 21 bp, Homo sapiens
ttcaaaacctgcagttaacag

SEQ ID NO: 878121 - DNA, 12 bp, Homo sapiens
ttcaaaagtatt

SEQ ID NO: 878122 - DNA, 14 bp, Homo sapiens
ttcaaaagtgatta

SEQ ID NO: 878123 - DNA, 20 bp, Homo sapiens
ttcaaaatatttaaaaatgt

SEQ ID NO: 878124 - DNA, 13 bp, Homo sapiens
ttcaaaatgctct

SEQ ID NO: 878125 - DNA, 20 bp, Homo sapiens
ttcaaaatgctttttattat

SEQ ID NO: 878126 - DNA, 14 bp, Homo sapiens
ttcaaaatgtctgt

SEQ ID NO: 878127 - DNA, 18 bp, Homo sapiens
ttcaaaattctaaatgta

SEQ ID NO: 878128 - DNA, 22 bp, Homo sapiens
ttcaaaccaaagctgcctgtgc

SEQ ID NO: 878129 - DNA, 21 bp, Homo sapiens
ttcaaaccttggtatctgttg

SEQ ID NO: 878130 - DNA, 15 bp, Homo sapiens
ttcaaactggggcct

SEQ ID NO: 878131 - DNA, 16 bp, Homo sapiens
ttcaaactggggcctc

SEQ ID NO: 878132 - DNA, 13 bp, Homo sapiens
ttcaaactttcac

SEQ ID NO: 878133 - DNA, 16 bp, Homo sapiens
ttcaaactttcacttt

SEQ ID NO: 878134 - DNA, 17 bp, Homo sapiens
ttcaaactttcactttg

SEQ ID NO: 878135 - DNA, 21 bp, Homo sapiens
ttcaaagaaatccaaatttct

SEQ ID NO: 878136 - DNA, 12 bp, Homo sapiens
ttcaaagagatg

SEQ ID NO: 878137 - DNA, 12 bp, Homo sapiens
ttcaaagcaatt

SEQ ID NO: 878138 - DNA, 22 bp, Homo sapiens
ttcaaagcaattgaaatgcatt

SEQ ID NO: 878139 - DNA, 21 bp, Homo sapiens
ttcaaagcacaataactagta

SEQ ID NO: 878140 - DNA, 17 bp, Homo sapiens
ttcaaagcagcagccac

SEQ ID NO: 878141 - DNA, 16 bp, Homo sapiens
ttcaaagcatgaaatg

SEQ ID NO: 878142 - DNA, 23 bp, Homo sapiens
ttcaaagccagcgtcctcctctg

SEQ ID NO: 878143 - DNA, 13 bp, Homo sapiens
ttcaaagccctgc

SEQ ID NO: 878144 - DNA, 16 bp, Homo sapiens
ttcaaagccctgcctc

SEQ ID NO: 878145 - DNA, 22 bp, Homo sapiens
ttcaaagcttaaaaagagctca

SEQ ID NO: 878146 - DNA, 23 bp, Homo sapiens
ttcaaagtgtatatttattcata

SEQ ID NO: 878147 - DNA, 20 bp, Homo sapiens
ttcaaagtgttgtgttcctg

SEQ ID NO: 878148 - DNA, 21 bp, Homo sapiens
ttcaaagttgtagttcttgtg

SEQ ID NO: 878149 - DNA, 19 bp, Homo sapiens
ttcaaataatccattccaa

SEQ ID NO: 878150 - DNA, 18 bp, Homo sapiens
ttcaaatagatttttgat

SEQ ID NO: 878151 - DNA, 12 bp, Homo sapiens
ttcaaatcctca

SEQ ID NO: 878152 - DNA, 20 bp, Homo sapiens
ttcaaatctcagcaaagcta

SEQ ID NO: 878153 - DNA, 21 bp, Homo sapiens
ttcaaatctgtaatcagcaat

SEQ ID NO: 878154 - DNA, 18 bp, Homo sapiens
ttcaaatgaactttaaaa

SEQ ID NO: 878155 - DNA, 12 bp, Homo sapiens
ttcaaatgaagg

SEQ ID NO: 878156 - DNA, 22 bp, Homo sapiens
ttcaaatgatttttacaagttt

SEQ ID NO: 878157 - DNA, 13 bp, Homo sapiens
ttcaaatgcattt

SEQ ID NO: 878158 - DNA, 14 bp, Homo sapiens
ttcaaatgcatttt

SEQ ID NO: 878159 - DNA, 16 bp, Homo sapiens
ttcaaattcttctgaa

SEQ ID NO: 878160 - DNA, 13 bp, Homo sapiens
ttcaaattgaatt

SEQ ID NO: 878161 - DNA, 17 bp, Homo sapiens
ttcaaattgctgcttgg

SEQ ID NO: 878162 - DNA, 22 bp, Homo sapiens
ttcaaattggaatggaactact

SEQ ID NO: 878163 - DNA, 16 bp, Homo sapiens
ttcaaattggtctgaa

SEQ ID NO: 878164 - DNA, 13 bp, Homo sapiens
ttcaaatttgtac

SEQ ID NO: 878165 - DNA, 22 bp, Homo sapiens
ttcaaatttgtctggttaaaaa

SEQ ID NO: 878166 - DNA, 14 bp, Homo sapiens
ttcaacaattctaa

SEQ ID NO: 878167 - DNA, 18 bp, Homo sapiens
ttcaacaattctaaaatg

SEQ ID NO: 878168 - DNA, 19 bp, Homo sapiens
ttcaacaattctaaaatga

SEQ ID NO: 878169 - DNA, 15 bp, Homo sapiens
ttcaacaatttcaat

SEQ ID NO: 878170 - DNA, 22 bp, Homo sapiens
ttcaacagatgaccgtgtacaa

SEQ ID NO: 878171 - DNA, 14 bp, Homo sapiens
ttcaacatcaatgt

SEQ ID NO: 878172 - DNA, 15 bp, Homo sapiens
ttcaacatcaatgtt

SEQ ID NO: 878173 - DNA, 19 bp, Homo sapiens
ttcaacatcaatgttcatt

SEQ ID NO: 878174 - DNA, 17 bp, Homo sapiens
ttcaacatgagtgtatt

SEQ ID NO: 878175 - DNA, 11 bp, Homo sapiens
ttcaacatgta

SEQ ID NO: 878176 - DNA, 21 bp, Homo sapiens
ttcaacatgttatttgtaata

SEQ ID NO: 878177 - DNA, 15 bp, Homo sapiens
ttcaacctaaatact

SEQ ID NO: 878178 - DNA, 16 bp, Homo sapiens
ttcaacctaaatactg

SEQ ID NO: 878179 - DNA, 13 bp, Homo sapiens
ttcaacgcagccc

SEQ ID NO: 878180 - DNA, 16 bp, Homo sapiens
ttcaacgcagccctgc

SEQ ID NO: 878181 - DNA, 14 bp, Homo sapiens
ttcaactgaaaaga

SEQ ID NO: 878182 - DNA, 13 bp, Homo sapiens
ttcaactgctttg

SEQ ID NO: 878183 - DNA, 19 bp, Homo sapiens
ttcaactgtcttcctcaaa

SEQ ID NO: 878184 - DNA, 19 bp, Homo sapiens
ttcaagaaaagtaagccct

SEQ ID NO: 878185 - DNA, 12 bp, Homo sapiens
ttcaagaaactg

SEQ ID NO: 878186 - DNA, 20 bp, Homo sapiens
ttcaagaaactgaggaattt

SEQ ID NO: 878187 - DNA, 17 bp, Homo sapiens
ttcaagaatgaaaaata

SEQ ID NO: 878188 - DNA, 13 bp, Homo sapiens
ttcaagaccagcc

SEQ ID NO: 878189 - DNA, 14 bp, Homo sapiens
ttcaagaccagcct

SEQ ID NO: 878190 - DNA, 19 bp, Homo sapiens
ttcaagacttgagcggagc

SEQ ID NO: 878191 - DNA, 12 bp, Homo sapiens
ttcaagattcta

SEQ ID NO: 878192 - DNA, 12 bp, Homo sapiens
ttcaagcaaaca

SEQ ID NO: 878193 - DNA, 13 bp, Homo sapiens
ttcaagcaaacat

SEQ ID NO: 878194 - DNA, 17 bp, Homo sapiens
ttcaagcaaacatcaaa

SEQ ID NO: 878195 - DNA, 20 bp, Homo sapiens
ttcaagcaaacatcaaataa

SEQ ID NO: 878196 - DNA, 18 bp, Homo sapiens
ttcaagcacactggaata

SEQ ID NO: 878197 - DNA, 19 bp, Homo sapiens
ttcaagcacactggaatat

SEQ ID NO: 878198 - DNA, 18 bp, Homo sapiens
ttcaagcatcctcagaag

SEQ ID NO: 878199 - DNA, 15 bp, Homo sapiens
ttcaagcctgtggga

SEQ ID NO: 878200 - DNA, 14 bp, Homo sapiens
ttcaagctatttaa

SEQ ID NO: 878201 - DNA, 12 bp, Homo sapiens
ttcaaggaaagt

SEQ ID NO: 878202 - DNA, 18 bp, Homo sapiens
ttcaaggaagaaaacgga

SEQ ID NO: 878203 - DNA, 16 bp, Homo sapiens
ttcaaggactgtttca

SEQ ID NO: 878204 - DNA, 14 bp, Homo sapiens
ttcaaggcctcccc

SEQ ID NO: 878205 - DNA, 17 bp, Homo sapiens
ttcaaggccttcagttt

SEQ ID NO: 878206 - DNA, 20 bp, Homo sapiens
ttcaaggccttcagtttatt

SEQ ID NO: 878207 - DNA, 13 bp, Homo sapiens
ttcaaggctgggg

SEQ ID NO: 878208 - DNA, 19 bp, Homo sapiens
ttcaaggctttaaaagtca

SEQ ID NO: 878209 - DNA, 17 bp, Homo sapiens
ttcaagggacaagtatt

SEQ ID NO: 878210 - DNA, 12 bp, Homo sapiens
ttcaagtaacac

SEQ ID NO: 878211 - DNA, 16 bp, Homo sapiens
ttcaagtcacctcctt

SEQ ID NO: 878212 - DNA, 20 bp, Homo sapiens
ttcaagtgattctcctgcct

SEQ ID NO: 878213 - DNA, 20 bp, Homo sapiens
ttcaagtgcctcttgttgca

SEQ ID NO: 878214 - DNA, 13 bp, Homo sapiens
ttcaagtgccttt

SEQ ID NO: 878215 - DNA, 16 bp, Homo sapiens
ttcaagttagctcagg

SEQ ID NO: 878216 - DNA, 14 bp, Homo sapiens
ttcaagttattcaa

SEQ ID NO: 878217 - DNA, 14 bp, Homo sapiens
ttcaagttattgta

SEQ ID NO: 878218 - DNA, 14 bp, Homo sapiens
ttcaagttcaatcc

SEQ ID NO: 878219 - DNA, 23 bp, Homo sapiens
ttcaagttccaagttgctaatac

SEQ ID NO: 878220 - DNA, 12 bp, Homo sapiens
ttcaagttgtaa

SEQ ID NO: 878221 - DNA, 13 bp, Homo sapiens
ttcaagttgtaaa

SEQ ID NO: 878222 - DNA, 22 bp, Homo sapiens
ttcaagttgtaaataatttatt

SEQ ID NO: 878223 - DNA, 18 bp, Homo sapiens
ttcaagttttaaagttca

SEQ ID NO: 878224 - DNA, 22 bp, Homo sapiens
ttcaagttttgggtatgtttaa

SEQ ID NO: 878225 - DNA, 17 bp, Homo sapiens
ttcaataaagcagttaa

SEQ ID NO: 878226 - DNA, 16 bp, Homo sapiens
ttcaataaagcattta

SEQ ID NO: 878227 - DNA, 17 bp, Homo sapiens
ttcaataaatgtatcat

SEQ ID NO: 878228 - DNA, 17 bp, Homo sapiens
ttcaataccgctcagta

SEQ ID NO: 878229 - DNA, 18 bp, Homo sapiens
ttcaatactcttgaaatg

SEQ ID NO: 878230 - DNA, 22 bp, Homo sapiens
ttcaatataagaagcaatcttt

SEQ ID NO: 878231 - DNA, 16 bp, Homo sapiens
ttcaatatgaatctat

SEQ ID NO: 878232 - DNA, 20 bp, Homo sapiens
ttcaatatgcaagcagcttt

SEQ ID NO: 878233 - DNA, 19 bp, Homo sapiens
ttcaatattgacatttgta

SEQ ID NO: 878234 - DNA, 21 bp, Homo sapiens
ttcaatattgacatttgtagt

SEQ ID NO: 878235 - DNA, 19 bp, Homo sapiens
ttcaatcaactttactgta

SEQ ID NO: 878236 - DNA, 15 bp, Homo sapiens
ttcaatctctggaaa

SEQ ID NO: 878237 - DNA, 18 bp, Homo sapiens
ttcaatctctgttctgct

SEQ ID NO: 878238 - DNA, 14 bp, Homo sapiens
ttcaatctgtaaac

SEQ ID NO: 878239 - DNA, 20 bp, Homo sapiens
ttcaatctgtaaactgtgta

SEQ ID NO: 878240 - DNA, 17 bp, Homo sapiens
ttcaatgacttctaatt

SEQ ID NO: 878241 - DNA, 19 bp, Homo sapiens
ttcaatgcatacaataaaa

SEQ ID NO: 878242 - DNA, 21 bp, Homo sapiens
ttcaatgtgaaacacatgcca

SEQ ID NO: 878243 - DNA, 16 bp, Homo sapiens
ttcaatgtgactgaaa

SEQ ID NO: 878244 - DNA, 21 bp, Homo sapiens
ttcaatgtgattctaatgtct

SEQ ID NO: 878245 - DNA, 21 bp, Homo sapiens
ttcaatgtgtataaattgtct

SEQ ID NO: 878246 - DNA, 18 bp, Homo sapiens
ttcaatgtgttggaaact

SEQ ID NO: 878247 - DNA, 20 bp, Homo sapiens
ttcaatgtttttaaaaatct

SEQ ID NO: 878248 - DNA, 12 bp, Homo sapiens
ttcaattaaaat

SEQ ID NO: 878249 - DNA, 21 bp, Homo sapiens
ttcaattagggatgctcaaac

SEQ ID NO: 878250 - DNA, 21 bp, Homo sapiens
ttcaattcagattgtcttgca

SEQ ID NO: 878251 - DNA, 13 bp, Homo sapiens
ttcaattcctggg

SEQ ID NO: 878252 - DNA, 16 bp, Homo sapiens
ttcaattctgtaatta

SEQ ID NO: 878253 - DNA, 15 bp, Homo sapiens
ttcaattttaaagac

SEQ ID NO: 878254 - DNA, 18 bp, Homo sapiens
ttcaattttttaatgttt

SEQ ID NO: 878255 - DNA, 15 bp, Homo sapiens
ttcacaaaatttcca

SEQ ID NO: 878256 - DNA, 21 bp, Homo sapiens
ttcacaaactgtgaaaatagt

SEQ ID NO: 878257 - DNA, 22 bp, Homo sapiens
ttcacaaacttttatactcttt

SEQ ID NO: 878258 - DNA, 18 bp, Homo sapiens
ttcacaaatgtcattgtc

SEQ ID NO: 878259 - DNA, 21 bp, Homo sapiens
ttcacaaccttctgtggctca

SEQ ID NO: 878260 - DNA, 16 bp, Homo sapiens
ttcacaagctaacttc

SEQ ID NO: 878261 - DNA, 17 bp, Homo sapiens
ttcacacctcacgctct

SEQ ID NO: 878262 - DNA, 19 bp, Homo sapiens
ttcacacctcacgctctgg

SEQ ID NO: 878263 - DNA, 21 bp, Homo sapiens
ttcacactgcaagagccttgg

SEQ ID NO: 878264 - DNA, 14 bp, Homo sapiens
ttcacagactgatt

SEQ ID NO: 878265 - DNA, 18 bp, Homo sapiens
ttcacagagcacgcctgc

SEQ ID NO: 878266 - DNA, 23 bp, Homo sapiens
ttcacagagtgtgctgctatttt

SEQ ID NO: 878267 - DNA, 12 bp, Homo sapiens
ttcacagcccag

SEQ ID NO: 878268 - DNA, 18 bp, Homo sapiens
ttcacaggcagtgcatgt

SEQ ID NO: 878269 - DNA, 15 bp, Homo sapiens
ttcacaggtcaataa

SEQ ID NO: 878270 - DNA, 19 bp, Homo sapiens
ttcacagtacccaaactgc

SEQ ID NO: 878271 - DNA, 17 bp, Homo sapiens
ttcacagtagagccagc

SEQ ID NO: 878272 - DNA, 16 bp, Homo sapiens
ttcacagtcactgatg

SEQ ID NO: 878273 - DNA, 19 bp, Homo sapiens
ttcacatcctgtgtttcta

SEQ ID NO: 878274 - DNA, 13 bp, Homo sapiens
ttcacatctcatt

SEQ ID NO: 878275 - DNA, 13 bp, Homo sapiens
ttcaccaaaatta

SEQ ID NO: 878276 - DNA, 14 bp, Homo sapiens
ttcaccaaatcttg

SEQ ID NO: 878277 - DNA, 13 bp, Homo sapiens
ttcaccaccccct

SEQ ID NO: 878278 - DNA, 18 bp, Homo sapiens
ttcaccactcctctccct

SEQ ID NO: 878279 - DNA, 14 bp, Homo sapiens
ttcaccagaagtta

SEQ ID NO: 878280 - DNA, 13 bp, Homo sapiens
ttcaccagtctgt

SEQ ID NO: 878281 - DNA, 20 bp, Homo sapiens
ttcaccagtctgtctactgt

SEQ ID NO: 878282 - DNA, 22 bp, Homo sapiens
ttcaccagtctgtctactgtgg

SEQ ID NO: 878283 - DNA, 16 bp, Homo sapiens
ttcaccagtgttcctg

SEQ ID NO: 878284 - DNA, 18 bp, Homo sapiens
ttcacccagctaatctgt

SEQ ID NO: 878285 - DNA, 23 bp, Homo sapiens
ttcaccccccactcaccagtgtc

SEQ ID NO: 878286 - DNA, 16 bp, Homo sapiens
ttcaccccctttcctg

SEQ ID NO: 878287 - DNA, 18 bp, Homo sapiens
ttcacccctacactgtga

SEQ ID NO: 878288 - DNA, 16 bp, Homo sapiens
ttcaccctccacttcc

SEQ ID NO: 878289 - DNA, 22 bp, Homo sapiens
ttcaccctgtcaagttaacaag

SEQ ID NO: 878290 - DNA, 17 bp, Homo sapiens
ttcacctaagtctctgt

SEQ ID NO: 878291 - DNA, 23 bp, Homo sapiens
ttcacctagcaacatatctctgc

SEQ ID NO: 878292 - DNA, 22 bp, Homo sapiens
ttcacctcactgaaaacatctg

SEQ ID NO: 878293 - DNA, 14 bp, Homo sapiens
ttcacctcagtaga

SEQ ID NO: 878294 - DNA, 14 bp, Homo sapiens
ttcacctctattct

SEQ ID NO: 878295 - DNA, 21 bp, Homo sapiens
ttcacctcttccactccttct

SEQ ID NO: 878296 - DNA, 18 bp, Homo sapiens
ttcacctcttcctctggt

SEQ ID NO: 878297 - DNA, 18 bp, Homo sapiens
ttcacctgccccaactct

SEQ ID NO: 878298 - DNA, 13 bp, Homo sapiens
ttcacctgtaaac

SEQ ID NO: 878299 - DNA, 16 bp, Homo sapiens
ttcacctgtaaacctg

SEQ ID NO: 878300 - DNA, 17 bp, Homo sapiens
ttcacctgtaaacctga

SEQ ID NO: 878301 - DNA, 16 bp, Homo sapiens
ttcacctgtgacaaag

SEQ ID NO: 878302 - DNA, 19 bp, Homo sapiens
ttcacctgtgacaaaggat

SEQ ID NO: 878303 - DNA, 15 bp, Homo sapiens
ttcacctgttatgta

SEQ ID NO: 878304 - DNA, 18 bp, Homo sapiens
ttcacctgttatgtatga

SEQ ID NO: 878305 - DNA, 23 bp, Homo sapiens
ttcacctgttatgtatgaaggaa

SEQ ID NO: 878306 - DNA, 15 bp, Homo sapiens
ttcaccttagtgcaa

SEQ ID NO: 878307 - DNA, 12 bp, Homo sapiens
ttcaccttccct

SEQ ID NO: 878308 - DNA, 14 bp, Homo sapiens
ttcaccttccctcg

SEQ ID NO: 878309 - DNA, 14 bp, Homo sapiens
ttcaccttggaagg

SEQ ID NO: 878310 - DNA, 15 bp, Homo sapiens
ttcaccttggaaggg

SEQ ID NO: 878311 - DNA, 22 bp, Homo sapiens
ttcacctttcctctccctcagg

SEQ ID NO: 878312 - DNA, 21 bp, Homo sapiens
ttcacgacaatgttgagaagt

SEQ ID NO: 878313 - DNA, 15 bp, Homo sapiens
ttcacgattcatttt

SEQ ID NO: 878314 - DNA, 21 bp, Homo sapiens
ttcacgggaactctccaaata

SEQ ID NO: 878315 - DNA, 18 bp, Homo sapiens
ttcacggtgacacaggtc

SEQ ID NO: 878316 - DNA, 19 bp, Homo sapiens
ttcacgtaaatattcatat

SEQ ID NO: 878317 - DNA, 20 bp, Homo sapiens
ttcacgtaagatacaagttt

SEQ ID NO: 878318 - DNA, 14 bp, Homo sapiens
ttcactaaagcagt

SEQ ID NO: 878319 - DNA, 18 bp, Homo sapiens
ttcactactcatgcgtga

SEQ ID NO: 878320 - DNA, 15 bp, Homo sapiens
ttcactagggctgag

SEQ ID NO: 878321 - DNA, 18 bp, Homo sapiens
ttcactataaatggtgtt

SEQ ID NO: 878322 - DNA, 14 bp, Homo sapiens
ttcactatttcctt

SEQ ID NO: 878323 - DNA, 20 bp, Homo sapiens
ttcactatttttatttatat

SEQ ID NO: 878324 - DNA, 21 bp, Homo sapiens
ttcactccggtgtgcctgcag

SEQ ID NO: 878325 - DNA, 22 bp, Homo sapiens
ttcactccggtgtgcctgcagc

SEQ ID NO: 878326 - DNA, 17 bp, Homo sapiens
ttcactcctgcttctct

SEQ ID NO: 878327 - DNA, 15 bp, Homo sapiens
ttcactcttcacttg

SEQ ID NO: 878328 - DNA, 16 bp, Homo sapiens
ttcactcttccagaat

SEQ ID NO: 878329 - DNA, 22 bp, Homo sapiens
ttcactgaagaaaccttcagat

SEQ ID NO: 878330 - DNA, 13 bp, Homo sapiens
ttcactgcaattt

SEQ ID NO: 878331 - DNA, 22 bp, Homo sapiens
ttcactgccccacttctggcat

SEQ ID NO: 878332 - DNA, 13 bp, Homo sapiens
ttcactgctggct

SEQ ID NO: 878333 - DNA, 18 bp, Homo sapiens
ttcactgctggctgcctt

SEQ ID NO: 878334 - DNA, 20 bp, Homo sapiens
ttcactggccacagttgttt

SEQ ID NO: 878335 - DNA, 17 bp, Homo sapiens
ttcactggttttacaca

SEQ ID NO: 878336 - DNA, 13 bp, Homo sapiens
ttcactgtactgc

SEQ ID NO: 878337 - DNA, 14 bp, Homo sapiens
ttcactgtatataa

SEQ ID NO: 878338 - DNA, 16 bp, Homo sapiens
ttcactgtatataaac

SEQ ID NO: 878339 - DNA, 23 bp, Homo sapiens
ttcactgtcaccaccctgctcat

SEQ ID NO: 878340 - DNA, 22 bp, Homo sapiens
ttcactgtcaggaagaaatcac

SEQ ID NO: 878341 - DNA, 17 bp, Homo sapiens
ttcactgtcatcttcaa

SEQ ID NO: 878342 - DNA, 22 bp, Homo sapiens
ttcactgtggccacagccccct

SEQ ID NO: 878343 - DNA, 21 bp, Homo sapiens
ttcactgtttcacttgctctt

SEQ ID NO: 878344 - DNA, 20 bp, Homo sapiens
ttcacttctttgcagagcct

SEQ ID NO: 878345 - DNA, 17 bp, Homo sapiens
ttcacttgaaagatttt

SEQ ID NO: 878346 - DNA, 19 bp, Homo sapiens
ttcacttgagcaagatgat

SEQ ID NO: 878347 - DNA, 16 bp, Homo sapiens
ttcacttgatgtttgt

SEQ ID NO: 878348 - DNA, 13 bp, Homo sapiens
ttcacttgtctcc

SEQ ID NO: 878349 - DNA, 18 bp, Homo sapiens
ttcacttgtctcctttct

SEQ ID NO: 878350 - DNA, 18 bp, Homo sapiens
ttcacttgtcttgctctt

SEQ ID NO: 878351 - DNA, 16 bp, Homo sapiens
ttcactttagatgctg

SEQ ID NO: 878352 - DNA, 17 bp, Homo sapiens
ttcactttagatgctga

SEQ ID NO: 878353 - DNA, 17 bp, Homo sapiens
ttcactttcaaaaacat

SEQ ID NO: 878354 - DNA, 19 bp, Homo sapiens
ttcactttcacatagatgt

SEQ ID NO: 878355 - DNA, 14 bp, Homo sapiens
ttcactttgaaaag

SEQ ID NO: 878356 - DNA, 23 bp, Homo sapiens
ttcactttgaaaagttggaagga

SEQ ID NO: 878357 - DNA, 20 bp, Homo sapiens
ttcacttttgacaaaggcaa

SEQ ID NO: 878358 - DNA, 15 bp, Homo sapiens
ttcagaaaatgttct

SEQ ID NO: 878359 - DNA, 15 bp, Homo sapiens
ttcagaaacagggca

SEQ ID NO: 878360 - DNA, 18 bp, Homo sapiens
ttcagaaatgctgcctgc

SEQ ID NO: 878361 - DNA, 11 bp, Homo sapiens
ttcagaaatgt

SEQ ID NO: 878362 - DNA, 13 bp, Homo sapiens
ttcagaaattaaa

SEQ ID NO: 878363 - DNA, 18 bp, Homo sapiens
ttcagaaattaaaatatt

SEQ ID NO: 878364 - DNA, 21 bp, Homo sapiens
ttcagaaattaaaatattatt

SEQ ID NO: 878365 - DNA, 14 bp, Homo sapiens
ttcagaaattccaa

SEQ ID NO: 878366 - DNA, 13 bp, Homo sapiens
ttcagaaattgga

SEQ ID NO: 878367 - DNA, 22 bp, Homo sapiens
ttcagaacaactgcaaagaaag

SEQ ID NO: 878368 - DNA, 13 bp, Homo sapiens
ttcagaacacttt

SEQ ID NO: 878369 - DNA, 17 bp, Homo sapiens
ttcagaacctcttcccc

SEQ ID NO: 878370 - DNA, 18 bp, Homo sapiens
ttcagaacctcttcccca

SEQ ID NO: 878371 - DNA, 13 bp, Homo sapiens
ttcagaactattt

SEQ ID NO: 878372 - DNA, 17 bp, Homo sapiens
ttcagaactatttaaaa

SEQ ID NO: 878373 - DNA, 20 bp, Homo sapiens
ttcagaactatttaaaataa

SEQ ID NO: 878374 - DNA, 22 bp, Homo sapiens
ttcagaactgagggctctgttt

SEQ ID NO: 878375 - DNA, 23 bp, Homo sapiens
ttcagaactgcccttgctgcccg

SEQ ID NO: 878376 - DNA, 22 bp, Homo sapiens
ttcagaagatggtgaagacaga

SEQ ID NO: 878377 - DNA, 16 bp, Homo sapiens
ttcagaagcaagccag

SEQ ID NO: 878378 - DNA, 17 bp, Homo sapiens
ttcagaagcaagccaga

SEQ ID NO: 878379 - DNA, 16 bp, Homo sapiens
ttcagaagctattttt

SEQ ID NO: 878380 - DNA, 17 bp, Homo sapiens
ttcagaagcttctgaaa

SEQ ID NO: 878381 - DNA, 13 bp, Homo sapiens
ttcagaaggagaa

SEQ ID NO: 878382 - DNA, 16 bp, Homo sapiens
ttcagaaggtgtgtcc

SEQ ID NO: 878383 - DNA, 17 bp, Homo sapiens
ttcagaagtcacacatt

SEQ ID NO: 878384 - DNA, 23 bp, Homo sapiens
ttcagaagtgagctttgctgcta

SEQ ID NO: 878385 - DNA, 15 bp, Homo sapiens
ttcagaagttagttt

SEQ ID NO: 878386 - DNA, 20 bp, Homo sapiens
ttcagaagtttggcaatagt

SEQ ID NO: 878387 - DNA, 21 bp, Homo sapiens
ttcagaataaattgatccttt

SEQ ID NO: 878388 - DNA, 21 bp, Homo sapiens
ttcagaatttagtgtatccat

SEQ ID NO: 878389 - DNA, 16 bp, Homo sapiens
ttcagaattttgtata

SEQ ID NO: 878390 - DNA, 21 bp, Homo sapiens
ttcagacacatgctatgttct

SEQ ID NO: 878391 - DNA, 20 bp, Homo sapiens
ttcagacacctgttcacaga

SEQ ID NO: 878392 - DNA, 22 bp, Homo sapiens
ttcagacacctgttcacagaaa

SEQ ID NO: 878393 - DNA, 15 bp, Homo sapiens
ttcagacactttgga

SEQ ID NO: 878394 - DNA, 10 bp, Homo sapiens
ttcagacccc

SEQ ID NO: 878395 - DNA, 13 bp, Homo sapiens
ttcagaccccagc

SEQ ID NO: 878396 - DNA, 16 bp, Homo sapiens
ttcagacccctgcctg

SEQ ID NO: 878397 - DNA, 14 bp, Homo sapiens
ttcagacgagatcc

SEQ ID NO: 878398 - DNA, 12 bp, Homo sapiens
ttcagactcaga

SEQ ID NO: 878399 - DNA, 14 bp, Homo sapiens
ttcagacttgtcaa

SEQ ID NO: 878400 - DNA, 19 bp, Homo sapiens
ttcagactttgcttcccat

SEQ ID NO: 878401 - DNA, 20 bp, Homo sapiens
ttcagagaaaggactgtgga

SEQ ID NO: 878402 - DNA, 15 bp, Homo sapiens
ttcagagactcaggg

SEQ ID NO: 878403 - DNA, 15 bp, Homo sapiens
ttcagagactgccct

SEQ ID NO: 878404 - DNA, 13 bp, Homo sapiens
ttcagagagctgg

SEQ ID NO: 878405 - DNA, 23 bp, Homo sapiens
ttcagagagtcaatgtcattaca

SEQ ID NO: 878406 - DNA, 18 bp, Homo sapiens
ttcagagcataaaaccta

SEQ ID NO: 878407 - DNA, 19 bp, Homo sapiens
ttcagagtggctcactggc

SEQ ID NO: 878408 - DNA, 16 bp, Homo sapiens
ttcagagtttgtgtgt

SEQ ID NO: 878409 - DNA, 17 bp, Homo sapiens
ttcagagtttgtgtgta

SEQ ID NO: 878410 - DNA, 21 bp, Homo sapiens
ttcagatacagggtgctcctt

SEQ ID NO: 878411 - DNA, 17 bp, Homo sapiens
ttcagatatcaaaattc

SEQ ID NO: 878412 - DNA, 22 bp, Homo sapiens
ttcagatctgaggttggatttg

SEQ ID NO: 878413 - DNA, 17 bp, Homo sapiens
ttcagatgaccttttgg

SEQ ID NO: 878414 - DNA, 19 bp, Homo sapiens
ttcagatgatttgaaagca

SEQ ID NO: 878415 - DNA, 19 bp, Homo sapiens
ttcagatgcttctgggaga

SEQ ID NO: 878416 - DNA, 17 bp, Homo sapiens
ttcagatgtaatgtttt

SEQ ID NO: 878417 - DNA, 18 bp, Homo sapiens
ttcagatgtaatgttttc

SEQ ID NO: 878418 - DNA, 13 bp, Homo sapiens
ttcagatgtatgt

SEQ ID NO: 878419 - DNA, 14 bp, Homo sapiens
ttcagatgtcttct

SEQ ID NO: 878420 - DNA, 20 bp, Homo sapiens
ttcagatgtcttctgcctgt

SEQ ID NO: 878421 - DNA, 14 bp, Homo sapiens
ttcagatgtgcaat

SEQ ID NO: 878422 - DNA, 15 bp, Homo sapiens
ttcagatgtgcattt

SEQ ID NO: 878423 - DNA, 17 bp, Homo sapiens
ttcagatgtgcatttca

SEQ ID NO: 878424 - DNA, 21 bp, Homo sapiens
ttcagattcccagagcaaaat

SEQ ID NO: 878425 - DNA, 22 bp, Homo sapiens
ttcagattcccagagcaaaata

SEQ ID NO: 878426 - DNA, 22 bp, Homo sapiens
ttcagattgtggaatgttggat

SEQ ID NO: 878427 - DNA, 13 bp, Homo sapiens
ttcagcaaaccat

SEQ ID NO: 878428 - DNA, 20 bp, Homo sapiens
ttcagcaaactcttttccca

SEQ ID NO: 878429 - DNA, 19 bp, Homo sapiens
ttcagcaagttagaactag

SEQ ID NO: 878430 - DNA, 14 bp, Homo sapiens
ttcagcacccccac

SEQ ID NO: 878431 - DNA, 17 bp, Homo sapiens
ttcagcacccccaccca

SEQ ID NO: 878432 - DNA, 17 bp, Homo sapiens
ttcagtttttgtatctt

SEQ ID NO: 878433 - DNA, 18 bp, Homo sapiens
ttcagtttttttaaatgc

SEQ ID NO: 878434 - DNA, 15 bp, Homo sapiens
ttcataaatgaattt

SEQ ID NO: 878435 - DNA, 14 bp, Homo sapiens
ttcataagacactt

SEQ ID NO: 878436 - DNA, 21 bp, Homo sapiens
ttcataatcagtaaatagtgt

SEQ ID NO: 878437 - DNA, 14 bp, Homo sapiens
ttcataatgaatta

SEQ ID NO: 878438 - DNA, 15 bp, Homo sapiens
ttcataattctgaaa

SEQ ID NO: 878439 - DNA, 16 bp, Homo sapiens
ttcataattctgaaac

SEQ ID NO: 878440 - DNA, 23 bp, Homo sapiens
ttcataattttagtaatttccta

SEQ ID NO: 878441 - DNA, 15 bp, Homo sapiens
ttcataccacttgaa

SEQ ID NO: 878442 - DNA, 12 bp, Homo sapiens
ttcataccgcct

SEQ ID NO: 878443 - DNA, 21 bp, Homo sapiens
ttcataccgcctcgtgccagc

SEQ ID NO: 878444 - DNA, 17 bp, Homo sapiens
ttcatagatgcaggagg

SEQ ID NO: 878445 - DNA, 15 bp, Homo sapiens
ttcatagctgtactt

SEQ ID NO: 878446 - DNA, 19 bp, Homo sapiens
ttcataggcggtcatgtgt

SEQ ID NO: 878447 - DNA, 20 bp, Homo sapiens
ttcatagggaaaggttttgt

SEQ ID NO: 878448 - DNA, 23 bp, Homo sapiens
ttcatagggaaaggttttgtatt

SEQ ID NO: 878449 - DNA, 19 bp, Homo sapiens
ttcataggtcactggctct

SEQ ID NO: 878450 - DNA, 14 bp, Homo sapiens
ttcatagtgccttt

SEQ ID NO: 878451 - DNA, 17 bp, Homo sapiens
ttcatagttcagaattt

SEQ ID NO: 878452 - DNA, 15 bp, Homo sapiens
ttcatataaaaacac

SEQ ID NO: 878453 - DNA, 20 bp, Homo sapiens
ttcatataaaagttgcgttt

SEQ ID NO: 878454 - DNA, 14 bp, Homo sapiens
ttcatataaagtat

SEQ ID NO: 878455 - DNA, 14 bp, Homo sapiens
ttcatatactataa

SEQ ID NO: 878456 - DNA, 15 bp, Homo sapiens
ttcatatactataat

SEQ ID NO: 878457 - DNA, 22 bp, Homo sapiens
ttcatatagcattgataatctt

SEQ ID NO: 878458 - DNA, 19 bp, Homo sapiens
ttcatatgctctgctttta

SEQ ID NO: 878459 - DNA, 15 bp, Homo sapiens
ttcatatgtcacctt

SEQ ID NO: 878460 - DNA, 18 bp, Homo sapiens
ttcatattaagacagtgt

SEQ ID NO: 878461 - DNA, 14 bp, Homo sapiens
ttcatattgaatat

SEQ ID NO: 878462 - DNA, 12 bp, Homo sapiens
ttcatattgtgc

SEQ ID NO: 878463 - DNA, 16 bp, Homo sapiens
ttcatatttacttctt

SEQ ID NO: 878464 - DNA, 13 bp, Homo sapiens
ttcatatttctac

SEQ ID NO: 878465 - DNA, 20 bp, Homo sapiens
ttcatatttgtctttgaatc

SEQ ID NO: 878466 - DNA, 22 bp, Homo sapiens
ttcatattttaaacagaggata

SEQ ID NO: 878467 - DNA, 19 bp, Homo sapiens
ttcatcactccaaaaacag

SEQ ID NO: 878468 - DNA, 16 bp, Homo sapiens
ttcatcacttcttcca

SEQ ID NO: 878469 - DNA, 20 bp, Homo sapiens
ttcatcacttcttccactgt

SEQ ID NO: 878470 - DNA, 21 bp, Homo sapiens
ttcatcatcctaagctattca

SEQ ID NO: 878471 - DNA, 20 bp, Homo sapiens
ttcatcattccctctcatct

SEQ ID NO: 878472 - DNA, 18 bp, Homo sapiens
ttcatcatttcagccaaa

SEQ ID NO: 878473 - DNA, 18 bp, Homo sapiens
ttcatcccatgatgtagt

SEQ ID NO: 878474 - DNA, 17 bp, Homo sapiens
ttcatcccgtatcacag

SEQ ID NO: 878475 - DNA, 15 bp, Homo sapiens
ttcatccgcctgtgg

SEQ ID NO: 878476 - DNA, 13 bp, Homo sapiens
ttcatcctataag

SEQ ID NO: 878477 - DNA, 19 bp, Homo sapiens
ttcatcctggcctcctttt

SEQ ID NO: 878478 - DNA, 13 bp, Homo sapiens
ttcatcctgtgtc

SEQ ID NO: 878479 - DNA, 23 bp, Homo sapiens
ttcatccttttttctcttctgtc

SEQ ID NO: 878480 - DNA, 23 bp, Homo sapiens
ttcatcgaatctactaattccac

SEQ ID NO: 878481 - DNA, 22 bp, Homo sapiens
ttcatctaataaatcagtgaac

SEQ ID NO: 878482 - DNA, 23 bp, Homo sapiens
ttcatctaatgtattatgagcca

SEQ ID NO: 878483 - DNA, 18 bp, Homo sapiens
ttcatctatttctgagaa

SEQ ID NO: 878484 - DNA, 12 bp, Homo sapiens
ttcatctcaagg

SEQ ID NO: 878485 - DNA, 12 bp, Homo sapiens
ttcatctcattt

SEQ ID NO: 878486 - DNA, 23 bp, Homo sapiens
ttcatctcatttaagggaaaaat

SEQ ID NO: 878487 - DNA, 14 bp, Homo sapiens
ttcatctccaggga

SEQ ID NO: 878488 - DNA, 15 bp, Homo sapiens
ttcatctccagggag

SEQ ID NO: 878489 - DNA, 15 bp, Homo sapiens
ttcatctccctgcca

SEQ ID NO: 878490 - DNA, 19 bp, Homo sapiens
ttcatctctctacctccac

SEQ ID NO: 878491 - DNA, 23 bp, Homo sapiens
ttcatctctctacctccaccctg

SEQ ID NO: 878492 - DNA, 12 bp, Homo sapiens
ttcatctctggt

SEQ ID NO: 878493 - DNA, 21 bp, Homo sapiens
ttcatctctggttttcttgcc

SEQ ID NO: 878494 - DNA, 14 bp, Homo sapiens
ttcatctgcaaagg

SEQ ID NO: 878495 - DNA, 14 bp, Homo sapiens
ttcatctgttgttc

SEQ ID NO: 878496 - DNA, 16 bp, Homo sapiens
ttcatctgttgttctg

SEQ ID NO: 878497 - DNA, 18 bp, Homo sapiens
ttcatctgttgttttgtt

SEQ ID NO: 878498 - DNA, 14 bp, Homo sapiens
ttcatcttcctgtg

SEQ ID NO: 878499 - DNA, 15 bp, Homo sapiens
ttcatcttcctgtgt

SEQ ID NO: 878500 - DNA, 18 bp, Homo sapiens
ttcatcttcctgtgtcct

SEQ ID NO: 878501 - DNA, 20 bp, Homo sapiens
ttcatcttcctgtgtcctga

SEQ ID NO: 878502 - DNA, 16 bp, Homo sapiens
ttcatcttctggaata

SEQ ID NO: 878503 - DNA, 16 bp, Homo sapiens
ttcatgaccagtaaag

SEQ ID NO: 878504 - DNA, 15 bp, Homo sapiens
ttcatgataatgaac

SEQ ID NO: 878505 - DNA, 18 bp, Homo sapiens
ttcatgataatgaacaga

SEQ ID NO: 878506 - DNA, 15 bp, Homo sapiens
ttcatgattagaaat

SEQ ID NO: 878507 - DNA, 23 bp, Homo sapiens
ttcatgattagaaattacctgtg

SEQ ID NO: 878508 - DNA, 13 bp, Homo sapiens
ttcatgattggct

SEQ ID NO: 878509 - DNA, 17 bp, Homo sapiens
ttcatgatttcatttca

SEQ ID NO: 878510 - DNA, 21 bp, Homo sapiens
ttcatgcaatgacatcttcaa

SEQ ID NO: 878511 - DNA, 17 bp, Homo sapiens
ttcatgcacttaaagaa

SEQ ID NO: 878512 - DNA, 19 bp, Homo sapiens
ttcatgcacttaaagaagt

SEQ ID NO: 878513 - DNA, 14 bp, Homo sapiens
ttcatgcagctgtg

SEQ ID NO: 878514 - DNA, 15 bp, Homo sapiens
ttcatgcagctgtgg

SEQ ID NO: 878515 - DNA, 21 bp, Homo sapiens
ttcatgccagctacttcctcc

SEQ ID NO: 878516 - DNA, 14 bp, Homo sapiens
ttcatgcctttgta

SEQ ID NO: 878517 - DNA, 21 bp, Homo sapiens
ttcatgcctttgtaagttatt

SEQ ID NO: 878518 - DNA, 18 bp, Homo sapiens
ttcatgctatctctgtgt

SEQ ID NO: 878519 - DNA, 17 bp, Homo sapiens
ttcatgctgaggtgatt

SEQ ID NO: 878520 - DNA, 14 bp, Homo sapiens
ttcatggacacttt

SEQ ID NO: 878521 - DNA, 13 bp, Homo sapiens
ttcatggatcaga

SEQ ID NO: 878522 - DNA, 18 bp, Homo sapiens
ttcatgtaaactgtgcac

SEQ ID NO: 878523 - DNA, 16 bp, Homo sapiens
ttcatgtaaagaaaaa

SEQ ID NO: 878524 - DNA, 14 bp, Homo sapiens
ttcatgtaaataaa

SEQ ID NO: 878525 - DNA, 16 bp, Homo sapiens
ttcatgtaactctcca

SEQ ID NO: 878526 - DNA, 17 bp, Homo sapiens
ttcatgtaactctccag

SEQ ID NO: 878527 - DNA, 21 bp, Homo sapiens
ttcatgtacaagatgaaggag

SEQ ID NO: 878528 - DNA, 15 bp, Homo sapiens
ttcatgtagaactca

SEQ ID NO: 878529 - DNA, 20 bp, Homo sapiens
ttcatgtagaactcagcagt

SEQ ID NO: 878530 - DNA, 21 bp, Homo sapiens
ttcatgtagagaaaagcacac

SEQ ID NO: 878531 - DNA, 22 bp, Homo sapiens
ttcatgtcaacttctggctcct

SEQ ID NO: 878532 - DNA, 22 bp, Homo sapiens
ttcatgtcccagaacttagcct

SEQ ID NO: 878533 - DNA, 22 bp, Homo sapiens
ttcatgttagttaccttatagt

SEQ ID NO: 878534 - DNA, 13 bp, Homo sapiens
ttcatgtttctta

SEQ ID NO: 878535 - DNA, 18 bp, Homo sapiens
ttcatgtttgtaaattaa

SEQ ID NO: 878536 - DNA, 20 bp, Homo sapiens
ttcattaaacttgaagcagt

SEQ ID NO: 878537 - DNA, 13 bp, Homo sapiens
ttcattaaagcat

SEQ ID NO: 878538 - DNA, 13 bp, Homo sapiens
ttcattaatgttt

SEQ ID NO: 878539 - DNA, 15 bp, Homo sapiens
ttcattaatgtttat

SEQ ID NO: 878540 - DNA, 16 bp, Homo sapiens
ttcattacatttctga

SEQ ID NO: 878541 - DNA, 13 bp, Homo sapiens
ttcattagcagtt

SEQ ID NO: 878542 - DNA, 16 bp, Homo sapiens
ttcattaggcaaagta

SEQ ID NO: 878543 - DNA, 23 bp, Homo sapiens
ttcattatgcacttttagaaatg

SEQ ID NO: 878544 - DNA, 13 bp, Homo sapiens
ttcattatgcttt

SEQ ID NO: 878545 - DNA, 14 bp, Homo sapiens
ttcattattcaaga

SEQ ID NO: 878546 - DNA, 17 bp, Homo sapiens
ttcattattggaattaa

SEQ ID NO: 878547 - DNA, 16 bp, Homo sapiens
ttcattatttgtcaaa

SEQ ID NO: 878548 - DNA, 16 bp, Homo sapiens
ttcattcaatattgac

SEQ ID NO: 878549 - DNA, 18 bp, Homo sapiens
ttcattcaatattgacat

SEQ ID NO: 878550 - DNA, 19 bp, Homo sapiens
ttcattcaatattgacatt

SEQ ID NO: 878551 - DNA, 17 bp, Homo sapiens
ttcattcatacttaaaa

SEQ ID NO: 878552 - DNA, 12 bp, Homo sapiens
ttcattcatccc

SEQ ID NO: 878553 - DNA, 14 bp, Homo sapiens
ttcattccagcagc

SEQ ID NO: 878554 - DNA, 16 bp, Homo sapiens
ttcattccagcagctg

SEQ ID NO: 878555 - DNA, 17 bp, Homo sapiens
ttcattccagcagctgc

SEQ ID NO: 878556 - DNA, 21 bp, Homo sapiens
ttcattccttcagatttggct

SEQ ID NO: 878557 - DNA, 16 bp, Homo sapiens
ttcattgcctttccag

SEQ ID NO: 878558 - DNA, 15 bp, Homo sapiens
ttcattggcagctca

SEQ ID NO: 878559 - DNA, 22 bp, Homo sapiens
ttcattggtctaatttattcaa

SEQ ID NO: 878560 - DNA, 17 bp, Homo sapiens
ttcattgtaatgttact

SEQ ID NO: 878561 - DNA, 16 bp, Homo sapiens
ttcatttaaactaaat

SEQ ID NO: 878562 - DNA, 22 bp, Homo sapiens
ttcatttaaactaaattactgt

SEQ ID NO: 878563 - DNA, 20 bp, Homo sapiens
ttcatttagataatttgaaa

SEQ ID NO: 878564 - DNA, 13 bp, Homo sapiens
ttcatttctagac

SEQ ID NO: 878565 - DNA, 14 bp, Homo sapiens
ttcatttctagact

SEQ ID NO: 878566 - DNA, 15 bp, Homo sapiens
ttcatttctagactc

SEQ ID NO: 878567 - DNA, 13 bp, Homo sapiens
ttcatttctctgc

SEQ ID NO: 878568 - DNA, 12 bp, Homo sapiens
ttcatttctgca

SEQ ID NO: 878569 - DNA, 14 bp, Homo sapiens
ttcatttctgcaga

SEQ ID NO: 878570 - DNA, 21 bp, Homo sapiens
ttcatttcttacgttctttca

SEQ ID NO: 878571 - DNA, 19 bp, Homo sapiens
ttcatttcttatcacataa

SEQ ID NO: 878572 - DNA, 16 bp, Homo sapiens
ttcatttgatgctaaa

SEQ ID NO: 878573 - DNA, 19 bp, Homo sapiens
ttcatttgcaattcatgta

SEQ ID NO: 878574 - DNA, 12 bp, Homo sapiens
ttcatttgcttt

SEQ ID NO: 878575 - DNA, 15 bp, Homo sapiens
ttcatttggtgctgg

SEQ ID NO: 878576 - DNA, 20 bp, Homo sapiens
ttcatttggtgttcctggaa

SEQ ID NO: 878577 - DNA, 22 bp, Homo sapiens
ttcatttggttcattaattcta

SEQ ID NO: 878578 - DNA, 14 bp, Homo sapiens
ttcatttgtacaag

SEQ ID NO: 878579 - DNA, 22 bp, Homo sapiens
ttcatttgtacaaggtaattgt

SEQ ID NO: 878580 - DNA, 15 bp, Homo sapiens
ttcatttgtgccaca

SEQ ID NO: 878581 - DNA, 19 bp, Homo sapiens
ttcattttaacatgatttc

SEQ ID NO: 878582 - DNA, 15 bp, Homo sapiens
ttcattttactcaga

SEQ ID NO: 878583 - DNA, 16 bp, Homo sapiens
ttcattttcatcactg

SEQ ID NO: 878584 - DNA, 13 bp, Homo sapiens
ttcattttgagct

SEQ ID NO: 878585 - DNA, 14 bp, Homo sapiens
ttcattttgcagaa

SEQ ID NO: 878586 - DNA, 19 bp, Homo sapiens
ttcattttgttttgctctg

SEQ ID NO: 878587 - DNA, 20 bp, Homo sapiens
ttcatttttaaagcctggct

SEQ ID NO: 878588 - DNA, 16 bp, Homo sapiens
ttcatttttaaatgtg

SEQ ID NO: 878589 - DNA, 22 bp, Homo sapiens
ttcatttttgaaactgcatttg

SEQ ID NO: 878590 - DNA, 23 bp, Homo sapiens
ttcatttttgatagctgtcccat

SEQ ID NO: 878591 - DNA, 23 bp, Homo sapiens
ttcatttttgtgagcctctttgt

SEQ ID NO: 878592 - DNA, 18 bp, Homo sapiens
ttcattttttttaattga

SEQ ID NO: 878593 - DNA, 19 bp, Homo sapiens
ttcatttttttttcaatca

SEQ ID NO: 878594 - DNA, 18 bp, Homo sapiens
ttccaaaaaggttgctgt

SEQ ID NO: 878595 - DNA, 22 bp, Homo sapiens
ttccaaaacatttctggacagt

SEQ ID NO: 878596 - DNA, 15 bp, Homo sapiens
ttccaaaatacaatg

SEQ ID NO: 878597 - DNA, 16 bp, Homo sapiens
ttccaaaatccaaaaa

SEQ ID NO: 878598 - DNA, 18 bp, Homo sapiens
ttccaaaatctcccattt

SEQ ID NO: 878599 - DNA, 19 bp, Homo sapiens
ttccaaagaatattttgat

SEQ ID NO: 878600 - DNA, 11 bp, Homo sapiens
ttccaaagctc

SEQ ID NO: 878601 - DNA, 22 bp, Homo sapiens
ttccaaagctttattaccagtg

SEQ ID NO: 878602 - DNA, 12 bp, Homo sapiens
ttccaaatgaac

SEQ ID NO: 878603 - DNA, 21 bp, Homo sapiens
ttccaaatgaatgttgtctgt

SEQ ID NO: 878604 - DNA, 13 bp, Homo sapiens
ttccaaattatta

SEQ ID NO: 878605 - DNA, 16 bp, Homo sapiens
ttccaaattatttctt

SEQ ID NO: 878606 - DNA, 23 bp, Homo sapiens
ttccaaattatttcttaattatt

SEQ ID NO: 878607 - DNA, 15 bp, Homo sapiens
ttccaaattcacaag

SEQ ID NO: 878608 - DNA, 14 bp, Homo sapiens
ttccaaattcagtt

SEQ ID NO: 878609 - DNA, 19 bp, Homo sapiens
ttccaaattcagtttcata

SEQ ID NO: 878610 - DNA, 13 bp, Homo sapiens
ttccaaattcatg

SEQ ID NO: 878611 - DNA, 16 bp, Homo sapiens
ttccaaatttggctca

SEQ ID NO: 878612 - DNA, 18 bp, Homo sapiens
ttccaaatttttttctta

SEQ ID NO: 878613 - DNA, 20 bp, Homo sapiens
ttccaacaagaagggactga

SEQ ID NO: 878614 - DNA, 22 bp, Homo sapiens
ttccaacaccacagacacacac

SEQ ID NO: 878615 - DNA, 15 bp, Homo sapiens
ttccaacatttctca

SEQ ID NO: 878616 - DNA, 15 bp, Homo sapiens
ttccaaccaggcagt

SEQ ID NO: 878617 - DNA, 18 bp, Homo sapiens
ttccaactactaatagaa

SEQ ID NO: 878618 - DNA, 15 bp, Homo sapiens
ttccaactcctgatg

SEQ ID NO: 878619 - DNA, 18 bp, Homo sapiens
ttccaactggcactctgt

SEQ ID NO: 878620 - DNA, 17 bp, Homo sapiens
ttccaagaaaatatcac

SEQ ID NO: 878621 - DNA, 19 bp, Homo sapiens
ttccaagacattgtcaata

SEQ ID NO: 878622 - DNA, 20 bp, Homo sapiens
ttccaagacattgtcaataa

SEQ ID NO: 878623 - DNA, 13 bp, Homo sapiens
ttccaagcccttt

SEQ ID NO: 878624 - DNA, 15 bp, Homo sapiens
ttccaagctccaaat

SEQ ID NO: 878625 - DNA, 21 bp, Homo sapiens
ttccaaggaaaattgaaagta

SEQ ID NO: 878626 - DNA, 19 bp, Homo sapiens
ttccaaggctttaaagctg

SEQ ID NO: 878627 - DNA, 21 bp, Homo sapiens
ttccaagggtatgggaagcca

SEQ ID NO: 878628 - DNA, 23 bp, Homo sapiens
ttccaagggtatgggaagccata

SEQ ID NO: 878629 - DNA, 20 bp, Homo sapiens
ttccaaggtcactcttggtc

SEQ ID NO: 878630 - DNA, 22 bp, Homo sapiens
ttccaagttccccatccctgtc

SEQ ID NO: 878631 - DNA, 18 bp, Homo sapiens
ttccaatagaaagaaact

SEQ ID NO: 878632 - DNA, 16 bp, Homo sapiens
ttccaatatgatgact

SEQ ID NO: 878633 - DNA, 20 bp, Homo sapiens
ttccaatctctgttctgttt

SEQ ID NO: 878634 - DNA, 15 bp, Homo sapiens
ttccaatgaaaaaat

SEQ ID NO: 878635 - DNA, 21 bp, Homo sapiens
ttccaatgttttattggggaa

SEQ ID NO: 878636 - DNA, 14 bp, Homo sapiens
ttccaattctaaat

SEQ ID NO: 878637 - DNA, 19 bp, Homo sapiens
ttccaattctatcttttgt

SEQ ID NO: 878638 - DNA, 21 bp, Homo sapiens
ttccaattctatcttttgttt

SEQ ID NO: 878639 - DNA, 22 bp, Homo sapiens
ttccaatttacatactctgctt

SEQ ID NO: 878640 - DNA, 16 bp, Homo sapiens
ttccacaaaattagaa

SEQ ID NO: 878641 - DNA, 11 bp, Homo sapiens
ttccacaaacc

SEQ ID NO: 878642 - DNA, 16 bp, Homo sapiens
ttccacaaagaaaatt

SEQ ID NO: 878643 - DNA, 20 bp, Homo sapiens
ttccacaagattcccagaga

SEQ ID NO: 878644 - DNA, 16 bp, Homo sapiens
ttccacagcagcagaa

SEQ ID NO: 878645 - DNA, 13 bp, Homo sapiens
ttccacagccgcc

SEQ ID NO: 878646 - DNA, 13 bp, Homo sapiens
ttccacagttatc

SEQ ID NO: 878647 - DNA, 16 bp, Homo sapiens
ttccacagttgccacc

SEQ ID NO: 878648 - DNA, 17 bp, Homo sapiens
ttccacagttgccacca

SEQ ID NO: 878649 - DNA, 21 bp, Homo sapiens
ttccacagttgccaccacctc

SEQ ID NO: 878650 - DNA, 15 bp, Homo sapiens
ttccacatgttactg

SEQ ID NO: 878651 - DNA, 13 bp, Homo sapiens
ttccacatttgtc

SEQ ID NO: 878652 - DNA, 21 bp, Homo sapiens
ttccaccacagccagcacctg

SEQ ID NO: 878653 - DNA, 15 bp, Homo sapiens
ttccaccaggccgtg

SEQ ID NO: 878654 - DNA, 18 bp, Homo sapiens
ttccacccagcttcaaag

SEQ ID NO: 878655 - DNA, 15 bp, Homo sapiens
ttccaccccaagaga

SEQ ID NO: 878656 - DNA, 18 bp, Homo sapiens
ttccaccccaagagaact

SEQ ID NO: 878657 - DNA, 12 bp, Homo sapiens
ttccaccccctc

SEQ ID NO: 878658 - DNA, 15 bp, Homo sapiens
ttccaccccctccct

SEQ ID NO: 878659 - DNA, 13 bp, Homo sapiens
ttccaccctggaa

SEQ ID NO: 878660 - DNA, 14 bp, Homo sapiens
ttccaccctggaga

SEQ ID NO: 878661 - DNA, 19 bp, Homo sapiens
ttccacctcacctctttgt

SEQ ID NO: 878662 - DNA, 22 bp, Homo sapiens
ttccacctcatggattgccaca

SEQ ID NO: 878663 - DNA, 23 bp, Homo sapiens
ttccacctccaccacatctgcca

SEQ ID NO: 878664 - DNA, 18 bp, Homo sapiens
ttccaccttaaattaaac

SEQ ID NO: 878665 - DNA, 15 bp, Homo sapiens
ttccacgctgtctcc

SEQ ID NO: 878666 - DNA, 16 bp, Homo sapiens
ttccacggcatcgcat

SEQ ID NO: 878667 - DNA, 23 bp, Homo sapiens
ttccacggcatcgcatccgtcct

SEQ ID NO: 878668 - DNA, 24 bp, Homo sapiens
ttccacggcatcgcatccgtcctg

SEQ ID NO: 878669 - DNA, 23 bp, Homo sapiens
ttccacgggtctcacttatacca

SEQ ID NO: 878670 - DNA, 17 bp, Homo sapiens
ttccactacacctggct

SEQ ID NO: 878671 - DNA, 19 bp, Homo sapiens
ttccactacacctggctga

SEQ ID NO: 878672 - DNA, 19 bp, Homo sapiens
ttccactattttcaaagaa

SEQ ID NO: 878673 - DNA, 20 bp, Homo sapiens
ttccactcaaaatatgtcaa

SEQ ID NO: 878674 - DNA, 17 bp, Homo sapiens
ttccactccaagatgcc

SEQ ID NO: 878675 - DNA, 16 bp, Homo sapiens
ttccactcctatggaa

SEQ ID NO: 878676 - DNA, 20 bp, Homo sapiens
ttccactcctatggaaaagg

SEQ ID NO: 878677 - DNA, 19 bp, Homo sapiens
ttccactctggattcagcc

SEQ ID NO: 878678 - DNA, 14 bp, Homo sapiens
ttccactgaaaatt

SEQ ID NO: 878679 - DNA, 20 bp, Homo sapiens
ttccactgagctccatgtgc

SEQ ID NO: 878680 - DNA, 15 bp, Homo sapiens
ttccactgagggcag

SEQ ID NO: 878681 - DNA, 19 bp, Homo sapiens
ttccactgcaaataaagcc

SEQ ID NO: 878682 - DNA, 23 bp, Homo sapiens
ttccactgcaaataaagcctttt

SEQ ID NO: 878683 - DNA, 22 bp, Homo sapiens
ttccactggacttgagcttggc

SEQ ID NO: 878684 - DNA, 13 bp, Homo sapiens
ttccactgtgtgt

SEQ ID NO: 878685 - DNA, 14 bp, Homo sapiens
ttccacttcttcct

SEQ ID NO: 878686 - DNA, 18 bp, Homo sapiens
ttccacttcttcctttct

SEQ ID NO: 878687 - DNA, 20 bp, Homo sapiens
ttccacttttttttgtatgt

SEQ ID NO: 878688 - DNA, 15 bp, Homo sapiens
ttccagaaaggatat

SEQ ID NO: 878689 - DNA, 16 bp, Homo sapiens
ttccagaacaaattgt

SEQ ID NO: 878690 - DNA, 17 bp, Homo sapiens
ttccagaacaaattgtt

SEQ ID NO: 878691 - DNA, 16 bp, Homo sapiens
ttccagaacagccctc

SEQ ID NO: 878692 - DNA, 18 bp, Homo sapiens
ttccagaagaagagaagc

SEQ ID NO: 878693 - DNA, 21 bp, Homo sapiens
ttccagaagaagagaagctgc

SEQ ID NO: 878694 - DNA, 17 bp, Homo sapiens
ttccagaagatgccctc

SEQ ID NO: 878695 - DNA, 12 bp, Homo sapiens
ttccagaatctt

SEQ ID NO: 878696 - DNA, 15 bp, Homo sapiens
ttccagaatgctgaa

SEQ ID NO: 878697 - DNA, 20 bp, Homo sapiens
ttccagaatgctgaactcct

SEQ ID NO: 878698 - DNA, 18 bp, Homo sapiens
ttccagaatgctgtacat

SEQ ID NO: 878699 - DNA, 19 bp, Homo sapiens
ttccagactcaggttccag

SEQ ID NO: 878700 - DNA, 21 bp, Homo sapiens
ttccagactcaggttccagaa

SEQ ID NO: 878701 - DNA, 17 bp, Homo sapiens
ttccagagagtcctctg

SEQ ID NO: 878702 - DNA, 14 bp, Homo sapiens
ttccagaggacagc

SEQ ID NO: 878703 - DNA, 17 bp, Homo sapiens
ttccagaggacagctct

SEQ ID NO: 878704 - DNA, 20 bp, Homo sapiens
ttccagaggacagctctggg

SEQ ID NO: 878705 - DNA, 17 bp, Homo sapiens
ttccagaggccctaggc

SEQ ID NO: 878706 - DNA, 20 bp, Homo sapiens
ttccagagtccggaggcagc

SEQ ID NO: 878707 - DNA, 16 bp, Homo sapiens
ttccagagtgctgagg

SEQ ID NO: 878708 - DNA, 18 bp, Homo sapiens
ttccagatcactgccaca

SEQ ID NO: 878709 - DNA, 22 bp, Homo sapiens
ttccagcaaaatggaagcaaag

SEQ ID NO: 878710 - DNA, 11 bp, Homo sapiens
ttccagcaata

SEQ ID NO: 878711 - DNA, 22 bp, Homo sapiens
ttccagcaataagaaatgaaca

SEQ ID NO: 878712 - DNA, 14 bp, Homo sapiens
ttccagcaattctc

SEQ ID NO: 878713 - DNA, 13 bp, Homo sapiens
ttccagccaggcc

SEQ ID NO: 878714 - DNA, 23 bp, Homo sapiens
ttccagccaggcccaggccagcc

SEQ ID NO: 878715 - DNA, 16 bp, Homo sapiens
ttccagcccctctggt

SEQ ID NO: 878716 - DNA, 20 bp, Homo sapiens
ttccagcccctctggtcgct

SEQ ID NO: 878717 - DNA, 11 bp, Homo sapiens
ttccagcctgg

SEQ ID NO: 878718 - DNA, 13 bp, Homo sapiens
ttccagcctggga

SEQ ID NO: 878719 - DNA, 20 bp, Homo sapiens
ttccagcctgggacacacac

SEQ ID NO: 878720 - DNA, 21 bp, Homo sapiens
ttccagcctgggacacacaca

SEQ ID NO: 878721 - DNA, 17 bp, Homo sapiens
ttccagccttatgtgtt

SEQ ID NO: 878722 - DNA, 13 bp, Homo sapiens
ttccagctctgcc

SEQ ID NO: 878723 - DNA, 11 bp, Homo sapiens
ttccagctgct

SEQ ID NO: 878724 - DNA, 12 bp, Homo sapiens
ttccagctgctg

SEQ ID NO: 878725 - DNA, 15 bp, Homo sapiens
ttccaggaaaaaata

SEQ ID NO: 878726 - DNA, 22 bp, Homo sapiens
ttccaggaaaaaataaaaagag

SEQ ID NO: 878727 - DNA, 23 bp, Homo sapiens
ttccaggaaactccacatctgcc

SEQ ID NO: 878728 - DNA, 15 bp, Homo sapiens
ttccaggaaccaaaa

SEQ ID NO: 878729 - DNA, 19 bp, Homo sapiens
ttccaggaaccaaaaagag

SEQ ID NO: 878730 - DNA, 21 bp, Homo sapiens
ttccaggaaccaaaaagagca

SEQ ID NO: 878731 - DNA, 18 bp, Homo sapiens
ttccaggaatgctgggcc

SEQ ID NO: 878732 - DNA, 19 bp, Homo sapiens
ttccaggaatgctgggccc

SEQ ID NO: 878733 - DNA, 18 bp, Homo sapiens
ttccaggagaaagccggg

SEQ ID NO: 878734 - DNA, 23 bp, Homo sapiens
ttccaggagaagggggctctgcc

SEQ ID NO: 878735 - DNA, 16 bp, Homo sapiens
ttccaggcaccctcag

SEQ ID NO: 878736 - DNA, 21 bp, Homo sapiens
ttccaggcaccctcagggagc

SEQ ID NO: 878737 - DNA, 11 bp, Homo sapiens
ttccaggcccc

SEQ ID NO: 878738 - DNA, 12 bp, Homo sapiens
ttccaggcccct

SEQ ID NO: 878739 - DNA, 22 bp, Homo sapiens
ttccaggcctgaagtcttctcc

SEQ ID NO: 878740 - DNA, 23 bp, Homo sapiens
ttccaggcttccctgacttgctt

SEQ ID NO: 878741 - DNA, 12 bp, Homo sapiens
ttccagggcagc

SEQ ID NO: 878742 - DNA, 14 bp, Homo sapiens
ttccagggctgggg

SEQ ID NO: 878743 - DNA, 15 bp, Homo sapiens
ttccagggctggggt

SEQ ID NO: 878744 - DNA, 23 bp, Homo sapiens
ttccagggctggggtgagcctga

SEQ ID NO: 878745 - DNA, 15 bp, Homo sapiens
ttccaggggaacctg

SEQ ID NO: 878746 - DNA, 17 bp, Homo sapiens
ttccaggggaacctgcc

SEQ ID NO: 878747 - DNA, 20 bp, Homo sapiens
ttccagtaacttttttgtgt

SEQ ID NO: 878748 - DNA, 17 bp, Homo sapiens
ttccagtacagtattct

SEQ ID NO: 878749 - DNA, 14 bp, Homo sapiens
ttccagtattgaaa

SEQ ID NO: 878750 - DNA, 17 bp, Homo sapiens
ttccagtcttcctgaca

SEQ ID NO: 878751 - DNA, 16 bp, Homo sapiens
ttccagtggaccctgg

SEQ ID NO: 878752 - DNA, 20 bp, Homo sapiens
ttccagtgttggctgtgtga

SEQ ID NO: 878753 - DNA, 16 bp, Homo sapiens
ttccagttgctgtgga

SEQ ID NO: 878754 - DNA, 17 bp, Homo sapiens
ttccagtttctccttga

SEQ ID NO: 878755 - DNA, 15 bp, Homo sapiens
ttccataaacaccca

SEQ ID NO: 878756 - DNA, 17 bp, Homo sapiens
ttccataaggaatgtag

SEQ ID NO: 878757 - DNA, 13 bp, Homo sapiens
ttccataattatg

SEQ ID NO: 878758 - DNA, 16 bp, Homo sapiens
ttccataattatgaca

SEQ ID NO: 878759 - DNA, 15 bp, Homo sapiens
ttccatacagctcta

SEQ ID NO: 878760 - DNA, 18 bp, Homo sapiens
ttccatacttctctcaga

SEQ ID NO: 878761 - DNA, 21 bp, Homo sapiens
ttccatagtgttaactgtcag

SEQ ID NO: 878762 - DNA, 16 bp, Homo sapiens
ttccatatccctgccc

SEQ ID NO: 878763 - DNA, 22 bp, Homo sapiens
ttccatatccctgcccagcctg

SEQ ID NO: 878764 - DNA, 21 bp, Homo sapiens
ttccatatcttgcgaatccaa

SEQ ID NO: 878765 - DNA, 15 bp, Homo sapiens
ttccatatggatttt

SEQ ID NO: 878766 - DNA, 22 bp, Homo sapiens
ttccatattgggaatatgtaga

SEQ ID NO: 878767 - DNA, 20 bp, Homo sapiens
ttccatcatcactgtaaaga

SEQ ID NO: 878768 - DNA, 15 bp, Homo sapiens
ttccatccctacccc

SEQ ID NO: 878769 - DNA, 18 bp, Homo sapiens
ttccatctttacaaaact

SEQ ID NO: 878770 - DNA, 13 bp, Homo sapiens
ttccatgaaaacg

SEQ ID NO: 878771 - DNA, 22 bp, Homo sapiens
ttccatgaaaacgttttattgt

SEQ ID NO: 878772 - DNA, 15 bp, Homo sapiens
ttccatgaatgtatc

SEQ ID NO: 878773 - DNA, 14 bp, Homo sapiens
ttccatgacctccc

SEQ ID NO: 878774 - DNA, 19 bp, Homo sapiens
ttccatgacctcccctccc

SEQ ID NO: 878775 - DNA, 18 bp, Homo sapiens
ttccatgactgcatttta

SEQ ID NO: 878776 - DNA, 18 bp, Homo sapiens
ttccatgattctatttat

SEQ ID NO: 878777 - DNA, 23 bp, Homo sapiens
ttccatgcccgagtccgcccatc

SEQ ID NO: 878778 - DNA, 15 bp, Homo sapiens
ttccatgcctgaggg

SEQ ID NO: 878779 - DNA, 16 bp, Homo sapiens
ttccatgcctgagggt

SEQ ID NO: 878780 - DNA, 18 bp, Homo sapiens
ttccatgcctgagggtgg

SEQ ID NO: 878781 - DNA, 21 bp, Homo sapiens
ttccatgcgtgtttctgactc

SEQ ID NO: 878782 - DNA, 23 bp, Homo sapiens
ttccatgggagccagctgctttt

SEQ ID NO: 878783 - DNA, 18 bp, Homo sapiens
ttccatgggcccgctgcc

SEQ ID NO: 878784 - DNA, 16 bp, Homo sapiens
ttccatgtcgcctctg

SEQ ID NO: 878785 - DNA, 17 bp, Homo sapiens
ttccatgtcgcctctgc

SEQ ID NO: 878786 - DNA, 19 bp, Homo sapiens
ttccatgtctccattttct

SEQ ID NO: 878787 - DNA, 15 bp, Homo sapiens
ttccatgtgaacagc

SEQ ID NO: 878788 - DNA, 16 bp, Homo sapiens
ggtcagccccaagggc

SEQ ID NO: 878789 - DNA, 21 bp, Homo sapiens
ggtcagcgactggatgctcgc

SEQ ID NO: 878790 - DNA, 14 bp, Homo sapiens
ggtcagctgggagc

SEQ ID NO: 878791 - DNA, 17 bp, Homo sapiens
ggtcagctgggagccag

SEQ ID NO: 878792 - DNA, 18 bp, Homo sapiens
ggtcagctgttactttct

SEQ ID NO: 878793 - DNA, 21 bp, Homo sapiens
ggtcaggagttcctaaccagc

SEQ ID NO: 878794 - DNA, 17 bp, Homo sapiens
ggtcaggcagccagtga

SEQ ID NO: 878795 - DNA, 14 bp, Homo sapiens
ggtcagggcagtgg

SEQ ID NO: 878796 - DNA, 20 bp, Homo sapiens
ggtcagggcagtggccaagc

SEQ ID NO: 878797 - DNA, 14 bp, Homo sapiens
ggtcagggccagac

SEQ ID NO: 878798 - DNA, 20 bp, Homo sapiens
ggtcagggccagactggaag

SEQ ID NO: 878799 - DNA, 17 bp, Homo sapiens
ggtcaggggctccctac

SEQ ID NO: 878800 - DNA, 15 bp, Homo sapiens
ggtcaggggggagaa

SEQ ID NO: 878801 - DNA, 17 bp, Homo sapiens
ggtcaggtccccatggc

SEQ ID NO: 878802 - DNA, 20 bp, Homo sapiens
ggtcaggttatactcctcct

SEQ ID NO: 878803 - DNA, 20 bp, Homo sapiens
ggtcagtagtcacaaactga

SEQ ID NO: 878804 - DNA, 22 bp, Homo sapiens
ggtcagtgccttttggaactgt

SEQ ID NO: 878805 - DNA, 14 bp, Homo sapiens
ggtcagtgtggaga

SEQ ID NO: 878806 - DNA, 15 bp, Homo sapiens
ggtcatcagatgcct

SEQ ID NO: 878807 - DNA, 19 bp, Homo sapiens
ggtcatcagatgcctgctt

SEQ ID NO: 878808 - DNA, 20 bp, Homo sapiens
ggtcatccttggtgctcttg

SEQ ID NO: 878809 - DNA, 16 bp, Homo sapiens
ggtcatgaagggctgg

SEQ ID NO: 878810 - DNA, 18 bp, Homo sapiens
ggtcatgtgggtcttcca

SEQ ID NO: 878811 - DNA, 14 bp, Homo sapiens
ggtcatgtttgcag

SEQ ID NO: 878812 - DNA, 22 bp, Homo sapiens
ggtcattgagggaccaaaaaag

SEQ ID NO: 878813 - DNA, 17 bp, Homo sapiens
ggtccaaaaaaaggaaa

SEQ ID NO: 878814 - DNA, 17 bp, Homo sapiens
ggtccaacaagaatgca

SEQ ID NO: 878815 - DNA, 18 bp, Homo sapiens
ggtccaagattctggagc

SEQ ID NO: 878816 - DNA, 13 bp, Homo sapiens
ggtccaagtggct

SEQ ID NO: 878817 - DNA, 23 bp, Homo sapiens
ggtccaatcctaggacagccttg

SEQ ID NO: 878818 - DNA, 16 bp, Homo sapiens
ggtccacaacacacag

SEQ ID NO: 878819 - DNA, 17 bp, Homo sapiens
ggtccacacctgggcat

SEQ ID NO: 878820 - DNA, 23 bp, Homo sapiens
ggtccaccctttcatagagaggc

SEQ ID NO: 878821 - DNA, 16 bp, Homo sapiens
ggtccaccggcccctg

SEQ ID NO: 878822 - DNA, 19 bp, Homo sapiens
ggtccaccggcccctggca

SEQ ID NO: 878823 - DNA, 12 bp, Homo sapiens
ggtccacgcctc

SEQ ID NO: 878824 - DNA, 16 bp, Homo sapiens
ggtccagaagtccctc

SEQ ID NO: 878825 - DNA, 20 bp, Homo sapiens
ggtccagctctgacatccct

SEQ ID NO: 878826 - DNA, 21 bp, Homo sapiens
ggtccagctctgacatccctt

SEQ ID NO: 878827 - DNA, 23 bp, Homo sapiens
ggtccagctctgacatcccttcc

SEQ ID NO: 878828 - DNA, 13 bp, Homo sapiens
ggtccagctctgg

SEQ ID NO: 878829 - DNA, 22 bp, Homo sapiens
ggtccagctctggaggggaggg

SEQ ID NO: 878830 - DNA, 20 bp, Homo sapiens
ggtccaggaaggcagctgct

SEQ ID NO: 878831 - DNA, 22 bp, Homo sapiens
ggtccaggaaggcagctgctct

SEQ ID NO: 878832 - DNA, 11 bp, Homo sapiens
ggtccaggaga

SEQ ID NO: 878833 - DNA, 11 bp, Homo sapiens
ggtccagggaa

SEQ ID NO: 878834 - DNA, 16 bp, Homo sapiens
ggtccagggcctgaca

SEQ ID NO: 878835 - DNA, 21 bp, Homo sapiens
ggtccagggctgttggaggac

SEQ ID NO: 878836 - DNA, 23 bp, Homo sapiens
ggtccagggctgttggaggaccc

SEQ ID NO: 878837 - DNA, 21 bp, Homo sapiens
ggtccagggttgatcacactc

SEQ ID NO: 878838 - DNA, 14 bp, Homo sapiens
ggtccatgggcaga

SEQ ID NO: 878839 - DNA, 17 bp, Homo sapiens
ggtccatgggcagagcc

SEQ ID NO: 878840 - DNA, 18 bp, Homo sapiens
ggtccatgggcagagccc

SEQ ID NO: 878841 - DNA, 14 bp, Homo sapiens
ggtccatttgttcc

SEQ ID NO: 878842 - DNA, 13 bp, Homo sapiens
ggtcccacactgg

SEQ ID NO: 878843 - DNA, 13 bp, Homo sapiens
ggtcccaccccca

SEQ ID NO: 878844 - DNA, 17 bp, Homo sapiens
ggtcccacctccagccc

SEQ ID NO: 878845 - DNA, 19 bp, Homo sapiens
gtgtggggttctcagtgcc

SEQ ID NO: 878846 - DNA, 13 bp, Homo sapiens
gtgtgggtcccgc

SEQ ID NO: 878847 - DNA, 17 bp, Homo sapiens
gtgtgggtgctgataat

SEQ ID NO: 878848 - DNA, 20 bp, Homo sapiens
gtgtgggtggggttatgtga

SEQ ID NO: 878849 - DNA, 14 bp, Homo sapiens
gtgtgggtgtgtgc

SEQ ID NO: 878850 - DNA, 15 bp, Homo sapiens
gtgtgggtgtgtgcg

SEQ ID NO: 878851 - DNA, 19 bp, Homo sapiens
gtgtggtaccttcagccct

SEQ ID NO: 878852 - DNA, 21 bp, Homo sapiens
gtgtggtaccttcagccctgg

SEQ ID NO: 878853 - DNA, 16 bp, Homo sapiens
gtgtggtagagtgtgc

SEQ ID NO: 878854 - DNA, 21 bp, Homo sapiens
gtgtggtgaggggctttctct

SEQ ID NO: 878855 - DNA, 14 bp, Homo sapiens
gtgtggtgcagtgt

SEQ ID NO: 878856 - DNA, 13 bp, Homo sapiens
gtgtggtggcctc

SEQ ID NO: 878857 - DNA, 16 bp, Homo sapiens
gtgtggtggcctcagc

SEQ ID NO: 878858 - DNA, 21 bp, Homo sapiens
gtgtggtgtttgtaggctgtg

SEQ ID NO: 878859 - DNA, 18 bp, Homo sapiens
gtgtggttgctcacagct

SEQ ID NO: 878860 - DNA, 14 bp, Homo sapiens
gtgtggttggaaaa

SEQ ID NO: 878861 - DNA, 11 bp, Homo sapiens
gtgtgtaaata

SEQ ID NO: 878862 - DNA, 13 bp, Homo sapiens
gtgtgtaattgtt

SEQ ID NO: 878863 - DNA, 19 bp, Homo sapiens
gtgtgtagacaaatatttg

SEQ ID NO: 878864 - DNA, 14 bp, Homo sapiens
gtgtgtagccaagg

SEQ ID NO: 878865 - DNA, 13 bp, Homo sapiens
gtgtgtatatatt

SEQ ID NO: 878866 - DNA, 15 bp, Homo sapiens
gtgtgtatgctgctt

SEQ ID NO: 878867 - DNA, 23 bp, Homo sapiens
gtgtgtatgtgtgtttctgtcct

SEQ ID NO: 878868 - DNA, 14 bp, Homo sapiens
gtgtgtatttctaa

SEQ ID NO: 878869 - DNA, 16 bp, Homo sapiens
gtgtgtcagctgaggc

SEQ ID NO: 878870 - DNA, 13 bp, Homo sapiens
gtgtgtcaggccc

SEQ ID NO: 878871 - DNA, 17 bp, Homo sapiens
gtgtgtcaggccctctg

SEQ ID NO: 878872 - DNA, 21 bp, Homo sapiens
gtgtgtcaggccctctgcctg

SEQ ID NO: 878873 - DNA, 22 bp, Homo sapiens
gtgtgtcaggccctctgcctgc

SEQ ID NO: 878874 - DNA, 14 bp, Homo sapiens
gtgtgtcagggatg

SEQ ID NO: 878875 - DNA, 17 bp, Homo sapiens
gtgtgtccaggctctgg

SEQ ID NO: 878876 - DNA, 16 bp, Homo sapiens
gtgtgtccccctctgt

SEQ ID NO: 878877 - DNA, 18 bp, Homo sapiens
gtgtgtcccctcacgcaa

SEQ ID NO: 878878 - DNA, 20 bp, Homo sapiens
gtgtgtccttgaactgaggc

SEQ ID NO: 878879 - DNA, 21 bp, Homo sapiens
gtgtgtccttgaactgaggcc

SEQ ID NO: 878880 - DNA, 23 bp, Homo sapiens
gtgtgtccttgaactgaggccct

SEQ ID NO: 878881 - DNA, 22 bp, Homo sapiens
gtgtgtctcgtgtcagtaattt

SEQ ID NO: 878882 - DNA, 16 bp, Homo sapiens
gtgtgtctgctcagta

SEQ ID NO: 878883 - DNA, 14 bp, Homo sapiens
gtgtgtcttaatta

SEQ ID NO: 878884 - DNA, 16 bp, Homo sapiens
gtgtgtgacactgatg

SEQ ID NO: 878885 - DNA, 14 bp, Homo sapiens
gtgtgtgagtgtga

SEQ ID NO: 878886 - DNA, 18 bp, Homo sapiens
gtgtgtgcacacgtgtgt

SEQ ID NO: 878887 - DNA, 19 bp, Homo sapiens
gtgtgtgcagagtccattt

SEQ ID NO: 878888 - DNA, 16 bp, Homo sapiens
gtgtgtgcatgtgtgt

SEQ ID NO: 878889 - DNA, 11 bp, Homo sapiens
gtgtgtgccct

SEQ ID NO: 878890 - DNA, 23 bp, Homo sapiens
gtgtgtgccctgggccaggcagg

SEQ ID NO: 878891 - DNA, 24 bp, Homo sapiens
gtgtgtgccctgggccaggcaggc

SEQ ID NO: 878892 - DNA, 17 bp, Homo sapiens
gtgtgtgcttacagtaa

SEQ ID NO: 878893 - DNA, 15 bp, Homo sapiens
gtgtgtggcctccct

SEQ ID NO: 878894 - DNA, 13 bp, Homo sapiens
gtgtgtgggcagg

SEQ ID NO: 878895 - DNA, 15 bp, Homo sapiens
gtgtgtgggtggggt

SEQ ID NO: 878896 - DNA, 13 bp, Homo sapiens
gtgtgtgggtgtg

SEQ ID NO: 878897 - DNA, 17 bp, Homo sapiens
gtgtgtggtagaaacaa

SEQ ID NO: 878898 - DNA, 15 bp, Homo sapiens
gtgtgtggttggaaa

SEQ ID NO: 878899 - DNA, 12 bp, Homo sapiens
gtgtgtgtatgt

SEQ ID NO: 878900 - DNA, 14 bp, Homo sapiens
gtgtgtgtctgtct

SEQ ID NO: 878901 - DNA, 15 bp, Homo sapiens
gtgtgtgtgcatgtg

SEQ ID NO: 878902 - DNA, 15 bp, Homo sapiens
gtgtgtgtggcaggg

SEQ ID NO: 878903 - DNA, 11 bp, Homo sapiens
gtgtgtgtgtg

SEQ ID NO: 878904 - DNA, 13 bp, Homo sapiens
gtgtgtgtgtgca

SEQ ID NO: 878905 - DNA, 16 bp, Homo sapiens
gtgtgttatattccaa

SEQ ID NO: 878906 - DNA, 22 bp, Homo sapiens
gtgtgttatattccaaggaaaa

SEQ ID NO: 878907 - DNA, 23 bp, Homo sapiens
gtgtgttcaccttcaaaatgttc

SEQ ID NO: 878908 - DNA, 15 bp, Homo sapiens
gtgtgttccaactgc

SEQ ID NO: 878909 - DNA, 18 bp, Homo sapiens
gtgtgttctgattagaaa

SEQ ID NO: 878910 - DNA, 12 bp, Homo sapiens
gtgtgttctgta

SEQ ID NO: 878911 - DNA, 21 bp, Homo sapiens
gtgtgttctgtaatggaactg

SEQ ID NO: 878912 - DNA, 17 bp, Homo sapiens
gtgtgttttcataataa

SEQ ID NO: 878913 - DNA, 20 bp, Homo sapiens
gtgttaatcttaatgtatat

SEQ ID NO: 878914 - DNA, 15 bp, Homo sapiens
gtgttaatttttgat

SEQ ID NO: 878915 - DNA, 14 bp, Homo sapiens
gtgttacagaggac

SEQ ID NO: 878916 - DNA, 16 bp, Homo sapiens
gtgttacattattcca

SEQ ID NO: 878917 - DNA, 23 bp, Homo sapiens
gtgttacccaggctggtctcaaa

SEQ ID NO: 878918 - DNA, 16 bp, Homo sapiens
gtgttacctgaaaaca

SEQ ID NO: 878919 - DNA, 15 bp, Homo sapiens
gtgttacctgtgtgc

SEQ ID NO: 878920 - DNA, 14 bp, Homo sapiens
gtgttactaagttt

SEQ ID NO: 878921 - DNA, 19 bp, Homo sapiens
gtgttactgctttgcaaag

SEQ ID NO: 878922 - DNA, 20 bp, Homo sapiens
gtgttactgctttgcaaaga

SEQ ID NO: 878923 - DNA, 16 bp, Homo sapiens
gtgttagggaagggcc

SEQ ID NO: 878924 - DNA, 23 bp, Homo sapiens
gtgttagggaagggcctgccaca

SEQ ID NO: 878925 - DNA, 16 bp, Homo sapiens
gtgttaggggcctggc

SEQ ID NO: 878926 - DNA, 13 bp, Homo sapiens
gtgttagtgtctg

SEQ ID NO: 878927 - DNA, 16 bp, Homo sapiens
gtgttagtgtctgtcc

SEQ ID NO: 878928 - DNA, 14 bp, Homo sapiens
gtgttagtgtgtgt

SEQ ID NO: 878929 - DNA, 18 bp, Homo sapiens
gtgttagtgtgtgtgcat

SEQ ID NO: 878930 - DNA, 14 bp, Homo sapiens
gtgttatgtatttc

SEQ ID NO: 878931 - DNA, 16 bp, Homo sapiens
gtgttattctttgcgt

SEQ ID NO: 878932 - DNA, 13 bp, Homo sapiens
gtgttattgcatg

SEQ ID NO: 878933 - DNA, 18 bp, Homo sapiens
gtgttattgcatgctgat

SEQ ID NO: 878934 - DNA, 21 bp, Homo sapiens
gtgttatttggaaccttgttt

SEQ ID NO: 878935 - DNA, 18 bp, Homo sapiens
gtgttcaaaatactactg

SEQ ID NO: 878936 - DNA, 15 bp, Homo sapiens
gtgttcaagaaataa

SEQ ID NO: 878937 - DNA, 14 bp, Homo sapiens
gtgttcaatatttt

SEQ ID NO: 878938 - DNA, 17 bp, Homo sapiens
gtgttcagctctttcca

SEQ ID NO: 878939 - DNA, 20 bp, Homo sapiens
gtgttcagctctttccaaat

SEQ ID NO: 878940 - DNA, 17 bp, Homo sapiens
gtgttcattaatgttta

SEQ ID NO: 878941 - DNA, 23 bp, Homo sapiens
gtgttcatttggtgttcctggaa

SEQ ID NO: 878942 - DNA, 11 bp, Homo sapiens
gtgttcatttt

SEQ ID NO: 878943 - DNA, 18 bp, Homo sapiens
gtgttcccaatctgaaat

SEQ ID NO: 878944 - DNA, 21 bp, Homo sapiens
gttaaatagagtatatgcact

SEQ ID NO: 878945 - DNA, 15 bp, Homo sapiens
gttaaatatacacta

SEQ ID NO: 878946 - DNA, 13 bp, Homo sapiens
gttaaatcatttg

SEQ ID NO: 878947 - DNA, 17 bp, Homo sapiens
gttaaatgaaattgtaa

SEQ ID NO: 878948 - DNA, 18 bp, Homo sapiens
gttaaatgaaattgtaaa

SEQ ID NO: 878949 - DNA, 15 bp, Homo sapiens
gttaaatgttattat

SEQ ID NO: 878950 - DNA, 23 bp, Homo sapiens
gttaacaaggaatgcctgtgcca

SEQ ID NO: 878951 - DNA, 23 bp, Homo sapiens
gttaacaatgcctattgtaatat

SEQ ID NO: 878952 - DNA, 20 bp, Homo sapiens
gttaaccagaataaagttct

SEQ ID NO: 878953 - DNA, 19 bp, Homo sapiens
gttaacctttttgtaaata

SEQ ID NO: 878954 - DNA, 19 bp, Homo sapiens
gttaacgtgatgtgccact

SEQ ID NO: 878955 - DNA, 23 bp, Homo sapiens
gttaactgaataccactctgtaa

SEQ ID NO: 878956 - DNA, 20 bp, Homo sapiens
gttaactgaatttggaatgt

SEQ ID NO: 878957 - DNA, 15 bp, Homo sapiens
gttaagaaatttcac

SEQ ID NO: 878958 - DNA, 17 bp, Homo sapiens
gttaagaatgaagttct

SEQ ID NO: 878959 - DNA, 19 bp, Homo sapiens
gttaagacatgatttcctt

SEQ ID NO: 878960 - DNA, 16 bp, Homo sapiens
gttaagatacagtgta

SEQ ID NO: 878961 - DNA, 18 bp, Homo sapiens
gttaagcaggcattgctt

SEQ ID NO: 878962 - DNA, 12 bp, Homo sapiens
gttaaggacttc

SEQ ID NO: 878963 - DNA, 16 bp, Homo sapiens
gttaaggcctgaatca

SEQ ID NO: 878964 - DNA, 22 bp, Homo sapiens
gttaagtctaaatatttcctta

SEQ ID NO: 878965 - DNA, 21 bp, Homo sapiens
gttaagtctcctgtcttatgg

SEQ ID NO: 878966 - DNA, 23 bp, Homo sapiens
gttaagttgagatagttttcatc

SEQ ID NO: 878967 - DNA, 12 bp, Homo sapiens
gttaataaaagt

SEQ ID NO: 878968 - DNA, 17 bp, Homo sapiens
gttaataacagctcctt

SEQ ID NO: 878969 - DNA, 21 bp, Homo sapiens
gttaatatatcccagaaatta

SEQ ID NO: 878970 - DNA, 21 bp, Homo sapiens
gttaatattaaaaagtctgta

SEQ ID NO: 878971 - DNA, 13 bp, Homo sapiens
gttaatattttgt

SEQ ID NO: 878972 - DNA, 17 bp, Homo sapiens
gttaatctcccagccca

SEQ ID NO: 878973 - DNA, 14 bp, Homo sapiens
gttaatcttaatgt

SEQ ID NO: 878974 - DNA, 12 bp, Homo sapiens
gttaatcttagg

SEQ ID NO: 878975 - DNA, 17 bp, Homo sapiens
gttaatgaaaatgtcag

SEQ ID NO: 878976 - DNA, 19 bp, Homo sapiens
gttaatgactctttctgaa

SEQ ID NO: 878977 - DNA, 22 bp, Homo sapiens
gttaatgctgaaacatcattac

SEQ ID NO: 878978 - DNA, 17 bp, Homo sapiens
gttaatgtatataaaaa

SEQ ID NO: 878979 - DNA, 15 bp, Homo sapiens
gttaatgtcattgct

SEQ ID NO: 878980 - DNA, 15 bp, Homo sapiens
gttaatgttatatca

SEQ ID NO: 878981 - DNA, 13 bp, Homo sapiens
gttaattcaccta

SEQ ID NO: 878982 - DNA, 19 bp, Homo sapiens
gttaattgcgtagaggcta

SEQ ID NO: 878983 - DNA, 16 bp, Homo sapiens
gttaatttataatgta

SEQ ID NO: 878984 - DNA, 12 bp, Homo sapiens
gttaattttacc

SEQ ID NO: 878985 - DNA, 17 bp, Homo sapiens
gttaattttgaagtgct

SEQ ID NO: 878986 - DNA, 15 bp, Homo sapiens
gttaatttttacatg

SEQ ID NO: 878987 - DNA, 21 bp, Homo sapiens
gttaatttttcttagtgttgt

SEQ ID NO: 878988 - DNA, 12 bp, Homo sapiens
gttaatttttga

SEQ ID NO: 878989 - DNA, 14 bp, Homo sapiens
gttaatttttgata

SEQ ID NO: 878990 - DNA, 18 bp, Homo sapiens
gttaattttttggtacaa

SEQ ID NO: 878991 - DNA, 20 bp, Homo sapiens
gttaattttttggtacaaaa

SEQ ID NO: 878992 - DNA, 21 bp, Homo sapiens
gttacaaaccaggtcaccatc

SEQ ID NO: 878993 - DNA, 13 bp, Homo sapiens
gttacaaactgca

SEQ ID NO: 878994 - DNA, 15 bp, Homo sapiens
gttacaaactgcaat

SEQ ID NO: 878995 - DNA, 12 bp, Homo sapiens
gttacaagtttg

SEQ ID NO: 878996 - DNA, 16 bp, Homo sapiens
gttacaagtttgctaa

SEQ ID NO: 878997 - DNA, 18 bp, Homo sapiens
gttacaagtttgctaaaa

SEQ ID NO: 878998 - DNA, 16 bp, Homo sapiens
gttacacaaaaatcta

SEQ ID NO: 878999 - DNA, 20 bp, Homo sapiens
gttacacagaaatgctgctg

SEQ ID NO: 879000 - DNA, 21 bp, Homo sapiens
gttacacagaaatgctgctgg

SEQ ID NO: 879001 - DNA, 16 bp, Homo sapiens
gttacacagcccaaga

SEQ ID NO: 879002 - DNA, 16 bp, Homo sapiens
gttacactaaaaggtg

SEQ ID NO: 879003 - DNA, 22 bp, Homo sapiens
gttacactggaggagagaagaa

SEQ ID NO: 879004 - DNA, 13 bp, Homo sapiens
gttacacttgtgc

SEQ ID NO: 879005 - DNA, 17 bp, Homo sapiens
gttacactttttggaag

SEQ ID NO: 879006 - DNA, 19 bp, Homo sapiens
gttacagcgagaggcagag

SEQ ID NO: 879007 - DNA, 21 bp, Homo sapiens
gttacagcgagaggcagagaa

SEQ ID NO: 879008 - DNA, 21 bp, Homo sapiens
gttacagtttatattgtggaa

SEQ ID NO: 879009 - DNA, 18 bp, Homo sapiens
gttacataagataaatgt

SEQ ID NO: 879010 - DNA, 18 bp, Homo sapiens
gttacattaatgcccagc

SEQ ID NO: 879011 - DNA, 16 bp, Homo sapiens
gttacattaatgttaa

SEQ ID NO: 879012 - DNA, 19 bp, Homo sapiens
gttaccatactgtctctgg

SEQ ID NO: 879013 - DNA, 22 bp, Homo sapiens
gttaccatactgtctctggagt

SEQ ID NO: 879014 - DNA, 16 bp, Homo sapiens
gttaccatttacatgt

SEQ ID NO: 879015 - DNA, 23 bp, Homo sapiens
gttaccattttaacgctgcctaa

SEQ ID NO: 879016 - DNA, 18 bp, Homo sapiens
gttaccgagtatctgtaa

SEQ ID NO: 879017 - DNA, 13 bp, Homo sapiens
gttacctccctcg

SEQ ID NO: 879018 - DNA, 22 bp, Homo sapiens
gttacctccctcgccccaaggt

SEQ ID NO: 879019 - DNA, 19 bp, Homo sapiens
gttacctgacctaaattag

SEQ ID NO: 879020 - DNA, 13 bp, Homo sapiens
gttacctgtgtgc

SEQ ID NO: 879021 - DNA, 16 bp, Homo sapiens
gttacctgttccattg

SEQ ID NO: 879022 - DNA, 15 bp, Homo sapiens
gttaccttatagtta

SEQ ID NO: 879023 - DNA, 18 bp, Homo sapiens
gttacgtagcctaaggct

SEQ ID NO: 879024 - DNA, 21 bp, Homo sapiens
gttacgtgaagaaataaatga

SEQ ID NO: 879025 - DNA, 23 bp, Homo sapiens
gttacgtgaagaaataaatgaaa

SEQ ID NO: 879026 - DNA, 16 bp, Homo sapiens
gttactaactaaactc

SEQ ID NO: 879027 - DNA, 13 bp, Homo sapiens
gttactaagaaga

SEQ ID NO: 879028 - DNA, 14 bp, Homo sapiens
gttactaagaagaa

SEQ ID NO: 879029 - DNA, 16 bp, Homo sapiens
gttactaatatgccta

SEQ ID NO: 879030 - DNA, 23 bp, Homo sapiens
gttactaattggcctctttaaga

SEQ ID NO: 879031 - DNA, 20 bp, Homo sapiens
gttactaggtaacttcatat

SEQ ID NO: 879032 - DNA, 22 bp, Homo sapiens
gttactatagtggtgagatgga

SEQ ID NO: 879033 - DNA, 12 bp, Homo sapiens
gttactattttc

SEQ ID NO: 879034 - DNA, 15 bp, Homo sapiens
gttactcagaattct

SEQ ID NO: 879035 - DNA, 17 bp, Homo sapiens
gttactcagccctgggc

SEQ ID NO: 879036 - DNA, 17 bp, Homo sapiens
gttactcaggaggctga

SEQ ID NO: 879037 - DNA, 20 bp, Homo sapiens
gttactcagggctcctccca

SEQ ID NO: 879038 - DNA, 23 bp, Homo sapiens
gttactcccttctcgtgtttgct

SEQ ID NO: 879039 - DNA, 18 bp, Homo sapiens
gttactctccaacctgga

SEQ ID NO: 879040 - DNA, 11 bp, Homo sapiens
gttactctctt

SEQ ID NO: 879041 - DNA, 21 bp, Homo sapiens
gttactctcttccacatgtta

SEQ ID NO: 879042 - DNA, 14 bp, Homo sapiens
gttactctgaaggg

SEQ ID NO: 879043 - DNA, 23 bp, Homo sapiens
gttactctgcctttctaagactc

SEQ ID NO: 879044 - DNA, 21 bp, Homo sapiens
gttactgaaggtgatggaggt

SEQ ID NO: 879045 - DNA, 19 bp, Homo sapiens
gttactgcctataatctta

SEQ ID NO: 879046 - DNA, 14 bp, Homo sapiens
gttactgccttaat

SEQ ID NO: 879047 - DNA, 20 bp, Homo sapiens
gttactgcttctctttgtgc

SEQ ID NO: 879048 - DNA, 20 bp, Homo sapiens
gttactggcacctgaaatta

SEQ ID NO: 879049 - DNA, 21 bp, Homo sapiens
gttactggcacctgaaattaa

SEQ ID NO: 879050 - DNA, 13 bp, Homo sapiens
gttactgtaattc

SEQ ID NO: 879051 - DNA, 13 bp, Homo sapiens
gttacttcctatc

SEQ ID NO: 879052 - DNA, 17 bp, Homo sapiens
gttacttgtctgaggcc

SEQ ID NO: 879053 - DNA, 15 bp, Homo sapiens
gttagaaaatgactt

SEQ ID NO: 879054 - DNA, 15 bp, Homo sapiens
gttagaaaggcagcc

SEQ ID NO: 879055 - DNA, 19 bp, Homo sapiens
gttagaaatgcagaatcct

SEQ ID NO: 879056 - DNA, 22 bp, Homo sapiens
gttagaatataggtctcttctc

SEQ ID NO: 879057 - DNA, 18 bp, Homo sapiens
gttagaatcttgttttgt

SEQ ID NO: 879058 - DNA, 13 bp, Homo sapiens
gttagaatgcaag

SEQ ID NO: 879059 - DNA, 15 bp, Homo sapiens
gttagagaataaatt

SEQ ID NO: 879060 - DNA, 15 bp, Homo sapiens
gttagagagaaagag

SEQ ID NO: 879061 - DNA, 19 bp, Homo sapiens
gttagagagcttttcactg

SEQ ID NO: 879062 - DNA, 20 bp, Homo sapiens
gttagagagggaccatgtgt

SEQ ID NO: 879063 - DNA, 21 bp, Homo sapiens
gttagagagggaccatgtgtc

SEQ ID NO: 879064 - DNA, 18 bp, Homo sapiens
gttagagaggtagcgagc

SEQ ID NO: 879065 - DNA, 17 bp, Homo sapiens
gttagaggaaaaatatt

SEQ ID NO: 879066 - DNA, 16 bp, Homo sapiens
gttagattaagaaata

SEQ ID NO: 879067 - DNA, 23 bp, Homo sapiens
gttagattcctcttgcctctctc

SEQ ID NO: 879068 - DNA, 18 bp, Homo sapiens
gttagcagacaggccccg

SEQ ID NO: 879069 - DNA, 17 bp, Homo sapiens
gttagcagagtctgtct

SEQ ID NO: 879070 - DNA, 18 bp, Homo sapiens
gttagcagagtctgtctc

SEQ ID NO: 879071 - DNA, 20 bp, Homo sapiens
gttagcagagtctgtctctt

SEQ ID NO: 879072 - DNA, 20 bp, Homo sapiens
gttagccctcagtcagttcc

SEQ ID NO: 879073 - DNA, 20 bp, Homo sapiens
gttagctcaggaggcttgga

SEQ ID NO: 879074 - DNA, 21 bp, Homo sapiens
gttagctccctgtggggcagg

SEQ ID NO: 879075 - DNA, 12 bp, Homo sapiens
gttagctcctgt

SEQ ID NO: 879076 - DNA, 15 bp, Homo sapiens
gttagctcctgtggc

SEQ ID NO: 879077 - DNA, 16 bp, Homo sapiens
gttagctcctgtggcc

SEQ ID NO: 879078 - DNA, 19 bp, Homo sapiens
gttaggaaataaaaccttt

SEQ ID NO: 879079 - DNA, 20 bp, Homo sapiens
gttaggaggctgcatgctct

SEQ ID NO: 879080 - DNA, 21 bp, Homo sapiens
gttaggagtggttctcatttg

SEQ ID NO: 879081 - DNA, 20 bp, Homo sapiens
gttaggatgcggctttctct

SEQ ID NO: 879082 - DNA, 15 bp, Homo sapiens
gttaggatttaacag

SEQ ID NO: 879083 - DNA, 17 bp, Homo sapiens
gttaggcttttctgcct

SEQ ID NO: 879084 - DNA, 17 bp, Homo sapiens
gttagggctgcttttct

SEQ ID NO: 879085 - DNA, 17 bp, Homo sapiens
gttagggtcagccattt

SEQ ID NO: 879086 - DNA, 23 bp, Homo sapiens
gttagggtgctctggaagagagg

SEQ ID NO: 879087 - DNA, 17 bp, Homo sapiens
gttagggtgtgtgttca

SEQ ID NO: 879088 - DNA, 18 bp, Homo sapiens
gttaggtagagggagttg

SEQ ID NO: 879089 - DNA, 21 bp, Homo sapiens
gttaggtagagggagttgtca

SEQ ID NO: 879090 - DNA, 22 bp, Homo sapiens
gttaggtcctcacttgggggaa

SEQ ID NO: 879091 - DNA, 17 bp, Homo sapiens
gttaggtgactaaaagg

SEQ ID NO: 879092 - DNA, 16 bp, Homo sapiens
gttagtaaaggaacca

SEQ ID NO: 879093 - DNA, 23 bp, Homo sapiens
gttagtaacatgaggggacattt

SEQ ID NO: 879094 - DNA, 13 bp, Homo sapiens
gttagtaatctgt

SEQ ID NO: 879095 - DNA, 16 bp, Homo sapiens
gttagtagcatgttga

SEQ ID NO: 879096 - DNA, 14 bp, Homo sapiens
gttagtatcttttg

SEQ ID NO: 879097 - DNA, 16 bp, Homo sapiens
gttagtcgggtgccag

SEQ ID NO: 879098 - DNA, 16 bp, Homo sapiens
gttagtgtctgtccat

SEQ ID NO: 879099 - DNA, 17 bp, Homo sapiens
gttagttaccttatagt

SEQ ID NO: 879100 - DNA, 23 bp, Homo sapiens
gttagttaccttatagttactgt

SEQ ID NO: 879101 - DNA, 13 bp, Homo sapiens
gttagttcccaac

SEQ ID NO: 879102 - DNA, 15 bp, Homo sapiens
gttagtttagtgtgt

SEQ ID NO: 879103 - DNA, 16 bp, Homo sapiens
gttagtttctttggga

SEQ ID NO: 879104 - DNA, 14 bp, Homo sapiens
gttagtttttactt

SEQ ID NO: 879105 - DNA, 14 bp, Homo sapiens
gttataaagataca

SEQ ID NO: 879106 - DNA, 15 bp, Homo sapiens
gttataaagatacag

SEQ ID NO: 879107 - DNA, 17 bp, Homo sapiens
gttataaatcaatgtca

SEQ ID NO: 879108 - DNA, 18 bp, Homo sapiens
gttataaatcaatgtcac

SEQ ID NO: 879109 - DNA, 19 bp, Homo sapiens
gttataataactgaactgt

SEQ ID NO: 879110 - DNA, 16 bp, Homo sapiens
gttatacaataaccca

SEQ ID NO: 879111 - DNA, 23 bp, Homo sapiens
gttatacaataacccagttactt

SEQ ID NO: 879112 - DNA, 17 bp, Homo sapiens
gttatacagttataaaa

SEQ ID NO: 879113 - DNA, 19 bp, Homo sapiens
gttatagaatagcctgagg

SEQ ID NO: 879114 - DNA, 20 bp, Homo sapiens
gttatagacagtcgttccca

SEQ ID NO: 879115 - DNA, 16 bp, Homo sapiens
gttatagtatatctgg

SEQ ID NO: 879116 - DNA, 17 bp, Homo sapiens
gttatagtgtttaactg

SEQ ID NO: 879117 - DNA, 20 bp, Homo sapiens
gttatagtgtttaactggca

SEQ ID NO: 879118 - DNA, 15 bp, Homo sapiens
gttatataatttaga

SEQ ID NO: 879119 - DNA, 17 bp, Homo sapiens
gttatatattttttgta

SEQ ID NO: 879120 - DNA, 14 bp, Homo sapiens
gttatatgaatata

SEQ ID NO: 879121 - DNA, 22 bp, Homo sapiens
gttatatgatattctttaaaca

SEQ ID NO: 879122 - DNA, 16 bp, Homo sapiens
gttatatgtacagttt

SEQ ID NO: 879123 - DNA, 17 bp, Homo sapiens
gttatatttaatgcatt

SEQ ID NO: 879124 - DNA, 15 bp, Homo sapiens
gttatatttcagatg

SEQ ID NO: 879125 - DNA, 17 bp, Homo sapiens
gttatcaaaatagtcta

SEQ ID NO: 879126 - DNA, 16 bp, Homo sapiens
gttatcaaggggatga

SEQ ID NO: 879127 - DNA, 23 bp, Homo sapiens
gttatcaccatagttttgtttaa

SEQ ID NO: 879128 - DNA, 16 bp, Homo sapiens
gttatcactttaagtt

SEQ ID NO: 879129 - DNA, 17 bp, Homo sapiens
gttatcactttaagttt

SEQ ID NO: 879130 - DNA, 16 bp, Homo sapiens
gttatcagtgcttccc

SEQ ID NO: 879131 - DNA, 17 bp, Homo sapiens
gttatcagtgcttcccg

SEQ ID NO: 879132 - DNA, 16 bp, Homo sapiens
gttatcatgaatttta

SEQ ID NO: 879133 - DNA, 22 bp, Homo sapiens
gttatcatgaattttaaagtat

SEQ ID NO: 879134 - DNA, 12 bp, Homo sapiens
gttatctctgtg

SEQ ID NO: 879135 - DNA, 16 bp, Homo sapiens
gttatctgcctggcct

SEQ ID NO: 879136 - DNA, 13 bp, Homo sapiens
gttatcttagctg

SEQ ID NO: 879137 - DNA, 14 bp, Homo sapiens
gttatcttctttat

SEQ ID NO: 879138 - DNA, 13 bp, Homo sapiens
gttatgaaaatcc

SEQ ID NO: 879139 - DNA, 22 bp, Homo sapiens
gttatgaaaatcctatatctgt

SEQ ID NO: 879140 - DNA, 23 bp, Homo sapiens
gttatgaaacatatcatggtaat

SEQ ID NO: 879141 - DNA, 12 bp, Homo sapiens
gttatgaacagc

SEQ ID NO: 879142 - DNA, 16 bp, Homo sapiens
gttatgaacagctgtg

SEQ ID NO: 879143 - DNA, 17 bp, Homo sapiens
gttatgaacagctgtgt

SEQ ID NO: 879144 - DNA, 21 bp, Homo sapiens
gttatgaacagctgtgtctgc

SEQ ID NO: 879145 - DNA, 13 bp, Homo sapiens
gttatgaacatcc

SEQ ID NO: 879146 - DNA, 17 bp, Homo sapiens
gttatgatattgtttaa

SEQ ID NO: 879147 - DNA, 22 bp, Homo sapiens
gttatgcactgtggtttcagat

SEQ ID NO: 879148 - DNA, 13 bp, Homo sapiens
gttatgctgtgac

SEQ ID NO: 879149 - DNA, 20 bp, Homo sapiens
gttatggcagcccggctgct

SEQ ID NO: 879150 - DNA, 21 bp, Homo sapiens
gttatggcagcccggctgctg

SEQ ID NO: 879151 - DNA, 22 bp, Homo sapiens
gttatggcagcccggctgctgc

SEQ ID NO: 879152 - DNA, 23 bp, Homo sapiens
gttatggcagcccggctgctgct

SEQ ID NO: 879153 - DNA, 16 bp, Homo sapiens
gttatggtgatgactt

SEQ ID NO: 879154 - DNA, 15 bp, Homo sapiens
gttatggtttaatgt

SEQ ID NO: 879155 - DNA, 11 bp, Homo sapiens
gttatgtacaa

SEQ ID NO: 879156 - DNA, 12 bp, Homo sapiens
gttatgtacaaa

SEQ ID NO: 879157 - DNA, 12 bp, Homo sapiens
gttatgtatttc

SEQ ID NO: 879158 - DNA, 13 bp, Homo sapiens
gttatgtatttcc

SEQ ID NO: 879159 - DNA, 22 bp, Homo sapiens
gttatgtcagaggaacagtcct

SEQ ID NO: 879160 - DNA, 18 bp, Homo sapiens
gttatgtgggtggcttct

SEQ ID NO: 879161 - DNA, 17 bp, Homo sapiens
gttatgtttttctgtgt

SEQ ID NO: 879162 - DNA, 12 bp, Homo sapiens
gttattaaatgt

SEQ ID NO: 879163 - DNA, 21 bp, Homo sapiens
gttattaactttaatgttttt

SEQ ID NO: 879164 - DNA, 16 bp, Homo sapiens
gttattaatgtttctt

SEQ ID NO: 879165 - DNA, 13 bp, Homo sapiens
gttattacctctc

SEQ ID NO: 879166 - DNA, 15 bp, Homo sapiens
gttattacttcctca

SEQ ID NO: 879167 - DNA, 15 bp, Homo sapiens
gttattatatttgac

SEQ ID NO: 879168 - DNA, 18 bp, Homo sapiens
gttattatatttgacatg

SEQ ID NO: 879169 - DNA, 17 bp, Homo sapiens
gttattatctatggaaa

SEQ ID NO: 879170 - DNA, 22 bp, Homo sapiens
gttattatctgggcttatatct

SEQ ID NO: 879171 - DNA, 17 bp, Homo sapiens
gttattatgctaatata

SEQ ID NO: 879172 - DNA, 23 bp, Homo sapiens
gttattattactctacactgaaa

SEQ ID NO: 879173 - DNA, 19 bp, Homo sapiens
gttattcaaatttgtacag

SEQ ID NO: 879174 - DNA, 20 bp, Homo sapiens
gttattcacaacctcaccaa

SEQ ID NO: 879175 - DNA, 13 bp, Homo sapiens
gttattgcagttt

SEQ ID NO: 879176 - DNA, 14 bp, Homo sapiens
gttattgcagttta

SEQ ID NO: 879177 - DNA, 16 bp, Homo sapiens
gttattgcagtttatc

SEQ ID NO: 879178 - DNA, 17 bp, Homo sapiens
gttattgtacagctgtt

SEQ ID NO: 879179 - DNA, 12 bp, Homo sapiens
gttattgtggaa

SEQ ID NO: 879180 - DNA, 13 bp, Homo sapiens
gttatttaaatga

SEQ ID NO: 879181 - DNA, 23 bp, Homo sapiens
gttatttaacagctgaattatct

SEQ ID NO: 879182 - DNA, 15 bp, Homo sapiens
gttatttagtaaagt

SEQ ID NO: 879183 - DNA, 21 bp, Homo sapiens
gttatttatcaatttttccca

SEQ ID NO: 879184 - DNA, 13 bp, Homo sapiens
gttatttatggtt

SEQ ID NO: 879185 - DNA, 16 bp, Homo sapiens
gttatttgtataaatt

SEQ ID NO: 879186 - DNA, 18 bp, Homo sapiens
gttatttgtataaattaa

SEQ ID NO: 879187 - DNA, 19 bp, Homo sapiens
gttatttgttattttcagt

SEQ ID NO: 879188 - DNA, 14 bp, Homo sapiens
gttattttattatt

SEQ ID NO: 879189 - DNA, 15 bp, Homo sapiens
gttattttctacagt

SEQ ID NO: 879190 - DNA, 20 bp, Homo sapiens
gttattttctacagtggttt

SEQ ID NO: 879191 - DNA, 14 bp, Homo sapiens
gttattttcttgtt

SEQ ID NO: 879192 - DNA, 21 bp, Homo sapiens
gttattttctttatcattgct

SEQ ID NO: 879193 - DNA, 20 bp, Homo sapiens
gttattttgatgtaaagatg

SEQ ID NO: 879194 - DNA, 18 bp, Homo sapiens
gttatttttcaaggaagg

SEQ ID NO: 879195 - DNA, 14 bp, Homo sapiens
gttatttttctctt

SEQ ID NO: 879196 - DNA, 21 bp, Homo sapiens
gttatttttctcttgtaccat

SEQ ID NO: 879197 - DNA, 21 bp, Homo sapiens
gttattttttaattattattt

SEQ ID NO: 879198 - DNA, 19 bp, Homo sapiens
gttcaaagactgtgaacag

SEQ ID NO: 879199 - DNA, 18 bp, Homo sapiens
gttcaaagagtctgtctt

SEQ ID NO: 879200 - DNA, 21 bp, Homo sapiens
gttcaaagatattttgctttg

SEQ ID NO: 879201 - DNA, 20 bp, Homo sapiens
gttcaaagtgtatatttatt

SEQ ID NO: 879202 - DNA, 23 bp, Homo sapiens
gttcaaagtgtatatttattcat

SEQ ID NO: 879203 - DNA, 22 bp, Homo sapiens
gttcaaatgcattttgggggtt

SEQ ID NO: 879204 - DNA, 12 bp, Homo sapiens
gttcaaattttt

SEQ ID NO: 879205 - DNA, 16 bp, Homo sapiens
gttcaagaaataagtt

SEQ ID NO: 879206 - DNA, 13 bp, Homo sapiens
gttcaagcctgtg

SEQ ID NO: 879207 - DNA, 20 bp, Homo sapiens
gttcaagcctgtgggagtag

SEQ ID NO: 879208 - DNA, 22 bp, Homo sapiens
gttcaagtgattcttccacctc

SEQ ID NO: 879209 - DNA, 12 bp, Homo sapiens
gttcaagttttg

SEQ ID NO: 879210 - DNA, 21 bp, Homo sapiens
gttcaatactcttgaaatgta

SEQ ID NO: 879211 - DNA, 17 bp, Homo sapiens
gttcaatggttctgaaa

SEQ ID NO: 879212 - DNA, 14 bp, Homo sapiens
gttcaatgttccat

SEQ ID NO: 879213 - DNA, 12 bp, Homo sapiens
gttcacaaactg

SEQ ID NO: 879214 - DNA, 15 bp, Homo sapiens
gttcacaaactgtga

SEQ ID NO: 879215 - DNA, 14 bp, Homo sapiens
gttcacagaaaaag

SEQ ID NO: 879216 - DNA, 18 bp, Homo sapiens
gttcacagtagagtaggg

SEQ ID NO: 879217 - DNA, 12 bp, Homo sapiens
gttcacattttt

SEQ ID NO: 879218 - DNA, 23 bp, Homo sapiens
gttcacatttttacaaataggta

SEQ ID NO: 879219 - DNA, 19 bp, Homo sapiens
gttcaccttcaaaatgttc

SEQ ID NO: 879220 - DNA, 22 bp, Homo sapiens
gttcaccttcaaaatgttctat

SEQ ID NO: 879221 - DNA, 21 bp, Homo sapiens
gttcacggtgacacaggtcag

SEQ ID NO: 879222 - DNA, 18 bp, Homo sapiens
gttcacgtaagatacaag

SEQ ID NO: 879223 - DNA, 24 bp, Homo sapiens
gttcactgagctccccagatctcc

SEQ ID NO: 879224 - DNA, 19 bp, Homo sapiens
gttcactgttgtacacagt

SEQ ID NO: 879225 - DNA, 17 bp, Homo sapiens
gttcacttaaattcttt

SEQ ID NO: 879226 - DNA, 23 bp, Homo sapiens
gttcacttgggctctctctagct

SEQ ID NO: 879227 - DNA, 19 bp, Homo sapiens
gttcagaaatgctgcctgc

SEQ ID NO: 879228 - DNA, 21 bp, Homo sapiens
gttcagaaatgctgcctgcct

SEQ ID NO: 879229 - DNA, 13 bp, Homo sapiens
gttcagaacaact

SEQ ID NO: 879230 - DNA, 22 bp, Homo sapiens
gttcagaatttagtgtatccat

SEQ ID NO: 879231 - DNA, 17 bp, Homo sapiens
gttcagagactcagggc

SEQ ID NO: 879232 - DNA, 23 bp, Homo sapiens
gttcagagtggctcactggctgg

SEQ ID NO: 879233 - DNA, 20 bp, Homo sapiens
gttcagatcttaatataaat

SEQ ID NO: 879234 - DNA, 17 bp, Homo sapiens
gttcagatgtgcatttc

SEQ ID NO: 879235 - DNA, 24 bp, Homo sapiens
gttcagcaaactaaccagcattcc

SEQ ID NO: 879236 - DNA, 22 bp, Homo sapiens
gttcagcactgtcccttgcctc

SEQ ID NO: 879237 - DNA, 15 bp, Homo sapiens
gttcagccaaggttt

SEQ ID NO: 879238 - DNA, 15 bp, Homo sapiens
gttcagcccctcctc

SEQ ID NO: 879239 - DNA, 18 bp, Homo sapiens
gttcagcccctcctctgc

SEQ ID NO: 879240 - DNA, 22 bp, Homo sapiens
gttcagcccctcctctgccacc

SEQ ID NO: 879241 - DNA, 19 bp, Homo sapiens
gttcagcccctgatctctg

SEQ ID NO: 879242 - DNA, 23 bp, Homo sapiens
gttcagcttggtgggagaaagtc

SEQ ID NO: 879243 - DNA, 20 bp, Homo sapiens
gttcaggagtcccaaggaaa

SEQ ID NO: 879244 - DNA, 17 bp, Homo sapiens
gttcagggaccgtccag

SEQ ID NO: 879245 - DNA, 20 bp, Homo sapiens
gttcagggaccgtccagggg

SEQ ID NO: 879246 - DNA, 22 bp, Homo sapiens
gttcagggaggggccggctggc

SEQ ID NO: 879247 - DNA, 15 bp, Homo sapiens
gttcaggggactcag

SEQ ID NO: 879248 - DNA, 19 bp, Homo sapiens
gttcaggggactcagccct

SEQ ID NO: 879249 - DNA, 23 bp, Homo sapiens
gttcagtctgaatgctgccacaa

SEQ ID NO: 879250 - DNA, 23 bp, Homo sapiens
gttcagtgagatatcatagagac

SEQ ID NO: 879251 - DNA, 13 bp, Homo sapiens
gttcagtgccttc

SEQ ID NO: 879252 - DNA, 15 bp, Homo sapiens
gttcagtgccttcct

SEQ ID NO: 879253 - DNA, 16 bp, Homo sapiens
gttcagtgtcccgggc

SEQ ID NO: 879254 - DNA, 21 bp, Homo sapiens
gttcagtttttttttttccag

SEQ ID NO: 879255 - DNA, 18 bp, Homo sapiens
gttcataataaaagtgaa

SEQ ID NO: 879256 - DNA, 17 bp, Homo sapiens
gttcatagggtctcttc

SEQ ID NO: 879257 - DNA, 18 bp, Homo sapiens
gttcatagggtctcttca

SEQ ID NO: 879258 - DNA, 20 bp, Homo sapiens
gttcatagggtctcttcagg

SEQ ID NO: 879259 - DNA, 20 bp, Homo sapiens
gttcataggtcactggctct

SEQ ID NO: 879260 - DNA, 19 bp, Homo sapiens
gttcatatgctctgctttt

SEQ ID NO: 879261 - DNA, 20 bp, Homo sapiens
gttcatatgctctgctttta

SEQ ID NO: 879262 - DNA, 19 bp, Homo sapiens
gttcatatgtaccatgtac

SEQ ID NO: 879263 - DNA, 15 bp, Homo sapiens
gttcatattggattg

SEQ ID NO: 879264 - DNA, 19 bp, Homo sapiens
gttcatcaccagtctgtaa

SEQ ID NO: 879265 - DNA, 12 bp, Homo sapiens
gttcatcagtgt

SEQ ID NO: 879266 - DNA, 22 bp, Homo sapiens
gttcatcatccagatgtggcta

SEQ ID NO: 879267 - DNA, 18 bp, Homo sapiens
gttcatccaatcctcact

SEQ ID NO: 879268 - DNA, 21 bp, Homo sapiens
gttcatccaatcctcactggg

SEQ ID NO: 879269 - DNA, 16 bp, Homo sapiens
gttcatcgattttcta

SEQ ID NO: 879270 - DNA, 14 bp, Homo sapiens
gttcatgagaatct

SEQ ID NO: 879271 - DNA, 16 bp, Homo sapiens
gttcatggtgatcagt

SEQ ID NO: 879272 - DNA, 15 bp, Homo sapiens
gttcatgtagagaaa

SEQ ID NO: 879273 - DNA, 16 bp, Homo sapiens
gttcatgtagagaaaa

SEQ ID NO: 879274 - DNA, 10 bp, Homo sapiens
gttcatgttg

SEQ ID NO: 879275 - DNA, 14 bp, Homo sapiens
gttcatgtttgctt

SEQ ID NO: 879276 - DNA, 19 bp, Homo sapiens
gttcattataatctcaaag

SEQ ID NO: 879277 - DNA, 22 bp, Homo sapiens
gttcattattggaattaacctg

SEQ ID NO: 879278 - DNA, 18 bp, Homo sapiens
gttcattgtaatgttact

SEQ ID NO: 879279 - DNA, 19 bp, Homo sapiens
gttcattgtaatgttactg

SEQ ID NO: 879280 - DNA, 23 bp, Homo sapiens
gttcattgtaatgttactgatca

SEQ ID NO: 879281 - DNA, 18 bp, Homo sapiens
gttcatttcacacagtga

SEQ ID NO: 879282 - DNA, 23 bp, Homo sapiens
gttcatttggtgttcctggaagc

SEQ ID NO: 879283 - DNA, 12 bp, Homo sapiens
gttcattttagt

SEQ ID NO: 879284 - DNA, 17 bp, Homo sapiens
gttcattttagtgactg

SEQ ID NO: 879285 - DNA, 18 bp, Homo sapiens
gttcattttagtgactgt

SEQ ID NO: 879286 - DNA, 22 bp, Homo sapiens
gttccaaaccagtttattctgt

SEQ ID NO: 879287 - DNA, 21 bp, Homo sapiens
gttccacacatttaaaacatt

SEQ ID NO: 879288 - DNA, 14 bp, Homo sapiens
gttccacagaggac

SEQ ID NO: 879289 - DNA, 14 bp, Homo sapiens
gttccacagttgcc

SEQ ID NO: 879290 - DNA, 18 bp, Homo sapiens
gttccacagttgccacca

SEQ ID NO: 879291 - DNA, 20 bp, Homo sapiens
gttccacgtccccctggggc

SEQ ID NO: 879292 - DNA, 12 bp, Homo sapiens
gttccactgaga

SEQ ID NO: 879293 - DNA, 14 bp, Homo sapiens
gttccactgagctc

SEQ ID NO: 879294 - DNA, 16 bp, Homo sapiens
gttccactgagctcca

SEQ ID NO: 879295 - DNA, 20 bp, Homo sapiens
gttccactgcaaataaagcc

SEQ ID NO: 879296 - DNA, 24 bp, Homo sapiens
gttccagaacagccctcggcctcc

SEQ ID NO: 879297 - DNA, 23 bp, Homo sapiens
gttccagaccccctgagccacag

SEQ ID NO: 879298 - DNA, 18 bp, Homo sapiens
gttccagactcaggttcc

SEQ ID NO: 879299 - DNA, 22 bp, Homo sapiens
gttccagattcctatgatggat

SEQ ID NO: 879300 - DNA, 22 bp, Homo sapiens
gttccaggcctgatcttgcctg

SEQ ID NO: 879301 - DNA, 20 bp, Homo sapiens
gttccagtgaggaaccctga

SEQ ID NO: 879302 - DNA, 20 bp, Homo sapiens
gttctcaagaatctagaaga

SEQ ID NO: 879303 - DNA, 21 bp, Homo sapiens
gttctcaagaatctagaagat

SEQ ID NO: 879304 - DNA, 13 bp, Homo sapiens
gttctcaatgaaa

SEQ ID NO: 879305 - DNA, 21 bp, Homo sapiens
gttctcacactggtctgctgt

SEQ ID NO: 879306 - DNA, 21 bp, Homo sapiens
gttctcactcctaggagagcc

SEQ ID NO: 879307 - DNA, 20 bp, Homo sapiens
gttctcacttattattaata

SEQ ID NO: 879308 - DNA, 13 bp, Homo sapiens
gttctcagagctc

SEQ ID NO: 879309 - DNA, 16 bp, Homo sapiens
gttctcaggacagcat

SEQ ID NO: 879310 - DNA, 13 bp, Homo sapiens
gttctcagtgccg

SEQ ID NO: 879311 - DNA, 18 bp, Homo sapiens
gttctcagtgccggaggc

SEQ ID NO: 879312 - DNA, 14 bp, Homo sapiens
gttctcatgaacta

SEQ ID NO: 879313 - DNA, 12 bp, Homo sapiens
gttctcatgaag

SEQ ID NO: 879314 - DNA, 22 bp, Homo sapiens
gttctcatttggtctgccagaa

SEQ ID NO: 879315 - DNA, 22 bp, Homo sapiens
gttctccagaatgtaagaaaac

SEQ ID NO: 879316 - DNA, 14 bp, Homo sapiens
gttctcccaaagat

SEQ ID NO: 879317 - DNA, 15 bp, Homo sapiens
gttctcccaaagatt

SEQ ID NO: 879318 - DNA, 21 bp, Homo sapiens
gttctcccagcactgcctcct

SEQ ID NO: 879319 - DNA, 22 bp, Homo sapiens
gttctcccagcactgcctcctg

SEQ ID NO: 879320 - DNA, 15 bp, Homo sapiens
gttctcccagggagt

SEQ ID NO: 879321 - DNA, 23 bp, Homo sapiens
gttctcccagggagtgagcagct

SEQ ID NO: 879322 - DNA, 13 bp, Homo sapiens
gttctccccaggg

SEQ ID NO: 879323 - DNA, 14 bp, Homo sapiens
gttctccctttctc

SEQ ID NO: 879324 - DNA, 21 bp, Homo sapiens
gttctccctttctctctcctc

SEQ ID NO: 879325 - DNA, 22 bp, Homo sapiens
gttctccctttctctctcctct

SEQ ID NO: 879326 - DNA, 18 bp, Homo sapiens
gttctccgggtgtggcct

SEQ ID NO: 879327 - DNA, 23 bp, Homo sapiens
gttctccgttagctcctgtggcc

SEQ ID NO: 879328 - DNA, 14 bp, Homo sapiens
gttctcctgcttgt

SEQ ID NO: 879329 - DNA, 18 bp, Homo sapiens
gttctcctggaggcaggg

SEQ ID NO: 879330 - DNA, 13 bp, Homo sapiens
gttctccttttcc

SEQ ID NO: 879331 - DNA, 17 bp, Homo sapiens
gttctccttttgaactt

SEQ ID NO: 879332 - DNA, 16 bp, Homo sapiens
gttctctgatgcagaa

SEQ ID NO: 879333 - DNA, 12 bp, Homo sapiens
gttctctgctga

SEQ ID NO: 879334 - DNA, 12 bp, Homo sapiens
gttctctgggag

SEQ ID NO: 879335 - DNA, 15 bp, Homo sapiens
gttctctgggagaaa

SEQ ID NO: 879336 - DNA, 20 bp, Homo sapiens
gttctctgggagaaaatcat

SEQ ID NO: 879337 - DNA, 14 bp, Homo sapiens
gttctctgtcctac

SEQ ID NO: 879338 - DNA, 20 bp, Homo sapiens
gttctcttaaatattctgaa

SEQ ID NO: 879339 - DNA, 17 bp, Homo sapiens
gttctcttcccaggcct

SEQ ID NO: 879340 - DNA, 20 bp, Homo sapiens
gttctcttcccaggcctttg

SEQ ID NO: 879341 - DNA, 16 bp, Homo sapiens
gttctctttaaaagct

SEQ ID NO: 879342 - DNA, 16 bp, Homo sapiens
gttctgaaaggagaca

SEQ ID NO: 879343 - DNA, 17 bp, Homo sapiens
gttctgaaatgttctta

SEQ ID NO: 879344 - DNA, 20 bp, Homo sapiens
gttctgaagccatgtagcca

SEQ ID NO: 879345 - DNA, 21 bp, Homo sapiens
gttctgaagtgggaaaaaata

SEQ ID NO: 879346 - DNA, 15 bp, Homo sapiens
gttctgaataatttc

SEQ ID NO: 879347 - DNA, 16 bp, Homo sapiens
gttctgaataatttct

SEQ ID NO: 879348 - DNA, 18 bp, Homo sapiens
gttctgaataatttctta

SEQ ID NO: 879349 - DNA, 22 bp, Homo sapiens
gttctgagaactgactttctcc

SEQ ID NO: 879350 - DNA, 23 bp, Homo sapiens
gttctgaggggtgtccgagaggc

SEQ ID NO: 879351 - DNA, 16 bp, Homo sapiens
gttctgagtaagtgtg

SEQ ID NO: 879352 - DNA, 13 bp, Homo sapiens
gttctgattagaa

SEQ ID NO: 879353 - DNA, 18 bp, Homo sapiens
gttctgattagaaatgac

SEQ ID NO: 879354 - DNA, 16 bp, Homo sapiens
gttctgcaaaaatatt

SEQ ID NO: 879355 - DNA, 22 bp, Homo sapiens
gttctgcaagaattaaaactga

SEQ ID NO: 879356 - DNA, 15 bp, Homo sapiens
gttctgcacacagca

SEQ ID NO: 879357 - DNA, 17 bp, Homo sapiens
gttctgcccccagccca

SEQ ID NO: 879358 - DNA, 12 bp, Homo sapiens
gttctgcctgga

SEQ ID NO: 879359 - DNA, 16 bp, Homo sapiens
gttctgctacattata

SEQ ID NO: 879360 - DNA, 15 bp, Homo sapiens
gttctgctcatcatt

SEQ ID NO: 879361 - DNA, 11 bp, Homo sapiens
gttctgctcct

SEQ ID NO: 879362 - DNA, 12 bp, Homo sapiens
gttctgctcctg

SEQ ID NO: 879363 - DNA, 13 bp, Homo sapiens
gttctgctcctgc

SEQ ID NO: 879364 - DNA, 15 bp, Homo sapiens
gttctgctcctgctt

SEQ ID NO: 879365 - DNA, 14 bp, Homo sapiens
gttctgctctggtt

SEQ ID NO: 879366 - DNA, 16 bp, Homo sapiens
gttctgctgaccaaat

SEQ ID NO: 879367 - DNA, 14 bp, Homo sapiens
gttctgctgccctc

SEQ ID NO: 879368 - DNA, 21 bp, Homo sapiens
gttctgcttcaataaatcttt

SEQ ID NO: 879369 - DNA, 17 bp, Homo sapiens
gttctgctttatctttt

SEQ ID NO: 879370 - DNA, 23 bp, Homo sapiens
gttctggactacacccaagcctg

SEQ ID NO: 879371 - DNA, 15 bp, Homo sapiens
gttctggactctgcc

SEQ ID NO: 879372 - DNA, 18 bp, Homo sapiens
gttctggactctgcccca

SEQ ID NO: 879373 - DNA, 20 bp, Homo sapiens
gttctggaggaaagggagga

SEQ ID NO: 879374 - DNA, 19 bp, Homo sapiens
gttctggccaccccagagt

SEQ ID NO: 879375 - DNA, 16 bp, Homo sapiens
gttctggccagaatgc

SEQ ID NO: 879376 - DNA, 20 bp, Homo sapiens
gttctggctgccccaacctg

SEQ ID NO: 879377 - DNA, 14 bp, Homo sapiens
gttctgggcctctg

SEQ ID NO: 879378 - DNA, 15 bp, Homo sapiens
gttctgggctggggc

SEQ ID NO: 879379 - DNA, 18 bp, Homo sapiens
gttctgggtgttgaccac

SEQ ID NO: 879380 - DNA, 15 bp, Homo sapiens
gttctggtatttccc

SEQ ID NO: 879381 - DNA, 17 bp, Homo sapiens
gttctggtcctttttgg

SEQ ID NO: 879382 - DNA, 13 bp, Homo sapiens
gttctggttccat

SEQ ID NO: 879383 - DNA, 22 bp, Homo sapiens
gttctggttccatttttcctct

SEQ ID NO: 879384 - DNA, 17 bp, Homo sapiens
gttctgtagctttctgg

SEQ ID NO: 879385 - DNA, 18 bp, Homo sapiens
gttctgtagctttctgga

SEQ ID NO: 879386 - DNA, 14 bp, Homo sapiens
gttctgtcttccca

SEQ ID NO: 879387 - DNA, 19 bp, Homo sapiens
gttctgtgacatcctgctt

SEQ ID NO: 879388 - DNA, 18 bp, Homo sapiens
gttctgtgcctcccccca

SEQ ID NO: 879389 - DNA, 20 bp, Homo sapiens
gttctgtgcctccccccaga

SEQ ID NO: 879390 - DNA, 22 bp, Homo sapiens
gttctgtgcctccccccagacc

SEQ ID NO: 879391 - DNA, 18 bp, Homo sapiens
gttctgtgggcttggcct

SEQ ID NO: 879392 - DNA, 19 bp, Homo sapiens
gttctgtgggcttggcctt

SEQ ID NO: 879393 - DNA, 14 bp, Homo sapiens
gttctgtggttcct

SEQ ID NO: 879394 - DNA, 19 bp, Homo sapiens
gttctgtggtttcatgtta

SEQ ID NO: 879395 - DNA, 23 bp, Homo sapiens
gttctgtggttttcccctccctg

SEQ ID NO: 879396 - DNA, 13 bp, Homo sapiens
gttctgttaactg

SEQ ID NO: 879397 - DNA, 16 bp, Homo sapiens
gttctgttaactgaat

SEQ ID NO: 879398 - DNA, 18 bp, Homo sapiens
gttctgttgacctgtgca

SEQ ID NO: 879399 - DNA, 16 bp, Homo sapiens
gttctgttgatcccac

SEQ ID NO: 879400 - DNA, 13 bp, Homo sapiens
gttctgtttgctg

SEQ ID NO: 879401 - DNA, 15 bp, Homo sapiens
gttctgtttggcact

SEQ ID NO: 879402 - DNA, 20 bp, Homo sapiens
gttctgtttggcacttgtat

SEQ ID NO: 879403 - DNA, 22 bp, Homo sapiens
gttctgttttcgtaccttccca

SEQ ID NO: 879404 - DNA, 14 bp, Homo sapiens
gttcttaattctta

SEQ ID NO: 879405 - DNA, 21 bp, Homo sapiens
gttcttacaagcttaaagctt

SEQ ID NO: 879406 - DNA, 22 bp, Homo sapiens
gttcttacctgtatgtctccag

SEQ ID NO: 879407 - DNA, 20 bp, Homo sapiens
gttcttagagtgtagctgta

SEQ ID NO: 879408 - DNA, 18 bp, Homo sapiens
gttcttagctttgaaact

SEQ ID NO: 879409 - DNA, 18 bp, Homo sapiens
gttgccaactaagccctc

SEQ ID NO: 879410 - DNA, 14 bp, Homo sapiens
gttgccaagacaaa

SEQ ID NO: 879411 - DNA, 16 bp, Homo sapiens
gttgccaagacaaatc

SEQ ID NO: 879412 - DNA, 15 bp, Homo sapiens
gttgccaagctccaa

SEQ ID NO: 879413 - DNA, 19 bp, Homo sapiens
gttgccaagctccaagccc

SEQ ID NO: 879414 - DNA, 13 bp, Homo sapiens
gttgccaagctgg

SEQ ID NO: 879415 - DNA, 20 bp, Homo sapiens
gttgccaccacctctgtggc

SEQ ID NO: 879416 - DNA, 23 bp, Homo sapiens
gttgccatcctaccgtcttttcc

SEQ ID NO: 879417 - DNA, 14 bp, Homo sapiens
gttgcccaggctgg

SEQ ID NO: 879418 - DNA, 15 bp, Homo sapiens
gttgcccaggctgga

SEQ ID NO: 879419 - DNA, 15 bp, Homo sapiens
gttgccccccagggt

SEQ ID NO: 879420 - DNA, 19 bp, Homo sapiens
gttgcccctttctcttttc

SEQ ID NO: 879421 - DNA, 18 bp, Homo sapiens
gttgccctagcccagact

SEQ ID NO: 879422 - DNA, 20 bp, Homo sapiens
gttgccctagcccagactct

SEQ ID NO: 879423 - DNA, 13 bp, Homo sapiens
gttgccctggcat

SEQ ID NO: 879424 - DNA, 15 bp, Homo sapiens
gttgcctgaaaaatg

SEQ ID NO: 879425 - DNA, 12 bp, Homo sapiens
gttgccttttat

SEQ ID NO: 879426 - DNA, 19 bp, Homo sapiens
gttgcgacgcgggcttctg

SEQ ID NO: 879427 - DNA, 15 bp, Homo sapiens
gttgcgacggagaga

SEQ ID NO: 879428 - DNA, 17 bp, Homo sapiens
gttgcgttcctttcttt

SEQ ID NO: 879429 - DNA, 18 bp, Homo sapiens
gttgctagttttttgctt

SEQ ID NO: 879430 - DNA, 22 bp, Homo sapiens
gttgctattgtaaggtctttgt

SEQ ID NO: 879431 - DNA, 23 bp, Homo sapiens
gttgctattgtaaggtctttgta

SEQ ID NO: 879432 - DNA, 22 bp, Homo sapiens
gttgctgactactactctgcca

SEQ ID NO: 879433 - DNA, 22 bp, Homo sapiens
gttgctgggagctgaaaaatca

SEQ ID NO: 879434 - DNA, 17 bp, Homo sapiens
gttgctggtcaggtccc

SEQ ID NO: 879435 - DNA, 14 bp, Homo sapiens
gttgctgtcactgt

SEQ ID NO: 879436 - DNA, 23 bp, Homo sapiens
gttgctgttattatatttgacat

SEQ ID NO: 879437 - DNA, 17 bp, Homo sapiens
gttgctgttttcctccc

SEQ ID NO: 879438 - DNA, 22 bp, Homo sapiens
gttgcttagatgagggtgactg

SEQ ID NO: 879439 - DNA, 12 bp, Homo sapiens
gttgcttctgaa

SEQ ID NO: 879440 - DNA, 15 bp, Homo sapiens
gttgcttctgaatca

SEQ ID NO: 879441 - DNA, 23 bp, Homo sapiens
gttgcttcttctacttcagtctt

SEQ ID NO: 879442 - DNA, 21 bp, Homo sapiens
gttgcttgcctgatataaatg

SEQ ID NO: 879443 - DNA, 23 bp, Homo sapiens
gttgcttggtgcacagattgctg

SEQ ID NO: 879444 - DNA, 20 bp, Homo sapiens
gttgctttaaagtacctgta

SEQ ID NO: 879445 - DNA, 18 bp, Homo sapiens
gttgctttaatatgagct

SEQ ID NO: 879446 - DNA, 20 bp, Homo sapiens
gttgctttctattatcatgg

SEQ ID NO: 879447 - DNA, 16 bp, Homo sapiens
gttgctttgccagagc

SEQ ID NO: 879448 - DNA, 19 bp, Homo sapiens
gttgctttgccagagcagg

SEQ ID NO: 879449 - DNA, 22 bp, Homo sapiens
gttggaaaatgtgtctctgctt

SEQ ID NO: 879450 - DNA, 14 bp, Homo sapiens
gttggaactttagg

SEQ ID NO: 879451 - DNA, 17 bp, Homo sapiens
gttgggtcaaggacagg

SEQ ID NO: 879452 - DNA, 18 bp, Homo sapiens
gttgggtcaaggacaggg

SEQ ID NO: 879453 - DNA, 19 bp, Homo sapiens
gttgggtgggtgggccctg

SEQ ID NO: 879454 - DNA, 18 bp, Homo sapiens
gttgggtttgctcatgta

SEQ ID NO: 879455 - DNA, 13 bp, Homo sapiens
gttggtagtttct

SEQ ID NO: 879456 - DNA, 14 bp, Homo sapiens
gttggtcaggctgg

SEQ ID NO: 879457 - DNA, 13 bp, Homo sapiens
gttggtccactgt

SEQ ID NO: 879458 - DNA, 18 bp, Homo sapiens
gttggtccactgtgttta

SEQ ID NO: 879459 - DNA, 22 bp, Homo sapiens
gttggtccagagcggaggctgt

SEQ ID NO: 879460 - DNA, 21 bp, Homo sapiens
gttggtctttctaatgtagct

SEQ ID NO: 879461 - DNA, 19 bp, Homo sapiens
gttggtggcagtgacttct

SEQ ID NO: 879462 - DNA, 15 bp, Homo sapiens
gttggtttcccctgc

SEQ ID NO: 879463 - DNA, 16 bp, Homo sapiens
gttggtttgtatgaga

SEQ ID NO: 879464 - DNA, 18 bp, Homo sapiens
gttggttttgacttcaga

SEQ ID NO: 879465 - DNA, 17 bp, Homo sapiens
gttgtaaaatagaaaaa

SEQ ID NO: 879466 - DNA, 22 bp, Homo sapiens
gttgtaaaatatagctgtacaa

SEQ ID NO: 879467 - DNA, 16 bp, Homo sapiens
gttgtaaatatataaa

SEQ ID NO: 879468 - DNA, 14 bp, Homo sapiens
gttgtaacctgctg

SEQ ID NO: 879469 - DNA, 17 bp, Homo sapiens
gttgtaatatttcttca

SEQ ID NO: 879470 - DNA, 23 bp, Homo sapiens
gttgtacctcttttgcttgccaa

SEQ ID NO: 879471 - DNA, 14 bp, Homo sapiens
gttgtactgctttg

SEQ ID NO: 879472 - DNA, 16 bp, Homo sapiens
gttgtactttatatct

SEQ ID NO: 879473 - DNA, 15 bp, Homo sapiens
gttgtagacaaagta

SEQ ID NO: 879474 - DNA, 14 bp, Homo sapiens
gttgtagcattttc

SEQ ID NO: 879475 - DNA, 15 bp, Homo sapiens
gttgtagcattttcc

SEQ ID NO: 879476 - DNA, 16 bp, Homo sapiens
gttgtagcattttcct

SEQ ID NO: 879477 - DNA, 19 bp, Homo sapiens
gttgtagttcttgtgcatg

SEQ ID NO: 879478 - DNA, 19 bp, Homo sapiens
gttgtataaatttatttac

SEQ ID NO: 879479 - DNA, 21 bp, Homo sapiens
gttgtataaatttatttactg

SEQ ID NO: 879480 - DNA, 21 bp, Homo sapiens
gttgtatctacagtaatgaaa

SEQ ID NO: 879481 - DNA, 14 bp, Homo sapiens
gttgtatgccttta

SEQ ID NO: 879482 - DNA, 22 bp, Homo sapiens
gttgtatgtttgctgattattt

SEQ ID NO: 879483 - DNA, 21 bp, Homo sapiens
gttgtatttctatatttattt

SEQ ID NO: 879484 - DNA, 14 bp, Homo sapiens
gttgtcaagaatag

SEQ ID NO: 879485 - DNA, 22 bp, Homo sapiens
gttgtcaagaatagcattgtaa

SEQ ID NO: 879486 - DNA, 20 bp, Homo sapiens
gttgtcaaggaagaagaaat

SEQ ID NO: 879487 - DNA, 15 bp, Homo sapiens
gttgtcaatattaaa

SEQ ID NO: 879488 - DNA, 10 bp, Homo sapiens
gttgtcagaa

SEQ ID NO: 879489 - DNA, 11 bp, Homo sapiens
gttgtcagaat

SEQ ID NO: 879490 - DNA, 21 bp, Homo sapiens
gttgtcagcaggcaggctggg

SEQ ID NO: 879491 - DNA, 20 bp, Homo sapiens
gttgtcattgctgttgtccc

SEQ ID NO: 879492 - DNA, 13 bp, Homo sapiens
gttgtcccatctg

SEQ ID NO: 879493 - DNA, 16 bp, Homo sapiens
gttgtcctccccttgg

SEQ ID NO: 879494 - DNA, 19 bp, Homo sapiens
gttgtcctccccttgggcg

SEQ ID NO: 879495 - DNA, 15 bp, Homo sapiens
gttgtcctgttaatt

SEQ ID NO: 879496 - DNA, 17 bp, Homo sapiens
gttgtccttaaatttgt

SEQ ID NO: 879497 - DNA, 16 bp, Homo sapiens
gttgtcgtttttagct

SEQ ID NO: 879498 - DNA, 18 bp, Homo sapiens
gttgtctacgggggcact

SEQ ID NO: 879499 - DNA, 17 bp, Homo sapiens
gtttaatatttaaacag

SEQ ID NO: 879500 - DNA, 14 bp, Homo sapiens
gtttaatttacaca

SEQ ID NO: 879501 - DNA, 20 bp, Homo sapiens
gtttacaaaaatttctgtaa

SEQ ID NO: 879502 - DNA, 15 bp, Homo sapiens
gtttacaatttacaa

SEQ ID NO: 879503 - DNA, 16 bp, Homo sapiens
gtttacaatttacaaa

SEQ ID NO: 879504 - DNA, 14 bp, Homo sapiens
gtttacagaaaaat

SEQ ID NO: 879505 - DNA, 17 bp, Homo sapiens
gtttacaggtggacaca

SEQ ID NO: 879506 - DNA, 22 bp, Homo sapiens
gtttacatagtctgaagtgaag

SEQ ID NO: 879507 - DNA, 22 bp, Homo sapiens
gtttacatggcgccctgcctcc

SEQ ID NO: 879508 - DNA, 18 bp, Homo sapiens
gtttaccagttgcctttt

SEQ ID NO: 879509 - DNA, 16 bp, Homo sapiens
gtttaccatttgtaat

SEQ ID NO: 879510 - DNA, 22 bp, Homo sapiens
gtttaccctcaaccctattcat

SEQ ID NO: 879511 - DNA, 20 bp, Homo sapiens
gtttacctcatccatgcact

SEQ ID NO: 879512 - DNA, 22 bp, Homo sapiens
gtttacctgaataaatggtagt

SEQ ID NO: 879513 - DNA, 12 bp, Homo sapiens
gtttaccttgta

SEQ ID NO: 879514 - DNA, 14 bp, Homo sapiens
gtttactttttaac

SEQ ID NO: 879515 - DNA, 16 bp, Homo sapiens
gtttagaacacacaca

SEQ ID NO: 879516 - DNA, 15 bp, Homo sapiens
gtttagattccagga

SEQ ID NO: 879517 - DNA, 20 bp, Homo sapiens
gtttagcttcctccagagga

SEQ ID NO: 879518 - DNA, 22 bp, Homo sapiens
gtttaggctatttgtaaatctg

SEQ ID NO: 879519 - DNA, 21 bp, Homo sapiens
gtttaggctggtggcccagga

SEQ ID NO: 879520 - DNA, 13 bp, Homo sapiens
gtttagtaagttt

SEQ ID NO: 879521 - DNA, 14 bp, Homo sapiens
gtttagttctgttg

SEQ ID NO: 879522 - DNA, 15 bp, Homo sapiens
gtttagttttacact

SEQ ID NO: 879523 - DNA, 16 bp, Homo sapiens
gtttagttttacacta

SEQ ID NO: 879524 - DNA, 18 bp, Homo sapiens
gtttagttttacatttta

SEQ ID NO: 879525 - DNA, 23 bp, Homo sapiens
gtttataaaacaatgacttttaa

SEQ ID NO: 879526 - DNA, 14 bp, Homo sapiens
gtttataaagcaga

SEQ ID NO: 879527 - DNA, 17 bp, Homo sapiens
gtttataattgtttata

SEQ ID NO: 879528 - DNA, 19 bp, Homo sapiens
gtttatacacaactttgca

SEQ ID NO: 879529 - DNA, 23 bp, Homo sapiens
gtttatacacaactttgcaaatt

SEQ ID NO: 879530 - DNA, 15 bp, Homo sapiens
gtttatacactgtgt

SEQ ID NO: 879531 - DNA, 20 bp, Homo sapiens
gtttatactgtatttctaag

SEQ ID NO: 879532 - DNA, 20 bp, Homo sapiens
gtttatagagggccaagact

SEQ ID NO: 879533 - DNA, 22 bp, Homo sapiens
gtttatatacagtacacagata

SEQ ID NO: 879534 - DNA, 12 bp, Homo sapiens
gtttatatactg

SEQ ID NO: 879535 - DNA, 21 bp, Homo sapiens
gtttatattttttcagttgtt

SEQ ID NO: 879536 - DNA, 23 bp, Homo sapiens
gtttatcaacttcgctagaaaaa

SEQ ID NO: 879537 - DNA, 12 bp, Homo sapiens
gtttatccaaat

SEQ ID NO: 879538 - DNA, 16 bp, Homo sapiens
gtttatccaaatcttg

SEQ ID NO: 879539 - DNA, 15 bp, Homo sapiens
gtttatcctttcata

SEQ ID NO: 879540 - DNA, 22 bp, Homo sapiens
gtttatcctttcatatagttag

SEQ ID NO: 879541 - DNA, 17 bp, Homo sapiens
gtttatgatatttcttg

SEQ ID NO: 879542 - DNA, 17 bp, Homo sapiens
gtttatgcaaggaagga

SEQ ID NO: 879543 - DNA, 14 bp, Homo sapiens
gtttatggcctcag

SEQ ID NO: 879544 - DNA, 18 bp, Homo sapiens
gtttatggcctcagctgc

SEQ ID NO: 879545 - DNA, 23 bp, Homo sapiens
gtttatggcctcagctgcctcac

SEQ ID NO: 879546 - DNA, 19 bp, Homo sapiens
gtttatgtaatagttctat

SEQ ID NO: 879547 - DNA, 14 bp, Homo sapiens
gtttattaatagaa

SEQ ID NO: 879548 - DNA, 17 bp, Homo sapiens
gtttattacttccatga

SEQ ID NO: 879549 - DNA, 15 bp, Homo sapiens
gtttattatttacat

SEQ ID NO: 879550 - DNA, 13 bp, Homo sapiens
gtttattcccaag

SEQ ID NO: 879551 - DNA, 20 bp, Homo sapiens
gtttattctctgctgcatct

SEQ ID NO: 879552 - DNA, 13 bp, Homo sapiens
gtttattctgatt

SEQ ID NO: 879553 - DNA, 16 bp, Homo sapiens
gtttattcttccagaa

SEQ ID NO: 879554 - DNA, 17 bp, Homo sapiens
gtttattcttccagaat

SEQ ID NO: 879555 - DNA, 19 bp, Homo sapiens
gtttattcttccagaatgc

SEQ ID NO: 879556 - DNA, 20 bp, Homo sapiens
gtttattcttccagaatgct

SEQ ID NO: 879557 - DNA, 20 bp, Homo sapiens
gtttattgtttgatgttttt

SEQ ID NO: 879558 - DNA, 14 bp, Homo sapiens
gtttatttattcac

SEQ ID NO: 879559 - DNA, 17 bp, Homo sapiens
gtttatttattctgcat

SEQ ID NO: 879560 - DNA, 21 bp, Homo sapiens
gtttatttccaaataaaatga

SEQ ID NO: 879561 - DNA, 20 bp, Homo sapiens
gtttatttccactattttca

SEQ ID NO: 879562 - DNA, 19 bp, Homo sapiens
gtttattttcaagaataat

SEQ ID NO: 879563 - DNA, 12 bp, Homo sapiens
gtttattttcag

SEQ ID NO: 879564 - DNA, 17 bp, Homo sapiens
gtttatttttcatattg

SEQ ID NO: 879565 - DNA, 20 bp, Homo sapiens
gtttcaaaaccatgcctggt

SEQ ID NO: 879566 - DNA, 19 bp, Homo sapiens
gtttcaaaagcaaaacatc

SEQ ID NO: 879567 - DNA, 13 bp, Homo sapiens
gtttcaaacttta

SEQ ID NO: 879568 - DNA, 16 bp, Homo sapiens
gtttcaaactttacta

SEQ ID NO: 879569 - DNA, 19 bp, Homo sapiens
gtttcaaagggattgcttt

SEQ ID NO: 879570 - DNA, 13 bp, Homo sapiens
gtttcaaatgtgc

SEQ ID NO: 879571 - DNA, 15 bp, Homo sapiens
gtttcaagaaaatct

SEQ ID NO: 879572 - DNA, 22 bp, Homo sapiens
gtttcaataaagtttgtacact

SEQ ID NO: 879573 - DNA, 22 bp, Homo sapiens
gtttcaatgcatacaataaaag

SEQ ID NO: 879574 - DNA, 22 bp, Homo sapiens
gtttcaattccacctgcaatca

SEQ ID NO: 879575 - DNA, 16 bp, Homo sapiens
gtttcaattgcatctc

SEQ ID NO: 879576 - DNA, 22 bp, Homo sapiens
gtttcaattgcatctcccagat

SEQ ID NO: 879577 - DNA, 17 bp, Homo sapiens
gtttcaccactcctctc

SEQ ID NO: 879578 - DNA, 18 bp, Homo sapiens
gtttcaccactcctctcc

SEQ ID NO: 879579 - DNA, 15 bp, Homo sapiens
gtttcactccctctt

SEQ ID NO: 879580 - DNA, 17 bp, Homo sapiens
gtttcactcctgcttct

SEQ ID NO: 879581 - DNA, 11 bp, Homo sapiens
gtttcagaaat

SEQ ID NO: 879582 - DNA, 19 bp, Homo sapiens
gtttcagagcataaaacct

SEQ ID NO: 879583 - DNA, 13 bp, Homo sapiens
gtttcagatgagg

SEQ ID NO: 879584 - DNA, 20 bp, Homo sapiens
gtttcagattttttaaaatt

SEQ ID NO: 879585 - DNA, 21 bp, Homo sapiens
gtttcagattttttaaaattt

SEQ ID NO: 879586 - DNA, 18 bp, Homo sapiens
gtttcagccaaggggctg

SEQ ID NO: 879587 - DNA, 18 bp, Homo sapiens
gtttcagtttttttaaat

SEQ ID NO: 879588 - DNA, 20 bp, Homo sapiens
gtttcagtttttttaaatgc

SEQ ID NO: 879589 - DNA, 13 bp, Homo sapiens
gtttcatatttct

SEQ ID NO: 879590 - DNA, 18 bp, Homo sapiens
gtttgactagatgatgga

SEQ ID NO: 879591 - DNA, 13 bp, Homo sapiens
gtttgactcagtt

SEQ ID NO: 879592 - DNA, 19 bp, Homo sapiens
gtttgactttcaaaatata

SEQ ID NO: 879593 - DNA, 13 bp, Homo sapiens
gtttgactttttg

SEQ ID NO: 879594 - DNA, 17 bp, Homo sapiens
gtttgagacaagccctg

SEQ ID NO: 879595 - DNA, 18 bp, Homo sapiens
gtttgagacaagccctgg

SEQ ID NO: 879596 - DNA, 21 bp, Homo sapiens
gtttgagacaagccctggcaa

SEQ ID NO: 879597 - DNA, 14 bp, Homo sapiens
gtttgagctgcctt

SEQ ID NO: 879598 - DNA, 18 bp, Homo sapiens
gtttgagctgccttccct

SEQ ID NO: 879599 - DNA, 17 bp, Homo sapiens
gtttgaggaagtggctg

SEQ ID NO: 879600 - DNA, 18 bp, Homo sapiens
gtttgagtttttcctccc

SEQ ID NO: 879601 - DNA, 16 bp, Homo sapiens
gtttgatagattttct

SEQ ID NO: 879602 - DNA, 19 bp, Homo sapiens
gtttgatcatttctgccat

SEQ ID NO: 879603 - DNA, 12 bp, Homo sapiens
gtttgatgtatg

SEQ ID NO: 879604 - DNA, 14 bp, Homo sapiens
gtttgatgtatgtg

SEQ ID NO: 879605 - DNA, 17 bp, Homo sapiens
gtttgattaaattcttg

SEQ ID NO: 879606 - DNA, 22 bp, Homo sapiens
gtttgattaaattcttgcaaag

SEQ ID NO: 879607 - DNA, 16 bp, Homo sapiens
gtttgattgaggagct

SEQ ID NO: 879608 - DNA, 11 bp, Homo sapiens
gtttgatttca

SEQ ID NO: 879609 - DNA, 21 bp, Homo sapiens
gtttgattttagctgcagaac

SEQ ID NO: 879610 - DNA, 17 bp, Homo sapiens
gtttgatttttgttttt

SEQ ID NO: 879611 - DNA, 16 bp, Homo sapiens
gtttgcaaagaccacc

SEQ ID NO: 879612 - DNA, 16 bp, Homo sapiens
gtttgcaaataggcag

SEQ ID NO: 879613 - DNA, 18 bp, Homo sapiens
gtttgcaccgcctgccct

SEQ ID NO: 879614 - DNA, 15 bp, Homo sapiens
gtttgcacctgtccc

SEQ ID NO: 879615 - DNA, 22 bp, Homo sapiens
gtttgcactgtatgctggacgg

SEQ ID NO: 879616 - DNA, 22 bp, Homo sapiens
gtttgcagaaaagcacctgccg

SEQ ID NO: 879617 - DNA, 21 bp, Homo sapiens
gtttgcatttggatgtgtaaa

SEQ ID NO: 879618 - DNA, 22 bp, Homo sapiens
gtttgccaaataaaaaacagaa

SEQ ID NO: 879619 - DNA, 17 bp, Homo sapiens
gtttgccaagctaatct

SEQ ID NO: 879620 - DNA, 11 bp, Homo sapiens
gtttgcctcct

SEQ ID NO: 879621 - DNA, 14 bp, Homo sapiens
gtttgctaaaagaa

SEQ ID NO: 879622 - DNA, 20 bp, Homo sapiens
gtttgctaaaagaagagagg

SEQ ID NO: 879623 - DNA, 19 bp, Homo sapiens
gtttgctcttttaagcagt

SEQ ID NO: 879624 - DNA, 17 bp, Homo sapiens
gtttgctgattatttat

SEQ ID NO: 879625 - DNA, 13 bp, Homo sapiens
gtttgctgtgcca

SEQ ID NO: 879626 - DNA, 22 bp, Homo sapiens
gtttgctgttgggtttttgctg

SEQ ID NO: 879627 - DNA, 22 bp, Homo sapiens
gtttgcttaaaatatgtgaagt

SEQ ID NO: 879628 - DNA, 13 bp, Homo sapiens
gtttgcttaaaca

SEQ ID NO: 879629 - DNA, 14 bp, Homo sapiens
gtttgcttaaacaa

SEQ ID NO: 879630 - DNA, 13 bp, Homo sapiens
gtttgcttattgt

SEQ ID NO: 879631 - DNA, 17 bp, Homo sapiens
gtttgcttcataaatga

SEQ ID NO: 879632 - DNA, 20 bp, Homo sapiens
gtttggaaaaaactctgaag

SEQ ID NO: 879633 - DNA, 17 bp, Homo sapiens
gtttggaaaagtggcgt

SEQ ID NO: 879634 - DNA, 13 bp, Homo sapiens
gtttggaaggagc

SEQ ID NO: 879635 - DNA, 15 bp, Homo sapiens
gtttggaatattaaa

SEQ ID NO: 879636 - DNA, 15 bp, Homo sapiens
gtttggaccccagct

SEQ ID NO: 879637 - DNA, 16 bp, Homo sapiens
gtttggaccccagctg

SEQ ID NO: 879638 - DNA, 15 bp, Homo sapiens
gtttggactgttttc

SEQ ID NO: 879639 - DNA, 17 bp, Homo sapiens
gtttggagatttttcat

SEQ ID NO: 879640 - DNA, 17 bp, Homo sapiens
gtttggatacagctgct

SEQ ID NO: 879641 - DNA, 15 bp, Homo sapiens
gtttggcaaggaaag

SEQ ID NO: 879642 - DNA, 17 bp, Homo sapiens
gtttggcaatagtttgc

SEQ ID NO: 879643 - DNA, 10 bp, Homo sapiens
gtttggccag

SEQ ID NO: 879644 - DNA, 14 bp, Homo sapiens
gtttggccagggag

SEQ ID NO: 879645 - DNA, 13 bp, Homo sapiens
gtttggcccaaga

SEQ ID NO: 879646 - DNA, 15 bp, Homo sapiens
gtttggccctggagc

SEQ ID NO: 879647 - DNA, 19 bp, Homo sapiens
gtttggccctggagccagg

SEQ ID NO: 879648 - DNA, 21 bp, Homo sapiens
gtttggcgggccaaggactgc

SEQ ID NO: 879649 - DNA, 15 bp, Homo sapiens
gtttggctgtgtcta

SEQ ID NO: 879650 - DNA, 18 bp, Homo sapiens
gtttggctgtgtctaaac

SEQ ID NO: 879651 - DNA, 19 bp, Homo sapiens
gtttggctgtgtctaaact

SEQ ID NO: 879652 - DNA, 22 bp, Homo sapiens
gtttggctgtgtctaaactgca

SEQ ID NO: 879653 - DNA, 18 bp, Homo sapiens
gtttggcttataaacaca

SEQ ID NO: 879654 - DNA, 14 bp, Homo sapiens
gtttgggagagtgg

SEQ ID NO: 879655 - DNA, 22 bp, Homo sapiens
gtttggggaatgcggccgcatt

SEQ ID NO: 879656 - DNA, 12 bp, Homo sapiens
gtttggggagaa

SEQ ID NO: 879657 - DNA, 20 bp, Homo sapiens
gtttggggagcagagacact

SEQ ID NO: 879658 - DNA, 21 bp, Homo sapiens
gtttgggggaaaaaaaagaaa

SEQ ID NO: 879659 - DNA, 19 bp, Homo sapiens
gtttgggggcgccctctct

SEQ ID NO: 879660 - DNA, 17 bp, Homo sapiens
gtttgggtttttttcct

SEQ ID NO: 879661 - DNA, 13 bp, Homo sapiens
gtttggtgcttct

SEQ ID NO: 879662 - DNA, 13 bp, Homo sapiens
gtttggtgctttt

SEQ ID NO: 879663 - DNA, 22 bp, Homo sapiens
gtttggtgggggtagagctgat

SEQ ID NO: 879664 - DNA, 16 bp, Homo sapiens
gtttggttagaggaag

SEQ ID NO: 879665 - DNA, 14 bp, Homo sapiens
gtttggttctgggg

SEQ ID NO: 879666 - DNA, 19 bp, Homo sapiens
gtttgtaaaattgttcctg

SEQ ID NO: 879667 - DNA, 10 bp, Homo sapiens
gtttgtaaat

SEQ ID NO: 879668 - DNA, 19 bp, Homo sapiens
gtttgtaaattaactttta

SEQ ID NO: 879669 - DNA, 16 bp, Homo sapiens
gtttgtaaattatttg

SEQ ID NO: 879670 - DNA, 16 bp, Homo sapiens
gtttgtaccatttatg

SEQ ID NO: 879671 - DNA, 15 bp, Homo sapiens
gtttgtagccaggta

SEQ ID NO: 879672 - DNA, 22 bp, Homo sapiens
gtttgtagtgccactgttgttt

SEQ ID NO: 879673 - DNA, 15 bp, Homo sapiens
gtttgtatatttgca

SEQ ID NO: 879674 - DNA, 14 bp, Homo sapiens
gtttgtatgagatg

SEQ ID NO: 879675 - DNA, 16 bp, Homo sapiens
gtttgtattttttatt

SEQ ID NO: 879676 - DNA, 19 bp, Homo sapiens
gtttgtcactgccaaagta

SEQ ID NO: 879677 - DNA, 17 bp, Homo sapiens
gtttgtcccccggggca

SEQ ID NO: 879678 - DNA, 22 bp, Homo sapiens
gtttgtcctgatgcttttgtct

SEQ ID NO: 879679 - DNA, 18 bp, Homo sapiens
gtttgtcgctcatgtgtg

SEQ ID NO: 879680 - DNA, 13 bp, Homo sapiens
gtttgtctatttt

SEQ ID NO: 879681 - DNA, 15 bp, Homo sapiens
gtttgtctgtcttca

SEQ ID NO: 879682 - DNA, 22 bp, Homo sapiens
gtttgtgagcatgggtgtgccc

SEQ ID NO: 879683 - DNA, 19 bp, Homo sapiens
gtttgtgatattaaatttc

SEQ ID NO: 879684 - DNA, 16 bp, Homo sapiens
gtttgtgcaaacataa

SEQ ID NO: 879685 - DNA, 16 bp, Homo sapiens
gtttgtggcctcagaa

SEQ ID NO: 879686 - DNA, 13 bp, Homo sapiens
gtttgtgggactg

SEQ ID NO: 879687 - DNA, 13 bp, Homo sapiens
gtttgtgtctttg

SEQ ID NO: 879688 - DNA, 16 bp, Homo sapiens
gtttgtgtgtatttgt

SEQ ID NO: 879689 - DNA, 21 bp, Homo sapiens
gtttgtgtgtatttgtattaa

SEQ ID NO: 879690 - DNA, 21 bp, Homo sapiens
gtttgtgtgttttgtacactt

SEQ ID NO: 879691 - DNA, 20 bp, Homo sapiens
gtttgtgttctgtttgttaa

SEQ ID NO: 879692 - DNA, 12 bp, Homo sapiens
gtttgttctccg

SEQ ID NO: 879693 - DNA, 17 bp, Homo sapiens
gtttgttctgttctggg

SEQ ID NO: 879694 - DNA, 19 bp, Homo sapiens
gtttgttgagctggtaaca

SEQ ID NO: 879695 - DNA, 13 bp, Homo sapiens
gtttgtttcttct

SEQ ID NO: 879696 - DNA, 20 bp, Homo sapiens
gtttgtttcttcttttcctt

SEQ ID NO: 879697 - DNA, 14 bp, Homo sapiens
gtttgtttctttgt

SEQ ID NO: 879698 - DNA, 15 bp, Homo sapiens
gtttgtttctttgtg

SEQ ID NO: 879699 - DNA, 15 bp, Homo sapiens
gtttgtttgtctgtt

SEQ ID NO: 879700 - DNA, 19 bp, Homo sapiens
gtttttttgtatagtaaag

SEQ ID NO: 879701 - DNA, 20 bp, Homo sapiens
gtttttttgtcaacattgtg

SEQ ID NO: 879702 - DNA, 20 bp, Homo sapiens
gttttttttgactaaagcta

SEQ ID NO: 879703 - DNA, 14 bp, Homo sapiens
gttttttttgtttg

SEQ ID NO: 879704 - DNA, 15 bp, Homo sapiens
gttttttttttctga

SEQ ID NO: 879705 - DNA, 18 bp, Homo sapiens
gttttttttttcttgtct

SEQ ID NO: 879706 - DNA, 18 bp, Homo sapiens
gttttttttttgaaagtc

SEQ ID NO: 879707 - DNA, 19 bp, Homo sapiens
gtttttttttttcttaaat

SEQ ID NO: 879708 - DNA, 15 bp, Homo sapiens
gttttttttttttcc

SEQ ID NO: 879709 - DNA, 22 bp, Homo sapiens
taaaaaaaaaggcatattgctt

SEQ ID NO: 879710 - DNA, 15 bp, Homo sapiens
taaaaatgaggtact

SEQ ID NO: 879711 - DNA, 22 bp, Homo sapiens
taaaaatgaggtactctcctgg

SEQ ID NO: 879712 - DNA, 13 bp, Homo sapiens
taaaaatgctgtg

SEQ ID NO: 879713 - DNA, 17 bp, Homo sapiens
taaaaatggctaactga

SEQ ID NO: 879714 - DNA, 20 bp, Homo sapiens
taaaaatggctaactgatga

SEQ ID NO: 879715 - DNA, 22 bp, Homo sapiens
taaaaatggctaactgatgaat

SEQ ID NO: 879716 - DNA, 21 bp, Homo sapiens
taaaaatggctcaagtagaaa

SEQ ID NO: 879717 - DNA, 19 bp, Homo sapiens
taaaaatgtaaatattcta

SEQ ID NO: 879718 - DNA, 16 bp, Homo sapiens
taaaaatgttctcaaa

SEQ ID NO: 879719 - DNA, 23 bp, Homo sapiens
taaaaatgttttttcatgtgttt

SEQ ID NO: 879720 - DNA, 18 bp, Homo sapiens
taaaaattaaaaaatgaa

SEQ ID NO: 879721 - DNA, 19 bp, Homo sapiens
taaaaattcccttcctgtt

SEQ ID NO: 879722 - DNA, 14 bp, Homo sapiens
taaaaattctgaat

SEQ ID NO: 879723 - DNA, 17 bp, Homo sapiens
taaaaattctgaatgta

SEQ ID NO: 879724 - DNA, 22 bp, Homo sapiens
taaaaattgaactgtaaactct

SEQ ID NO: 879725 - DNA, 17 bp, Homo sapiens
taaaaattgtgatcaga

SEQ ID NO: 879726 - DNA, 12 bp, Homo sapiens
taaaaattgttt

SEQ ID NO: 879727 - DNA, 22 bp, Homo sapiens
taaaacaaaacaaaacaaactt

SEQ ID NO: 879728 - DNA, 16 bp, Homo sapiens
taaaacaaaaccaagc

SEQ ID NO: 879729 - DNA, 21 bp, Homo sapiens
taaaacaaaaccaagccttgg

SEQ ID NO: 879730 - DNA, 11 bp, Homo sapiens
taaaacaaaag

SEQ ID NO: 879731 - DNA, 12 bp, Homo sapiens
taaaacaaaaga

SEQ ID NO: 879732 - DNA, 13 bp, Homo sapiens
taaaacaaaagag

SEQ ID NO: 879733 - DNA, 17 bp, Homo sapiens
taaaacaaaatctgaac

SEQ ID NO: 879734 - DNA, 20 bp, Homo sapiens
taaaacaaaggaactaactt

SEQ ID NO: 879735 - DNA, 22 bp, Homo sapiens
taaaacaaatatacattttcta

SEQ ID NO: 879736 - DNA, 16 bp, Homo sapiens
taaaacaacaacaaaa

SEQ ID NO: 879737 - DNA, 16 bp, Homo sapiens
taaaacaacagatgta

SEQ ID NO: 879738 - DNA, 14 bp, Homo sapiens
taaaacaagcctta

SEQ ID NO: 879739 - DNA, 18 bp, Homo sapiens
taaaacaatgacttttaa

SEQ ID NO: 879740 - DNA, 21 bp, Homo sapiens
taaaacaattctgtgacatac

SEQ ID NO: 879741 - DNA, 21 bp, Homo sapiens
taaaacacacctaagagaaaa

SEQ ID NO: 879742 - DNA, 10 bp, Homo sapiens
taaaacacta

SEQ ID NO: 879743 - DNA, 14 bp, Homo sapiens
taaaacactaaaag

SEQ ID NO: 879744 - DNA, 15 bp, Homo sapiens
taaaacactcatccc

SEQ ID NO: 879745 - DNA, 17 bp, Homo sapiens
taaaacaggcaaagttt

SEQ ID NO: 879746 - DNA, 21 bp, Homo sapiens
taaaacaggcaaagttttaca

SEQ ID NO: 879747 - DNA, 13 bp, Homo sapiens
taaaacatagcaa

SEQ ID NO: 879748 - DNA, 15 bp, Homo sapiens
taaaacatagcaaat

SEQ ID NO: 879749 - DNA, 21 bp, Homo sapiens
taaaacatatttcattttaac

SEQ ID NO: 879750 - DNA, 18 bp, Homo sapiens
taaaacatgactcctaca

SEQ ID NO: 879751 - DNA, 15 bp, Homo sapiens
taaaacattaaaata

SEQ ID NO: 879752 - DNA, 16 bp, Homo sapiens
taaaacattaaaatat

SEQ ID NO: 879753 - DNA, 19 bp, Homo sapiens
taaaacattaaaatataat

SEQ ID NO: 879754 - DNA, 13 bp, Homo sapiens
taaaacattactt

SEQ ID NO: 879755 - DNA, 17 bp, Homo sapiens
taaaacatttgtttccc

SEQ ID NO: 879756 - DNA, 19 bp, Homo sapiens
taaaacatttgtttccccc

SEQ ID NO: 879757 - DNA, 19 bp, Homo sapiens
taaaacattttatttcttt

SEQ ID NO: 879758 - DNA, 11 bp, Homo sapiens
taaaaccaaag

SEQ ID NO: 879759 - DNA, 13 bp, Homo sapiens
taaaaccaaagag

SEQ ID NO: 879760 - DNA, 18 bp, Homo sapiens
taaaaccacagctgggca

SEQ ID NO: 879761 - DNA, 21 bp, Homo sapiens
taaaaccacagctgggcaggg

SEQ ID NO: 879762 - DNA, 21 bp, Homo sapiens
taaaaccatcagatatttctt

SEQ ID NO: 879763 - DNA, 14 bp, Homo sapiens
taaaataagttaaa

SEQ ID NO: 879764 - DNA, 14 bp, Homo sapiens
taaaataattttgt

SEQ ID NO: 879765 - DNA, 16 bp, Homo sapiens
taaaataattttgtaa

SEQ ID NO: 879766 - DNA, 21 bp, Homo sapiens
taaaatacgatcggtttcata

SEQ ID NO: 879767 - DNA, 22 bp, Homo sapiens
taaaatactctagcctgggcca

SEQ ID NO: 879768 - DNA, 19 bp, Homo sapiens
taaaatacttttactctgc

SEQ ID NO: 879769 - DNA, 18 bp, Homo sapiens
taaaatactttttatcac

SEQ ID NO: 879770 - DNA, 14 bp, Homo sapiens
taaaatagaaaaag

SEQ ID NO: 879771 - DNA, 19 bp, Homo sapiens
taaaatagaaattttgtaa

SEQ ID NO: 879772 - DNA, 22 bp, Homo sapiens
taaaatagaaattttgtaagaa

SEQ ID NO: 879773 - DNA, 22 bp, Homo sapiens
taaaatagaataattcttttct

SEQ ID NO: 879774 - DNA, 23 bp, Homo sapiens
taaaatagacctaactgaataca

SEQ ID NO: 879775 - DNA, 16 bp, Homo sapiens
taaaatagcaaaagaa

SEQ ID NO: 879776 - DNA, 16 bp, Homo sapiens
taaaatagcatactgt

SEQ ID NO: 879777 - DNA, 18 bp, Homo sapiens
taaaatagcatactgtgt

SEQ ID NO: 879778 - DNA, 23 bp, Homo sapiens
taaaatagcatactgtgtatgtt

SEQ ID NO: 879779 - DNA, 23 bp, Homo sapiens
taaaatagcggtacaagttctgg

SEQ ID NO: 879780 - DNA, 20 bp, Homo sapiens
taaaatagcgttcttgtaat

SEQ ID NO: 879781 - DNA, 18 bp, Homo sapiens
taaaatagcttgtatagt

SEQ ID NO: 879782 - DNA, 20 bp, Homo sapiens
taaaataggattattttaaa

SEQ ID NO: 879783 - DNA, 18 bp, Homo sapiens
taaaatagtctctttaaa

SEQ ID NO: 879784 - DNA, 21 bp, Homo sapiens
taaaatagtttatttttcaca

SEQ ID NO: 879785 - DNA, 20 bp, Homo sapiens
taaaatatagagacaggaca

SEQ ID NO: 879786 - DNA, 23 bp, Homo sapiens
taaaatatagagacaggacagaa

SEQ ID NO: 879787 - DNA, 17 bp, Homo sapiens
taaaatatatagtgaaa

SEQ ID NO: 879788 - DNA, 14 bp, Homo sapiens
taaaatatatgttc

SEQ ID NO: 879789 - DNA, 19 bp, Homo sapiens
taaaatatcataaagcatt

SEQ ID NO: 879790 - DNA, 20 bp, Homo sapiens
taaaatatcataaagcattt

SEQ ID NO: 879791 - DNA, 16 bp, Homo sapiens
taaaatatcctcaggg

SEQ ID NO: 879792 - DNA, 13 bp, Homo sapiens
taaaatatgtgaa

SEQ ID NO: 879793 - DNA, 22 bp, Homo sapiens
taaaatatgtgaagttttcctt

SEQ ID NO: 879794 - DNA, 15 bp, Homo sapiens
taaaatattattgaa

SEQ ID NO: 879795 - DNA, 18 bp, Homo sapiens
taaaatattatttgatat

SEQ ID NO: 879796 - DNA, 19 bp, Homo sapiens
taaaatattatttgatatc

SEQ ID NO: 879797 - DNA, 21 bp, Homo sapiens
taaaatattatttgatatctg

SEQ ID NO: 879798 - DNA, 22 bp, Homo sapiens
taaaatattcctgcatttgtga

SEQ ID NO: 879799 - DNA, 15 bp, Homo sapiens
taaaatatttaactt

SEQ ID NO: 879800 - DNA, 13 bp, Homo sapiens
taaaatatttatt

SEQ ID NO: 879801 - DNA, 14 bp, Homo sapiens
taaaatatttgaat

SEQ ID NO: 879802 - DNA, 17 bp, Homo sapiens
taaaatatttgcctttt

SEQ ID NO: 879803 - DNA, 21 bp, Homo sapiens
taaaatatttgtctttaaaca

SEQ ID NO: 879804 - DNA, 13 bp, Homo sapiens
taaaatattttag

SEQ ID NO: 879805 - DNA, 12 bp, Homo sapiens
taaaatattttg

SEQ ID NO: 879806 - DNA, 16 bp, Homo sapiens
taaaatattttgaatc

SEQ ID NO: 879807 - DNA, 19 bp, Homo sapiens
taaaatcacattttaagtg

SEQ ID NO: 879808 - DNA, 11 bp, Homo sapiens
taaaatcactt

SEQ ID NO: 879809 - DNA, 13 bp, Homo sapiens
taaaatcacttca

SEQ ID NO: 879810 - DNA, 15 bp, Homo sapiens
taaaatcacttcaga

SEQ ID NO: 879811 - DNA, 18 bp, Homo sapiens
taaaatccaatattgtaa

SEQ ID NO: 879812 - DNA, 17 bp, Homo sapiens
taaaatccattttaggt

SEQ ID NO: 879813 - DNA, 22 bp, Homo sapiens
taaaatccccttcgctgaaatt

SEQ ID NO: 879814 - DNA, 18 bp, Homo sapiens
taaaatctcttgattata

SEQ ID NO: 879815 - DNA, 21 bp, Homo sapiens
taaaatctgagggaaatgttt

SEQ ID NO: 879816 - DNA, 23 bp, Homo sapiens
taaaatctgagggaaatgttttg

SEQ ID NO: 879817 - DNA, 17 bp, Homo sapiens
taaaatctgatttaatg

SEQ ID NO: 879818 - DNA, 14 bp, Homo sapiens
taaaatctgtgaat

SEQ ID NO: 879819 - DNA, 18 bp, Homo sapiens
taaaatctgtttttctca

SEQ ID NO: 879820 - DNA, 20 bp, Homo sapiens
taaaatcttggcacagaaac

SEQ ID NO: 879821 - DNA, 16 bp, Homo sapiens
taaaatgaaaattgta

SEQ ID NO: 879822 - DNA, 16 bp, Homo sapiens
taaaatgaacatctct

SEQ ID NO: 879823 - DNA, 21 bp, Homo sapiens
taaaatgaacatctcttgaaa

SEQ ID NO: 879824 - DNA, 22 bp, Homo sapiens
taaaatgacaaagccattcttt

SEQ ID NO: 879825 - DNA, 20 bp, Homo sapiens
taaaatgaggttcaactgtt

SEQ ID NO: 879826 - DNA, 16 bp, Homo sapiens
taaaatgattgtagta

SEQ ID NO: 879827 - DNA, 12 bp, Homo sapiens
taaaatgcaaat

SEQ ID NO: 879828 - DNA, 15 bp, Homo sapiens
taaaatgcaaatgaa

SEQ ID NO: 879829 - DNA, 21 bp, Homo sapiens
taaaatgcaaatgaatcattg

SEQ ID NO: 879830 - DNA, 15 bp, Homo sapiens
taaaatgcaatgtaa

SEQ ID NO: 879831 - DNA, 16 bp, Homo sapiens
taaaatgccatagttt

SEQ ID NO: 879832 - DNA, 19 bp, Homo sapiens
taaaatgccatagtttgtg

SEQ ID NO: 879833 - DNA, 18 bp, Homo sapiens
taaaatgcccatttcgaa

SEQ ID NO: 879834 - DNA, 19 bp, Homo sapiens
taaaatgcccatttcgaag

SEQ ID NO: 879835 - DNA, 17 bp, Homo sapiens
taaaatgcctcagctat

SEQ ID NO: 879836 - DNA, 17 bp, Homo sapiens
taaaatgcctcagtgta

SEQ ID NO: 879837 - DNA, 12 bp, Homo sapiens
taaaatggaaaa

SEQ ID NO: 879838 - DNA, 17 bp, Homo sapiens
taaaatggacacaaatt

SEQ ID NO: 879839 - DNA, 18 bp, Homo sapiens
taaaatggacacaaattt

SEQ ID NO: 879840 - DNA, 22 bp, Homo sapiens
taaaatggatgccttgaataat

SEQ ID NO: 879841 - DNA, 23 bp, Homo sapiens
taaaatggggataataatactga

SEQ ID NO: 879842 - DNA, 16 bp, Homo sapiens
taaaatggtttgtcct

SEQ ID NO: 879843 - DNA, 20 bp, Homo sapiens
taaaatgtatatttttaaag

SEQ ID NO: 879844 - DNA, 17 bp, Homo sapiens
taaaatgtatctaagaa

SEQ ID NO: 879845 - DNA, 20 bp, Homo sapiens
taaaatgtattatgtcctgt

SEQ ID NO: 879846 - DNA, 14 bp, Homo sapiens
taaaatgtattcaa

SEQ ID NO: 879847 - DNA, 12 bp, Homo sapiens
taaaatgtgatt

SEQ ID NO: 879848 - DNA, 18 bp, Homo sapiens
taaaatgtgatttttctt

SEQ ID NO: 879849 - DNA, 15 bp, Homo sapiens
taaaatgttgaaaag

SEQ ID NO: 879850 - DNA, 12 bp, Homo sapiens
taaaatgtttaa

SEQ ID NO: 879851 - DNA, 12 bp, Homo sapiens
taaaatgtttca

SEQ ID NO: 879852 - DNA, 17 bp, Homo sapiens
taaaatgtttcattatg

SEQ ID NO: 879853 - DNA, 22 bp, Homo sapiens
taaaatgtttcattatgcactt

SEQ ID NO: 879854 - DNA, 21 bp, Homo sapiens
taaaatgtttggatggtttgt

SEQ ID NO: 879855 - DNA, 17 bp, Homo sapiens
taaaattacaaaagaga

SEQ ID NO: 879856 - DNA, 21 bp, Homo sapiens
taaaattagtcttttgtaata

SEQ ID NO: 879857 - DNA, 13 bp, Homo sapiens
taaaattatttca

SEQ ID NO: 879858 - DNA, 21 bp, Homo sapiens
taaaattcaaggccacaaaaa

SEQ ID NO: 879859 - DNA, 20 bp, Homo sapiens
taaaattcagtttttgtatc

SEQ ID NO: 879860 - DNA, 22 bp, Homo sapiens
taaaattcagtttttttccagt

SEQ ID NO: 879861 - DNA, 14 bp, Homo sapiens
taaaattcatttct

SEQ ID NO: 879862 - DNA, 17 bp, Homo sapiens
taaaattccaaattcat

SEQ ID NO: 879863 - DNA, 13 bp, Homo sapiens
taaaattgatttc

SEQ ID NO: 879864 - DNA, 13 bp, Homo sapiens
taaaattgatttt

SEQ ID NO: 879865 - DNA, 17 bp, Homo sapiens
taaaattgcagtttcat

SEQ ID NO: 879866 - DNA, 19 bp, Homo sapiens
taaaattgcagtttcatgt

SEQ ID NO: 879867 - DNA, 22 bp, Homo sapiens
taaaattgcagtttcatgtatg

SEQ ID NO: 879868 - DNA, 14 bp, Homo sapiens
taaaattggcacca

SEQ ID NO: 879869 - DNA, 17 bp, Homo sapiens
taaaattgtgatgtttt

SEQ ID NO: 879870 - DNA, 19 bp, Homo sapiens
taaaattgttctcttaaat

SEQ ID NO: 879871 - DNA, 21 bp, Homo sapiens
taaaatttaacttcttcataa

SEQ ID NO: 879872 - DNA, 12 bp, Homo sapiens
taaaatttacag

SEQ ID NO: 879873 - DNA, 15 bp, Homo sapiens
taaaatttcataatt

SEQ ID NO: 879874 - DNA, 17 bp, Homo sapiens
taaaatttcataattct

SEQ ID NO: 879875 - DNA, 15 bp, Homo sapiens
taaaatttggtgctt

SEQ ID NO: 879876 - DNA, 16 bp, Homo sapiens
taaaatttgtcttaaa

SEQ ID NO: 879877 - DNA, 13 bp, Homo sapiens
taaaatttgttct

SEQ ID NO: 879878 - DNA, 20 bp, Homo sapiens
taaaatttgttcttgtattt

SEQ ID NO: 879879 - DNA, 22 bp, Homo sapiens
taaaattttaggcactcttaaa

SEQ ID NO: 879880 - DNA, 23 bp, Homo sapiens
taaaattttttgatgtcagcctt

SEQ ID NO: 879881 - DNA, 17 bp, Homo sapiens
taaacaaaatagaaagt

SEQ ID NO: 879882 - DNA, 16 bp, Homo sapiens
taaacaaaatgaaaat

SEQ ID NO: 879883 - DNA, 18 bp, Homo sapiens
taaacaaaatttcacagt

SEQ ID NO: 879884 - DNA, 13 bp, Homo sapiens
taaacaaactctt

SEQ ID NO: 879885 - DNA, 14 bp, Homo sapiens
taaacaaagcagta

SEQ ID NO: 879886 - DNA, 13 bp, Homo sapiens
taaacaaaggttg

SEQ ID NO: 879887 - DNA, 14 bp, Homo sapiens
taaacaaagttact

SEQ ID NO: 879888 - DNA, 17 bp, Homo sapiens
taaacaaagttactagg

SEQ ID NO: 879889 - DNA, 18 bp, Homo sapiens
taaacaaagtttcagagt

SEQ ID NO: 879890 - DNA, 14 bp, Homo sapiens
taaacaaataaaat

SEQ ID NO: 879891 - DNA, 14 bp, Homo sapiens
taaacaaatatgaa

SEQ ID NO: 879892 - DNA, 19 bp, Homo sapiens
taaacaaattcatattctg

SEQ ID NO: 879893 - DNA, 18 bp, Homo sapiens
taaacaacagctgaagca

SEQ ID NO: 879894 - DNA, 19 bp, Homo sapiens
taaacaagaccacgtttct

SEQ ID NO: 879895 - DNA, 21 bp, Homo sapiens
taaacaagaccacgtttctaa

SEQ ID NO: 879896 - DNA, 19 bp, Homo sapiens
taaacaagcatttcaaatt

SEQ ID NO: 879897 - DNA, 18 bp, Homo sapiens
taaacaagtatttgttaa

SEQ ID NO: 879898 - DNA, 23 bp, Homo sapiens
taaacaagtatttgttaatttag

SEQ ID NO: 879899 - DNA, 21 bp, Homo sapiens
taaacaatctttcatgtcttg

SEQ ID NO: 879900 - DNA, 18 bp, Homo sapiens
taaacaatttattttatt

SEQ ID NO: 879901 - DNA, 12 bp, Homo sapiens
taaacacacaga

SEQ ID NO: 879902 - DNA, 14 bp, Homo sapiens
taaacacacagata

SEQ ID NO: 879903 - DNA, 22 bp, Homo sapiens
taaacacacagatacacacaca

SEQ ID NO: 879904 - DNA, 14 bp, Homo sapiens
taaacacagacagg

SEQ ID NO: 879905 - DNA, 18 bp, Homo sapiens
taaacacagtcaaaataa

SEQ ID NO: 879906 - DNA, 13 bp, Homo sapiens
taaacacatagat

SEQ ID NO: 879907 - DNA, 18 bp, Homo sapiens
taaacacccttcacatac

SEQ ID NO: 879908 - DNA, 17 bp, Homo sapiens
taaacactcaccttcta

SEQ ID NO: 879909 - DNA, 16 bp, Homo sapiens
taaacactgtaatctt

SEQ ID NO: 879910 - DNA, 20 bp, Homo sapiens
taaacactgtaatcttaaaa

SEQ ID NO: 879911 - DNA, 23 bp, Homo sapiens
taaacactgtattgtaagtggaa

SEQ ID NO: 879912 - DNA, 13 bp, Homo sapiens
taaacagaaaact

SEQ ID NO: 879913 - DNA, 19 bp, Homo sapiens
taaacagaaaactcccaat

SEQ ID NO: 879914 - DNA, 23 bp, Homo sapiens
taaacagaataaaagttcctctc

SEQ ID NO: 879915 - DNA, 13 bp, Homo sapiens
taaacagacaata

SEQ ID NO: 879916 - DNA, 17 bp, Homo sapiens
taaacagacaggaattt

SEQ ID NO: 879917 - DNA, 15 bp, Homo sapiens
taaacagatgtatta

SEQ ID NO: 879918 - DNA, 17 bp, Homo sapiens
taaacagatttgattgt

SEQ ID NO: 879919 - DNA, 15 bp, Homo sapiens
taaacagatttttac

SEQ ID NO: 879920 - DNA, 18 bp, Homo sapiens
taaacagcaactacagaa

SEQ ID NO: 879921 - DNA, 23 bp, Homo sapiens
taaacagcttcatgcctttgtaa

SEQ ID NO: 879922 - DNA, 15 bp, Homo sapiens
taaacaggcccagca

SEQ ID NO: 879923 - DNA, 21 bp, Homo sapiens
taaacaggtatttttttaaat

SEQ ID NO: 879924 - DNA, 17 bp, Homo sapiens
taaacagttgttactta

SEQ ID NO: 879925 - DNA, 13 bp, Homo sapiens
taaacataattgt

SEQ ID NO: 879926 - DNA, 21 bp, Homo sapiens
taaacataattgtggattata

SEQ ID NO: 879927 - DNA, 18 bp, Homo sapiens
taaacatcagcaagactt

SEQ ID NO: 879928 - DNA, 18 bp, Homo sapiens
taaacatggttacaatca

SEQ ID NO: 879929 - DNA, 20 bp, Homo sapiens
taaacatgtaaatacaaatt

SEQ ID NO: 879930 - DNA, 19 bp, Homo sapiens
taaacattaagtaaatgct

SEQ ID NO: 879931 - DNA, 21 bp, Homo sapiens
taaacattaatagcagccttt

SEQ ID NO: 879932 - DNA, 22 bp, Homo sapiens
taaacattaatagcagcctttc

SEQ ID NO: 879933 - DNA, 22 bp, Homo sapiens
taaacattaatcaatcatctgt

SEQ ID NO: 879934 - DNA, 23 bp, Homo sapiens
taaacattcctccagcctcccct

SEQ ID NO: 879935 - DNA, 18 bp, Homo sapiens
taaacattcttttaactt

SEQ ID NO: 879936 - DNA, 14 bp, Homo sapiens
taaacatttgttcc

SEQ ID NO: 879937 - DNA, 18 bp, Homo sapiens
taaacatttgttcctgga

SEQ ID NO: 879938 - DNA, 21 bp, Homo sapiens
taaacatttgttcctggagtt

SEQ ID NO: 879939 - DNA, 20 bp, Homo sapiens
taaacatttttcacatctct

SEQ ID NO: 879940 - DNA, 16 bp, Homo sapiens
taaaccaaaaactgaa

SEQ ID NO: 879941 - DNA, 15 bp, Homo sapiens
taaaccaaacccagc

SEQ ID NO: 879942 - DNA, 18 bp, Homo sapiens
taaaccaaacccagccac

SEQ ID NO: 879943 - DNA, 17 bp, Homo sapiens
taaaccaaggactgagc

SEQ ID NO: 879944 - DNA, 18 bp, Homo sapiens
taaaccaagttatttttc

SEQ ID NO: 879945 - DNA, 22 bp, Homo sapiens
taaaccacataatttttgtaca

SEQ ID NO: 879946 - DNA, 21 bp, Homo sapiens
taaaccaccctctggggacag

SEQ ID NO: 879947 - DNA, 18 bp, Homo sapiens
taaaccacttctctgctg

SEQ ID NO: 879948 - DNA, 22 bp, Homo sapiens
taaaccacttctctgctgcctc

SEQ ID NO: 879949 - DNA, 12 bp, Homo sapiens
taaaccattgga

SEQ ID NO: 879950 - DNA, 18 bp, Homo sapiens
taaaccatttttgttact

SEQ ID NO: 879951 - DNA, 18 bp, Homo sapiens
taaacccacaagctgcct

SEQ ID NO: 879952 - DNA, 20 bp, Homo sapiens
taaacccacaagctgcctct

SEQ ID NO: 879953 - DNA, 16 bp, Homo sapiens
taaacccatacaatgt

SEQ ID NO: 879954 - DNA, 14 bp, Homo sapiens
taaacccctgtccc

SEQ ID NO: 879955 - DNA, 15 bp, Homo sapiens
taaacccgcacccca

SEQ ID NO: 879956 - DNA, 15 bp, Homo sapiens
taaaccctatctgtg

SEQ ID NO: 879957 - DNA, 18 bp, Homo sapiens
taaaccctatctgtgatt

SEQ ID NO: 879958 - DNA, 16 bp, Homo sapiens
taaaccgccaaggctg

SEQ ID NO: 879959 - DNA, 15 bp, Homo sapiens
taaacctaaaaaaga

SEQ ID NO: 879960 - DNA, 11 bp, Homo sapiens
taaacctacct

SEQ ID NO: 879961 - DNA, 17 bp, Homo sapiens
taaacctagtaaaacct

SEQ ID NO: 879962 - DNA, 19 bp, Homo sapiens
taaacctagtaaaaccttg

SEQ ID NO: 879963 - DNA, 18 bp, Homo sapiens
taaacctcctgcctccca

SEQ ID NO: 879964 - DNA, 16 bp, Homo sapiens
taaacctcctgctgtg

SEQ ID NO: 879965 - DNA, 13 bp, Homo sapiens
taaacctgaagat

SEQ ID NO: 879966 - DNA, 17 bp, Homo sapiens
taaacctgaagatgtct

SEQ ID NO: 879967 - DNA, 23 bp, Homo sapiens
taaacctgaagatgtctcctcaa

SEQ ID NO: 879968 - DNA, 20 bp, Homo sapiens
taaacctgtctccactgtgc

SEQ ID NO: 879969 - DNA, 14 bp, Homo sapiens
taaaccttcagaag

SEQ ID NO: 879970 - DNA, 13 bp, Homo sapiens
taaacctttaatg

SEQ ID NO: 879971 - DNA, 19 bp, Homo sapiens
taaacctttaatgagaaaa

SEQ ID NO: 879972 - DNA, 14 bp, Homo sapiens
taaacctttcataa

SEQ ID NO: 879973 - DNA, 16 bp, Homo sapiens
taaacctttcataatt

SEQ ID NO: 879974 - DNA, 14 bp, Homo sapiens
taaacctttttctt

SEQ ID NO: 879975 - DNA, 10 bp, Homo sapiens
taaacgaaat

SEQ ID NO: 879976 - DNA, 20 bp, Homo sapiens
taaacggttcagtttcttct

SEQ ID NO: 879977 - DNA, 15 bp, Homo sapiens
taaacgtatgcatgt

SEQ ID NO: 879978 - DNA, 22 bp, Homo sapiens
taaacgtgatgatcagctgttt

SEQ ID NO: 879979 - DNA, 17 bp, Homo sapiens
taaacgtgcagactatg

SEQ ID NO: 879980 - DNA, 16 bp, Homo sapiens
taaacgtggattttaa

SEQ ID NO: 879981 - DNA, 19 bp, Homo sapiens
taaacgtggtcaccttcga

SEQ ID NO: 879982 - DNA, 14 bp, Homo sapiens
taaacgtgtaaatt

SEQ ID NO: 879983 - DNA, 17 bp, Homo sapiens
taaacgtgtaaattgca

SEQ ID NO: 879984 - DNA, 21 bp, Homo sapiens
taaacgtgtaaattgcacaga

SEQ ID NO: 879985 - DNA, 19 bp, Homo sapiens
taaactaaaaaaaaaaagg

SEQ ID NO: 879986 - DNA, 14 bp, Homo sapiens
taaactaaatgtgc

SEQ ID NO: 879987 - DNA, 16 bp, Homo sapiens
taaactaataattgca

SEQ ID NO: 879988 - DNA, 19 bp, Homo sapiens
taaactaattttgtacgta

SEQ ID NO: 879989 - DNA, 19 bp, Homo sapiens
taaactacaaagtaaaatg

SEQ ID NO: 879990 - DNA, 23 bp, Homo sapiens
taaactacaaagtaaaatgaaca

SEQ ID NO: 879991 - DNA, 14 bp, Homo sapiens
taaactacatcttg

SEQ ID NO: 879992 - DNA, 18 bp, Homo sapiens
taaactaccctccagagt

SEQ ID NO: 879993 - DNA, 14 bp, Homo sapiens
taaactactctttg

SEQ ID NO: 879994 - DNA, 15 bp, Homo sapiens
taaactactctttga

SEQ ID NO: 879995 - DNA, 20 bp, Homo sapiens
taaactatcttggtgaattt

SEQ ID NO: 879996 - DNA, 21 bp, Homo sapiens
taaactatcttggtgaatttt

SEQ ID NO: 879997 - DNA, 22 bp, Homo sapiens
taaactatcttggtgaattttt

SEQ ID NO: 879998 - DNA, 20 bp, Homo sapiens
taaactatgttcctaacaaa

SEQ ID NO: 879999 - DNA, 21 bp, Homo sapiens
taaactattagagtatttccc

SEQ ID NO: 880000 - DNA, 17 bp, Homo sapiens
taaactattggaaagta

SEQ ID NO: 880001 - DNA, 20 bp, Homo sapiens
taaactcaaaacttaacata

SEQ ID NO: 880002 - DNA, 21 bp, Homo sapiens
taaactcaaatgtaatagttt

SEQ ID NO: 880003 - DNA, 19 bp, Homo sapiens
taaactcagatctgatcaa

SEQ ID NO: 880004 - DNA, 19 bp, Homo sapiens
taaactcagattgactaaa

SEQ ID NO: 880005 - DNA, 19 bp, Homo sapiens
taaactcagggacagagcc

SEQ ID NO: 880006 - DNA, 20 bp, Homo sapiens
taaactccaggatttataaa

SEQ ID NO: 880007 - DNA, 23 bp, Homo sapiens
taaactccaggatttataaagca

SEQ ID NO: 880008 - DNA, 17 bp, Homo sapiens
taaactcctactaaatc

SEQ ID NO: 880009 - DNA, 23 bp, Homo sapiens
taaactcctggcctcaagcaatc

SEQ ID NO: 880010 - DNA, 14 bp, Homo sapiens
taaactcctgtcct

SEQ ID NO: 880011 - DNA, 20 bp, Homo sapiens
taaactccttaacttcaggg

SEQ ID NO: 880012 - DNA, 14 bp, Homo sapiens
taaactctaaagat

SEQ ID NO: 880013 - DNA, 16 bp, Homo sapiens
taaactctgccagaaa

SEQ ID NO: 880014 - DNA, 18 bp, Homo sapiens
taaactctggacactcta

SEQ ID NO: 880015 - DNA, 13 bp, Homo sapiens
taaactgaatttg

SEQ ID NO: 880016 - DNA, 20 bp, Homo sapiens
taaactgcaaacagaaatca

SEQ ID NO: 880017 - DNA, 11 bp, Homo sapiens
taaactgcggt

SEQ ID NO: 880018 - DNA, 22 bp, Homo sapiens
taaactgggaaggctttcaggc

SEQ ID NO: 880019 - DNA, 20 bp, Homo sapiens
taaactggtgagagtatata

SEQ ID NO: 880020 - DNA, 17 bp, Homo sapiens
taaactgtacagtgtct

SEQ ID NO: 880021 - DNA, 22 bp, Homo sapiens
taaactgtagcgaccccagact

SEQ ID NO: 880022 - DNA, 12 bp, Homo sapiens
taaactgtgcac

SEQ ID NO: 880023 - DNA, 20 bp, Homo sapiens
taaactgtgtggactgtgat

SEQ ID NO: 880024 - DNA, 12 bp, Homo sapiens
taaactgtgttt

SEQ ID NO: 880025 - DNA, 16 bp, Homo sapiens
taaactgttagcactg

SEQ ID NO: 880026 - DNA, 17 bp, Homo sapiens
taaactgttagcactgt

SEQ ID NO: 880027 - DNA, 18 bp, Homo sapiens
taaactgttagcactgtt

SEQ ID NO: 880028 - DNA, 14 bp, Homo sapiens
taaactgttttcaa

SEQ ID NO: 880029 - DNA, 17 bp, Homo sapiens
taaactgttttcaagtc

SEQ ID NO: 880030 - DNA, 13 bp, Homo sapiens
taaacttaatcta

SEQ ID NO: 880031 - DNA, 18 bp, Homo sapiens
taaacttagaggaaaatg

SEQ ID NO: 880032 - DNA, 21 bp, Homo sapiens
taaacttagaggaaaatgagt

SEQ ID NO: 880033 - DNA, 13 bp, Homo sapiens
taaacttccaaag

SEQ ID NO: 880034 - DNA, 16 bp, Homo sapiens
taaacttccaaagctt

SEQ ID NO: 880035 - DNA, 11 bp, Homo sapiens
taaacttgaaa

SEQ ID NO: 880036 - DNA, 14 bp, Homo sapiens
taaacttgaaatat

SEQ ID NO: 880037 - DNA, 21 bp, Homo sapiens
taaacttgaaatatataatat

SEQ ID NO: 880038 - DNA, 15 bp, Homo sapiens
taaacttggaatcaa

SEQ ID NO: 880039 - DNA, 14 bp, Homo sapiens
taaacttgtcagaa

SEQ ID NO: 880040 - DNA, 13 bp, Homo sapiens
taaacttgtgtat

SEQ ID NO: 880041 - DNA, 20 bp, Homo sapiens
taaactttacccaaaaacta

SEQ ID NO: 880042 - DNA, 18 bp, Homo sapiens
taaactttagagtagcat

SEQ ID NO: 880043 - DNA, 15 bp, Homo sapiens
taaactttatttgta

SEQ ID NO: 880044 - DNA, 16 bp, Homo sapiens
taaactttatttgtaa

SEQ ID NO: 880045 - DNA, 17 bp, Homo sapiens
taaactttatttgtaaa

SEQ ID NO: 880046 - DNA, 23 bp, Homo sapiens
taaactttatttgtaaaccattg

SEQ ID NO: 880047 - DNA, 14 bp, Homo sapiens
taaactttctccat

SEQ ID NO: 880048 - DNA, 15 bp, Homo sapiens
taaactttggccttt

SEQ ID NO: 880049 - DNA, 18 bp, Homo sapiens
taaactttgtgctgatct

SEQ ID NO: 880050 - DNA, 14 bp, Homo sapiens
taaacttttaccac

SEQ ID NO: 880051 - DNA, 15 bp, Homo sapiens
taaactttttcaatg

SEQ ID NO: 880052 - DNA, 16 bp, Homo sapiens
taaactttttttctgt

SEQ ID NO: 880053 - DNA, 18 bp, Homo sapiens
taaactttttttctgtac

SEQ ID NO: 880054 - DNA, 18 bp, Homo sapiens
taaacttttttttgagaa

SEQ ID NO: 880055 - DNA, 15 bp, Homo sapiens
taaagaaaaaaattg

SEQ ID NO: 880056 - DNA, 21 bp, Homo sapiens
taaagaaaaaaattgaaatgt

SEQ ID NO: 880057 - DNA, 13 bp, Homo sapiens
taaagaaaagatg

SEQ ID NO: 880058 - DNA, 16 bp, Homo sapiens
taaagaaacttggctg

SEQ ID NO: 880059 - DNA, 21 bp, Homo sapiens
taaagaaacttggctggaatt

SEQ ID NO: 880060 - DNA, 11 bp, Homo sapiens
taaagaaagat

SEQ ID NO: 880061 - DNA, 13 bp, Homo sapiens
taaagaaaggaaa

SEQ ID NO: 880062 - DNA, 16 bp, Homo sapiens
taaagaaaggaaaaga

SEQ ID NO: 880063 - DNA, 17 bp, Homo sapiens
taaagaaaggaaaagaa

SEQ ID NO: 880064 - DNA, 23 bp, Homo sapiens
taaagaaaggaaaagaaaacaaa

SEQ ID NO: 880065 - DNA, 11 bp, Homo sapiens
taaagaaagtc

SEQ ID NO: 880066 - DNA, 13 bp, Homo sapiens
taaagaaagtgta

SEQ ID NO: 880067 - DNA, 17 bp, Homo sapiens
taaagaaagtgtatttg

SEQ ID NO: 880068 - DNA, 23 bp, Homo sapiens
taaagaaagtgtatttggaaata

SEQ ID NO: 880069 - DNA, 16 bp, Homo sapiens
taaagaaatagaacaa

SEQ ID NO: 880070 - DNA, 17 bp, Homo sapiens
taaagaaatatttacct

SEQ ID NO: 880071 - DNA, 23 bp, Homo sapiens
taaagaaatgaaaaaaaaaaaca

SEQ ID NO: 880072 - DNA, 10 bp, Homo sapiens
taaagaaatt

SEQ ID NO: 880073 - DNA, 19 bp, Homo sapiens
taaagaactccttattttg

SEQ ID NO: 880074 - DNA, 23 bp, Homo sapiens
taaagaactccttattttgtatt

SEQ ID NO: 880075 - DNA, 14 bp, Homo sapiens
taaagaacttaaat

SEQ ID NO: 880076 - DNA, 11 bp, Homo sapiens
taaagaagacc

SEQ ID NO: 880077 - DNA, 20 bp, Homo sapiens
taaagaagacctgagaatgt

SEQ ID NO: 880078 - DNA, 21 bp, Homo sapiens
taaagaagacctgagaatgta

SEQ ID NO: 880079 - DNA, 17 bp, Homo sapiens
taaagaagataaacaca

SEQ ID NO: 880080 - DNA, 12 bp, Homo sapiens
taaagaaggggg

SEQ ID NO: 880081 - DNA, 20 bp, Homo sapiens
taaagaagggggctttcttt

SEQ ID NO: 880082 - DNA, 17 bp, Homo sapiens
taaagaagtatttttag

SEQ ID NO: 880083 - DNA, 17 bp, Homo sapiens
taaagaagttgaagttt

SEQ ID NO: 880084 - DNA, 14 bp, Homo sapiens
taaagaataaagtc

SEQ ID NO: 880085 - DNA, 19 bp, Homo sapiens
taaagaatatgacttttta

SEQ ID NO: 880086 - DNA, 15 bp, Homo sapiens
taaagaatgccattt

SEQ ID NO: 880087 - DNA, 14 bp, Homo sapiens
taaagaattacttg

SEQ ID NO: 880088 - DNA, 11 bp, Homo sapiens
taaagacaaag

SEQ ID NO: 880089 - DNA, 15 bp, Homo sapiens
taaagacaaagacaa

SEQ ID NO: 880090 - DNA, 16 bp, Homo sapiens
taaagacaaataaatg

SEQ ID NO: 880091 - DNA, 10 bp, Homo sapiens
taaagacaag

SEQ ID NO: 880092 - DNA, 15 bp, Homo sapiens
taaagacacctactg

SEQ ID NO: 880093 - DNA, 23 bp, Homo sapiens
taaagacaggagacaaaagagca

SEQ ID NO: 880094 - DNA, 23 bp, Homo sapiens
taaagacaggttacgaagacaaa

SEQ ID NO: 880095 - DNA, 15 bp, Homo sapiens
taaagaccagaaatt

SEQ ID NO: 880096 - DNA, 18 bp, Homo sapiens
taaagacccaacttgcca

SEQ ID NO: 880097 - DNA, 21 bp, Homo sapiens
taaagacccagggggagaatg

SEQ ID NO: 880098 - DNA, 17 bp, Homo sapiens
taaagacgatttgtcag

SEQ ID NO: 880099 - DNA, 15 bp, Homo sapiens
taaagactaagtagc

SEQ ID NO: 880100 - DNA, 20 bp, Homo sapiens
taaagactggcttttattaa

SEQ ID NO: 880101 - DNA, 13 bp, Homo sapiens
taaagactgtgct

SEQ ID NO: 880102 - DNA, 14 bp, Homo sapiens
taaagacttgagaa

SEQ ID NO: 880103 - DNA, 20 bp, Homo sapiens
taaagacttttatgtgagat

SEQ ID NO: 880104 - DNA, 22 bp, Homo sapiens
taaagacttttatgtgagattt

SEQ ID NO: 880105 - DNA, 23 bp, Homo sapiens
taaagacttttatgtgagatttc

SEQ ID NO: 880106 - DNA, 20 bp, Homo sapiens
taaagagaaaagggaaaaaa

SEQ ID NO: 880107 - DNA, 22 bp, Homo sapiens
taaagagacagtgatattggaa

SEQ ID NO: 880108 - DNA, 13 bp, Homo sapiens
taaagagaggtta

SEQ ID NO: 880109 - DNA, 16 bp, Homo sapiens
taaagagatagcttct

SEQ ID NO: 880110 - DNA, 19 bp, Homo sapiens
taaagaggagaaggaaaac

SEQ ID NO: 880111 - DNA, 12 bp, Homo sapiens
taaagagttctt

SEQ ID NO: 880112 - DNA, 20 bp, Homo sapiens
taaatgttgaaagatcaaaa

SEQ ID NO: 880113 - DNA, 17 bp, Homo sapiens
taaatgttggaatgtta

SEQ ID NO: 880114 - DNA, 14 bp, Homo sapiens
taaatgtttaaaga

SEQ ID NO: 880115 - DNA, 19 bp, Homo sapiens
taaatgtttatactgtatt

SEQ ID NO: 880116 - DNA, 17 bp, Homo sapiens
taaatgtttcaaatgca

SEQ ID NO: 880117 - DNA, 18 bp, Homo sapiens
taaatgtttcttttccct

SEQ ID NO: 880118 - DNA, 19 bp, Homo sapiens
taaatgtttcttttccctt

SEQ ID NO: 880119 - DNA, 20 bp, Homo sapiens
taaatgtttgttatttacac

SEQ ID NO: 880120 - DNA, 12 bp, Homo sapiens
taaattaaacaa

SEQ ID NO: 880121 - DNA, 15 bp, Homo sapiens
taaattaaacaattt

SEQ ID NO: 880122 - DNA, 22 bp, Homo sapiens
taaattaaacaatttattttat

SEQ ID NO: 880123 - DNA, 18 bp, Homo sapiens
taaattaaacatgctgtt

SEQ ID NO: 880124 - DNA, 19 bp, Homo sapiens
taaattaaacatgctgtta

SEQ ID NO: 880125 - DNA, 17 bp, Homo sapiens
taaattaaacatttttc

SEQ ID NO: 880126 - DNA, 17 bp, Homo sapiens
taaattaaataaactgt

SEQ ID NO: 880127 - DNA, 19 bp, Homo sapiens
taaattaaataaactgttt

SEQ ID NO: 880128 - DNA, 14 bp, Homo sapiens
taaattaaatatat

SEQ ID NO: 880129 - DNA, 21 bp, Homo sapiens
taaattaaatatatgtatgta

SEQ ID NO: 880130 - DNA, 14 bp, Homo sapiens
taaattaactttta

SEQ ID NO: 880131 - DNA, 18 bp, Homo sapiens
taaattaacttttataaa

SEQ ID NO: 880132 - DNA, 20 bp, Homo sapiens
taaattaacttttataaact

SEQ ID NO: 880133 - DNA, 21 bp, Homo sapiens
taaattaacttttataaactt

SEQ ID NO: 880134 - DNA, 12 bp, Homo sapiens
taaattaagaca

SEQ ID NO: 880135 - DNA, 21 bp, Homo sapiens
taaattaagatcctaaactct

SEQ ID NO: 880136 - DNA, 16 bp, Homo sapiens
taaattaatacagagt

SEQ ID NO: 880137 - DNA, 14 bp, Homo sapiens
taaattaatatctt

SEQ ID NO: 880138 - DNA, 15 bp, Homo sapiens
taaattaatatcttt

SEQ ID NO: 880139 - DNA, 16 bp, Homo sapiens
taaattacaattttat

SEQ ID NO: 880140 - DNA, 17 bp, Homo sapiens
taaattacaattttatc

SEQ ID NO: 880141 - DNA, 21 bp, Homo sapiens
taaattacagtaatcccattt

SEQ ID NO: 880142 - DNA, 15 bp, Homo sapiens
taaattacattttta

SEQ ID NO: 880143 - DNA, 16 bp, Homo sapiens
taaattactatagcaa

SEQ ID NO: 880144 - DNA, 20 bp, Homo sapiens
taaattactatagcaaagta

SEQ ID NO: 880145 - DNA, 23 bp, Homo sapiens
taaattactatagcaaagtagta

SEQ ID NO: 880146 - DNA, 20 bp, Homo sapiens
taaattactatctgttgaaa

SEQ ID NO: 880147 - DNA, 11 bp, Homo sapiens
taaattagaat

SEQ ID NO: 880148 - DNA, 14 bp, Homo sapiens
taaattagaatgaa

SEQ ID NO: 880149 - DNA, 19 bp, Homo sapiens
taaattagaatgaatttat

SEQ ID NO: 880150 - DNA, 14 bp, Homo sapiens
taaattaggaataa

SEQ ID NO: 880151 - DNA, 17 bp, Homo sapiens
taaattataacttaaaa

SEQ ID NO: 880152 - DNA, 18 bp, Homo sapiens
taaattatggcatttcta

SEQ ID NO: 880153 - DNA, 19 bp, Homo sapiens
taaattatggcatttctat

SEQ ID NO: 880154 - DNA, 18 bp, Homo sapiens
taaattatgttttaaaca

SEQ ID NO: 880155 - DNA, 23 bp, Homo sapiens
taaattattcagaactatttaaa

SEQ ID NO: 880156 - DNA, 14 bp, Homo sapiens
taaattattgatga

SEQ ID NO: 880157 - DNA, 15 bp, Homo sapiens
taaattattgatgat

SEQ ID NO: 880158 - DNA, 18 bp, Homo sapiens
taaattattgatgatttt

SEQ ID NO: 880159 - DNA, 13 bp, Homo sapiens
taaattattgtaa

SEQ ID NO: 880160 - DNA, 16 bp, Homo sapiens
taaattattgtaaact

SEQ ID NO: 880161 - DNA, 22 bp, Homo sapiens
taaattatttgattatttaaga

SEQ ID NO: 880162 - DNA, 13 bp, Homo sapiens
taaattatttgct

SEQ ID NO: 880163 - DNA, 18 bp, Homo sapiens
taaattattttttctatg

SEQ ID NO: 880164 - DNA, 20 bp, Homo sapiens
taaattattttttctatgaa

SEQ ID NO: 880165 - DNA, 16 bp, Homo sapiens
taaattcactttcatt

SEQ ID NO: 880166 - DNA, 20 bp, Homo sapiens
taaattcagatatatttttc

SEQ ID NO: 880167 - DNA, 16 bp, Homo sapiens
taaattcagatcaaaa

SEQ ID NO: 880168 - DNA, 14 bp, Homo sapiens
taaattcagtccta

SEQ ID NO: 880169 - DNA, 20 bp, Homo sapiens
taaattccactgaaaattta

SEQ ID NO: 880170 - DNA, 23 bp, Homo sapiens
taaattccactgaaaatttaaca

SEQ ID NO: 880171 - DNA, 18 bp, Homo sapiens
taaattcccaacttctct

SEQ ID NO: 880172 - DNA, 22 bp, Homo sapiens
taaattcctactccctcttcca

SEQ ID NO: 880173 - DNA, 20 bp, Homo sapiens
taaattcctcaacagtgttt

SEQ ID NO: 880174 - DNA, 22 bp, Homo sapiens
taaattcctcaacagtgttttc

SEQ ID NO: 880175 - DNA, 12 bp, Homo sapiens
taaattcctctt

SEQ ID NO: 880176 - DNA, 14 bp, Homo sapiens
taaattcctctttg

SEQ ID NO: 880177 - DNA, 17 bp, Homo sapiens
taaattcctctttgctt

SEQ ID NO: 880178 - DNA, 18 bp, Homo sapiens
taaattcctctttgcttt

SEQ ID NO: 880179 - DNA, 19 bp, Homo sapiens
taaattcctctttgctttg

SEQ ID NO: 880180 - DNA, 20 bp, Homo sapiens
taaattcctctttgctttgc

SEQ ID NO: 880181 - DNA, 14 bp, Homo sapiens
taaattctatgtta

SEQ ID NO: 880182 - DNA, 18 bp, Homo sapiens
taaattctatgttaaata

SEQ ID NO: 880183 - DNA, 22 bp, Homo sapiens
taaattcttgcaaagtatccct

SEQ ID NO: 880184 - DNA, 12 bp, Homo sapiens
taaattcttttg

SEQ ID NO: 880185 - DNA, 15 bp, Homo sapiens
taaattgaataagtg

SEQ ID NO: 880186 - DNA, 12 bp, Homo sapiens
taaattgactgt

SEQ ID NO: 880187 - DNA, 16 bp, Homo sapiens
taaattgatcctttga

SEQ ID NO: 880188 - DNA, 15 bp, Homo sapiens
taaattgatttgtta

SEQ ID NO: 880189 - DNA, 22 bp, Homo sapiens
taaattgatttttataaatact

SEQ ID NO: 880190 - DNA, 13 bp, Homo sapiens
taaattgcaagaa

SEQ ID NO: 880191 - DNA, 20 bp, Homo sapiens
taaattgcagaattcaaaag

SEQ ID NO: 880192 - DNA, 15 bp, Homo sapiens
taaattggaaacatt

SEQ ID NO: 880193 - DNA, 20 bp, Homo sapiens
taaattggaaacattttctt

SEQ ID NO: 880194 - DNA, 17 bp, Homo sapiens
taaattggtattaacta

SEQ ID NO: 880195 - DNA, 13 bp, Homo sapiens
taaattgtaaaac

SEQ ID NO: 880196 - DNA, 17 bp, Homo sapiens
taaattgtaaattttag

SEQ ID NO: 880197 - DNA, 15 bp, Homo sapiens
taaattgtacatttt

SEQ ID NO: 880198 - DNA, 21 bp, Homo sapiens
taaattgtacattttgtaaaa

SEQ ID NO: 880199 - DNA, 19 bp, Homo sapiens
taaattgtatacattttgt

SEQ ID NO: 880200 - DNA, 18 bp, Homo sapiens
taaattgtctttaaaaac

SEQ ID NO: 880201 - DNA, 13 bp, Homo sapiens
taaatttaagaaa

SEQ ID NO: 880202 - DNA, 14 bp, Homo sapiens
taaatttaagaaaa

SEQ ID NO: 880203 - DNA, 22 bp, Homo sapiens
taaatttaagcaaacgtctatt

SEQ ID NO: 880204 - DNA, 14 bp, Homo sapiens
taaatttatatact

SEQ ID NO: 880205 - DNA, 16 bp, Homo sapiens
taaatttattaaataa

SEQ ID NO: 880206 - DNA, 15 bp, Homo sapiens
taaatttatttcaaa

SEQ ID NO: 880207 - DNA, 17 bp, Homo sapiens
taaatttatttcaaaaa

SEQ ID NO: 880208 - DNA, 14 bp, Homo sapiens
taaatttcaaatgc

SEQ ID NO: 880209 - DNA, 20 bp, Homo sapiens
taaatttcagtcaattctga

SEQ ID NO: 880210 - DNA, 11 bp, Homo sapiens
taaatttctgg

SEQ ID NO: 880211 - DNA, 15 bp, Homo sapiens
taaatttcttctggt

SEQ ID NO: 880212 - DNA, 13 bp, Homo sapiens
taaatttgaatct

SEQ ID NO: 880213 - DNA, 17 bp, Homo sapiens
taaatttgacttttctg

SEQ ID NO: 880214 - DNA, 13 bp, Homo sapiens
taaattttaaagc

SEQ ID NO: 880215 - DNA, 16 bp, Homo sapiens
taaattttaaagccat

SEQ ID NO: 880216 - DNA, 16 bp, Homo sapiens
taaattttacccttta

SEQ ID NO: 880217 - DNA, 18 bp, Homo sapiens
taaattttaccctttaga

SEQ ID NO: 880218 - DNA, 22 bp, Homo sapiens
taaattttagagcataccagta

SEQ ID NO: 880219 - DNA, 18 bp, Homo sapiens
taaattttatttttatta

SEQ ID NO: 880220 - DNA, 23 bp, Homo sapiens
taaattttatttttattactttt

SEQ ID NO: 880221 - DNA, 15 bp, Homo sapiens
taaattttcttttaa

SEQ ID NO: 880222 - DNA, 19 bp, Homo sapiens
taaattttcttttaagcat

SEQ ID NO: 880223 - DNA, 21 bp, Homo sapiens
taaattttcttttaagcattt

SEQ ID NO: 880224 - DNA, 22 bp, Homo sapiens
taaattttcttttaagcatttg

SEQ ID NO: 880225 - DNA, 14 bp, Homo sapiens
taaattttgtaatg

SEQ ID NO: 880226 - DNA, 17 bp, Homo sapiens
taaattttgtatgaaaa

SEQ ID NO: 880227 - DNA, 15 bp, Homo sapiens
taaatttttcataga

SEQ ID NO: 880228 - DNA, 18 bp, Homo sapiens
taaatttttgtcatttta

SEQ ID NO: 880229 - DNA, 16 bp, Homo sapiens
taaattttttgttgac

SEQ ID NO: 880230 - DNA, 18 bp, Homo sapiens
taaattttttgttgacat

SEQ ID NO: 880231 - DNA, 14 bp, Homo sapiens
taaatttttttcct

SEQ ID NO: 880232 - DNA, 20 bp, Homo sapiens
taacaaaaataaaaactctt

SEQ ID NO: 880233 - DNA, 17 bp, Homo sapiens
taacaaaacttcttaga

SEQ ID NO: 880234 - DNA, 15 bp, Homo sapiens
taacaaaatgtatgt

SEQ ID NO: 880235 - DNA, 20 bp, Homo sapiens
taacaaaatgtatgtctggt

SEQ ID NO: 880236 - DNA, 18 bp, Homo sapiens
taacaaaccaacatcttt

SEQ ID NO: 880237 - DNA, 12 bp, Homo sapiens
taacaaataaaa

SEQ ID NO: 880238 - DNA, 12 bp, Homo sapiens
taacaaatgaac

SEQ ID NO: 880239 - DNA, 15 bp, Homo sapiens
taacaaatgtaaaat

SEQ ID NO: 880240 - DNA, 12 bp, Homo sapiens
taacaaattatg

SEQ ID NO: 880241 - DNA, 19 bp, Homo sapiens
taacaagaactttaaattg

SEQ ID NO: 880242 - DNA, 12 bp, Homo sapiens
taacaagaatgt

SEQ ID NO: 880243 - DNA, 22 bp, Homo sapiens
taacaagcaaggatatcagagc

SEQ ID NO: 880244 - DNA, 11 bp, Homo sapiens
taacaaggaat

SEQ ID NO: 880245 - DNA, 18 bp, Homo sapiens
taacaaggaatgcctgtg

SEQ ID NO: 880246 - DNA, 21 bp, Homo sapiens
taacaaggagctcaccctgcc

SEQ ID NO: 880247 - DNA, 13 bp, Homo sapiens
taacaagtgtatc

SEQ ID NO: 880248 - DNA, 19 bp, Homo sapiens
taacaataactactgtgtt

SEQ ID NO: 880249 - DNA, 13 bp, Homo sapiens
taacaatacaaat

SEQ ID NO: 880250 - DNA, 16 bp, Homo sapiens
taacaatacaaatgga

SEQ ID NO: 880251 - DNA, 17 bp, Homo sapiens
taacaatacaaatggat

SEQ ID NO: 880252 - DNA, 18 bp, Homo sapiens
taacaatacaaatggatt

SEQ ID NO: 880253 - DNA, 18 bp, Homo sapiens
taacaatacatgagaaag

SEQ ID NO: 880254 - DNA, 18 bp, Homo sapiens
taacaatccattcacaag

SEQ ID NO: 880255 - DNA, 21 bp, Homo sapiens
taacaatccattcacaagcct

SEQ ID NO: 880256 - DNA, 17 bp, Homo sapiens
taacaatgcctattgta

SEQ ID NO: 880257 - DNA, 17 bp, Homo sapiens
taacaattaattgtctt

SEQ ID NO: 880258 - DNA, 15 bp, Homo sapiens
taacaattgtcttaa

SEQ ID NO: 880259 - DNA, 21 bp, Homo sapiens
taacaattgtcttaaaaccag

SEQ ID NO: 880260 - DNA, 13 bp, Homo sapiens
taacaatttcctt

SEQ ID NO: 880261 - DNA, 21 bp, Homo sapiens
taacaatttcctttatattta

SEQ ID NO: 880262 - DNA, 14 bp, Homo sapiens
taacaatttctgtc

SEQ ID NO: 880263 - DNA, 18 bp, Homo sapiens
taacaattttaatgctat

SEQ ID NO: 880264 - DNA, 17 bp, Homo sapiens
taacacaagccacagaa

SEQ ID NO: 880265 - DNA, 23 bp, Homo sapiens
taacacactaccgaatgtgtctt

SEQ ID NO: 880266 - DNA, 16 bp, Homo sapiens
taacacagagagacag

SEQ ID NO: 880267 - DNA, 13 bp, Homo sapiens
taacacagccttc

SEQ ID NO: 880268 - DNA, 18 bp, Homo sapiens
taacacagtgtttcaatt

SEQ ID NO: 880269 - DNA, 23 bp, Homo sapiens
taacacatagcgccgtgctgtaa

SEQ ID NO: 880270 - DNA, 14 bp, Homo sapiens
taacacatgtcctt

SEQ ID NO: 880271 - DNA, 23 bp, Homo sapiens
taacacattctttataaaatgta

SEQ ID NO: 880272 - DNA, 18 bp, Homo sapiens
taacaccatgattaacca

SEQ ID NO: 880273 - DNA, 17 bp, Homo sapiens
taacaccgtcccagggc

SEQ ID NO: 880274 - DNA, 14 bp, Homo sapiens
taacaccttggact

SEQ ID NO: 880275 - DNA, 16 bp, Homo sapiens
taacaccttggactgt

SEQ ID NO: 880276 - DNA, 16 bp, Homo sapiens
taacacgctgcctggt

SEQ ID NO: 880277 - DNA, 23 bp, Homo sapiens
taacacgctgcctggtctgtctg

SEQ ID NO: 880278 - DNA, 14 bp, Homo sapiens
taacactaaatgct

SEQ ID NO: 880279 - DNA, 22 bp, Homo sapiens
taacactaatatatttaaaaat

SEQ ID NO: 880280 - DNA, 19 bp, Homo sapiens
taacactatgtttatttac

SEQ ID NO: 880281 - DNA, 21 bp, Homo sapiens
taacactcgactctgctgctc

SEQ ID NO: 880282 - DNA, 16 bp, Homo sapiens
taacactgtgatttat

SEQ ID NO: 880283 - DNA, 16 bp, Homo sapiens
taacacttaaatttct

SEQ ID NO: 880284 - DNA, 15 bp, Homo sapiens
taacacttctgtatg

SEQ ID NO: 880285 - DNA, 16 bp, Homo sapiens
taacacttctgtatgc

SEQ ID NO: 880286 - DNA, 19 bp, Homo sapiens
taacacttctgtatgcatc

SEQ ID NO: 880287 - DNA, 21 bp, Homo sapiens
taacactttaaaaccagttac

SEQ ID NO: 880288 - DNA, 16 bp, Homo sapiens
taacagaaactttcaa

SEQ ID NO: 880289 - DNA, 22 bp, Homo sapiens
taacagaaattgtatattgtaa

SEQ ID NO: 880290 - DNA, 19 bp, Homo sapiens
taacagaagaaaatagaat

SEQ ID NO: 880291 - DNA, 21 bp, Homo sapiens
taacagatgcaatgtgctact

SEQ ID NO: 880292 - DNA, 18 bp, Homo sapiens
taacagcatgctgctttg

SEQ ID NO: 880293 - DNA, 23 bp, Homo sapiens
taacagcattcttgtcacaataa

SEQ ID NO: 880294 - DNA, 15 bp, Homo sapiens
taacagccaagaagc

SEQ ID NO: 880295 - DNA, 16 bp, Homo sapiens
taacagccaagaagcc

SEQ ID NO: 880296 - DNA, 17 bp, Homo sapiens
taacagccctcctctgc

SEQ ID NO: 880297 - DNA, 13 bp, Homo sapiens
taacagcctcttg

SEQ ID NO: 880298 - DNA, 16 bp, Homo sapiens
taacagcctcttgccc

SEQ ID NO: 880299 - DNA, 15 bp, Homo sapiens
taacagctgaattat

SEQ ID NO: 880300 - DNA, 19 bp, Homo sapiens
taacagctgaattatctat

SEQ ID NO: 880301 - DNA, 16 bp, Homo sapiens
taacaggacgagatga

SEQ ID NO: 880302 - DNA, 20 bp, Homo sapiens
taacaggcatttgttcactg

SEQ ID NO: 880303 - DNA, 15 bp, Homo sapiens
taacaggccaaagag

SEQ ID NO: 880304 - DNA, 22 bp, Homo sapiens
taacaggctcaatattcctgaa

SEQ ID NO: 880305 - DNA, 15 bp, Homo sapiens
taacagggcagaaat

SEQ ID NO: 880306 - DNA, 16 bp, Homo sapiens
taacaggtctcctctt

SEQ ID NO: 880307 - DNA, 19 bp, Homo sapiens
taacaggtctcctcttaaa

SEQ ID NO: 880308 - DNA, 14 bp, Homo sapiens
taacagtcaagaaa

SEQ ID NO: 880309 - DNA, 14 bp, Homo sapiens
taacagtgtttaaa

SEQ ID NO: 880310 - DNA, 18 bp, Homo sapiens
taacagttatatcaagct

SEQ ID NO: 880311 - DNA, 18 bp, Homo sapiens
taacagttatatttttgt

SEQ ID NO: 880312 - DNA, 22 bp, Homo sapiens
taacagttgtgtcataaattac

SEQ ID NO: 880313 - DNA, 13 bp, Homo sapiens
taacagttttcca

SEQ ID NO: 880314 - DNA, 20 bp, Homo sapiens
taacagttttccatgaaaac

SEQ ID NO: 880315 - DNA, 21 bp, Homo sapiens
taacataaaatccaatattgt

SEQ ID NO: 880316 - DNA, 15 bp, Homo sapiens
taacataaaatctgt

SEQ ID NO: 880317 - DNA, 15 bp, Homo sapiens
taacataactgcttc

SEQ ID NO: 880318 - DNA, 20 bp, Homo sapiens
taacataatggttgtgaaat

SEQ ID NO: 880319 - DNA, 23 bp, Homo sapiens
taacataatggttgtgaaatgta

SEQ ID NO: 880320 - DNA, 18 bp, Homo sapiens
taacatacaagaaaatgt

SEQ ID NO: 880321 - DNA, 22 bp, Homo sapiens
taacatacctaagaagtacatt

SEQ ID NO: 880322 - DNA, 14 bp, Homo sapiens
taacatatttacta

SEQ ID NO: 880323 - DNA, 23 bp, Homo sapiens
taacatatttactaagccacaag

SEQ ID NO: 880324 - DNA, 18 bp, Homo sapiens
taacatcagtgtctgttt

SEQ ID NO: 880325 - DNA, 17 bp, Homo sapiens
taacatcataattacat

SEQ ID NO: 880326 - DNA, 14 bp, Homo sapiens
taacatctaaaaat

SEQ ID NO: 880327 - DNA, 20 bp, Homo sapiens
taacatctaaaaatagactt

SEQ ID NO: 880328 - DNA, 20 bp, Homo sapiens
taacatctttacgtactgta

SEQ ID NO: 880329 - DNA, 20 bp, Homo sapiens
taacatctttattgaaattc

SEQ ID NO: 880330 - DNA, 12 bp, Homo sapiens
taacatctttgt

SEQ ID NO: 880331 - DNA, 13 bp, Homo sapiens
taacatctttgtt

SEQ ID NO: 880332 - DNA, 18 bp, Homo sapiens
taacatgaggggacattt

SEQ ID NO: 880333 - DNA, 14 bp, Homo sapiens
taacatgatttcaa

SEQ ID NO: 880334 - DNA, 18 bp, Homo sapiens
taacatgcatactttatt

SEQ ID NO: 880335 - DNA, 15 bp, Homo sapiens
taacatgctgccatt

SEQ ID NO: 880336 - DNA, 19 bp, Homo sapiens
taacatgtaattaagtact

SEQ ID NO: 880337 - DNA, 15 bp, Homo sapiens
taacatgtatcccaa

SEQ ID NO: 880338 - DNA, 22 bp, Homo sapiens
taacatgtgttaagtattttca

SEQ ID NO: 880339 - DNA, 17 bp, Homo sapiens
taacattagatgtcatg

SEQ ID NO: 880340 - DNA, 12 bp, Homo sapiens
taacattattta

SEQ ID NO: 880341 - DNA, 17 bp, Homo sapiens
taacattcacagcccag

SEQ ID NO: 880342 - DNA, 16 bp, Homo sapiens
taacattcgatctcat

SEQ ID NO: 880343 - DNA, 23 bp, Homo sapiens
taacattctattgactttcttaa

SEQ ID NO: 880344 - DNA, 13 bp, Homo sapiens
taacattctgaat

SEQ ID NO: 880345 - DNA, 15 bp, Homo sapiens
taacattgaccaaga

SEQ ID NO: 880346 - DNA, 19 bp, Homo sapiens
taacattgaccaagaactg

SEQ ID NO: 880347 - DNA, 12 bp, Homo sapiens
taacattgcact

SEQ ID NO: 880348 - DNA, 19 bp, Homo sapiens
taacattgtaaagtatgtg

SEQ ID NO: 880349 - DNA, 16 bp, Homo sapiens
taacatttaaattcca

SEQ ID NO: 880350 - DNA, 16 bp, Homo sapiens
taactctattaatgag

SEQ ID NO: 880351 - DNA, 19 bp, Homo sapiens
taactctccagccattgta

SEQ ID NO: 880352 - DNA, 14 bp, Homo sapiens
taactctctttatg

SEQ ID NO: 880353 - DNA, 13 bp, Homo sapiens
taactctctttcc

SEQ ID NO: 880354 - DNA, 17 bp, Homo sapiens
taactctctttccttga

SEQ ID NO: 880355 - DNA, 17 bp, Homo sapiens
taactctgcccaccctc

SEQ ID NO: 880356 - DNA, 18 bp, Homo sapiens
taactctgcccaccctcc

SEQ ID NO: 880357 - DNA, 11 bp, Homo sapiens
taactctggga

SEQ ID NO: 880358 - DNA, 13 bp, Homo sapiens
taactgaactgtt

SEQ ID NO: 880359 - DNA, 14 bp, Homo sapiens
taactgaaggagaa

SEQ ID NO: 880360 - DNA, 15 bp, Homo sapiens
taactgtgtactgtt

SEQ ID NO: 880361 - DNA, 18 bp, Homo sapiens
taactgtgtatgtacata

SEQ ID NO: 880362 - DNA, 19 bp, Homo sapiens
taactgtgtatgtacatat

SEQ ID NO: 880363 - DNA, 14 bp, Homo sapiens
taactgttacagta

SEQ ID NO: 880364 - DNA, 20 bp, Homo sapiens
taactgttacagtaatgtca

SEQ ID NO: 880365 - DNA, 18 bp, Homo sapiens
taacttaaaaaaatgaca

SEQ ID NO: 880366 - DNA, 17 bp, Homo sapiens
taacttaaatagtattt

SEQ ID NO: 880367 - DNA, 13 bp, Homo sapiens
taacttaactgaa

SEQ ID NO: 880368 - DNA, 14 bp, Homo sapiens
taacttaactgaaa

SEQ ID NO: 880369 - DNA, 15 bp, Homo sapiens
taacttaatgaaaac

SEQ ID NO: 880370 - DNA, 18 bp, Homo sapiens
taacttaatgaaaacaat

SEQ ID NO: 880371 - DNA, 15 bp, Homo sapiens
taacttacatttgta

SEQ ID NO: 880372 - DNA, 20 bp, Homo sapiens
taacttacggatttattata

SEQ ID NO: 880373 - DNA, 24 bp, Homo sapiens
taacttagaaggatggcatctcca

SEQ ID NO: 880374 - DNA, 16 bp, Homo sapiens
taacttatattgaaga

SEQ ID NO: 880375 - DNA, 19 bp, Homo sapiens
taacttatattgtaagaaa

SEQ ID NO: 880376 - DNA, 22 bp, Homo sapiens
taacttatctagaaagaaaaga

SEQ ID NO: 880377 - DNA, 15 bp, Homo sapiens
taacttattagaaac

SEQ ID NO: 880378 - DNA, 12 bp, Homo sapiens
taacttattcca

SEQ ID NO: 880379 - DNA, 15 bp, Homo sapiens
taacttattccgaga

SEQ ID NO: 880380 - DNA, 13 bp, Homo sapiens
taacttcacatat

SEQ ID NO: 880381 - DNA, 21 bp, Homo sapiens
taacttcacatattgatttcc

SEQ ID NO: 880382 - DNA, 13 bp, Homo sapiens
taacttcagtcct

SEQ ID NO: 880383 - DNA, 15 bp, Homo sapiens
taacttccaaataaa

SEQ ID NO: 880384 - DNA, 17 bp, Homo sapiens
taacttccaatttacat

SEQ ID NO: 880385 - DNA, 18 bp, Homo sapiens
taacttcctgctgcaccc

SEQ ID NO: 880386 - DNA, 22 bp, Homo sapiens
taacttcctgctgcaccctgcg

SEQ ID NO: 880387 - DNA, 22 bp, Homo sapiens
taacttctgtaatttaaaagct

SEQ ID NO: 880388 - DNA, 18 bp, Homo sapiens
taacttcttaaaagttgt

SEQ ID NO: 880389 - DNA, 23 bp, Homo sapiens
taacttcttatggaattgatttg

SEQ ID NO: 880390 - DNA, 15 bp, Homo sapiens
taacttgagttttat

SEQ ID NO: 880391 - DNA, 21 bp, Homo sapiens
taacttgagttttatttattt

SEQ ID NO: 880392 - DNA, 21 bp, Homo sapiens
taacttgatatagaaagctgt

SEQ ID NO: 880393 - DNA, 20 bp, Homo sapiens
taacttgcttaaatttctta

SEQ ID NO: 880394 - DNA, 19 bp, Homo sapiens
taacttgcttagtatggtt

SEQ ID NO: 880395 - DNA, 13 bp, Homo sapiens
taacttggggagg

SEQ ID NO: 880396 - DNA, 20 bp, Homo sapiens
taacttgtatattccaccat

SEQ ID NO: 880397 - DNA, 21 bp, Homo sapiens
taacttgtatattccaccatt

SEQ ID NO: 880398 - DNA, 15 bp, Homo sapiens
taactttaaacatct

SEQ ID NO: 880399 - DNA, 12 bp, Homo sapiens
taactttaagtt

SEQ ID NO: 880400 - DNA, 22 bp, Homo sapiens
taactttaattctctttcaaag

SEQ ID NO: 880401 - DNA, 14 bp, Homo sapiens
taactttacagaaa

SEQ ID NO: 880402 - DNA, 16 bp, Homo sapiens
taactttactctgtgt

SEQ ID NO: 880403 - DNA, 14 bp, Homo sapiens
taactttatgtgta

SEQ ID NO: 880404 - DNA, 13 bp, Homo sapiens
taactttctgggt

SEQ ID NO: 880405 - DNA, 17 bp, Homo sapiens
taactttgtggtctaaa

SEQ ID NO: 880406 - DNA, 22 bp, Homo sapiens
taactttgtggtctaaagtgtt

SEQ ID NO: 880407 - DNA, 13 bp, Homo sapiens
taacttttaatgg

SEQ ID NO: 880408 - DNA, 17 bp, Homo sapiens
taacttttaatggtgat

SEQ ID NO: 880409 - DNA, 17 bp, Homo sapiens
taacttttataaacttt

SEQ ID NO: 880410 - DNA, 18 bp, Homo sapiens
taacttttataaacttta

SEQ ID NO: 880411 - DNA, 22 bp, Homo sapiens
taacttttataaactttacctt

SEQ ID NO: 880412 - DNA, 13 bp, Homo sapiens
taacttttatatt

SEQ ID NO: 880413 - DNA, 14 bp, Homo sapiens
taacttttatatta

SEQ ID NO: 880414 - DNA, 17 bp, Homo sapiens
taacttttctttttccc

SEQ ID NO: 880415 - DNA, 15 bp, Homo sapiens
taacttttggaatca

SEQ ID NO: 880416 - DNA, 16 bp, Homo sapiens
taacttttggaatcat

SEQ ID NO: 880417 - DNA, 17 bp, Homo sapiens
taacttttggaatcata

SEQ ID NO: 880418 - DNA, 20 bp, Homo sapiens
taacttttgtaaatacacat

SEQ ID NO: 880419 - DNA, 18 bp, Homo sapiens
taacttttgtaagacaaa

SEQ ID NO: 880420 - DNA, 13 bp, Homo sapiens
taacttttgtttt

SEQ ID NO: 880421 - DNA, 23 bp, Homo sapiens
taacttttttgtggcaattagtg

SEQ ID NO: 880422 - DNA, 17 bp, Homo sapiens
taacttttttgtgtatg

SEQ ID NO: 880423 - DNA, 22 bp, Homo sapiens
taacttttttgtgtatgtactt

SEQ ID NO: 880424 - DNA, 23 bp, Homo sapiens
taacttttttgtgtatgtactta

SEQ ID NO: 880425 - DNA, 17 bp, Homo sapiens
taactttttttcagttc

SEQ ID NO: 880426 - DNA, 21 bp, Homo sapiens
taacttttttttttttaacat

SEQ ID NO: 880427 - DNA, 22 bp, Homo sapiens
taacttttttttttttaacatc

SEQ ID NO: 880428 - DNA, 14 bp, Homo sapiens
taagaaaaaaaatg

SEQ ID NO: 880429 - DNA, 22 bp, Homo sapiens
taagaaaaaaagcacaaagttc

SEQ ID NO: 880430 - DNA, 11 bp, Homo sapiens
taagaaaaaag

SEQ ID NO: 880431 - DNA, 20 bp, Homo sapiens
taagaaaaaataacacacat

SEQ ID NO: 880432 - DNA, 21 bp, Homo sapiens
taagaaaaaattctttcactt

SEQ ID NO: 880433 - DNA, 10 bp, Homo sapiens
taagaaaaac

SEQ ID NO: 880434 - DNA, 14 bp, Homo sapiens
taagaaaaacaaag

SEQ ID NO: 880435 - DNA, 21 bp, Homo sapiens
taagaaaaataggtcagataa

SEQ ID NO: 880436 - DNA, 22 bp, Homo sapiens
taagaaaaatgaaaacttttgt

SEQ ID NO: 880437 - DNA, 14 bp, Homo sapiens
taagaaaagagata

SEQ ID NO: 880438 - DNA, 22 bp, Homo sapiens
taagaaaagagatattttaaaa

SEQ ID NO: 880439 - DNA, 21 bp, Homo sapiens
taagaaaagatacgactttat

SEQ ID NO: 880440 - DNA, 17 bp, Homo sapiens
taagctttctctcagaa

SEQ ID NO: 880441 - DNA, 18 bp, Homo sapiens
taagctttctctcagaaa

SEQ ID NO: 880442 - DNA, 19 bp, Homo sapiens
taagctttctctcagaaat

SEQ ID NO: 880443 - DNA, 19 bp, Homo sapiens
taagcttttaagaaaaaca

SEQ ID NO: 880444 - DNA, 20 bp, Homo sapiens
taagcttttaagaaaaacaa

SEQ ID NO: 880445 - DNA, 21 bp, Homo sapiens
taagcttttaagaaaaacaaa

SEQ ID NO: 880446 - DNA, 12 bp, Homo sapiens
taagcttttatt

SEQ ID NO: 880447 - DNA, 15 bp, Homo sapiens
taagcttttatttct

SEQ ID NO: 880448 - DNA, 13 bp, Homo sapiens
taagctttttgga

SEQ ID NO: 880449 - DNA, 15 bp, Homo sapiens
taaggaaacttctga

SEQ ID NO: 880450 - DNA, 22 bp, Homo sapiens
taaggaaacttctgatgtttat

SEQ ID NO: 880451 - DNA, 22 bp, Homo sapiens
taaggaaactttatttaaatgc

SEQ ID NO: 880452 - DNA, 21 bp, Homo sapiens
taaggaaatgttgagggcaag

SEQ ID NO: 880453 - DNA, 22 bp, Homo sapiens
taaggaagccagtcaccttctg

SEQ ID NO: 880454 - DNA, 18 bp, Homo sapiens
taaggaatttcctcccaa

SEQ ID NO: 880455 - DNA, 16 bp, Homo sapiens
taaggacaaattagca

SEQ ID NO: 880456 - DNA, 18 bp, Homo sapiens
taaggacaaattagcatg

SEQ ID NO: 880457 - DNA, 15 bp, Homo sapiens
taaggacacactaat

SEQ ID NO: 880458 - DNA, 17 bp, Homo sapiens
taaggacttctgcagct

SEQ ID NO: 880459 - DNA, 16 bp, Homo sapiens
taaggagactgaggct

SEQ ID NO: 880460 - DNA, 22 bp, Homo sapiens
taaggagagttcaagcctgtgg

SEQ ID NO: 880461 - DNA, 18 bp, Homo sapiens
taaggagcatcagccagt

SEQ ID NO: 880462 - DNA, 22 bp, Homo sapiens
taaggaggggaaaaaaatgttg

SEQ ID NO: 880463 - DNA, 20 bp, Homo sapiens
taaggagtttttttgtcaga

SEQ ID NO: 880464 - DNA, 19 bp, Homo sapiens
taaggatatgattaatatt

SEQ ID NO: 880465 - DNA, 21 bp, Homo sapiens
taaggatatgcattaaccact

SEQ ID NO: 880466 - DNA, 18 bp, Homo sapiens
taaggatccggaaagaag

SEQ ID NO: 880467 - DNA, 16 bp, Homo sapiens
taaggatctctcagga

SEQ ID NO: 880468 - DNA, 17 bp, Homo sapiens
taaggatgactttagaa

SEQ ID NO: 880469 - DNA, 21 bp, Homo sapiens
taaggatgcttgtacataatg

SEQ ID NO: 880470 - DNA, 19 bp, Homo sapiens
taaggatggagccagctct

SEQ ID NO: 880471 - DNA, 14 bp, Homo sapiens
taaggcaacattcc

SEQ ID NO: 880472 - DNA, 22 bp, Homo sapiens
taaggcattccacacctaagaa

SEQ ID NO: 880473 - DNA, 15 bp, Homo sapiens
taaggccagggcctc

SEQ ID NO: 880474 - DNA, 18 bp, Homo sapiens
taaggccagggcctctcc

SEQ ID NO: 880475 - DNA, 20 bp, Homo sapiens
taaggcctaaggaagccagt

SEQ ID NO: 880476 - DNA, 16 bp, Homo sapiens
taaggctccccacccc

SEQ ID NO: 880477 - DNA, 19 bp, Homo sapiens
taaggctgctggcttcagg

SEQ ID NO: 880478 - DNA, 13 bp, Homo sapiens
taaggctgtgtaa

SEQ ID NO: 880479 - DNA, 16 bp, Homo sapiens
taaggctgtgtaagat

SEQ ID NO: 880480 - DNA, 22 bp, Homo sapiens
taaggctgtgtaagatttgttt

SEQ ID NO: 880481 - DNA, 18 bp, Homo sapiens
taaggcttaggtgccagg

SEQ ID NO: 880482 - DNA, 21 bp, Homo sapiens
taaggcttaggtgccaggctg

SEQ ID NO: 880483 - DNA, 11 bp, Homo sapiens
taagggaaaaa

SEQ ID NO: 880484 - DNA, 12 bp, Homo sapiens
taagggaaaaat

SEQ ID NO: 880485 - DNA, 17 bp, Homo sapiens
taagggaaaaatatata

SEQ ID NO: 880486 - DNA, 13 bp, Homo sapiens
taagggaagaatt

SEQ ID NO: 880487 - DNA, 21 bp, Homo sapiens
taagggaaggaactctggctt

SEQ ID NO: 880488 - DNA, 18 bp, Homo sapiens
taagggacgggggtggga

SEQ ID NO: 880489 - DNA, 14 bp, Homo sapiens
taagggagaaaaaa

SEQ ID NO: 880490 - DNA, 18 bp, Homo sapiens
taagggagagctgagcca

SEQ ID NO: 880491 - DNA, 12 bp, Homo sapiens
taagggcagccc

SEQ ID NO: 880492 - DNA, 15 bp, Homo sapiens
taagggcatttttat

SEQ ID NO: 880493 - DNA, 15 bp, Homo sapiens
taaggggaagataag

SEQ ID NO: 880494 - DNA, 19 bp, Homo sapiens
taaggggccttgctctgag

SEQ ID NO: 880495 - DNA, 18 bp, Homo sapiens
taagggtggaaaaatgcc

SEQ ID NO: 880496 - DNA, 13 bp, Homo sapiens
taagggtgggtgc

SEQ ID NO: 880497 - DNA, 20 bp, Homo sapiens
taagggtgggtgctcagaat

SEQ ID NO: 880498 - DNA, 15 bp, Homo sapiens
taagggttaagaaaa

SEQ ID NO: 880499 - DNA, 18 bp, Homo sapiens
taagggttgaaggcagtc

SEQ ID NO: 880500 - DNA, 19 bp, Homo sapiens
taaggtacaagaagcattt

SEQ ID NO: 880501 - DNA, 15 bp, Homo sapiens
taaggtattgtgcat

SEQ ID NO: 880502 - DNA, 20 bp, Homo sapiens
taaggtccaacaagaatgca

SEQ ID NO: 880503 - DNA, 21 bp, Homo sapiens
taaggtccctgggggtgcaga

SEQ ID NO: 880504 - DNA, 13 bp, Homo sapiens
taaggtctcatgc

SEQ ID NO: 880505 - DNA, 21 bp, Homo sapiens
taaggtctttcagtacttttt

SEQ ID NO: 880506 - DNA, 15 bp, Homo sapiens
taaggtctttgtaaa

SEQ ID NO: 880507 - DNA, 12 bp, Homo sapiens
taaggtgcagtt

SEQ ID NO: 880508 - DNA, 18 bp, Homo sapiens
taaggtgcctcagttttc

SEQ ID NO: 880509 - DNA, 21 bp, Homo sapiens
taaggtgcctcagttttcctt

SEQ ID NO: 880510 - DNA, 15 bp, Homo sapiens
taaggttgtgcaggg

SEQ ID NO: 880511 - DNA, 21 bp, Homo sapiens
taaggtttccagtcagatgag

SEQ ID NO: 880512 - DNA, 20 bp, Homo sapiens
taaggtttcctgctccagtg

SEQ ID NO: 880513 - DNA, 14 bp, Homo sapiens
taagtaaaaatatg

SEQ ID NO: 880514 - DNA, 21 bp, Homo sapiens
taagtaaaagtctacctgtgt

SEQ ID NO: 880515 - DNA, 12 bp, Homo sapiens
taagtaaagtga

SEQ ID NO: 880516 - DNA, 13 bp, Homo sapiens
taagtaaatgctg

SEQ ID NO: 880517 - DNA, 20 bp, Homo sapiens
taagtaagaaaatattttgt

SEQ ID NO: 880518 - DNA, 14 bp, Homo sapiens
taagtaagaaattt

SEQ ID NO: 880519 - DNA, 13 bp, Homo sapiens
taagtaataattt

SEQ ID NO: 880520 - DNA, 22 bp, Homo sapiens
taagtctcctttactgaatgta

SEQ ID NO: 880521 - DNA, 11 bp, Homo sapiens
taagtctctgt

SEQ ID NO: 880522 - DNA, 19 bp, Homo sapiens
taagtctcttacaaaagct

SEQ ID NO: 880523 - DNA, 22 bp, Homo sapiens
taagtctgtattataataagca

SEQ ID NO: 880524 - DNA, 15 bp, Homo sapiens
taagtcttccttaaa

SEQ ID NO: 880525 - DNA, 20 bp, Homo sapiens
taagtcttccttaaatgact

SEQ ID NO: 880526 - DNA, 14 bp, Homo sapiens
taagtctttactct

SEQ ID NO: 880527 - DNA, 21 bp, Homo sapiens
taagtcttttttttttccaaa

SEQ ID NO: 880528 - DNA, 16 bp, Homo sapiens
taagtgaaaaggtcat

SEQ ID NO: 880529 - DNA, 18 bp, Homo sapiens
taagtgaactattgtggg

SEQ ID NO: 880530 - DNA, 23 bp, Homo sapiens
taagtgacaccaataaatgtttg

SEQ ID NO: 880531 - DNA, 15 bp, Homo sapiens
taagtgagagagaca

SEQ ID NO: 880532 - DNA, 16 bp, Homo sapiens
taagtgcactttttta

SEQ ID NO: 880533 - DNA, 19 bp, Homo sapiens
taagtgcctcacatttttt

SEQ ID NO: 880534 - DNA, 14 bp, Homo sapiens
taagtgctgcattt

SEQ ID NO: 880535 - DNA, 22 bp, Homo sapiens
taagtgctgcatttaaaagata

SEQ ID NO: 880536 - DNA, 17 bp, Homo sapiens
taagtggaggcacttta

SEQ ID NO: 880537 - DNA, 13 bp, Homo sapiens
taagtggctgctg

SEQ ID NO: 880538 - DNA, 16 bp, Homo sapiens
taagtggtagtaattt

SEQ ID NO: 880539 - DNA, 16 bp, Homo sapiens
taagtgtaaaaaatgt

SEQ ID NO: 880540 - DNA, 19 bp, Homo sapiens
taagtgtaaaaaatgtctc

SEQ ID NO: 880541 - DNA, 13 bp, Homo sapiens
taagtgtaaatag

SEQ ID NO: 880542 - DNA, 14 bp, Homo sapiens
taagtgtaaatgaa

SEQ ID NO: 880543 - DNA, 16 bp, Homo sapiens
taagtgtaacctcagt

SEQ ID NO: 880544 - DNA, 14 bp, Homo sapiens
taagtgtaatgttg

SEQ ID NO: 880545 - DNA, 19 bp, Homo sapiens
taagtgtacaattgatctt

SEQ ID NO: 880546 - DNA, 14 bp, Homo sapiens
taagtgtacatatg

SEQ ID NO: 880547 - DNA, 15 bp, Homo sapiens
taagtgtagctcaaa

SEQ ID NO: 880548 - DNA, 15 bp, Homo sapiens
taagtgtatcttaat

SEQ ID NO: 880549 - DNA, 13 bp, Homo sapiens
taagtgtattttt

SEQ ID NO: 880550 - DNA, 15 bp, Homo sapiens
taagtgtggttttgt

SEQ ID NO: 880551 - DNA, 16 bp, Homo sapiens
taagtgtgtcttccta

SEQ ID NO: 880552 - DNA, 14 bp, Homo sapiens
taagtgtgtgtgtg

SEQ ID NO: 880553 - DNA, 14 bp, Homo sapiens
taagtgttgtaaat

SEQ ID NO: 880554 - DNA, 13 bp, Homo sapiens
taagttaataatg

SEQ ID NO: 880555 - DNA, 17 bp, Homo sapiens
taagttaataatgtatt

SEQ ID NO: 880556 - DNA, 16 bp, Homo sapiens
taagttaatgtatata

SEQ ID NO: 880557 - DNA, 14 bp, Homo sapiens
taagttaatttaaa

SEQ ID NO: 880558 - DNA, 14 bp, Homo sapiens
taagttatagtata

SEQ ID NO: 880559 - DNA, 23 bp, Homo sapiens
taagttatgcctctgacagtcca

SEQ ID NO: 880560 - DNA, 13 bp, Homo sapiens
taagttattacct

SEQ ID NO: 880561 - DNA, 14 bp, Homo sapiens
taagttattacctc

SEQ ID NO: 880562 - DNA, 14 bp, Homo sapiens
taagttattgcagt

SEQ ID NO: 880563 - DNA, 15 bp, Homo sapiens
taagttattgcagtt

SEQ ID NO: 880564 - DNA, 17 bp, Homo sapiens
taagttatttcttgttt

SEQ ID NO: 880565 - DNA, 20 bp, Homo sapiens
taagttatttcttgtttgtt

SEQ ID NO: 880566 - DNA, 17 bp, Homo sapiens
taagttcacattagaat

SEQ ID NO: 880567 - DNA, 18 bp, Homo sapiens
taagttcatgtttgtaaa

SEQ ID NO: 880568 - DNA, 18 bp, Homo sapiens
taagttctaagttcatgt

SEQ ID NO: 880569 - DNA, 14 bp, Homo sapiens
taagttcttaatgt

SEQ ID NO: 880570 - DNA, 21 bp, Homo sapiens
taagttcttatgaggagggga

SEQ ID NO: 880571 - DNA, 23 bp, Homo sapiens
taagttctttgatttgtaccatt

SEQ ID NO: 880572 - DNA, 15 bp, Homo sapiens
taagttgaaaaagga

SEQ ID NO: 880573 - DNA, 20 bp, Homo sapiens
taagttgaaaaaggaaatat

SEQ ID NO: 880574 - DNA, 17 bp, Homo sapiens
taagttgaatggcctgc

SEQ ID NO: 880575 - DNA, 16 bp, Homo sapiens
taagttgctgtaaaat

SEQ ID NO: 880576 - DNA, 18 bp, Homo sapiens
taagttgctgtaaaattt

SEQ ID NO: 880577 - DNA, 19 bp, Homo sapiens
taagttgtaccaaaacatc

SEQ ID NO: 880578 - DNA, 20 bp, Homo sapiens
taagttgtaccaaaacatcc

SEQ ID NO: 880579 - DNA, 14 bp, Homo sapiens
taagttgtattaaa

SEQ ID NO: 880580 - DNA, 18 bp, Homo sapiens
taagttgtcaaagaagct

SEQ ID NO: 880581 - DNA, 16 bp, Homo sapiens
taagttgttatttcag

SEQ ID NO: 880582 - DNA, 22 bp, Homo sapiens
taagtttatccaaatcttgaat

SEQ ID NO: 880583 - DNA, 15 bp, Homo sapiens
taagtttctcttcac

SEQ ID NO: 880584 - DNA, 12 bp, Homo sapiens
taagtttgtagt

SEQ ID NO: 880585 - DNA, 17 bp, Homo sapiens
taagttttagaatcttt

SEQ ID NO: 880586 - DNA, 18 bp, Homo sapiens
taagttttgatataatct

SEQ ID NO: 880587 - DNA, 19 bp, Homo sapiens
taagttttgtgtgtatata

SEQ ID NO: 880588 - DNA, 17 bp, Homo sapiens
taataaaaaaagaaagc

SEQ ID NO: 880589 - DNA, 17 bp, Homo sapiens
taataaaaaacaagaaa

SEQ ID NO: 880590 - DNA, 21 bp, Homo sapiens
taataaaaaacaagaaaccaa

SEQ ID NO: 880591 - DNA, 14 bp, Homo sapiens
taataaaaaatgga

SEQ ID NO: 880592 - DNA, 15 bp, Homo sapiens
taataaaaaattatg

SEQ ID NO: 880593 - DNA, 22 bp, Homo sapiens
taataaaaagcatttggtgcct

SEQ ID NO: 880594 - DNA, 15 bp, Homo sapiens
taataaaaagctttt

SEQ ID NO: 880595 - DNA, 18 bp, Homo sapiens
taataaaactgcacagtg

SEQ ID NO: 880596 - DNA, 21 bp, Homo sapiens
taataaaactgcacagtgctg

SEQ ID NO: 880597 - DNA, 22 bp, Homo sapiens
taataaaactgcacagtgctgt

SEQ ID NO: 880598 - DNA, 22 bp, Homo sapiens
taataaaactgcgaggacatca

SEQ ID NO: 880599 - DNA, 13 bp, Homo sapiens
taataaaagaaca

SEQ ID NO: 880600 - DNA, 15 bp, Homo sapiens
taataaaagatttac

SEQ ID NO: 880601 - DNA, 16 bp, Homo sapiens
taataaaagatttaca

SEQ ID NO: 880602 - DNA, 18 bp, Homo sapiens
taataaaagatttacatt

SEQ ID NO: 880603 - DNA, 14 bp, Homo sapiens
taataaaaggaaaa

SEQ ID NO: 880604 - DNA, 20 bp, Homo sapiens
taataaaaggaaaagcaaat

SEQ ID NO: 880605 - DNA, 11 bp, Homo sapiens
taataaaatgc

SEQ ID NO: 880606 - DNA, 13 bp, Homo sapiens
taataaaatgcaa

SEQ ID NO: 880607 - DNA, 20 bp, Homo sapiens
taataaacgagatgtttgcc

SEQ ID NO: 880608 - DNA, 15 bp, Homo sapiens
taataaactgtatta

SEQ ID NO: 880609 - DNA, 14 bp, Homo sapiens
taataaactgtgtt

SEQ ID NO: 880610 - DNA, 22 bp, Homo sapiens
taataaagaaatatttacctaa

SEQ ID NO: 880611 - DNA, 14 bp, Homo sapiens
taataaagatgagt

SEQ ID NO: 880612 - DNA, 17 bp, Homo sapiens
taataaagatgctcttt

SEQ ID NO: 880613 - DNA, 12 bp, Homo sapiens
taataaagcatt

SEQ ID NO: 880614 - DNA, 14 bp, Homo sapiens
taataaagcattct

SEQ ID NO: 880615 - DNA, 15 bp, Homo sapiens
taataaagctactga

SEQ ID NO: 880616 - DNA, 16 bp, Homo sapiens
taataaagctactgat

SEQ ID NO: 880617 - DNA, 19 bp, Homo sapiens
taataaaggtcttaaataa

SEQ ID NO: 880618 - DNA, 18 bp, Homo sapiens
taataaagtagcaaaaca

SEQ ID NO: 880619 - DNA, 23 bp, Homo sapiens
taataaagtagcaaaacaaattc

SEQ ID NO: 880620 - DNA, 16 bp, Homo sapiens
taataaagtgttacgt

SEQ ID NO: 880621 - DNA, 15 bp, Homo sapiens
taataaatatttatg

SEQ ID NO: 880622 - DNA, 21 bp, Homo sapiens
taataaatctaggatgtgatg

SEQ ID NO: 880623 - DNA, 17 bp, Homo sapiens
taataaatgtacattaa

SEQ ID NO: 880624 - DNA, 19 bp, Homo sapiens
taataaatgtacattaatt

SEQ ID NO: 880625 - DNA, 14 bp, Homo sapiens
taataaattcaaaa

SEQ ID NO: 880626 - DNA, 16 bp, Homo sapiens
taataaattcatcaga

SEQ ID NO: 880627 - DNA, 16 bp, Homo sapiens
taataaattgacataa

SEQ ID NO: 880628 - DNA, 18 bp, Homo sapiens
taataacaaggagatttc

SEQ ID NO: 880629 - DNA, 15 bp, Homo sapiens
taataacagctcctt

SEQ ID NO: 880630 - DNA, 20 bp, Homo sapiens
taataactcggattccagcc

SEQ ID NO: 880631 - DNA, 14 bp, Homo sapiens
taataactgaactg

SEQ ID NO: 880632 - DNA, 15 bp, Homo sapiens
taataactgaactgt

SEQ ID NO: 880633 - DNA, 16 bp, Homo sapiens
taataactgaactgtt

SEQ ID NO: 880634 - DNA, 17 bp, Homo sapiens
taataactgtgtactgt

SEQ ID NO: 880635 - DNA, 22 bp, Homo sapiens
taataactttattgcatataga

SEQ ID NO: 880636 - DNA, 14 bp, Homo sapiens
taataagaacagat

SEQ ID NO: 880637 - DNA, 19 bp, Homo sapiens
taataagaatggttgcctt

SEQ ID NO: 880638 - DNA, 14 bp, Homo sapiens
taataagatggctg

SEQ ID NO: 880639 - DNA, 17 bp, Homo sapiens
taataagatggctgtgg

SEQ ID NO: 880640 - DNA, 19 bp, Homo sapiens
taataagcacttgcctgga

SEQ ID NO: 880641 - DNA, 19 bp, Homo sapiens
taataagctactagcaaaa

SEQ ID NO: 880642 - DNA, 21 bp, Homo sapiens
taataagtttgtgttagaaaa

SEQ ID NO: 880643 - DNA, 15 bp, Homo sapiens
taataagttttgata

SEQ ID NO: 880644 - DNA, 20 bp, Homo sapiens
taataagttttgatataatc

SEQ ID NO: 880645 - DNA, 22 bp, Homo sapiens
taataagttttgatataatctt

SEQ ID NO: 880646 - DNA, 14 bp, Homo sapiens
taataataaatagt

SEQ ID NO: 880647 - DNA, 12 bp, Homo sapiens
taataatactga

SEQ ID NO: 880648 - DNA, 15 bp, Homo sapiens
taataatatcaaaga

SEQ ID NO: 880649 - DNA, 14 bp, Homo sapiens
taataatgaagtag

SEQ ID NO: 880650 - DNA, 19 bp, Homo sapiens
taataatgaagtagaagtt

SEQ ID NO: 880651 - DNA, 14 bp, Homo sapiens
taataatgtgcaaa

SEQ ID NO: 880652 - DNA, 16 bp, Homo sapiens
taataatttttgctga

SEQ ID NO: 880653 - DNA, 18 bp, Homo sapiens
taataatttttgctgaat

SEQ ID NO: 880654 - DNA, 20 bp, Homo sapiens
taatacaaaagggtcttgac

SEQ ID NO: 880655 - DNA, 14 bp, Homo sapiens
taatacaaactaat

SEQ ID NO: 880656 - DNA, 15 bp, Homo sapiens
taatacaaactatat

SEQ ID NO: 880657 - DNA, 22 bp, Homo sapiens
taatacaacatgtagctgagtt

SEQ ID NO: 880658 - DNA, 19 bp, Homo sapiens
taatacaagtaatattatt

SEQ ID NO: 880659 - DNA, 14 bp, Homo sapiens
taatacacagtact

SEQ ID NO: 880660 - DNA, 14 bp, Homo sapiens
taatacaccactac

SEQ ID NO: 880661 - DNA, 20 bp, Homo sapiens
taatacagagtacgttaaaa

SEQ ID NO: 880662 - DNA, 18 bp, Homo sapiens
taatacagcaacaattta

SEQ ID NO: 880663 - DNA, 22 bp, Homo sapiens
taatacagcaacaatttatgaa

SEQ ID NO: 880664 - DNA, 13 bp, Homo sapiens
taatacaggaaat

SEQ ID NO: 880665 - DNA, 22 bp, Homo sapiens
taatacattctatgacattttt

SEQ ID NO: 880666 - DNA, 14 bp, Homo sapiens
taataccaaatatt

SEQ ID NO: 880667 - DNA, 16 bp, Homo sapiens
taataccaaatatttt

SEQ ID NO: 880668 - DNA, 17 bp, Homo sapiens
taataccacagctattt

SEQ ID NO: 880669 - DNA, 20 bp, Homo sapiens
taataccacagctatttaga

SEQ ID NO: 880670 - DNA, 19 bp, Homo sapiens
taatacccccgtcggaatg

SEQ ID NO: 880671 - DNA, 23 bp, Homo sapiens
taatacccccgtcggaatggtaa

SEQ ID NO: 880672 - DNA, 18 bp, Homo sapiens
taatacctgattgatcac

SEQ ID NO: 880673 - DNA, 20 bp, Homo sapiens
taatacctgattgatcacac

SEQ ID NO: 880674 - DNA, 20 bp, Homo sapiens
taatacctgggtgattacat

SEQ ID NO: 880675 - DNA, 13 bp, Homo sapiens
taatactaaaact

SEQ ID NO: 880676 - DNA, 16 bp, Homo sapiens
taatactaaaactcag

SEQ ID NO: 880677 - DNA, 16 bp, Homo sapiens
taatactccagagaca

SEQ ID NO: 880678 - DNA, 12 bp, Homo sapiens
taatactgacct

SEQ ID NO: 880679 - DNA, 20 bp, Homo sapiens
taatactggaataatttgta

SEQ ID NO: 880680 - DNA, 19 bp, Homo sapiens
taatacttcatttggtgct

SEQ ID NO: 880681 - DNA, 23 bp, Homo sapiens
taatacttgcaactaaggacaaa

SEQ ID NO: 880682 - DNA, 13 bp, Homo sapiens
taatactttgtat

SEQ ID NO: 880683 - DNA, 20 bp, Homo sapiens
taatagaaataaattcctaa

SEQ ID NO: 880684 - DNA, 12 bp, Homo sapiens
taatagaagaac

SEQ ID NO: 880685 - DNA, 20 bp, Homo sapiens
taatagaataaaggcagttt

SEQ ID NO: 880686 - DNA, 14 bp, Homo sapiens
taatagacaattta

SEQ ID NO: 880687 - DNA, 22 bp, Homo sapiens
taatagacaatttattatggca

SEQ ID NO: 880688 - DNA, 16 bp, Homo sapiens
taatagagttggagtt

SEQ ID NO: 880689 - DNA, 21 bp, Homo sapiens
taatagagttggagttttatt

SEQ ID NO: 880690 - DNA, 22 bp, Homo sapiens
taatagagttggagttttattt

SEQ ID NO: 880691 - DNA, 15 bp, Homo sapiens
taatagatgatggta

SEQ ID NO: 880692 - DNA, 14 bp, Homo sapiens
taatagatgtttga

SEQ ID NO: 880693 - DNA, 22 bp, Homo sapiens
taatagatgtttgatagatttt

SEQ ID NO: 880694 - DNA, 22 bp, Homo sapiens
taatagattttttcagacttgt

SEQ ID NO: 880695 - DNA, 21 bp, Homo sapiens
taatagattttttttaaagtt

SEQ ID NO: 880696 - DNA, 21 bp, Homo sapiens
taatagcagcctttctctctt

SEQ ID NO: 880697 - DNA, 22 bp, Homo sapiens
taatagcccataaagtctgaga

SEQ ID NO: 880698 - DNA, 19 bp, Homo sapiens
taatagcgggttactttca

SEQ ID NO: 880699 - DNA, 18 bp, Homo sapiens
taatagcttttattgtat

SEQ ID NO: 880700 - DNA, 21 bp, Homo sapiens
taatagcttttattgtataaa

SEQ ID NO: 880701 - DNA, 18 bp, Homo sapiens
taatagcttttgattagt

SEQ ID NO: 880702 - DNA, 20 bp, Homo sapiens
taatcatatgtgtctttata

SEQ ID NO: 880703 - DNA, 16 bp, Homo sapiens
taatcatctataaaga

SEQ ID NO: 880704 - DNA, 15 bp, Homo sapiens
taatcatgctcatgt

SEQ ID NO: 880705 - DNA, 16 bp, Homo sapiens
taatcatgtaaatgct

SEQ ID NO: 880706 - DNA, 19 bp, Homo sapiens
taatcatgtgggtgagcca

SEQ ID NO: 880707 - DNA, 20 bp, Homo sapiens
taatcatgtgggtgagccag

SEQ ID NO: 880708 - DNA, 20 bp, Homo sapiens
taatcattgcttatgtcaaa

SEQ ID NO: 880709 - DNA, 22 bp, Homo sapiens
taatcatttcttgggccctcct

SEQ ID NO: 880710 - DNA, 13 bp, Homo sapiens
taatcatttgttt

SEQ ID NO: 880711 - DNA, 21 bp, Homo sapiens
taatcatttgtttacatttga

SEQ ID NO: 880712 - DNA, 20 bp, Homo sapiens
taatccaatccactaacact

SEQ ID NO: 880713 - DNA, 18 bp, Homo sapiens
taatccagtattgctgat

SEQ ID NO: 880714 - DNA, 21 bp, Homo sapiens
taatcccagcactttgggagg

SEQ ID NO: 880715 - DNA, 23 bp, Homo sapiens
taatcccagcactttgggaggcc

SEQ ID NO: 880716 - DNA, 20 bp, Homo sapiens
taatcccagctactcaggag

SEQ ID NO: 880717 - DNA, 19 bp, Homo sapiens
taatcccagctacttggga

SEQ ID NO: 880718 - DNA, 20 bp, Homo sapiens
taatcccatttcccaaacct

SEQ ID NO: 880719 - DNA, 15 bp, Homo sapiens
taatccccatcatta

SEQ ID NO: 880720 - DNA, 17 bp, Homo sapiens
taatccccatcattact

SEQ ID NO: 880721 - DNA, 14 bp, Homo sapiens
taatcccctgcact

SEQ ID NO: 880722 - DNA, 19 bp, Homo sapiens
taatccctgggcattgctt

SEQ ID NO: 880723 - DNA, 19 bp, Homo sapiens
taatccgaatctctttttg

SEQ ID NO: 880724 - DNA, 21 bp, Homo sapiens
taatcctatctggggagctcc

SEQ ID NO: 880725 - DNA, 23 bp, Homo sapiens
taatcctatctggggagctcctg

SEQ ID NO: 880726 - DNA, 19 bp, Homo sapiens
taatccttctagtttccca

SEQ ID NO: 880727 - DNA, 21 bp, Homo sapiens
taatccttctagtttcccaca

SEQ ID NO: 880728 - DNA, 16 bp, Homo sapiens
taatcctttgttttct

SEQ ID NO: 880729 - DNA, 14 bp, Homo sapiens
taatcgatgaatgt

SEQ ID NO: 880730 - DNA, 14 bp, Homo sapiens
taatctaaaatgat

SEQ ID NO: 880731 - DNA, 13 bp, Homo sapiens
taatctaaatgga

SEQ ID NO: 880732 - DNA, 15 bp, Homo sapiens
taatctactgtaaag

SEQ ID NO: 880733 - DNA, 21 bp, Homo sapiens
taatctactttttgtatttag

SEQ ID NO: 880734 - DNA, 14 bp, Homo sapiens
taatctagacaata

SEQ ID NO: 880735 - DNA, 17 bp, Homo sapiens
taatctagatatcgact

SEQ ID NO: 880736 - DNA, 20 bp, Homo sapiens
taatctagtgacacctcagt

SEQ ID NO: 880737 - DNA, 17 bp, Homo sapiens
taatctatattaaatga

SEQ ID NO: 880738 - DNA, 18 bp, Homo sapiens
taatctatgtgtttctgt

SEQ ID NO: 880739 - DNA, 19 bp, Homo sapiens
taatctatgtgtttctgta

SEQ ID NO: 880740 - DNA, 23 bp, Homo sapiens
taatctatgtgtttctgtaacaa

SEQ ID NO: 880741 - DNA, 17 bp, Homo sapiens
taatctcctctgctcat

SEQ ID NO: 880742 - DNA, 18 bp, Homo sapiens
taatctcctcttttatct

SEQ ID NO: 880743 - DNA, 19 bp, Homo sapiens
taatctctctctctttttt

SEQ ID NO: 880744 - DNA, 19 bp, Homo sapiens
taatctctctgcagctgcc

SEQ ID NO: 880745 - DNA, 23 bp, Homo sapiens
taatctctgattccctgatttaa

SEQ ID NO: 880746 - DNA, 22 bp, Homo sapiens
taatctctttggttcctgtata

SEQ ID NO: 880747 - DNA, 14 bp, Homo sapiens
taatctgaaaattt

SEQ ID NO: 880748 - DNA, 21 bp, Homo sapiens
taatctgaaaggatgtggaag

SEQ ID NO: 880749 - DNA, 13 bp, Homo sapiens
taatctgaagata

SEQ ID NO: 880750 - DNA, 23 bp, Homo sapiens
taatctgaagatatatttcactt

SEQ ID NO: 880751 - DNA, 11 bp, Homo sapiens
taatctgcctg

SEQ ID NO: 880752 - DNA, 19 bp, Homo sapiens
taatctgcctggttttatt

SEQ ID NO: 880753 - DNA, 17 bp, Homo sapiens
taatctggactcctctg

SEQ ID NO: 880754 - DNA, 19 bp, Homo sapiens
taatctggactcctctgtc

SEQ ID NO: 880755 - DNA, 21 bp, Homo sapiens
taatctggactcctctgtcca

SEQ ID NO: 880756 - DNA, 12 bp, Homo sapiens
taatctggatgt

SEQ ID NO: 880757 - DNA, 15 bp, Homo sapiens
taatctgtcaaaaca

SEQ ID NO: 880758 - DNA, 22 bp, Homo sapiens
taatctgtttgtgcaaacataa

SEQ ID NO: 880759 - DNA, 16 bp, Homo sapiens
taatcttaatgtatat

SEQ ID NO: 880760 - DNA, 18 bp, Homo sapiens
taatcttataattgttct

SEQ ID NO: 880761 - DNA, 17 bp, Homo sapiens
taatcttattttatctt

SEQ ID NO: 880762 - DNA, 15 bp, Homo sapiens
taatcttctgccttc

SEQ ID NO: 880763 - DNA, 16 bp, Homo sapiens
taatcttgaatgtttg

SEQ ID NO: 880764 - DNA, 16 bp, Homo sapiens
taatcttgaattgtaa

SEQ ID NO: 880765 - DNA, 20 bp, Homo sapiens
taatcttgctttctttagaa

SEQ ID NO: 880766 - DNA, 17 bp, Homo sapiens
taatcttggcttcttaa

SEQ ID NO: 880767 - DNA, 21 bp, Homo sapiens
taatcttggcttcttaaaaac

SEQ ID NO: 880768 - DNA, 13 bp, Homo sapiens
taatcttgtgtag

SEQ ID NO: 880769 - DNA, 19 bp, Homo sapiens
taatctttacctgtataca

SEQ ID NO: 880770 - DNA, 22 bp, Homo sapiens
taatctttatactgggtttcaa

SEQ ID NO: 880771 - DNA, 21 bp, Homo sapiens
taatctttcacttgaaagatt

SEQ ID NO: 880772 - DNA, 21 bp, Homo sapiens
taatctttctttacctgagac

SEQ ID NO: 880773 - DNA, 22 bp, Homo sapiens
taatctttgggtaacttcaaaa

SEQ ID NO: 880774 - DNA, 19 bp, Homo sapiens
taatctttttctccaccca

SEQ ID NO: 880775 - DNA, 17 bp, Homo sapiens
taatgaaaaacaaaaag

SEQ ID NO: 880776 - DNA, 18 bp, Homo sapiens
taatgaaaaacaaaaagc

SEQ ID NO: 880777 - DNA, 13 bp, Homo sapiens
taatgaaaacaat

SEQ ID NO: 880778 - DNA, 21 bp, Homo sapiens
taatgaaaaggaagttaatac

SEQ ID NO: 880779 - DNA, 18 bp, Homo sapiens
taatgaaaatgaatatct

SEQ ID NO: 880780 - DNA, 13 bp, Homo sapiens
taatgaaaatgtc

SEQ ID NO: 880781 - DNA, 14 bp, Homo sapiens
taatgaaagactgt

SEQ ID NO: 880782 - DNA, 22 bp, Homo sapiens
taatgaaagactgtacaaagta

SEQ ID NO: 880783 - DNA, 14 bp, Homo sapiens
taatgaaatctgtt

SEQ ID NO: 880784 - DNA, 19 bp, Homo sapiens
taatgaaatctgtttgttg

SEQ ID NO: 880785 - DNA, 17 bp, Homo sapiens
taatgaaatgataaaga

SEQ ID NO: 880786 - DNA, 20 bp, Homo sapiens
taatgaaatgataaagactt

SEQ ID NO: 880787 - DNA, 21 bp, Homo sapiens
taatgaaatgataaagacttt

SEQ ID NO: 880788 - DNA, 15 bp, Homo sapiens
taatgaaatgtttac

SEQ ID NO: 880789 - DNA, 19 bp, Homo sapiens
taatgaacaaatatgcttt

SEQ ID NO: 880790 - DNA, 13 bp, Homo sapiens
taatgaacaaatg

SEQ ID NO: 880791 - DNA, 21 bp, Homo sapiens
taatgaactaccatctgatgt

SEQ ID NO: 880792 - DNA, 14 bp, Homo sapiens
taatgaactttgaa

SEQ ID NO: 880793 - DNA, 22 bp, Homo sapiens
taatgaagggaaaggatatttt

SEQ ID NO: 880794 - DNA, 17 bp, Homo sapiens
taatgaataaactgaat

SEQ ID NO: 880795 - DNA, 23 bp, Homo sapiens
taatgaataaactgaatattttg

SEQ ID NO: 880796 - DNA, 15 bp, Homo sapiens
taatgaatggactca

SEQ ID NO: 880797 - DNA, 15 bp, Homo sapiens
taatgaattataaca

SEQ ID NO: 880798 - DNA, 19 bp, Homo sapiens
taatgaattataacagtta

SEQ ID NO: 880799 - DNA, 19 bp, Homo sapiens
taatgatgttgataatttc

SEQ ID NO: 880800 - DNA, 21 bp, Homo sapiens
taatgattcaaatgttttaaa

SEQ ID NO: 880801 - DNA, 23 bp, Homo sapiens
taatgcaaaaggctgattactga

SEQ ID NO: 880802 - DNA, 21 bp, Homo sapiens
taatgcaaaatttttttaatc

SEQ ID NO: 880803 - DNA, 12 bp, Homo sapiens
taatgcactttc

SEQ ID NO: 880804 - DNA, 22 bp, Homo sapiens
taatgcagccacgattggagaa

SEQ ID NO: 880805 - DNA, 17 bp, Homo sapiens
taatgcatgttaggaaa

SEQ ID NO: 880806 - DNA, 17 bp, Homo sapiens
taatgcattaaacctgt

SEQ ID NO: 880807 - DNA, 22 bp, Homo sapiens
taatgcattaaacctgtctcca

SEQ ID NO: 880808 - DNA, 13 bp, Homo sapiens
taatgcccagcca

SEQ ID NO: 880809 - DNA, 22 bp, Homo sapiens
taatgcccagccagccacccct

SEQ ID NO: 880810 - DNA, 23 bp, Homo sapiens
taatgcccagccagccacccctg

SEQ ID NO: 880811 - DNA, 18 bp, Homo sapiens
taatgcctcttcattctt

SEQ ID NO: 880812 - DNA, 15 bp, Homo sapiens
taatgcctgcttttt

SEQ ID NO: 880813 - DNA, 21 bp, Homo sapiens
taatgccttactcttcttgaa

SEQ ID NO: 880814 - DNA, 14 bp, Homo sapiens
taatgcgtgcatac

SEQ ID NO: 880815 - DNA, 15 bp, Homo sapiens
taatgcgtgcatacc

SEQ ID NO: 880816 - DNA, 13 bp, Homo sapiens
taatgctactgtc

SEQ ID NO: 880817 - DNA, 17 bp, Homo sapiens
taatgctcccatctcct

SEQ ID NO: 880818 - DNA, 15 bp, Homo sapiens
taatgctctatgttt

SEQ ID NO: 880819 - DNA, 16 bp, Homo sapiens
taatgctgcacttcct

SEQ ID NO: 880820 - DNA, 12 bp, Homo sapiens
taatgctgcctt

SEQ ID NO: 880821 - DNA, 16 bp, Homo sapiens
taatgctggcctgact

SEQ ID NO: 880822 - DNA, 17 bp, Homo sapiens
taatgctgtctttgtgg

SEQ ID NO: 880823 - DNA, 19 bp, Homo sapiens
taatgctgtttctaagaaa

SEQ ID NO: 880824 - DNA, 19 bp, Homo sapiens
taatgcttagagaatgttc

SEQ ID NO: 880825 - DNA, 16 bp, Homo sapiens
taatgcttcaagtgtt

SEQ ID NO: 880826 - DNA, 20 bp, Homo sapiens
taatgcttcattcaatattg

SEQ ID NO: 880827 - DNA, 13 bp, Homo sapiens
taatgctttctga

SEQ ID NO: 880828 - DNA, 23 bp, Homo sapiens
taatgctttttgagtttcatgtt

SEQ ID NO: 880829 - DNA, 18 bp, Homo sapiens
taatggaaacatttacaa

SEQ ID NO: 880830 - DNA, 23 bp, Homo sapiens
taatggaagtgtatttattttac

SEQ ID NO: 880831 - DNA, 15 bp, Homo sapiens
taatggactgtgaat

SEQ ID NO: 880832 - DNA, 17 bp, Homo sapiens
taatggagcatcaagcc

SEQ ID NO: 880833 - DNA, 21 bp, Homo sapiens
taatggcagttatattttgca

SEQ ID NO: 880834 - DNA, 15 bp, Homo sapiens
taatggcatttctct

SEQ ID NO: 880835 - DNA, 20 bp, Homo sapiens
taatgggggtagcagctgga

SEQ ID NO: 880836 - DNA, 18 bp, Homo sapiens
taatggggtcctggccat

SEQ ID NO: 880837 - DNA, 16 bp, Homo sapiens
taatgggtaattctga

SEQ ID NO: 880838 - DNA, 18 bp, Homo sapiens
taatgggtttcatatttc

SEQ ID NO: 880839 - DNA, 18 bp, Homo sapiens
taatggtatcctactgag

SEQ ID NO: 880840 - DNA, 22 bp, Homo sapiens
taatggtatcctactgagcatt

SEQ ID NO: 880841 - DNA, 15 bp, Homo sapiens
taatggtcccatcca

SEQ ID NO: 880842 - DNA, 19 bp, Homo sapiens
taatggtgtagaacactaa

SEQ ID NO: 880843 - DNA, 22 bp, Homo sapiens
taatggttgtgaaatgtaacat

SEQ ID NO: 880844 - DNA, 14 bp, Homo sapiens
taatggtttttatt

SEQ ID NO: 880845 - DNA, 19 bp, Homo sapiens
taatggtttttatttctcg

SEQ ID NO: 880846 - DNA, 14 bp, Homo sapiens
taatgtaaaatgtt

SEQ ID NO: 880847 - DNA, 19 bp, Homo sapiens
taatgtaaactttgtcatg

SEQ ID NO: 880848 - DNA, 17 bp, Homo sapiens
taatgtaattcaggact

SEQ ID NO: 880849 - DNA, 20 bp, Homo sapiens
taatgtacagagtggcccct

SEQ ID NO: 880850 - DNA, 19 bp, Homo sapiens
taatgtactgatttcagta

SEQ ID NO: 880851 - DNA, 13 bp, Homo sapiens
taatgtatataaa

SEQ ID NO: 880852 - DNA, 14 bp, Homo sapiens
taatgtatataaaa

SEQ ID NO: 880853 - DNA, 15 bp, Homo sapiens
taatgtatatttgct

SEQ ID NO: 880854 - DNA, 22 bp, Homo sapiens
taatgtatatttgctgcaaaga

SEQ ID NO: 880855 - DNA, 19 bp, Homo sapiens
taatgtatcaaatacattt

SEQ ID NO: 880856 - DNA, 16 bp, Homo sapiens
taatgtatttgaaaat

SEQ ID NO: 880857 - DNA, 23 bp, Homo sapiens
taatgtatttgaaaattacatgt

SEQ ID NO: 880858 - DNA, 13 bp, Homo sapiens
taatgtattttca

SEQ ID NO: 880859 - DNA, 15 bp, Homo sapiens
taatgtcaccacctt

SEQ ID NO: 880860 - DNA, 22 bp, Homo sapiens
taatgtcaccaccttcccagct

SEQ ID NO: 880861 - DNA, 16 bp, Homo sapiens
taatgtcactgttttt

SEQ ID NO: 880862 - DNA, 19 bp, Homo sapiens
taatgtcagactttgctgc

SEQ ID NO: 880863 - DNA, 15 bp, Homo sapiens
taatgtcatggcctt

SEQ ID NO: 880864 - DNA, 13 bp, Homo sapiens
taatgtcattgct

SEQ ID NO: 880865 - DNA, 19 bp, Homo sapiens
taatgtctcactgttctgc

SEQ ID NO: 880866 - DNA, 19 bp, Homo sapiens
taatgtcttcatttcattg

SEQ ID NO: 880867 - DNA, 15 bp, Homo sapiens
taatgtgaaaatcat

SEQ ID NO: 880868 - DNA, 23 bp, Homo sapiens
taatgtgaaactggattaaactt

SEQ ID NO: 880869 - DNA, 15 bp, Homo sapiens
taatgtgaagacatt

SEQ ID NO: 880870 - DNA, 16 bp, Homo sapiens
taatgtgaagacattt

SEQ ID NO: 880871 - DNA, 13 bp, Homo sapiens
taatgtgaatttt

SEQ ID NO: 880872 - DNA, 20 bp, Homo sapiens
taatgtgagtttggtctgga

SEQ ID NO: 880873 - DNA, 21 bp, Homo sapiens
taatgtgatggatggcacaat

SEQ ID NO: 880874 - DNA, 22 bp, Homo sapiens
taatgtgatggatggcacaatg

SEQ ID NO: 880875 - DNA, 21 bp, Homo sapiens
taatgtgcaaattttgcattt

SEQ ID NO: 880876 - DNA, 15 bp, Homo sapiens
taatgtgtctgtgtt

SEQ ID NO: 880877 - DNA, 12 bp, Homo sapiens
taatgttactga

SEQ ID NO: 880878 - DNA, 21 bp, Homo sapiens
taatgttactgatcatgcatt

SEQ ID NO: 880879 - DNA, 15 bp, Homo sapiens
taatgttctgtgata

SEQ ID NO: 880880 - DNA, 11 bp, Homo sapiens
taatgttgaat

SEQ ID NO: 880881 - DNA, 13 bp, Homo sapiens
taatgttgaatgt

SEQ ID NO: 880882 - DNA, 21 bp, Homo sapiens
taatgttggacagacactgtt

SEQ ID NO: 880883 - DNA, 21 bp, Homo sapiens
taatgttgggtagaaagagat

SEQ ID NO: 880884 - DNA, 23 bp, Homo sapiens
taatgttgttccttttgaaagaa

SEQ ID NO: 880885 - DNA, 12 bp, Homo sapiens
taatgtttaaat

SEQ ID NO: 880886 - DNA, 17 bp, Homo sapiens
taatgtttatgagccag

SEQ ID NO: 880887 - DNA, 16 bp, Homo sapiens
taatgtttattaaatg

SEQ ID NO: 880888 - DNA, 17 bp, Homo sapiens
taatgtttatttagctc

SEQ ID NO: 880889 - DNA, 15 bp, Homo sapiens
taatgtttgatttag

SEQ ID NO: 880890 - DNA, 16 bp, Homo sapiens
taatgttttaaatgta

SEQ ID NO: 880891 - DNA, 17 bp, Homo sapiens
taatgttttaaatgtac

SEQ ID NO: 880892 - DNA, 21 bp, Homo sapiens
taatgttttcattatgttcat

SEQ ID NO: 880893 - DNA, 19 bp, Homo sapiens
taatgttttctttgcaaag

SEQ ID NO: 880894 - DNA, 17 bp, Homo sapiens
taatgttttgtacaatt

SEQ ID NO: 880895 - DNA, 21 bp, Homo sapiens
taatgttttttgccacagctt

SEQ ID NO: 880896 - DNA, 22 bp, Homo sapiens
taattaaaaaaaatccttgtga

SEQ ID NO: 880897 - DNA, 13 bp, Homo sapiens
taattaaaaactt

SEQ ID NO: 880898 - DNA, 20 bp, Homo sapiens
taattaaaaactttaaagat

SEQ ID NO: 880899 - DNA, 10 bp, Homo sapiens
taattaaaag

SEQ ID NO: 880900 - DNA, 13 bp, Homo sapiens
taattaaaagact

SEQ ID NO: 880901 - DNA, 22 bp, Homo sapiens
taattaaaatctggaaatctgt

SEQ ID NO: 880902 - DNA, 17 bp, Homo sapiens
taattaaactagtttaa

SEQ ID NO: 880903 - DNA, 18 bp, Homo sapiens
taattaaactagtttaag

SEQ ID NO: 880904 - DNA, 14 bp, Homo sapiens
taattaaagcacac

SEQ ID NO: 880905 - DNA, 22 bp, Homo sapiens
taattaaataaatcattaatac

SEQ ID NO: 880906 - DNA, 14 bp, Homo sapiens
taattaaataatac

SEQ ID NO: 880907 - DNA, 19 bp, Homo sapiens
taattaaatgaacttatgt

SEQ ID NO: 880908 - DNA, 14 bp, Homo sapiens
taattaaatttaac

SEQ ID NO: 880909 - DNA, 20 bp, Homo sapiens
taattgttgaacaggtgttt

SEQ ID NO: 880910 - DNA, 13 bp, Homo sapiens
taattgttgatat

SEQ ID NO: 880911 - DNA, 18 bp, Homo sapiens
taattgttggagtattta

SEQ ID NO: 880912 - DNA, 13 bp, Homo sapiens
taattgttgtgtg

SEQ ID NO: 880913 - DNA, 15 bp, Homo sapiens
taattgttgttctgt

SEQ ID NO: 880914 - DNA, 18 bp, Homo sapiens
taattgttgttctgttaa

SEQ ID NO: 880915 - DNA, 21 bp, Homo sapiens
taattgttgttctgttaactg

SEQ ID NO: 880916 - DNA, 18 bp, Homo sapiens
taattgtttccaacttgt

SEQ ID NO: 880917 - DNA, 21 bp, Homo sapiens
taattgttttttaaagcaagt

SEQ ID NO: 880918 - DNA, 17 bp, Homo sapiens
taatttaaaaagtgcta

SEQ ID NO: 880919 - DNA, 14 bp, Homo sapiens
taatttaaaaatat

SEQ ID NO: 880920 - DNA, 19 bp, Homo sapiens
taatttaaaacttttgttt

SEQ ID NO: 880921 - DNA, 20 bp, Homo sapiens
taatttaaacaggcccagca

SEQ ID NO: 880922 - DNA, 21 bp, Homo sapiens
taatttaaacatttgttcctg

SEQ ID NO: 880923 - DNA, 23 bp, Homo sapiens
taatttaaacatttgttcctgga

SEQ ID NO: 880924 - DNA, 12 bp, Homo sapiens
taatttaaagcc

SEQ ID NO: 880925 - DNA, 19 bp, Homo sapiens
taatttaaagccacaacca

SEQ ID NO: 880926 - DNA, 19 bp, Homo sapiens
taatttaactttctgggtt

SEQ ID NO: 880927 - DNA, 19 bp, Homo sapiens
taatttaagtcattttcat

SEQ ID NO: 880928 - DNA, 20 bp, Homo sapiens
taatttaagtcattttcatg

SEQ ID NO: 880929 - DNA, 21 bp, Homo sapiens
taatttaatgcatgttaggaa

SEQ ID NO: 880930 - DNA, 12 bp, Homo sapiens
taatttaatggg

SEQ ID NO: 880931 - DNA, 14 bp, Homo sapiens
taatttaatgtatt

SEQ ID NO: 880932 - DNA, 19 bp, Homo sapiens
taatttacaaaaatataaa

SEQ ID NO: 880933 - DNA, 18 bp, Homo sapiens
taatttactttgtagact

SEQ ID NO: 880934 - DNA, 16 bp, Homo sapiens
taatttagaaaacttt

SEQ ID NO: 880935 - DNA, 12 bp, Homo sapiens
taatttagaaac

SEQ ID NO: 880936 - DNA, 23 bp, Homo sapiens
taatttagaaactgatttcttca

SEQ ID NO: 880937 - DNA, 20 bp, Homo sapiens
taatttagaagatattattt

SEQ ID NO: 880938 - DNA, 17 bp, Homo sapiens
taatttagacttggatt

SEQ ID NO: 880939 - DNA, 14 bp, Homo sapiens
taatttagagcgtt

SEQ ID NO: 880940 - DNA, 20 bp, Homo sapiens
taatttagagcgtttggtta

SEQ ID NO: 880941 - DNA, 20 bp, Homo sapiens
taatttagtaaatgttatct

SEQ ID NO: 880942 - DNA, 21 bp, Homo sapiens
taatttagtggatggaatatc

SEQ ID NO: 880943 - DNA, 17 bp, Homo sapiens
taatttagtttcatata

SEQ ID NO: 880944 - DNA, 13 bp, Homo sapiens
taatttataaaaa

SEQ ID NO: 880945 - DNA, 16 bp, Homo sapiens
taatttataaaaaggt

SEQ ID NO: 880946 - DNA, 15 bp, Homo sapiens
taatttataatgtat

SEQ ID NO: 880947 - DNA, 14 bp, Homo sapiens
taatttatatctaa

SEQ ID NO: 880948 - DNA, 20 bp, Homo sapiens
taatttattaattgctttga

SEQ ID NO: 880949 - DNA, 14 bp, Homo sapiens
taatttattattaa

SEQ ID NO: 880950 - DNA, 17 bp, Homo sapiens
taatttattattgaaat

SEQ ID NO: 880951 - DNA, 11 bp, Homo sapiens
taatttattgg

SEQ ID NO: 880952 - DNA, 12 bp, Homo sapiens
taatttattggg

SEQ ID NO: 880953 - DNA, 15 bp, Homo sapiens
taatttatttcatcc

SEQ ID NO: 880954 - DNA, 12 bp, Homo sapiens
taatttatttgt

SEQ ID NO: 880955 - DNA, 14 bp, Homo sapiens
taatttatttgttt

SEQ ID NO: 880956 - DNA, 14 bp, Homo sapiens
taatttattttgct

SEQ ID NO: 880957 - DNA, 17 bp, Homo sapiens
taatttcaaaaatataa

SEQ ID NO: 880958 - DNA, 19 bp, Homo sapiens
taatttcaaaaatataact

SEQ ID NO: 880959 - DNA, 16 bp, Homo sapiens
taatttcaaaatacat

SEQ ID NO: 880960 - DNA, 15 bp, Homo sapiens
taatttcaaaatgct

SEQ ID NO: 880961 - DNA, 16 bp, Homo sapiens
taatttcaaaatgctt

SEQ ID NO: 880962 - DNA, 13 bp, Homo sapiens
taatttcaggaaa

SEQ ID NO: 880963 - DNA, 13 bp, Homo sapiens
taatttcatacta

SEQ ID NO: 880964 - DNA, 24 bp, Homo sapiens
taatttcatactatttagattttc

SEQ ID NO: 880965 - DNA, 18 bp, Homo sapiens
taatttccaggaaaaaat

SEQ ID NO: 880966 - DNA, 16 bp, Homo sapiens
taatttccatttactt

SEQ ID NO: 880967 - DNA, 16 bp, Homo sapiens
taatttcctcactgcc

SEQ ID NO: 880968 - DNA, 17 bp, Homo sapiens
taatttcctcactgcct

SEQ ID NO: 880969 - DNA, 23 bp, Homo sapiens
taatttcctcactgcctggtaaa

SEQ ID NO: 880970 - DNA, 18 bp, Homo sapiens
taatttccttctgttaag

SEQ ID NO: 880971 - DNA, 22 bp, Homo sapiens
taatttccttctgttaagaaag

SEQ ID NO: 880972 - DNA, 20 bp, Homo sapiens
taatttcctttttgacactg

SEQ ID NO: 880973 - DNA, 20 bp, Homo sapiens
taatttctaagaagttactt

SEQ ID NO: 880974 - DNA, 22 bp, Homo sapiens
taatttctactctgtcttaaat

SEQ ID NO: 880975 - DNA, 19 bp, Homo sapiens
taatttctgccatttcatg

SEQ ID NO: 880976 - DNA, 19 bp, Homo sapiens
taatttcttactaaacatt

SEQ ID NO: 880977 - DNA, 23 bp, Homo sapiens
taatttcttcatgtgatgtcatg

SEQ ID NO: 880978 - DNA, 13 bp, Homo sapiens
taatttgaaaaag

SEQ ID NO: 880979 - DNA, 22 bp, Homo sapiens
taatttgaaaacataatctgca

SEQ ID NO: 880980 - DNA, 12 bp, Homo sapiens
taatttgaactg

SEQ ID NO: 880981 - DNA, 13 bp, Homo sapiens
taatttgaatgtg

SEQ ID NO: 880982 - DNA, 20 bp, Homo sapiens
taatttgaatgtggttactt

SEQ ID NO: 880983 - DNA, 13 bp, Homo sapiens
taatttgaattgg

SEQ ID NO: 880984 - DNA, 12 bp, Homo sapiens
taatttgagaat

SEQ ID NO: 880985 - DNA, 18 bp, Homo sapiens
taatttgaggacaaccat

SEQ ID NO: 880986 - DNA, 22 bp, Homo sapiens
taatttgaggacaaccattcca

SEQ ID NO: 880987 - DNA, 12 bp, Homo sapiens
taatttgatctt

SEQ ID NO: 880988 - DNA, 20 bp, Homo sapiens
taatttgatgaaagctgatt

SEQ ID NO: 880989 - DNA, 17 bp, Homo sapiens
taatttgatgaggtatt

SEQ ID NO: 880990 - DNA, 21 bp, Homo sapiens
taatttgatggtatttctttc

SEQ ID NO: 880991 - DNA, 13 bp, Homo sapiens
taatttgcacagt

SEQ ID NO: 880992 - DNA, 16 bp, Homo sapiens
taatttgcattaaatt

SEQ ID NO: 880993 - DNA, 17 bp, Homo sapiens
taatttgcattaaattc

SEQ ID NO: 880994 - DNA, 15 bp, Homo sapiens
taatttgccattttt

SEQ ID NO: 880995 - DNA, 17 bp, Homo sapiens
taatttggagcacaaaa

SEQ ID NO: 880996 - DNA, 17 bp, Homo sapiens
taatttggataataaaa

SEQ ID NO: 880997 - DNA, 17 bp, Homo sapiens
taatttggggaaaatga

SEQ ID NO: 880998 - DNA, 13 bp, Homo sapiens
taatttgtaaact

SEQ ID NO: 880999 - DNA, 18 bp, Homo sapiens
taatttgtaaacttctga

SEQ ID NO: 881000 - DNA, 12 bp, Homo sapiens
taatttgtaaag

SEQ ID NO: 881001 - DNA, 13 bp, Homo sapiens
taatttgtaaagt

SEQ ID NO: 881002 - DNA, 15 bp, Homo sapiens
taatttgtaaattga

SEQ ID NO: 881003 - DNA, 14 bp, Homo sapiens
taatttgtacaatg

SEQ ID NO: 881004 - DNA, 18 bp, Homo sapiens
taatttgtacaggggcca

SEQ ID NO: 881005 - DNA, 16 bp, Homo sapiens
taatttgtatgctaaa

SEQ ID NO: 881006 - DNA, 15 bp, Homo sapiens
taatttgtgaatttg

SEQ ID NO: 881007 - DNA, 17 bp, Homo sapiens
taatttgtgaatttgca

SEQ ID NO: 881008 - DNA, 18 bp, Homo sapiens
taatttgtttaaaattct

SEQ ID NO: 881009 - DNA, 19 bp, Homo sapiens
taatttgtttaaaattctc

SEQ ID NO: 881010 - DNA, 16 bp, Homo sapiens
taatttgtttccagca

SEQ ID NO: 881011 - DNA, 13 bp, Homo sapiens
taattttaaataa

SEQ ID NO: 881012 - DNA, 15 bp, Homo sapiens
taattttaaataacc

SEQ ID NO: 881013 - DNA, 12 bp, Homo sapiens
taattttaactg

SEQ ID NO: 881014 - DNA, 14 bp, Homo sapiens
taattttaactgat

SEQ ID NO: 881015 - DNA, 14 bp, Homo sapiens
taattttacaattt

SEQ ID NO: 881016 - DNA, 19 bp, Homo sapiens
taattttacacgcttttgt

SEQ ID NO: 881017 - DNA, 21 bp, Homo sapiens
taattttacatgtttataaat

SEQ ID NO: 881018 - DNA, 22 bp, Homo sapiens
taattttacatgtttataaatc

SEQ ID NO: 881019 - DNA, 23 bp, Homo sapiens
taattttagtattcattctgcat

SEQ ID NO: 881020 - DNA, 16 bp, Homo sapiens
taattttattcaagaa

SEQ ID NO: 881021 - DNA, 17 bp, Homo sapiens
taattttatttataaac

SEQ ID NO: 881022 - DNA, 18 bp, Homo sapiens
taattttattttaaaatt

SEQ ID NO: 881023 - DNA, 21 bp, Homo sapiens
taattttctagattttctact

SEQ ID NO: 881024 - DNA, 20 bp, Homo sapiens
taattttcttggttctttca

SEQ ID NO: 881025 - DNA, 17 bp, Homo sapiens
taattttgacactgaaa

SEQ ID NO: 881026 - DNA, 18 bp, Homo sapiens
taattttgcatactgaaa

SEQ ID NO: 881027 - DNA, 19 bp, Homo sapiens
taattttgcatactgaaaa

SEQ ID NO: 881028 - DNA, 21 bp, Homo sapiens
taattttgcatactgaaaatc

SEQ ID NO: 881029 - DNA, 14 bp, Homo sapiens
taattttgccttta

SEQ ID NO: 881030 - DNA, 20 bp, Homo sapiens
taattttggaataatttcta

SEQ ID NO: 881031 - DNA, 21 bp, Homo sapiens
taattttggaataatttctat

SEQ ID NO: 881032 - DNA, 19 bp, Homo sapiens
taattttgtaatgtatcaa

SEQ ID NO: 881033 - DNA, 14 bp, Homo sapiens
taattttgtgcatt

SEQ ID NO: 881034 - DNA, 15 bp, Homo sapiens
tacaataaatattct

SEQ ID NO: 881035 - DNA, 14 bp, Homo sapiens
tacaataacccagt

SEQ ID NO: 881036 - DNA, 20 bp, Homo sapiens
tacaataataaatcctcagg

SEQ ID NO: 881037 - DNA, 14 bp, Homo sapiens
tacaatacaatgta

SEQ ID NO: 881038 - DNA, 16 bp, Homo sapiens
tacaatacaatgtaca

SEQ ID NO: 881039 - DNA, 18 bp, Homo sapiens
tacaataccgttaagata

SEQ ID NO: 881040 - DNA, 15 bp, Homo sapiens
tacaatatgaaaagg

SEQ ID NO: 881041 - DNA, 20 bp, Homo sapiens
tacaatcaaaggaaaatagt

SEQ ID NO: 881042 - DNA, 18 bp, Homo sapiens
tacaatctgtatctttga

SEQ ID NO: 881043 - DNA, 13 bp, Homo sapiens
tacaatgacttta

SEQ ID NO: 881044 - DNA, 12 bp, Homo sapiens
tacaatgatggt

SEQ ID NO: 881045 - DNA, 13 bp, Homo sapiens
tacaatggccatg

SEQ ID NO: 881046 - DNA, 21 bp, Homo sapiens
tacaatggcccgacatttctt

SEQ ID NO: 881047 - DNA, 22 bp, Homo sapiens
tacaatggtcatttccagacaa

SEQ ID NO: 881048 - DNA, 13 bp, Homo sapiens
tacaatggtttat

SEQ ID NO: 881049 - DNA, 20 bp, Homo sapiens
tacaatggtttattcccaag

SEQ ID NO: 881050 - DNA, 14 bp, Homo sapiens
tacaatgtaaacca

SEQ ID NO: 881051 - DNA, 17 bp, Homo sapiens
tacaatgtacaattatg

SEQ ID NO: 881052 - DNA, 13 bp, Homo sapiens
tacaatgtattaa

SEQ ID NO: 881053 - DNA, 17 bp, Homo sapiens
tacaatgtcatatactg

SEQ ID NO: 881054 - DNA, 16 bp, Homo sapiens
tacaatgtgaacttta

SEQ ID NO: 881055 - DNA, 22 bp, Homo sapiens
tacaatgtgaactttattaaat

SEQ ID NO: 881056 - DNA, 17 bp, Homo sapiens
tacaatgttatcaacca

SEQ ID NO: 881057 - DNA, 14 bp, Homo sapiens
tacaatgttgtatt

SEQ ID NO: 881058 - DNA, 16 bp, Homo sapiens
tacaatgttgtatttg

SEQ ID NO: 881059 - DNA, 18 bp, Homo sapiens
tacaatgttgtatttgtt

SEQ ID NO: 881060 - DNA, 19 bp, Homo sapiens
tacaatgttgtatttgtta

SEQ ID NO: 881061 - DNA, 12 bp, Homo sapiens
tacaatgtttta

SEQ ID NO: 881062 - DNA, 12 bp, Homo sapiens
tacaattaaagg

SEQ ID NO: 881063 - DNA, 21 bp, Homo sapiens
tacaattaaaggtcctgccct

SEQ ID NO: 881064 - DNA, 19 bp, Homo sapiens
tacaattatatcagtcctc

SEQ ID NO: 881065 - DNA, 19 bp, Homo sapiens
tacaattatgtctcttgag

SEQ ID NO: 881066 - DNA, 22 bp, Homo sapiens
tacaattatttttacagttctc

SEQ ID NO: 881067 - DNA, 13 bp, Homo sapiens
tacaattgaaatg

SEQ ID NO: 881068 - DNA, 14 bp, Homo sapiens
tacaattgatcttt

SEQ ID NO: 881069 - DNA, 22 bp, Homo sapiens
tacaatttacaaagtgtgtatt

SEQ ID NO: 881070 - DNA, 22 bp, Homo sapiens
tacaatttgcacaatatttctt

SEQ ID NO: 881071 - DNA, 16 bp, Homo sapiens
tacaatttgttaattc

SEQ ID NO: 881072 - DNA, 17 bp, Homo sapiens
tacaattttaaagttct

SEQ ID NO: 881073 - DNA, 21 bp, Homo sapiens
tacaattttaaagttcttatt

SEQ ID NO: 881074 - DNA, 22 bp, Homo sapiens
tacaattttaaagttcttattt

SEQ ID NO: 881075 - DNA, 18 bp, Homo sapiens
tacaattttatctgtttc

SEQ ID NO: 881076 - DNA, 21 bp, Homo sapiens
tacaattttctcccaggaagc

SEQ ID NO: 881077 - DNA, 19 bp, Homo sapiens
tacaatttttaataaattg

SEQ ID NO: 881078 - DNA, 17 bp, Homo sapiens
tacaatttttatttctt

SEQ ID NO: 881079 - DNA, 22 bp, Homo sapiens
tacaatttttatttcttttact

SEQ ID NO: 881080 - DNA, 14 bp, Homo sapiens
tacacaactcactc

SEQ ID NO: 881081 - DNA, 17 bp, Homo sapiens
tacacaactttgcaaat

SEQ ID NO: 881082 - DNA, 21 bp, Homo sapiens
tacacaatatacgaaaagcca

SEQ ID NO: 881083 - DNA, 16 bp, Homo sapiens
tacacaatgaattctt

SEQ ID NO: 881084 - DNA, 21 bp, Homo sapiens
tacacaatggtttttaaattt

SEQ ID NO: 881085 - DNA, 20 bp, Homo sapiens
tacacaattaattcatccct

SEQ ID NO: 881086 - DNA, 14 bp, Homo sapiens
tacacacacagcct

SEQ ID NO: 881087 - DNA, 12 bp, Homo sapiens
tacacacatata

SEQ ID NO: 881088 - DNA, 13 bp, Homo sapiens
tacacacatatac

SEQ ID NO: 881089 - DNA, 21 bp, Homo sapiens
tacacacatatacatatatat

SEQ ID NO: 881090 - DNA, 13 bp, Homo sapiens
tacacacatatat

SEQ ID NO: 881091 - DNA, 18 bp, Homo sapiens
tacacacatgccctcctg

SEQ ID NO: 881092 - DNA, 14 bp, Homo sapiens
tacacacccccaga

SEQ ID NO: 881093 - DNA, 17 bp, Homo sapiens
tacacacgtttgtttct

SEQ ID NO: 881094 - DNA, 17 bp, Homo sapiens
tacacactgcatgtttg

SEQ ID NO: 881095 - DNA, 17 bp, Homo sapiens
tacacactgtacacata

SEQ ID NO: 881096 - DNA, 21 bp, Homo sapiens
tacacagaaatgctgctggcc

SEQ ID NO: 881097 - DNA, 13 bp, Homo sapiens
tacacagacatta

SEQ ID NO: 881098 - DNA, 22 bp, Homo sapiens
tacacagagaaatacaaaataa

SEQ ID NO: 881099 - DNA, 12 bp, Homo sapiens
tacacagagaag

SEQ ID NO: 881100 - DNA, 14 bp, Homo sapiens
tacacagagaaggc

SEQ ID NO: 881101 - DNA, 23 bp, Homo sapiens
tacacagcacaccagccgctgca

SEQ ID NO: 881102 - DNA, 17 bp, Homo sapiens
tacacagcaccagaatg

SEQ ID NO: 881103 - DNA, 15 bp, Homo sapiens
tacacaggggccctg

SEQ ID NO: 881104 - DNA, 15 bp, Homo sapiens
tacacagtaaaaact

SEQ ID NO: 881105 - DNA, 16 bp, Homo sapiens
tacacagtaaaaactt

SEQ ID NO: 881106 - DNA, 18 bp, Homo sapiens
tacacagtaagtcattta

SEQ ID NO: 881107 - DNA, 16 bp, Homo sapiens
tacacagtaattgtga

SEQ ID NO: 881108 - DNA, 14 bp, Homo sapiens
tacacagtacttta

SEQ ID NO: 881109 - DNA, 22 bp, Homo sapiens
tacacataagaccgtgtcccaa

SEQ ID NO: 881110 - DNA, 15 bp, Homo sapiens
tacacatacatacat

SEQ ID NO: 881111 - DNA, 23 bp, Homo sapiens
tacacatagcaggggcaccttcc

SEQ ID NO: 881112 - DNA, 18 bp, Homo sapiens
tacacatccccagaatcc

SEQ ID NO: 881113 - DNA, 15 bp, Homo sapiens
tacacatgtaaaata

SEQ ID NO: 881114 - DNA, 17 bp, Homo sapiens
tacacatgtaaaatatg

SEQ ID NO: 881115 - DNA, 21 bp, Homo sapiens
tacacatgtgctgatgtttac

SEQ ID NO: 881116 - DNA, 15 bp, Homo sapiens
tacacattagatttt

SEQ ID NO: 881117 - DNA, 23 bp, Homo sapiens
tacacattagattttattttact

SEQ ID NO: 881118 - DNA, 15 bp, Homo sapiens
tacacatttttcaga

SEQ ID NO: 881119 - DNA, 17 bp, Homo sapiens
tacacatttttcagata

SEQ ID NO: 881120 - DNA, 19 bp, Homo sapiens
tacaccacctcactcctgt

SEQ ID NO: 881121 - DNA, 16 bp, Homo sapiens
tacaccactacattct

SEQ ID NO: 881122 - DNA, 20 bp, Homo sapiens
tacaccactacattctgtta

SEQ ID NO: 881123 - DNA, 20 bp, Homo sapiens
tacaccagagataatatgag

SEQ ID NO: 881124 - DNA, 20 bp, Homo sapiens
tacaccagcattccttttga

SEQ ID NO: 881125 - DNA, 19 bp, Homo sapiens
tacaccatgtttgagctca

SEQ ID NO: 881126 - DNA, 14 bp, Homo sapiens
tacacccagcaata

SEQ ID NO: 881127 - DNA, 14 bp, Homo sapiens
tacaccccttttcc

SEQ ID NO: 881128 - DNA, 17 bp, Homo sapiens
tacaccgactagccagg

SEQ ID NO: 881129 - DNA, 15 bp, Homo sapiens
tacaccgggcctgga

SEQ ID NO: 881130 - DNA, 17 bp, Homo sapiens
tacaccgggcctggaga

SEQ ID NO: 881131 - DNA, 15 bp, Homo sapiens
tacacctaaaggtgt

SEQ ID NO: 881132 - DNA, 12 bp, Homo sapiens
tacacctggctg

SEQ ID NO: 881133 - DNA, 14 bp, Homo sapiens
tacaccttgccttg

SEQ ID NO: 881134 - DNA, 20 bp, Homo sapiens
tacaccttgccttgctgttt

SEQ ID NO: 881135 - DNA, 21 bp, Homo sapiens
tacacgaccatttgataggga

SEQ ID NO: 881136 - DNA, 15 bp, Homo sapiens
tacacgagatttctt

SEQ ID NO: 881137 - DNA, 16 bp, Homo sapiens
tacacgagatttcttt

SEQ ID NO: 881138 - DNA, 17 bp, Homo sapiens
tacacgcttttgtgatg

SEQ ID NO: 881139 - DNA, 13 bp, Homo sapiens
tacacggaaaacg

SEQ ID NO: 881140 - DNA, 19 bp, Homo sapiens
tacacggactgaggtgcct

SEQ ID NO: 881141 - DNA, 13 bp, Homo sapiens
tacacgtgcctgt

SEQ ID NO: 881142 - DNA, 19 bp, Homo sapiens
tacacgttagatttgccgt

SEQ ID NO: 881143 - DNA, 14 bp, Homo sapiens
tacacgtttatctt

SEQ ID NO: 881144 - DNA, 20 bp, Homo sapiens
tacactaagggtgtaagtaa

SEQ ID NO: 881145 - DNA, 19 bp, Homo sapiens
tacactaatatatggacct

SEQ ID NO: 881146 - DNA, 19 bp, Homo sapiens
tacactaccaaacactcag

SEQ ID NO: 881147 - DNA, 17 bp, Homo sapiens
tacactaggaaacgtgt

SEQ ID NO: 881148 - DNA, 15 bp, Homo sapiens
tacactatgataaag

SEQ ID NO: 881149 - DNA, 19 bp, Homo sapiens
tacactcaagcatgaagat

SEQ ID NO: 881150 - DNA, 17 bp, Homo sapiens
tacactccagcctgagc

SEQ ID NO: 881151 - DNA, 18 bp, Homo sapiens
tacactccagcctgagca

SEQ ID NO: 881152 - DNA, 14 bp, Homo sapiens
tacactctgctgtt

SEQ ID NO: 881153 - DNA, 17 bp, Homo sapiens
tacactgaatatttata

SEQ ID NO: 881154 - DNA, 14 bp, Homo sapiens
tacactgaattgaa

SEQ ID NO: 881155 - DNA, 17 bp, Homo sapiens
tacactgaattgaatct

SEQ ID NO: 881156 - DNA, 12 bp, Homo sapiens
tacactgaggac

SEQ ID NO: 881157 - DNA, 16 bp, Homo sapiens
tacactgaggagagat

SEQ ID NO: 881158 - DNA, 14 bp, Homo sapiens
tacactgcactttg

SEQ ID NO: 881159 - DNA, 22 bp, Homo sapiens
tacactgcactttgtttagaaa

SEQ ID NO: 881160 - DNA, 15 bp, Homo sapiens
tacactggatatgtt

SEQ ID NO: 881161 - DNA, 21 bp, Homo sapiens
tacactggtctaatgtttgtg

SEQ ID NO: 881162 - DNA, 16 bp, Homo sapiens
tacactggtgtgtccc

SEQ ID NO: 881163 - DNA, 19 bp, Homo sapiens
tacactgtagtttttgaaa

SEQ ID NO: 881164 - DNA, 22 bp, Homo sapiens
tacactgtattacataaataaa

SEQ ID NO: 881165 - DNA, 16 bp, Homo sapiens
tacactgtatttgtat

SEQ ID NO: 881166 - DNA, 12 bp, Homo sapiens
tacactgtgaac

SEQ ID NO: 881167 - DNA, 16 bp, Homo sapiens
tacactgtgccttttc

SEQ ID NO: 881168 - DNA, 17 bp, Homo sapiens
tacactgtgccttttcc

SEQ ID NO: 881169 - DNA, 18 bp, Homo sapiens
tacactgtgccttttccc

SEQ ID NO: 881170 - DNA, 14 bp, Homo sapiens
tacactgtttcaaa

SEQ ID NO: 881171 - DNA, 16 bp, Homo sapiens
tacacttcctgcttaa

SEQ ID NO: 881172 - DNA, 13 bp, Homo sapiens
tacacttggagcc

SEQ ID NO: 881173 - DNA, 21 bp, Homo sapiens
tacactttatgccggatgtgc

SEQ ID NO: 881174 - DNA, 23 bp, Homo sapiens
tacactttatgccggatgtgctt

SEQ ID NO: 881175 - DNA, 14 bp, Homo sapiens
tacactttgttgca

SEQ ID NO: 881176 - DNA, 21 bp, Homo sapiens
tacagaaagatggatgtgctt

SEQ ID NO: 881177 - DNA, 13 bp, Homo sapiens
tacagaaagctgc

SEQ ID NO: 881178 - DNA, 14 bp, Homo sapiens
tacagaaagctgcc

SEQ ID NO: 881179 - DNA, 19 bp, Homo sapiens
tacagaaatactgctctga

SEQ ID NO: 881180 - DNA, 17 bp, Homo sapiens
tacagaaattagccggg

SEQ ID NO: 881181 - DNA, 16 bp, Homo sapiens
tacagaacacaaatgt

SEQ ID NO: 881182 - DNA, 11 bp, Homo sapiens
tacagaactac

SEQ ID NO: 881183 - DNA, 16 bp, Homo sapiens
tacagaactctttcaa

SEQ ID NO: 881184 - DNA, 19 bp, Homo sapiens
tacagaactctttcaaaac

SEQ ID NO: 881185 - DNA, 18 bp, Homo sapiens
tacagaacttcagaaaga

SEQ ID NO: 881186 - DNA, 19 bp, Homo sapiens
tacagaacttcagaaagac

SEQ ID NO: 881187 - DNA, 22 bp, Homo sapiens
tacagaagccaagctccctgga

SEQ ID NO: 881188 - DNA, 21 bp, Homo sapiens
tacagaagcccatgtcttctg

SEQ ID NO: 881189 - DNA, 18 bp, Homo sapiens
tacagaataatgtgttaa

SEQ ID NO: 881190 - DNA, 19 bp, Homo sapiens
tacagaatagaatacattg

SEQ ID NO: 881191 - DNA, 18 bp, Homo sapiens
tacagaatcattgcttat

SEQ ID NO: 881192 - DNA, 17 bp, Homo sapiens
tacagaatgcattaaaa

SEQ ID NO: 881193 - DNA, 20 bp, Homo sapiens
tacagacaaggttctgccct

SEQ ID NO: 881194 - DNA, 13 bp, Homo sapiens
tacagacactaag

SEQ ID NO: 881195 - DNA, 14 bp, Homo sapiens
tacagacaggaaga

SEQ ID NO: 881196 - DNA, 14 bp, Homo sapiens
tacagacatattta

SEQ ID NO: 881197 - DNA, 15 bp, Homo sapiens
tacagacatatttaa

SEQ ID NO: 881198 - DNA, 22 bp, Homo sapiens
tacagacatggagatgtaaaat

SEQ ID NO: 881199 - DNA, 19 bp, Homo sapiens
tacagaccgaactgttgta

SEQ ID NO: 881200 - DNA, 19 bp, Homo sapiens
tacagactgttttactgtt

SEQ ID NO: 881201 - DNA, 20 bp, Homo sapiens
tacagactgttttactgttt

SEQ ID NO: 881202 - DNA, 15 bp, Homo sapiens
tacagacttctccag

SEQ ID NO: 881203 - DNA, 18 bp, Homo sapiens
tacagagaaattctgtgg

SEQ ID NO: 881204 - DNA, 14 bp, Homo sapiens
tacagagaagaaaa

SEQ ID NO: 881205 - DNA, 20 bp, Homo sapiens
tacagagaatttctaaagta

SEQ ID NO: 881206 - DNA, 16 bp, Homo sapiens
tacagagaggagaaac

SEQ ID NO: 881207 - DNA, 17 bp, Homo sapiens
tacagagaggagaaaca

SEQ ID NO: 881208 - DNA, 20 bp, Homo sapiens
tacagagaggatacatttaa

SEQ ID NO: 881209 - DNA, 15 bp, Homo sapiens
tacagagctttcttt

SEQ ID NO: 881210 - DNA, 10 bp, Homo sapiens
tacagaggac

SEQ ID NO: 881211 - DNA, 15 bp, Homo sapiens
tacagaggaccctta

SEQ ID NO: 881212 - DNA, 15 bp, Homo sapiens
tacagataattcatt

SEQ ID NO: 881213 - DNA, 18 bp, Homo sapiens
tacagataattcatttgt

SEQ ID NO: 881214 - DNA, 19 bp, Homo sapiens
tacagataattcatttgta

SEQ ID NO: 881215 - DNA, 20 bp, Homo sapiens
tacagataattcatttgtat

SEQ ID NO: 881216 - DNA, 24 bp, Homo sapiens
tacagataattcatttgtattgct

SEQ ID NO: 881217 - DNA, 13 bp, Homo sapiens
tacagatttaata

SEQ ID NO: 881218 - DNA, 19 bp, Homo sapiens
tacagcaacaatttatgaa

SEQ ID NO: 881219 - DNA, 20 bp, Homo sapiens
tacagcaacaatttatgaat

SEQ ID NO: 881220 - DNA, 13 bp, Homo sapiens
tacagcacagaat

SEQ ID NO: 881221 - DNA, 17 bp, Homo sapiens
tacagcactactctgtg

SEQ ID NO: 881222 - DNA, 19 bp, Homo sapiens
tacagcactactctgtgcc

SEQ ID NO: 881223 - DNA, 17 bp, Homo sapiens
tacagcactactgggtg

SEQ ID NO: 881224 - DNA, 19 bp, Homo sapiens
tacagcactactgggtgtc

SEQ ID NO: 881225 - DNA, 22 bp, Homo sapiens
tacagcactactgggtgtcatt

SEQ ID NO: 881226 - DNA, 15 bp, Homo sapiens
tacagcattaaaatt

SEQ ID NO: 881227 - DNA, 14 bp, Homo sapiens
tacagcattgtctt

SEQ ID NO: 881228 - DNA, 23 bp, Homo sapiens
tacagcattgtctttgctgtact

SEQ ID NO: 881229 - DNA, 22 bp, Homo sapiens
tacagccaaaaaggaccaactg

SEQ ID NO: 881230 - DNA, 18 bp, Homo sapiens
tacagccaaagataatct

SEQ ID NO: 881231 - DNA, 23 bp, Homo sapiens
tacagccgtcccgcgttcaagac

SEQ ID NO: 881232 - DNA, 20 bp, Homo sapiens
tacagccttaatattttcct

SEQ ID NO: 881233 - DNA, 16 bp, Homo sapiens
tacagcgagaggcaga

SEQ ID NO: 881234 - DNA, 20 bp, Homo sapiens
tacagcgagaggcagagaaa

SEQ ID NO: 881235 - DNA, 20 bp, Homo sapiens
tacagcgcggaggaggaggg

SEQ ID NO: 881236 - DNA, 16 bp, Homo sapiens
tacagcggctcccctc

SEQ ID NO: 881237 - DNA, 16 bp, Homo sapiens
tacagctaatcagcat

SEQ ID NO: 881238 - DNA, 18 bp, Homo sapiens
tacagctaatcagcattc

SEQ ID NO: 881239 - DNA, 19 bp, Homo sapiens
tacagtcttccatttgcaa

SEQ ID NO: 881240 - DNA, 20 bp, Homo sapiens
tacagtcttccatttgcaag

SEQ ID NO: 881241 - DNA, 22 bp, Homo sapiens
tacagtcttccatttgcaaggg

SEQ ID NO: 881242 - DNA, 16 bp, Homo sapiens
tacagtgaattgtctt

SEQ ID NO: 881243 - DNA, 17 bp, Homo sapiens
tacagtgactactatta

SEQ ID NO: 881244 - DNA, 17 bp, Homo sapiens
tacagtgactccctggg

SEQ ID NO: 881245 - DNA, 18 bp, Homo sapiens
tacagtgactccctggga

SEQ ID NO: 881246 - DNA, 17 bp, Homo sapiens
tacagtgaggagggtgg

SEQ ID NO: 881247 - DNA, 14 bp, Homo sapiens
tacagtgcagacag

SEQ ID NO: 881248 - DNA, 15 bp, Homo sapiens
tacagtgcagacagg

SEQ ID NO: 881249 - DNA, 16 bp, Homo sapiens
tacagtgcagacaggc

SEQ ID NO: 881250 - DNA, 22 bp, Homo sapiens
tacagtgcagagccttctcaga

SEQ ID NO: 881251 - DNA, 12 bp, Homo sapiens
tacagtgcagtt

SEQ ID NO: 881252 - DNA, 20 bp, Homo sapiens
tacagtgcccaccgccctcc

SEQ ID NO: 881253 - DNA, 21 bp, Homo sapiens
tacagtggttttatactgaag

SEQ ID NO: 881254 - DNA, 15 bp, Homo sapiens
tacagtgtacagtct

SEQ ID NO: 881255 - DNA, 21 bp, Homo sapiens
tacagtgtctttttttgtata

SEQ ID NO: 881256 - DNA, 12 bp, Homo sapiens
tacagtgttacc

SEQ ID NO: 881257 - DNA, 19 bp, Homo sapiens
tacagttagggttttgcaa

SEQ ID NO: 881258 - DNA, 13 bp, Homo sapiens
tacagttagtctt

SEQ ID NO: 881259 - DNA, 14 bp, Homo sapiens
tacagttataaaat

SEQ ID NO: 881260 - DNA, 20 bp, Homo sapiens
tacagttctttcctctttct

SEQ ID NO: 881261 - DNA, 20 bp, Homo sapiens
tacagttgaaaaacagctga

SEQ ID NO: 881262 - DNA, 19 bp, Homo sapiens
tacagttgaaaacttgtaa

SEQ ID NO: 881263 - DNA, 17 bp, Homo sapiens
tacagttgaaataactg

SEQ ID NO: 881264 - DNA, 14 bp, Homo sapiens
tacagttgtcctga

SEQ ID NO: 881265 - DNA, 20 bp, Homo sapiens
tacagttgttttttgaaaac

SEQ ID NO: 881266 - DNA, 13 bp, Homo sapiens
tacagtttctgct

SEQ ID NO: 881267 - DNA, 14 bp, Homo sapiens
tacagtttctgctt

SEQ ID NO: 881268 - DNA, 17 bp, Homo sapiens
tacagtttgactttttg

SEQ ID NO: 881269 - DNA, 19 bp, Homo sapiens
tacagtttgttagtatgag

SEQ ID NO: 881270 - DNA, 14 bp, Homo sapiens
tacagttttaactg

SEQ ID NO: 881271 - DNA, 13 bp, Homo sapiens
tacagttttcatt

SEQ ID NO: 881272 - DNA, 17 bp, Homo sapiens
tacataaaagaaataaa

SEQ ID NO: 881273 - DNA, 21 bp, Homo sapiens
tacataaacaacgcattgcca

SEQ ID NO: 881274 - DNA, 12 bp, Homo sapiens
tacataaagact

SEQ ID NO: 881275 - DNA, 14 bp, Homo sapiens
tacataaagactgt

SEQ ID NO: 881276 - DNA, 18 bp, Homo sapiens
tacataaagctcccttga

SEQ ID NO: 881277 - DNA, 23 bp, Homo sapiens
tacataactctgtaaaaacactg

SEQ ID NO: 881278 - DNA, 22 bp, Homo sapiens
tacataagataaatgtgctgaa

SEQ ID NO: 881279 - DNA, 20 bp, Homo sapiens
tacataaggatgactttttt

SEQ ID NO: 881280 - DNA, 15 bp, Homo sapiens
tacataatctgtaca

SEQ ID NO: 881281 - DNA, 20 bp, Homo sapiens
tacataatctgtacaatgaa

SEQ ID NO: 881282 - DNA, 19 bp, Homo sapiens
tacataatgcgtgcatacc

SEQ ID NO: 881283 - DNA, 23 bp, Homo sapiens
tacataatgcgtgcataccactt

SEQ ID NO: 881284 - DNA, 18 bp, Homo sapiens
tacataatgtttttcctt

SEQ ID NO: 881285 - DNA, 18 bp, Homo sapiens
tacataattgattaaaat

SEQ ID NO: 881286 - DNA, 18 bp, Homo sapiens
tacatacacaccagggaa

SEQ ID NO: 881287 - DNA, 14 bp, Homo sapiens
tacatacacataca

SEQ ID NO: 881288 - DNA, 15 bp, Homo sapiens
tacatacacatacat

SEQ ID NO: 881289 - DNA, 15 bp, Homo sapiens
tacatacaccagcat

SEQ ID NO: 881290 - DNA, 22 bp, Homo sapiens
tacatacataatgtttttcctt

SEQ ID NO: 881291 - DNA, 13 bp, Homo sapiens
tacatacatacat

SEQ ID NO: 881292 - DNA, 16 bp, Homo sapiens
tacatacatacataca

SEQ ID NO: 881293 - DNA, 13 bp, Homo sapiens
tacatacatatat

SEQ ID NO: 881294 - DNA, 16 bp, Homo sapiens
tacatacatatatatc

SEQ ID NO: 881295 - DNA, 13 bp, Homo sapiens
tacatacggtcag

SEQ ID NO: 881296 - DNA, 15 bp, Homo sapiens
tacatacggtcaggt

SEQ ID NO: 881297 - DNA, 22 bp, Homo sapiens
tacatacggtcaggtttaacat

SEQ ID NO: 881298 - DNA, 16 bp, Homo sapiens
tacatacgtctgccag

SEQ ID NO: 881299 - DNA, 17 bp, Homo sapiens
tacatacgtctgccagg

SEQ ID NO: 881300 - DNA, 14 bp, Homo sapiens
tacatactgccgaa

SEQ ID NO: 881301 - DNA, 14 bp, Homo sapiens
tacatactggcctc

SEQ ID NO: 881302 - DNA, 15 bp, Homo sapiens
tacatactggcctct

SEQ ID NO: 881303 - DNA, 19 bp, Homo sapiens
tacatactggcctctgtga

SEQ ID NO: 881304 - DNA, 23 bp, Homo sapiens
tacatactttatcaatgtgtctt

SEQ ID NO: 881305 - DNA, 22 bp, Homo sapiens
tacatagaacacttcagacaca

SEQ ID NO: 881306 - DNA, 12 bp, Homo sapiens
tacatagacatt

SEQ ID NO: 881307 - DNA, 17 bp, Homo sapiens
tacatagacatttcaaa

SEQ ID NO: 881308 - DNA, 18 bp, Homo sapiens
tacatagagatctatttt

SEQ ID NO: 881309 - DNA, 17 bp, Homo sapiens
tacatagatcagccatt

SEQ ID NO: 881310 - DNA, 23 bp, Homo sapiens
tacatagatcagccattaaaata

SEQ ID NO: 881311 - DNA, 20 bp, Homo sapiens
tacataggcttctattacct

SEQ ID NO: 881312 - DNA, 13 bp, Homo sapiens
tacataggtctgt

SEQ ID NO: 881313 - DNA, 21 bp, Homo sapiens
tacataggtctgtatggctgt

SEQ ID NO: 881314 - DNA, 22 bp, Homo sapiens
tacataggtctgtatggctgta

SEQ ID NO: 881315 - DNA, 16 bp, Homo sapiens
tacatagtctgaagtg

SEQ ID NO: 881316 - DNA, 21 bp, Homo sapiens
tacatagtgctgctgtgtgct

SEQ ID NO: 881317 - DNA, 22 bp, Homo sapiens
tacatagtgctgctgtgtgctt

SEQ ID NO: 881318 - DNA, 22 bp, Homo sapiens
tacatataaatgaatctggtgt

SEQ ID NO: 881319 - DNA, 15 bp, Homo sapiens
tacatatataaaact

SEQ ID NO: 881320 - DNA, 13 bp, Homo sapiens
tacatatatacat

SEQ ID NO: 881321 - DNA, 11 bp, Homo sapiens
tacatatatat

SEQ ID NO: 881322 - DNA, 20 bp, Homo sapiens
tacatatatatatacacata

SEQ ID NO: 881323 - DNA, 23 bp, Homo sapiens
tacatatatatatacacatacat

SEQ ID NO: 881324 - DNA, 23 bp, Homo sapiens
tacatatatatatttgtaacatt

SEQ ID NO: 881325 - DNA, 13 bp, Homo sapiens
tacatatatattt

SEQ ID NO: 881326 - DNA, 17 bp, Homo sapiens
tacatatatctacacat

SEQ ID NO: 881327 - DNA, 16 bp, Homo sapiens
tacatatctttattaa

SEQ ID NO: 881328 - DNA, 19 bp, Homo sapiens
tacatatgctgatctttta

SEQ ID NO: 881329 - DNA, 13 bp, Homo sapiens
tacatatgcttta

SEQ ID NO: 881330 - DNA, 14 bp, Homo sapiens
tacatatgctttaa

SEQ ID NO: 881331 - DNA, 20 bp, Homo sapiens
tacatatggatgttactctc

SEQ ID NO: 881332 - DNA, 15 bp, Homo sapiens
tacatattactgttg

SEQ ID NO: 881333 - DNA, 23 bp, Homo sapiens
tacatattaggaaaatatgggtt

SEQ ID NO: 881334 - DNA, 14 bp, Homo sapiens
tacatattcctttg

SEQ ID NO: 881335 - DNA, 13 bp, Homo sapiens
tacatattgtctg

SEQ ID NO: 881336 - DNA, 18 bp, Homo sapiens
tacatatttgactctttc

SEQ ID NO: 881337 - DNA, 19 bp, Homo sapiens
tacatatttgactctttca

SEQ ID NO: 881338 - DNA, 22 bp, Homo sapiens
tacatatttgactctttcaaag

SEQ ID NO: 881339 - DNA, 16 bp, Homo sapiens
tacatatttgtggaat

SEQ ID NO: 881340 - DNA, 13 bp, Homo sapiens
tacatcactttgt

SEQ ID NO: 881341 - DNA, 18 bp, Homo sapiens
tacatcagactctagaaa

SEQ ID NO: 881342 - DNA, 22 bp, Homo sapiens
tacatcagtatagtgttttatt

SEQ ID NO: 881343 - DNA, 22 bp, Homo sapiens
tacatcatgctggaacctgcaa

SEQ ID NO: 881344 - DNA, 14 bp, Homo sapiens
tacatcatgttatt

SEQ ID NO: 881345 - DNA, 19 bp, Homo sapiens
tacatccaaagcagacagc

SEQ ID NO: 881346 - DNA, 20 bp, Homo sapiens
tacatctattttggattgta

SEQ ID NO: 881347 - DNA, 19 bp, Homo sapiens
tacatctgcaatatgaatt

SEQ ID NO: 881348 - DNA, 15 bp, Homo sapiens
tacatctgctgtgtg

SEQ ID NO: 881349 - DNA, 13 bp, Homo sapiens
tacatctggctgg

SEQ ID NO: 881350 - DNA, 14 bp, Homo sapiens
tacatcttctgcct

SEQ ID NO: 881351 - DNA, 15 bp, Homo sapiens
tacatctttcacatt

SEQ ID NO: 881352 - DNA, 20 bp, Homo sapiens
tacatctttcacattggcta

SEQ ID NO: 881353 - DNA, 13 bp, Homo sapiens
tacatcttttcta

SEQ ID NO: 881354 - DNA, 16 bp, Homo sapiens
tacatgaaaacacatt

SEQ ID NO: 881355 - DNA, 21 bp, Homo sapiens
tacatgaaaattttaaaaata

SEQ ID NO: 881356 - DNA, 15 bp, Homo sapiens
tacatgaaacagaaa

SEQ ID NO: 881357 - DNA, 21 bp, Homo sapiens
tacatgaagaatagaaacaag

SEQ ID NO: 881358 - DNA, 21 bp, Homo sapiens
tacatgacatttatttttcat

SEQ ID NO: 881359 - DNA, 14 bp, Homo sapiens
tacatgactgggcc

SEQ ID NO: 881360 - DNA, 15 bp, Homo sapiens
tacatgactgggcct

SEQ ID NO: 881361 - DNA, 16 bp, Homo sapiens
tacatgactgtttctt

SEQ ID NO: 881362 - DNA, 21 bp, Homo sapiens
tacatgactgtttcttttgta

SEQ ID NO: 881363 - DNA, 17 bp, Homo sapiens
tacatgagaacaaacag

SEQ ID NO: 881364 - DNA, 12 bp, Homo sapiens
taccacagcagc

SEQ ID NO: 881365 - DNA, 15 bp, Homo sapiens
taccaccccttcctg

SEQ ID NO: 881366 - DNA, 14 bp, Homo sapiens
taccacctgtacat

SEQ ID NO: 881367 - DNA, 15 bp, Homo sapiens
taccacctttactgt

SEQ ID NO: 881368 - DNA, 18 bp, Homo sapiens
taccactatttaagttat

SEQ ID NO: 881369 - DNA, 14 bp, Homo sapiens
taccactctgtaat

SEQ ID NO: 881370 - DNA, 15 bp, Homo sapiens
taccactctgtaatt

SEQ ID NO: 881371 - DNA, 22 bp, Homo sapiens
taccactgctgatattttctct

SEQ ID NO: 881372 - DNA, 19 bp, Homo sapiens
taccacttctgtgggcatg

SEQ ID NO: 881373 - DNA, 21 bp, Homo sapiens
taccacttctgtgggcatggc

SEQ ID NO: 881374 - DNA, 18 bp, Homo sapiens
taccacttgcctttttct

SEQ ID NO: 881375 - DNA, 16 bp, Homo sapiens
taccagaagggcttca

SEQ ID NO: 881376 - DNA, 22 bp, Homo sapiens
taccagacaaaaaaatttaaaa

SEQ ID NO: 881377 - DNA, 14 bp, Homo sapiens
taccagagacctga

SEQ ID NO: 881378 - DNA, 22 bp, Homo sapiens
taccagaggaagttatggcagt

SEQ ID NO: 881379 - DNA, 16 bp, Homo sapiens
taccagatataaaata

SEQ ID NO: 881380 - DNA, 15 bp, Homo sapiens
taccagatgaacatt

SEQ ID NO: 881381 - DNA, 17 bp, Homo sapiens
taccagatgaacatttc

SEQ ID NO: 881382 - DNA, 12 bp, Homo sapiens
taccagatgcta

SEQ ID NO: 881383 - DNA, 21 bp, Homo sapiens
taccagcaagaataaaaaaga

SEQ ID NO: 881384 - DNA, 13 bp, Homo sapiens
taccagcgaggag

SEQ ID NO: 881385 - DNA, 20 bp, Homo sapiens
taccagcgcccgctgggctg

SEQ ID NO: 881386 - DNA, 14 bp, Homo sapiens
taccagctcagggg

SEQ ID NO: 881387 - DNA, 18 bp, Homo sapiens
taccagctcctccagccc

SEQ ID NO: 881388 - DNA, 20 bp, Homo sapiens
taccagctcctccagccctg

SEQ ID NO: 881389 - DNA, 15 bp, Homo sapiens
taccaggatgctaaa

SEQ ID NO: 881390 - DNA, 15 bp, Homo sapiens
taccaggttgaaaga

SEQ ID NO: 881391 - DNA, 18 bp, Homo sapiens
taccagtatttagaagcc

SEQ ID NO: 881392 - DNA, 19 bp, Homo sapiens
taccagtatttagaagcca

SEQ ID NO: 881393 - DNA, 22 bp, Homo sapiens
taccagtctatttccactgaac

SEQ ID NO: 881394 - DNA, 18 bp, Homo sapiens
taccagtgaaccaaagag

SEQ ID NO: 881395 - DNA, 11 bp, Homo sapiens
taccagtgtgg

SEQ ID NO: 881396 - DNA, 12 bp, Homo sapiens
taccagttgcct

SEQ ID NO: 881397 - DNA, 16 bp, Homo sapiens
taccagttgcctttta

SEQ ID NO: 881398 - DNA, 19 bp, Homo sapiens
taccagttgccttttatcc

SEQ ID NO: 881399 - DNA, 17 bp, Homo sapiens
taccagttgtatttaat

SEQ ID NO: 881400 - DNA, 19 bp, Homo sapiens
taccataaagcctttaaaa

SEQ ID NO: 881401 - DNA, 17 bp, Homo sapiens
taccataagggactgtg

SEQ ID NO: 881402 - DNA, 17 bp, Homo sapiens
taccataagtgacacca

SEQ ID NO: 881403 - DNA, 20 bp, Homo sapiens
taccatagaaaaatgtataa

SEQ ID NO: 881404 - DNA, 14 bp, Homo sapiens
taccataggaagac

SEQ ID NO: 881405 - DNA, 19 bp, Homo sapiens
taccataggaagacataaa

SEQ ID NO: 881406 - DNA, 17 bp, Homo sapiens
taccatcccctgtagag

SEQ ID NO: 881407 - DNA, 17 bp, Homo sapiens
taccatccttacaatgt

SEQ ID NO: 881408 - DNA, 20 bp, Homo sapiens
taccatgaacagaaaacatt

SEQ ID NO: 881409 - DNA, 20 bp, Homo sapiens
taccatgagaagagggcctg

SEQ ID NO: 881410 - DNA, 23 bp, Homo sapiens
taccatgctgctttttggcacag

SEQ ID NO: 881411 - DNA, 18 bp, Homo sapiens
taccatgtaatggcagtt

SEQ ID NO: 881412 - DNA, 15 bp, Homo sapiens
taccatgtcactgtg

SEQ ID NO: 881413 - DNA, 18 bp, Homo sapiens
taccatgtggatgcagca

SEQ ID NO: 881414 - DNA, 14 bp, Homo sapiens
taccattaaaactg

SEQ ID NO: 881415 - DNA, 16 bp, Homo sapiens
taccattaaaactgct

SEQ ID NO: 881416 - DNA, 17 bp, Homo sapiens
taccattaaaactgctt

SEQ ID NO: 881417 - DNA, 14 bp, Homo sapiens
taccattaattaca

SEQ ID NO: 881418 - DNA, 19 bp, Homo sapiens
taccattatttaatttgta

SEQ ID NO: 881419 - DNA, 22 bp, Homo sapiens
taccattcagatcactgaattt

SEQ ID NO: 881420 - DNA, 16 bp, Homo sapiens
taccattccttcaaat

SEQ ID NO: 881421 - DNA, 16 bp, Homo sapiens
taccattgaaatcagc

SEQ ID NO: 881422 - DNA, 14 bp, Homo sapiens
taccattgtaatat

SEQ ID NO: 881423 - DNA, 14 bp, Homo sapiens
taccatttatacaa

SEQ ID NO: 881424 - DNA, 17 bp, Homo sapiens
taccatttatacaaatt

SEQ ID NO: 881425 - DNA, 23 bp, Homo sapiens
taccatttcctcagcttatctct

SEQ ID NO: 881426 - DNA, 20 bp, Homo sapiens
taccatttgtaataaagtat

SEQ ID NO: 881427 - DNA, 20 bp, Homo sapiens
taccattttttaaggaaaca

SEQ ID NO: 881428 - DNA, 20 bp, Homo sapiens
tacccaaaccctaggttccc

SEQ ID NO: 881429 - DNA, 19 bp, Homo sapiens
tacccaaattttaatattc

SEQ ID NO: 881430 - DNA, 15 bp, Homo sapiens
tacccaatgggaccg

SEQ ID NO: 881431 - DNA, 21 bp, Homo sapiens
tacccacacattccagggctg

SEQ ID NO: 881432 - DNA, 14 bp, Homo sapiens
tacccacaggtgag

SEQ ID NO: 881433 - DNA, 21 bp, Homo sapiens
tacccacaggtgaggggcagg

SEQ ID NO: 881434 - DNA, 13 bp, Homo sapiens
tacccaccccagc

SEQ ID NO: 881435 - DNA, 22 bp, Homo sapiens
tacccaccccagcacagccacc

SEQ ID NO: 881436 - DNA, 19 bp, Homo sapiens
tacccacccttacttcctg

SEQ ID NO: 881437 - DNA, 17 bp, Homo sapiens
tacccaccgatggagcc

SEQ ID NO: 881438 - DNA, 20 bp, Homo sapiens
tacccacgttctcacaccca

SEQ ID NO: 881439 - DNA, 17 bp, Homo sapiens
tacccactcggtcccag

SEQ ID NO: 881440 - DNA, 13 bp, Homo sapiens
tacccactgccat

SEQ ID NO: 881441 - DNA, 14 bp, Homo sapiens
tacccactgccatg

SEQ ID NO: 881442 - DNA, 20 bp, Homo sapiens
tacccagccatctgcccagg

SEQ ID NO: 881443 - DNA, 15 bp, Homo sapiens
tacccagccatgtgt

SEQ ID NO: 881444 - DNA, 22 bp, Homo sapiens
tacccagcgtggcccaggccgg

SEQ ID NO: 881445 - DNA, 13 bp, Homo sapiens
tacccagctcctt

SEQ ID NO: 881446 - DNA, 18 bp, Homo sapiens
tacccaggctggagtgca

SEQ ID NO: 881447 - DNA, 22 bp, Homo sapiens
tacccaggtattacacaagcca

SEQ ID NO: 881448 - DNA, 19 bp, Homo sapiens
tacccagtattactgctgc

SEQ ID NO: 881449 - DNA, 21 bp, Homo sapiens
tacccagtattactgctgctg

SEQ ID NO: 881450 - DNA, 19 bp, Homo sapiens
tacccatctaggaaagaaa

SEQ ID NO: 881451 - DNA, 16 bp, Homo sapiens
tacccattctgttttc

SEQ ID NO: 881452 - DNA, 14 bp, Homo sapiens
taccccaaggccag

SEQ ID NO: 881453 - DNA, 18 bp, Homo sapiens
taccccaatttcggattt

SEQ ID NO: 881454 - DNA, 14 bp, Homo sapiens
taccccaccctcag

SEQ ID NO: 881455 - DNA, 23 bp, Homo sapiens
taccccaccctcagcaccccttc

SEQ ID NO: 881456 - DNA, 20 bp, Homo sapiens
taccccagcctacccttcct

SEQ ID NO: 881457 - DNA, 21 bp, Homo sapiens
taccccagtcccagggaaggt

SEQ ID NO: 881458 - DNA, 19 bp, Homo sapiens
taccccataccccttattg

SEQ ID NO: 881459 - DNA, 17 bp, Homo sapiens
taccccatcctccctcc

SEQ ID NO: 881460 - DNA, 20 bp, Homo sapiens
tacccccccttttctcccca

SEQ ID NO: 881461 - DNA, 13 bp, Homo sapiens
taccccctcatcc

SEQ ID NO: 881462 - DNA, 16 bp, Homo sapiens
taccccctcatccccc

SEQ ID NO: 881463 - DNA, 19 bp, Homo sapiens
taccccctcttcaaagcag

SEQ ID NO: 881464 - DNA, 17 bp, Homo sapiens
taccccgcagacacctt

SEQ ID NO: 881465 - DNA, 19 bp, Homo sapiens
tacccctcaaactgcacat

SEQ ID NO: 881466 - DNA, 20 bp, Homo sapiens
tacccctcgactcagcacca

SEQ ID NO: 881467 - DNA, 14 bp, Homo sapiens
tacccctgccctgc

SEQ ID NO: 881468 - DNA, 16 bp, Homo sapiens
tacccctgccctgctc

SEQ ID NO: 881469 - DNA, 22 bp, Homo sapiens
tacccctgctcccattcctccc

SEQ ID NO: 881470 - DNA, 17 bp, Homo sapiens
tacccctggctgtactg

SEQ ID NO: 881471 - DNA, 12 bp, Homo sapiens
taccccttcctg

SEQ ID NO: 881472 - DNA, 13 bp, Homo sapiens
taccccttcctgt

SEQ ID NO: 881473 - DNA, 18 bp, Homo sapiens
taccccttcctgtcctgc

SEQ ID NO: 881474 - DNA, 19 bp, Homo sapiens
taccccttcctgtcctgcc

SEQ ID NO: 881475 - DNA, 23 bp, Homo sapiens
taccccttcctgtcctgcctcct

SEQ ID NO: 881476 - DNA, 20 bp, Homo sapiens
taccccttctttgcagggct

SEQ ID NO: 881477 - DNA, 13 bp, Homo sapiens
tacccgagcccag

SEQ ID NO: 881478 - DNA, 21 bp, Homo sapiens
tacccgagcccagctacattc

SEQ ID NO: 881479 - DNA, 23 bp, Homo sapiens
tacccgagcccagctacattcct

SEQ ID NO: 881480 - DNA, 20 bp, Homo sapiens
tacccgcccgcgtccaaccc

SEQ ID NO: 881481 - DNA, 16 bp, Homo sapiens
taccctagaagaaaac

SEQ ID NO: 881482 - DNA, 22 bp, Homo sapiens
taccctcaaccctattcattag

SEQ ID NO: 881483 - DNA, 17 bp, Homo sapiens
taccctcccaccagaac

SEQ ID NO: 881484 - DNA, 11 bp, Homo sapiens
taccctccccc

SEQ ID NO: 881485 - DNA, 15 bp, Homo sapiens
taccctcctctgctg

SEQ ID NO: 881486 - DNA, 15 bp, Homo sapiens
taccctcctggctct

SEQ ID NO: 881487 - DNA, 20 bp, Homo sapiens
taccctccttccacatgtac

SEQ ID NO: 881488 - DNA, 18 bp, Homo sapiens
tacatgagaacaaacaga

SEQ ID NO: 881489 - DNA, 23 bp, Homo sapiens
tacatgaggactctattctttaa

SEQ ID NO: 881490 - DNA, 20 bp, Homo sapiens
tacatgatacatttttattt

SEQ ID NO: 881491 - DNA, 23 bp, Homo sapiens
tacatgcaccttatatttctgtg

SEQ ID NO: 881492 - DNA, 17 bp, Homo sapiens
tacatgcatacaaagag

SEQ ID NO: 881493 - DNA, 18 bp, Homo sapiens
tacatgctaagagaagta

SEQ ID NO: 881494 - DNA, 19 bp, Homo sapiens
tacatgctaagagaagtag

SEQ ID NO: 881495 - DNA, 14 bp, Homo sapiens
tacatgctcttttt

SEQ ID NO: 881496 - DNA, 22 bp, Homo sapiens
tacatgctgaaaaatatagcct

SEQ ID NO: 881497 - DNA, 12 bp, Homo sapiens
tacatgctgcta

SEQ ID NO: 881498 - DNA, 17 bp, Homo sapiens
tacatgctgtgctcttt

SEQ ID NO: 881499 - DNA, 22 bp, Homo sapiens
tacatggaataacatgtaatta

SEQ ID NO: 881500 - DNA, 16 bp, Homo sapiens
tacatggcagagtttg

SEQ ID NO: 881501 - DNA, 17 bp, Homo sapiens
tacatggcgccctgcct

SEQ ID NO: 881502 - DNA, 19 bp, Homo sapiens
tacatgtaaaacattatct

SEQ ID NO: 881503 - DNA, 24 bp, Homo sapiens
tacatgtacctatagaaatagaac

SEQ ID NO: 881504 - DNA, 20 bp, Homo sapiens
tacatgtagagatttgagtg

SEQ ID NO: 881505 - DNA, 22 bp, Homo sapiens
tacatgtattgcacattgtaaa

SEQ ID NO: 881506 - DNA, 17 bp, Homo sapiens
tacatgtgccgaatgtg

SEQ ID NO: 881507 - DNA, 14 bp, Homo sapiens
tacatgtggtttat

SEQ ID NO: 881508 - DNA, 19 bp, Homo sapiens
tacatgtgtagggaaagtt

SEQ ID NO: 881509 - DNA, 20 bp, Homo sapiens
tacatgtgtgtatatgtaga

SEQ ID NO: 881510 - DNA, 18 bp, Homo sapiens
tacatgttcttgtcataa

SEQ ID NO: 881511 - DNA, 13 bp, Homo sapiens
tacatgtttataa

SEQ ID NO: 881512 - DNA, 15 bp, Homo sapiens
tacatgtttccatca

SEQ ID NO: 881513 - DNA, 22 bp, Homo sapiens
tacatgtttccatcatttctgt

SEQ ID NO: 881514 - DNA, 22 bp, Homo sapiens
tacatgtttgcacctttctagt

SEQ ID NO: 881515 - DNA, 17 bp, Homo sapiens
tacatgttttttcattt

SEQ ID NO: 881516 - DNA, 18 bp, Homo sapiens
tacatgttttttcatttg

SEQ ID NO: 881517 - DNA, 21 bp, Homo sapiens
tacatgttttttcatttgtaa

SEQ ID NO: 881518 - DNA, 13 bp, Homo sapiens
tacattaaacaat

SEQ ID NO: 881519 - DNA, 18 bp, Homo sapiens
tacattaacggtgctaaa

SEQ ID NO: 881520 - DNA, 15 bp, Homo sapiens
tacattaatgcccag

SEQ ID NO: 881521 - DNA, 19 bp, Homo sapiens
tacattaatgcccagccag

SEQ ID NO: 881522 - DNA, 21 bp, Homo sapiens
tacattaatgcccagccagcc

SEQ ID NO: 881523 - DNA, 20 bp, Homo sapiens
tacattagcagtttgctttg

SEQ ID NO: 881524 - DNA, 20 bp, Homo sapiens
tacattagttttaatctctt

SEQ ID NO: 881525 - DNA, 21 bp, Homo sapiens
tacattattaaacgatttcta

SEQ ID NO: 881526 - DNA, 15 bp, Homo sapiens
tacattattccaatg

SEQ ID NO: 881527 - DNA, 17 bp, Homo sapiens
tacattcaaatttgtct

SEQ ID NO: 881528 - DNA, 14 bp, Homo sapiens
tacattcaactttt

SEQ ID NO: 881529 - DNA, 15 bp, Homo sapiens
tacattcaatgttta

SEQ ID NO: 881530 - DNA, 17 bp, Homo sapiens
tacattccccagagtgg

SEQ ID NO: 881531 - DNA, 21 bp, Homo sapiens
tacattccctctcctgcccag

SEQ ID NO: 881532 - DNA, 15 bp, Homo sapiens
tacattcctaactag

SEQ ID NO: 881533 - DNA, 10 bp, Homo sapiens
tacattcctc

SEQ ID NO: 881534 - DNA, 14 bp, Homo sapiens
tacattcctcagct

SEQ ID NO: 881535 - DNA, 20 bp, Homo sapiens
tacattcctcagctgccaag

SEQ ID NO: 881536 - DNA, 22 bp, Homo sapiens
tacattctaatttgcattgtgt

SEQ ID NO: 881537 - DNA, 19 bp, Homo sapiens
tacattcttccatcatcac

SEQ ID NO: 881538 - DNA, 11 bp, Homo sapiens
tacattcttta

SEQ ID NO: 881539 - DNA, 16 bp, Homo sapiens
tacattctttattctg

SEQ ID NO: 881540 - DNA, 19 bp, Homo sapiens
tacattgaattcattataa

SEQ ID NO: 881541 - DNA, 12 bp, Homo sapiens
tacattgcttaa

SEQ ID NO: 881542 - DNA, 19 bp, Homo sapiens
tacattggctggtaacagt

SEQ ID NO: 881543 - DNA, 16 bp, Homo sapiens
tacattgtgaaacttc

SEQ ID NO: 881544 - DNA, 15 bp, Homo sapiens
tacattgtgtgaaaa

SEQ ID NO: 881545 - DNA, 21 bp, Homo sapiens
tacattgttacctctatatac

SEQ ID NO: 881546 - DNA, 23 bp, Homo sapiens
tacattgttgagctattgctgtt

SEQ ID NO: 881547 - DNA, 19 bp, Homo sapiens
tacatttaaaacattaaaa

SEQ ID NO: 881548 - DNA, 17 bp, Homo sapiens
tacatttaataaaactg

SEQ ID NO: 881549 - DNA, 14 bp, Homo sapiens
tacatttaataata

SEQ ID NO: 881550 - DNA, 15 bp, Homo sapiens
tacatttaataatat

SEQ ID NO: 881551 - DNA, 19 bp, Homo sapiens
tacatttaataatatcaaa

SEQ ID NO: 881552 - DNA, 13 bp, Homo sapiens
tacatttaataca

SEQ ID NO: 881553 - DNA, 15 bp, Homo sapiens
tacatttaatacagc

SEQ ID NO: 881554 - DNA, 13 bp, Homo sapiens
tacatttatacat

SEQ ID NO: 881555 - DNA, 17 bp, Homo sapiens
tacatttatgttccttt

SEQ ID NO: 881556 - DNA, 21 bp, Homo sapiens
tacatttatgttcctttattt

SEQ ID NO: 881557 - DNA, 21 bp, Homo sapiens
tacatttatttattactgtcc

SEQ ID NO: 881558 - DNA, 23 bp, Homo sapiens
tacatttcataaggcctgccctc

SEQ ID NO: 881559 - DNA, 12 bp, Homo sapiens
tacatttctgaa

SEQ ID NO: 881560 - DNA, 13 bp, Homo sapiens
tacatttctgaat

SEQ ID NO: 881561 - DNA, 13 bp, Homo sapiens
tacatttgatttg

SEQ ID NO: 881562 - DNA, 18 bp, Homo sapiens
tacatttgatttgttcat

SEQ ID NO: 881563 - DNA, 19 bp, Homo sapiens
tacatttgggagtttttat

SEQ ID NO: 881564 - DNA, 23 bp, Homo sapiens
tacatttgtaagtgtaaaaaatg

SEQ ID NO: 881565 - DNA, 16 bp, Homo sapiens
tacatttgtactttat

SEQ ID NO: 881566 - DNA, 15 bp, Homo sapiens
tacattttacacact

SEQ ID NO: 881567 - DNA, 15 bp, Homo sapiens
tacattttagtttct

SEQ ID NO: 881568 - DNA, 18 bp, Homo sapiens
tacattttcgtcctgtag

SEQ ID NO: 881569 - DNA, 13 bp, Homo sapiens
tacattttctaaa

SEQ ID NO: 881570 - DNA, 15 bp, Homo sapiens
tacattttctaaata

SEQ ID NO: 881571 - DNA, 20 bp, Homo sapiens
tacattttctaaataaaaat

SEQ ID NO: 881572 - DNA, 18 bp, Homo sapiens
tacattttgtaaaatatt

SEQ ID NO: 881573 - DNA, 24 bp, Homo sapiens
tacatttttaagctccatgtgcat

SEQ ID NO: 881574 - DNA, 22 bp, Homo sapiens
tacatttttaagtgctgcattt

SEQ ID NO: 881575 - DNA, 15 bp, Homo sapiens
tacatttttacaata

SEQ ID NO: 881576 - DNA, 19 bp, Homo sapiens
tacatttttacaataaata

SEQ ID NO: 881577 - DNA, 16 bp, Homo sapiens
tacatttttgggggga

SEQ ID NO: 881578 - DNA, 19 bp, Homo sapiens
tacatttttggggggagag

SEQ ID NO: 881579 - DNA, 16 bp, Homo sapiens
tacattttttaaaact

SEQ ID NO: 881580 - DNA, 20 bp, Homo sapiens
tacattttttgggcagcaat

SEQ ID NO: 881581 - DNA, 19 bp, Homo sapiens
taccaaaaaccatgttgcg

SEQ ID NO: 881582 - DNA, 22 bp, Homo sapiens
taccaaaaaccatgttgcgttc

SEQ ID NO: 881583 - DNA, 20 bp, Homo sapiens
taccaaacaaggaagccaaa

SEQ ID NO: 881584 - DNA, 21 bp, Homo sapiens
taccaaacaaggaagccaaag

SEQ ID NO: 881585 - DNA, 17 bp, Homo sapiens
taccaaacattacaaaa

SEQ ID NO: 881586 - DNA, 20 bp, Homo sapiens
taccaaagtgtcttttgaca

SEQ ID NO: 881587 - DNA, 16 bp, Homo sapiens
taccaaatattttagc

SEQ ID NO: 881588 - DNA, 13 bp, Homo sapiens
taccaaattaaaa

SEQ ID NO: 881589 - DNA, 19 bp, Homo sapiens
taccaaattaaaaaaaaat

SEQ ID NO: 881590 - DNA, 12 bp, Homo sapiens
taccaacttcct

SEQ ID NO: 881591 - DNA, 15 bp, Homo sapiens
taccaaggatgaatt

SEQ ID NO: 881592 - DNA, 12 bp, Homo sapiens
taccaaggattt

SEQ ID NO: 881593 - DNA, 21 bp, Homo sapiens
taccaagtatgaagtataaat

SEQ ID NO: 881594 - DNA, 14 bp, Homo sapiens
taccaagttgtgct

SEQ ID NO: 881595 - DNA, 11 bp, Homo sapiens
taccaataaac

SEQ ID NO: 881596 - DNA, 12 bp, Homo sapiens
taccaataaact

SEQ ID NO: 881597 - DNA, 14 bp, Homo sapiens
taccaataaactga

SEQ ID NO: 881598 - DNA, 16 bp, Homo sapiens
taccaataaactgagc

SEQ ID NO: 881599 - DNA, 19 bp, Homo sapiens
taccaatcattttaattat

SEQ ID NO: 881600 - DNA, 20 bp, Homo sapiens
taccaatcattttaattatt

SEQ ID NO: 881601 - DNA, 17 bp, Homo sapiens
taccaatgaaaaaatgt

SEQ ID NO: 881602 - DNA, 11 bp, Homo sapiens
taccaatgcat

SEQ ID NO: 881603 - DNA, 21 bp, Homo sapiens
taccaatgctcttttcacagc

SEQ ID NO: 881604 - DNA, 14 bp, Homo sapiens
taccaatgctgttg

SEQ ID NO: 881605 - DNA, 18 bp, Homo sapiens
taccaatgctgttgtaaa

SEQ ID NO: 881606 - DNA, 19 bp, Homo sapiens
taccaatgcttttatcaaa

SEQ ID NO: 881607 - DNA, 19 bp, Homo sapiens
taccaatgtgttttctgta

SEQ ID NO: 881608 - DNA, 17 bp, Homo sapiens
taccaattgatgtttta

SEQ ID NO: 881609 - DNA, 21 bp, Homo sapiens
taccacaaaccctgctgaaca

SEQ ID NO: 881610 - DNA, 22 bp, Homo sapiens
taccacaaaccctgctgaacac

SEQ ID NO: 881611 - DNA, 14 bp, Homo sapiens
taccacaaggaaaa

SEQ ID NO: 881612 - DNA, 21 bp, Homo sapiens
taccctccttccacatgtaca

SEQ ID NO: 881613 - DNA, 15 bp, Homo sapiens
taccctcgggcccac

SEQ ID NO: 881614 - DNA, 20 bp, Homo sapiens
taccctcgggcccacctggc

SEQ ID NO: 881615 - DNA, 23 bp, Homo sapiens
taccctcgggcccacctggccac

SEQ ID NO: 881616 - DNA, 15 bp, Homo sapiens
taccctctcagctcc

SEQ ID NO: 881617 - DNA, 21 bp, Homo sapiens
taccctctcagctccaggtgg

SEQ ID NO: 881618 - DNA, 22 bp, Homo sapiens
taccctctggaggggtgtggct

SEQ ID NO: 881619 - DNA, 15 bp, Homo sapiens
taccctctttgctgc

SEQ ID NO: 881620 - DNA, 16 bp, Homo sapiens
taccctctttgctgca

SEQ ID NO: 881621 - DNA, 19 bp, Homo sapiens
taccctctttgctgcagag

SEQ ID NO: 881622 - DNA, 15 bp, Homo sapiens
taccctcttttacca

SEQ ID NO: 881623 - DNA, 18 bp, Homo sapiens
taccctgatctggaccct

SEQ ID NO: 881624 - DNA, 17 bp, Homo sapiens
taccctgtctgtccctt

SEQ ID NO: 881625 - DNA, 21 bp, Homo sapiens
taccctgtctgtcccttttct

SEQ ID NO: 881626 - DNA, 11 bp, Homo sapiens
taccctgtgtc

SEQ ID NO: 881627 - DNA, 14 bp, Homo sapiens
taccctgtgtcaga

SEQ ID NO: 881628 - DNA, 21 bp, Homo sapiens
taccctgtgtcagagcctacc

SEQ ID NO: 881629 - DNA, 20 bp, Homo sapiens
tacccttccacctcctagag

SEQ ID NO: 881630 - DNA, 18 bp, Homo sapiens
tacccttgagacctggaa

SEQ ID NO: 881631 - DNA, 20 bp, Homo sapiens
tacccttggctcaatcctct

SEQ ID NO: 881632 - DNA, 23 bp, Homo sapiens
taccctttaagatatccatcttt

SEQ ID NO: 881633 - DNA, 20 bp, Homo sapiens
taccctttagactgtagcct

SEQ ID NO: 881634 - DNA, 18 bp, Homo sapiens
taccctttttctccagct

SEQ ID NO: 881635 - DNA, 15 bp, Homo sapiens
taccgaatgtgtctt

SEQ ID NO: 881636 - DNA, 13 bp, Homo sapiens
taccgagtatctg

SEQ ID NO: 881637 - DNA, 17 bp, Homo sapiens
taccgagtctcttctcc

SEQ ID NO: 881638 - DNA, 18 bp, Homo sapiens
taccgagtctcttctcca

SEQ ID NO: 881639 - DNA, 21 bp, Homo sapiens
taccgagtctcttctccactg

SEQ ID NO: 881640 - DNA, 16 bp, Homo sapiens
taccgatggtcccagg

SEQ ID NO: 881641 - DNA, 14 bp, Homo sapiens
taccgccctgcggg

SEQ ID NO: 881642 - DNA, 22 bp, Homo sapiens
taccgccctgcgggccacaggg

SEQ ID NO: 881643 - DNA, 15 bp, Homo sapiens
taccgccctgggctg

SEQ ID NO: 881644 - DNA, 16 bp, Homo sapiens
taccgccctgggctgg

SEQ ID NO: 881645 - DNA, 18 bp, Homo sapiens
taccgcctcgtgccagca

SEQ ID NO: 881646 - DNA, 20 bp, Homo sapiens
taccgcctcgtgccagcagc

SEQ ID NO: 881647 - DNA, 22 bp, Homo sapiens
taccgcctcgtgccagcagcct

SEQ ID NO: 881648 - DNA, 15 bp, Homo sapiens
taccgcgttgtaaaa

SEQ ID NO: 881649 - DNA, 13 bp, Homo sapiens
taccgcttcctta

SEQ ID NO: 881650 - DNA, 19 bp, Homo sapiens
taccgtcgacaagaatgtc

SEQ ID NO: 881651 - DNA, 13 bp, Homo sapiens
taccgtctacatt

SEQ ID NO: 881652 - DNA, 17 bp, Homo sapiens
taccgtctacatttcac

SEQ ID NO: 881653 - DNA, 23 bp, Homo sapiens
taccgtgagtgacatagcctcat

SEQ ID NO: 881654 - DNA, 15 bp, Homo sapiens
taccgtttcttccct

SEQ ID NO: 881655 - DNA, 22 bp, Homo sapiens
tacctaaaaggaaatctcaccc

SEQ ID NO: 881656 - DNA, 15 bp, Homo sapiens
tacctaaacagatat

SEQ ID NO: 881657 - DNA, 15 bp, Homo sapiens
tacctaacattattt

SEQ ID NO: 881658 - DNA, 17 bp, Homo sapiens
tacctaagattacaaat

SEQ ID NO: 881659 - DNA, 20 bp, Homo sapiens
tacctaagattacaaatcag

SEQ ID NO: 881660 - DNA, 22 bp, Homo sapiens
tacctaagcatatcgtaaagct

SEQ ID NO: 881661 - DNA, 17 bp, Homo sapiens
tacctaccacagtgtct

SEQ ID NO: 881662 - DNA, 14 bp, Homo sapiens
tacctaccagtatt

SEQ ID NO: 881663 - DNA, 18 bp, Homo sapiens
tacctactgtgtcttgga

SEQ ID NO: 881664 - DNA, 14 bp, Homo sapiens
tacctactttgact

SEQ ID NO: 881665 - DNA, 16 bp, Homo sapiens
tacctagatttacagc

SEQ ID NO: 881666 - DNA, 18 bp, Homo sapiens
tacctagctaattattta

SEQ ID NO: 881667 - DNA, 11 bp, Homo sapiens
tacctagctgt

SEQ ID NO: 881668 - DNA, 23 bp, Homo sapiens
tacctagctgtgccccctctggt

SEQ ID NO: 881669 - DNA, 14 bp, Homo sapiens
tacctagtgaaact

SEQ ID NO: 881670 - DNA, 16 bp, Homo sapiens
tacctagtgaaacttt

SEQ ID NO: 881671 - DNA, 19 bp, Homo sapiens
tacctagtgaaacttttct

SEQ ID NO: 881672 - DNA, 13 bp, Homo sapiens
tacctatccacaa

SEQ ID NO: 881673 - DNA, 18 bp, Homo sapiens
tacctatctgtggaaagc

SEQ ID NO: 881674 - DNA, 13 bp, Homo sapiens
tacctatttcctc

SEQ ID NO: 881675 - DNA, 12 bp, Homo sapiens
tacctatttctg

SEQ ID NO: 881676 - DNA, 13 bp, Homo sapiens
tacctatttctga

SEQ ID NO: 881677 - DNA, 14 bp, Homo sapiens
tacctatttctgat

SEQ ID NO: 881678 - DNA, 16 bp, Homo sapiens
tacctatttctgatga

SEQ ID NO: 881679 - DNA, 12 bp, Homo sapiens
tacctatttgac

SEQ ID NO: 881680 - DNA, 17 bp, Homo sapiens
tacctattttatatgat

SEQ ID NO: 881681 - DNA, 16 bp, Homo sapiens
tacctcaaagggcagt

SEQ ID NO: 881682 - DNA, 22 bp, Homo sapiens
tacctcaacccccatttctatt

SEQ ID NO: 881683 - DNA, 18 bp, Homo sapiens
tacctcaagccccatttc

SEQ ID NO: 881684 - DNA, 21 bp, Homo sapiens
tacctcaagccccatttcctc

SEQ ID NO: 881685 - DNA, 19 bp, Homo sapiens
tacctcaagttcttggacc

SEQ ID NO: 881686 - DNA, 14 bp, Homo sapiens
tacctcaatttttg

SEQ ID NO: 881687 - DNA, 15 bp, Homo sapiens
tacctcactggggtc

SEQ ID NO: 881688 - DNA, 18 bp, Homo sapiens
tacctcagataatatgtt

SEQ ID NO: 881689 - DNA, 14 bp, Homo sapiens
tacctcagcctaga

SEQ ID NO: 881690 - DNA, 17 bp, Homo sapiens
tacctcaggcagctcaa

SEQ ID NO: 881691 - DNA, 21 bp, Homo sapiens
tacctcagtggatcttcagaa

SEQ ID NO: 881692 - DNA, 19 bp, Homo sapiens
tacctcatcatccacccgc

SEQ ID NO: 881693 - DNA, 20 bp, Homo sapiens
tacctcatcatccacccgct

SEQ ID NO: 881694 - DNA, 14 bp, Homo sapiens
tacctcatctctga

SEQ ID NO: 881695 - DNA, 15 bp, Homo sapiens
tacctcatctctgaa

SEQ ID NO: 881696 - DNA, 16 bp, Homo sapiens
tacctcatctctgaaa

SEQ ID NO: 881697 - DNA, 16 bp, Homo sapiens
tacctccaaccctgcc

SEQ ID NO: 881698 - DNA, 15 bp, Homo sapiens
tacctccaagcaagt

SEQ ID NO: 881699 - DNA, 13 bp, Homo sapiens
tacctccaccctg

SEQ ID NO: 881700 - DNA, 17 bp, Homo sapiens
tacctcccacactccca

SEQ ID NO: 881701 - DNA, 20 bp, Homo sapiens
tacctcccacactcccaagg

SEQ ID NO: 881702 - DNA, 20 bp, Homo sapiens
tacctccccttttctatgtt

SEQ ID NO: 881703 - DNA, 11 bp, Homo sapiens
tacctccctcc

SEQ ID NO: 881704 - DNA, 12 bp, Homo sapiens
tacctccctccc

SEQ ID NO: 881705 - DNA, 21 bp, Homo sapiens
tacctccctccccgtctcatt

SEQ ID NO: 881706 - DNA, 12 bp, Homo sapiens
tacctccctcct

SEQ ID NO: 881707 - DNA, 15 bp, Homo sapiens
tacctccctcctcag

SEQ ID NO: 881708 - DNA, 16 bp, Homo sapiens
tacctccctcctcagg

SEQ ID NO: 881709 - DNA, 11 bp, Homo sapiens
tacctccctcg

SEQ ID NO: 881710 - DNA, 15 bp, Homo sapiens
tacctcctctcagtg

SEQ ID NO: 881711 - DNA, 17 bp, Homo sapiens
tacctcctctcagtgtt

SEQ ID NO: 881712 - DNA, 11 bp, Homo sapiens
tacctcctgcc

SEQ ID NO: 881713 - DNA, 18 bp, Homo sapiens
tacctcggtgccttcctc

SEQ ID NO: 881714 - DNA, 21 bp, Homo sapiens
tacctctagctgttctttttt

SEQ ID NO: 881715 - DNA, 23 bp, Homo sapiens
tacctctcaagctagtgtttcta

SEQ ID NO: 881716 - DNA, 15 bp, Homo sapiens
tacctctctgggacc

SEQ ID NO: 881717 - DNA, 16 bp, Homo sapiens
tacctctctgggacct

SEQ ID NO: 881718 - DNA, 14 bp, Homo sapiens
tacctctctgtccc

SEQ ID NO: 881719 - DNA, 15 bp, Homo sapiens
tacctctctgtccct

SEQ ID NO: 881720 - DNA, 14 bp, Homo sapiens
tacctctctttctc

SEQ ID NO: 881721 - DNA, 15 bp, Homo sapiens
tacctctctttctca

SEQ ID NO: 881722 - DNA, 21 bp, Homo sapiens
tacctctggaaccccccaggc

SEQ ID NO: 881723 - DNA, 13 bp, Homo sapiens
tacctctgtatag

SEQ ID NO: 881724 - DNA, 16 bp, Homo sapiens
tacctcttactttgct

SEQ ID NO: 881725 - DNA, 21 bp, Homo sapiens
tacctcttactttgcttgaga

SEQ ID NO: 881726 - DNA, 16 bp, Homo sapiens
tacctcttagctgagt

SEQ ID NO: 881727 - DNA, 14 bp, Homo sapiens
tacctcttattgca

SEQ ID NO: 881728 - DNA, 21 bp, Homo sapiens
tacctgaaaacactgtgcaca

SEQ ID NO: 881729 - DNA, 12 bp, Homo sapiens
tacctgaaagga

SEQ ID NO: 881730 - DNA, 18 bp, Homo sapiens
tacctgacctcttgctgt

SEQ ID NO: 881731 - DNA, 22 bp, Homo sapiens
tacctgacctcttgctgtctct

SEQ ID NO: 881732 - DNA, 12 bp, Homo sapiens
tacctgagacca

SEQ ID NO: 881733 - DNA, 21 bp, Homo sapiens
tacctgattgatcacacagtg

SEQ ID NO: 881734 - DNA, 12 bp, Homo sapiens
tacctgattttt

SEQ ID NO: 881735 - DNA, 18 bp, Homo sapiens
tacctgattttttttcct

SEQ ID NO: 881736 - DNA, 21 bp, Homo sapiens
tacctgctcacgtcaaatgca

SEQ ID NO: 881737 - DNA, 19 bp, Homo sapiens
tacctgctgccccagctga

SEQ ID NO: 881738 - DNA, 15 bp, Homo sapiens
tacctggaatcaaat

SEQ ID NO: 881739 - DNA, 14 bp, Homo sapiens
tacctggaatgtgt

SEQ ID NO: 881740 - DNA, 23 bp, Homo sapiens
tacctggagaagaatggctttca

SEQ ID NO: 881741 - DNA, 11 bp, Homo sapiens
tacctgggaaa

SEQ ID NO: 881742 - DNA, 18 bp, Homo sapiens
tacctgggaaaggaccca

SEQ ID NO: 881743 - DNA, 22 bp, Homo sapiens
tacctgggaaaggacccaccca

SEQ ID NO: 881744 - DNA, 22 bp, Homo sapiens
tacctggtttacttctttagca

SEQ ID NO: 881745 - DNA, 14 bp, Homo sapiens
tacctgtacactga

SEQ ID NO: 881746 - DNA, 19 bp, Homo sapiens
tacctgtacactgacttga

SEQ ID NO: 881747 - DNA, 20 bp, Homo sapiens
tacctgtagtgagaaactga

SEQ ID NO: 881748 - DNA, 20 bp, Homo sapiens
tacctgtctaggaaggtgtg

SEQ ID NO: 881749 - DNA, 13 bp, Homo sapiens
tacctgtgaaata

SEQ ID NO: 881750 - DNA, 15 bp, Homo sapiens
tacctgtgaagtgtt

SEQ ID NO: 881751 - DNA, 14 bp, Homo sapiens
tacctgtgtacata

SEQ ID NO: 881752 - DNA, 22 bp, Homo sapiens
tacctgtgtattttttaaagct

SEQ ID NO: 881753 - DNA, 16 bp, Homo sapiens
tacctgttagctccct

SEQ ID NO: 881754 - DNA, 23 bp, Homo sapiens
tacctgttatttatcaatttttc

SEQ ID NO: 881755 - DNA, 13 bp, Homo sapiens
tacctgttcctcc

SEQ ID NO: 881756 - DNA, 13 bp, Homo sapiens
tacctgttcctta

SEQ ID NO: 881757 - DNA, 16 bp, Homo sapiens
tacctgttctgtagct

SEQ ID NO: 881758 - DNA, 19 bp, Homo sapiens
taccttagataatatttct

SEQ ID NO: 881759 - DNA, 18 bp, Homo sapiens
taccttatgctacacaga

SEQ ID NO: 881760 - DNA, 12 bp, Homo sapiens
taccttatttat

SEQ ID NO: 881761 - DNA, 17 bp, Homo sapiens
taccttatttatttttg

SEQ ID NO: 881762 - DNA, 18 bp, Homo sapiens
taccttatttatttttgt

SEQ ID NO: 881763 - DNA, 21 bp, Homo sapiens
taccttatttatttttgtgta

SEQ ID NO: 881764 - DNA, 15 bp, Homo sapiens
taccttcaaacttta

SEQ ID NO: 881765 - DNA, 16 bp, Homo sapiens
taccttcaaactttag

SEQ ID NO: 881766 - DNA, 23 bp, Homo sapiens
taccttcaatgaattaattcaga

SEQ ID NO: 881767 - DNA, 17 bp, Homo sapiens
taccttcagccctggcc

SEQ ID NO: 881768 - DNA, 14 bp, Homo sapiens
taccttcatttcag

SEQ ID NO: 881769 - DNA, 18 bp, Homo sapiens
taccttcctgtccctgag

SEQ ID NO: 881770 - DNA, 15 bp, Homo sapiens
taccttccttccctg

SEQ ID NO: 881771 - DNA, 16 bp, Homo sapiens
taccttccttccctgg

SEQ ID NO: 881772 - DNA, 16 bp, Homo sapiens
taccttctaaaagcca

SEQ ID NO: 881773 - DNA, 15 bp, Homo sapiens
taccttctatgtatt

SEQ ID NO: 881774 - DNA, 18 bp, Homo sapiens
taccttctgacagcccaa

SEQ ID NO: 881775 - DNA, 14 bp, Homo sapiens
taccttctggttgc

SEQ ID NO: 881776 - DNA, 22 bp, Homo sapiens
taccttgaaaataagaatagaa

SEQ ID NO: 881777 - DNA, 18 bp, Homo sapiens
taccttgaacactggggg

SEQ ID NO: 881778 - DNA, 18 bp, Homo sapiens
taccttgacacatagttt

SEQ ID NO: 881779 - DNA, 15 bp, Homo sapiens
taccttgttgtgttt

SEQ ID NO: 881780 - DNA, 21 bp, Homo sapiens
taccttgtttttaatctcctg

SEQ ID NO: 881781 - DNA, 16 bp, Homo sapiens
tacctttaattttaat

SEQ ID NO: 881782 - DNA, 15 bp, Homo sapiens
tacctttctagcctt

SEQ ID NO: 881783 - DNA, 17 bp, Homo sapiens
tacctttctagccttag

SEQ ID NO: 881784 - DNA, 19 bp, Homo sapiens
tacctttgaaatattaaaa

SEQ ID NO: 881785 - DNA, 15 bp, Homo sapiens
tacctttgcgtggat

SEQ ID NO: 881786 - DNA, 17 bp, Homo sapiens
taccttttcagggctgg

SEQ ID NO: 881787 - DNA, 21 bp, Homo sapiens
taccttttctataagttgtac

SEQ ID NO: 881788 - DNA, 16 bp, Homo sapiens
taccttttctgttgta

SEQ ID NO: 881789 - DNA, 21 bp, Homo sapiens
taccttttgaggagccccagc

SEQ ID NO: 881790 - DNA, 14 bp, Homo sapiens
taccttttgtctct

SEQ ID NO: 881791 - DNA, 15 bp, Homo sapiens
taccttttgtctctt

SEQ ID NO: 881792 - DNA, 14 bp, Homo sapiens
tacctttttatatt

SEQ ID NO: 881793 - DNA, 23 bp, Homo sapiens
tacgaaaaaatggtagcatttta

SEQ ID NO: 881794 - DNA, 17 bp, Homo sapiens
tacgaaataattgttgt

SEQ ID NO: 881795 - DNA, 22 bp, Homo sapiens
tacgaacctacagttttaactg

SEQ ID NO: 881796 - DNA, 17 bp, Homo sapiens
tacgactttattttctg

SEQ ID NO: 881797 - DNA, 13 bp, Homo sapiens
tacgatgcttcaa

SEQ ID NO: 881798 - DNA, 16 bp, Homo sapiens
tacgcacataccttca

SEQ ID NO: 881799 - DNA, 14 bp, Homo sapiens
tacgcatcccatct

SEQ ID NO: 881800 - DNA, 19 bp, Homo sapiens
tacgcccaacccttcccca

SEQ ID NO: 881801 - DNA, 16 bp, Homo sapiens
tacgcccatctcagga

SEQ ID NO: 881802 - DNA, 15 bp, Homo sapiens
tacgctcatctctgg

SEQ ID NO: 881803 - DNA, 22 bp, Homo sapiens
tacgctgaagatggcatcctgt

SEQ ID NO: 881804 - DNA, 15 bp, Homo sapiens
tacgctttgattcat

SEQ ID NO: 881805 - DNA, 12 bp, Homo sapiens
tacgctttgtca

SEQ ID NO: 881806 - DNA, 19 bp, Homo sapiens
tacggagggaggacatcat

SEQ ID NO: 881807 - DNA, 20 bp, Homo sapiens
tacggagggaggacatcata

SEQ ID NO: 881808 - DNA, 16 bp, Homo sapiens
tacggatttattatat

SEQ ID NO: 881809 - DNA, 15 bp, Homo sapiens
tacggattttcagtt

SEQ ID NO: 881810 - DNA, 18 bp, Homo sapiens
tacggggaaaatgcattt

SEQ ID NO: 881811 - DNA, 19 bp, Homo sapiens
tacggggaaaatgcatttt

SEQ ID NO: 881812 - DNA, 16 bp, Homo sapiens
tacgggggctgtgact

SEQ ID NO: 881813 - DNA, 11 bp, Homo sapiens
tacggtacaga

SEQ ID NO: 881814 - DNA, 12 bp, Homo sapiens
tacgtacacatt

SEQ ID NO: 881815 - DNA, 17 bp, Homo sapiens
tacgtagttgtgctttt

SEQ ID NO: 881816 - DNA, 15 bp, Homo sapiens
tacgtataaatatca

SEQ ID NO: 881817 - DNA, 20 bp, Homo sapiens
tacgtataaatatcagtatt

SEQ ID NO: 881818 - DNA, 14 bp, Homo sapiens
tacgtatttttctg

SEQ ID NO: 881819 - DNA, 13 bp, Homo sapiens
tacgtctgggaga

SEQ ID NO: 881820 - DNA, 21 bp, Homo sapiens
tacgtgcaaacaacctgaatc

SEQ ID NO: 881821 - DNA, 22 bp, Homo sapiens
tacgtgcaaacaacctgaatct

SEQ ID NO: 881822 - DNA, 17 bp, Homo sapiens
tacgtgtcaaaaaagaa

SEQ ID NO: 881823 - DNA, 18 bp, Homo sapiens
tacgttcctattgtcatt

SEQ ID NO: 881824 - DNA, 15 bp, Homo sapiens
tacgttctctttaaa

SEQ ID NO: 881825 - DNA, 14 bp, Homo sapiens
tacgttgtgcattt

SEQ ID NO: 881826 - DNA, 12 bp, Homo sapiens
tacgtttaaagt

SEQ ID NO: 881827 - DNA, 13 bp, Homo sapiens
tacgtttaaagtg

SEQ ID NO: 881828 - DNA, 15 bp, Homo sapiens
tacgtttaaagtgca

SEQ ID NO: 881829 - DNA, 15 bp, Homo sapiens
tacgtttctgtggag

SEQ ID NO: 881830 - DNA, 22 bp, Homo sapiens
tacgtttgcaccgcctgccctc

SEQ ID NO: 881831 - DNA, 17 bp, Homo sapiens
tacgttttgtgtatatt

SEQ ID NO: 881832 - DNA, 16 bp, Homo sapiens
tactaaaaagaaggaa

SEQ ID NO: 881833 - DNA, 19 bp, Homo sapiens
tactaaaaagtataaaata

SEQ ID NO: 881834 - DNA, 21 bp, Homo sapiens
tactaaaaagtataaaatagt

SEQ ID NO: 881835 - DNA, 22 bp, Homo sapiens
tactaaagatatcagagctctt

SEQ ID NO: 881836 - DNA, 22 bp, Homo sapiens
tactaacaaatgtaaaattatg

SEQ ID NO: 881837 - DNA, 23 bp, Homo sapiens
tactaacaatcagctccttcctg

SEQ ID NO: 881838 - DNA, 14 bp, Homo sapiens
tactaacactggct

SEQ ID NO: 881839 - DNA, 15 bp, Homo sapiens
tactaagaaaagata

SEQ ID NO: 881840 - DNA, 15 bp, Homo sapiens
tactaagaagaaaat

SEQ ID NO: 881841 - DNA, 20 bp, Homo sapiens
tactaagcatagcaaacaga

SEQ ID NO: 881842 - DNA, 23 bp, Homo sapiens
tactaaggagtaatctgtgtaca

SEQ ID NO: 881843 - DNA, 23 bp, Homo sapiens
tactaagtgatgctgtgatacct

SEQ ID NO: 881844 - DNA, 14 bp, Homo sapiens
tactaagttcacat

SEQ ID NO: 881845 - DNA, 12 bp, Homo sapiens
tactaataaatt

SEQ ID NO: 881846 - DNA, 21 bp, Homo sapiens
tactaatagacaatttattat

SEQ ID NO: 881847 - DNA, 16 bp, Homo sapiens
tactaatctgagattg

SEQ ID NO: 881848 - DNA, 15 bp, Homo sapiens
tactaatgatgagca

SEQ ID NO: 881849 - DNA, 19 bp, Homo sapiens
tactaatgatgagcattta

SEQ ID NO: 881850 - DNA, 13 bp, Homo sapiens
tactaattccaca

SEQ ID NO: 881851 - DNA, 15 bp, Homo sapiens
tactaattttacaca

SEQ ID NO: 881852 - DNA, 17 bp, Homo sapiens
tactaattttacacatt

SEQ ID NO: 881853 - DNA, 15 bp, Homo sapiens
tactaatttttgctt

SEQ ID NO: 881854 - DNA, 20 bp, Homo sapiens
tactaatttttgcttaacat

SEQ ID NO: 881855 - DNA, 21 bp, Homo sapiens
tactaatttttgcttaacatt

SEQ ID NO: 881856 - DNA, 22 bp, Homo sapiens
tactaatttttgcttaacatta

SEQ ID NO: 881857 - DNA, 18 bp, Homo sapiens
tactacaaaatttgaaat

SEQ ID NO: 881858 - DNA, 13 bp, Homo sapiens
tactacaaggcta

SEQ ID NO: 881859 - DNA, 21 bp, Homo sapiens
tactacagtcaagatagaaag

SEQ ID NO: 881860 - DNA, 13 bp, Homo sapiens
tactaccagaagg

SEQ ID NO: 881861 - DNA, 22 bp, Homo sapiens
tactacctgtgtatatagtttt

SEQ ID NO: 881862 - DNA, 16 bp, Homo sapiens
tactaccttgaaaata

SEQ ID NO: 881863 - DNA, 18 bp, Homo sapiens
tactacggagaaactcat

SEQ ID NO: 881864 - DNA, 17 bp, Homo sapiens
tactactcctgtaggaa

SEQ ID NO: 881865 - DNA, 21 bp, Homo sapiens
tactactgattttaaaatgaa

SEQ ID NO: 881866 - DNA, 22 bp, Homo sapiens
tactacttaaaatgattctcta

SEQ ID NO: 881867 - DNA, 12 bp, Homo sapiens
tactactttgtt

SEQ ID NO: 881868 - DNA, 20 bp, Homo sapiens
tactagagatattttgtaaa

SEQ ID NO: 881869 - DNA, 14 bp, Homo sapiens
tactagatgtcttt

SEQ ID NO: 881870 - DNA, 21 bp, Homo sapiens
tactagcaaaataaaacatag

SEQ ID NO: 881871 - DNA, 24 bp, Homo sapiens
tactagcaaaataaaacatagcaa

SEQ ID NO: 881872 - DNA, 20 bp, Homo sapiens
tactagctacaaaaaatatt

SEQ ID NO: 881873 - DNA, 23 bp, Homo sapiens
tactaggaagaacgttttttcct

SEQ ID NO: 881874 - DNA, 19 bp, Homo sapiens
tactagggagccatttgag

SEQ ID NO: 881875 - DNA, 21 bp, Homo sapiens
tactagggatccctcatctgt

SEQ ID NO: 881876 - DNA, 15 bp, Homo sapiens
tactaggtaacttca

SEQ ID NO: 881877 - DNA, 16 bp, Homo sapiens
tactaggtaacttcat

SEQ ID NO: 881878 - DNA, 19 bp, Homo sapiens
tactaggtaacttcatatt

SEQ ID NO: 881879 - DNA, 21 bp, Homo sapiens
tactagtcaccagagacttta

SEQ ID NO: 881880 - DNA, 16 bp, Homo sapiens
tactagtcctctagaa

SEQ ID NO: 881881 - DNA, 18 bp, Homo sapiens
tactagtcctctagaaat

SEQ ID NO: 881882 - DNA, 15 bp, Homo sapiens
tactagtgttctgtt

SEQ ID NO: 881883 - DNA, 14 bp, Homo sapiens
tactagttacacat

SEQ ID NO: 881884 - DNA, 19 bp, Homo sapiens
tactataattgtaaatatt

SEQ ID NO: 881885 - DNA, 16 bp, Homo sapiens
tactatagcaaagtag

SEQ ID NO: 881886 - DNA, 16 bp, Homo sapiens
tactatagtaccagta

SEQ ID NO: 881887 - DNA, 13 bp, Homo sapiens
tactatatacata

SEQ ID NO: 881888 - DNA, 18 bp, Homo sapiens
tactatcatctcttaaat

SEQ ID NO: 881889 - DNA, 15 bp, Homo sapiens
tactatccatgtaat

SEQ ID NO: 881890 - DNA, 23 bp, Homo sapiens
tactatccccaaactcctttact

SEQ ID NO: 881891 - DNA, 15 bp, Homo sapiens
tactatctgttgaaa

SEQ ID NO: 881892 - DNA, 23 bp, Homo sapiens
tactatgatcagaagaacatgat

SEQ ID NO: 881893 - DNA, 17 bp, Homo sapiens
tactatgatgggcttct

SEQ ID NO: 881894 - DNA, 15 bp, Homo sapiens
tactatgcagtatct

SEQ ID NO: 881895 - DNA, 19 bp, Homo sapiens
tactatgcagtatctctta

SEQ ID NO: 881896 - DNA, 23 bp, Homo sapiens
tactatggccctggcctagcata

SEQ ID NO: 881897 - DNA, 16 bp, Homo sapiens
tactatggctgattta

SEQ ID NO: 881898 - DNA, 17 bp, Homo sapiens
tactatgtctgaacata

SEQ ID NO: 881899 - DNA, 21 bp, Homo sapiens
tactatgtgccagttcctgta

SEQ ID NO: 881900 - DNA, 18 bp, Homo sapiens
tactatgttaataacttg

SEQ ID NO: 881901 - DNA, 18 bp, Homo sapiens
tactattccctttgactt

SEQ ID NO: 881902 - DNA, 19 bp, Homo sapiens
tactattcttggttcttat

SEQ ID NO: 881903 - DNA, 21 bp, Homo sapiens
tactatttaaagcctcctcat

SEQ ID NO: 881904 - DNA, 14 bp, Homo sapiens
tactattttcattt

SEQ ID NO: 881905 - DNA, 18 bp, Homo sapiens
tactattttctacaatta

SEQ ID NO: 881906 - DNA, 23 bp, Homo sapiens
tactcaaatggtgtcatggctga

SEQ ID NO: 881907 - DNA, 19 bp, Homo sapiens
tactcaagcgggtggctct

SEQ ID NO: 881908 - DNA, 22 bp, Homo sapiens
tactcaatgcctggagacagat

SEQ ID NO: 881909 - DNA, 21 bp, Homo sapiens
tactcacagtctctttaatct

SEQ ID NO: 881910 - DNA, 11 bp, Homo sapiens
tactcacattt

SEQ ID NO: 881911 - DNA, 14 bp, Homo sapiens
tactcacattttgt

SEQ ID NO: 881912 - DNA, 16 bp, Homo sapiens
tactcacattttgtta

SEQ ID NO: 881913 - DNA, 14 bp, Homo sapiens
tactcacttttcac

SEQ ID NO: 881914 - DNA, 21 bp, Homo sapiens
tactcagaaatggacaaagaa

SEQ ID NO: 881915 - DNA, 16 bp, Homo sapiens
tactcagaagcctgag

SEQ ID NO: 881916 - DNA, 18 bp, Homo sapiens
tactcagaatagctgttt

SEQ ID NO: 881917 - DNA, 22 bp, Homo sapiens
tactcagaattctctagtttga

SEQ ID NO: 881918 - DNA, 14 bp, Homo sapiens
tactcagagcagag

SEQ ID NO: 881919 - DNA, 15 bp, Homo sapiens
tactcagagcagatg

SEQ ID NO: 881920 - DNA, 22 bp, Homo sapiens
tactcagatgaccccagaaact

SEQ ID NO: 881921 - DNA, 19 bp, Homo sapiens
tactcagcagcagagagcc

SEQ ID NO: 881922 - DNA, 15 bp, Homo sapiens
tactcagcagccctc

SEQ ID NO: 881923 - DNA, 12 bp, Homo sapiens
tactcagccctg

SEQ ID NO: 881924 - DNA, 13 bp, Homo sapiens
tactcagccctgg

SEQ ID NO: 881925 - DNA, 16 bp, Homo sapiens
tactcagccctgggcc

SEQ ID NO: 881926 - DNA, 12 bp, Homo sapiens
tactcagcctgc

SEQ ID NO: 881927 - DNA, 15 bp, Homo sapiens
tactcaggaggctga

SEQ ID NO: 881928 - DNA, 22 bp, Homo sapiens
tactcaggaggctgaggcagaa

SEQ ID NO: 881929 - DNA, 15 bp, Homo sapiens
tactcagggctcctc

SEQ ID NO: 881930 - DNA, 14 bp, Homo sapiens
tactcaggggatgt

SEQ ID NO: 881931 - DNA, 17 bp, Homo sapiens
tactcaggggatgttta

SEQ ID NO: 881932 - DNA, 16 bp, Homo sapiens
tactcagtcaaacact

SEQ ID NO: 881933 - DNA, 19 bp, Homo sapiens
tactcagtgttagagaaat

SEQ ID NO: 881934 - DNA, 17 bp, Homo sapiens
tactcatcagagcagct

SEQ ID NO: 881935 - DNA, 20 bp, Homo sapiens
tactcatcgggcccagggac

SEQ ID NO: 881936 - DNA, 21 bp, Homo sapiens
tactcatcgggcccagggaca

SEQ ID NO: 881937 - DNA, 17 bp, Homo sapiens
tactcatgaatgaaaat

SEQ ID NO: 881938 - DNA, 17 bp, Homo sapiens
tactcatgatcttgtga

SEQ ID NO: 881939 - DNA, 13 bp, Homo sapiens
tactcatgcgtga

SEQ ID NO: 881940 - DNA, 15 bp, Homo sapiens
tactcattagaatta

SEQ ID NO: 881941 - DNA, 14 bp, Homo sapiens
tactcatttttcat

SEQ ID NO: 881942 - DNA, 19 bp, Homo sapiens
tactccaaggtttataaag

SEQ ID NO: 881943 - DNA, 21 bp, Homo sapiens
tactccactgccctggcagca

SEQ ID NO: 881944 - DNA, 12 bp, Homo sapiens
tactccagcctg

SEQ ID NO: 881945 - DNA, 14 bp, Homo sapiens
tactccagcctggg

SEQ ID NO: 881946 - DNA, 16 bp, Homo sapiens
tactccagcctgggtg

SEQ ID NO: 881947 - DNA, 19 bp, Homo sapiens
tactccagtggtgaagaaa

SEQ ID NO: 881948 - DNA, 15 bp, Homo sapiens
tactccataaacaga

SEQ ID NO: 881949 - DNA, 16 bp, Homo sapiens
tactccccttgagctg

SEQ ID NO: 881950 - DNA, 19 bp, Homo sapiens
tactccctgcagatgccac

SEQ ID NO: 881951 - DNA, 15 bp, Homo sapiens
tactcccttcctggc

SEQ ID NO: 881952 - DNA, 17 bp, Homo sapiens
tactccgttcctggcat

SEQ ID NO: 881953 - DNA, 17 bp, Homo sapiens
tactcctacctcagcct

SEQ ID NO: 881954 - DNA, 12 bp, Homo sapiens
tactcctcccag

SEQ ID NO: 881955 - DNA, 16 bp, Homo sapiens
tactcctcctctttct

SEQ ID NO: 881956 - DNA, 18 bp, Homo sapiens
tactcctcctctttctct

SEQ ID NO: 881957 - DNA, 16 bp, Homo sapiens
tactcctcctgctcct

SEQ ID NO: 881958 - DNA, 12 bp, Homo sapiens
tactcctctgca

SEQ ID NO: 881959 - DNA, 13 bp, Homo sapiens
tactcctctgcag

SEQ ID NO: 881960 - DNA, 12 bp, Homo sapiens
tactcctgcaaa

SEQ ID NO: 881961 - DNA, 17 bp, Homo sapiens
tactcctgcaaaatttt

SEQ ID NO: 881962 - DNA, 12 bp, Homo sapiens
tactcctgggct

SEQ ID NO: 881963 - DNA, 13 bp, Homo sapiens
tactcctgggtca

SEQ ID NO: 881964 - DNA, 19 bp, Homo sapiens
tactcctgtaattcctacc

SEQ ID NO: 881965 - DNA, 17 bp, Homo sapiens
tactcctgtgctctgga

SEQ ID NO: 881966 - DNA, 19 bp, Homo sapiens
tactccttttggctgggga

SEQ ID NO: 881967 - DNA, 15 bp, Homo sapiens
tactctacactgaaa

SEQ ID NO: 881968 - DNA, 14 bp, Homo sapiens
tactctagaacatg

SEQ ID NO: 881969 - DNA, 18 bp, Homo sapiens
tactctagcctgggccag

SEQ ID NO: 881970 - DNA, 14 bp, Homo sapiens
tactctagttctgt

SEQ ID NO: 881971 - DNA, 18 bp, Homo sapiens
tactctcaaaatctttgt

SEQ ID NO: 881972 - DNA, 16 bp, Homo sapiens
tactctccaacctgga

SEQ ID NO: 881973 - DNA, 18 bp, Homo sapiens
tactctccaacctggaca

SEQ ID NO: 881974 - DNA, 20 bp, Homo sapiens
tactctccccacgagggctg

SEQ ID NO: 881975 - DNA, 22 bp, Homo sapiens
tactctccccacgagggctggc

SEQ ID NO: 881976 - DNA, 20 bp, Homo sapiens
tactctcctcggccccctcc

SEQ ID NO: 881977 - DNA, 19 bp, Homo sapiens
tactctgaagggcatcatg

SEQ ID NO: 881978 - DNA, 13 bp, Homo sapiens
tactctgagccca

SEQ ID NO: 881979 - DNA, 14 bp, Homo sapiens
tactctgagcccag

SEQ ID NO: 881980 - DNA, 17 bp, Homo sapiens
tactctgagcccaggcc

SEQ ID NO: 881981 - DNA, 14 bp, Homo sapiens
tactctgccctcta

SEQ ID NO: 881982 - DNA, 16 bp, Homo sapiens
tactctgccctctaga

SEQ ID NO: 881983 - DNA, 18 bp, Homo sapiens
tactctgctccaaagtag

SEQ ID NO: 881984 - DNA, 23 bp, Homo sapiens
tactctggaatgtttttccctcc

SEQ ID NO: 881985 - DNA, 12 bp, Homo sapiens
tactctggtgga

SEQ ID NO: 881986 - DNA, 17 bp, Homo sapiens
tactctggttctttgtt

SEQ ID NO: 881987 - DNA, 15 bp, Homo sapiens
tactctgtcagatgg

SEQ ID NO: 881988 - DNA, 15 bp, Homo sapiens
tactctgtctcccag

SEQ ID NO: 881989 - DNA, 18 bp, Homo sapiens
tactctgtcttaaatgag

SEQ ID NO: 881990 - DNA, 11 bp, Homo sapiens
tactctgtgta

SEQ ID NO: 881991 - DNA, 19 bp, Homo sapiens
tactctgtgtaaagacttg

SEQ ID NO: 881992 - DNA, 19 bp, Homo sapiens
tactctgttccttcacatc

SEQ ID NO: 881993 - DNA, 21 bp, Homo sapiens
tactcttaaatcatttggtta

SEQ ID NO: 881994 - DNA, 22 bp, Homo sapiens
tactcttaaatcatttggttaa

SEQ ID NO: 881995 - DNA, 21 bp, Homo sapiens
tactcttaggaagagaaacca

SEQ ID NO: 881996 - DNA, 21 bp, Homo sapiens
tactcttatgatcaattgtta

SEQ ID NO: 881997 - DNA, 19 bp, Homo sapiens
tactcttcgcttctggtat

SEQ ID NO: 881998 - DNA, 14 bp, Homo sapiens
tactcttcttgaaa

SEQ ID NO: 881999 - DNA, 17 bp, Homo sapiens
tactcttgctgatggct

SEQ ID NO: 882000 - DNA, 16 bp, Homo sapiens
tactcttggtttttat

SEQ ID NO: 882001 - DNA, 14 bp, Homo sapiens
tactcttgtcattt

SEQ ID NO: 882002 - DNA, 21 bp, Homo sapiens
tactctttatttctagcagag

SEQ ID NO: 882003 - DNA, 22 bp, Homo sapiens
tactctttgagatagaagaact

SEQ ID NO: 882004 - DNA, 14 bp, Homo sapiens
tactctttgtgggg

SEQ ID NO: 882005 - DNA, 18 bp, Homo sapiens
tactctttttctaaagtg

SEQ ID NO: 882006 - DNA, 20 bp, Homo sapiens
tactgaaaatacaaaaatta

SEQ ID NO: 882007 - DNA, 14 bp, Homo sapiens
tactgaaacagatt

SEQ ID NO: 882008 - DNA, 22 bp, Homo sapiens
tactgaagaaaaggggagcaca

SEQ ID NO: 882009 - DNA, 13 bp, Homo sapiens
tactgaaggaaaa

SEQ ID NO: 882010 - DNA, 14 bp, Homo sapiens
tactgaaggaaaaa

SEQ ID NO: 882011 - DNA, 23 bp, Homo sapiens
tactgaaggaaaaacacaagcaa

SEQ ID NO: 882012 - DNA, 19 bp, Homo sapiens
tactgaatgaagcagtatt

SEQ ID NO: 882013 - DNA, 12 bp, Homo sapiens
tactgaattttt

SEQ ID NO: 882014 - DNA, 18 bp, Homo sapiens
tactgacaataaaaatgt

SEQ ID NO: 882015 - DNA, 17 bp, Homo sapiens
tactgacagaagttatt

SEQ ID NO: 882016 - DNA, 14 bp, Homo sapiens
tactgacagggagc

SEQ ID NO: 882017 - DNA, 23 bp, Homo sapiens
tactgacagggagcagcccccgg

SEQ ID NO: 882018 - DNA, 13 bp, Homo sapiens
tactgacatgtgg

SEQ ID NO: 882019 - DNA, 13 bp, Homo sapiens
tactgacccaact

SEQ ID NO: 882020 - DNA, 17 bp, Homo sapiens
tactgacccaactgggg

SEQ ID NO: 882021 - DNA, 22 bp, Homo sapiens
tactgacctacctcaaagggca

SEQ ID NO: 882022 - DNA, 20 bp, Homo sapiens
tactgactttgcttgctttg

SEQ ID NO: 882023 - DNA, 20 bp, Homo sapiens
tactgagaaaagcctctcca

SEQ ID NO: 882024 - DNA, 19 bp, Homo sapiens
tactgagacttgttcttgg

SEQ ID NO: 882025 - DNA, 19 bp, Homo sapiens
tactgagccttgtaattct

SEQ ID NO: 882026 - DNA, 20 bp, Homo sapiens
tactgaggaaatatttccat

SEQ ID NO: 882027 - DNA, 17 bp, Homo sapiens
tactgaggggattctct

SEQ ID NO: 882028 - DNA, 15 bp, Homo sapiens
tactgaggtgctatg

SEQ ID NO: 882029 - DNA, 21 bp, Homo sapiens
tactgagttttttattccagt

SEQ ID NO: 882030 - DNA, 18 bp, Homo sapiens
tactgatgttcctttgga

SEQ ID NO: 882031 - DNA, 22 bp, Homo sapiens
tactgattattttcttcatcca

SEQ ID NO: 882032 - DNA, 14 bp, Homo sapiens
tactgattgtttca

SEQ ID NO: 882033 - DNA, 18 bp, Homo sapiens
tactgatttcagtaagtc

SEQ ID NO: 882034 - DNA, 21 bp, Homo sapiens
tactgatttcctttggagctt

SEQ ID NO: 882035 - DNA, 21 bp, Homo sapiens
tactgcaaatcaggcttttgt

SEQ ID NO: 882036 - DNA, 21 bp, Homo sapiens
tactgcacagtggcacaaaaa

SEQ ID NO: 882037 - DNA, 16 bp, Homo sapiens
tactgcactccagcct

SEQ ID NO: 882038 - DNA, 19 bp, Homo sapiens
tactgcactccagcctggg

SEQ ID NO: 882039 - DNA, 16 bp, Homo sapiens
tactgcactttccccc

SEQ ID NO: 882040 - DNA, 15 bp, Homo sapiens
tactgcagcacctcc

SEQ ID NO: 882041 - DNA, 16 bp, Homo sapiens
tactgcagcacctcca

SEQ ID NO: 882042 - DNA, 20 bp, Homo sapiens
tactgcagcctttgcctccc

SEQ ID NO: 882043 - DNA, 15 bp, Homo sapiens
tactgcagctttaca

SEQ ID NO: 882044 - DNA, 19 bp, Homo sapiens
tactgcagctttacatgca

SEQ ID NO: 882045 - DNA, 13 bp, Homo sapiens
tactgcatacttt

SEQ ID NO: 882046 - DNA, 17 bp, Homo sapiens
tactgcatatgaaagga

SEQ ID NO: 882047 - DNA, 20 bp, Homo sapiens
tactgcccaggcctgcctgt

SEQ ID NO: 882048 - DNA, 22 bp, Homo sapiens
tactgcccggggcagctgccag

SEQ ID NO: 882049 - DNA, 20 bp, Homo sapiens
tactgccgaagaattgtctt

SEQ ID NO: 882050 - DNA, 21 bp, Homo sapiens
tactgccgaagaattgtcttg

SEQ ID NO: 882051 - DNA, 15 bp, Homo sapiens
tactgcctactgtta

SEQ ID NO: 882052 - DNA, 21 bp, Homo sapiens
tactgcctctacagttaatag

SEQ ID NO: 882053 - DNA, 15 bp, Homo sapiens
tactgcctgaataaa

SEQ ID NO: 882054 - DNA, 12 bp, Homo sapiens
tactgccttaat

SEQ ID NO: 882055 - DNA, 22 bp, Homo sapiens
tactgccttaataaaaaatgaa

SEQ ID NO: 882056 - DNA, 19 bp, Homo sapiens
tactgcctttagaaaatat

SEQ ID NO: 882057 - DNA, 19 bp, Homo sapiens
tactgcgactttctgcctg

SEQ ID NO: 882058 - DNA, 20 bp, Homo sapiens
tactgctaagtatttcccag

SEQ ID NO: 882059 - DNA, 21 bp, Homo sapiens
tactgctaagtatttcccagc

SEQ ID NO: 882060 - DNA, 22 bp, Homo sapiens
tactgctaagtatttcccagca

SEQ ID NO: 882061 - DNA, 15 bp, Homo sapiens
tactgctaatgttga

SEQ ID NO: 882062 - DNA, 16 bp, Homo sapiens
tactgctaatgttgat

SEQ ID NO: 882063 - DNA, 19 bp, Homo sapiens
tactgctagtcttaagaac

SEQ ID NO: 882064 - DNA, 16 bp, Homo sapiens
tactgctctagaaagt

SEQ ID NO: 882065 - DNA, 14 bp, Homo sapiens
tactgctctgaata

SEQ ID NO: 882066 - DNA, 14 bp, Homo sapiens
tactgctctgagaa

SEQ ID NO: 882067 - DNA, 16 bp, Homo sapiens
tactgctgattcttgt

SEQ ID NO: 882068 - DNA, 13 bp, Homo sapiens
tactgctggagtc

SEQ ID NO: 882069 - DNA, 16 bp, Homo sapiens
tactgctgtcttccaa

SEQ ID NO: 882070 - DNA, 14 bp, Homo sapiens
tactgcttctcttt

SEQ ID NO: 882071 - DNA, 19 bp, Homo sapiens
tactggaaatgtagcactt

SEQ ID NO: 882072 - DNA, 20 bp, Homo sapiens
tactggaaatgtagcactta

SEQ ID NO: 882073 - DNA, 23 bp, Homo sapiens
tactggaagttttgcatttatgg

SEQ ID NO: 882074 - DNA, 15 bp, Homo sapiens
tactggaataaacag

SEQ ID NO: 882075 - DNA, 18 bp, Homo sapiens
tactggaataaacagtga

SEQ ID NO: 882076 - DNA, 19 bp, Homo sapiens
tactggaataatttgtaaa

SEQ ID NO: 882077 - DNA, 17 bp, Homo sapiens
tactggacaaaatcaat

SEQ ID NO: 882078 - DNA, 14 bp, Homo sapiens
tactggagaagtct

SEQ ID NO: 882079 - DNA, 17 bp, Homo sapiens
tactggataaattgttt

SEQ ID NO: 882080 - DNA, 14 bp, Homo sapiens
tactggcagctcct

SEQ ID NO: 882081 - DNA, 13 bp, Homo sapiens
tactggcctctgt

SEQ ID NO: 882082 - DNA, 15 bp, Homo sapiens
tactggcctctgtga

SEQ ID NO: 882083 - DNA, 18 bp, Homo sapiens
tactggcctttttcattt

SEQ ID NO: 882084 - DNA, 18 bp, Homo sapiens
tactggctctttattcat

SEQ ID NO: 882085 - DNA, 19 bp, Homo sapiens
tactgggtgaggaaatcca

SEQ ID NO: 882086 - DNA, 14 bp, Homo sapiens
tactgggtgtcatt

SEQ ID NO: 882087 - DNA, 15 bp, Homo sapiens
tactgggttcttgtt

SEQ ID NO: 882088 - DNA, 13 bp, Homo sapiens
tactggtaagatt

SEQ ID NO: 882089 - DNA, 15 bp, Homo sapiens
tactggttgactttc

SEQ ID NO: 882090 - DNA, 13 bp, Homo sapiens
tactggttgcatg

SEQ ID NO: 882091 - DNA, 20 bp, Homo sapiens
tactggttgcatggaaatca

SEQ ID NO: 882092 - DNA, 21 bp, Homo sapiens
tactgtaaaagttataataac

SEQ ID NO: 882093 - DNA, 22 bp, Homo sapiens
tactgtaaaagttataataact

SEQ ID NO: 882094 - DNA, 13 bp, Homo sapiens
tactgtaactgct

SEQ ID NO: 882095 - DNA, 23 bp, Homo sapiens
tactgtaactgctcagagcttta

SEQ ID NO: 882096 - DNA, 18 bp, Homo sapiens
tactgtaactgtcagtgt

SEQ ID NO: 882097 - DNA, 11 bp, Homo sapiens
tactgtaactt

SEQ ID NO: 882098 - DNA, 12 bp, Homo sapiens
tactgtaacttt

SEQ ID NO: 882099 - DNA, 14 bp, Homo sapiens
tactgtaacttttt

SEQ ID NO: 882100 - DNA, 19 bp, Homo sapiens
tactgtaacttttttaaat

SEQ ID NO: 882101 - DNA, 21 bp, Homo sapiens
tactgtaatgggtaattctga

SEQ ID NO: 882102 - DNA, 16 bp, Homo sapiens
tactgtaatttgtgat

SEQ ID NO: 882103 - DNA, 17 bp, Homo sapiens
tactgtaatttgtgata

SEQ ID NO: 882104 - DNA, 12 bp, Homo sapiens
tactgtaatttt

SEQ ID NO: 882105 - DNA, 15 bp, Homo sapiens
tactgtacataaatt

SEQ ID NO: 882106 - DNA, 15 bp, Homo sapiens
tactgtacatgctat

SEQ ID NO: 882107 - DNA, 20 bp, Homo sapiens
tactgtacattttttttcaa

SEQ ID NO: 882108 - DNA, 13 bp, Homo sapiens
tactgtagttttt

SEQ ID NO: 882109 - DNA, 15 bp, Homo sapiens
tactgtagtttttct

SEQ ID NO: 882110 - DNA, 16 bp, Homo sapiens
tactgtatatgtattc

SEQ ID NO: 882111 - DNA, 15 bp, Homo sapiens
tactgtatattcagg

SEQ ID NO: 882112 - DNA, 18 bp, Homo sapiens
tactgtattgggcttctt

SEQ ID NO: 882113 - DNA, 17 bp, Homo sapiens
tactgtatttctaagaa

SEQ ID NO: 882114 - DNA, 23 bp, Homo sapiens
tactgtattttgtattgtttcaa

SEQ ID NO: 882115 - DNA, 19 bp, Homo sapiens
tactgtatttttactattg

SEQ ID NO: 882116 - DNA, 14 bp, Homo sapiens
tactgtcaaatgat

SEQ ID NO: 882117 - DNA, 17 bp, Homo sapiens
tactgtcaaatgatgtg

SEQ ID NO: 882118 - DNA, 13 bp, Homo sapiens
tactgtcaataaa

SEQ ID NO: 882119 - DNA, 23 bp, Homo sapiens
tactgtcatcctcaaagaaagtg

SEQ ID NO: 882120 - DNA, 22 bp, Homo sapiens
tactgtccaccagtttatacag

SEQ ID NO: 882121 - DNA, 12 bp, Homo sapiens
tactgtcctgga

SEQ ID NO: 882122 - DNA, 18 bp, Homo sapiens
tactgtctcctccctggg

SEQ ID NO: 882123 - DNA, 19 bp, Homo sapiens
tactgtctcctccctgggc

SEQ ID NO: 882124 - DNA, 17 bp, Homo sapiens
tactgtctctggagtga

SEQ ID NO: 882125 - DNA, 21 bp, Homo sapiens
tactgtctggttttaacaatt

SEQ ID NO: 882126 - DNA, 22 bp, Homo sapiens
tactgtctggttttaacaattt

SEQ ID NO: 882127 - DNA, 15 bp, Homo sapiens
tactgtcttactatt

SEQ ID NO: 882128 - DNA, 23 bp, Homo sapiens
tactgtgcagaataatggaaaca

SEQ ID NO: 882129 - DNA, 13 bp, Homo sapiens
tactgtggggaga

SEQ ID NO: 882130 - DNA, 11 bp, Homo sapiens
tactgtgtatg

SEQ ID NO: 882131 - DNA, 21 bp, Homo sapiens
tactgtgtgcttgttttataa

SEQ ID NO: 882132 - DNA, 17 bp, Homo sapiens
tactgtgtgtgtgaatg

SEQ ID NO: 882133 - DNA, 18 bp, Homo sapiens
tactgtgtgtgtgaatga

SEQ ID NO: 882134 - DNA, 19 bp, Homo sapiens
tactgtgtgtgtgaatgaa

SEQ ID NO: 882135 - DNA, 22 bp, Homo sapiens
tactgtgtgttttcccaaagca

SEQ ID NO: 882136 - DNA, 13 bp, Homo sapiens
tactgtgttccaa

SEQ ID NO: 882137 - DNA, 12 bp, Homo sapiens
tactgtgttcct

SEQ ID NO: 882138 - DNA, 19 bp, Homo sapiens
tactgtgttcctggcaata

SEQ ID NO: 882139 - DNA, 12 bp, Homo sapiens
tactgttactct

SEQ ID NO: 882140 - DNA, 22 bp, Homo sapiens
tactgttactctaaatagaaat

SEQ ID NO: 882141 - DNA, 16 bp, Homo sapiens
tactgttatctatctg

SEQ ID NO: 882142 - DNA, 23 bp, Homo sapiens
tactgttcaatggttctgaaata

SEQ ID NO: 882143 - DNA, 19 bp, Homo sapiens
tactgttcctttcagatga

SEQ ID NO: 882144 - DNA, 23 bp, Homo sapiens
tactgttcggaaggggttcctca

SEQ ID NO: 882145 - DNA, 17 bp, Homo sapiens
tactgttctgtgtcttt

SEQ ID NO: 882146 - DNA, 14 bp, Homo sapiens
tactgttgatacaa

SEQ ID NO: 882147 - DNA, 18 bp, Homo sapiens
tactgttgatacaaacca

SEQ ID NO: 882148 - DNA, 23 bp, Homo sapiens
tactgttgcacaattttgataaa

SEQ ID NO: 882149 - DNA, 16 bp, Homo sapiens
tactgttgctttggga

SEQ ID NO: 882150 - DNA, 17 bp, Homo sapiens
tactgtttacagtttag

SEQ ID NO: 882151 - DNA, 22 bp, Homo sapiens
tactgtttattacttccatgaa

SEQ ID NO: 882152 - DNA, 19 bp, Homo sapiens
tactgtttcttgcactgaa

SEQ ID NO: 882153 - DNA, 20 bp, Homo sapiens
tactgtttcttgcactgaat

SEQ ID NO: 882154 - DNA, 17 bp, Homo sapiens
tactgttttatgttgat

SEQ ID NO: 882155 - DNA, 18 bp, Homo sapiens
tactgttttgaataaatt

SEQ ID NO: 882156 - DNA, 22 bp, Homo sapiens
tactgttttgaataaattttca

SEQ ID NO: 882157 - DNA, 15 bp, Homo sapiens
tactgttttgggcct

SEQ ID NO: 882158 - DNA, 16 bp, Homo sapiens
tactgtttttaatgtt

SEQ ID NO: 882159 - DNA, 15 bp, Homo sapiens
tacttaaaatgacaa

SEQ ID NO: 882160 - DNA, 20 bp, Homo sapiens
tacttaaaatgacaaagcca

SEQ ID NO: 882161 - DNA, 21 bp, Homo sapiens
tacttaaaatgacaaagccat

SEQ ID NO: 882162 - DNA, 22 bp, Homo sapiens
tacttaaagttgattttgaact

SEQ ID NO: 882163 - DNA, 23 bp, Homo sapiens
tacttaaagttgattttgaactt

SEQ ID NO: 882164 - DNA, 13 bp, Homo sapiens
tacttaacatatc

SEQ ID NO: 882165 - DNA, 13 bp, Homo sapiens
tacttaataaatt

SEQ ID NO: 882166 - DNA, 15 bp, Homo sapiens
tacttaatccaatgg

SEQ ID NO: 882167 - DNA, 13 bp, Homo sapiens
tacttacatttca

SEQ ID NO: 882168 - DNA, 18 bp, Homo sapiens
tacttacatttcagacat

SEQ ID NO: 882169 - DNA, 16 bp, Homo sapiens
tacttacatttccatt

SEQ ID NO: 882170 - DNA, 19 bp, Homo sapiens
tacttagccagttcaaagt

SEQ ID NO: 882171 - DNA, 21 bp, Homo sapiens
tacttagccagttcaaagtgt

SEQ ID NO: 882172 - DNA, 16 bp, Homo sapiens
tacttagggaagaaaa

SEQ ID NO: 882173 - DNA, 24 bp, Homo sapiens
tacttagggaagaaaaagcaagtg

SEQ ID NO: 882174 - DNA, 16 bp, Homo sapiens
tacttaggttattttg

SEQ ID NO: 882175 - DNA, 13 bp, Homo sapiens
tacttagtggtat

SEQ ID NO: 882176 - DNA, 16 bp, Homo sapiens
tacttatcatttttgt

SEQ ID NO: 882177 - DNA, 23 bp, Homo sapiens
tacttatcatttttgtataaaaa

SEQ ID NO: 882178 - DNA, 18 bp, Homo sapiens
tacttatgcaagatattt

SEQ ID NO: 882179 - DNA, 18 bp, Homo sapiens
tacttatttgtatatggt

SEQ ID NO: 882180 - DNA, 19 bp, Homo sapiens
tacttattttcagtgcatc

SEQ ID NO: 882181 - DNA, 20 bp, Homo sapiens
tacttattttcagtgcatca

SEQ ID NO: 882182 - DNA, 21 bp, Homo sapiens
tacttattttcagtgcatcat

SEQ ID NO: 882183 - DNA, 20 bp, Homo sapiens
tacttatttttgacagtgtt

SEQ ID NO: 882184 - DNA, 16 bp, Homo sapiens
tacttcaaaaataatg

SEQ ID NO: 882185 - DNA, 21 bp, Homo sapiens
tacttcaaaagccataacttg

SEQ ID NO: 882186 - DNA, 16 bp, Homo sapiens
tacttcagctttggat

SEQ ID NO: 882187 - DNA, 22 bp, Homo sapiens
tacttcaggggcacttcattga

SEQ ID NO: 882188 - DNA, 12 bp, Homo sapiens
tacttcagtatg

SEQ ID NO: 882189 - DNA, 18 bp, Homo sapiens
tacttcatagctccttgg

SEQ ID NO: 882190 - DNA, 14 bp, Homo sapiens
tacttccaagaaaa

SEQ ID NO: 882191 - DNA, 17 bp, Homo sapiens
tacttcccaaagccctt

SEQ ID NO: 882192 - DNA, 14 bp, Homo sapiens
tacttcccctggga

SEQ ID NO: 882193 - DNA, 17 bp, Homo sapiens
tacttcccctgggatgc

SEQ ID NO: 882194 - DNA, 14 bp, Homo sapiens
tacttccccttcct

SEQ ID NO: 882195 - DNA, 20 bp, Homo sapiens
tacttccccttcctaattcc

SEQ ID NO: 882196 - DNA, 16 bp, Homo sapiens
tacttcctcctcccca

SEQ ID NO: 882197 - DNA, 13 bp, Homo sapiens
tacttcctcctga

SEQ ID NO: 882198 - DNA, 16 bp, Homo sapiens
tacttcctcctgatgg

SEQ ID NO: 882199 - DNA, 17 bp, Homo sapiens
tacttcctcctgatggc

SEQ ID NO: 882200 - DNA, 13 bp, Homo sapiens
tacttcctggcct

SEQ ID NO: 882201 - DNA, 13 bp, Homo sapiens
tacttcctgtgta

SEQ ID NO: 882202 - DNA, 13 bp, Homo sapiens
tacttcctttctc

SEQ ID NO: 882203 - DNA, 21 bp, Homo sapiens
tacttcgtcttcgccctctga

SEQ ID NO: 882204 - DNA, 17 bp, Homo sapiens
tacttcgtcttctaatt

SEQ ID NO: 882205 - DNA, 18 bp, Homo sapiens
tacttcgtcttctaattt

SEQ ID NO: 882206 - DNA, 14 bp, Homo sapiens
tacttctctataaa

SEQ ID NO: 882207 - DNA, 18 bp, Homo sapiens
tacttctgactttacttg

SEQ ID NO: 882208 - DNA, 16 bp, Homo sapiens
tacttctgtaattgtg

SEQ ID NO: 882209 - DNA, 20 bp, Homo sapiens
tacttctgtaattgtgtgga

SEQ ID NO: 882210 - DNA, 16 bp, Homo sapiens
tacttctgtgttcatt

SEQ ID NO: 882211 - DNA, 17 bp, Homo sapiens
tacttctgtgttcattt

SEQ ID NO: 882212 - DNA, 18 bp, Homo sapiens
tacttctgtgttcatttt

SEQ ID NO: 882213 - DNA, 12 bp, Homo sapiens
tacttctgtttc

SEQ ID NO: 882214 - DNA, 13 bp, Homo sapiens
tacttctgtttct

SEQ ID NO: 882215 - DNA, 14 bp, Homo sapiens
tacttctgtttctc

SEQ ID NO: 882216 - DNA, 18 bp, Homo sapiens
tacttctgtttgggagac

SEQ ID NO: 882217 - DNA, 14 bp, Homo sapiens
tacttcttaaaatt

SEQ ID NO: 882218 - DNA, 14 bp, Homo sapiens
tacttcttatacat

SEQ ID NO: 882219 - DNA, 15 bp, Homo sapiens
tacttcttatacatt

SEQ ID NO: 882220 - DNA, 15 bp, Homo sapiens
tacttcttctgtaat

SEQ ID NO: 882221 - DNA, 21 bp, Homo sapiens
tacttcttgaatataaaaaat

SEQ ID NO: 882222 - DNA, 18 bp, Homo sapiens
tacttgaagaaacagagt

SEQ ID NO: 882223 - DNA, 23 bp, Homo sapiens
tacttgaagtctaaaagcagaaa

SEQ ID NO: 882224 - DNA, 12 bp, Homo sapiens
tacttgaatttc

SEQ ID NO: 882225 - DNA, 12 bp, Homo sapiens
tacttgaatttt

SEQ ID NO: 882226 - DNA, 18 bp, Homo sapiens
tacttgaattttttgaaa

SEQ ID NO: 882227 - DNA, 24 bp, Homo sapiens
tacttgaattttttgaaatgggca

SEQ ID NO: 882228 - DNA, 22 bp, Homo sapiens
tacttgaccgtttttatattac

SEQ ID NO: 882229 - DNA, 22 bp, Homo sapiens
tacttgacctctgtgaccaact

SEQ ID NO: 882230 - DNA, 15 bp, Homo sapiens
tacttgactcattta

SEQ ID NO: 882231 - DNA, 17 bp, Homo sapiens
tacttgactcatttaaa

SEQ ID NO: 882232 - DNA, 22 bp, Homo sapiens
tacttgagaccaacttttcaat

SEQ ID NO: 882233 - DNA, 15 bp, Homo sapiens
tacttgataatatta

SEQ ID NO: 882234 - DNA, 18 bp, Homo sapiens
tacttgatgccaaaatga

SEQ ID NO: 882235 - DNA, 20 bp, Homo sapiens
tacttgcaactaaggacaaa

SEQ ID NO: 882236 - DNA, 16 bp, Homo sapiens
tacttgcactctttaa

SEQ ID NO: 882237 - DNA, 22 bp, Homo sapiens
tacttgcactctttaacacatt

SEQ ID NO: 882238 - DNA, 11 bp, Homo sapiens
tacttgcactg

SEQ ID NO: 882239 - DNA, 14 bp, Homo sapiens
tacttgcagttgtg

SEQ ID NO: 882240 - DNA, 16 bp, Homo sapiens
tacttgccctgaccat

SEQ ID NO: 882241 - DNA, 21 bp, Homo sapiens
tacttgctttcaattgacaaa

SEQ ID NO: 882242 - DNA, 19 bp, Homo sapiens
tacttggagtaattgcaca

SEQ ID NO: 882243 - DNA, 16 bp, Homo sapiens
tacttggcattgagta

SEQ ID NO: 882244 - DNA, 23 bp, Homo sapiens
tacttggctgcttcctgtgacag

SEQ ID NO: 882245 - DNA, 19 bp, Homo sapiens
tacttgggaagctgaggcg

SEQ ID NO: 882246 - DNA, 15 bp, Homo sapiens
tacttgggagcctga

SEQ ID NO: 882247 - DNA, 17 bp, Homo sapiens
tacttgtaaaatgcttt

SEQ ID NO: 882248 - DNA, 16 bp, Homo sapiens
tacttgtattccctta

SEQ ID NO: 882249 - DNA, 15 bp, Homo sapiens
tacttgtctgaggcc

SEQ ID NO: 882250 - DNA, 18 bp, Homo sapiens
tacttgtctgaggcctca

SEQ ID NO: 882251 - DNA, 20 bp, Homo sapiens
tacttgtctgtcaaatgttt

SEQ ID NO: 882252 - DNA, 18 bp, Homo sapiens
tacttgtgttacttgcca

SEQ ID NO: 882253 - DNA, 21 bp, Homo sapiens
tacttgtgtttgcttaaacaa

SEQ ID NO: 882254 - DNA, 20 bp, Homo sapiens
tacttgtttctctgttgtaa

SEQ ID NO: 882255 - DNA, 16 bp, Homo sapiens
tactttaaaaaggaaa

SEQ ID NO: 882256 - DNA, 14 bp, Homo sapiens
tactttaaaggaaa

SEQ ID NO: 882257 - DNA, 22 bp, Homo sapiens
tactttaagcactacataaact

SEQ ID NO: 882258 - DNA, 17 bp, Homo sapiens
tactttacctctctgtc

SEQ ID NO: 882259 - DNA, 18 bp, Homo sapiens
tactttacctctctgtca

SEQ ID NO: 882260 - DNA, 15 bp, Homo sapiens
tactttacttttgct

SEQ ID NO: 882261 - DNA, 16 bp, Homo sapiens
tactttacttttgctg

SEQ ID NO: 882262 - DNA, 17 bp, Homo sapiens
tactttagaagcctgca

SEQ ID NO: 882263 - DNA, 17 bp, Homo sapiens
tactttatatcttgttt

SEQ ID NO: 882264 - DNA, 21 bp, Homo sapiens
tactttatcatgaatgctttt

SEQ ID NO: 882265 - DNA, 17 bp, Homo sapiens
tactttattaacttacg

SEQ ID NO: 882266 - DNA, 21 bp, Homo sapiens
tactttattgtacagactgtt

SEQ ID NO: 882267 - DNA, 22 bp, Homo sapiens
tactttcctattttcttttcca

SEQ ID NO: 882268 - DNA, 20 bp, Homo sapiens
tactttgacagtgtttttag

SEQ ID NO: 882269 - DNA, 15 bp, Homo sapiens
tactttgattctgat

SEQ ID NO: 882270 - DNA, 12 bp, Homo sapiens
tactttgcattg

SEQ ID NO: 882271 - DNA, 16 bp, Homo sapiens
tactttgccatttttc

SEQ ID NO: 882272 - DNA, 21 bp, Homo sapiens
tactttgccatttttctataa

SEQ ID NO: 882273 - DNA, 13 bp, Homo sapiens
tactttgcttcat

SEQ ID NO: 882274 - DNA, 14 bp, Homo sapiens
tactttgcttcata

SEQ ID NO: 882275 - DNA, 17 bp, Homo sapiens
tactttgcttcatagta

SEQ ID NO: 882276 - DNA, 20 bp, Homo sapiens
tactttggatgcaattaaaa

SEQ ID NO: 882277 - DNA, 23 bp, Homo sapiens
tactttggtagctgggaaagcat

SEQ ID NO: 882278 - DNA, 16 bp, Homo sapiens
tactttgtacttgtgt

SEQ ID NO: 882279 - DNA, 21 bp, Homo sapiens
tactttgtacttgtgtttgct

SEQ ID NO: 882280 - DNA, 19 bp, Homo sapiens
tactttgtagactgtttca

SEQ ID NO: 882281 - DNA, 16 bp, Homo sapiens
tactttgtatacaagt

SEQ ID NO: 882282 - DNA, 16 bp, Homo sapiens
tactttgtctgaaaaa

SEQ ID NO: 882283 - DNA, 16 bp, Homo sapiens
tactttgtgtttagct

SEQ ID NO: 882284 - DNA, 21 bp, Homo sapiens
tacttttaaactgtgtacata

SEQ ID NO: 882285 - DNA, 18 bp, Homo sapiens
tacttttaccactattta

SEQ ID NO: 882286 - DNA, 16 bp, Homo sapiens
tacttttataataaaa

SEQ ID NO: 882287 - DNA, 22 bp, Homo sapiens
tacttttataataaaaggaaaa

SEQ ID NO: 882288 - DNA, 19 bp, Homo sapiens
tacttttattattttaatt

SEQ ID NO: 882289 - DNA, 15 bp, Homo sapiens
tacttttcacactgt

SEQ ID NO: 882290 - DNA, 22 bp, Homo sapiens
tacttttcccctgttaaacagt

SEQ ID NO: 882291 - DNA, 19 bp, Homo sapiens
tacttttctaaaatctaaa

SEQ ID NO: 882292 - DNA, 16 bp, Homo sapiens
tacttttctggttcca

SEQ ID NO: 882293 - DNA, 19 bp, Homo sapiens
tacttttctggttccaaac

SEQ ID NO: 882294 - DNA, 19 bp, Homo sapiens
tacttttctttattagctt

SEQ ID NO: 882295 - DNA, 13 bp, Homo sapiens
tacttttgagtat

SEQ ID NO: 882296 - DNA, 16 bp, Homo sapiens
tacttttgagtgtgtg

SEQ ID NO: 882297 - DNA, 15 bp, Homo sapiens
tacttttgtaaatat

SEQ ID NO: 882298 - DNA, 20 bp, Homo sapiens
tacttttgtaatctattcct

SEQ ID NO: 882299 - DNA, 13 bp, Homo sapiens
tacttttgtccaa

SEQ ID NO: 882300 - DNA, 20 bp, Homo sapiens
tactttttatactccataca

SEQ ID NO: 882301 - DNA, 12 bp, Homo sapiens
tactttttctaa

SEQ ID NO: 882302 - DNA, 14 bp, Homo sapiens
tactttttctaatg

SEQ ID NO: 882303 - DNA, 19 bp, Homo sapiens
tactttttgaacttttcat

SEQ ID NO: 882304 - DNA, 15 bp, Homo sapiens
tactttttggctgga

SEQ ID NO: 882305 - DNA, 15 bp, Homo sapiens
tactttttgtagaga

SEQ ID NO: 882306 - DNA, 21 bp, Homo sapiens
tacttttttaaatattttcta

SEQ ID NO: 882307 - DNA, 23 bp, Homo sapiens
tacttttttaaatattttctatt

SEQ ID NO: 882308 - DNA, 19 bp, Homo sapiens
tacttttttaacatgtgtt

SEQ ID NO: 882309 - DNA, 18 bp, Homo sapiens
tacttttttcttatttaa

SEQ ID NO: 882310 - DNA, 14 bp, Homo sapiens
tactttttttctgt

SEQ ID NO: 882311 - DNA, 20 bp, Homo sapiens
tactttttttgtagatgaac

SEQ ID NO: 882312 - DNA, 18 bp, Homo sapiens
tacttttttttagttcaa

SEQ ID NO: 882313 - DNA, 21 bp, Homo sapiens
tacttttttttagttcaatac

SEQ ID NO: 882314 - DNA, 12 bp, Homo sapiens
tagaaaaaaaga

SEQ ID NO: 882315 - DNA, 14 bp, Homo sapiens
tagaaaaaaagaaa

SEQ ID NO: 882316 - DNA, 18 bp, Homo sapiens
tagaaaaacatttaaact

SEQ ID NO: 882317 - DNA, 21 bp, Homo sapiens
tagaaaaacatttaaactttt

SEQ ID NO: 882318 - DNA, 22 bp, Homo sapiens
tagaaaaacatttaaacttttt

SEQ ID NO: 882319 - DNA, 20 bp, Homo sapiens
tagaaaaagtcaatgtactt

SEQ ID NO: 882320 - DNA, 21 bp, Homo sapiens
tagaaaaagtcaatgtacttg

SEQ ID NO: 882321 - DNA, 23 bp, Homo sapiens
tagaaaaagtcaatgtacttgtt

SEQ ID NO: 882322 - DNA, 15 bp, Homo sapiens
tagaaaaataaaaat

SEQ ID NO: 882323 - DNA, 15 bp, Homo sapiens
tagaaaaataaaatg

SEQ ID NO: 882324 - DNA, 21 bp, Homo sapiens
tagaaaaatatatgcttacat

SEQ ID NO: 882325 - DNA, 19 bp, Homo sapiens
tagaaaaatgtataaaaat

SEQ ID NO: 882326 - DNA, 16 bp, Homo sapiens
tagaaaaattattaga

SEQ ID NO: 882327 - DNA, 17 bp, Homo sapiens
tagaaaaattattagaa

SEQ ID NO: 882328 - DNA, 21 bp, Homo sapiens
tagaaaaattattagaacatt

SEQ ID NO: 882329 - DNA, 23 bp, Homo sapiens
tagaaaaattattagaacattca

SEQ ID NO: 882330 - DNA, 13 bp, Homo sapiens
tagaaaaatttca

SEQ ID NO: 882331 - DNA, 16 bp, Homo sapiens
tagaaaacaaaggagc

SEQ ID NO: 882332 - DNA, 23 bp, Homo sapiens
tagaaaacaaaggagcattaagc

SEQ ID NO: 882333 - DNA, 13 bp, Homo sapiens
tagaaaactgaaa

SEQ ID NO: 882334 - DNA, 16 bp, Homo sapiens
tagaaaactttaaagc

SEQ ID NO: 882335 - DNA, 17 bp, Homo sapiens
tagaaaagaaaacattt

SEQ ID NO: 882336 - DNA, 22 bp, Homo sapiens
tagaaaagaaaacatttaacat

SEQ ID NO: 882337 - DNA, 16 bp, Homo sapiens
tagaaaagagacttct

SEQ ID NO: 882338 - DNA, 21 bp, Homo sapiens
tagaaaagcagtcccattcat

SEQ ID NO: 882339 - DNA, 22 bp, Homo sapiens
tagaaaagcagtcccattcata

SEQ ID NO: 882340 - DNA, 15 bp, Homo sapiens
tagaaaagttaacat

SEQ ID NO: 882341 - DNA, 16 bp, Homo sapiens
tagaaaagttaacatt

SEQ ID NO: 882342 - DNA, 14 bp, Homo sapiens
tagaaaagttatta

SEQ ID NO: 882343 - DNA, 20 bp, Homo sapiens
tagaaaagttgcagatgtat

SEQ ID NO: 882344 - DNA, 22 bp, Homo sapiens
tagaaaagttgcagatgtattg

SEQ ID NO: 882345 - DNA, 17 bp, Homo sapiens
tagaaaagtttcgactt

SEQ ID NO: 882346 - DNA, 17 bp, Homo sapiens
tagaaaatgacttattt

SEQ ID NO: 882347 - DNA, 20 bp, Homo sapiens
tagaaaatgacttatttctg

SEQ ID NO: 882348 - DNA, 22 bp, Homo sapiens
tagaaaatgacttatttctgct

SEQ ID NO: 882349 - DNA, 19 bp, Homo sapiens
tagaaaatgcaaaatgaaa

SEQ ID NO: 882350 - DNA, 12 bp, Homo sapiens
tagaaaatgtga

SEQ ID NO: 882351 - DNA, 22 bp, Homo sapiens
tagaaaattagtgaccattatt

SEQ ID NO: 882352 - DNA, 13 bp, Homo sapiens
tagaaaattattt

SEQ ID NO: 882353 - DNA, 19 bp, Homo sapiens
tagaaaattatttgtatga

SEQ ID NO: 882354 - DNA, 16 bp, Homo sapiens
tagaaaatttgcttta

SEQ ID NO: 882355 - DNA, 11 bp, Homo sapiens
tagaaaatttt

SEQ ID NO: 882356 - DNA, 17 bp, Homo sapiens
tagaaacaaaaagagct

SEQ ID NO: 882357 - DNA, 10 bp, Homo sapiens
tagaaacaga

SEQ ID NO: 882358 - DNA, 23 bp, Homo sapiens
tagaaacatggttttgaaatgct

SEQ ID NO: 882359 - DNA, 15 bp, Homo sapiens
tagaaacattgtaaa

SEQ ID NO: 882360 - DNA, 21 bp, Homo sapiens
tagaaacccaagctcctcctc

SEQ ID NO: 882361 - DNA, 18 bp, Homo sapiens
tagaaacctctctatttt

SEQ ID NO: 882362 - DNA, 19 bp, Homo sapiens
tagaaactaattgacttta

SEQ ID NO: 882363 - DNA, 13 bp, Homo sapiens
tagaaactattgg

SEQ ID NO: 882364 - DNA, 14 bp, Homo sapiens
tagaaactctggct

SEQ ID NO: 882365 - DNA, 16 bp, Homo sapiens
tagaaactctggctca

SEQ ID NO: 882366 - DNA, 22 bp, Homo sapiens
tagaaactctggctcagcctgt

SEQ ID NO: 882367 - DNA, 16 bp, Homo sapiens
tagaaactgatttctt

SEQ ID NO: 882368 - DNA, 22 bp, Homo sapiens
tagaaactgatttcttcagaat

SEQ ID NO: 882369 - DNA, 19 bp, Homo sapiens
tagaaagaaaagaccctga

SEQ ID NO: 882370 - DNA, 20 bp, Homo sapiens
tagaaagaaaagaccctgag

SEQ ID NO: 882371 - DNA, 22 bp, Homo sapiens
tagaaagaaaagaccctgagac

SEQ ID NO: 882372 - DNA, 23 bp, Homo sapiens
tagaaagaaaagaccctgagact

SEQ ID NO: 882373 - DNA, 21 bp, Homo sapiens
tagaaagaaactaaacagaaa

SEQ ID NO: 882374 - DNA, 14 bp, Homo sapiens
tagaaagaagccca

SEQ ID NO: 882375 - DNA, 21 bp, Homo sapiens
tagaaagaagcccaatattat

SEQ ID NO: 882376 - DNA, 17 bp, Homo sapiens
tagaaagacatctgcct

SEQ ID NO: 882377 - DNA, 19 bp, Homo sapiens
tagaaagacatctgcctgt

SEQ ID NO: 882378 - DNA, 16 bp, Homo sapiens
tagaaagagaaacagt

SEQ ID NO: 882379 - DNA, 16 bp, Homo sapiens
tagaaagagttctatg

SEQ ID NO: 882380 - DNA, 13 bp, Homo sapiens
tagaaagcatttt

SEQ ID NO: 882381 - DNA, 11 bp, Homo sapiens
tagaaagctat

SEQ ID NO: 882382 - DNA, 20 bp, Homo sapiens
tagaaagctggcaacatgaa

SEQ ID NO: 882383 - DNA, 13 bp, Homo sapiens
tagaaaggagaga

SEQ ID NO: 882384 - DNA, 12 bp, Homo sapiens
tagaaaggcagc

SEQ ID NO: 882385 - DNA, 22 bp, Homo sapiens
tagaaagtatagatggccaaag

SEQ ID NO: 882386 - DNA, 17 bp, Homo sapiens
tagaaagtgccagaaag

SEQ ID NO: 882387 - DNA, 15 bp, Homo sapiens
tagaaagtgctgata

SEQ ID NO: 882388 - DNA, 21 bp, Homo sapiens
tagaaagttagggggttctta

SEQ ID NO: 882389 - DNA, 18 bp, Homo sapiens
tagaaagttccaaatgtt

SEQ ID NO: 882390 - DNA, 21 bp, Homo sapiens
tagaaagttgatattcaacct

SEQ ID NO: 882391 - DNA, 15 bp, Homo sapiens
tagaaataaacctta

SEQ ID NO: 882392 - DNA, 19 bp, Homo sapiens
tagaaataaaggatgtgat

SEQ ID NO: 882393 - DNA, 16 bp, Homo sapiens
tagaaataaatagcta

SEQ ID NO: 882394 - DNA, 16 bp, Homo sapiens
tagaaataacagaaga

SEQ ID NO: 882395 - DNA, 16 bp, Homo sapiens
tagaaataagtggtta

SEQ ID NO: 882396 - DNA, 23 bp, Homo sapiens
tagaaataagtggttatttctca

SEQ ID NO: 882397 - DNA, 11 bp, Homo sapiens
tagaaatactt

SEQ ID NO: 882398 - DNA, 15 bp, Homo sapiens
tagaaatataattga

SEQ ID NO: 882399 - DNA, 14 bp, Homo sapiens
tagaaatatattta

SEQ ID NO: 882400 - DNA, 21 bp, Homo sapiens
tagaaatatctgaaaatgtat

SEQ ID NO: 882401 - DNA, 16 bp, Homo sapiens
tagaaatatctttctc

SEQ ID NO: 882402 - DNA, 14 bp, Homo sapiens
tagaaatatgattt

SEQ ID NO: 882403 - DNA, 15 bp, Homo sapiens
tagaaatattcacat

SEQ ID NO: 882404 - DNA, 13 bp, Homo sapiens
tagaaatcacaac

SEQ ID NO: 882405 - DNA, 14 bp, Homo sapiens
tagaaatcattgta

SEQ ID NO: 882406 - DNA, 17 bp, Homo sapiens
tagaaatctaaaagaat

SEQ ID NO: 882407 - DNA, 21 bp, Homo sapiens
tagaaatctatcttaaaacct

SEQ ID NO: 882408 - DNA, 18 bp, Homo sapiens
tagaaatgaccaatatta

SEQ ID NO: 882409 - DNA, 17 bp, Homo sapiens
tagaaatggtttcctct

SEQ ID NO: 882410 - DNA, 15 bp, Homo sapiens
tagaaatgtaaactg

SEQ ID NO: 882411 - DNA, 16 bp, Homo sapiens
tagaaatgtaaactgc

SEQ ID NO: 882412 - DNA, 18 bp, Homo sapiens
tagaaatgtatcctgata

SEQ ID NO: 882413 - DNA, 15 bp, Homo sapiens
tagaaatgtgaatga

SEQ ID NO: 882414 - DNA, 19 bp, Homo sapiens
tagaaattacacccaaaga

SEQ ID NO: 882415 - DNA, 18 bp, Homo sapiens
tagaaattagctgtgtga

SEQ ID NO: 882416 - DNA, 15 bp, Homo sapiens
tagaaatttccagag

SEQ ID NO: 882417 - DNA, 22 bp, Homo sapiens
tagaaattttacaataggtgct

SEQ ID NO: 882418 - DNA, 17 bp, Homo sapiens
tagaaattttgtaagaa

SEQ ID NO: 882419 - DNA, 18 bp, Homo sapiens
tagaaattttgtaagaag

SEQ ID NO: 882420 - DNA, 22 bp, Homo sapiens
tagaaatttttcagatgcttct

SEQ ID NO: 882421 - DNA, 12 bp, Homo sapiens
tagaacaaaaaa

SEQ ID NO: 882422 - DNA, 19 bp, Homo sapiens
tagaacacaaaacttgaaa

SEQ ID NO: 882423 - DNA, 12 bp, Homo sapiens
tagaacacacac

SEQ ID NO: 882424 - DNA, 23 bp, Homo sapiens
tagaacacctgccttctaccctc

SEQ ID NO: 882425 - DNA, 15 bp, Homo sapiens
tagaacactaattca

SEQ ID NO: 882426 - DNA, 22 bp, Homo sapiens
tagaacagggaaaataggcagg

SEQ ID NO: 882427 - DNA, 20 bp, Homo sapiens
tagaacagtggaaactatgt

SEQ ID NO: 882428 - DNA, 16 bp, Homo sapiens
tagaacataaagcaaa

SEQ ID NO: 882429 - DNA, 14 bp, Homo sapiens
tagaacatgcacat

SEQ ID NO: 882430 - DNA, 22 bp, Homo sapiens
tagaacatggttaccatgtctt

SEQ ID NO: 882431 - DNA, 15 bp, Homo sapiens
tagaacctaattcaa

SEQ ID NO: 882432 - DNA, 14 bp, Homo sapiens
tagaactatctgca

SEQ ID NO: 882433 - DNA, 16 bp, Homo sapiens
tagaactatctgcatt

SEQ ID NO: 882434 - DNA, 15 bp, Homo sapiens
tagaactcactctgg

SEQ ID NO: 882435 - DNA, 19 bp, Homo sapiens
tagaactcactctgggctg

SEQ ID NO: 882436 - DNA, 21 bp, Homo sapiens
tagaactcttaaatacttttt

SEQ ID NO: 882437 - DNA, 19 bp, Homo sapiens
tagaactgtatgtcagaca

SEQ ID NO: 882438 - DNA, 20 bp, Homo sapiens
tagaactgtatgtcagacat

SEQ ID NO: 882439 - DNA, 15 bp, Homo sapiens
tagaactgtctgtga

SEQ ID NO: 882440 - DNA, 21 bp, Homo sapiens
tagaacttgcagctgatgttg

SEQ ID NO: 882441 - DNA, 22 bp, Homo sapiens
tagaacttggatgtacctgccc

SEQ ID NO: 882442 - DNA, 17 bp, Homo sapiens
tagaactttaagtctca

SEQ ID NO: 882443 - DNA, 16 bp, Homo sapiens
tagaactttgtatttt

SEQ ID NO: 882444 - DNA, 17 bp, Homo sapiens
tagaagaaaagcccatt

SEQ ID NO: 882445 - DNA, 23 bp, Homo sapiens
tagaagaaccaaatacctcaatt

SEQ ID NO: 882446 - DNA, 11 bp, Homo sapiens
tagaagaagag

SEQ ID NO: 882447 - DNA, 23 bp, Homo sapiens
tagaagaatatcgatataaattg

SEQ ID NO: 882448 - DNA, 17 bp, Homo sapiens
tagaagaatattgtatt

SEQ ID NO: 882449 - DNA, 13 bp, Homo sapiens
tagaagaatttta

SEQ ID NO: 882450 - DNA, 15 bp, Homo sapiens
tagaagacatttata

SEQ ID NO: 882451 - DNA, 13 bp, Homo sapiens
tagaagagcacag

SEQ ID NO: 882452 - DNA, 17 bp, Homo sapiens
tagaagagtctattgtc

SEQ ID NO: 882453 - DNA, 18 bp, Homo sapiens
tagaagatggcacttata

SEQ ID NO: 882454 - DNA, 14 bp, Homo sapiens
tagaagatgtgtaa

SEQ ID NO: 882455 - DNA, 21 bp, Homo sapiens
tagaagattgttggtgaattt

SEQ ID NO: 882456 - DNA, 18 bp, Homo sapiens
tagaagcaaagatttcag

SEQ ID NO: 882457 - DNA, 20 bp, Homo sapiens
tagaagcaaggagaaaatat

SEQ ID NO: 882458 - DNA, 21 bp, Homo sapiens
tagaagcactacaccttgcct

SEQ ID NO: 882459 - DNA, 15 bp, Homo sapiens
tagaagccaagggaa

SEQ ID NO: 882460 - DNA, 19 bp, Homo sapiens
tagaagccaagggaaaggg

SEQ ID NO: 882461 - DNA, 15 bp, Homo sapiens
tagaagcccctgtcg

SEQ ID NO: 882462 - DNA, 12 bp, Homo sapiens
tagaagctcttg

SEQ ID NO: 882463 - DNA, 21 bp, Homo sapiens
tagaaggaagtgtgtttgcct

SEQ ID NO: 882464 - DNA, 18 bp, Homo sapiens
tagaaggaatttgtactt

SEQ ID NO: 882465 - DNA, 17 bp, Homo sapiens
tagaaggatgtacattt

SEQ ID NO: 882466 - DNA, 19 bp, Homo sapiens
tagaaggccacatgtcacc

SEQ ID NO: 882467 - DNA, 14 bp, Homo sapiens
tagaaggcttctct

SEQ ID NO: 882468 - DNA, 19 bp, Homo sapiens
tagaagggccagtcctgcc

SEQ ID NO: 882469 - DNA, 14 bp, Homo sapiens
tagaagtagaattg

SEQ ID NO: 882470 - DNA, 15 bp, Homo sapiens
tagaagtctggaaaa

SEQ ID NO: 882471 - DNA, 16 bp, Homo sapiens
tagaagtctggaaaaa

SEQ ID NO: 882472 - DNA, 18 bp, Homo sapiens
tagaagtctttcagatga

SEQ ID NO: 882473 - DNA, 13 bp, Homo sapiens
tagaatagtttga

SEQ ID NO: 882474 - DNA, 22 bp, Homo sapiens
tagaatataggtctcttctccc

SEQ ID NO: 882475 - DNA, 15 bp, Homo sapiens
tagaatattcagaca

SEQ ID NO: 882476 - DNA, 17 bp, Homo sapiens
tagaatattcagacaaa

SEQ ID NO: 882477 - DNA, 22 bp, Homo sapiens
tagaatattcagacaaaatgga

SEQ ID NO: 882478 - DNA, 20 bp, Homo sapiens
tagaatatttattacctctg

SEQ ID NO: 882479 - DNA, 22 bp, Homo sapiens
tagaatcaaacattttgaaagt

SEQ ID NO: 882480 - DNA, 16 bp, Homo sapiens
tagaatcaatttaagt

SEQ ID NO: 882481 - DNA, 23 bp, Homo sapiens
tagaatccaaacttggatttttg

SEQ ID NO: 882482 - DNA, 16 bp, Homo sapiens
tagaatccgaagggaa

SEQ ID NO: 882483 - DNA, 13 bp, Homo sapiens
tagaatgataaat

SEQ ID NO: 882484 - DNA, 19 bp, Homo sapiens
tagaatgatgttttaaaaa

SEQ ID NO: 882485 - DNA, 12 bp, Homo sapiens
tagaatgcaagc

SEQ ID NO: 882486 - DNA, 15 bp, Homo sapiens
tagaatgtaaagctt

SEQ ID NO: 882487 - DNA, 17 bp, Homo sapiens
tagaatgtaaagcttgt

SEQ ID NO: 882488 - DNA, 18 bp, Homo sapiens
tagaatgtaaagcttgtc

SEQ ID NO: 882489 - DNA, 13 bp, Homo sapiens
tagaatgtgattt

SEQ ID NO: 882490 - DNA, 12 bp, Homo sapiens
tagaatgtggat

SEQ ID NO: 882491 - DNA, 13 bp, Homo sapiens
tagaatgtgtttt

SEQ ID NO: 882492 - DNA, 18 bp, Homo sapiens
tagaatgtgttttctgaa

SEQ ID NO: 882493 - DNA, 16 bp, Homo sapiens
tagaattagtatgtct

SEQ ID NO: 882494 - DNA, 16 bp, Homo sapiens
tagaattatttaaaca

SEQ ID NO: 882495 - DNA, 18 bp, Homo sapiens
tagaattatttttcactc

SEQ ID NO: 882496 - DNA, 16 bp, Homo sapiens
tagaattctagtgctg

SEQ ID NO: 882497 - DNA, 19 bp, Homo sapiens
tagaattctagtgctgctg

SEQ ID NO: 882498 - DNA, 20 bp, Homo sapiens
tagaattgagtgtttaaagt

SEQ ID NO: 882499 - DNA, 15 bp, Homo sapiens
tagaattgcattgac

SEQ ID NO: 882500 - DNA, 23 bp, Homo sapiens
tagaatttattcaattcctctgg

SEQ ID NO: 882501 - DNA, 15 bp, Homo sapiens
tagaattttctccct

SEQ ID NO: 882502 - DNA, 13 bp, Homo sapiens
tagaatttttaaa

SEQ ID NO: 882503 - DNA, 14 bp, Homo sapiens
tagaatttttaaaa

SEQ ID NO: 882504 - DNA, 13 bp, Homo sapiens
tagacaaaaagta

SEQ ID NO: 882505 - DNA, 15 bp, Homo sapiens
tagacaaaaagtata

SEQ ID NO: 882506 - DNA, 22 bp, Homo sapiens
tagacaaagccttaagcaaatt

SEQ ID NO: 882507 - DNA, 17 bp, Homo sapiens
tagacaaatagaaaatg

SEQ ID NO: 882508 - DNA, 19 bp, Homo sapiens
tagacaaatatttggaggg

SEQ ID NO: 882509 - DNA, 19 bp, Homo sapiens
tagacaagatattgtacat

SEQ ID NO: 882510 - DNA, 20 bp, Homo sapiens
tagacaagatattgtacata

SEQ ID NO: 882511 - DNA, 19 bp, Homo sapiens
tagacacatgaaggtaaat

SEQ ID NO: 882512 - DNA, 16 bp, Homo sapiens
tagacaccacctggag

SEQ ID NO: 882513 - DNA, 17 bp, Homo sapiens
tagacaccacctggagt

SEQ ID NO: 882514 - DNA, 18 bp, Homo sapiens
tagacaccacctggagtg

SEQ ID NO: 882515 - DNA, 18 bp, Homo sapiens
tagacacccattttcaca

SEQ ID NO: 882516 - DNA, 16 bp, Homo sapiens
tagacacgcacggcag

SEQ ID NO: 882517 - DNA, 13 bp, Homo sapiens
tagacactggaca

SEQ ID NO: 882518 - DNA, 15 bp, Homo sapiens
tagacactttggaag

SEQ ID NO: 882519 - DNA, 14 bp, Homo sapiens
tagacagaagaaac

SEQ ID NO: 882520 - DNA, 18 bp, Homo sapiens
tagacagagttgcttaat

SEQ ID NO: 882521 - DNA, 18 bp, Homo sapiens
tagacagtgctgccctgc

SEQ ID NO: 882522 - DNA, 13 bp, Homo sapiens
tagacataacaaa

SEQ ID NO: 882523 - DNA, 14 bp, Homo sapiens
tagacatcaaactc

SEQ ID NO: 882524 - DNA, 23 bp, Homo sapiens
tagacatcaaactcaatgcttta

SEQ ID NO: 882525 - DNA, 14 bp, Homo sapiens
tagacatctgtcct

SEQ ID NO: 882526 - DNA, 15 bp, Homo sapiens
tagacattctcacat

SEQ ID NO: 882527 - DNA, 21 bp, Homo sapiens
tagacatttcaaaattaatag

SEQ ID NO: 882528 - DNA, 17 bp, Homo sapiens
tagacatttttgtgcca

SEQ ID NO: 882529 - DNA, 13 bp, Homo sapiens
tagaccaaaataa

SEQ ID NO: 882530 - DNA, 14 bp, Homo sapiens
tagaccaaaataaa

SEQ ID NO: 882531 - DNA, 17 bp, Homo sapiens
tagaccaaagcaaagaa

SEQ ID NO: 882532 - DNA, 20 bp, Homo sapiens
tagaccaaagcaaagaaaat

SEQ ID NO: 882533 - DNA, 10 bp, Homo sapiens
tagaccaata

SEQ ID NO: 882534 - DNA, 12 bp, Homo sapiens
tagaccaataaa

SEQ ID NO: 882535 - DNA, 23 bp, Homo sapiens
tagaccacggctgccccttccac

SEQ ID NO: 882536 - DNA, 15 bp, Homo sapiens
tagaccagtttgcat

SEQ ID NO: 882537 - DNA, 14 bp, Homo sapiens
tagaccctccccaa

SEQ ID NO: 882538 - DNA, 16 bp, Homo sapiens
tagaccctgggtgggc

SEQ ID NO: 882539 - DNA, 11 bp, Homo sapiens
tagacctatac

SEQ ID NO: 882540 - DNA, 16 bp, Homo sapiens
tagacctatactgaaa

SEQ ID NO: 882541 - DNA, 13 bp, Homo sapiens
tagacctcagcct

SEQ ID NO: 882542 - DNA, 20 bp, Homo sapiens
tagacctcagcctgtgctgc

SEQ ID NO: 882543 - DNA, 21 bp, Homo sapiens
tagaccttgagggtgggccag

SEQ ID NO: 882544 - DNA, 23 bp, Homo sapiens
tagaccttgagggtgggccagca

SEQ ID NO: 882545 - DNA, 19 bp, Homo sapiens
tagaccttgttacttctga

SEQ ID NO: 882546 - DNA, 16 bp, Homo sapiens
tagacctttatttttc

SEQ ID NO: 882547 - DNA, 18 bp, Homo sapiens
tagacctttatttttcta

SEQ ID NO: 882548 - DNA, 20 bp, Homo sapiens
tagaccttttttttttttcc

SEQ ID NO: 882549 - DNA, 13 bp, Homo sapiens
tagacgaagaagc

SEQ ID NO: 882550 - DNA, 17 bp, Homo sapiens
tagacgaagaagctggc

SEQ ID NO: 882551 - DNA, 20 bp, Homo sapiens
tagacgcccctcccaagcgt

SEQ ID NO: 882552 - DNA, 16 bp, Homo sapiens
tagacgccttccaggt

SEQ ID NO: 882553 - DNA, 21 bp, Homo sapiens
tagacgccttccaggtcagga

SEQ ID NO: 882554 - DNA, 24 bp, Homo sapiens
tagactaattaaaatctggaaatc

SEQ ID NO: 882555 - DNA, 21 bp, Homo sapiens
tagactagcaatctcttcatt

SEQ ID NO: 882556 - DNA, 22 bp, Homo sapiens
tagactataaatgttgctatgt

SEQ ID NO: 882557 - DNA, 21 bp, Homo sapiens
tagactcatcttactgtacct

SEQ ID NO: 882558 - DNA, 21 bp, Homo sapiens
tagactcatggtgtgttacac

SEQ ID NO: 882559 - DNA, 16 bp, Homo sapiens
tagactctaagataca

SEQ ID NO: 882560 - DNA, 22 bp, Homo sapiens
tagactctgtctacctggtctg

SEQ ID NO: 882561 - DNA, 22 bp, Homo sapiens
tagactgacttgtttgtcttcc

SEQ ID NO: 882562 - DNA, 20 bp, Homo sapiens
tagactgaggtataaagaca

SEQ ID NO: 882563 - DNA, 14 bp, Homo sapiens
tagactggacagct

SEQ ID NO: 882564 - DNA, 16 bp, Homo sapiens
tagactggacagcttg

SEQ ID NO: 882565 - DNA, 21 bp, Homo sapiens
tagactggagtgaggcttcca

SEQ ID NO: 882566 - DNA, 22 bp, Homo sapiens
tagactggagtgaggcttccag

SEQ ID NO: 882567 - DNA, 23 bp, Homo sapiens
tagactgtaactttttttcagtt

SEQ ID NO: 882568 - DNA, 18 bp, Homo sapiens
tagactgtgattcagaaa

SEQ ID NO: 882569 - DNA, 19 bp, Homo sapiens
tagacttcccaacagcctt

SEQ ID NO: 882570 - DNA, 19 bp, Homo sapiens
tagacttcccactgttctg

SEQ ID NO: 882571 - DNA, 19 bp, Homo sapiens
tagacttgcaccttatgtc

SEQ ID NO: 882572 - DNA, 18 bp, Homo sapiens
tagacttggacccaaaaa

SEQ ID NO: 882573 - DNA, 20 bp, Homo sapiens
tagacttggattctttccat

SEQ ID NO: 882574 - DNA, 22 bp, Homo sapiens
tagacttgggatggggagggag

SEQ ID NO: 882575 - DNA, 19 bp, Homo sapiens
tagacttggtgtgaagact

SEQ ID NO: 882576 - DNA, 21 bp, Homo sapiens
tagactttctcagtgggacaa

SEQ ID NO: 882577 - DNA, 23 bp, Homo sapiens
tagagatgtttttaaaagtttca

SEQ ID NO: 882578 - DNA, 18 bp, Homo sapiens
tagagattacctcctgag

SEQ ID NO: 882579 - DNA, 19 bp, Homo sapiens
tagagattacctcctgaga

SEQ ID NO: 882580 - DNA, 14 bp, Homo sapiens
tagagattgtacat

SEQ ID NO: 882581 - DNA, 15 bp, Homo sapiens
tagagatttgtctaa

SEQ ID NO: 882582 - DNA, 16 bp, Homo sapiens
tagagatttgtctaat

SEQ ID NO: 882583 - DNA, 17 bp, Homo sapiens
tagagcaaaatcaacat

SEQ ID NO: 882584 - DNA, 18 bp, Homo sapiens
tagagcacagcttcttct

SEQ ID NO: 882585 - DNA, 21 bp, Homo sapiens
tagagcacagcttcttctgcc

SEQ ID NO: 882586 - DNA, 23 bp, Homo sapiens
tagagcacagcttcttctgcccc

SEQ ID NO: 882587 - DNA, 20 bp, Homo sapiens
tagagcacctagtccagtga

SEQ ID NO: 882588 - DNA, 23 bp, Homo sapiens
tagagcagggattaacctctgca

SEQ ID NO: 882589 - DNA, 16 bp, Homo sapiens
tagagccaactgattt

SEQ ID NO: 882590 - DNA, 17 bp, Homo sapiens
tagagccaagctgcaca

SEQ ID NO: 882591 - DNA, 13 bp, Homo sapiens
tagagcccctcct

SEQ ID NO: 882592 - DNA, 12 bp, Homo sapiens
tagagccctcag

SEQ ID NO: 882593 - DNA, 14 bp, Homo sapiens
tagagcctgaggga

SEQ ID NO: 882594 - DNA, 22 bp, Homo sapiens
tagagccttttatctgcagaac

SEQ ID NO: 882595 - DNA, 16 bp, Homo sapiens
tagagctagctgccac

SEQ ID NO: 882596 - DNA, 15 bp, Homo sapiens
tagagctgatccaga

SEQ ID NO: 882597 - DNA, 14 bp, Homo sapiens
tagagctgccactg

SEQ ID NO: 882598 - DNA, 18 bp, Homo sapiens
tagagctgccactgggca

SEQ ID NO: 882599 - DNA, 22 bp, Homo sapiens
tagagctgccactgggcacctg

SEQ ID NO: 882600 - DNA, 16 bp, Homo sapiens
tagagctgggtggcct

SEQ ID NO: 882601 - DNA, 14 bp, Homo sapiens
tagagcttccaaat

SEQ ID NO: 882602 - DNA, 12 bp, Homo sapiens
tagagctttctt

SEQ ID NO: 882603 - DNA, 23 bp, Homo sapiens
tagagctttctttcacaaaaaag

SEQ ID NO: 882604 - DNA, 15 bp, Homo sapiens
tagagctttttaata

SEQ ID NO: 882605 - DNA, 18 bp, Homo sapiens
tagaggaaaaaaatgact

SEQ ID NO: 882606 - DNA, 12 bp, Homo sapiens
tagaggaaaatg

SEQ ID NO: 882607 - DNA, 21 bp, Homo sapiens
tagaggaaagggatggtaagt

SEQ ID NO: 882608 - DNA, 22 bp, Homo sapiens
tagaggaagaaatgtcagatgc

SEQ ID NO: 882609 - DNA, 21 bp, Homo sapiens
tagaggaaggctgaactcttc

SEQ ID NO: 882610 - DNA, 22 bp, Homo sapiens
tagaggacctgagtttgggaga

SEQ ID NO: 882611 - DNA, 13 bp, Homo sapiens
tagaggatgtggc

SEQ ID NO: 882612 - DNA, 17 bp, Homo sapiens
tagaggcccaggcacca

SEQ ID NO: 882613 - DNA, 20 bp, Homo sapiens
tagaggcttctccgccagcc

SEQ ID NO: 882614 - DNA, 22 bp, Homo sapiens
tagaggcttctccgccagcctc

SEQ ID NO: 882615 - DNA, 15 bp, Homo sapiens
tagagggacctctcc

SEQ ID NO: 882616 - DNA, 14 bp, Homo sapiens
tagagggaggggcc

SEQ ID NO: 882617 - DNA, 14 bp, Homo sapiens
tagagggcccatca

SEQ ID NO: 882618 - DNA, 15 bp, Homo sapiens
tagagggccttgctt

SEQ ID NO: 882619 - DNA, 22 bp, Homo sapiens
tagagggccttgcttctcttct

SEQ ID NO: 882620 - DNA, 17 bp, Homo sapiens
tagagggttcctgtaga

SEQ ID NO: 882621 - DNA, 18 bp, Homo sapiens
tagaggtcctctggagcc

SEQ ID NO: 882622 - DNA, 19 bp, Homo sapiens
tagaggtcctctggagccc

SEQ ID NO: 882623 - DNA, 14 bp, Homo sapiens
tagaggttttgtat

SEQ ID NO: 882624 - DNA, 19 bp, Homo sapiens
tagaggttttgttgtttta

SEQ ID NO: 882625 - DNA, 12 bp, Homo sapiens
tagagtaatgaa

SEQ ID NO: 882626 - DNA, 14 bp, Homo sapiens
tagagtaatgaaat

SEQ ID NO: 882627 - DNA, 22 bp, Homo sapiens
tagagtagggtagaaggaaagc

SEQ ID NO: 882628 - DNA, 21 bp, Homo sapiens
tagagtcaactacacaaagca

SEQ ID NO: 882629 - DNA, 15 bp, Homo sapiens
tagagtcaatttgct

SEQ ID NO: 882630 - DNA, 17 bp, Homo sapiens
tagagtcaatttgctga

SEQ ID NO: 882631 - DNA, 13 bp, Homo sapiens
tagagtcattcat

SEQ ID NO: 882632 - DNA, 14 bp, Homo sapiens
tagagtcattcata

SEQ ID NO: 882633 - DNA, 14 bp, Homo sapiens
tagagtcctcactc

SEQ ID NO: 882634 - DNA, 22 bp, Homo sapiens
tagagtctcagaaactcccctg

SEQ ID NO: 882635 - DNA, 17 bp, Homo sapiens
tagagtctgaacagctg

SEQ ID NO: 882636 - DNA, 14 bp, Homo sapiens
tagagtgcccagca

SEQ ID NO: 882637 - DNA, 12 bp, Homo sapiens
tagagtgggagc

SEQ ID NO: 882638 - DNA, 11 bp, Homo sapiens
tagagtgtagc

SEQ ID NO: 882639 - DNA, 20 bp, Homo sapiens
tagagtgtagcctaaagggc

SEQ ID NO: 882640 - DNA, 21 bp, Homo sapiens
tagagtgtagctgtaagggca

SEQ ID NO: 882641 - DNA, 17 bp, Homo sapiens
tagagttatcttcttta

SEQ ID NO: 882642 - DNA, 17 bp, Homo sapiens
tagagttcttctttctt

SEQ ID NO: 882643 - DNA, 14 bp, Homo sapiens
tagagttgatacta

SEQ ID NO: 882644 - DNA, 16 bp, Homo sapiens
tagagttgctgagagg

SEQ ID NO: 882645 - DNA, 13 bp, Homo sapiens
tagagttggagtt

SEQ ID NO: 882646 - DNA, 12 bp, Homo sapiens
tagagtttaaca

SEQ ID NO: 882647 - DNA, 13 bp, Homo sapiens
tagagtttaacac

SEQ ID NO: 882648 - DNA, 15 bp, Homo sapiens
tagataaaaagatgg

SEQ ID NO: 882649 - DNA, 23 bp, Homo sapiens
tagataacaagacctcagtgcct

SEQ ID NO: 882650 - DNA, 19 bp, Homo sapiens
tagataacttcttgaaaaa

SEQ ID NO: 882651 - DNA, 17 bp, Homo sapiens
tagataatttgaaaaag

SEQ ID NO: 882652 - DNA, 19 bp, Homo sapiens
tagatacactaaaaatctg

SEQ ID NO: 882653 - DNA, 14 bp, Homo sapiens
tagatactggaaac

SEQ ID NO: 882654 - DNA, 16 bp, Homo sapiens
tagatactgtatcatg

SEQ ID NO: 882655 - DNA, 12 bp, Homo sapiens
tagatagaaata

SEQ ID NO: 882656 - DNA, 21 bp, Homo sapiens
tagatagaaataaatagctat

SEQ ID NO: 882657 - DNA, 23 bp, Homo sapiens
tagatagaaataaatagctatat

SEQ ID NO: 882658 - DNA, 23 bp, Homo sapiens
tagatagccctgtcctggtggta

SEQ ID NO: 882659 - DNA, 22 bp, Homo sapiens
tagatagttaaaagactgcagc

SEQ ID NO: 882660 - DNA, 13 bp, Homo sapiens
tagatataatgaa

SEQ ID NO: 882661 - DNA, 14 bp, Homo sapiens
tagatataatgaac

SEQ ID NO: 882662 - DNA, 20 bp, Homo sapiens
tagatataatgaacaaaatt

SEQ ID NO: 882663 - DNA, 20 bp, Homo sapiens
tagatatcatgcaaatttca

SEQ ID NO: 882664 - DNA, 15 bp, Homo sapiens
tagatatgaaagctg

SEQ ID NO: 882665 - DNA, 13 bp, Homo sapiens
tagatatgcctta

SEQ ID NO: 882666 - DNA, 17 bp, Homo sapiens
tagatcaaatactttaa

SEQ ID NO: 882667 - DNA, 15 bp, Homo sapiens
tagatcaataaatgt

SEQ ID NO: 882668 - DNA, 17 bp, Homo sapiens
tagatcaataaatgtca

SEQ ID NO: 882669 - DNA, 16 bp, Homo sapiens
tagatcagccattaaa

SEQ ID NO: 882670 - DNA, 19 bp, Homo sapiens
tagatcagccattaaaata

SEQ ID NO: 882671 - DNA, 21 bp, Homo sapiens
tagatcagccattaaaataaa

SEQ ID NO: 882672 - DNA, 16 bp, Homo sapiens
tagatcagtatttcac

SEQ ID NO: 882673 - DNA, 20 bp, Homo sapiens
taattttgtgtaagaaatac

SEQ ID NO: 882674 - DNA, 15 bp, Homo sapiens
taatttttaactttt

SEQ ID NO: 882675 - DNA, 22 bp, Homo sapiens
taatttttattaattttagttt

SEQ ID NO: 882676 - DNA, 18 bp, Homo sapiens
taatttttatttttttga

SEQ ID NO: 882677 - DNA, 15 bp, Homo sapiens
taatttttcctgcat

SEQ ID NO: 882678 - DNA, 16 bp, Homo sapiens
taatttttcctgcatg

SEQ ID NO: 882679 - DNA, 20 bp, Homo sapiens
taatttttgatactaagcat

SEQ ID NO: 882680 - DNA, 23 bp, Homo sapiens
taatttttgatactaagcattga

SEQ ID NO: 882681 - DNA, 20 bp, Homo sapiens
taatttttgctgaattcctt

SEQ ID NO: 882682 - DNA, 18 bp, Homo sapiens
taatttttgcttaacatt

SEQ ID NO: 882683 - DNA, 21 bp, Homo sapiens
taatttttgtattatttttgt

SEQ ID NO: 882684 - DNA, 20 bp, Homo sapiens
taattttttgtacttttagt

SEQ ID NO: 882685 - DNA, 16 bp, Homo sapiens
taatttttttaatgtt

SEQ ID NO: 882686 - DNA, 21 bp, Homo sapiens
taatttttttatgttttgttt

SEQ ID NO: 882687 - DNA, 13 bp, Homo sapiens
taattttttttaa

SEQ ID NO: 882688 - DNA, 16 bp, Homo sapiens
taattttttttaatgt

SEQ ID NO: 882689 - DNA, 22 bp, Homo sapiens
taattttttttttccttttaaa

SEQ ID NO: 882690 - DNA, 19 bp, Homo sapiens
tacaaaaaaaaagttttat

SEQ ID NO: 882691 - DNA, 17 bp, Homo sapiens
tacaaaaaattagctgg

SEQ ID NO: 882692 - DNA, 11 bp, Homo sapiens
tacaaaaaccc

SEQ ID NO: 882693 - DNA, 16 bp, Homo sapiens
tacaaaaaccctaatt

SEQ ID NO: 882694 - DNA, 20 bp, Homo sapiens
tacaaaaagcataaaaatta

SEQ ID NO: 882695 - DNA, 14 bp, Homo sapiens
tacaaaaataaatt

SEQ ID NO: 882696 - DNA, 14 bp, Homo sapiens
tacaaaaatataaa

SEQ ID NO: 882697 - DNA, 18 bp, Homo sapiens
tacaaaaatataaaatat

SEQ ID NO: 882698 - DNA, 17 bp, Homo sapiens
tacaaaaattagccggg

SEQ ID NO: 882699 - DNA, 14 bp, Homo sapiens
tacaaaacaaactc

SEQ ID NO: 882700 - DNA, 16 bp, Homo sapiens
tacaaaactgtaaata

SEQ ID NO: 882701 - DNA, 12 bp, Homo sapiens
tacaaaacttta

SEQ ID NO: 882702 - DNA, 21 bp, Homo sapiens
tacaaaagaagggctggtatt

SEQ ID NO: 882703 - DNA, 21 bp, Homo sapiens
tacaaaataacattctgaatc

SEQ ID NO: 882704 - DNA, 13 bp, Homo sapiens
tacaaaatattta

SEQ ID NO: 882705 - DNA, 13 bp, Homo sapiens
tacaaaatgattt

SEQ ID NO: 882706 - DNA, 14 bp, Homo sapiens
tacaaaatgccaag

SEQ ID NO: 882707 - DNA, 22 bp, Homo sapiens
tacaaaattgcctataatactt

SEQ ID NO: 882708 - DNA, 18 bp, Homo sapiens
tacaaacaaaagcagccc

SEQ ID NO: 882709 - DNA, 21 bp, Homo sapiens
tacaaacaatgcaaccaacta

SEQ ID NO: 882710 - DNA, 11 bp, Homo sapiens
tacaaacatga

SEQ ID NO: 882711 - DNA, 14 bp, Homo sapiens
tacaaacatggaaa

SEQ ID NO: 882712 - DNA, 23 bp, Homo sapiens
tacaaacatggaaaacagagtat

SEQ ID NO: 882713 - DNA, 19 bp, Homo sapiens
tacaaaccactgtgaacat

SEQ ID NO: 882714 - DNA, 14 bp, Homo sapiens
tacaaaccaggtca

SEQ ID NO: 882715 - DNA, 20 bp, Homo sapiens
tacaaaccaggtcaccatcc

SEQ ID NO: 882716 - DNA, 13 bp, Homo sapiens
tacaaacctacca

SEQ ID NO: 882717 - DNA, 14 bp, Homo sapiens
tacaaactcagatc

SEQ ID NO: 882718 - DNA, 23 bp, Homo sapiens
tacaaactcatcctcttttaatg

SEQ ID NO: 882719 - DNA, 19 bp, Homo sapiens
tacaaactcccacttgtca

SEQ ID NO: 882720 - DNA, 12 bp, Homo sapiens
tacaaactctca

SEQ ID NO: 882721 - DNA, 14 bp, Homo sapiens
tacaaactctcacc

SEQ ID NO: 882722 - DNA, 15 bp, Homo sapiens
tacaaactgaagagt

SEQ ID NO: 882723 - DNA, 12 bp, Homo sapiens
tacaaactgcaa

SEQ ID NO: 882724 - DNA, 14 bp, Homo sapiens
tacaaactgcaata

SEQ ID NO: 882725 - DNA, 15 bp, Homo sapiens
tacaaagtaaaatga

SEQ ID NO: 882726 - DNA, 18 bp, Homo sapiens
tacaaagtagaagtctta

SEQ ID NO: 882727 - DNA, 13 bp, Homo sapiens
tacaaagtgatgt

SEQ ID NO: 882728 - DNA, 17 bp, Homo sapiens
tacaaagttaaaattgt

SEQ ID NO: 882729 - DNA, 18 bp, Homo sapiens
tacaaagttaaaattgtt

SEQ ID NO: 882730 - DNA, 17 bp, Homo sapiens
tacaaataaacagttgt

SEQ ID NO: 882731 - DNA, 12 bp, Homo sapiens
tacaaatataag

SEQ ID NO: 882732 - DNA, 16 bp, Homo sapiens
tacaaatgaagaaagt

SEQ ID NO: 882733 - DNA, 17 bp, Homo sapiens
tacaaatgaagaaagtc

SEQ ID NO: 882734 - DNA, 16 bp, Homo sapiens
tacaaatgacactgca

SEQ ID NO: 882735 - DNA, 13 bp, Homo sapiens
tacaaatgtgata

SEQ ID NO: 882736 - DNA, 14 bp, Homo sapiens
tacaaattagaaaa

SEQ ID NO: 882737 - DNA, 14 bp, Homo sapiens
tacaaattctactt

SEQ ID NO: 882738 - DNA, 14 bp, Homo sapiens
tacaaatttagtgc

SEQ ID NO: 882739 - DNA, 13 bp, Homo sapiens
tacaaatttatgc

SEQ ID NO: 882740 - DNA, 14 bp, Homo sapiens
tacaaatttatgca

SEQ ID NO: 882741 - DNA, 17 bp, Homo sapiens
tacaaatttatgcattt

SEQ ID NO: 882742 - DNA, 20 bp, Homo sapiens
tacaaatttatgcatttcat

SEQ ID NO: 882743 - DNA, 21 bp, Homo sapiens
tacaaatttatgcatttcatt

SEQ ID NO: 882744 - DNA, 16 bp, Homo sapiens
tacaaatttgttattt

SEQ ID NO: 882745 - DNA, 14 bp, Homo sapiens
tacaaattttcact

SEQ ID NO: 882746 - DNA, 24 bp, Homo sapiens
tacaaattttcactgctgctcctc

SEQ ID NO: 882747 - DNA, 20 bp, Homo sapiens
tacaaattttcttttgaaag

SEQ ID NO: 882748 - DNA, 20 bp, Homo sapiens
tacaaattttttaatttcca

SEQ ID NO: 882749 - DNA, 16 bp, Homo sapiens
tacaacaaaaggactt

SEQ ID NO: 882750 - DNA, 15 bp, Homo sapiens
tacaacaactatttt

SEQ ID NO: 882751 - DNA, 23 bp, Homo sapiens
tacaacagaaaccagaaaagcaa

SEQ ID NO: 882752 - DNA, 22 bp, Homo sapiens
tacaacataatctagtttacag

SEQ ID NO: 882753 - DNA, 17 bp, Homo sapiens
tacaaccaagctctctg

SEQ ID NO: 882754 - DNA, 17 bp, Homo sapiens
tacaaccccctccaccc

SEQ ID NO: 882755 - DNA, 19 bp, Homo sapiens
tacaactaaaaataaatta

SEQ ID NO: 882756 - DNA, 18 bp, Homo sapiens
tacaactaaataacacag

SEQ ID NO: 882757 - DNA, 20 bp, Homo sapiens
tacaactaaataacacagat

SEQ ID NO: 882758 - DNA, 20 bp, Homo sapiens
tacaactaacgcaaccaagt

SEQ ID NO: 882759 - DNA, 23 bp, Homo sapiens
tacaactggagtttttttataca

SEQ ID NO: 882760 - DNA, 18 bp, Homo sapiens
tacaacttaaataataaa

SEQ ID NO: 882761 - DNA, 15 bp, Homo sapiens
tacaacttaatggaa

SEQ ID NO: 882762 - DNA, 14 bp, Homo sapiens
tacaacttcagcag

SEQ ID NO: 882763 - DNA, 23 bp, Homo sapiens
tacaactttaccataaagccttt

SEQ ID NO: 882764 - DNA, 15 bp, Homo sapiens
tacaagacacagtga

SEQ ID NO: 882765 - DNA, 16 bp, Homo sapiens
tacaagagagtgaaat

SEQ ID NO: 882766 - DNA, 16 bp, Homo sapiens
tacaagagcagcctgt

SEQ ID NO: 882767 - DNA, 23 bp, Homo sapiens
tacaagagcagcctgtggcatct

SEQ ID NO: 882768 - DNA, 19 bp, Homo sapiens
tacaagagcttaacagtgt

SEQ ID NO: 882769 - DNA, 15 bp, Homo sapiens
tacaagatattgatg

SEQ ID NO: 882770 - DNA, 22 bp, Homo sapiens
tacaagatggcgaccaccaaag

SEQ ID NO: 882771 - DNA, 20 bp, Homo sapiens
tacaagattgaaaatcttgt

SEQ ID NO: 882772 - DNA, 17 bp, Homo sapiens
tacaagatttagaaaaa

SEQ ID NO: 882773 - DNA, 15 bp, Homo sapiens
tacaagcatatttga

SEQ ID NO: 882774 - DNA, 22 bp, Homo sapiens
tacaagccaaagtggcatgttt

SEQ ID NO: 882775 - DNA, 14 bp, Homo sapiens
tacaagccccccct

SEQ ID NO: 882776 - DNA, 19 bp, Homo sapiens
tacaagcccccccttccac

SEQ ID NO: 882777 - DNA, 19 bp, Homo sapiens
tacaaggacattcactgct

SEQ ID NO: 882778 - DNA, 20 bp, Homo sapiens
tacaaggacattcactgctg

SEQ ID NO: 882779 - DNA, 21 bp, Homo sapiens
tacaaggccccaaggtttaca

SEQ ID NO: 882780 - DNA, 19 bp, Homo sapiens
tacaagggcataaagtaaa

SEQ ID NO: 882781 - DNA, 16 bp, Homo sapiens
tacaaggtaattgttt

SEQ ID NO: 882782 - DNA, 20 bp, Homo sapiens
tacaaggtaggctgcaaaat

SEQ ID NO: 882783 - DNA, 18 bp, Homo sapiens
tacaagtactggtaagat

SEQ ID NO: 882784 - DNA, 13 bp, Homo sapiens
tacaagtggctcc

SEQ ID NO: 882785 - DNA, 13 bp, Homo sapiens
tagcatcttcctc

SEQ ID NO: 882786 - DNA, 14 bp, Homo sapiens
tagcatcttcctct

SEQ ID NO: 882787 - DNA, 13 bp, Homo sapiens
tagcatcttctgg

SEQ ID NO: 882788 - DNA, 23 bp, Homo sapiens
tagcatcttctggagtctccagt

SEQ ID NO: 882789 - DNA, 22 bp, Homo sapiens
tagcatgaacttgtgggatggt

SEQ ID NO: 882790 - DNA, 16 bp, Homo sapiens
tagcatgacaagcccc

SEQ ID NO: 882791 - DNA, 17 bp, Homo sapiens
tagcatgacaagcccca

SEQ ID NO: 882792 - DNA, 20 bp, Homo sapiens
tagcatgacaagccccaggc

SEQ ID NO: 882793 - DNA, 18 bp, Homo sapiens
tagcatgcaagcttggtc

SEQ ID NO: 882794 - DNA, 17 bp, Homo sapiens
tagcatggactctgggt

SEQ ID NO: 882795 - DNA, 13 bp, Homo sapiens
tagcatgggaggt

SEQ ID NO: 882796 - DNA, 15 bp, Homo sapiens
tagcatggggcccct

SEQ ID NO: 882797 - DNA, 20 bp, Homo sapiens
tagcatgggtccaagagaca

SEQ ID NO: 882798 - DNA, 21 bp, Homo sapiens
tagcatgggtccaagagacat

SEQ ID NO: 882799 - DNA, 23 bp, Homo sapiens
tagcatgttcctccttttcttca

SEQ ID NO: 882800 - DNA, 12 bp, Homo sapiens
tagcatgttcta

SEQ ID NO: 882801 - DNA, 12 bp, Homo sapiens
tagcattaacta

SEQ ID NO: 882802 - DNA, 17 bp, Homo sapiens
tagcattcctcaggaag

SEQ ID NO: 882803 - DNA, 14 bp, Homo sapiens
tagcattctttgga

SEQ ID NO: 882804 - DNA, 20 bp, Homo sapiens
tagcattctttggagttaaa

SEQ ID NO: 882805 - DNA, 19 bp, Homo sapiens
tagcattgataatcttcag

SEQ ID NO: 882806 - DNA, 24 bp, Homo sapiens
tagcattgtaaaattatttcatga

SEQ ID NO: 882807 - DNA, 12 bp, Homo sapiens
tagcattgttat

SEQ ID NO: 882808 - DNA, 12 bp, Homo sapiens
tagcatttattt

SEQ ID NO: 882809 - DNA, 12 bp, Homo sapiens
tagcatttcttg

SEQ ID NO: 882810 - DNA, 16 bp, Homo sapiens
tagcatttcttgatgt

SEQ ID NO: 882811 - DNA, 16 bp, Homo sapiens
tagcattttaaacaaa

SEQ ID NO: 882812 - DNA, 18 bp, Homo sapiens
tagcattttaaacaaaat

SEQ ID NO: 882813 - DNA, 19 bp, Homo sapiens
tagcattttcttgaaccaa

SEQ ID NO: 882814 - DNA, 14 bp, Homo sapiens
tagcatttttatgc

SEQ ID NO: 882815 - DNA, 22 bp, Homo sapiens
tagcatttttatgcagacagtc

SEQ ID NO: 882816 - DNA, 17 bp, Homo sapiens
tagcatttttctaaaac

SEQ ID NO: 882817 - DNA, 21 bp, Homo sapiens
tagccaaaaaggcaaataatg

SEQ ID NO: 882818 - DNA, 17 bp, Homo sapiens
tagccaaagccaggcct

SEQ ID NO: 882819 - DNA, 21 bp, Homo sapiens
tagccaaggtgggctgagccc

SEQ ID NO: 882820 - DNA, 23 bp, Homo sapiens
tagccaaggtgggctgagccctg

SEQ ID NO: 882821 - DNA, 19 bp, Homo sapiens
tagccaatattaaaagaga

SEQ ID NO: 882822 - DNA, 21 bp, Homo sapiens
tagccaatattaaaagagacc

SEQ ID NO: 882823 - DNA, 15 bp, Homo sapiens
tagccacagctgctg

SEQ ID NO: 882824 - DNA, 19 bp, Homo sapiens
tagccacagctgctgttct

SEQ ID NO: 882825 - DNA, 22 bp, Homo sapiens
tagccacagctgctgttctcag

SEQ ID NO: 882826 - DNA, 19 bp, Homo sapiens
tagccacatccctttgaaa

SEQ ID NO: 882827 - DNA, 20 bp, Homo sapiens
tagccactaaccttgcctgg

SEQ ID NO: 882828 - DNA, 21 bp, Homo sapiens
tagccactaaccttgcctggt

SEQ ID NO: 882829 - DNA, 13 bp, Homo sapiens
tagccactcagga

SEQ ID NO: 882830 - DNA, 20 bp, Homo sapiens
tagccagacaaaatttgaga

SEQ ID NO: 882831 - DNA, 20 bp, Homo sapiens
tagccagacacgttctgatt

SEQ ID NO: 882832 - DNA, 15 bp, Homo sapiens
tagccagacactctg

SEQ ID NO: 882833 - DNA, 15 bp, Homo sapiens
tagccagagaggagc

SEQ ID NO: 882834 - DNA, 17 bp, Homo sapiens
tagccagagaggagcac

SEQ ID NO: 882835 - DNA, 18 bp, Homo sapiens
tagccagagaggagcacc

SEQ ID NO: 882836 - DNA, 20 bp, Homo sapiens
tagccagcacacagggcagt

SEQ ID NO: 882837 - DNA, 16 bp, Homo sapiens
tagccaggagtctgtg

SEQ ID NO: 882838 - DNA, 19 bp, Homo sapiens
tagccaggagtctgtgctc

SEQ ID NO: 882839 - DNA, 21 bp, Homo sapiens
tagccaggagtctgtgctctt

SEQ ID NO: 882840 - DNA, 13 bp, Homo sapiens
tagccataataaa

SEQ ID NO: 882841 - DNA, 24 bp, Homo sapiens
tagccataattttgcatactgaaa

SEQ ID NO: 882842 - DNA, 16 bp, Homo sapiens
tagccatggctcaggc

SEQ ID NO: 882843 - DNA, 14 bp, Homo sapiens
tagccatggctggg

SEQ ID NO: 882844 - DNA, 13 bp, Homo sapiens
tagcccactccct

SEQ ID NO: 882845 - DNA, 21 bp, Homo sapiens
tagcccacttacatttacaaa

SEQ ID NO: 882846 - DNA, 19 bp, Homo sapiens
tagcccagaacaaaaagaa

SEQ ID NO: 882847 - DNA, 14 bp, Homo sapiens
tagcccagactctg

SEQ ID NO: 882848 - DNA, 13 bp, Homo sapiens
tagcccaggagca

SEQ ID NO: 882849 - DNA, 15 bp, Homo sapiens
tagcccagtgttttc

SEQ ID NO: 882850 - DNA, 21 bp, Homo sapiens
tagcccataaagtctgagaaa

SEQ ID NO: 882851 - DNA, 18 bp, Homo sapiens
tagccccaggtcttttct

SEQ ID NO: 882852 - DNA, 18 bp, Homo sapiens
tagccccctggcctctgt

SEQ ID NO: 882853 - DNA, 20 bp, Homo sapiens
tagccccgccccagccctca

SEQ ID NO: 882854 - DNA, 15 bp, Homo sapiens
tagccccggcccccc

SEQ ID NO: 882855 - DNA, 13 bp, Homo sapiens
tagcccctctctc

SEQ ID NO: 882856 - DNA, 16 bp, Homo sapiens
tagccctcacattaga

SEQ ID NO: 882857 - DNA, 13 bp, Homo sapiens
tagccctcccact

SEQ ID NO: 882858 - DNA, 16 bp, Homo sapiens
tagccctccccccagc

SEQ ID NO: 882859 - DNA, 15 bp, Homo sapiens
tagccctccccctca

SEQ ID NO: 882860 - DNA, 18 bp, Homo sapiens
tagccctccccctcaacc

SEQ ID NO: 882861 - DNA, 11 bp, Homo sapiens
tagccctgagc

SEQ ID NO: 882862 - DNA, 17 bp, Homo sapiens
tagccctgtcctggtgg

SEQ ID NO: 882863 - DNA, 22 bp, Homo sapiens
tagccctgtcctggtggtattt

SEQ ID NO: 882864 - DNA, 17 bp, Homo sapiens
tagcgcacccagagaaa

SEQ ID NO: 882865 - DNA, 18 bp, Homo sapiens
tagcgcacccagagaaaa

SEQ ID NO: 882866 - DNA, 12 bp, Homo sapiens
tagcgctctgga

SEQ ID NO: 882867 - DNA, 15 bp, Homo sapiens
tagcgctctggacag

SEQ ID NO: 882868 - DNA, 13 bp, Homo sapiens
tagcgctgttttt

SEQ ID NO: 882869 - DNA, 14 bp, Homo sapiens
tagcggagcccagc

SEQ ID NO: 882870 - DNA, 16 bp, Homo sapiens
tagcggagcccagcct

SEQ ID NO: 882871 - DNA, 13 bp, Homo sapiens
tagcggctcctcg

SEQ ID NO: 882872 - DNA, 23 bp, Homo sapiens
tagcggctcctcgcccccaccag

SEQ ID NO: 882873 - DNA, 14 bp, Homo sapiens
tagcgtcaagacat

SEQ ID NO: 882874 - DNA, 15 bp, Homo sapiens
tagcgtcaagacatt

SEQ ID NO: 882875 - DNA, 19 bp, Homo sapiens
tagcgtcctgccctgcccc

SEQ ID NO: 882876 - DNA, 17 bp, Homo sapiens
tagcgtgctcactgacc

SEQ ID NO: 882877 - DNA, 18 bp, Homo sapiens
tagcgtgtgtagatagta

SEQ ID NO: 882878 - DNA, 21 bp, Homo sapiens
tagcgttctggactctgcccc

SEQ ID NO: 882879 - DNA, 13 bp, Homo sapiens
tagcgttcttgta

SEQ ID NO: 882880 - DNA, 14 bp, Homo sapiens
tagcgttcttgtaa

SEQ ID NO: 882881 - DNA, 21 bp, Homo sapiens
tagcgttcttgtaattttaca

SEQ ID NO: 882882 - DNA, 18 bp, Homo sapiens
tagctaaacggattccaa

SEQ ID NO: 882883 - DNA, 20 bp, Homo sapiens
tagctaaatgcaatttaaaa

SEQ ID NO: 882884 - DNA, 15 bp, Homo sapiens
tagctaagtacacaa

SEQ ID NO: 882885 - DNA, 19 bp, Homo sapiens
tagctaataacatgtgaaa

SEQ ID NO: 882886 - DNA, 19 bp, Homo sapiens
tagctacaaaaaatatttt

SEQ ID NO: 882887 - DNA, 23 bp, Homo sapiens
tagctacaatttgtttttgcatt

SEQ ID NO: 882888 - DNA, 15 bp, Homo sapiens
tagctacactgagca

SEQ ID NO: 882889 - DNA, 20 bp, Homo sapiens
tagctacaggaagcacccca

SEQ ID NO: 882890 - DNA, 18 bp, Homo sapiens
tagctactggaaatatta

SEQ ID NO: 882891 - DNA, 18 bp, Homo sapiens
tagctactgtatgcaaag

SEQ ID NO: 882892 - DNA, 13 bp, Homo sapiens
tagctagccagcc

SEQ ID NO: 882893 - DNA, 12 bp, Homo sapiens
tagctagcgcac

SEQ ID NO: 882894 - DNA, 12 bp, Homo sapiens
tagctagtagca

SEQ ID NO: 882895 - DNA, 16 bp, Homo sapiens
tagctagtagcaatgt

SEQ ID NO: 882896 - DNA, 15 bp, Homo sapiens
tagctatatccatgt

SEQ ID NO: 882897 - DNA, 15 bp, Homo sapiens
tagctatcagaagac

SEQ ID NO: 882898 - DNA, 14 bp, Homo sapiens
tagctatgctgtat

SEQ ID NO: 882899 - DNA, 13 bp, Homo sapiens
tagctattactgt

SEQ ID NO: 882900 - DNA, 18 bp, Homo sapiens
tagctcaagtttaaaagc

SEQ ID NO: 882901 - DNA, 12 bp, Homo sapiens
tagctcactgaa

SEQ ID NO: 882902 - DNA, 14 bp, Homo sapiens
tagctcaggtgcct

SEQ ID NO: 882903 - DNA, 22 bp, Homo sapiens
tagctcattctccttgtgttac

SEQ ID NO: 882904 - DNA, 12 bp, Homo sapiens
tagctcctgtgg

SEQ ID NO: 882905 - DNA, 14 bp, Homo sapiens
tagctcggcaccaa

SEQ ID NO: 882906 - DNA, 18 bp, Homo sapiens
tagctcggcaccaactaa

SEQ ID NO: 882907 - DNA, 11 bp, Homo sapiens
tagctctccca

SEQ ID NO: 882908 - DNA, 15 bp, Homo sapiens
tagctctctaggcct

SEQ ID NO: 882909 - DNA, 17 bp, Homo sapiens
tagctctctaggcctct

SEQ ID NO: 882910 - DNA, 12 bp, Homo sapiens
tagctctgcctc

SEQ ID NO: 882911 - DNA, 11 bp, Homo sapiens
tagctctgggg

SEQ ID NO: 882912 - DNA, 22 bp, Homo sapiens
tagctctggggtgggcagtttt

SEQ ID NO: 882913 - DNA, 16 bp, Homo sapiens
tagctctgtggaattc

SEQ ID NO: 882914 - DNA, 13 bp, Homo sapiens
tagctcttacaca

SEQ ID NO: 882915 - DNA, 14 bp, Homo sapiens
tagctctttggtct

SEQ ID NO: 882916 - DNA, 19 bp, Homo sapiens
tagctcttttttgtttgtt

SEQ ID NO: 882917 - DNA, 21 bp, Homo sapiens
tagctgaaaactaatgtactg

SEQ ID NO: 882918 - DNA, 22 bp, Homo sapiens
tagctgaaaagggcactcccaa

SEQ ID NO: 882919 - DNA, 16 bp, Homo sapiens
tagctgaggggacggg

SEQ ID NO: 882920 - DNA, 20 bp, Homo sapiens
tagctgaggggacgggcaag

SEQ ID NO: 882921 - DNA, 11 bp, Homo sapiens
tagctgagtgt

SEQ ID NO: 882922 - DNA, 14 bp, Homo sapiens
tagctgatgaaact

SEQ ID NO: 882923 - DNA, 21 bp, Homo sapiens
tagctgatgaacttattctgt

SEQ ID NO: 882924 - DNA, 23 bp, Homo sapiens
tagctgccttcgcaccttgctgt

SEQ ID NO: 882925 - DNA, 15 bp, Homo sapiens
tagctgctctgagca

SEQ ID NO: 882926 - DNA, 12 bp, Homo sapiens
tagctgctgtca

SEQ ID NO: 882927 - DNA, 15 bp, Homo sapiens
tagctggcaggacac

SEQ ID NO: 882928 - DNA, 16 bp, Homo sapiens
tagctggcaggacaca

SEQ ID NO: 882929 - DNA, 14 bp, Homo sapiens
tagctgggactaca

SEQ ID NO: 882930 - DNA, 21 bp, Homo sapiens
tagctggggcttatgggtggc

SEQ ID NO: 882931 - DNA, 19 bp, Homo sapiens
tagctggggcttcaccagt

SEQ ID NO: 882932 - DNA, 16 bp, Homo sapiens
tagctgggttccggga

SEQ ID NO: 882933 - DNA, 20 bp, Homo sapiens
tagctggtggttgtgccttt

SEQ ID NO: 882934 - DNA, 22 bp, Homo sapiens
tagctggtttcctcattcctga

SEQ ID NO: 882935 - DNA, 17 bp, Homo sapiens
tagctgtaaggcatgaa

SEQ ID NO: 882936 - DNA, 19 bp, Homo sapiens
tagctgtaagggcagtgcc

SEQ ID NO: 882937 - DNA, 16 bp, Homo sapiens
tagctgtacaaatata

SEQ ID NO: 882938 - DNA, 18 bp, Homo sapiens
tagctgtacaaatataag

SEQ ID NO: 882939 - DNA, 16 bp, Homo sapiens
tagctgtactataagt

SEQ ID NO: 882940 - DNA, 21 bp, Homo sapiens
tagctgtatgatttgttttga

SEQ ID NO: 882941 - DNA, 15 bp, Homo sapiens
tagctgtctagagta

SEQ ID NO: 882942 - DNA, 21 bp, Homo sapiens
tagctgtctgctcagacagaa

SEQ ID NO: 882943 - DNA, 17 bp, Homo sapiens
tagctgttactgcaagt

SEQ ID NO: 882944 - DNA, 20 bp, Homo sapiens
tagctgttttagctgaggga

SEQ ID NO: 882945 - DNA, 19 bp, Homo sapiens
tagctgttttgtgtatatt

SEQ ID NO: 882946 - DNA, 15 bp, Homo sapiens
tagcttaactaattt

SEQ ID NO: 882947 - DNA, 15 bp, Homo sapiens
tagcttacaggaagc

SEQ ID NO: 882948 - DNA, 16 bp, Homo sapiens
tagcttagacctcagc

SEQ ID NO: 882949 - DNA, 13 bp, Homo sapiens
tagcttatctttc

SEQ ID NO: 882950 - DNA, 14 bp, Homo sapiens
tagcttcagttgtt

SEQ ID NO: 882951 - DNA, 14 bp, Homo sapiens
tagcttccacctca

SEQ ID NO: 882952 - DNA, 15 bp, Homo sapiens
tagcttccacctcat

SEQ ID NO: 882953 - DNA, 19 bp, Homo sapiens
tagcttcctccagaggagg

SEQ ID NO: 882954 - DNA, 19 bp, Homo sapiens
tagcttctcttctttctga

SEQ ID NO: 882955 - DNA, 21 bp, Homo sapiens
tagcttctcttctttctgaag

SEQ ID NO: 882956 - DNA, 17 bp, Homo sapiens
tagcttgaagcccaaga

SEQ ID NO: 882957 - DNA, 15 bp, Homo sapiens
tagcttgttccctgt

SEQ ID NO: 882958 - DNA, 14 bp, Homo sapiens
tagctttaaaaggg

SEQ ID NO: 882959 - DNA, 18 bp, Homo sapiens
tagctttacatattcctt

SEQ ID NO: 882960 - DNA, 13 bp, Homo sapiens
tagctttactgtt

SEQ ID NO: 882961 - DNA, 19 bp, Homo sapiens
tagctttactgtttgttat

SEQ ID NO: 882962 - DNA, 20 bp, Homo sapiens
tagctttatatatggacatg

SEQ ID NO: 882963 - DNA, 20 bp, Homo sapiens
tagctttattttttaagtat

SEQ ID NO: 882964 - DNA, 22 bp, Homo sapiens
tagctttattttttaagtattt

SEQ ID NO: 882965 - DNA, 12 bp, Homo sapiens
tagctttctgga

SEQ ID NO: 882966 - DNA, 13 bp, Homo sapiens
tagctttgaaact

SEQ ID NO: 882967 - DNA, 16 bp, Homo sapiens
tagctttgggtgcctt

SEQ ID NO: 882968 - DNA, 13 bp, Homo sapiens
tagctttgtgttt

SEQ ID NO: 882969 - DNA, 20 bp, Homo sapiens
tagcttttaggaaaatcact

SEQ ID NO: 882970 - DNA, 18 bp, Homo sapiens
tagcttttctatttttga

SEQ ID NO: 882971 - DNA, 16 bp, Homo sapiens
taggaaaaaattgaaa

SEQ ID NO: 882972 - DNA, 17 bp, Homo sapiens
taggaaaagtacattta

SEQ ID NO: 882973 - DNA, 20 bp, Homo sapiens
taggaaacaccattataaaa

SEQ ID NO: 882974 - DNA, 17 bp, Homo sapiens
taggaaactaagcattg

SEQ ID NO: 882975 - DNA, 22 bp, Homo sapiens
taggaaagcgtggttccaagaa

SEQ ID NO: 882976 - DNA, 19 bp, Homo sapiens
taggaaataaaacctttca

SEQ ID NO: 882977 - DNA, 22 bp, Homo sapiens
taggaaatggctttgtgattca

SEQ ID NO: 882978 - DNA, 14 bp, Homo sapiens
taggaaatttaaga

SEQ ID NO: 882979 - DNA, 16 bp, Homo sapiens
taggaaatttaagact

SEQ ID NO: 882980 - DNA, 23 bp, Homo sapiens
taggaacaagctggcttctgtga

SEQ ID NO: 882981 - DNA, 22 bp, Homo sapiens
taggaaccgtggtatgtctgcc

SEQ ID NO: 882982 - DNA, 21 bp, Homo sapiens
taggaacttaaataatgtgaa

SEQ ID NO: 882983 - DNA, 16 bp, Homo sapiens
taggaacttcagagat

SEQ ID NO: 882984 - DNA, 19 bp, Homo sapiens
taggaagaaagaagacaaa

SEQ ID NO: 882985 - DNA, 18 bp, Homo sapiens
taggaagacataaaactt

SEQ ID NO: 882986 - DNA, 15 bp, Homo sapiens
taggaagagaaacca

SEQ ID NO: 882987 - DNA, 18 bp, Homo sapiens
taggaagtgtaacagctg

SEQ ID NO: 882988 - DNA, 22 bp, Homo sapiens
taggaagtgtaacagctgaggt

SEQ ID NO: 882989 - DNA, 17 bp, Homo sapiens
taggaagttttttctac

SEQ ID NO: 882990 - DNA, 12 bp, Homo sapiens
taggaataataa

SEQ ID NO: 882991 - DNA, 15 bp, Homo sapiens
taggaataataaatt

SEQ ID NO: 882992 - DNA, 16 bp, Homo sapiens
taggaataataaattc

SEQ ID NO: 882993 - DNA, 14 bp, Homo sapiens
taggaatctcttca

SEQ ID NO: 882994 - DNA, 22 bp, Homo sapiens
taggaatctcttcactaccctg

SEQ ID NO: 882995 - DNA, 14 bp, Homo sapiens
taggaatctgcctt

SEQ ID NO: 882996 - DNA, 19 bp, Homo sapiens
taggaatctgccttccagc

SEQ ID NO: 882997 - DNA, 21 bp, Homo sapiens
taggaatctgccttccagccc

SEQ ID NO: 882998 - DNA, 18 bp, Homo sapiens
taggaattaagttatctt

SEQ ID NO: 882999 - DNA, 21 bp, Homo sapiens
taggaattcccagcccaaagc

SEQ ID NO: 883000 - DNA, 17 bp, Homo sapiens
taggaattgtttataca

SEQ ID NO: 883001 - DNA, 19 bp, Homo sapiens
taggaattgtttatacaca

SEQ ID NO: 883002 - DNA, 16 bp, Homo sapiens
taggaatttgtataaa

SEQ ID NO: 883003 - DNA, 18 bp, Homo sapiens
taggacaatcagtcccct

SEQ ID NO: 883004 - DNA, 18 bp, Homo sapiens
taggacatactgcatgta

SEQ ID NO: 883005 - DNA, 17 bp, Homo sapiens
taggaccaagcatcttg

SEQ ID NO: 883006 - DNA, 16 bp, Homo sapiens
taggaccactcagccc

SEQ ID NO: 883007 - DNA, 18 bp, Homo sapiens
taggaccactcagcccct

SEQ ID NO: 883008 - DNA, 19 bp, Homo sapiens
taggacctttccaccacag

SEQ ID NO: 883009 - DNA, 22 bp, Homo sapiens
taggacgccaacttctcccacc

SEQ ID NO: 883010 - DNA, 17 bp, Homo sapiens
taggactaccgcaggcc

SEQ ID NO: 883011 - DNA, 16 bp, Homo sapiens
taggactctgaggctc

SEQ ID NO: 883012 - DNA, 18 bp, Homo sapiens
taggactctgaggctctt

SEQ ID NO: 883013 - DNA, 15 bp, Homo sapiens
taggactctggacaa

SEQ ID NO: 883014 - DNA, 23 bp, Homo sapiens
taggacttggtaagatgactctg

SEQ ID NO: 883015 - DNA, 19 bp, Homo sapiens
taggactttgaattatttc

SEQ ID NO: 883016 - DNA, 14 bp, Homo sapiens
taggagaaacacat

SEQ ID NO: 883017 - DNA, 19 bp, Homo sapiens
taggagagattgggagaaa

SEQ ID NO: 883018 - DNA, 16 bp, Homo sapiens
taggagagcactgcct

SEQ ID NO: 883019 - DNA, 10 bp, Homo sapiens
taggagagga

SEQ ID NO: 883020 - DNA, 11 bp, Homo sapiens
taggagaggag

SEQ ID NO: 883021 - DNA, 16 bp, Homo sapiens
taggagaggagaaaaa

SEQ ID NO: 883022 - DNA, 22 bp, Homo sapiens
taggagagggggcgatatagag

SEQ ID NO: 883023 - DNA, 22 bp, Homo sapiens
taggagataccaggttgaaaga

SEQ ID NO: 883024 - DNA, 15 bp, Homo sapiens
taggagcaagaagaa

SEQ ID NO: 883025 - DNA, 19 bp, Homo sapiens
taggagcaagaagaaaatg

SEQ ID NO: 883026 - DNA, 18 bp, Homo sapiens
taggagcccttctctttg

SEQ ID NO: 883027 - DNA, 21 bp, Homo sapiens
taggaggctgcatgctctgga

SEQ ID NO: 883028 - DNA, 21 bp, Homo sapiens
taggagggaagatttttccat

SEQ ID NO: 883029 - DNA, 18 bp, Homo sapiens
taggagggagactgtggt

SEQ ID NO: 883030 - DNA, 18 bp, Homo sapiens
taggagggagttatctaa

SEQ ID NO: 883031 - DNA, 13 bp, Homo sapiens
taggagtctgagc

SEQ ID NO: 883032 - DNA, 22 bp, Homo sapiens
taggagtggttctcatttggtc

SEQ ID NO: 883033 - DNA, 22 bp, Homo sapiens
taggagttaacccctgcgctct

SEQ ID NO: 883034 - DNA, 21 bp, Homo sapiens
tatcagttactcagccctggg

SEQ ID NO: 883035 - DNA, 20 bp, Homo sapiens
tatcatactgttttgaataa

SEQ ID NO: 883036 - DNA, 15 bp, Homo sapiens
tatcatagaaatgta

SEQ ID NO: 883037 - DNA, 18 bp, Homo sapiens
tatcatagaaatgtaact

SEQ ID NO: 883038 - DNA, 19 bp, Homo sapiens
tatcatcccaacagccaag

SEQ ID NO: 883039 - DNA, 11 bp, Homo sapiens
tatcatgaatg

SEQ ID NO: 883040 - DNA, 12 bp, Homo sapiens
tatcatgaattt

SEQ ID NO: 883041 - DNA, 16 bp, Homo sapiens
tatcatgaattttaaa

SEQ ID NO: 883042 - DNA, 16 bp, Homo sapiens
tatcatgacaaagact

SEQ ID NO: 883043 - DNA, 14 bp, Homo sapiens
tatcatgacatgtt

SEQ ID NO: 883044 - DNA, 14 bp, Homo sapiens
tatcatgcaaaata

SEQ ID NO: 883045 - DNA, 15 bp, Homo sapiens
tatcatgcaaatgct

SEQ ID NO: 883046 - DNA, 17 bp, Homo sapiens
tatcatgcaaatgctgt

SEQ ID NO: 883047 - DNA, 23 bp, Homo sapiens
tatcatgcacacaattagatttc

SEQ ID NO: 883048 - DNA, 14 bp, Homo sapiens
tatcatgccctgtg

SEQ ID NO: 883049 - DNA, 15 bp, Homo sapiens
tatcatggaatattt

SEQ ID NO: 883050 - DNA, 15 bp, Homo sapiens
tatcatggtatttga

SEQ ID NO: 883051 - DNA, 16 bp, Homo sapiens
tatcatggtgaaaagc

SEQ ID NO: 883052 - DNA, 19 bp, Homo sapiens
tatcatgtcgtaggtaaac

SEQ ID NO: 883053 - DNA, 19 bp, Homo sapiens
tatcatgttttataatttg

SEQ ID NO: 883054 - DNA, 12 bp, Homo sapiens
tatcattaaaat

SEQ ID NO: 883055 - DNA, 18 bp, Homo sapiens
tatcattaaaatatatgt

SEQ ID NO: 883056 - DNA, 16 bp, Homo sapiens
tatcattaaacaaata

SEQ ID NO: 883057 - DNA, 23 bp, Homo sapiens
tatcattccaattctaaatccga

SEQ ID NO: 883058 - DNA, 19 bp, Homo sapiens
tatcattctacagaataat

SEQ ID NO: 883059 - DNA, 12 bp, Homo sapiens
tatcattctcag

SEQ ID NO: 883060 - DNA, 13 bp, Homo sapiens
tatcatttactct

SEQ ID NO: 883061 - DNA, 15 bp, Homo sapiens
tatcatttcactgtc

SEQ ID NO: 883062 - DNA, 13 bp, Homo sapiens
tatcatttgtgaa

SEQ ID NO: 883063 - DNA, 16 bp, Homo sapiens
tatcatttgtgaagaa

SEQ ID NO: 883064 - DNA, 14 bp, Homo sapiens
tatcattttaaaaa

SEQ ID NO: 883065 - DNA, 19 bp, Homo sapiens
tatcattttaaaaacttta

SEQ ID NO: 883066 - DNA, 18 bp, Homo sapiens
tatcatttttacactatt

SEQ ID NO: 883067 - DNA, 16 bp, Homo sapiens
tatcatttttgtataa

SEQ ID NO: 883068 - DNA, 15 bp, Homo sapiens
tatcatttttgtgca

SEQ ID NO: 883069 - DNA, 15 bp, Homo sapiens
tatccaaaatgcttg

SEQ ID NO: 883070 - DNA, 23 bp, Homo sapiens
tatccaaaatgtgtatttcttat

SEQ ID NO: 883071 - DNA, 20 bp, Homo sapiens
tatccaaagaacttgatttg

SEQ ID NO: 883072 - DNA, 17 bp, Homo sapiens
tatccaaagactgtact

SEQ ID NO: 883073 - DNA, 15 bp, Homo sapiens
tatccaatgtctttt

SEQ ID NO: 883074 - DNA, 20 bp, Homo sapiens
tatccacaatagctgacggc

SEQ ID NO: 883075 - DNA, 21 bp, Homo sapiens
tatccacaatagtcagaaaac

SEQ ID NO: 883076 - DNA, 21 bp, Homo sapiens
tatccacaggatattaaacgt

SEQ ID NO: 883077 - DNA, 15 bp, Homo sapiens
tatccacagtactca

SEQ ID NO: 883078 - DNA, 19 bp, Homo sapiens
tatccacccagcaggcaga

SEQ ID NO: 883079 - DNA, 13 bp, Homo sapiens
tatccacccagcc

SEQ ID NO: 883080 - DNA, 14 bp, Homo sapiens
tatccacccagccc

SEQ ID NO: 883081 - DNA, 15 bp, Homo sapiens
tatccacccagccca

SEQ ID NO: 883082 - DNA, 15 bp, Homo sapiens
tatccactttgcaca

SEQ ID NO: 883083 - DNA, 18 bp, Homo sapiens
tatccactttgcacagct

SEQ ID NO: 883084 - DNA, 13 bp, Homo sapiens
tatccacttttct

SEQ ID NO: 883085 - DNA, 12 bp, Homo sapiens
tatccagagctg

SEQ ID NO: 883086 - DNA, 13 bp, Homo sapiens
tatccagaggaat

SEQ ID NO: 883087 - DNA, 23 bp, Homo sapiens
tatccagcaagcagtctaccctg

SEQ ID NO: 883088 - DNA, 24 bp, Homo sapiens
tatccagcaagcagtctaccctgt

SEQ ID NO: 883089 - DNA, 19 bp, Homo sapiens
tatccagctagtgccaaat

SEQ ID NO: 883090 - DNA, 17 bp, Homo sapiens
tatccaggcaccaggac

SEQ ID NO: 883091 - DNA, 20 bp, Homo sapiens
tatccagtgacttgttctga

SEQ ID NO: 883092 - DNA, 21 bp, Homo sapiens
tatccagtgacttgttctgag

SEQ ID NO: 883093 - DNA, 14 bp, Homo sapiens
tatccagttactgc

SEQ ID NO: 883094 - DNA, 14 bp, Homo sapiens
tatccagttcctgc

SEQ ID NO: 883095 - DNA, 16 bp, Homo sapiens
tatccagttcctgctc

SEQ ID NO: 883096 - DNA, 18 bp, Homo sapiens
tatccagttcctgctctc

SEQ ID NO: 883097 - DNA, 21 bp, Homo sapiens
tatccagttcctgctctctgc

SEQ ID NO: 883098 - DNA, 22 bp, Homo sapiens
tatccatattttattactgttt

SEQ ID NO: 883099 - DNA, 20 bp, Homo sapiens
tatccatctttttcttttta

SEQ ID NO: 883100 - DNA, 16 bp, Homo sapiens
tatcccaaacttcgga

SEQ ID NO: 883101 - DNA, 22 bp, Homo sapiens
tatcccaaagttgttgtaacct

SEQ ID NO: 883102 - DNA, 17 bp, Homo sapiens
tatcccaacattctgca

SEQ ID NO: 883103 - DNA, 21 bp, Homo sapiens
tatcccaagaccctgccccct

SEQ ID NO: 883104 - DNA, 21 bp, Homo sapiens
tatcccacccaacagctcaga

SEQ ID NO: 883105 - DNA, 21 bp, Homo sapiens
tatcccagagaacaatcacta

SEQ ID NO: 883106 - DNA, 19 bp, Homo sapiens
tatcccagcttgctgaggg

SEQ ID NO: 883107 - DNA, 12 bp, Homo sapiens
tatcccagtgtg

SEQ ID NO: 883108 - DNA, 18 bp, Homo sapiens
tatccccatccaggtctt

SEQ ID NO: 883109 - DNA, 17 bp, Homo sapiens
tatccccccatcttgct

SEQ ID NO: 883110 - DNA, 19 bp, Homo sapiens
tatccccccatcttgcttc

SEQ ID NO: 883111 - DNA, 13 bp, Homo sapiens
tatcccctgcctc

SEQ ID NO: 883112 - DNA, 15 bp, Homo sapiens
tatcccctgcctcct

SEQ ID NO: 883113 - DNA, 19 bp, Homo sapiens
tatcccctgcctcctgcca

SEQ ID NO: 883114 - DNA, 14 bp, Homo sapiens
tatcccgagtctgg

SEQ ID NO: 883115 - DNA, 20 bp, Homo sapiens
tatccctactgtaatttgtg

SEQ ID NO: 883116 - DNA, 15 bp, Homo sapiens
tatccctcacctgta

SEQ ID NO: 883117 - DNA, 23 bp, Homo sapiens
tatccctcccgtgtgtggttgga

SEQ ID NO: 883118 - DNA, 19 bp, Homo sapiens
tatccctcttgtaagtcat

SEQ ID NO: 883119 - DNA, 16 bp, Homo sapiens
tatcctacagtacaat

SEQ ID NO: 883120 - DNA, 16 bp, Homo sapiens
tatcctcactgccctc

SEQ ID NO: 883121 - DNA, 16 bp, Homo sapiens
tatcctccctgcccat

SEQ ID NO: 883122 - DNA, 16 bp, Homo sapiens
tatcctcctgttctga

SEQ ID NO: 883123 - DNA, 15 bp, Homo sapiens
tatcctctctctctc

SEQ ID NO: 883124 - DNA, 18 bp, Homo sapiens
tatcctctcttcctcttc

SEQ ID NO: 883125 - DNA, 17 bp, Homo sapiens
tatcctgaaatttcaga

SEQ ID NO: 883126 - DNA, 22 bp, Homo sapiens
tatcctgattataggattttaa

SEQ ID NO: 883127 - DNA, 16 bp, Homo sapiens
tatcctgcccagtgtt

SEQ ID NO: 883128 - DNA, 21 bp, Homo sapiens
tatcctgcgggttttaattta

SEQ ID NO: 883129 - DNA, 18 bp, Homo sapiens
tatcctgctagctgtaga

SEQ ID NO: 883130 - DNA, 16 bp, Homo sapiens
tatcctggaacaatat

SEQ ID NO: 883131 - DNA, 14 bp, Homo sapiens
tatcctggccctgg

SEQ ID NO: 883132 - DNA, 22 bp, Homo sapiens
tatcctggccttgtacttgctt

SEQ ID NO: 883133 - DNA, 13 bp, Homo sapiens
tatcctgtctgag

SEQ ID NO: 883134 - DNA, 14 bp, Homo sapiens
tatcctgtctgagg

SEQ ID NO: 883135 - DNA, 19 bp, Homo sapiens
tatcctgtgacatgtaaca

SEQ ID NO: 883136 - DNA, 17 bp, Homo sapiens
tatccttaatattttat

SEQ ID NO: 883137 - DNA, 18 bp, Homo sapiens
tatccttaggaaaatgct

SEQ ID NO: 883138 - DNA, 17 bp, Homo sapiens
tatccttatgccacccc

SEQ ID NO: 883139 - DNA, 16 bp, Homo sapiens
tatccttgcacctcag

SEQ ID NO: 883140 - DNA, 17 bp, Homo sapiens
tatccttggagagcagc

SEQ ID NO: 883141 - DNA, 23 bp, Homo sapiens
tatccttgggggctcccagggca

SEQ ID NO: 883142 - DNA, 23 bp, Homo sapiens
tatcgacttgtttttgcacatgt

SEQ ID NO: 883143 - DNA, 14 bp, Homo sapiens
tatcgagtttgcaa

SEQ ID NO: 883144 - DNA, 17 bp, Homo sapiens
tatcgccttttgacagc

SEQ ID NO: 883145 - DNA, 14 bp, Homo sapiens
tatcggaagcagtg

SEQ ID NO: 883146 - DNA, 17 bp, Homo sapiens
tatcgggaacagtgttt

SEQ ID NO: 883147 - DNA, 15 bp, Homo sapiens
tatcgggagcagtgt

SEQ ID NO: 883148 - DNA, 15 bp, Homo sapiens
tatcgttatcactgt

SEQ ID NO: 883149 - DNA, 17 bp, Homo sapiens
tatctaaaggatggaaa

SEQ ID NO: 883150 - DNA, 12 bp, Homo sapiens
tatctaaagtta

SEQ ID NO: 883151 - DNA, 14 bp, Homo sapiens
tatctaaagttata

SEQ ID NO: 883152 - DNA, 22 bp, Homo sapiens
tatctttccatgggagccagct

SEQ ID NO: 883153 - DNA, 16 bp, Homo sapiens
tatctttctaaaactg

SEQ ID NO: 883154 - DNA, 22 bp, Homo sapiens
tatctttctttccatttacagt

SEQ ID NO: 883155 - DNA, 17 bp, Homo sapiens
tatcttttgtttccttt

SEQ ID NO: 883156 - DNA, 18 bp, Homo sapiens
tatctttttaaaaactct

SEQ ID NO: 883157 - DNA, 21 bp, Homo sapiens
tatctttttaaaaactcttca

SEQ ID NO: 883158 - DNA, 23 bp, Homo sapiens
tatctttttaaaaactcttcagt

SEQ ID NO: 883159 - DNA, 18 bp, Homo sapiens
tatctttttacctttcat

SEQ ID NO: 883160 - DNA, 13 bp, Homo sapiens
tatgaaaaaatat

SEQ ID NO: 883161 - DNA, 15 bp, Homo sapiens
tatgaaaaaatatga

SEQ ID NO: 883162 - DNA, 17 bp, Homo sapiens
tatgaaaaaatatgaac

SEQ ID NO: 883163 - DNA, 12 bp, Homo sapiens
tatgaaaaacat

SEQ ID NO: 883164 - DNA, 14 bp, Homo sapiens
tatggcatttctat

SEQ ID NO: 883165 - DNA, 15 bp, Homo sapiens
tatggcatttctatt

SEQ ID NO: 883166 - DNA, 17 bp, Homo sapiens
tatggccatgccctaga

SEQ ID NO: 883167 - DNA, 12 bp, Homo sapiens
tatggcccagaa

SEQ ID NO: 883168 - DNA, 14 bp, Homo sapiens
tatggcccagcctt

SEQ ID NO: 883169 - DNA, 20 bp, Homo sapiens
tatggccctgcaaaaatata

SEQ ID NO: 883170 - DNA, 23 bp, Homo sapiens
tatggcctaaatttattaaataa

SEQ ID NO: 883171 - DNA, 23 bp, Homo sapiens
tatggcttatttctatgacaaat

SEQ ID NO: 883172 - DNA, 21 bp, Homo sapiens
tatggcttttgtgcattatct

SEQ ID NO: 883173 - DNA, 13 bp, Homo sapiens
tatgggaagccat

SEQ ID NO: 883174 - DNA, 14 bp, Homo sapiens
tatgggagaaatag

SEQ ID NO: 883175 - DNA, 23 bp, Homo sapiens
tatgggagatggcagcagtgaag

SEQ ID NO: 883176 - DNA, 15 bp, Homo sapiens
tatgggagccccagg

SEQ ID NO: 883177 - DNA, 16 bp, Homo sapiens
tatgggagccccaggg

SEQ ID NO: 883178 - DNA, 13 bp, Homo sapiens
tatgggagctgtc

SEQ ID NO: 883179 - DNA, 16 bp, Homo sapiens
tatgggcttggaccac

SEQ ID NO: 883180 - DNA, 18 bp, Homo sapiens
tatggggaggccctgcct

SEQ ID NO: 883181 - DNA, 15 bp, Homo sapiens
tatgggggcatctct

SEQ ID NO: 883182 - DNA, 20 bp, Homo sapiens
tatgggggcatctcttcccc

SEQ ID NO: 883183 - DNA, 22 bp, Homo sapiens
tatgggggcctggattcatttc

SEQ ID NO: 883184 - DNA, 19 bp, Homo sapiens
tatgggggttgtaaattgg

SEQ ID NO: 883185 - DNA, 14 bp, Homo sapiens
tatgggtctaggac

SEQ ID NO: 883186 - DNA, 22 bp, Homo sapiens
tatgggtggctttcaaggctgg

SEQ ID NO: 883187 - DNA, 11 bp, Homo sapiens
tatggtaaaaa

SEQ ID NO: 883188 - DNA, 15 bp, Homo sapiens
tatggtaaaaaattt

SEQ ID NO: 883189 - DNA, 22 bp, Homo sapiens
tatggtagaaaaatttcacgat

SEQ ID NO: 883190 - DNA, 20 bp, Homo sapiens
tatggtataatggttgactg

SEQ ID NO: 883191 - DNA, 14 bp, Homo sapiens
tatggtatttgagt

SEQ ID NO: 883192 - DNA, 14 bp, Homo sapiens
tatggtgagatgca

SEQ ID NO: 883193 - DNA, 15 bp, Homo sapiens
tatggtgatgactta

SEQ ID NO: 883194 - DNA, 14 bp, Homo sapiens
tatggttctccaag

SEQ ID NO: 883195 - DNA, 15 bp, Homo sapiens
tatggttgccacccc

SEQ ID NO: 883196 - DNA, 19 bp, Homo sapiens
tatgtaaaaggattattac

SEQ ID NO: 883197 - DNA, 17 bp, Homo sapiens
tatgtaaagtatgtaaa

SEQ ID NO: 883198 - DNA, 20 bp, Homo sapiens
tatgtaaagtatgtaaacag

SEQ ID NO: 883199 - DNA, 21 bp, Homo sapiens
tatgtaaatggtatgtcattc

SEQ ID NO: 883200 - DNA, 14 bp, Homo sapiens
tatgtaaattattg

SEQ ID NO: 883201 - DNA, 16 bp, Homo sapiens
tatgtaaattattgta

SEQ ID NO: 883202 - DNA, 17 bp, Homo sapiens
tatgtaaattattgtaa

SEQ ID NO: 883203 - DNA, 18 bp, Homo sapiens
tatgtaaattattgtaaa

SEQ ID NO: 883204 - DNA, 16 bp, Homo sapiens
tatgtaacaattgttt

SEQ ID NO: 883205 - DNA, 19 bp, Homo sapiens
tatgtaacatgatgttaac

SEQ ID NO: 883206 - DNA, 12 bp, Homo sapiens
tatgtaacatgt

SEQ ID NO: 883207 - DNA, 19 bp, Homo sapiens
tatgtaatacttaaataaa

SEQ ID NO: 883208 - DNA, 14 bp, Homo sapiens
tatgtaatataaat

SEQ ID NO: 883209 - DNA, 15 bp, Homo sapiens
tatgtaatatttaca

SEQ ID NO: 883210 - DNA, 17 bp, Homo sapiens
tatgtaatatttacata

SEQ ID NO: 883211 - DNA, 15 bp, Homo sapiens
tatgtaatgcaaaat

SEQ ID NO: 883212 - DNA, 17 bp, Homo sapiens
tatgtaatttatgcaag

SEQ ID NO: 883213 - DNA, 16 bp, Homo sapiens
tatgtaatttcaaaat

SEQ ID NO: 883214 - DNA, 13 bp, Homo sapiens
tatgtacaaacta

SEQ ID NO: 883215 - DNA, 14 bp, Homo sapiens
tatgtacaaccctg

SEQ ID NO: 883216 - DNA, 17 bp, Homo sapiens
tatgtacaaccctgacc

SEQ ID NO: 883217 - DNA, 14 bp, Homo sapiens
tatgtacaagtgtt

SEQ ID NO: 883218 - DNA, 21 bp, Homo sapiens
tatgtacagaaaacatgtata

SEQ ID NO: 883219 - DNA, 19 bp, Homo sapiens
tatgtacctctagctgttc

SEQ ID NO: 883220 - DNA, 22 bp, Homo sapiens
tatgtacgtttgtatgtgtgta

SEQ ID NO: 883221 - DNA, 14 bp, Homo sapiens
tatgtactagtgtt

SEQ ID NO: 883222 - DNA, 20 bp, Homo sapiens
tatgtactcctctttacact

SEQ ID NO: 883223 - DNA, 15 bp, Homo sapiens
tatgtacttagctgt

SEQ ID NO: 883224 - DNA, 23 bp, Homo sapiens
tatgtacttagctgtactataag

SEQ ID NO: 883225 - DNA, 15 bp, Homo sapiens
tatgtacttgtcaaa

SEQ ID NO: 883226 - DNA, 14 bp, Homo sapiens
tatgtagataacaa

SEQ ID NO: 883227 - DNA, 13 bp, Homo sapiens
tatgtagatacaa

SEQ ID NO: 883228 - DNA, 21 bp, Homo sapiens
tatgtagcaggaaataaagta

SEQ ID NO: 883229 - DNA, 23 bp, Homo sapiens
tatgtagccttcacacagataga

SEQ ID NO: 883230 - DNA, 14 bp, Homo sapiens
tatgtagtaattga

SEQ ID NO: 883231 - DNA, 20 bp, Homo sapiens
tatgtagtaattgacatgtg

SEQ ID NO: 883232 - DNA, 21 bp, Homo sapiens
tatgtagtgcatttttaaact

SEQ ID NO: 883233 - DNA, 17 bp, Homo sapiens
tatgtataaattaatac

SEQ ID NO: 883234 - DNA, 13 bp, Homo sapiens
tatgtatacacac

SEQ ID NO: 883235 - DNA, 15 bp, Homo sapiens
tatgtatacacacat

SEQ ID NO: 883236 - DNA, 17 bp, Homo sapiens
tatgtatacacacatat

SEQ ID NO: 883237 - DNA, 22 bp, Homo sapiens
tatgtatacacacatatacata

SEQ ID NO: 883238 - DNA, 22 bp, Homo sapiens
tatgtatatgacatttaaatgt

SEQ ID NO: 883239 - DNA, 18 bp, Homo sapiens
tatgtatattaaaaaaga

SEQ ID NO: 883240 - DNA, 15 bp, Homo sapiens
tatgtatcaagccct

SEQ ID NO: 883241 - DNA, 20 bp, Homo sapiens
tatgtatggaatacagtgtt

SEQ ID NO: 883242 - DNA, 23 bp, Homo sapiens
tatgtatgggtagggtaaatcag

SEQ ID NO: 883243 - DNA, 17 bp, Homo sapiens
tatgtatggtatccaag

SEQ ID NO: 883244 - DNA, 16 bp, Homo sapiens
tatgtatgtttacata

SEQ ID NO: 883245 - DNA, 19 bp, Homo sapiens
tatgtattaagccaaacat

SEQ ID NO: 883246 - DNA, 20 bp, Homo sapiens
tatgtattaagccaaacatg

SEQ ID NO: 883247 - DNA, 20 bp, Homo sapiens
tatgtattgtaaacatgtgt

SEQ ID NO: 883248 - DNA, 23 bp, Homo sapiens
tatgtatttaagatgtacattta

SEQ ID NO: 883249 - DNA, 12 bp, Homo sapiens
tatgtatttata

SEQ ID NO: 883250 - DNA, 10 bp, Homo sapiens
tatgtatttt

SEQ ID NO: 883251 - DNA, 16 bp, Homo sapiens
tatgtattttcctaat

SEQ ID NO: 883252 - DNA, 14 bp, Homo sapiens
tatgtattttgaaa

SEQ ID NO: 883253 - DNA, 23 bp, Homo sapiens
tatgtcaaatggagctgaatttg

SEQ ID NO: 883254 - DNA, 16 bp, Homo sapiens
tatgtcaatttgtata

SEQ ID NO: 883255 - DNA, 20 bp, Homo sapiens
tatgtcacctggcacattca

SEQ ID NO: 883256 - DNA, 16 bp, Homo sapiens
tatgtcagtggtttct

SEQ ID NO: 883257 - DNA, 17 bp, Homo sapiens
tatgtcatcagtaaagt

SEQ ID NO: 883258 - DNA, 17 bp, Homo sapiens
tatgtcattatttattg

SEQ ID NO: 883259 - DNA, 15 bp, Homo sapiens
tatgtccatccatat

SEQ ID NO: 883260 - DNA, 15 bp, Homo sapiens
tatgtcccttgctgt

SEQ ID NO: 883261 - DNA, 20 bp, Homo sapiens
tatgtcctgtgagatgtgta

SEQ ID NO: 883262 - DNA, 16 bp, Homo sapiens
tatgtccttcagctga

SEQ ID NO: 883263 - DNA, 22 bp, Homo sapiens
tatgtcgagagctggccaaaga

SEQ ID NO: 883264 - DNA, 22 bp, Homo sapiens
tatgtcgtagaattccttcgaa

SEQ ID NO: 883265 - DNA, 23 bp, Homo sapiens
tatgtcgtagaattccttcgaaa

SEQ ID NO: 883266 - DNA, 22 bp, Homo sapiens
tatgtcgtgttttcaaggaaga

SEQ ID NO: 883267 - DNA, 17 bp, Homo sapiens
tatgtctcatgtaattt

SEQ ID NO: 883268 - DNA, 14 bp, Homo sapiens
tatgtctcttctga

SEQ ID NO: 883269 - DNA, 19 bp, Homo sapiens
tatgtctcttgagcatcaa

SEQ ID NO: 883270 - DNA, 14 bp, Homo sapiens
tatgtctgcttctg

SEQ ID NO: 883271 - DNA, 12 bp, Homo sapiens
tatgtctgtgtg

SEQ ID NO: 883272 - DNA, 15 bp, Homo sapiens
tatgtctgtgtgtgt

SEQ ID NO: 883273 - DNA, 16 bp, Homo sapiens
tatgtctgtttttgta

SEQ ID NO: 883274 - DNA, 19 bp, Homo sapiens
tatgtctgtttttgtatct

SEQ ID NO: 883275 - DNA, 15 bp, Homo sapiens
tatgtgaaaaattaa

SEQ ID NO: 883276 - DNA, 16 bp, Homo sapiens
tatgtgaaaaattaac

SEQ ID NO: 883277 - DNA, 14 bp, Homo sapiens
tatgtgaaaggata

SEQ ID NO: 883278 - DNA, 12 bp, Homo sapiens
tatgtgaagaaa

SEQ ID NO: 883279 - DNA, 13 bp, Homo sapiens
tatgtgaagaaaa

SEQ ID NO: 883280 - DNA, 12 bp, Homo sapiens
tatgtgaatgat

SEQ ID NO: 883281 - DNA, 22 bp, Homo sapiens
tatgtgaatgatctctctgaat

SEQ ID NO: 883282 - DNA, 12 bp, Homo sapiens
tatgtgaatttt

SEQ ID NO: 883283 - DNA, 18 bp, Homo sapiens
tattcttaagcactttga

SEQ ID NO: 883284 - DNA, 22 bp, Homo sapiens
tattcttaagggaacttccaca

SEQ ID NO: 883285 - DNA, 15 bp, Homo sapiens
tattcttataaaaat

SEQ ID NO: 883286 - DNA, 22 bp, Homo sapiens
tattcttctcttccttttatca

SEQ ID NO: 883287 - DNA, 20 bp, Homo sapiens
tattcttggaccatgccaga

SEQ ID NO: 883288 - DNA, 16 bp, Homo sapiens
tattcttgtccacatt

SEQ ID NO: 883289 - DNA, 13 bp, Homo sapiens
tattcttgtgctt

SEQ ID NO: 883290 - DNA, 15 bp, Homo sapiens
tattcttgtttgaat

SEQ ID NO: 883291 - DNA, 16 bp, Homo sapiens
tattctttctcataaa

SEQ ID NO: 883292 - DNA, 21 bp, Homo sapiens
tattctttctcataaaactgt

SEQ ID NO: 883293 - DNA, 17 bp, Homo sapiens
tattcttttgatcacat

SEQ ID NO: 883294 - DNA, 14 bp, Homo sapiens
tattgaaaacactt

SEQ ID NO: 883295 - DNA, 15 bp, Homo sapiens
tattgaaaacactta

SEQ ID NO: 883296 - DNA, 22 bp, Homo sapiens
tattgaaaacttcaaagctgaa

SEQ ID NO: 883297 - DNA, 19 bp, Homo sapiens
tattgaaaattgaaaagta

SEQ ID NO: 883298 - DNA, 20 bp, Homo sapiens
tattgaaaattgaaaagtac

SEQ ID NO: 883299 - DNA, 14 bp, Homo sapiens
tattgaaagaatta

SEQ ID NO: 883300 - DNA, 14 bp, Homo sapiens
tattgaaagaccag

SEQ ID NO: 883301 - DNA, 23 bp, Homo sapiens
tattgaaagagtctgggaccctt

SEQ ID NO: 883302 - DNA, 13 bp, Homo sapiens
tattgaaagccaa

SEQ ID NO: 883303 - DNA, 14 bp, Homo sapiens
tattgaactgtatt

SEQ ID NO: 883304 - DNA, 19 bp, Homo sapiens
tattgaacttttgtactga

SEQ ID NO: 883305 - DNA, 16 bp, Homo sapiens
tattgaagttgtttat

SEQ ID NO: 883306 - DNA, 19 bp, Homo sapiens
tattgaagttgtttatcaa

SEQ ID NO: 883307 - DNA, 15 bp, Homo sapiens
tattgaataaagaga

SEQ ID NO: 883308 - DNA, 20 bp, Homo sapiens
tattgaatataatatatttg

SEQ ID NO: 883309 - DNA, 21 bp, Homo sapiens
tattgaatataatatatttgt

SEQ ID NO: 883310 - DNA, 22 bp, Homo sapiens
tattgaatataatatatttgtg

SEQ ID NO: 883311 - DNA, 13 bp, Homo sapiens
tattgaatatatc

SEQ ID NO: 883312 - DNA, 20 bp, Homo sapiens
tattgaatcagtttccaatt

SEQ ID NO: 883313 - DNA, 11 bp, Homo sapiens
tattgaatcta

SEQ ID NO: 883314 - DNA, 12 bp, Homo sapiens
tattgaatgttt

SEQ ID NO: 883315 - DNA, 16 bp, Homo sapiens
tattgacaacagtttt

SEQ ID NO: 883316 - DNA, 13 bp, Homo sapiens
tattgacaataaa

SEQ ID NO: 883317 - DNA, 13 bp, Homo sapiens
tattgacaataat

SEQ ID NO: 883318 - DNA, 23 bp, Homo sapiens
tattgacacagaaaatgttgaga

SEQ ID NO: 883319 - DNA, 13 bp, Homo sapiens
tattgacactgaa

SEQ ID NO: 883320 - DNA, 19 bp, Homo sapiens
tattgacactgaacttaat

SEQ ID NO: 883321 - DNA, 20 bp, Homo sapiens
tattgactgggcaacactgc

SEQ ID NO: 883322 - DNA, 22 bp, Homo sapiens
tattgactgtaccacagacaca

SEQ ID NO: 883323 - DNA, 20 bp, Homo sapiens
tattgacttgttacatgaag

SEQ ID NO: 883324 - DNA, 15 bp, Homo sapiens
tattgagaaagagca

SEQ ID NO: 883325 - DNA, 13 bp, Homo sapiens
tattgagaatcag

SEQ ID NO: 883326 - DNA, 14 bp, Homo sapiens
tattgagatttctt

SEQ ID NO: 883327 - DNA, 21 bp, Homo sapiens
tattgaggccaagaatattgc

SEQ ID NO: 883328 - DNA, 18 bp, Homo sapiens
tattgagggccagtgatg

SEQ ID NO: 883329 - DNA, 22 bp, Homo sapiens
tattgagggccagtgatgatgt

SEQ ID NO: 883330 - DNA, 23 bp, Homo sapiens
tattgagggtcattctttattct

SEQ ID NO: 883331 - DNA, 14 bp, Homo sapiens
tattgagtcaaatg

SEQ ID NO: 883332 - DNA, 14 bp, Homo sapiens
tattgatagtactc

SEQ ID NO: 883333 - DNA, 16 bp, Homo sapiens
tattgatattcaataa

SEQ ID NO: 883334 - DNA, 23 bp, Homo sapiens
tattgatgcaatataagcataaa

SEQ ID NO: 883335 - DNA, 16 bp, Homo sapiens
tattgattaaaaatgt

SEQ ID NO: 883336 - DNA, 20 bp, Homo sapiens
tattgattacaaataaacag

SEQ ID NO: 883337 - DNA, 23 bp, Homo sapiens
tattgattcacctcctaaaacaa

SEQ ID NO: 883338 - DNA, 17 bp, Homo sapiens
tattgatttaaaagtgt

SEQ ID NO: 883339 - DNA, 14 bp, Homo sapiens
tattgcaaatgagg

SEQ ID NO: 883340 - DNA, 24 bp, Homo sapiens
tattgcaaatgagggaagaacatt

SEQ ID NO: 883341 - DNA, 18 bp, Homo sapiens
tattgcaataaagtataa

SEQ ID NO: 883342 - DNA, 14 bp, Homo sapiens
tattgcacattgtt

SEQ ID NO: 883343 - DNA, 10 bp, Homo sapiens
tattgcacta

SEQ ID NO: 883344 - DNA, 16 bp, Homo sapiens
tattgcactaggaatt

SEQ ID NO: 883345 - DNA, 17 bp, Homo sapiens
tattgcactaggaattc

SEQ ID NO: 883346 - DNA, 20 bp, Homo sapiens
tattgcagacctgtcaccct

SEQ ID NO: 883347 - DNA, 13 bp, Homo sapiens
tattgcagtttat

SEQ ID NO: 883348 - DNA, 19 bp, Homo sapiens
tattgcagtttatcattca

SEQ ID NO: 883349 - DNA, 14 bp, Homo sapiens
tattgcatctgtat

SEQ ID NO: 883350 - DNA, 21 bp, Homo sapiens
tattgcatctgtataagtaag

SEQ ID NO: 883351 - DNA, 13 bp, Homo sapiens
tattgcatttata

SEQ ID NO: 883352 - DNA, 14 bp, Homo sapiens
tattgccaatgcta

SEQ ID NO: 883353 - DNA, 21 bp, Homo sapiens
tattgcccatgatataacttt

SEQ ID NO: 883354 - DNA, 20 bp, Homo sapiens
tattgccttatttgtctgta

SEQ ID NO: 883355 - DNA, 16 bp, Homo sapiens
tattgcgaatgtgcag

SEQ ID NO: 883356 - DNA, 11 bp, Homo sapiens
tattgctaaaa

SEQ ID NO: 883357 - DNA, 14 bp, Homo sapiens
tattgctaaaagtg

SEQ ID NO: 883358 - DNA, 15 bp, Homo sapiens
tattgctaaaagtgc

SEQ ID NO: 883359 - DNA, 16 bp, Homo sapiens
tattgctaaaagtgca

SEQ ID NO: 883360 - DNA, 22 bp, Homo sapiens
tattgctaaaagtgcatttaag

SEQ ID NO: 883361 - DNA, 16 bp, Homo sapiens
tattgctgagagaaat

SEQ ID NO: 883362 - DNA, 13 bp, Homo sapiens
tattgctgccaaa

SEQ ID NO: 883363 - DNA, 15 bp, Homo sapiens
tattgctgccaaaac

SEQ ID NO: 883364 - DNA, 15 bp, Homo sapiens
tattgcttattttat

SEQ ID NO: 883365 - DNA, 13 bp, Homo sapiens
tattgcttcatct

SEQ ID NO: 883366 - DNA, 23 bp, Homo sapiens
tattgcttcttctcctatgtgta

SEQ ID NO: 883367 - DNA, 19 bp, Homo sapiens
tattgcttgttggattttt

SEQ ID NO: 883368 - DNA, 16 bp, Homo sapiens
tattggaaagtgattt

SEQ ID NO: 883369 - DNA, 21 bp, Homo sapiens
tattggaagctgctgaggccc

SEQ ID NO: 883370 - DNA, 14 bp, Homo sapiens
tattggaaggtatt

SEQ ID NO: 883371 - DNA, 16 bp, Homo sapiens
tattggaatataattg

SEQ ID NO: 883372 - DNA, 16 bp, Homo sapiens
tattggagcacatgtt

SEQ ID NO: 883373 - DNA, 21 bp, Homo sapiens
tattggattgcgcctttgtat

SEQ ID NO: 883374 - DNA, 18 bp, Homo sapiens
tattggcagccaaggaat

SEQ ID NO: 883375 - DNA, 11 bp, Homo sapiens
tattggccact

SEQ ID NO: 883376 - DNA, 12 bp, Homo sapiens
tattggcctgga

SEQ ID NO: 883377 - DNA, 16 bp, Homo sapiens
tattgggccttttgga

SEQ ID NO: 883378 - DNA, 15 bp, Homo sapiens
tattggggaattaaa

SEQ ID NO: 883379 - DNA, 19 bp, Homo sapiens
tattggggaattaaatagt

SEQ ID NO: 883380 - DNA, 20 bp, Homo sapiens
tattgggtgtagatttctga

SEQ ID NO: 883381 - DNA, 18 bp, Homo sapiens
tattggtaaattctggta

SEQ ID NO: 883382 - DNA, 13 bp, Homo sapiens
tattggtaattaa

SEQ ID NO: 883383 - DNA, 13 bp, Homo sapiens
tattggtccagct

SEQ ID NO: 883384 - DNA, 18 bp, Homo sapiens
tattggtgcttgactctc

SEQ ID NO: 883385 - DNA, 18 bp, Homo sapiens
tattggtgtatattatat

SEQ ID NO: 883386 - DNA, 19 bp, Homo sapiens
tattggttggtgtgaagaa

SEQ ID NO: 883387 - DNA, 20 bp, Homo sapiens
tattggtttaaagaaagtgt

SEQ ID NO: 883388 - DNA, 15 bp, Homo sapiens
tattgtaaacatgtg

SEQ ID NO: 883389 - DNA, 17 bp, Homo sapiens
tattgtaaacatgtgtt

SEQ ID NO: 883390 - DNA, 18 bp, Homo sapiens
tattgtaaactttttcaa

SEQ ID NO: 883391 - DNA, 15 bp, Homo sapiens
tattgtaaatatgtt

SEQ ID NO: 883392 - DNA, 15 bp, Homo sapiens
tattgtaaatattgt

SEQ ID NO: 883393 - DNA, 14 bp, Homo sapiens
tattgtaaatgtgg

SEQ ID NO: 883394 - DNA, 18 bp, Homo sapiens
tattgtaaatgtggattt

SEQ ID NO: 883395 - DNA, 20 bp, Homo sapiens
tattgtaaccctgtctggat

SEQ ID NO: 883396 - DNA, 17 bp, Homo sapiens
tattgtaagaaatactg

SEQ ID NO: 883397 - DNA, 14 bp, Homo sapiens
tattgtaaggtctt

SEQ ID NO: 883398 - DNA, 15 bp, Homo sapiens
tattgtaaggtcttt

SEQ ID NO: 883399 - DNA, 14 bp, Homo sapiens
tattgtaagtggaa

SEQ ID NO: 883400 - DNA, 21 bp, Homo sapiens
tattgtacaaatgtaagcaaa

SEQ ID NO: 883401 - DNA, 12 bp, Homo sapiens
tattgtacagtt

SEQ ID NO: 883402 - DNA, 17 bp, Homo sapiens
tatttagaactttgtat

SEQ ID NO: 883403 - DNA, 15 bp, Homo sapiens
tatttagacaagaga

SEQ ID NO: 883404 - DNA, 21 bp, Homo sapiens
tatttagactcatcttactgt

SEQ ID NO: 883405 - DNA, 18 bp, Homo sapiens
tatttagatataacacta

SEQ ID NO: 883406 - DNA, 17 bp, Homo sapiens
tatttctgatttcataa

SEQ ID NO: 883407 - DNA, 22 bp, Homo sapiens
tatttctggcagctgtggtaca

SEQ ID NO: 883408 - DNA, 22 bp, Homo sapiens
tatttctgggtcttttgctact

SEQ ID NO: 883409 - DNA, 20 bp, Homo sapiens
tatttctgtatatttgtcat

SEQ ID NO: 883410 - DNA, 12 bp, Homo sapiens
tatttctgtgta

SEQ ID NO: 883411 - DNA, 19 bp, Homo sapiens
tatttctgttccagtcaca

SEQ ID NO: 883412 - DNA, 20 bp, Homo sapiens
tatttcttaacctttgctat

SEQ ID NO: 883413 - DNA, 18 bp, Homo sapiens
tatttcttaattattata

SEQ ID NO: 883414 - DNA, 18 bp, Homo sapiens
tatttcttatacgctttt

SEQ ID NO: 883415 - DNA, 13 bp, Homo sapiens
tatttcttgtttg

SEQ ID NO: 883416 - DNA, 15 bp, Homo sapiens
tatttctttctcgaa

SEQ ID NO: 883417 - DNA, 23 bp, Homo sapiens
tatttctttttaattattttaaa

SEQ ID NO: 883418 - DNA, 16 bp, Homo sapiens
tatttgaaaaaaactt

SEQ ID NO: 883419 - DNA, 23 bp, Homo sapiens
tatttgaacatgtgccttttctg

SEQ ID NO: 883420 - DNA, 14 bp, Homo sapiens
tatttgaatgaaaa

SEQ ID NO: 883421 - DNA, 15 bp, Homo sapiens
tatttgaatgaaaac

SEQ ID NO: 883422 - DNA, 18 bp, Homo sapiens
tatttgaatgaaaacatt

SEQ ID NO: 883423 - DNA, 17 bp, Homo sapiens
tatttgaattatttctg

SEQ ID NO: 883424 - DNA, 12 bp, Homo sapiens
tatttgaatttt

SEQ ID NO: 883425 - DNA, 18 bp, Homo sapiens
tatttgaattttaaatct

SEQ ID NO: 883426 - DNA, 19 bp, Homo sapiens
tatttgaattttaaatcta

SEQ ID NO: 883427 - DNA, 21 bp, Homo sapiens
tatttgaattttaaatctaaa

SEQ ID NO: 883428 - DNA, 23 bp, Homo sapiens
tatttgaatttttacatttgttg

SEQ ID NO: 883429 - DNA, 17 bp, Homo sapiens
tatttgactctttcaaa

SEQ ID NO: 883430 - DNA, 14 bp, Homo sapiens
tatttgagaaaata

SEQ ID NO: 883431 - DNA, 14 bp, Homo sapiens
tatttgagaatata

SEQ ID NO: 883432 - DNA, 12 bp, Homo sapiens
tatttgagacgg

SEQ ID NO: 883433 - DNA, 23 bp, Homo sapiens
tatttgagcatgcacagctgctt

SEQ ID NO: 883434 - DNA, 17 bp, Homo sapiens
tatttgaggagtgttaa

SEQ ID NO: 883435 - DNA, 14 bp, Homo sapiens
tatttgattattta

SEQ ID NO: 883436 - DNA, 16 bp, Homo sapiens
tatttgattcaaaata

SEQ ID NO: 883437 - DNA, 13 bp, Homo sapiens
tatttgatttata

SEQ ID NO: 883438 - DNA, 14 bp, Homo sapiens
tatttgatttctaa

SEQ ID NO: 883439 - DNA, 16 bp, Homo sapiens
tatttgatttctaatt

SEQ ID NO: 883440 - DNA, 16 bp, Homo sapiens
tatttgcagtatgaac

SEQ ID NO: 883441 - DNA, 20 bp, Homo sapiens
tatttgcagtgcagtataga

SEQ ID NO: 883442 - DNA, 23 bp, Homo sapiens
tatttgcagttcacctgcactta

SEQ ID NO: 883443 - DNA, 20 bp, Homo sapiens
tatttgcatatttttctaaa

SEQ ID NO: 883444 - DNA, 12 bp, Homo sapiens
tatttgcatgtt

SEQ ID NO: 883445 - DNA, 16 bp, Homo sapiens
tatttgcatgttatgt

SEQ ID NO: 883446 - DNA, 21 bp, Homo sapiens
tatttgctaatcaaagccagg

SEQ ID NO: 883447 - DNA, 14 bp, Homo sapiens
tatttgctcagctg

SEQ ID NO: 883448 - DNA, 11 bp, Homo sapiens
tatttgctgca

SEQ ID NO: 883449 - DNA, 13 bp, Homo sapiens
tatttgctgcaaa

SEQ ID NO: 883450 - DNA, 18 bp, Homo sapiens
tatttgctgcaaagagaa

SEQ ID NO: 883451 - DNA, 19 bp, Homo sapiens
tatttgctgtattgccccc

SEQ ID NO: 883452 - DNA, 11 bp, Homo sapiens
tatttgctttt

SEQ ID NO: 883453 - DNA, 15 bp, Homo sapiens
tatttgctttttgct

SEQ ID NO: 883454 - DNA, 12 bp, Homo sapiens
tatttggaaaga

SEQ ID NO: 883455 - DNA, 21 bp, Homo sapiens
tatttggctatggatctgatt

SEQ ID NO: 883456 - DNA, 13 bp, Homo sapiens
tatttggctgggc

SEQ ID NO: 883457 - DNA, 20 bp, Homo sapiens
tatttggctgggctacaatt

SEQ ID NO: 883458 - DNA, 22 bp, Homo sapiens
tatttgggagggaaaagggaag

SEQ ID NO: 883459 - DNA, 23 bp, Homo sapiens
tatttgggagggaaaagggaagt

SEQ ID NO: 883460 - DNA, 17 bp, Homo sapiens
tatttggtactgtattt

SEQ ID NO: 883461 - DNA, 19 bp, Homo sapiens
tatttgtaaaccattgtaa

SEQ ID NO: 883462 - DNA, 12 bp, Homo sapiens
tatttgtaagat

SEQ ID NO: 883463 - DNA, 14 bp, Homo sapiens
tatttgtaatagat

SEQ ID NO: 883464 - DNA, 14 bp, Homo sapiens
tatttgtacaattt

SEQ ID NO: 883465 - DNA, 24 bp, Homo sapiens
tatttgtactgtttaatgttctgt

SEQ ID NO: 883466 - DNA, 15 bp, Homo sapiens
tatttgtaggagaaa

SEQ ID NO: 883467 - DNA, 17 bp, Homo sapiens
tatttgtatagttgctt

SEQ ID NO: 883468 - DNA, 23 bp, Homo sapiens
tatttgtatagttgcttgcctga

SEQ ID NO: 883469 - DNA, 15 bp, Homo sapiens
tatttgtatctctga

SEQ ID NO: 883470 - DNA, 23 bp, Homo sapiens
tatttgtatctctgaagcatgtt

SEQ ID NO: 883471 - DNA, 14 bp, Homo sapiens
tatttgtatgatat

SEQ ID NO: 883472 - DNA, 13 bp, Homo sapiens
tatttgtattaat

SEQ ID NO: 883473 - DNA, 14 bp, Homo sapiens
tatttgtattaata

SEQ ID NO: 883474 - DNA, 17 bp, Homo sapiens
tatttgtattaataaag

SEQ ID NO: 883475 - DNA, 19 bp, Homo sapiens
tatttgtattaataaagca

SEQ ID NO: 883476 - DNA, 20 bp, Homo sapiens
tatttgtattaataaagcat

SEQ ID NO: 883477 - DNA, 21 bp, Homo sapiens
tatttgtattaataaagcatt

SEQ ID NO: 883478 - DNA, 12 bp, Homo sapiens
tatttgtcaaat

SEQ ID NO: 883479 - DNA, 20 bp, Homo sapiens
tatttgtcatgctgggattt

SEQ ID NO: 883480 - DNA, 18 bp, Homo sapiens
tatttgtcttaaaaaatg

SEQ ID NO: 883481 - DNA, 16 bp, Homo sapiens
tatttgtcttccgatc

SEQ ID NO: 883482 - DNA, 17 bp, Homo sapiens
tatttgtctttaaacag

SEQ ID NO: 883483 - DNA, 21 bp, Homo sapiens
tatttgtgctatagtatttga

SEQ ID NO: 883484 - DNA, 14 bp, Homo sapiens
tatttgtggaataa

SEQ ID NO: 883485 - DNA, 17 bp, Homo sapiens
tatttgtgtatttaaca

SEQ ID NO: 883486 - DNA, 20 bp, Homo sapiens
tatttgttatttattaaatt

SEQ ID NO: 883487 - DNA, 14 bp, Homo sapiens
tatttgttcagaga

SEQ ID NO: 883488 - DNA, 13 bp, Homo sapiens
tatttgtttccct

SEQ ID NO: 883489 - DNA, 17 bp, Homo sapiens
tatttgtttttcattca

SEQ ID NO: 883490 - DNA, 12 bp, Homo sapiens
tattttaaaaaa

SEQ ID NO: 883491 - DNA, 22 bp, Homo sapiens
tattttaaaatagcgttcttgt

SEQ ID NO: 883492 - DNA, 23 bp, Homo sapiens
tattttaaaatagcgttcttgta

SEQ ID NO: 883493 - DNA, 14 bp, Homo sapiens
tattttaaaatatt

SEQ ID NO: 883494 - DNA, 15 bp, Homo sapiens
tattttaaaatattt

SEQ ID NO: 883495 - DNA, 22 bp, Homo sapiens
tattttaaaatatttaaacctt

SEQ ID NO: 883496 - DNA, 14 bp, Homo sapiens
tattttaaaatttg

SEQ ID NO: 883497 - DNA, 19 bp, Homo sapiens
tattttaaacaaaatagaa

SEQ ID NO: 883498 - DNA, 13 bp, Homo sapiens
tattttaaagaat

SEQ ID NO: 883499 - DNA, 15 bp, Homo sapiens
tattttaaatatact

SEQ ID NO: 883500 - DNA, 16 bp, Homo sapiens
tattttaacactttgt

SEQ ID NO: 883501 - DNA, 13 bp, Homo sapiens
tattttaagaaag

SEQ ID NO: 883502 - DNA, 14 bp, Homo sapiens
tattttaagaaaga

SEQ ID NO: 883503 - DNA, 17 bp, Homo sapiens
tattttaagaaagagaa

SEQ ID NO: 883504 - DNA, 14 bp, Homo sapiens
tattttaatagaat

SEQ ID NO: 883505 - DNA, 14 bp, Homo sapiens
tattttaattactg

SEQ ID NO: 883506 - DNA, 14 bp, Homo sapiens
tattttacaatttt

SEQ ID NO: 883507 - DNA, 21 bp, Homo sapiens
tattttacagctcattaaact

SEQ ID NO: 883508 - DNA, 17 bp, Homo sapiens
tcaaattaataatctta

SEQ ID NO: 883509 - DNA, 23 bp, Homo sapiens
tcaaattaatctttctttacctg

SEQ ID NO: 883510 - DNA, 24 bp, Homo sapiens
tcaaattataagagacagacactt

SEQ ID NO: 883511 - DNA, 20 bp, Homo sapiens
tcaaattcatttttttcact

SEQ ID NO: 883512 - DNA, 21 bp, Homo sapiens
tcaaattcctatttttaaata

SEQ ID NO: 883513 - DNA, 13 bp, Homo sapiens
tcaaattgaattt

SEQ ID NO: 883514 - DNA, 14 bp, Homo sapiens
tcaaattgtatcta

SEQ ID NO: 883515 - DNA, 12 bp, Homo sapiens
tcaaatttgtac

SEQ ID NO: 883516 - DNA, 17 bp, Homo sapiens
tcaaatttttttttaac

SEQ ID NO: 883517 - DNA, 20 bp, Homo sapiens
tcaaatttttttttaacgtg

SEQ ID NO: 883518 - DNA, 18 bp, Homo sapiens
tcaacaaaaattgtccct

SEQ ID NO: 883519 - DNA, 15 bp, Homo sapiens
tcaacaaagcacagt

SEQ ID NO: 883520 - DNA, 18 bp, Homo sapiens
tcaacaacatcagaaaga

SEQ ID NO: 883521 - DNA, 22 bp, Homo sapiens
tcaacaactttgtgctttcctg

SEQ ID NO: 883522 - DNA, 21 bp, Homo sapiens
tcaacaaggatcaggctgctg

SEQ ID NO: 883523 - DNA, 22 bp, Homo sapiens
tcaacaaggatcaggctgctgg

SEQ ID NO: 883524 - DNA, 22 bp, Homo sapiens
tcaacaatcagtcatcatgggt

SEQ ID NO: 883525 - DNA, 14 bp, Homo sapiens
tcaacaattctaaa

SEQ ID NO: 883526 - DNA, 17 bp, Homo sapiens
tcaacacccgccccccc

SEQ ID NO: 883527 - DNA, 18 bp, Homo sapiens
tcaacactgaaaaaatac

SEQ ID NO: 883528 - DNA, 21 bp, Homo sapiens
tcaacagaagcatttgtattt

SEQ ID NO: 883529 - DNA, 16 bp, Homo sapiens
tcaacagagactgaat

SEQ ID NO: 883530 - DNA, 22 bp, Homo sapiens
tcaacagatgaccgtgtacaat

SEQ ID NO: 883531 - DNA, 18 bp, Homo sapiens
tcaacagtaaaccactga

SEQ ID NO: 883532 - DNA, 20 bp, Homo sapiens
tcaacagtaaaccactgaaa

SEQ ID NO: 883533 - DNA, 14 bp, Homo sapiens
tcaacagtgttttc

SEQ ID NO: 883534 - DNA, 23 bp, Homo sapiens
tcaacatgcattgccatgaattt

SEQ ID NO: 883535 - DNA, 20 bp, Homo sapiens
tcaacatgctccaaatataa

SEQ ID NO: 883536 - DNA, 18 bp, Homo sapiens
tcaacatggcaattgcac

SEQ ID NO: 883537 - DNA, 17 bp, Homo sapiens
tcaacatgtgtttctga

SEQ ID NO: 883538 - DNA, 15 bp, Homo sapiens
tcaacatgttactga

SEQ ID NO: 883539 - DNA, 19 bp, Homo sapiens
tcaacatgttactgaccag

SEQ ID NO: 883540 - DNA, 21 bp, Homo sapiens
tcaacatgttactgaccagca

SEQ ID NO: 883541 - DNA, 22 bp, Homo sapiens
tcaacatgttactgaccagcaa

SEQ ID NO: 883542 - DNA, 14 bp, Homo sapiens
tcaacatttatgac

SEQ ID NO: 883543 - DNA, 13 bp, Homo sapiens
tcaaccaactgca

SEQ ID NO: 883544 - DNA, 17 bp, Homo sapiens
tcaaccaactgcacaat

SEQ ID NO: 883545 - DNA, 17 bp, Homo sapiens
tcaaccaatgccaaaaa

SEQ ID NO: 883546 - DNA, 15 bp, Homo sapiens
tcaaccaatgtagaa

SEQ ID NO: 883547 - DNA, 13 bp, Homo sapiens
tcaaccaggaaga

SEQ ID NO: 883548 - DNA, 22 bp, Homo sapiens
tcaaccaggtccagatgtgcta

SEQ ID NO: 883549 - DNA, 22 bp, Homo sapiens
tcaacccattgttgtcaaggaa

SEQ ID NO: 883550 - DNA, 16 bp, Homo sapiens
tcaaccccagacactg

SEQ ID NO: 883551 - DNA, 18 bp, Homo sapiens
tcaacccccatttctatt

SEQ ID NO: 883552 - DNA, 14 bp, Homo sapiens
tcaacccccctccc

SEQ ID NO: 883553 - DNA, 17 bp, Homo sapiens
tcaacccccctcccaga

SEQ ID NO: 883554 - DNA, 21 bp, Homo sapiens
tcaacccccctcccagacagg

SEQ ID NO: 883555 - DNA, 16 bp, Homo sapiens
tcaacccctttgtaat

SEQ ID NO: 883556 - DNA, 17 bp, Homo sapiens
tcaaccctccctcagcc

SEQ ID NO: 883557 - DNA, 18 bp, Homo sapiens
tcaaccctccctcagccc

SEQ ID NO: 883558 - DNA, 19 bp, Homo sapiens
tcaaccctccctcagcccc

SEQ ID NO: 883559 - DNA, 20 bp, Homo sapiens
tcaaccctccctcagcccct

SEQ ID NO: 883560 - DNA, 15 bp, Homo sapiens
tcaaccctctcctgt

SEQ ID NO: 883561 - DNA, 13 bp, Homo sapiens
tcaaccctgcaat

SEQ ID NO: 883562 - DNA, 21 bp, Homo sapiens
tcaacctaccaccccttcctg

SEQ ID NO: 883563 - DNA, 12 bp, Homo sapiens
tcaacctcctgg

SEQ ID NO: 883564 - DNA, 15 bp, Homo sapiens
tcaacctgtgatgag

SEQ ID NO: 883565 - DNA, 20 bp, Homo sapiens
tcaacctgtgatgaggggag

SEQ ID NO: 883566 - DNA, 20 bp, Homo sapiens
tcaaccttgccagcatcact

SEQ ID NO: 883567 - DNA, 15 bp, Homo sapiens
tcaacgcctctcctc

SEQ ID NO: 883568 - DNA, 14 bp, Homo sapiens
tcaactaaatgaga

SEQ ID NO: 883569 - DNA, 21 bp, Homo sapiens
tcaactaattttatttctatt

SEQ ID NO: 883570 - DNA, 19 bp, Homo sapiens
tcaactcacctaatgttta

SEQ ID NO: 883571 - DNA, 19 bp, Homo sapiens
tcaactcataagactttgg

SEQ ID NO: 883572 - DNA, 18 bp, Homo sapiens
tcaactccagagcccctt

SEQ ID NO: 883573 - DNA, 14 bp, Homo sapiens
tcaactccctgccc

SEQ ID NO: 883574 - DNA, 12 bp, Homo sapiens
tcaactcctggc

SEQ ID NO: 883575 - DNA, 19 bp, Homo sapiens
tcaactcctggctccgcag

SEQ ID NO: 883576 - DNA, 21 bp, Homo sapiens
tcaactcgggggcgcctggag

SEQ ID NO: 883577 - DNA, 14 bp, Homo sapiens
tcaactctacccct

SEQ ID NO: 883578 - DNA, 18 bp, Homo sapiens
tcaactctacccctgctc

SEQ ID NO: 883579 - DNA, 23 bp, Homo sapiens
tcaactctacccctgctcccatt

SEQ ID NO: 883580 - DNA, 17 bp, Homo sapiens
tcaactctcactcctga

SEQ ID NO: 883581 - DNA, 24 bp, Homo sapiens
tcaactgaccagcctccatgctgc

SEQ ID NO: 883582 - DNA, 19 bp, Homo sapiens
tcaactgccaaaatgctct

SEQ ID NO: 883583 - DNA, 23 bp, Homo sapiens
tcaactggagcaagaaggaagga

SEQ ID NO: 883584 - DNA, 21 bp, Homo sapiens
tcaactgtaggttatttaaaa

SEQ ID NO: 883585 - DNA, 16 bp, Homo sapiens
tcaactgtattgggcc

SEQ ID NO: 883586 - DNA, 19 bp, Homo sapiens
tcaacttgcatccaactcc

SEQ ID NO: 883587 - DNA, 18 bp, Homo sapiens
tcaactttactgtaatat

SEQ ID NO: 883588 - DNA, 13 bp, Homo sapiens
tcaacttttctaa

SEQ ID NO: 883589 - DNA, 19 bp, Homo sapiens
tcaagaaaatctttgttga

SEQ ID NO: 883590 - DNA, 21 bp, Homo sapiens
tcaagaaaatctttgttgaag

SEQ ID NO: 883591 - DNA, 16 bp, Homo sapiens
tcaagaaacagccagc

SEQ ID NO: 883592 - DNA, 17 bp, Homo sapiens
tcaagaaacagccagca

SEQ ID NO: 883593 - DNA, 22 bp, Homo sapiens
tcaagaaataaaaggaagccaa

SEQ ID NO: 883594 - DNA, 14 bp, Homo sapiens
tcaagaaataagtt

SEQ ID NO: 883595 - DNA, 17 bp, Homo sapiens
tcaagaaataagttttt

SEQ ID NO: 883596 - DNA, 11 bp, Homo sapiens
tcaagaaatga

SEQ ID NO: 883597 - DNA, 20 bp, Homo sapiens
tcaagaacaaacactgcagt

SEQ ID NO: 883598 - DNA, 14 bp, Homo sapiens
tcaagaacctggaa

SEQ ID NO: 883599 - DNA, 14 bp, Homo sapiens
tcaagaactatata

SEQ ID NO: 883600 - DNA, 17 bp, Homo sapiens
tcaagaagtaagagcta

SEQ ID NO: 883601 - DNA, 22 bp, Homo sapiens
tcaagaagtgaagaatgcacaa

SEQ ID NO: 883602 - DNA, 20 bp, Homo sapiens
tcaagaattagaagtctttc

SEQ ID NO: 883603 - DNA, 13 bp, Homo sapiens
tcaagacatttgc

SEQ ID NO: 883604 - DNA, 14 bp, Homo sapiens
tcaagaccagagac

SEQ ID NO: 883605 - DNA, 16 bp, Homo sapiens
tcaagaccagcctggg

SEQ ID NO: 883606 - DNA, 22 bp, Homo sapiens
tcaagacccccatttgtcccag

SEQ ID NO: 883607 - DNA, 16 bp, Homo sapiens
tcaagacccctgtctt

SEQ ID NO: 883608 - DNA, 23 bp, Homo sapiens
tcaagacccggttattcgcccac

SEQ ID NO: 883609 - DNA, 20 bp, Homo sapiens
tcaagactttagcttttcct

SEQ ID NO: 883610 - DNA, 19 bp, Homo sapiens
tcaagagagtaatgggttt

SEQ ID NO: 883611 - DNA, 16 bp, Homo sapiens
tcaagagatctttctt

SEQ ID NO: 883612 - DNA, 21 bp, Homo sapiens
tcaagagatctttctttccaa

SEQ ID NO: 883613 - DNA, 12 bp, Homo sapiens
tcaagaggaatc

SEQ ID NO: 883614 - DNA, 16 bp, Homo sapiens
tcaagaggcgtgtgca

SEQ ID NO: 883615 - DNA, 18 bp, Homo sapiens
tcaagaggcgtgtgcagg

SEQ ID NO: 883616 - DNA, 12 bp, Homo sapiens
tcaagaggctga

SEQ ID NO: 883617 - DNA, 15 bp, Homo sapiens
tcaagagtccggatt

SEQ ID NO: 883618 - DNA, 19 bp, Homo sapiens
tcaagagtccggatttcta

SEQ ID NO: 883619 - DNA, 12 bp, Homo sapiens
tcaagagtgggg

SEQ ID NO: 883620 - DNA, 21 bp, Homo sapiens
tcaagatacctttgcgtggat

SEQ ID NO: 883621 - DNA, 13 bp, Homo sapiens
tcaagatagaaag

SEQ ID NO: 883622 - DNA, 18 bp, Homo sapiens
tcaagatatatgtgtata

SEQ ID NO: 883623 - DNA, 15 bp, Homo sapiens
tcaagatattaaaat

SEQ ID NO: 883624 - DNA, 15 bp, Homo sapiens
tcaagatcaacattc

SEQ ID NO: 883625 - DNA, 20 bp, Homo sapiens
tcaagatgcctcctgtcaga

SEQ ID NO: 883626 - DNA, 18 bp, Homo sapiens
tcaagatgtcagactggc

SEQ ID NO: 883627 - DNA, 16 bp, Homo sapiens
tcaagattctaaagct

SEQ ID NO: 883628 - DNA, 15 bp, Homo sapiens
tcaagatttgaccaa

SEQ ID NO: 883629 - DNA, 18 bp, Homo sapiens
tcaagattttgaatgctt

SEQ ID NO: 883630 - DNA, 22 bp, Homo sapiens
tcaagcaaacatcaaataaatt

SEQ ID NO: 883631 - DNA, 23 bp, Homo sapiens
tcaagcaagatgagctgtgcgct

SEQ ID NO: 883632 - DNA, 14 bp, Homo sapiens
tcaagcaataattg

SEQ ID NO: 883633 - DNA, 17 bp, Homo sapiens
tcaagcaataattgttt

SEQ ID NO: 883634 - DNA, 20 bp, Homo sapiens
tcaagcaataattgtttcca

SEQ ID NO: 883635 - DNA, 18 bp, Homo sapiens
tcaagcaatcctcctgcc

SEQ ID NO: 883636 - DNA, 20 bp, Homo sapiens
tcaagcaatcctcctgcctc

SEQ ID NO: 883637 - DNA, 21 bp, Homo sapiens
tcaagcaatcctcctgcctca

SEQ ID NO: 883638 - DNA, 22 bp, Homo sapiens
tcaagcaatcctcctgcctcag

SEQ ID NO: 883639 - DNA, 23 bp, Homo sapiens
tcaagcaatcctcctgcctcagc

SEQ ID NO: 883640 - DNA, 17 bp, Homo sapiens
tcaagcacactggaata

SEQ ID NO: 883641 - DNA, 18 bp, Homo sapiens
tcaagcacactggaatat

SEQ ID NO: 883642 - DNA, 13 bp, Homo sapiens
tcaagcacatgta

SEQ ID NO: 883643 - DNA, 20 bp, Homo sapiens
tcaagcacatgtaataaatt

SEQ ID NO: 883644 - DNA, 21 bp, Homo sapiens
tcaagcacatgtaataaattc

SEQ ID NO: 883645 - DNA, 21 bp, Homo sapiens
tcaagcagcgaccgccccctc

SEQ ID NO: 883646 - DNA, 18 bp, Homo sapiens
tcaagcagtcgtgcctgt

SEQ ID NO: 883647 - DNA, 15 bp, Homo sapiens
tcaagcatattggaa

SEQ ID NO: 883648 - DNA, 16 bp, Homo sapiens
tcaagcatgaagataa

SEQ ID NO: 883649 - DNA, 22 bp, Homo sapiens
tcaagcatgcaataatgtgcaa

SEQ ID NO: 883650 - DNA, 15 bp, Homo sapiens
tcaagcatgtatttt

SEQ ID NO: 883651 - DNA, 15 bp, Homo sapiens
tcaagcatttaggaa

SEQ ID NO: 883652 - DNA, 16 bp, Homo sapiens
tcaagccaatcccctc

SEQ ID NO: 883653 - DNA, 20 bp, Homo sapiens
tcaagccaatcccctccttg

SEQ ID NO: 883654 - DNA, 21 bp, Homo sapiens
tcaagccaatcccctccttgg

SEQ ID NO: 883655 - DNA, 15 bp, Homo sapiens
tcaagcccagaaagt

SEQ ID NO: 883656 - DNA, 20 bp, Homo sapiens
tcaagccccattccctctct

SEQ ID NO: 883657 - DNA, 13 bp, Homo sapiens
tcaagcctctaaa

SEQ ID NO: 883658 - DNA, 15 bp, Homo sapiens
tcaagcctctaaaca

SEQ ID NO: 883659 - DNA, 14 bp, Homo sapiens
tcaagcctgcctag

SEQ ID NO: 883660 - DNA, 14 bp, Homo sapiens
tcaagcctgtggga

SEQ ID NO: 883661 - DNA, 20 bp, Homo sapiens
tcaagcctgtgggagtagaa

SEQ ID NO: 883662 - DNA, 15 bp, Homo sapiens
tcaagcgattctcct

SEQ ID NO: 883663 - DNA, 18 bp, Homo sapiens
tcaagctaagtaaaaata

SEQ ID NO: 883664 - DNA, 19 bp, Homo sapiens
tcaagctagaaggccacat

SEQ ID NO: 883665 - DNA, 16 bp, Homo sapiens
tcaagctagtgtttct

SEQ ID NO: 883666 - DNA, 15 bp, Homo sapiens
tcaagctatttaata

SEQ ID NO: 883667 - DNA, 14 bp, Homo sapiens
tcaagctcctcctc

SEQ ID NO: 883668 - DNA, 13 bp, Homo sapiens
tcaagctgagaaa

SEQ ID NO: 883669 - DNA, 18 bp, Homo sapiens
tcaagctgtcccctctgt

SEQ ID NO: 883670 - DNA, 17 bp, Homo sapiens
tcaagcttgtgtacttg

SEQ ID NO: 883671 - DNA, 18 bp, Homo sapiens
tcaagcttgtgtacttga

SEQ ID NO: 883672 - DNA, 20 bp, Homo sapiens
tcaaggaaaggctcatttaa

SEQ ID NO: 883673 - DNA, 20 bp, Homo sapiens
tcaaggaaagggggtcccag

SEQ ID NO: 883674 - DNA, 12 bp, Homo sapiens
tcaaggaagaaa

SEQ ID NO: 883675 - DNA, 17 bp, Homo sapiens
tcaaggaagaaaacgga

SEQ ID NO: 883676 - DNA, 16 bp, Homo sapiens
tcaaggaatttcttaa

SEQ ID NO: 883677 - DNA, 19 bp, Homo sapiens
tcaaggaatttcttaactt

SEQ ID NO: 883678 - DNA, 17 bp, Homo sapiens
tcacaggcagtgcatgt

SEQ ID NO: 883679 - DNA, 19 bp, Homo sapiens
tcacaggcagtgcatgtga

SEQ ID NO: 883680 - DNA, 16 bp, Homo sapiens
tcacaggctgagaact

SEQ ID NO: 883681 - DNA, 20 bp, Homo sapiens
tcacaggctgggtcaaaaga

SEQ ID NO: 883682 - DNA, 18 bp, Homo sapiens
tcacaggcttctgagcac

SEQ ID NO: 883683 - DNA, 13 bp, Homo sapiens
tcacagggcaggc

SEQ ID NO: 883684 - DNA, 14 bp, Homo sapiens
tcacagggcaggcc

SEQ ID NO: 883685 - DNA, 17 bp, Homo sapiens
tcacagggccccagaag

SEQ ID NO: 883686 - DNA, 23 bp, Homo sapiens
tcacagggccccagaaggcaggg

SEQ ID NO: 883687 - DNA, 17 bp, Homo sapiens
tcacaggggcggggcag

SEQ ID NO: 883688 - DNA, 14 bp, Homo sapiens
tcacagggttgggc

SEQ ID NO: 883689 - DNA, 24 bp, Homo sapiens
tcacagggttgggcccagatctgg

SEQ ID NO: 883690 - DNA, 15 bp, Homo sapiens
tcacaggtgtgggat

SEQ ID NO: 883691 - DNA, 16 bp, Homo sapiens
tcacagtaaaaataaa

SEQ ID NO: 883692 - DNA, 21 bp, Homo sapiens
tcacagtaaaaataaaatact

SEQ ID NO: 883693 - DNA, 17 bp, Homo sapiens
tcacagtacagcatgtg

SEQ ID NO: 883694 - DNA, 18 bp, Homo sapiens
tcacagtacctatgactt

SEQ ID NO: 883695 - DNA, 14 bp, Homo sapiens
tcacagtagagcca

SEQ ID NO: 883696 - DNA, 20 bp, Homo sapiens
tcacagtagagccagcttgg

SEQ ID NO: 883697 - DNA, 21 bp, Homo sapiens
tcacagtagagccagcttggg

SEQ ID NO: 883698 - DNA, 16 bp, Homo sapiens
tcacagtagagtaggg

SEQ ID NO: 883699 - DNA, 20 bp, Homo sapiens
tcacagtccaaccagaaaca

SEQ ID NO: 883700 - DNA, 19 bp, Homo sapiens
tcacagtcctatgtacaga

SEQ ID NO: 883701 - DNA, 18 bp, Homo sapiens
tcacagtctcagttctct

SEQ ID NO: 883702 - DNA, 19 bp, Homo sapiens
tcacagtctcagttctctt

SEQ ID NO: 883703 - DNA, 19 bp, Homo sapiens
tcacagtctctttaatctt

SEQ ID NO: 883704 - DNA, 23 bp, Homo sapiens
tcacagtctctttaatcttcagt

SEQ ID NO: 883705 - DNA, 12 bp, Homo sapiens
tcacagtgcagc

SEQ ID NO: 883706 - DNA, 17 bp, Homo sapiens
tcacagtgctcttttct

SEQ ID NO: 883707 - DNA, 18 bp, Homo sapiens
tcacagtgctcttttctc

SEQ ID NO: 883708 - DNA, 18 bp, Homo sapiens
tcacagtgcttttaagtg

SEQ ID NO: 883709 - DNA, 14 bp, Homo sapiens
tcacagtgtactct

SEQ ID NO: 883710 - DNA, 18 bp, Homo sapiens
tcacagtgtttgcaatgg

SEQ ID NO: 883711 - DNA, 19 bp, Homo sapiens
tcacagtgtttttattgct

SEQ ID NO: 883712 - DNA, 19 bp, Homo sapiens
tcacagttcaaaattctaa

SEQ ID NO: 883713 - DNA, 13 bp, Homo sapiens
tcacagttcctcg

SEQ ID NO: 883714 - DNA, 16 bp, Homo sapiens
tcacagttcctcgccc

SEQ ID NO: 883715 - DNA, 20 bp, Homo sapiens
tcacagttcctcgccctggg

SEQ ID NO: 883716 - DNA, 22 bp, Homo sapiens
tcacagttgccatgtagacccc

SEQ ID NO: 883717 - DNA, 19 bp, Homo sapiens
tcacataagagagatgaga

SEQ ID NO: 883718 - DNA, 19 bp, Homo sapiens
tcacataagctcagaatcc

SEQ ID NO: 883719 - DNA, 20 bp, Homo sapiens
tcacataagctcagaatcca

SEQ ID NO: 883720 - DNA, 18 bp, Homo sapiens
tcacatacaattattttt

SEQ ID NO: 883721 - DNA, 15 bp, Homo sapiens
tcacataccctcccc

SEQ ID NO: 883722 - DNA, 19 bp, Homo sapiens
tcacatagcccacttacat

SEQ ID NO: 883723 - DNA, 20 bp, Homo sapiens
tcacatagcccacttacatt

SEQ ID NO: 883724 - DNA, 21 bp, Homo sapiens
tcacatagtcctcagggctca

SEQ ID NO: 883725 - DNA, 18 bp, Homo sapiens
tcacatatatcaaagtga

SEQ ID NO: 883726 - DNA, 18 bp, Homo sapiens
tcacatattgatttccgt

SEQ ID NO: 883727 - DNA, 18 bp, Homo sapiens
tcacatcaagcatgcaat

SEQ ID NO: 883728 - DNA, 19 bp, Homo sapiens
tcacatcaagcatgcaata

SEQ ID NO: 883729 - DNA, 16 bp, Homo sapiens
tcacatcagcaatttc

SEQ ID NO: 883730 - DNA, 16 bp, Homo sapiens
tcacatccaactggaa

SEQ ID NO: 883731 - DNA, 19 bp, Homo sapiens
tcacatccaactggaaatt

SEQ ID NO: 883732 - DNA, 15 bp, Homo sapiens
tcacatcctcctgcc

SEQ ID NO: 883733 - DNA, 16 bp, Homo sapiens
tcacatcctcctgccc

SEQ ID NO: 883734 - DNA, 14 bp, Homo sapiens
tcacatcctctcca

SEQ ID NO: 883735 - DNA, 15 bp, Homo sapiens
tcacatcctctccag

SEQ ID NO: 883736 - DNA, 10 bp, Homo sapiens
tcacatcctg

SEQ ID NO: 883737 - DNA, 15 bp, Homo sapiens
tcacatcctggcctg

SEQ ID NO: 883738 - DNA, 22 bp, Homo sapiens
tcacatcctgggatccagtgta

SEQ ID NO: 883739 - DNA, 17 bp, Homo sapiens
tcacatcctgtgtttct

SEQ ID NO: 883740 - DNA, 19 bp, Homo sapiens
tcacatctaaagctttatc

SEQ ID NO: 883741 - DNA, 20 bp, Homo sapiens
tcacatctaaagctttatct

SEQ ID NO: 883742 - DNA, 17 bp, Homo sapiens
tcacatcttaaattcat

SEQ ID NO: 883743 - DNA, 18 bp, Homo sapiens
tcacatgaattattacag

SEQ ID NO: 883744 - DNA, 23 bp, Homo sapiens
tcacatgagctatttccattcca

SEQ ID NO: 883745 - DNA, 19 bp, Homo sapiens
tcacatgctaaagccagga

SEQ ID NO: 883746 - DNA, 21 bp, Homo sapiens
tcacatgtcagtaccttcaaa

SEQ ID NO: 883747 - DNA, 23 bp, Homo sapiens
tcacatgtgaaaagcttaataaa

SEQ ID NO: 883748 - DNA, 13 bp, Homo sapiens
tcacatgtggcaa

SEQ ID NO: 883749 - DNA, 15 bp, Homo sapiens
tcacattaggctgtt

SEQ ID NO: 883750 - DNA, 16 bp, Homo sapiens
tcacattatttgcatg

SEQ ID NO: 883751 - DNA, 16 bp, Homo sapiens
tcacattctgcttaaa

SEQ ID NO: 883752 - DNA, 14 bp, Homo sapiens
tcacattcttggct

SEQ ID NO: 883753 - DNA, 21 bp, Homo sapiens
tcacattcttggcttaatcat

SEQ ID NO: 883754 - DNA, 19 bp, Homo sapiens
tcacattgatgtaaggact

SEQ ID NO: 883755 - DNA, 16 bp, Homo sapiens
tcacattgttaagaaa

SEQ ID NO: 883756 - DNA, 11 bp, Homo sapiens
tcacattgttt

SEQ ID NO: 883757 - DNA, 18 bp, Homo sapiens
tcacattgtttgctgcta

SEQ ID NO: 883758 - DNA, 19 bp, Homo sapiens
tcacatttagaaaagtgaa

SEQ ID NO: 883759 - DNA, 16 bp, Homo sapiens
tcacatttgatgtaca

SEQ ID NO: 883760 - DNA, 14 bp, Homo sapiens
tcacattttccttt

SEQ ID NO: 883761 - DNA, 17 bp, Homo sapiens
tcacattttccttttca

SEQ ID NO: 883762 - DNA, 15 bp, Homo sapiens
tcacattttgttaag

SEQ ID NO: 883763 - DNA, 15 bp, Homo sapiens
tcacatttttttatg

SEQ ID NO: 883764 - DNA, 14 bp, Homo sapiens
tcacatttttttct

SEQ ID NO: 883765 - DNA, 13 bp, Homo sapiens
tcaccaaaaacat

SEQ ID NO: 883766 - DNA, 23 bp, Homo sapiens
tcaccaaaaccaaacttgttcat

SEQ ID NO: 883767 - DNA, 17 bp, Homo sapiens
tcaccaaaatttctaca

SEQ ID NO: 883768 - DNA, 13 bp, Homo sapiens
tcaccaaactagt

SEQ ID NO: 883769 - DNA, 14 bp, Homo sapiens
tatttctattatta

SEQ ID NO: 883770 - DNA, 21 bp, Homo sapiens
tatttctcaacaaagcacagt

SEQ ID NO: 883771 - DNA, 18 bp, Homo sapiens
tatttctccatcccctcc

SEQ ID NO: 883772 - DNA, 21 bp, Homo sapiens
tatttctccatcccctccctg

SEQ ID NO: 883773 - DNA, 19 bp, Homo sapiens
tatttctcgggtgcatttg

SEQ ID NO: 883774 - DNA, 16 bp, Homo sapiens
tatttctctatgttta

SEQ ID NO: 883775 - DNA, 15 bp, Homo sapiens
tatttctctctcctg

SEQ ID NO: 883776 - DNA, 17 bp, Homo sapiens
tatttctctctcctggt

SEQ ID NO: 883777 - DNA, 16 bp, Homo sapiens
tatttctgagaaggtc

SEQ ID NO: 883778 - DNA, 15 bp, Homo sapiens
tatttctgatgatgt

SEQ ID NO: 883779 - DNA, 12 bp, Homo sapiens
tatttctgattt

SEQ ID NO: 883780 - DNA, 16 bp, Homo sapiens
tatttctgatttcata

SEQ ID NO: 883781 - DNA, 22 bp, Homo sapiens
tcactgtagttttgagtgtata

SEQ ID NO: 883782 - DNA, 17 bp, Homo sapiens
tcactgtatataaacat

SEQ ID NO: 883783 - DNA, 18 bp, Homo sapiens
tcactgtatataaacata

SEQ ID NO: 883784 - DNA, 20 bp, Homo sapiens
tcactgtatataaacatatt

SEQ ID NO: 883785 - DNA, 15 bp, Homo sapiens
tcactgtcactgccg

SEQ ID NO: 883786 - DNA, 17 bp, Homo sapiens
tcactgtcactgccgac

SEQ ID NO: 883787 - DNA, 20 bp, Homo sapiens
tcactgtcaggaagaaatca

SEQ ID NO: 883788 - DNA, 19 bp, Homo sapiens
tcactgtcctccaagccag

SEQ ID NO: 883789 - DNA, 13 bp, Homo sapiens
tcactgtgaaatt

SEQ ID NO: 883790 - DNA, 14 bp, Homo sapiens
tcactgtgaaattt

SEQ ID NO: 883791 - DNA, 17 bp, Homo sapiens
tcactgtgaaatttcat

SEQ ID NO: 883792 - DNA, 14 bp, Homo sapiens
tcactgtgagggga

SEQ ID NO: 883793 - DNA, 12 bp, Homo sapiens
tcactgtgatca

SEQ ID NO: 883794 - DNA, 21 bp, Homo sapiens
tcactgtgatcaatattttta

SEQ ID NO: 883795 - DNA, 16 bp, Homo sapiens
tcactgtgctggggca

SEQ ID NO: 883796 - DNA, 18 bp, Homo sapiens
tcactgtgggaaggccag

SEQ ID NO: 883797 - DNA, 20 bp, Homo sapiens
tcactgttccctctgctcct

SEQ ID NO: 883798 - DNA, 16 bp, Homo sapiens
tcactgttctgcaaag

SEQ ID NO: 883799 - DNA, 22 bp, Homo sapiens
tcactgttgagttctgattgtg

SEQ ID NO: 883800 - DNA, 19 bp, Homo sapiens
tcactgttgtacacagtct

SEQ ID NO: 883801 - DNA, 23 bp, Homo sapiens
tcactgtttcatctaagtgcctc

SEQ ID NO: 883802 - DNA, 14 bp, Homo sapiens
tcactgtttcctgg

SEQ ID NO: 883803 - DNA, 20 bp, Homo sapiens
tcactgtttctctgctgttg

SEQ ID NO: 883804 - DNA, 23 bp, Homo sapiens
tcactgtttttattccttccatc

SEQ ID NO: 883805 - DNA, 15 bp, Homo sapiens
tcacttaaagggtct

SEQ ID NO: 883806 - DNA, 17 bp, Homo sapiens
tcacttaaattcttttg

SEQ ID NO: 883807 - DNA, 18 bp, Homo sapiens
tcacttaaattcttttga

SEQ ID NO: 883808 - DNA, 22 bp, Homo sapiens
tcacttaactataaggtgcctc

SEQ ID NO: 883809 - DNA, 23 bp, Homo sapiens
tcacttaactataaggtgcctca

SEQ ID NO: 883810 - DNA, 22 bp, Homo sapiens
tcacttaagttagttccactga

SEQ ID NO: 883811 - DNA, 13 bp, Homo sapiens
tcacttaatcttt

SEQ ID NO: 883812 - DNA, 16 bp, Homo sapiens
tcacttaatctttcta

SEQ ID NO: 883813 - DNA, 14 bp, Homo sapiens
tcacttaatgtttc

SEQ ID NO: 883814 - DNA, 21 bp, Homo sapiens
tcacttacataaagctccctt

SEQ ID NO: 883815 - DNA, 22 bp, Homo sapiens
tcacttaccccgagacctcact

SEQ ID NO: 883816 - DNA, 18 bp, Homo sapiens
tcacttacgtttgtcctt

SEQ ID NO: 883817 - DNA, 12 bp, Homo sapiens
tcacttatacca

SEQ ID NO: 883818 - DNA, 20 bp, Homo sapiens
tcacttataccaaagggaaa

SEQ ID NO: 883819 - DNA, 19 bp, Homo sapiens
tcacttatcccaagagaat

SEQ ID NO: 883820 - DNA, 20 bp, Homo sapiens
tcacttccagatatccacat

SEQ ID NO: 883821 - DNA, 22 bp, Homo sapiens
tcacttccagtgttggctgtgt

SEQ ID NO: 883822 - DNA, 18 bp, Homo sapiens
tcacttccatacagctct

SEQ ID NO: 883823 - DNA, 17 bp, Homo sapiens
tcacttcctacaagagc

SEQ ID NO: 883824 - DNA, 17 bp, Homo sapiens
tcacttctgaccacact

SEQ ID NO: 883825 - DNA, 23 bp, Homo sapiens
tcacttgaaagattttattgtat

SEQ ID NO: 883826 - DNA, 14 bp, Homo sapiens
tcacttgagcccag

SEQ ID NO: 883827 - DNA, 18 bp, Homo sapiens
tcacttgatgtgccattt

SEQ ID NO: 883828 - DNA, 20 bp, Homo sapiens
tcacttgatgtgccatttta

SEQ ID NO: 883829 - DNA, 19 bp, Homo sapiens
tcacttgatgtttgttaga

SEQ ID NO: 883830 - DNA, 13 bp, Homo sapiens
tcacttgccacat

SEQ ID NO: 883831 - DNA, 16 bp, Homo sapiens
tcacttgccatgcagg

SEQ ID NO: 883832 - DNA, 18 bp, Homo sapiens
tcacttgggagctgctgg

SEQ ID NO: 883833 - DNA, 15 bp, Homo sapiens
tcacttgtacaaaat

SEQ ID NO: 883834 - DNA, 17 bp, Homo sapiens
tcacttgtattgacttt

SEQ ID NO: 883835 - DNA, 16 bp, Homo sapiens
tcacttgtctcctttc

SEQ ID NO: 883836 - DNA, 13 bp, Homo sapiens
tcacttgtgcttt

SEQ ID NO: 883837 - DNA, 15 bp, Homo sapiens
tcacttgtgctttgc

SEQ ID NO: 883838 - DNA, 19 bp, Homo sapiens
tcacttgtgctttgctctt

SEQ ID NO: 883839 - DNA, 20 bp, Homo sapiens
tcacttgttgttttactaaa

SEQ ID NO: 883840 - DNA, 23 bp, Homo sapiens
tcacttgttgttttactaaagaa

SEQ ID NO: 883841 - DNA, 15 bp, Homo sapiens
tcactttaagatctt

SEQ ID NO: 883842 - DNA, 14 bp, Homo sapiens
tcactttagatgct

SEQ ID NO: 883843 - DNA, 17 bp, Homo sapiens
tcactttcacatagatg

SEQ ID NO: 883844 - DNA, 19 bp, Homo sapiens
tcactttcacatagatgtc

SEQ ID NO: 883845 - DNA, 14 bp, Homo sapiens
tcactttcctcagt

SEQ ID NO: 883846 - DNA, 21 bp, Homo sapiens
tcactttctcttttgttttaa

SEQ ID NO: 883847 - DNA, 14 bp, Homo sapiens
tcactttgaaaagt

SEQ ID NO: 883848 - DNA, 22 bp, Homo sapiens
tcactttgaaaagttggaagga

SEQ ID NO: 883849 - DNA, 19 bp, Homo sapiens
tcactttgccttctggtta

SEQ ID NO: 883850 - DNA, 15 bp, Homo sapiens
tcactttgctctggg

SEQ ID NO: 883851 - DNA, 14 bp, Homo sapiens
tcactttgtgaatt

SEQ ID NO: 883852 - DNA, 15 bp, Homo sapiens
tcactttgtgaatta

SEQ ID NO: 883853 - DNA, 22 bp, Homo sapiens
tcacttttcaatttgtcatgtt

SEQ ID NO: 883854 - DNA, 13 bp, Homo sapiens
tcacttttcactt

SEQ ID NO: 883855 - DNA, 16 bp, Homo sapiens
tcacttttcagtgatg

SEQ ID NO: 883856 - DNA, 12 bp, Homo sapiens
tcacttttcctc

SEQ ID NO: 883857 - DNA, 20 bp, Homo sapiens
tcacttttccttttcttaaa

SEQ ID NO: 883858 - DNA, 14 bp, Homo sapiens
tcacttttgttctg

SEQ ID NO: 883859 - DNA, 16 bp, Homo sapiens
tcacttttgttctgct

SEQ ID NO: 883860 - DNA, 20 bp, Homo sapiens
tcacttttgttctgctttat

SEQ ID NO: 883861 - DNA, 21 bp, Homo sapiens
tcacttttgttgcccaggctg

SEQ ID NO: 883862 - DNA, 14 bp, Homo sapiens
tcactttttccaaa

SEQ ID NO: 883863 - DNA, 13 bp, Homo sapiens
tcactttttctga

SEQ ID NO: 883864 - DNA, 14 bp, Homo sapiens
tcactttttctgat

SEQ ID NO: 883865 - DNA, 16 bp, Homo sapiens
tcactttttctgataa

SEQ ID NO: 883866 - DNA, 15 bp, Homo sapiens
tcacttttttataaa

SEQ ID NO: 883867 - DNA, 20 bp, Homo sapiens
tcactttttttttttttccc

SEQ ID NO: 883868 - DNA, 13 bp, Homo sapiens
tcagaaaagctat

SEQ ID NO: 883869 - DNA, 20 bp, Homo sapiens
tcagaaaagctattaaagtt

SEQ ID NO: 883870 - DNA, 14 bp, Homo sapiens
tcagaaaagggaag

SEQ ID NO: 883871 - DNA, 21 bp, Homo sapiens
tcagaaaagtaattttgtcac

SEQ ID NO: 883872 - DNA, 16 bp, Homo sapiens
tcagaaacagggcagc

SEQ ID NO: 883873 - DNA, 22 bp, Homo sapiens
tcagaaacatcagttactctga

SEQ ID NO: 883874 - DNA, 18 bp, Homo sapiens
tcagaaaccaaacagttt

SEQ ID NO: 883875 - DNA, 22 bp, Homo sapiens
tcagaaaccagttatgtgaatg

SEQ ID NO: 883876 - DNA, 19 bp, Homo sapiens
tcagaaacccggcttcctg

SEQ ID NO: 883877 - DNA, 15 bp, Homo sapiens
tcagaaacttgtgaa

SEQ ID NO: 883878 - DNA, 16 bp, Homo sapiens
tcagaaacttgtgaag

SEQ ID NO: 883879 - DNA, 22 bp, Homo sapiens
tcagaaagaattgatcagaatc

SEQ ID NO: 883880 - DNA, 13 bp, Homo sapiens
tcagaaaggattt

SEQ ID NO: 883881 - DNA, 19 bp, Homo sapiens
tcagaaagtaacaatctat

SEQ ID NO: 883882 - DNA, 17 bp, Homo sapiens
tcagaaagtgacatttg

SEQ ID NO: 883883 - DNA, 17 bp, Homo sapiens
tcagaaatggacaaaga

SEQ ID NO: 883884 - DNA, 17 bp, Homo sapiens
tcagaaattaaaatatt

SEQ ID NO: 883885 - DNA, 18 bp, Homo sapiens
tcagaaattaaaatatta

SEQ ID NO: 883886 - DNA, 14 bp, Homo sapiens
tcagaaatttaatt

SEQ ID NO: 883887 - DNA, 21 bp, Homo sapiens
tcagaaatttaattcatgttt

SEQ ID NO: 883888 - DNA, 23 bp, Homo sapiens
tcagaaatttaattcatgtttct

SEQ ID NO: 883889 - DNA, 20 bp, Homo sapiens
tcagaacaacttgctactta

SEQ ID NO: 883890 - DNA, 16 bp, Homo sapiens
tcagaacaatccgatt

SEQ ID NO: 883891 - DNA, 14 bp, Homo sapiens
tcagaacacacaga

SEQ ID NO: 883892 - DNA, 21 bp, Homo sapiens
tcagaacagaggcatttaaaa

SEQ ID NO: 883893 - DNA, 15 bp, Homo sapiens
tcagagcatgtgtca

SEQ ID NO: 883894 - DNA, 17 bp, Homo sapiens
tcagagcatgtgtcaga

SEQ ID NO: 883895 - DNA, 18 bp, Homo sapiens
tcagagccaagtcctccc

SEQ ID NO: 883896 - DNA, 21 bp, Homo sapiens
tcagagccacccctaaagaga

SEQ ID NO: 883897 - DNA, 23 bp, Homo sapiens
tcagagccagcctggctctgccc

SEQ ID NO: 883898 - DNA, 12 bp, Homo sapiens
tcagagcccatg

SEQ ID NO: 883899 - DNA, 20 bp, Homo sapiens
tcagagcccctacagcattg

SEQ ID NO: 883900 - DNA, 15 bp, Homo sapiens
tcagagccctggctg

SEQ ID NO: 883901 - DNA, 16 bp, Homo sapiens
tcagagccctggctgg

SEQ ID NO: 883902 - DNA, 16 bp, Homo sapiens
tcagagccgtggtcct

SEQ ID NO: 883903 - DNA, 20 bp, Homo sapiens
tcagagccgtggtcctttgg

SEQ ID NO: 883904 - DNA, 14 bp, Homo sapiens
tcagagcctgacct

SEQ ID NO: 883905 - DNA, 19 bp, Homo sapiens
tcagagccttccatgacct

SEQ ID NO: 883906 - DNA, 20 bp, Homo sapiens
tcagagcctttcctcaaaac

SEQ ID NO: 883907 - DNA, 20 bp, Homo sapiens
tcagagcgccaggaagccag

SEQ ID NO: 883908 - DNA, 16 bp, Homo sapiens
tcagagctcttaatgt

SEQ ID NO: 883909 - DNA, 16 bp, Homo sapiens
tcagagcttgaagatt

SEQ ID NO: 883910 - DNA, 10 bp, Homo sapiens
tcagagcttt

SEQ ID NO: 883911 - DNA, 18 bp, Homo sapiens
tcagagctttaaaagtat

SEQ ID NO: 883912 - DNA, 16 bp, Homo sapiens
tcagagctttgtcact

SEQ ID NO: 883913 - DNA, 23 bp, Homo sapiens
tcagagctttgtcacttgccaca

SEQ ID NO: 883914 - DNA, 21 bp, Homo sapiens
tcagaggaacagtcctgttca

SEQ ID NO: 883915 - DNA, 12 bp, Homo sapiens
tcagaggacccc

SEQ ID NO: 883916 - DNA, 17 bp, Homo sapiens
tcagaggaccccagggt

SEQ ID NO: 883917 - DNA, 13 bp, Homo sapiens
tcagaggagaaga

SEQ ID NO: 883918 - DNA, 19 bp, Homo sapiens
tcagaggagcgcaggcagc

SEQ ID NO: 883919 - DNA, 14 bp, Homo sapiens
tcagaggagtaaat

SEQ ID NO: 883920 - DNA, 15 bp, Homo sapiens
tcagaggcccccagt

SEQ ID NO: 883921 - DNA, 24 bp, Homo sapiens
tcagaggcccccagtggggacagg

SEQ ID NO: 883922 - DNA, 22 bp, Homo sapiens
tcagaggccctcgctgccagct

SEQ ID NO: 883923 - DNA, 18 bp, Homo sapiens
tcagaggcctgctgccag

SEQ ID NO: 883924 - DNA, 16 bp, Homo sapiens
tcagaggctgagccct

SEQ ID NO: 883925 - DNA, 19 bp, Homo sapiens
tcagaggctgagccctgta

SEQ ID NO: 883926 - DNA, 17 bp, Homo sapiens
tcagagggggactgctg

SEQ ID NO: 883927 - DNA, 18 bp, Homo sapiens
tcagagggggactgctgc

SEQ ID NO: 883928 - DNA, 22 bp, Homo sapiens
tcagagggggactgctgctgcc

SEQ ID NO: 883929 - DNA, 17 bp, Homo sapiens
tcagagtaggtgggtag

SEQ ID NO: 883930 - DNA, 22 bp, Homo sapiens
tcagagtatattgttgaagaga

SEQ ID NO: 883931 - DNA, 16 bp, Homo sapiens
tcagagtccactgtgg

SEQ ID NO: 883932 - DNA, 13 bp, Homo sapiens
tcagagtccagtg

SEQ ID NO: 883933 - DNA, 21 bp, Homo sapiens
tcagagtccagtgctctgcct

SEQ ID NO: 883934 - DNA, 15 bp, Homo sapiens
tcagagtgaccctca

SEQ ID NO: 883935 - DNA, 17 bp, Homo sapiens
tcagagtgaccctcagc

SEQ ID NO: 883936 - DNA, 21 bp, Homo sapiens
tcagagtggcgtgagctgccc

SEQ ID NO: 883937 - DNA, 23 bp, Homo sapiens
tcagagtggcgtgagctgcccgg

SEQ ID NO: 883938 - DNA, 21 bp, Homo sapiens
tcagagtggctcactggctgg

SEQ ID NO: 883939 - DNA, 23 bp, Homo sapiens
tcagagttaccattatttaattt

SEQ ID NO: 883940 - DNA, 17 bp, Homo sapiens
tcagagttgctttaaag

SEQ ID NO: 883941 - DNA, 17 bp, Homo sapiens
tcagataacaactgtga

SEQ ID NO: 883942 - DNA, 18 bp, Homo sapiens
tcagataagtgtaaatag

SEQ ID NO: 883943 - DNA, 17 bp, Homo sapiens
tcagataatatgtttag

SEQ ID NO: 883944 - DNA, 16 bp, Homo sapiens
tcagatacatcactgc

SEQ ID NO: 883945 - DNA, 20 bp, Homo sapiens
tcagatacttatgaaatctc

SEQ ID NO: 883946 - DNA, 13 bp, Homo sapiens
tcagatagtctat

SEQ ID NO: 883947 - DNA, 18 bp, Homo sapiens
tcagatataaaagactga

SEQ ID NO: 883948 - DNA, 23 bp, Homo sapiens
tcagatataagagaagtctcatt

SEQ ID NO: 883949 - DNA, 23 bp, Homo sapiens
tcagatatatttttcacagtttt

SEQ ID NO: 883950 - DNA, 16 bp, Homo sapiens
tcagatatgcttacta

SEQ ID NO: 883951 - DNA, 16 bp, Homo sapiens
tcagatcaaaatgcct

SEQ ID NO: 883952 - DNA, 19 bp, Homo sapiens
tcagatcactgaatttata

SEQ ID NO: 883953 - DNA, 21 bp, Homo sapiens
tcagatcactgaatttataaa

SEQ ID NO: 883954 - DNA, 13 bp, Homo sapiens
tcagatcagtgct

SEQ ID NO: 883955 - DNA, 16 bp, Homo sapiens
tcagatctttctcctt

SEQ ID NO: 883956 - DNA, 18 bp, Homo sapiens
tcagatctttctccttga

SEQ ID NO: 883957 - DNA, 17 bp, Homo sapiens
tcagatgactctctcca

SEQ ID NO: 883958 - DNA, 13 bp, Homo sapiens
tcagatgagaaca

SEQ ID NO: 883959 - DNA, 20 bp, Homo sapiens
tcagatgagaacaaagctgt

SEQ ID NO: 883960 - DNA, 21 bp, Homo sapiens
tcagatgagaacaaagctgtt

SEQ ID NO: 883961 - DNA, 21 bp, Homo sapiens
tcagatgaggtcaacacaggt

SEQ ID NO: 883962 - DNA, 23 bp, Homo sapiens
tcagatgaggtcaacacaggtag

SEQ ID NO: 883963 - DNA, 21 bp, Homo sapiens
tcagatgcccagagggcccag

SEQ ID NO: 883964 - DNA, 13 bp, Homo sapiens
tcagatgcctgct

SEQ ID NO: 883965 - DNA, 13 bp, Homo sapiens
tcagatgcttctg

SEQ ID NO: 883966 - DNA, 22 bp, Homo sapiens
tcagatgcttgcggcaaaagga

SEQ ID NO: 883967 - DNA, 12 bp, Homo sapiens
tcagatggaaaa

SEQ ID NO: 883968 - DNA, 22 bp, Homo sapiens
tcagcaccttggcccaggagct

SEQ ID NO: 883969 - DNA, 16 bp, Homo sapiens
tcagcacgatttctgt

SEQ ID NO: 883970 - DNA, 14 bp, Homo sapiens
tcagcactgtccct

SEQ ID NO: 883971 - DNA, 23 bp, Homo sapiens
tcagcactttgggaggctgaggc

SEQ ID NO: 883972 - DNA, 17 bp, Homo sapiens
tcagcagaacctgcaca

SEQ ID NO: 883973 - DNA, 20 bp, Homo sapiens
tcagcagaacctgcacacag

SEQ ID NO: 883974 - DNA, 22 bp, Homo sapiens
tcagcagagttattgaatctta

SEQ ID NO: 883975 - DNA, 16 bp, Homo sapiens
tcagcagccagtctca

SEQ ID NO: 883976 - DNA, 23 bp, Homo sapiens
tcagcagccagtctcagagacca

SEQ ID NO: 883977 - DNA, 24 bp, Homo sapiens
tcagcagccagtctcagagaccag

SEQ ID NO: 883978 - DNA, 14 bp, Homo sapiens
tcagcagccctcct

SEQ ID NO: 883979 - DNA, 16 bp, Homo sapiens
tcagcagccctcctca

SEQ ID NO: 883980 - DNA, 21 bp, Homo sapiens
tcagcagccgccttaagctga

SEQ ID NO: 883981 - DNA, 22 bp, Homo sapiens
tcagcagccgccttaagctgat

SEQ ID NO: 883982 - DNA, 17 bp, Homo sapiens
tcagcaggcaggctggg

SEQ ID NO: 883983 - DNA, 18 bp, Homo sapiens
tcagcaggcaggctgggg

SEQ ID NO: 883984 - DNA, 22 bp, Homo sapiens
tcagcaggctccagttgaacac

SEQ ID NO: 883985 - DNA, 18 bp, Homo sapiens
tcagcagggactgtaaac

SEQ ID NO: 883986 - DNA, 22 bp, Homo sapiens
tcagcagggactgtaaacacag

SEQ ID NO: 883987 - DNA, 15 bp, Homo sapiens
tcagcagtcaataca

SEQ ID NO: 883988 - DNA, 12 bp, Homo sapiens
tcagcagtctag

SEQ ID NO: 883989 - DNA, 13 bp, Homo sapiens
tcagcagtgacca

SEQ ID NO: 883990 - DNA, 17 bp, Homo sapiens
tcagcatatgtgtaaag

SEQ ID NO: 883991 - DNA, 17 bp, Homo sapiens
tcagcatctgtgatggg

SEQ ID NO: 883992 - DNA, 13 bp, Homo sapiens
tcagcatgaaaat

SEQ ID NO: 883993 - DNA, 16 bp, Homo sapiens
tcagcatgacaaaaat

SEQ ID NO: 883994 - DNA, 18 bp, Homo sapiens
tcagcatgacaaaaataa

SEQ ID NO: 883995 - DNA, 24 bp, Homo sapiens
tcagcatgacaaaaataacactgt

SEQ ID NO: 883996 - DNA, 23 bp, Homo sapiens
tcagcatgggtccttgatgccag

SEQ ID NO: 883997 - DNA, 16 bp, Homo sapiens
tcagcatgtctattca

SEQ ID NO: 883998 - DNA, 19 bp, Homo sapiens
tcagcatgtctattcagct

SEQ ID NO: 883999 - DNA, 21 bp, Homo sapiens
tcagcatgtctattcagcttc

SEQ ID NO: 884000 - DNA, 20 bp, Homo sapiens
tcagcattagagaaatgaat

SEQ ID NO: 884001 - DNA, 23 bp, Homo sapiens
tcagcattgtctcgtgtacagct

SEQ ID NO: 884002 - DNA, 19 bp, Homo sapiens
tcagcattgtgacttggag

SEQ ID NO: 884003 - DNA, 13 bp, Homo sapiens
tcagcatttcttt

SEQ ID NO: 884004 - DNA, 22 bp, Homo sapiens
tcagccaaatttcctgtttgaa

SEQ ID NO: 884005 - DNA, 23 bp, Homo sapiens
tcagccaaggttttataaggctg

SEQ ID NO: 884006 - DNA, 16 bp, Homo sapiens
tcagccaatttgtctc

SEQ ID NO: 884007 - DNA, 13 bp, Homo sapiens
tcagccacagcct

SEQ ID NO: 884008 - DNA, 17 bp, Homo sapiens
tcagccaccctgagttg

SEQ ID NO: 884009 - DNA, 13 bp, Homo sapiens
tcagccacctccc

SEQ ID NO: 884010 - DNA, 16 bp, Homo sapiens
tcagccacctccctct

SEQ ID NO: 884011 - DNA, 22 bp, Homo sapiens
tcagccacctccctctgccagt

SEQ ID NO: 884012 - DNA, 15 bp, Homo sapiens
tcagccacctgggaa

SEQ ID NO: 884013 - DNA, 16 bp, Homo sapiens
tcagccacctgggaac

SEQ ID NO: 884014 - DNA, 21 bp, Homo sapiens
tcagccactaagaacccctct

SEQ ID NO: 884015 - DNA, 14 bp, Homo sapiens
tcagccagagaagc

SEQ ID NO: 884016 - DNA, 14 bp, Homo sapiens
tcagccagccttcc

SEQ ID NO: 884017 - DNA, 15 bp, Homo sapiens
tcagccagccttccc

SEQ ID NO: 884018 - DNA, 18 bp, Homo sapiens
tcagccagccttccccac

SEQ ID NO: 884019 - DNA, 23 bp, Homo sapiens
tcagccagctaccccttgtgggc

SEQ ID NO: 884020 - DNA, 12 bp, Homo sapiens
tcagccagctta

SEQ ID NO: 884021 - DNA, 16 bp, Homo sapiens
tcagccagcttaaacc

SEQ ID NO: 884022 - DNA, 19 bp, Homo sapiens
tcagccaggagctgtcacc

SEQ ID NO: 884023 - DNA, 18 bp, Homo sapiens
tcagccaggcgtggttac

SEQ ID NO: 884024 - DNA, 13 bp, Homo sapiens
tcagccagggcca

SEQ ID NO: 884025 - DNA, 18 bp, Homo sapiens
tcagccagggccaggggt

SEQ ID NO: 884026 - DNA, 18 bp, Homo sapiens
tcagccagtggcacagga

SEQ ID NO: 884027 - DNA, 15 bp, Homo sapiens
tcagccatcagccat

SEQ ID NO: 884028 - DNA, 20 bp, Homo sapiens
tcagccatccgcagactgct

SEQ ID NO: 884029 - DNA, 20 bp, Homo sapiens
tcagccatcgtcctgggact

SEQ ID NO: 884030 - DNA, 21 bp, Homo sapiens
tcagccatgaggagttgctgt

SEQ ID NO: 884031 - DNA, 23 bp, Homo sapiens
tcagccatgaggagttgctgttt

SEQ ID NO: 884032 - DNA, 14 bp, Homo sapiens
tcagccatggccct

SEQ ID NO: 884033 - DNA, 18 bp, Homo sapiens
tcagccatgggaacctca

SEQ ID NO: 884034 - DNA, 19 bp, Homo sapiens
tcagccatgggaacctcat

SEQ ID NO: 884035 - DNA, 13 bp, Homo sapiens
tcagccattaaaa

SEQ ID NO: 884036 - DNA, 14 bp, Homo sapiens
tcagccattaaaat

SEQ ID NO: 884037 - DNA, 19 bp, Homo sapiens
tcagccattaaaataaaac

SEQ ID NO: 884038 - DNA, 20 bp, Homo sapiens
tcagccattaaaataaaaca

SEQ ID NO: 884039 - DNA, 22 bp, Homo sapiens
tcagccattaaaataaaacaag

SEQ ID NO: 884040 - DNA, 18 bp, Homo sapiens
tcagccatttccccctcc

SEQ ID NO: 884041 - DNA, 17 bp, Homo sapiens
tcagccatttttaatga

SEQ ID NO: 884042 - DNA, 14 bp, Homo sapiens
tcagcccacccccc

SEQ ID NO: 884043 - DNA, 17 bp, Homo sapiens
tcagcccacccccctca

SEQ ID NO: 884044 - DNA, 13 bp, Homo sapiens
tcagcccaccctc

SEQ ID NO: 884045 - DNA, 20 bp, Homo sapiens
tcagcccaggtcagctgtta

SEQ ID NO: 884046 - DNA, 15 bp, Homo sapiens
tcagccccatcgccc

SEQ ID NO: 884047 - DNA, 16 bp, Homo sapiens
tcagcccccaccaggg

SEQ ID NO: 884048 - DNA, 22 bp, Homo sapiens
tcagcccccaccaggggaagga

SEQ ID NO: 884049 - DNA, 12 bp, Homo sapiens
tcagcccccagc

SEQ ID NO: 884050 - DNA, 15 bp, Homo sapiens
tcagcccccagcctt

SEQ ID NO: 884051 - DNA, 17 bp, Homo sapiens
tcagcccccaggccagg

SEQ ID NO: 884052 - DNA, 18 bp, Homo sapiens
tcagcccccaggccaggt

SEQ ID NO: 884053 - DNA, 16 bp, Homo sapiens
tcagccccgcctgtca

SEQ ID NO: 884054 - DNA, 17 bp, Homo sapiens
tcagccccgcctgtcac

SEQ ID NO: 884055 - DNA, 23 bp, Homo sapiens
tcagccccgcctgtcacaataaa

SEQ ID NO: 884056 - DNA, 12 bp, Homo sapiens
tcagcccctacc

SEQ ID NO: 884057 - DNA, 19 bp, Homo sapiens
tcagcccctacccctgccc

SEQ ID NO: 884058 - DNA, 20 bp, Homo sapiens
tcagcccctacccctgccct

SEQ ID NO: 884059 - DNA, 13 bp, Homo sapiens
tcagcccctagga

SEQ ID NO: 884060 - DNA, 14 bp, Homo sapiens
tcagcccctaggag

SEQ ID NO: 884061 - DNA, 22 bp, Homo sapiens
tcagcccctaggagtatatttc

SEQ ID NO: 884062 - DNA, 16 bp, Homo sapiens
tcagcccctcctctgc

SEQ ID NO: 884063 - DNA, 22 bp, Homo sapiens
tcagcccctcctctgccacctc

SEQ ID NO: 884064 - DNA, 23 bp, Homo sapiens
tcagcccctcctctgccacctcc

SEQ ID NO: 884065 - DNA, 11 bp, Homo sapiens
tcagcccctct

SEQ ID NO: 884066 - DNA, 15 bp, Homo sapiens
tcagcccctcttccc

SEQ ID NO: 884067 - DNA, 19 bp, Homo sapiens
tcagcccctcttcccttcc

SEQ ID NO: 884068 - DNA, 20 bp, Homo sapiens
tcagcccctcttgcccccca

SEQ ID NO: 884069 - DNA, 21 bp, Homo sapiens
tcagcccctcttgccccccac

SEQ ID NO: 884070 - DNA, 23 bp, Homo sapiens
tcagcccctcttgccccccaccc

SEQ ID NO: 884071 - DNA, 14 bp, Homo sapiens
tcagcccctgatct

SEQ ID NO: 884072 - DNA, 17 bp, Homo sapiens
tcagcccctgggaacag

SEQ ID NO: 884073 - DNA, 18 bp, Homo sapiens
tcagcccctgggaacagg

SEQ ID NO: 884074 - DNA, 22 bp, Homo sapiens
tcagcccctgggaacaggcccc

SEQ ID NO: 884075 - DNA, 16 bp, Homo sapiens
tcagccctccctgccc

SEQ ID NO: 884076 - DNA, 13 bp, Homo sapiens
tcagccctgaccc

SEQ ID NO: 884077 - DNA, 16 bp, Homo sapiens
tcagccctgaccctgt

SEQ ID NO: 884078 - DNA, 13 bp, Homo sapiens
tcagccctggcct

SEQ ID NO: 884079 - DNA, 19 bp, Homo sapiens
tcagccctgggccccacca

SEQ ID NO: 884080 - DNA, 10 bp, Homo sapiens
tcagcccttg

SEQ ID NO: 884081 - DNA, 19 bp, Homo sapiens
tcagcccttggcttctgct

SEQ ID NO: 884082 - DNA, 20 bp, Homo sapiens
tcagcccttggcttctgctt

SEQ ID NO: 884083 - DNA, 23 bp, Homo sapiens
tcagccctttgctctgatttcct

SEQ ID NO: 884084 - DNA, 16 bp, Homo sapiens
tcagccgtcagccatc

SEQ ID NO: 884085 - DNA, 21 bp, Homo sapiens
tcagcctactccgctcactga

SEQ ID NO: 884086 - DNA, 20 bp, Homo sapiens
tcagcctagccgacctcagc

SEQ ID NO: 884087 - DNA, 19 bp, Homo sapiens
tcagcctcattcagcatgg

SEQ ID NO: 884088 - DNA, 20 bp, Homo sapiens
tcagcctcccaaagtgctgg

SEQ ID NO: 884089 - DNA, 21 bp, Homo sapiens
tcagcctcccaaagtgctggg

SEQ ID NO: 884090 - DNA, 20 bp, Homo sapiens
tcagcctcccaagtagctgg

SEQ ID NO: 884091 - DNA, 21 bp, Homo sapiens
tcagcctcccaagtagctggg

SEQ ID NO: 884092 - DNA, 20 bp, Homo sapiens
tcagctactgccaagggcag

SEQ ID NO: 884093 - DNA, 18 bp, Homo sapiens
tcagctagcttttaggaa

SEQ ID NO: 884094 - DNA, 14 bp, Homo sapiens
tcagctagtggctc

SEQ ID NO: 884095 - DNA, 23 bp, Homo sapiens
tcagctcaattgttaatgtgatg

SEQ ID NO: 884096 - DNA, 18 bp, Homo sapiens
tcagctcagcgccagcct

SEQ ID NO: 884097 - DNA, 15 bp, Homo sapiens
tcagctcaggcagct

SEQ ID NO: 884098 - DNA, 22 bp, Homo sapiens
tcagctccagaataccttcttc

SEQ ID NO: 884099 - DNA, 22 bp, Homo sapiens
tcagctcccaacgagcctcctc

SEQ ID NO: 884100 - DNA, 17 bp, Homo sapiens
tcagctccttcctggag

SEQ ID NO: 884101 - DNA, 13 bp, Homo sapiens
tcagctctcctgg

SEQ ID NO: 884102 - DNA, 19 bp, Homo sapiens
tcagctctctgccctgtgt

SEQ ID NO: 884103 - DNA, 20 bp, Homo sapiens
tcagctctctgccctgtgta

SEQ ID NO: 884104 - DNA, 18 bp, Homo sapiens
tcagctctctgggacctc

SEQ ID NO: 884105 - DNA, 23 bp, Homo sapiens
tcagctctgcaagaattgaagca

SEQ ID NO: 884106 - DNA, 18 bp, Homo sapiens
tcagctctgggagaggat

SEQ ID NO: 884107 - DNA, 19 bp, Homo sapiens
tcagctctgggccattctc

SEQ ID NO: 884108 - DNA, 19 bp, Homo sapiens
tcagctcttggctccactg

SEQ ID NO: 884109 - DNA, 16 bp, Homo sapiens
tcagctctttccaaat

SEQ ID NO: 884110 - DNA, 17 bp, Homo sapiens
tcagctctttccaaatt

SEQ ID NO: 884111 - DNA, 16 bp, Homo sapiens
tcagctgaacctgggt

SEQ ID NO: 884112 - DNA, 22 bp, Homo sapiens
tcagctgaatgcctcctgtggg

SEQ ID NO: 884113 - DNA, 22 bp, Homo sapiens
tcagctgcaaggtactctggtg

SEQ ID NO: 884114 - DNA, 20 bp, Homo sapiens
tcagctgcacattcctggcc

SEQ ID NO: 884115 - DNA, 19 bp, Homo sapiens
tcagctgcatggagcctgg

SEQ ID NO: 884116 - DNA, 20 bp, Homo sapiens
tcagctgcatggagcctgga

SEQ ID NO: 884117 - DNA, 16 bp, Homo sapiens
tcagctgccaagcact

SEQ ID NO: 884118 - DNA, 24 bp, Homo sapiens
tcagctgcctcacttcctacaaga

SEQ ID NO: 884119 - DNA, 13 bp, Homo sapiens
tcagctgcctgaa

SEQ ID NO: 884120 - DNA, 16 bp, Homo sapiens
tcagctgcctgaaaca

SEQ ID NO: 884121 - DNA, 22 bp, Homo sapiens
tcagctgctcagcaacctttca

SEQ ID NO: 884122 - DNA, 14 bp, Homo sapiens
tcagctgctcccac

SEQ ID NO: 884123 - DNA, 17 bp, Homo sapiens
tcagctgctcccacact

SEQ ID NO: 884124 - DNA, 15 bp, Homo sapiens
tcagctgcttctgct

SEQ ID NO: 884125 - DNA, 20 bp, Homo sapiens
tcagctgcttctgctgccta

SEQ ID NO: 884126 - DNA, 22 bp, Homo sapiens
tcagctggctgagacactgaag

SEQ ID NO: 884127 - DNA, 14 bp, Homo sapiens
tcagctgggagcca

SEQ ID NO: 884128 - DNA, 17 bp, Homo sapiens
tcagctgggagccagtg

SEQ ID NO: 884129 - DNA, 20 bp, Homo sapiens
tcagctgggcagtgccagcc

SEQ ID NO: 884130 - DNA, 22 bp, Homo sapiens
tcagctgtcacctgctcacagg

SEQ ID NO: 884131 - DNA, 23 bp, Homo sapiens
tcagctgtcacctgctcacaggg

SEQ ID NO: 884132 - DNA, 15 bp, Homo sapiens
tcagctgtcctgcag

SEQ ID NO: 884133 - DNA, 17 bp, Homo sapiens
tcagctgttactttctt

SEQ ID NO: 884134 - DNA, 19 bp, Homo sapiens
tcagcttaattctccttcc

SEQ ID NO: 884135 - DNA, 20 bp, Homo sapiens
tcagcttaattctccttccc

SEQ ID NO: 884136 - DNA, 13 bp, Homo sapiens
tcagcttataatg

SEQ ID NO: 884137 - DNA, 19 bp, Homo sapiens
tcagcttatctcttttata

SEQ ID NO: 884138 - DNA, 20 bp, Homo sapiens
tcagcttatctcttttatat

SEQ ID NO: 884139 - DNA, 16 bp, Homo sapiens
tcagcttatgggatcc

SEQ ID NO: 884140 - DNA, 22 bp, Homo sapiens
tcagcttcctgctgctggggcc

SEQ ID NO: 884141 - DNA, 21 bp, Homo sapiens
tcagcttcggggccggtgagg

SEQ ID NO: 884142 - DNA, 21 bp, Homo sapiens
tcagcttcttcacaggcactc

SEQ ID NO: 884143 - DNA, 18 bp, Homo sapiens
tcagcttcttcctaggtc

SEQ ID NO: 884144 - DNA, 21 bp, Homo sapiens
tcagcttgaacctgcttcctg

SEQ ID NO: 884145 - DNA, 19 bp, Homo sapiens
tcagcttgggcttcttcct

SEQ ID NO: 884146 - DNA, 24 bp, Homo sapiens
tcagcttgggcttcttcctcctcc

SEQ ID NO: 884147 - DNA, 20 bp, Homo sapiens
tcagctttcagagccagtga

SEQ ID NO: 884148 - DNA, 22 bp, Homo sapiens
tcagctttcagagccagtgaag

SEQ ID NO: 884149 - DNA, 22 bp, Homo sapiens
tcagctttgagaagccttcagc

SEQ ID NO: 884150 - DNA, 14 bp, Homo sapiens
tcagcttttctgat

SEQ ID NO: 884151 - DNA, 17 bp, Homo sapiens
tcagcttttgttctaga

SEQ ID NO: 884152 - DNA, 13 bp, Homo sapiens
tcaggaaaaatga

SEQ ID NO: 884153 - DNA, 21 bp, Homo sapiens
tcaggaaaactgacagaggag

SEQ ID NO: 884154 - DNA, 9 bp, Homo sapiens
tcaggaaac

SEQ ID NO: 884155 - DNA, 22 bp, Homo sapiens
tcaggaaacgagactttccatt

SEQ ID NO: 884156 - DNA, 15 bp, Homo sapiens
tcaggaaaggaatca

SEQ ID NO: 884157 - DNA, 15 bp, Homo sapiens
tcaggaaaggctgta

SEQ ID NO: 884158 - DNA, 18 bp, Homo sapiens
tcaggaacagctatggga

SEQ ID NO: 884159 - DNA, 21 bp, Homo sapiens
tcaggaacagtggctgggtgg

SEQ ID NO: 884160 - DNA, 14 bp, Homo sapiens
tcaggaaccagggc

SEQ ID NO: 884161 - DNA, 20 bp, Homo sapiens
tcaggaacgttgccacacca

SEQ ID NO: 884162 - DNA, 14 bp, Homo sapiens
tcaggaagaagaga

SEQ ID NO: 884163 - DNA, 14 bp, Homo sapiens
tcaggaagctctct

SEQ ID NO: 884164 - DNA, 18 bp, Homo sapiens
tcaggaatattttccaaa

SEQ ID NO: 884165 - DNA, 18 bp, Homo sapiens
tcaggaatcagaaatcat

SEQ ID NO: 884166 - DNA, 22 bp, Homo sapiens
tcaggaatgagtcaatcagcct

SEQ ID NO: 884167 - DNA, 19 bp, Homo sapiens
tcaggacaaggccttgctc

SEQ ID NO: 884168 - DNA, 22 bp, Homo sapiens
tcaggacataggcacaggcaaa

SEQ ID NO: 884169 - DNA, 15 bp, Homo sapiens
tcaggatgaacccag

SEQ ID NO: 884170 - DNA, 13 bp, Homo sapiens
tcaggatgcacat

SEQ ID NO: 884171 - DNA, 18 bp, Homo sapiens
tcaggatgcacatttctg

SEQ ID NO: 884172 - DNA, 19 bp, Homo sapiens
tcaggatgcacatttctgg

SEQ ID NO: 884173 - DNA, 13 bp, Homo sapiens
tcaggattgtctg

SEQ ID NO: 884174 - DNA, 15 bp, Homo sapiens
tcaggcaagcccctc

SEQ ID NO: 884175 - DNA, 20 bp, Homo sapiens
tcaggcaagcccctcagccc

SEQ ID NO: 884176 - DNA, 22 bp, Homo sapiens
tcaggcaagcccctcagccctt

SEQ ID NO: 884177 - DNA, 24 bp, Homo sapiens
tcaggcaagcccctcagcccttgc

SEQ ID NO: 884178 - DNA, 14 bp, Homo sapiens
tcaggcactggtgg

SEQ ID NO: 884179 - DNA, 21 bp, Homo sapiens
tcaggcagacaagagctgctg

SEQ ID NO: 884180 - DNA, 23 bp, Homo sapiens
tcaggcagcaccacactgggtgc

SEQ ID NO: 884181 - DNA, 17 bp, Homo sapiens
tcaggcagcaggggctg

SEQ ID NO: 884182 - DNA, 13 bp, Homo sapiens
tcaggcagccagt

SEQ ID NO: 884183 - DNA, 20 bp, Homo sapiens
tcaggcagccagtgagatga

SEQ ID NO: 884184 - DNA, 13 bp, Homo sapiens
tcaggcagctcaa

SEQ ID NO: 884185 - DNA, 21 bp, Homo sapiens
tcaggcaggaagggcaggaag

SEQ ID NO: 884186 - DNA, 18 bp, Homo sapiens
tcaggcaggtgggatgga

SEQ ID NO: 884187 - DNA, 22 bp, Homo sapiens
tcaggcataggcctgggtgctg

SEQ ID NO: 884188 - DNA, 14 bp, Homo sapiens
tcaggcatgcctgt

SEQ ID NO: 884189 - DNA, 16 bp, Homo sapiens
tcaggcatgcctgtgt

SEQ ID NO: 884190 - DNA, 17 bp, Homo sapiens
tcaggcatggctcagag

SEQ ID NO: 884191 - DNA, 14 bp, Homo sapiens
tcaggcattttgtt

SEQ ID NO: 884192 - DNA, 17 bp, Homo sapiens
tcaggccacctgccccc

SEQ ID NO: 884193 - DNA, 21 bp, Homo sapiens
tcaggccacctgcccccttct

SEQ ID NO: 884194 - DNA, 13 bp, Homo sapiens
tcaggccacttga

SEQ ID NO: 884195 - DNA, 19 bp, Homo sapiens
tcaggccagcccagccagg

SEQ ID NO: 884196 - DNA, 15 bp, Homo sapiens
tcaggccagggctca

SEQ ID NO: 884197 - DNA, 17 bp, Homo sapiens
tcaggcccgtcggagct

SEQ ID NO: 884198 - DNA, 21 bp, Homo sapiens
tcaggcccgtcggagctgcct

SEQ ID NO: 884199 - DNA, 16 bp, Homo sapiens
tcaggccctgactcct

SEQ ID NO: 884200 - DNA, 19 bp, Homo sapiens
tcaggccctgactcctctg

SEQ ID NO: 884201 - DNA, 19 bp, Homo sapiens
tcaggcccttattttcaag

SEQ ID NO: 884202 - DNA, 16 bp, Homo sapiens
tcaggcctaggaggcc

SEQ ID NO: 884203 - DNA, 18 bp, Homo sapiens
tcaggcctataaccccag

SEQ ID NO: 884204 - DNA, 23 bp, Homo sapiens
tcaggcctgaacccgtccattca

SEQ ID NO: 884205 - DNA, 15 bp, Homo sapiens
tcaggcctgggcagg

SEQ ID NO: 884206 - DNA, 20 bp, Homo sapiens
tcaggcctgggcaggaccct

SEQ ID NO: 884207 - DNA, 21 bp, Homo sapiens
tcaggcgatccacctgtctca

SEQ ID NO: 884208 - DNA, 15 bp, Homo sapiens
tcaggctccattagg

SEQ ID NO: 884209 - DNA, 17 bp, Homo sapiens
tcaggctccccagaact

SEQ ID NO: 884210 - DNA, 18 bp, Homo sapiens
tcaggctccccagaactg

SEQ ID NO: 884211 - DNA, 15 bp, Homo sapiens
tcaggctcttctcct

SEQ ID NO: 884212 - DNA, 13 bp, Homo sapiens
tcaggctgaggtg

SEQ ID NO: 884213 - DNA, 12 bp, Homo sapiens
tcaggctgctgg

SEQ ID NO: 884214 - DNA, 15 bp, Homo sapiens
tcaggctgcttggga

SEQ ID NO: 884215 - DNA, 22 bp, Homo sapiens
tcaggctggtctcgaactcctg

SEQ ID NO: 884216 - DNA, 12 bp, Homo sapiens
tcaggctgttat

SEQ ID NO: 884217 - DNA, 16 bp, Homo sapiens
tcaggctgttattatg

SEQ ID NO: 884218 - DNA, 16 bp, Homo sapiens
tcaggcttgaaatgca

SEQ ID NO: 884219 - DNA, 18 bp, Homo sapiens
tcaggcttgaaatgcatt

SEQ ID NO: 884220 - DNA, 16 bp, Homo sapiens
tcagggaaaagcagct

SEQ ID NO: 884221 - DNA, 18 bp, Homo sapiens
tcagggaaaagcagctct

SEQ ID NO: 884222 - DNA, 19 bp, Homo sapiens
tcagggaaactaagattct

SEQ ID NO: 884223 - DNA, 16 bp, Homo sapiens
tcagggaaaggccagt

SEQ ID NO: 884224 - DNA, 17 bp, Homo sapiens
tcagggaactgcttgcc

SEQ ID NO: 884225 - DNA, 19 bp, Homo sapiens
tcagggaactgcttgccca

SEQ ID NO: 884226 - DNA, 21 bp, Homo sapiens
tcagggaactgcttgcccagg

SEQ ID NO: 884227 - DNA, 21 bp, Homo sapiens
tcagggacagagacacctgca

SEQ ID NO: 884228 - DNA, 15 bp, Homo sapiens
tcagggacagagcca

SEQ ID NO: 884229 - DNA, 15 bp, Homo sapiens
tcagggacaggatga

SEQ ID NO: 884230 - DNA, 22 bp, Homo sapiens
tcagggaccggtgctgcaggag

SEQ ID NO: 884231 - DNA, 12 bp, Homo sapiens
tcagggacctca

SEQ ID NO: 884232 - DNA, 13 bp, Homo sapiens
tcagggacctcag

SEQ ID NO: 884233 - DNA, 18 bp, Homo sapiens
tcagggacctcaggggca

SEQ ID NO: 884234 - DNA, 18 bp, Homo sapiens
tcagggagacaggcaggg

SEQ ID NO: 884235 - DNA, 14 bp, Homo sapiens
tcagggagaggtca

SEQ ID NO: 884236 - DNA, 23 bp, Homo sapiens
tcagggagcagggaaggcctgac

SEQ ID NO: 884237 - DNA, 14 bp, Homo sapiens
tcagggagggaagg

SEQ ID NO: 884238 - DNA, 12 bp, Homo sapiens
tcagggagggcc

SEQ ID NO: 884239 - DNA, 20 bp, Homo sapiens
tcagggagggccagggaggc

SEQ ID NO: 884240 - DNA, 22 bp, Homo sapiens
tcagggagggccagggaggcag

SEQ ID NO: 884241 - DNA, 14 bp, Homo sapiens
tcagggaggggccg

SEQ ID NO: 884242 - DNA, 19 bp, Homo sapiens
tcagggagtgctggctcac

SEQ ID NO: 884243 - DNA, 15 bp, Homo sapiens
tcagggcagcgccag

SEQ ID NO: 884244 - DNA, 15 bp, Homo sapiens
tcagggcagctgcct

SEQ ID NO: 884245 - DNA, 17 bp, Homo sapiens
tcagggcagctgcctgg

SEQ ID NO: 884246 - DNA, 21 bp, Homo sapiens
tcagggcagctgcctggccat

SEQ ID NO: 884247 - DNA, 14 bp, Homo sapiens
tcagggcagtggcc

SEQ ID NO: 884248 - DNA, 20 bp, Homo sapiens
tcagggcagtggccaagcct

SEQ ID NO: 884249 - DNA, 22 bp, Homo sapiens
tcagggcagtggccaagcctgc

SEQ ID NO: 884250 - DNA, 23 bp, Homo sapiens
tcagggcagtggccaagcctgct

SEQ ID NO: 884251 - DNA, 21 bp, Homo sapiens
tcagggccagaaggagggcag

SEQ ID NO: 884252 - DNA, 23 bp, Homo sapiens
tcagggccagaaggagggcagag

SEQ ID NO: 884253 - DNA, 17 bp, Homo sapiens
tcagggccaggtgcaga

SEQ ID NO: 884254 - DNA, 14 bp, Homo sapiens
tcagggccagtcct

SEQ ID NO: 884255 - DNA, 18 bp, Homo sapiens
tcagggccatgctgaggc

SEQ ID NO: 884256 - DNA, 23 bp, Homo sapiens
tcagggccctgccccaggcctgg

SEQ ID NO: 884257 - DNA, 18 bp, Homo sapiens
tcaggggctgtttgagga

SEQ ID NO: 884258 - DNA, 15 bp, Homo sapiens
tcaggggctttgggc

SEQ ID NO: 884259 - DNA, 14 bp, Homo sapiens
tcagggggccagct

SEQ ID NO: 884260 - DNA, 21 bp, Homo sapiens
tcagggggccagctggggaga

SEQ ID NO: 884261 - DNA, 20 bp, Homo sapiens
tcagggggtaggagagcact

SEQ ID NO: 884262 - DNA, 22 bp, Homo sapiens
tcagggggtaggagagcactgc

SEQ ID NO: 884263 - DNA, 23 bp, Homo sapiens
tcagggggtaggagagcactgcc

SEQ ID NO: 884264 - DNA, 19 bp, Homo sapiens
tcaggggtcaggtgtcagg

SEQ ID NO: 884265 - DNA, 22 bp, Homo sapiens
tcaggggtcaggtgtcaggccc

SEQ ID NO: 884266 - DNA, 23 bp, Homo sapiens
tcaggggtcgtcaccacctctcc

SEQ ID NO: 884267 - DNA, 13 bp, Homo sapiens
tcaggggtgcaca

SEQ ID NO: 884268 - DNA, 17 bp, Homo sapiens
tcaggggtggagaagtg

SEQ ID NO: 884269 - DNA, 21 bp, Homo sapiens
tcagggtcaaagacagaatgg

SEQ ID NO: 884270 - DNA, 22 bp, Homo sapiens
tcagggtcaaagacagaatggt

SEQ ID NO: 884271 - DNA, 20 bp, Homo sapiens
tcagggtgaactgcaaagct

SEQ ID NO: 884272 - DNA, 13 bp, Homo sapiens
tcagggtgggcca

SEQ ID NO: 884273 - DNA, 21 bp, Homo sapiens
tcagggtgggccactctcccc

SEQ ID NO: 884274 - DNA, 21 bp, Homo sapiens
tcaggtaacactacagagtac

SEQ ID NO: 884275 - DNA, 14 bp, Homo sapiens
tcaggtaatatacc

SEQ ID NO: 884276 - DNA, 15 bp, Homo sapiens
tcaggtaatatacct

SEQ ID NO: 884277 - DNA, 16 bp, Homo sapiens
tcaggtaatatacctg

SEQ ID NO: 884278 - DNA, 21 bp, Homo sapiens
tcaggtaatatacctggttta

SEQ ID NO: 884279 - DNA, 17 bp, Homo sapiens
tcaggtaatcattttaa

SEQ ID NO: 884280 - DNA, 22 bp, Homo sapiens
tcaggtacagcgggctgtgccc

SEQ ID NO: 884281 - DNA, 21 bp, Homo sapiens
tcaggtaggcccttgtcctgc

SEQ ID NO: 884282 - DNA, 14 bp, Homo sapiens
tcaggtagtactgg

SEQ ID NO: 884283 - DNA, 21 bp, Homo sapiens
tcaggtatgttgcctttatgg

SEQ ID NO: 884284 - DNA, 15 bp, Homo sapiens
tcaggtcagctggga

SEQ ID NO: 884285 - DNA, 23 bp, Homo sapiens
tcaggtccaggccagtgggcctg

SEQ ID NO: 884286 - DNA, 22 bp, Homo sapiens
tcaggtcccagcgagccacagg

SEQ ID NO: 884287 - DNA, 12 bp, Homo sapiens
tcaggtccctgc

SEQ ID NO: 884288 - DNA, 17 bp, Homo sapiens
tcaggtccgtgggccgt

SEQ ID NO: 884289 - DNA, 19 bp, Homo sapiens
tcaggtctcccacgtggga

SEQ ID NO: 884290 - DNA, 13 bp, Homo sapiens
tcaggtctgggca

SEQ ID NO: 884291 - DNA, 18 bp, Homo sapiens
tcaggtctgtaactgccc

SEQ ID NO: 884292 - DNA, 21 bp, Homo sapiens
tcaggtgaaactccagatgcc

SEQ ID NO: 884293 - DNA, 19 bp, Homo sapiens
tcaggtgcacacatcacca

SEQ ID NO: 884294 - DNA, 13 bp, Homo sapiens
tcaggtgccactc

SEQ ID NO: 884295 - DNA, 22 bp, Homo sapiens
tcaggtgccttacatcttttct

SEQ ID NO: 884296 - DNA, 23 bp, Homo sapiens
tcaggtgccttacatcttttcta

SEQ ID NO: 884297 - DNA, 17 bp, Homo sapiens
tcaggtggactctggga

SEQ ID NO: 884298 - DNA, 13 bp, Homo sapiens
tcaggtgtataaa

SEQ ID NO: 884299 - DNA, 16 bp, Homo sapiens
tcaggtgtataaatgt

SEQ ID NO: 884300 - DNA, 19 bp, Homo sapiens
tcaggttcactcattgaca

SEQ ID NO: 884301 - DNA, 20 bp, Homo sapiens
tcaggttcactcattgacat

SEQ ID NO: 884302 - DNA, 14 bp, Homo sapiens
tcaggttccatccc

SEQ ID NO: 884303 - DNA, 18 bp, Homo sapiens
tcaggttcttagtgtcac

SEQ ID NO: 884304 - DNA, 17 bp, Homo sapiens
tcaggttgtagtaaaga

SEQ ID NO: 884305 - DNA, 19 bp, Homo sapiens
tcaggttgtagtaaagaaa

SEQ ID NO: 884306 - DNA, 23 bp, Homo sapiens
tcaggtttaacatttgccttgca

SEQ ID NO: 884307 - DNA, 21 bp, Homo sapiens
tcaggtttggtttttttgtac

SEQ ID NO: 884308 - DNA, 19 bp, Homo sapiens
tcaggttttcttttaagaa

SEQ ID NO: 884309 - DNA, 20 bp, Homo sapiens
tcaggttttcttttaagaat

SEQ ID NO: 884310 - DNA, 15 bp, Homo sapiens
tcagtaaagtacctt

SEQ ID NO: 884311 - DNA, 20 bp, Homo sapiens
tcagtaacaaaggtttaaag

SEQ ID NO: 884312 - DNA, 19 bp, Homo sapiens
tcagtaacataactgcttc

SEQ ID NO: 884313 - DNA, 17 bp, Homo sapiens
tcagtaacatttctgtt

SEQ ID NO: 884314 - DNA, 21 bp, Homo sapiens
tcagtaacatttctgttctca

SEQ ID NO: 884315 - DNA, 19 bp, Homo sapiens
tcagtaagaaaaagaagaa

SEQ ID NO: 884316 - DNA, 12 bp, Homo sapiens
tcagtaagaggt

SEQ ID NO: 884317 - DNA, 15 bp, Homo sapiens
tcagtaagctgtgtg

SEQ ID NO: 884318 - DNA, 14 bp, Homo sapiens
tcagtaagttatct

SEQ ID NO: 884319 - DNA, 19 bp, Homo sapiens
tcagtaatataatttgcca

SEQ ID NO: 884320 - DNA, 19 bp, Homo sapiens
tcagtaatttagaaatcat

SEQ ID NO: 884321 - DNA, 15 bp, Homo sapiens
tcagtaatttgagga

SEQ ID NO: 884322 - DNA, 18 bp, Homo sapiens
tcagtaatttgtttaaaa

SEQ ID NO: 884323 - DNA, 21 bp, Homo sapiens
tcagtacccctggtaaaccaa

SEQ ID NO: 884324 - DNA, 22 bp, Homo sapiens
tcagtacccctggtaaaccaag

SEQ ID NO: 884325 - DNA, 16 bp, Homo sapiens
tcagtaccctctcagc

SEQ ID NO: 884326 - DNA, 14 bp, Homo sapiens
tcagtactttttta

SEQ ID NO: 884327 - DNA, 18 bp, Homo sapiens
tcagtagaaaaggatcta

SEQ ID NO: 884328 - DNA, 17 bp, Homo sapiens
tcagtagaattaccatt

SEQ ID NO: 884329 - DNA, 19 bp, Homo sapiens
tcagtagagaattcatgtg

SEQ ID NO: 884330 - DNA, 15 bp, Homo sapiens
tcagtagatactaaa

SEQ ID NO: 884331 - DNA, 17 bp, Homo sapiens
tcagtagattgcagaaa

SEQ ID NO: 884332 - DNA, 18 bp, Homo sapiens
tcagtaggactccttatt

SEQ ID NO: 884333 - DNA, 18 bp, Homo sapiens
tcagtagtcacaaactga

SEQ ID NO: 884334 - DNA, 18 bp, Homo sapiens
tcagtagtttcatgtaaa

SEQ ID NO: 884335 - DNA, 13 bp, Homo sapiens
tcagtagtttgag

SEQ ID NO: 884336 - DNA, 15 bp, Homo sapiens
tcagtataaacaaag

SEQ ID NO: 884337 - DNA, 16 bp, Homo sapiens
tcagtataatttttta

SEQ ID NO: 884338 - DNA, 15 bp, Homo sapiens
tcagtatactgtgtg

SEQ ID NO: 884339 - DNA, 19 bp, Homo sapiens
tcagtatagcattgaacat

SEQ ID NO: 884340 - DNA, 20 bp, Homo sapiens
tcagtatccatgctcttgac

SEQ ID NO: 884341 - DNA, 18 bp, Homo sapiens
tcagtatctgtatctctc

SEQ ID NO: 884342 - DNA, 16 bp, Homo sapiens
tcagtatgttgtcaaa

SEQ ID NO: 884343 - DNA, 18 bp, Homo sapiens
tcagtatgttgtcaaaga

SEQ ID NO: 884344 - DNA, 21 bp, Homo sapiens
tcagtattaaaggggggaggg

SEQ ID NO: 884345 - DNA, 17 bp, Homo sapiens
tcagtattactttctgc

SEQ ID NO: 884346 - DNA, 19 bp, Homo sapiens
tcagtatttccttccactg

SEQ ID NO: 884347 - DNA, 13 bp, Homo sapiens
tcagtattttcca

SEQ ID NO: 884348 - DNA, 14 bp, Homo sapiens
tcagtattttccag

SEQ ID NO: 884349 - DNA, 19 bp, Homo sapiens
tcagtattttccagcctta

SEQ ID NO: 884350 - DNA, 15 bp, Homo sapiens
tcagtattttttact

SEQ ID NO: 884351 - DNA, 13 bp, Homo sapiens
tcagtcaaaactt

SEQ ID NO: 884352 - DNA, 16 bp, Homo sapiens
tcagtcaatattttta

SEQ ID NO: 884353 - DNA, 14 bp, Homo sapiens
tcagtcacagccac

SEQ ID NO: 884354 - DNA, 18 bp, Homo sapiens
tcagtcacccccacttcc

SEQ ID NO: 884355 - DNA, 20 bp, Homo sapiens
tcagtcactaaaaggaagac

SEQ ID NO: 884356 - DNA, 23 bp, Homo sapiens
tcagtcagttcccggagcacagc

SEQ ID NO: 884357 - DNA, 18 bp, Homo sapiens
tcagtcatcaaagcagaa

SEQ ID NO: 884358 - DNA, 21 bp, Homo sapiens
tcagtcatcaaagcagaagtc

SEQ ID NO: 884359 - DNA, 12 bp, Homo sapiens
tcagtccactgt

SEQ ID NO: 884360 - DNA, 14 bp, Homo sapiens
tcagtcccaaagcg

SEQ ID NO: 884361 - DNA, 18 bp, Homo sapiens
tcagtccccacagataac

SEQ ID NO: 884362 - DNA, 18 bp, Homo sapiens
tcagtccccgtgaaggag

SEQ ID NO: 884363 - DNA, 11 bp, Homo sapiens
tcagtcccctc

SEQ ID NO: 884364 - DNA, 13 bp, Homo sapiens
tcagtcccctccc

SEQ ID NO: 884365 - DNA, 14 bp, Homo sapiens
tcagtcccctccca

SEQ ID NO: 884366 - DNA, 20 bp, Homo sapiens
tcagtcccctcccatctggg

SEQ ID NO: 884367 - DNA, 22 bp, Homo sapiens
tcagtcccctctctctgggtca

SEQ ID NO: 884368 - DNA, 13 bp, Homo sapiens
tcagtcctcatct

SEQ ID NO: 884369 - DNA, 20 bp, Homo sapiens
tcagtccttattatcccagc

SEQ ID NO: 884370 - DNA, 22 bp, Homo sapiens
tcagtccttattatcccagctt

SEQ ID NO: 884371 - DNA, 22 bp, Homo sapiens
tcatatgtagccttcacacaga

SEQ ID NO: 884372 - DNA, 20 bp, Homo sapiens
tcatatgttgctcagtctcc

SEQ ID NO: 884373 - DNA, 20 bp, Homo sapiens
tcatattaagacagtgtaca

SEQ ID NO: 884374 - DNA, 21 bp, Homo sapiens
tcatattaagacagtgtacaa

SEQ ID NO: 884375 - DNA, 12 bp, Homo sapiens
tcatattataca

SEQ ID NO: 884376 - DNA, 14 bp, Homo sapiens
tcatattgaatata

SEQ ID NO: 884377 - DNA, 22 bp, Homo sapiens
tcatattggattgcgcctttgt

SEQ ID NO: 884378 - DNA, 13 bp, Homo sapiens
tcatattgtatgt

SEQ ID NO: 884379 - DNA, 21 bp, Homo sapiens
tcatattgtgattctgccttt

SEQ ID NO: 884380 - DNA, 14 bp, Homo sapiens
tcatattgtttcct

SEQ ID NO: 884381 - DNA, 12 bp, Homo sapiens
tcatatttaaag

SEQ ID NO: 884382 - DNA, 15 bp, Homo sapiens
tcatatttacttctt

SEQ ID NO: 884383 - DNA, 22 bp, Homo sapiens
tcatatttacttcttatacatt

SEQ ID NO: 884384 - DNA, 14 bp, Homo sapiens
tcatatttcccctt

SEQ ID NO: 884385 - DNA, 13 bp, Homo sapiens
tcatatttctacc

SEQ ID NO: 884386 - DNA, 20 bp, Homo sapiens
tcatatttgaggagtgttaa

SEQ ID NO: 884387 - DNA, 19 bp, Homo sapiens
tcatatttgggggctaagg

SEQ ID NO: 884388 - DNA, 20 bp, Homo sapiens
tcatattttaaacagaggat

SEQ ID NO: 884389 - DNA, 16 bp, Homo sapiens
tcatattttaaatctg

SEQ ID NO: 884390 - DNA, 13 bp, Homo sapiens
tcatattttgcca

SEQ ID NO: 884391 - DNA, 15 bp, Homo sapiens
tcatattttgccact

SEQ ID NO: 884392 - DNA, 19 bp, Homo sapiens
tcatcaaaaagccttattt

SEQ ID NO: 884393 - DNA, 16 bp, Homo sapiens
tcatcaaaatcatgga

SEQ ID NO: 884394 - DNA, 13 bp, Homo sapiens
tcatcaactgaat

SEQ ID NO: 884395 - DNA, 16 bp, Homo sapiens
tcatcaagaagggctg

SEQ ID NO: 884396 - DNA, 21 bp, Homo sapiens
tcatcaagcaggaattatgtc

SEQ ID NO: 884397 - DNA, 13 bp, Homo sapiens
tcatcaatcaaat

SEQ ID NO: 884398 - DNA, 23 bp, Homo sapiens
tcatcacaagaacacacacatat

SEQ ID NO: 884399 - DNA, 14 bp, Homo sapiens
tcatcacactgggt

SEQ ID NO: 884400 - DNA, 16 bp, Homo sapiens
tcatcaccagtctgta

SEQ ID NO: 884401 - DNA, 12 bp, Homo sapiens
tcatcaccagtg

SEQ ID NO: 884402 - DNA, 16 bp, Homo sapiens
tcatcaccccagaggc

SEQ ID NO: 884403 - DNA, 21 bp, Homo sapiens
tcatcacctgctagaacctct

SEQ ID NO: 884404 - DNA, 14 bp, Homo sapiens
tcatcactccctgg

SEQ ID NO: 884405 - DNA, 20 bp, Homo sapiens
tcatcactccctggatgtgt

SEQ ID NO: 884406 - DNA, 16 bp, Homo sapiens
tcatcactggactgca

SEQ ID NO: 884407 - DNA, 17 bp, Homo sapiens
tcatcactggactgcat

SEQ ID NO: 884408 - DNA, 15 bp, Homo sapiens
tcatcactggatgaa

SEQ ID NO: 884409 - DNA, 14 bp, Homo sapiens
tcatcactgtaaag

SEQ ID NO: 884410 - DNA, 14 bp, Homo sapiens
tcatcagagcagct

SEQ ID NO: 884411 - DNA, 15 bp, Homo sapiens
tcatcagagcagcta

SEQ ID NO: 884412 - DNA, 16 bp, Homo sapiens
tcatcagatgcctgct

SEQ ID NO: 884413 - DNA, 12 bp, Homo sapiens
tcatcagcattt

SEQ ID NO: 884414 - DNA, 11 bp, Homo sapiens
tcatcaggatg

SEQ ID NO: 884415 - DNA, 12 bp, Homo sapiens
tcatcaggctct

SEQ ID NO: 884416 - DNA, 13 bp, Homo sapiens
tcatcagggcctg

SEQ ID NO: 884417 - DNA, 19 bp, Homo sapiens
tcatcagtgcctctttgaa

SEQ ID NO: 884418 - DNA, 18 bp, Homo sapiens
tcatcagtgtgtaaataa

SEQ ID NO: 884419 - DNA, 21 bp, Homo sapiens
tcatcagtgtgtaaataattt

SEQ ID NO: 884420 - DNA, 12 bp, Homo sapiens
tcatcagtgtta

SEQ ID NO: 884421 - DNA, 16 bp, Homo sapiens
tcatcagtgttaaaaa

SEQ ID NO: 884422 - DNA, 13 bp, Homo sapiens
tcatcataaaata

SEQ ID NO: 884423 - DNA, 11 bp, Homo sapiens
tcatcatcagg

SEQ ID NO: 884424 - DNA, 14 bp, Homo sapiens
tcatcatcagggcc

SEQ ID NO: 884425 - DNA, 13 bp, Homo sapiens
tcatcatccaccc

SEQ ID NO: 884426 - DNA, 14 bp, Homo sapiens
tcatcatccacccg

SEQ ID NO: 884427 - DNA, 19 bp, Homo sapiens
tcatcatccacccgctgcc

SEQ ID NO: 884428 - DNA, 23 bp, Homo sapiens
tcatcatcgtcatcatcataggt

SEQ ID NO: 884429 - DNA, 20 bp, Homo sapiens
tcatcatggaggtcatacat

SEQ ID NO: 884430 - DNA, 13 bp, Homo sapiens
tcatcatgtctat

SEQ ID NO: 884431 - DNA, 15 bp, Homo sapiens
tcatcattccctctc

SEQ ID NO: 884432 - DNA, 14 bp, Homo sapiens
tcatcattccttga

SEQ ID NO: 884433 - DNA, 12 bp, Homo sapiens
tcatcattgttt

SEQ ID NO: 884434 - DNA, 22 bp, Homo sapiens
tcatcattgtttctgcatgaat

SEQ ID NO: 884435 - DNA, 13 bp, Homo sapiens
tcatcatttcagc

SEQ ID NO: 884436 - DNA, 20 bp, Homo sapiens
tcatcatttcagccaaagtc

SEQ ID NO: 884437 - DNA, 20 bp, Homo sapiens
tcatccaacaagaagaaata

SEQ ID NO: 884438 - DNA, 19 bp, Homo sapiens
tcatccaatcctcactggg

SEQ ID NO: 884439 - DNA, 23 bp, Homo sapiens
tcatccacccgctgcccctcccc

SEQ ID NO: 884440 - DNA, 21 bp, Homo sapiens
tcatccactagtgcaaatcat

SEQ ID NO: 884441 - DNA, 22 bp, Homo sapiens
tcatccactagtgcaaatcata

SEQ ID NO: 884442 - DNA, 12 bp, Homo sapiens
tcatccagggcc

SEQ ID NO: 884443 - DNA, 21 bp, Homo sapiens
tcatccagtttgttctccggg

SEQ ID NO: 884444 - DNA, 22 bp, Homo sapiens
tcatccagtttgttctccgggt

SEQ ID NO: 884445 - DNA, 15 bp, Homo sapiens
tcatccatgcacttt

SEQ ID NO: 884446 - DNA, 22 bp, Homo sapiens
tcatccatgcactttaattgaa

SEQ ID NO: 884447 - DNA, 13 bp, Homo sapiens
tcatccatttctt

SEQ ID NO: 884448 - DNA, 20 bp, Homo sapiens
tcatcccaacagccaagacc

SEQ ID NO: 884449 - DNA, 12 bp, Homo sapiens
tcatcccaacct

SEQ ID NO: 884450 - DNA, 13 bp, Homo sapiens
tcatcccagctgc

SEQ ID NO: 884451 - DNA, 18 bp, Homo sapiens
tcatcccattctgcgtca

SEQ ID NO: 884452 - DNA, 15 bp, Homo sapiens
tcatccccccacccg

SEQ ID NO: 884453 - DNA, 16 bp, Homo sapiens
tcatcccccctgctgc

SEQ ID NO: 884454 - DNA, 17 bp, Homo sapiens
tcatcccccctgctgcc

SEQ ID NO: 884455 - DNA, 14 bp, Homo sapiens
tcatcccgtatcac

SEQ ID NO: 884456 - DNA, 13 bp, Homo sapiens
tcatccctccttg

SEQ ID NO: 884457 - DNA, 14 bp, Homo sapiens
tcatccctttctcc

SEQ ID NO: 884458 - DNA, 19 bp, Homo sapiens
tcatccctttctcccagtg

SEQ ID NO: 884459 - DNA, 15 bp, Homo sapiens
tcatccgcctgtggg

SEQ ID NO: 884460 - DNA, 15 bp, Homo sapiens
tcatcctaagctatt

SEQ ID NO: 884461 - DNA, 17 bp, Homo sapiens
tcatcctcaaagaaagt

SEQ ID NO: 884462 - DNA, 18 bp, Homo sapiens
tcatcctcaaagaaagtg

SEQ ID NO: 884463 - DNA, 21 bp, Homo sapiens
tcatcctcaaagaaagtgtat

SEQ ID NO: 884464 - DNA, 22 bp, Homo sapiens
tcatcctcaaagaaagtgtatt

SEQ ID NO: 884465 - DNA, 23 bp, Homo sapiens
tcatcctcacagtgaacactcag

SEQ ID NO: 884466 - DNA, 20 bp, Homo sapiens
tcatcctcccttgccccagg

SEQ ID NO: 884467 - DNA, 21 bp, Homo sapiens
tcatcctcccttgccccaggc

SEQ ID NO: 884468 - DNA, 16 bp, Homo sapiens
tcatcctcctttcagt

SEQ ID NO: 884469 - DNA, 19 bp, Homo sapiens
tcatcctctggaagggatg

SEQ ID NO: 884470 - DNA, 13 bp, Homo sapiens
tcatcctgagccc

SEQ ID NO: 884471 - DNA, 20 bp, Homo sapiens
tcatcctgctcttttgtgat

SEQ ID NO: 884472 - DNA, 21 bp, Homo sapiens
tcatcctgctcttttgtgatg

SEQ ID NO: 884473 - DNA, 12 bp, Homo sapiens
tcatcctgcttc

SEQ ID NO: 884474 - DNA, 21 bp, Homo sapiens
tcatcctgcttctcttttcct

SEQ ID NO: 884475 - DNA, 22 bp, Homo sapiens
tcatcctgcttctcttttcctc

SEQ ID NO: 884476 - DNA, 16 bp, Homo sapiens
tcatcctggcacgccc

SEQ ID NO: 884477 - DNA, 20 bp, Homo sapiens
tcatcctggcacgccctact

SEQ ID NO: 884478 - DNA, 22 bp, Homo sapiens
tcatcctggcacgccctactcc

SEQ ID NO: 884479 - DNA, 20 bp, Homo sapiens
tcatcctggcctccttttgc

SEQ ID NO: 884480 - DNA, 15 bp, Homo sapiens
tcatcctgtgctcgg

SEQ ID NO: 884481 - DNA, 13 bp, Homo sapiens
tcatcctgtgtcc

SEQ ID NO: 884482 - DNA, 12 bp, Homo sapiens
tcatcctgtttt

SEQ ID NO: 884483 - DNA, 13 bp, Homo sapiens
tcatcctgttttc

SEQ ID NO: 884484 - DNA, 13 bp, Homo sapiens
tcatccttcccca

SEQ ID NO: 884485 - DNA, 21 bp, Homo sapiens
tcatccttggtgctcttgctt

SEQ ID NO: 884486 - DNA, 13 bp, Homo sapiens
tcatcctttccct

SEQ ID NO: 884487 - DNA, 15 bp, Homo sapiens
tcatcctttccctct

SEQ ID NO: 884488 - DNA, 20 bp, Homo sapiens
tcatcctttccctctcccag

SEQ ID NO: 884489 - DNA, 23 bp, Homo sapiens
tcatcctttccctctcccagtcc

SEQ ID NO: 884490 - DNA, 17 bp, Homo sapiens
tcatccttttggataag

SEQ ID NO: 884491 - DNA, 21 bp, Homo sapiens
tcatcgaatctactaattcca

SEQ ID NO: 884492 - DNA, 15 bp, Homo sapiens
tcatcgccagaggtg

SEQ ID NO: 884493 - DNA, 14 bp, Homo sapiens
tcatcggaggctgg

SEQ ID NO: 884494 - DNA, 18 bp, Homo sapiens
tcatcgggcccagggaca

SEQ ID NO: 884495 - DNA, 14 bp, Homo sapiens
tcatcggtgcctgg

SEQ ID NO: 884496 - DNA, 15 bp, Homo sapiens
tcatcgtaaagtgct

SEQ ID NO: 884497 - DNA, 18 bp, Homo sapiens
tcatcgttccccacccct

SEQ ID NO: 884498 - DNA, 13 bp, Homo sapiens
tcatctaataaat

SEQ ID NO: 884499 - DNA, 17 bp, Homo sapiens
tcatctaataaatcagt

SEQ ID NO: 884500 - DNA, 21 bp, Homo sapiens
tcatctaattctggcaggacc

SEQ ID NO: 884501 - DNA, 17 bp, Homo sapiens
tcatctatgaggaaagg

SEQ ID NO: 884502 - DNA, 21 bp, Homo sapiens
tcatctattcaagcacttaca

SEQ ID NO: 884503 - DNA, 14 bp, Homo sapiens
tcatctatttctga

SEQ ID NO: 884504 - DNA, 14 bp, Homo sapiens
tcatctcatttaag

SEQ ID NO: 884505 - DNA, 14 bp, Homo sapiens
tcatctccagcctc

SEQ ID NO: 884506 - DNA, 20 bp, Homo sapiens
tcatctccatcatatgcctg

SEQ ID NO: 884507 - DNA, 12 bp, Homo sapiens
tcatctcccacc

SEQ ID NO: 884508 - DNA, 18 bp, Homo sapiens
tcatctcctgaccctccc

SEQ ID NO: 884509 - DNA, 15 bp, Homo sapiens
tcatctcctgagtat

SEQ ID NO: 884510 - DNA, 22 bp, Homo sapiens
tcatctcctgccttcctcctgg

SEQ ID NO: 884511 - DNA, 23 bp, Homo sapiens
tcatctcctgccttcctcctggg

SEQ ID NO: 884512 - DNA, 15 bp, Homo sapiens
tcatctccttcctga

SEQ ID NO: 884513 - DNA, 18 bp, Homo sapiens
tcatctcctttattgcag

SEQ ID NO: 884514 - DNA, 21 bp, Homo sapiens
tcatctcggctgttcctgaga

SEQ ID NO: 884515 - DNA, 14 bp, Homo sapiens
tcatctctacaaaa

SEQ ID NO: 884516 - DNA, 13 bp, Homo sapiens
tcatctctactaa

SEQ ID NO: 884517 - DNA, 20 bp, Homo sapiens
tcatctctctacctccaccc

SEQ ID NO: 884518 - DNA, 14 bp, Homo sapiens
tcatctctctgggg

SEQ ID NO: 884519 - DNA, 16 bp, Homo sapiens
tcatctctctggggcc

SEQ ID NO: 884520 - DNA, 20 bp, Homo sapiens
tcatctctctggggccctgg

SEQ ID NO: 884521 - DNA, 22 bp, Homo sapiens
tcatctctctggggccctgggc

SEQ ID NO: 884522 - DNA, 18 bp, Homo sapiens
tcatctctgaaaattctg

SEQ ID NO: 884523 - DNA, 12 bp, Homo sapiens
tcatctctggtt

SEQ ID NO: 884524 - DNA, 21 bp, Homo sapiens
tcatctctggttttcttgcca

SEQ ID NO: 884525 - DNA, 21 bp, Homo sapiens
tcatctcttaaattttgtttt

SEQ ID NO: 884526 - DNA, 21 bp, Homo sapiens
tcatctgattggacaggcatg

SEQ ID NO: 884527 - DNA, 16 bp, Homo sapiens
tcatctgcacccttct

SEQ ID NO: 884528 - DNA, 23 bp, Homo sapiens
tcatctgcacccttcttttctca

SEQ ID NO: 884529 - DNA, 16 bp, Homo sapiens
tcatctgcctgcgctc

SEQ ID NO: 884530 - DNA, 23 bp, Homo sapiens
tcatctggcaacatctttatccg

SEQ ID NO: 884531 - DNA, 12 bp, Homo sapiens
tcatctgggaaa

SEQ ID NO: 884532 - DNA, 18 bp, Homo sapiens
tcatctgggaaagacatc

SEQ ID NO: 884533 - DNA, 18 bp, Homo sapiens
tcatctggggacctggtt

SEQ ID NO: 884534 - DNA, 16 bp, Homo sapiens
tcatctgggtggtctg

SEQ ID NO: 884535 - DNA, 13 bp, Homo sapiens
tcatctgtaactc

SEQ ID NO: 884536 - DNA, 12 bp, Homo sapiens
tcatctgtccct

SEQ ID NO: 884537 - DNA, 18 bp, Homo sapiens
tcatctgtccctccggga

SEQ ID NO: 884538 - DNA, 21 bp, Homo sapiens
tcatctgtctttcactggaat

SEQ ID NO: 884539 - DNA, 22 bp, Homo sapiens
tcatctgtggagctgccacaga

SEQ ID NO: 884540 - DNA, 19 bp, Homo sapiens
tcatctgtgtgaaaatggg

SEQ ID NO: 884541 - DNA, 19 bp, Homo sapiens
tcatctgttagggccttgg

SEQ ID NO: 884542 - DNA, 16 bp, Homo sapiens
tcatctgttgttctgt

SEQ ID NO: 884543 - DNA, 17 bp, Homo sapiens
tcatctgttgttctgtg

SEQ ID NO: 884544 - DNA, 12 bp, Homo sapiens
tcatcttaaact

SEQ ID NO: 884545 - DNA, 13 bp, Homo sapiens
tcatcttaaacta

SEQ ID NO: 884546 - DNA, 21 bp, Homo sapiens
tcatcttcactgcaattttgt

SEQ ID NO: 884547 - DNA, 20 bp, Homo sapiens
tcatcttcagttgtctctga

SEQ ID NO: 884548 - DNA, 13 bp, Homo sapiens
tcatcttcctgtg

SEQ ID NO: 884549 - DNA, 15 bp, Homo sapiens
tcatcttcctgtgtc

SEQ ID NO: 884550 - DNA, 11 bp, Homo sapiens
tcatcttctct

SEQ ID NO: 884551 - DNA, 22 bp, Homo sapiens
tcatcttgatgtctatgataga

SEQ ID NO: 884552 - DNA, 23 bp, Homo sapiens
tcatcttgtgagtggataatcag

SEQ ID NO: 884553 - DNA, 14 bp, Homo sapiens
tcatcttttatcta

SEQ ID NO: 884554 - DNA, 22 bp, Homo sapiens
tcatgaaaacagcccctttacc

SEQ ID NO: 884555 - DNA, 23 bp, Homo sapiens
tcatgaaaagaggaacaggtgga

SEQ ID NO: 884556 - DNA, 15 bp, Homo sapiens
tcatgaaatatgcat

SEQ ID NO: 884557 - DNA, 15 bp, Homo sapiens
tcatgaacagctctg

SEQ ID NO: 884558 - DNA, 21 bp, Homo sapiens
tcatgaacagctctgagatcc

SEQ ID NO: 884559 - DNA, 23 bp, Homo sapiens
tcatgaacatgttcctgaattct

SEQ ID NO: 884560 - DNA, 15 bp, Homo sapiens
tcatgaagccttgct

SEQ ID NO: 884561 - DNA, 14 bp, Homo sapiens
tcatgaatatgatg

SEQ ID NO: 884562 - DNA, 19 bp, Homo sapiens
tcatgaatctttcatacat

SEQ ID NO: 884563 - DNA, 21 bp, Homo sapiens
tcatgaatctttcatacatat

SEQ ID NO: 884564 - DNA, 22 bp, Homo sapiens
tcatgaatctttcatacatata

SEQ ID NO: 884565 - DNA, 18 bp, Homo sapiens
tcatgaattttaaagtat

SEQ ID NO: 884566 - DNA, 16 bp, Homo sapiens
tcatgacagtgcttgc

SEQ ID NO: 884567 - DNA, 18 bp, Homo sapiens
tcatgacagtgcttgcat

SEQ ID NO: 884568 - DNA, 17 bp, Homo sapiens
tcatgacatgttatata

SEQ ID NO: 884569 - DNA, 21 bp, Homo sapiens
tcatgacatgttatatatttt

SEQ ID NO: 884570 - DNA, 13 bp, Homo sapiens
tcatgaccactgg

SEQ ID NO: 884571 - DNA, 15 bp, Homo sapiens
tcatgaccagcaaat

SEQ ID NO: 884572 - DNA, 15 bp, Homo sapiens
tcatgagaagccaag

SEQ ID NO: 884573 - DNA, 13 bp, Homo sapiens
tcatgagcctgct

SEQ ID NO: 884574 - DNA, 20 bp, Homo sapiens
tcatgaggaccagggtggag

SEQ ID NO: 884575 - DNA, 18 bp, Homo sapiens
tcatgataccacctttac

SEQ ID NO: 884576 - DNA, 13 bp, Homo sapiens
tcatgatccaact

SEQ ID NO: 884577 - DNA, 14 bp, Homo sapiens
tcatgatctccctg

SEQ ID NO: 884578 - DNA, 15 bp, Homo sapiens
tcatgatgctagcca

SEQ ID NO: 884579 - DNA, 18 bp, Homo sapiens
tcatgattatagcaacta

SEQ ID NO: 884580 - DNA, 15 bp, Homo sapiens
tcatgattccatgcc

SEQ ID NO: 884581 - DNA, 11 bp, Homo sapiens
tcatgcaaaat

SEQ ID NO: 884582 - DNA, 13 bp, Homo sapiens
tcatgcaaaatat

SEQ ID NO: 884583 - DNA, 20 bp, Homo sapiens
tcatgcaaatgctgtattct

SEQ ID NO: 884584 - DNA, 13 bp, Homo sapiens
tcatgcaatgaca

SEQ ID NO: 884585 - DNA, 15 bp, Homo sapiens
tcatgcaatgacatc

SEQ ID NO: 884586 - DNA, 21 bp, Homo sapiens
tcatgcacacaattagatttc

SEQ ID NO: 884587 - DNA, 20 bp, Homo sapiens
tcatgcacagtatttgtaat

SEQ ID NO: 884588 - DNA, 17 bp, Homo sapiens
tcatgcatagtcccagc

SEQ ID NO: 884589 - DNA, 12 bp, Homo sapiens
tcatgccagcta

SEQ ID NO: 884590 - DNA, 15 bp, Homo sapiens
tcatgccatctgttt

SEQ ID NO: 884591 - DNA, 13 bp, Homo sapiens
tcatgcccacccc

SEQ ID NO: 884592 - DNA, 15 bp, Homo sapiens
tcatgcccaccccct

SEQ ID NO: 884593 - DNA, 16 bp, Homo sapiens
tcatgcccaccccctg

SEQ ID NO: 884594 - DNA, 22 bp, Homo sapiens
tcatgcccaccccctgccctgc

SEQ ID NO: 884595 - DNA, 16 bp, Homo sapiens
tcatgcccagctctct

SEQ ID NO: 884596 - DNA, 22 bp, Homo sapiens
tcatgcccccctcaaacctcct

SEQ ID NO: 884597 - DNA, 16 bp, Homo sapiens
tcatgcctttgtaagt

SEQ ID NO: 884598 - DNA, 22 bp, Homo sapiens
tcatgcgatggtcccccacacc

SEQ ID NO: 884599 - DNA, 22 bp, Homo sapiens
tcatgcgttttatatcttccta

SEQ ID NO: 884600 - DNA, 15 bp, Homo sapiens
tcatgctccaagact

SEQ ID NO: 884601 - DNA, 13 bp, Homo sapiens
tcatgtacttttt

SEQ ID NO: 884602 - DNA, 15 bp, Homo sapiens
tcatgtactttttag

SEQ ID NO: 884603 - DNA, 17 bp, Homo sapiens
tcatgtagaactcagca

SEQ ID NO: 884604 - DNA, 17 bp, Homo sapiens
tcatgtagagaaaagca

SEQ ID NO: 884605 - DNA, 14 bp, Homo sapiens
tcatgtatgcaagt

SEQ ID NO: 884606 - DNA, 15 bp, Homo sapiens
tcatgtatgtatata

SEQ ID NO: 884607 - DNA, 19 bp, Homo sapiens
tcatgtatgttatgatatt

SEQ ID NO: 884608 - DNA, 21 bp, Homo sapiens
tcatgtatgttcagaagaaat

SEQ ID NO: 884609 - DNA, 22 bp, Homo sapiens
tcatgtatgttcagaagaaatt

SEQ ID NO: 884610 - DNA, 13 bp, Homo sapiens
tcatgtatgtttc

SEQ ID NO: 884611 - DNA, 16 bp, Homo sapiens
tcatgtatgtttctct

SEQ ID NO: 884612 - DNA, 21 bp, Homo sapiens
tcatgtcaacttctggctcct

SEQ ID NO: 884613 - DNA, 18 bp, Homo sapiens
tcatgtcacctacatatg

SEQ ID NO: 884614 - DNA, 14 bp, Homo sapiens
tcatgtcaggcctg

SEQ ID NO: 884615 - DNA, 15 bp, Homo sapiens
tcatgtccctccagg

SEQ ID NO: 884616 - DNA, 18 bp, Homo sapiens
tcatgtccctgtccccag

SEQ ID NO: 884617 - DNA, 14 bp, Homo sapiens
tcatgtcttgtcat

SEQ ID NO: 884618 - DNA, 15 bp, Homo sapiens
tcatgtgatgtcatg

SEQ ID NO: 884619 - DNA, 18 bp, Homo sapiens
tcatgtgcatctggtgta

SEQ ID NO: 884620 - DNA, 21 bp, Homo sapiens
tcatgtggactgggaccgtgc

SEQ ID NO: 884621 - DNA, 21 bp, Homo sapiens
tcatgtggcacttgggcattt

SEQ ID NO: 884622 - DNA, 20 bp, Homo sapiens
tcatgtggcccaactctcct

SEQ ID NO: 884623 - DNA, 15 bp, Homo sapiens
tcatgtggctcagtg

SEQ ID NO: 884624 - DNA, 13 bp, Homo sapiens
tcatgtggctgga

SEQ ID NO: 884625 - DNA, 20 bp, Homo sapiens
tcatgtgggtgagccagtgg

SEQ ID NO: 884626 - DNA, 22 bp, Homo sapiens
tcatgtgggtgagccagtggaa

SEQ ID NO: 884627 - DNA, 20 bp, Homo sapiens
tcatgtgtgcaacagggtat

SEQ ID NO: 884628 - DNA, 15 bp, Homo sapiens
tcatgtgtgcatgtg

SEQ ID NO: 884629 - DNA, 23 bp, Homo sapiens
tcatgtgtgtccacgactgtctc

SEQ ID NO: 884630 - DNA, 21 bp, Homo sapiens
tcatgttaacctctgctttta

SEQ ID NO: 884631 - DNA, 21 bp, Homo sapiens
tcatgttactaaatggtgtta

SEQ ID NO: 884632 - DNA, 22 bp, Homo sapiens
tcatgttatatttaatgcatta

SEQ ID NO: 884633 - DNA, 12 bp, Homo sapiens
tcatgttatttt

SEQ ID NO: 884634 - DNA, 17 bp, Homo sapiens
tcatgttcactgtgagt

SEQ ID NO: 884635 - DNA, 17 bp, Homo sapiens
tcatgttccttttgaaa

SEQ ID NO: 884636 - DNA, 20 bp, Homo sapiens
tcatgttctcttcccaggcc

SEQ ID NO: 884637 - DNA, 13 bp, Homo sapiens
tcatgttctgtgg

SEQ ID NO: 884638 - DNA, 17 bp, Homo sapiens
tcatgttcttaattctt

SEQ ID NO: 884639 - DNA, 19 bp, Homo sapiens
tcatgttgatcatgtactt

SEQ ID NO: 884640 - DNA, 21 bp, Homo sapiens
tcatgttgatcatgtactttt

SEQ ID NO: 884641 - DNA, 20 bp, Homo sapiens
tcatgtttaacgtttctcat

SEQ ID NO: 884642 - DNA, 22 bp, Homo sapiens
tcatgtttaacgtttctcatta

SEQ ID NO: 884643 - DNA, 17 bp, Homo sapiens
tcatgtttatgagaaac

SEQ ID NO: 884644 - DNA, 15 bp, Homo sapiens
tcatgtttcttaaat

SEQ ID NO: 884645 - DNA, 21 bp, Homo sapiens
tcatgtttgcttcataaatga

SEQ ID NO: 884646 - DNA, 15 bp, Homo sapiens
tcatgttttataatt

SEQ ID NO: 884647 - DNA, 16 bp, Homo sapiens
tcatgttttgtgacta

SEQ ID NO: 884648 - DNA, 22 bp, Homo sapiens
tcattaaaaattacctttaatt

SEQ ID NO: 884649 - DNA, 15 bp, Homo sapiens
tcattaaaatatatg

SEQ ID NO: 884650 - DNA, 18 bp, Homo sapiens
tcattaaaatatatgttc

SEQ ID NO: 884651 - DNA, 15 bp, Homo sapiens
tcattaaactgattc

SEQ ID NO: 884652 - DNA, 13 bp, Homo sapiens
tcattaaataaat

SEQ ID NO: 884653 - DNA, 19 bp, Homo sapiens
tcattaaataaatttgact

SEQ ID NO: 884654 - DNA, 13 bp, Homo sapiens
tcattaaatggaa

SEQ ID NO: 884655 - DNA, 16 bp, Homo sapiens
tcattaagtaatcttt

SEQ ID NO: 884656 - DNA, 23 bp, Homo sapiens
tcattaatagctgccttcaagga

SEQ ID NO: 884657 - DNA, 20 bp, Homo sapiens
tcattaatgatgatcttcag

SEQ ID NO: 884658 - DNA, 15 bp, Homo sapiens
tcattaattaacccc

SEQ ID NO: 884659 - DNA, 23 bp, Homo sapiens
tcattacagattctgctagcctg

SEQ ID NO: 884660 - DNA, 15 bp, Homo sapiens
tcattacagttcttt

SEQ ID NO: 884661 - DNA, 18 bp, Homo sapiens
tcattacagttctttcct

SEQ ID NO: 884662 - DNA, 21 bp, Homo sapiens
tcattacagttctttcctctt

SEQ ID NO: 884663 - DNA, 15 bp, Homo sapiens
tcattacatagaaca

SEQ ID NO: 884664 - DNA, 22 bp, Homo sapiens
tcattactacactggtgtgtcc

SEQ ID NO: 884665 - DNA, 15 bp, Homo sapiens
tcattactgggcctt

SEQ ID NO: 884666 - DNA, 17 bp, Homo sapiens
tcattactgttccagat

SEQ ID NO: 884667 - DNA, 19 bp, Homo sapiens
tcattacttgggaaatttt

SEQ ID NO: 884668 - DNA, 21 bp, Homo sapiens
tcattacttgggaaattttta

SEQ ID NO: 884669 - DNA, 13 bp, Homo sapiens
tcattaggcaaag

SEQ ID NO: 884670 - DNA, 15 bp, Homo sapiens
tcattaggcaaagta

SEQ ID NO: 884671 - DNA, 22 bp, Homo sapiens
tcattaggcaaagtacaaaatt

SEQ ID NO: 884672 - DNA, 12 bp, Homo sapiens
tcattataaaat

SEQ ID NO: 884673 - DNA, 15 bp, Homo sapiens
tcattataaacgtga

SEQ ID NO: 884674 - DNA, 23 bp, Homo sapiens
tcattataaacgtgatgatcagc

SEQ ID NO: 884675 - DNA, 14 bp, Homo sapiens
tcattatctgagtt

SEQ ID NO: 884676 - DNA, 21 bp, Homo sapiens
tcattttcctgttcagtgaga

SEQ ID NO: 884677 - DNA, 22 bp, Homo sapiens
tcattttctacgtcatgtattt

SEQ ID NO: 884678 - DNA, 12 bp, Homo sapiens
tcattttctaga

SEQ ID NO: 884679 - DNA, 14 bp, Homo sapiens
tcattttctagata

SEQ ID NO: 884680 - DNA, 13 bp, Homo sapiens
tcattttctggtt

SEQ ID NO: 884681 - DNA, 13 bp, Homo sapiens
tcattttgcagaa

SEQ ID NO: 884682 - DNA, 16 bp, Homo sapiens
tcattttgcagaagga

SEQ ID NO: 884683 - DNA, 22 bp, Homo sapiens
tcattttgcagaaggaaatgat

SEQ ID NO: 884684 - DNA, 14 bp, Homo sapiens
tcattttgcattca

SEQ ID NO: 884685 - DNA, 14 bp, Homo sapiens
tcattttggtactt

SEQ ID NO: 884686 - DNA, 16 bp, Homo sapiens
tcatttttaacagcat

SEQ ID NO: 884687 - DNA, 14 bp, Homo sapiens
tcatttttaatgta

SEQ ID NO: 884688 - DNA, 13 bp, Homo sapiens
tcatttttacact

SEQ ID NO: 884689 - DNA, 21 bp, Homo sapiens
tcatttttataacctggcaaa

SEQ ID NO: 884690 - DNA, 23 bp, Homo sapiens
tcatttttataacctggcaaaat

SEQ ID NO: 884691 - DNA, 13 bp, Homo sapiens
tcatttttatagc

SEQ ID NO: 884692 - DNA, 14 bp, Homo sapiens
tcatttttcactgt

SEQ ID NO: 884693 - DNA, 17 bp, Homo sapiens
tcatttttcactgtaca

SEQ ID NO: 884694 - DNA, 15 bp, Homo sapiens
tcatttttccgtaaa

SEQ ID NO: 884695 - DNA, 16 bp, Homo sapiens
tcatttttgtgcacag

SEQ ID NO: 884696 - DNA, 18 bp, Homo sapiens
tccacatgctgcctggca

SEQ ID NO: 884697 - DNA, 12 bp, Homo sapiens
tccacatgtaca

SEQ ID NO: 884698 - DNA, 13 bp, Homo sapiens
tccacatgtacat

SEQ ID NO: 884699 - DNA, 18 bp, Homo sapiens
tccaccaacccatcagaa

SEQ ID NO: 884700 - DNA, 20 bp, Homo sapiens
tccaccaagtgtctagagtc

SEQ ID NO: 884701 - DNA, 15 bp, Homo sapiens
tccaccacatctgcc

SEQ ID NO: 884702 - DNA, 13 bp, Homo sapiens
tccaccaccactg

SEQ ID NO: 884703 - DNA, 14 bp, Homo sapiens
tccaccaccactgg

SEQ ID NO: 884704 - DNA, 18 bp, Homo sapiens
tccaccaccactggccac

SEQ ID NO: 884705 - DNA, 23 bp, Homo sapiens
tccaccaccactggccaccaggc

SEQ ID NO: 884706 - DNA, 13 bp, Homo sapiens
tccaccacccaaa

SEQ ID NO: 884707 - DNA, 17 bp, Homo sapiens
tccaccacccaaaagtc

SEQ ID NO: 884708 - DNA, 12 bp, Homo sapiens
tccaccagaccc

SEQ ID NO: 884709 - DNA, 13 bp, Homo sapiens
tccaccagaccca

SEQ ID NO: 884710 - DNA, 15 bp, Homo sapiens
tccaccagcctgctg

SEQ ID NO: 884711 - DNA, 17 bp, Homo sapiens
tccaccagcctgctgac

SEQ ID NO: 884712 - DNA, 17 bp, Homo sapiens
tccaccaggccgtgcct

SEQ ID NO: 884713 - DNA, 19 bp, Homo sapiens
tccaccaggccgtgccttg

SEQ ID NO: 884714 - DNA, 17 bp, Homo sapiens
tccaccaggcctcactg

SEQ ID NO: 884715 - DNA, 16 bp, Homo sapiens
tccaccagtttataca

SEQ ID NO: 884716 - DNA, 18 bp, Homo sapiens
tccaccagtttatacaga

SEQ ID NO: 884717 - DNA, 23 bp, Homo sapiens
tccaccatcactcactcactccc

SEQ ID NO: 884718 - DNA, 14 bp, Homo sapiens
tccaccatgcagaa

SEQ ID NO: 884719 - DNA, 17 bp, Homo sapiens
tccaccattcacatttg

SEQ ID NO: 884720 - DNA, 19 bp, Homo sapiens
tccacccaaaccccttccc

SEQ ID NO: 884721 - DNA, 20 bp, Homo sapiens
tccacccaaaccccttccca

SEQ ID NO: 884722 - DNA, 23 bp, Homo sapiens
tccacccaaccctatctcctgac

SEQ ID NO: 884723 - DNA, 12 bp, Homo sapiens
tccacccagccc

SEQ ID NO: 884724 - DNA, 15 bp, Homo sapiens
tccacccagcccatt

SEQ ID NO: 884725 - DNA, 13 bp, Homo sapiens
tccacccagcccc

SEQ ID NO: 884726 - DNA, 17 bp, Homo sapiens
tccacccagcccctggc

SEQ ID NO: 884727 - DNA, 13 bp, Homo sapiens
tccacccaggctg

SEQ ID NO: 884728 - DNA, 16 bp, Homo sapiens
tccacccaggctgcac

SEQ ID NO: 884729 - DNA, 20 bp, Homo sapiens
tccacccaggctgcactgca

SEQ ID NO: 884730 - DNA, 22 bp, Homo sapiens
tccacccaggctgcactgcagt

SEQ ID NO: 884731 - DNA, 23 bp, Homo sapiens
tccacccaggctgcactgcagtg

SEQ ID NO: 884732 - DNA, 22 bp, Homo sapiens
tccacccatcctaccaatgcat

SEQ ID NO: 884733 - DNA, 19 bp, Homo sapiens
tccaccccaagagaactcg

SEQ ID NO: 884734 - DNA, 12 bp, Homo sapiens
tccaccccatcc

SEQ ID NO: 884735 - DNA, 19 bp, Homo sapiens
tccacccccagaggaagtg

SEQ ID NO: 884736 - DNA, 15 bp, Homo sapiens
tccacccccaggtgc

SEQ ID NO: 884737 - DNA, 18 bp, Homo sapiens
tccacccccatgtggcag

SEQ ID NO: 884738 - DNA, 21 bp, Homo sapiens
tccacccccatgtggcagccc

SEQ ID NO: 884739 - DNA, 22 bp, Homo sapiens
tccacccccatgtggcagccca

SEQ ID NO: 884740 - DNA, 22 bp, Homo sapiens
tccaccccccactcagtgcctc

SEQ ID NO: 884741 - DNA, 20 bp, Homo sapiens
tccacccccgccacggccac

SEQ ID NO: 884742 - DNA, 21 bp, Homo sapiens
tccacccccgccacggccacc

SEQ ID NO: 884743 - DNA, 23 bp, Homo sapiens
tccacccccgccacggccaccct

SEQ ID NO: 884744 - DNA, 13 bp, Homo sapiens
tccaccccctccc

SEQ ID NO: 884745 - DNA, 18 bp, Homo sapiens
tccaccccctccctggcc

SEQ ID NO: 884746 - DNA, 17 bp, Homo sapiens
tccacccgctgcccctc

SEQ ID NO: 884747 - DNA, 19 bp, Homo sapiens
tccacccgggggagcccag

SEQ ID NO: 884748 - DNA, 15 bp, Homo sapiens
tccacccgtcctccc

SEQ ID NO: 884749 - DNA, 20 bp, Homo sapiens
tccacccgtcctccctcagc

SEQ ID NO: 884750 - DNA, 18 bp, Homo sapiens
tccaccctcatttttcct

SEQ ID NO: 884751 - DNA, 12 bp, Homo sapiens
tccaccctcctc

SEQ ID NO: 884752 - DNA, 15 bp, Homo sapiens
tccaccctcctctag

SEQ ID NO: 884753 - DNA, 18 bp, Homo sapiens
tccaccctcctctagcca

SEQ ID NO: 884754 - DNA, 12 bp, Homo sapiens
tccaccctgcat

SEQ ID NO: 884755 - DNA, 20 bp, Homo sapiens
tccaccctgccaagactcct

SEQ ID NO: 884756 - DNA, 23 bp, Homo sapiens
tccaccctgccaagactcctcag

SEQ ID NO: 884757 - DNA, 21 bp, Homo sapiens
tccaccctgtcccccagctct

SEQ ID NO: 884758 - DNA, 14 bp, Homo sapiens
tccaccctgttagt

SEQ ID NO: 884759 - DNA, 15 bp, Homo sapiens
tccaccctgttagtt

SEQ ID NO: 884760 - DNA, 14 bp, Homo sapiens
tccacccttccatc

SEQ ID NO: 884761 - DNA, 15 bp, Homo sapiens
tccacccttggcctg

SEQ ID NO: 884762 - DNA, 19 bp, Homo sapiens
tccacccttggcctgtctc

SEQ ID NO: 884763 - DNA, 17 bp, Homo sapiens
tccaccgaccaactgcc

SEQ ID NO: 884764 - DNA, 19 bp, Homo sapiens
tccaccgaccaactgccct

SEQ ID NO: 884765 - DNA, 20 bp, Homo sapiens
tccaccgaccaactgcccta

SEQ ID NO: 884766 - DNA, 19 bp, Homo sapiens
tccaccgctgcctaagtgg

SEQ ID NO: 884767 - DNA, 13 bp, Homo sapiens
tccacctcagcct

SEQ ID NO: 884768 - DNA, 14 bp, Homo sapiens
tccacctcagcctc

SEQ ID NO: 884769 - DNA, 14 bp, Homo sapiens
tccacctcagcctt

SEQ ID NO: 884770 - DNA, 16 bp, Homo sapiens
tccacctcatcactgg

SEQ ID NO: 884771 - DNA, 24 bp, Homo sapiens
tccacctcatcactggactgcatg

SEQ ID NO: 884772 - DNA, 21 bp, Homo sapiens
tccacctcatggattgccaca

SEQ ID NO: 884773 - DNA, 22 bp, Homo sapiens
tccacctcatggattgccacag

SEQ ID NO: 884774 - DNA, 14 bp, Homo sapiens
tccacctccctacc

SEQ ID NO: 884775 - DNA, 16 bp, Homo sapiens
tccacctctggtggct

SEQ ID NO: 884776 - DNA, 18 bp, Homo sapiens
tccacctcttcacccccc

SEQ ID NO: 884777 - DNA, 12 bp, Homo sapiens
tccacctgcctt

SEQ ID NO: 884778 - DNA, 14 bp, Homo sapiens
tccacctgccttgg

SEQ ID NO: 884779 - DNA, 17 bp, Homo sapiens
tccacctggccccatgt

SEQ ID NO: 884780 - DNA, 16 bp, Homo sapiens
tccacctgtctcagcc

SEQ ID NO: 884781 - DNA, 16 bp, Homo sapiens
tccacctgtgccctca

SEQ ID NO: 884782 - DNA, 14 bp, Homo sapiens
tccacctgtgctgc

SEQ ID NO: 884783 - DNA, 15 bp, Homo sapiens
tccacctgtgctgct

SEQ ID NO: 884784 - DNA, 17 bp, Homo sapiens
tccacctgtgctgctgc

SEQ ID NO: 884785 - DNA, 12 bp, Homo sapiens
tccacctgtggg

SEQ ID NO: 884786 - DNA, 18 bp, Homo sapiens
tccaccttaaattaaaca

SEQ ID NO: 884787 - DNA, 15 bp, Homo sapiens
tccaccttcccatgc

SEQ ID NO: 884788 - DNA, 13 bp, Homo sapiens
tccaccttccctt

SEQ ID NO: 884789 - DNA, 14 bp, Homo sapiens
tccacctttcccaa

SEQ ID NO: 884790 - DNA, 17 bp, Homo sapiens
tccacgactgtctccat

SEQ ID NO: 884791 - DNA, 15 bp, Homo sapiens
tccacgcagcaccct

SEQ ID NO: 884792 - DNA, 15 bp, Homo sapiens
tccacgcctcctggc

SEQ ID NO: 884793 - DNA, 17 bp, Homo sapiens
tccacgcctcctggcca

SEQ ID NO: 884794 - DNA, 16 bp, Homo sapiens
tccacgctgtctccag

SEQ ID NO: 884795 - DNA, 21 bp, Homo sapiens
tccacgctgtctccagacccc

SEQ ID NO: 884796 - DNA, 22 bp, Homo sapiens
tccacgctgtctccagaccccc

SEQ ID NO: 884797 - DNA, 23 bp, Homo sapiens
tccacgctgtctccagaccccca

SEQ ID NO: 884798 - DNA, 22 bp, Homo sapiens
tccacggagccactcctctgac

SEQ ID NO: 884799 - DNA, 18 bp, Homo sapiens
tccacggtccgcggcctg

SEQ ID NO: 884800 - DNA, 18 bp, Homo sapiens
tccacggtctgttcttga

SEQ ID NO: 884801 - DNA, 13 bp, Homo sapiens
tccacggtgcgtg

SEQ ID NO: 884802 - DNA, 15 bp, Homo sapiens
tccacggtgcgtggc

SEQ ID NO: 884803 - DNA, 15 bp, Homo sapiens
tccacgtggcctctc

SEQ ID NO: 884804 - DNA, 19 bp, Homo sapiens
tccacgtggcctctctctc

SEQ ID NO: 884805 - DNA, 20 bp, Homo sapiens
tccacgtgtccgtccaccct

SEQ ID NO: 884806 - DNA, 19 bp, Homo sapiens
tccacgttctgctcatcat

SEQ ID NO: 884807 - DNA, 21 bp, Homo sapiens
tccacgttctgctcatcattc

SEQ ID NO: 884808 - DNA, 14 bp, Homo sapiens
tccactaaaaatat

SEQ ID NO: 884809 - DNA, 18 bp, Homo sapiens
tccactacacctggctga

SEQ ID NO: 884810 - DNA, 18 bp, Homo sapiens
tccactagtgcaaatcat

SEQ ID NO: 884811 - DNA, 13 bp, Homo sapiens
tccactattttca

SEQ ID NO: 884812 - DNA, 18 bp, Homo sapiens
tccactattttcaaagaa

SEQ ID NO: 884813 - DNA, 15 bp, Homo sapiens
tccactcactccagc

SEQ ID NO: 884814 - DNA, 16 bp, Homo sapiens
tccactcactccagcc

SEQ ID NO: 884815 - DNA, 17 bp, Homo sapiens
tccactcactccagccc

SEQ ID NO: 884816 - DNA, 22 bp, Homo sapiens
tccactcagctgtcctgcagca

SEQ ID NO: 884817 - DNA, 18 bp, Homo sapiens
tccactccagctctgaga

SEQ ID NO: 884818 - DNA, 15 bp, Homo sapiens
tccactccattgtcg

SEQ ID NO: 884819 - DNA, 17 bp, Homo sapiens
tccactcgacccagaat

SEQ ID NO: 884820 - DNA, 18 bp, Homo sapiens
tccactcgtgtgtttcta

SEQ ID NO: 884821 - DNA, 17 bp, Homo sapiens
tccactctaccctccca

SEQ ID NO: 884822 - DNA, 18 bp, Homo sapiens
tccactctagttctagat

SEQ ID NO: 884823 - DNA, 14 bp, Homo sapiens
tccactctgcttct

SEQ ID NO: 884824 - DNA, 23 bp, Homo sapiens
tccactctgcttctctgacttct

SEQ ID NO: 884825 - DNA, 24 bp, Homo sapiens
tccactctgcttctctgacttctg

SEQ ID NO: 884826 - DNA, 20 bp, Homo sapiens
tccactctggattcagcctt

SEQ ID NO: 884827 - DNA, 22 bp, Homo sapiens
tccactctggattcagccttct

SEQ ID NO: 884828 - DNA, 14 bp, Homo sapiens
tccactgaaaattt

SEQ ID NO: 884829 - DNA, 15 bp, Homo sapiens
tccactgaacaaaac

SEQ ID NO: 884830 - DNA, 15 bp, Homo sapiens
tccactgagggcagt

SEQ ID NO: 884831 - DNA, 17 bp, Homo sapiens
tccactgcaaataaagc

SEQ ID NO: 884832 - DNA, 19 bp, Homo sapiens
tccactgcaaataaagcct

SEQ ID NO: 884833 - DNA, 20 bp, Homo sapiens
tccactgcaaataaagcctt

SEQ ID NO: 884834 - DNA, 17 bp, Homo sapiens
tccactgcaagtctgtg

SEQ ID NO: 884835 - DNA, 12 bp, Homo sapiens
tccactgccctg

SEQ ID NO: 884836 - DNA, 13 bp, Homo sapiens
tccactgccctgg

SEQ ID NO: 884837 - DNA, 15 bp, Homo sapiens
tccactgccctggca

SEQ ID NO: 884838 - DNA, 22 bp, Homo sapiens
tccactgccttcgatacaccgg

SEQ ID NO: 884839 - DNA, 14 bp, Homo sapiens
tccactgctggaca

SEQ ID NO: 884840 - DNA, 17 bp, Homo sapiens
tccactggacttgagct

SEQ ID NO: 884841 - DNA, 23 bp, Homo sapiens
tccactggggaatgctcccagct

SEQ ID NO: 884842 - DNA, 19 bp, Homo sapiens
tccactgtatattttttaa

SEQ ID NO: 884843 - DNA, 11 bp, Homo sapiens
tccactgtcct

SEQ ID NO: 884844 - DNA, 18 bp, Homo sapiens
tccactgtcctccttggc

SEQ ID NO: 884845 - DNA, 17 bp, Homo sapiens
tccactgtgcctttgca

SEQ ID NO: 884846 - DNA, 18 bp, Homo sapiens
tccactgtgtgttgacac

SEQ ID NO: 884847 - DNA, 23 bp, Homo sapiens
tccactgtgtgttgacactgttt

SEQ ID NO: 884848 - DNA, 23 bp, Homo sapiens
tccactgttgggtgggtgggccc

SEQ ID NO: 884849 - DNA, 12 bp, Homo sapiens
tccacttctctg

SEQ ID NO: 884850 - DNA, 16 bp, Homo sapiens
tccacttctctgggtc

SEQ ID NO: 884851 - DNA, 20 bp, Homo sapiens
tccacttctggtcccctgtg

SEQ ID NO: 884852 - DNA, 17 bp, Homo sapiens
tccacttcttcctttct

SEQ ID NO: 884853 - DNA, 17 bp, Homo sapiens
tccacttgccctgttct

SEQ ID NO: 884854 - DNA, 18 bp, Homo sapiens
tccacttgccctgttctc

SEQ ID NO: 884855 - DNA, 11 bp, Homo sapiens
tccacttgtat

SEQ ID NO: 884856 - DNA, 22 bp, Homo sapiens
tccacttgtatatatggatcag

SEQ ID NO: 884857 - DNA, 22 bp, Homo sapiens
tccactttgctggttcagcctt

SEQ ID NO: 884858 - DNA, 16 bp, Homo sapiens
tccactttgttcttta

SEQ ID NO: 884859 - DNA, 21 bp, Homo sapiens
tccactttgttggcccttcca

SEQ ID NO: 884860 - DNA, 22 bp, Homo sapiens
tccactttgtttcgtggggagg

SEQ ID NO: 884861 - DNA, 18 bp, Homo sapiens
tccacttttcttcttcct

SEQ ID NO: 884862 - DNA, 20 bp, Homo sapiens
tccacttttttttgtatgtt

SEQ ID NO: 884863 - DNA, 18 bp, Homo sapiens
tccagaaaacctctcctg

SEQ ID NO: 884864 - DNA, 15 bp, Homo sapiens
tccagaaacagctgc

SEQ ID NO: 884865 - DNA, 22 bp, Homo sapiens
tccagaaacagctgcttctccc

SEQ ID NO: 884866 - DNA, 21 bp, Homo sapiens
tccagaaacggccattcagca

SEQ ID NO: 884867 - DNA, 20 bp, Homo sapiens
tccagaaactcctgtttctc

SEQ ID NO: 884868 - DNA, 11 bp, Homo sapiens
tccagaaagaa

SEQ ID NO: 884869 - DNA, 17 bp, Homo sapiens
tccagaaaggatattta

SEQ ID NO: 884870 - DNA, 19 bp, Homo sapiens
tccagaaaggatatttaag

SEQ ID NO: 884871 - DNA, 22 bp, Homo sapiens
tccagaaataaaacaactctga

SEQ ID NO: 884872 - DNA, 16 bp, Homo sapiens
tccagaacacaacctt

SEQ ID NO: 884873 - DNA, 22 bp, Homo sapiens
tccagaactcactggggcctac

SEQ ID NO: 884874 - DNA, 13 bp, Homo sapiens
tccagaagaacaa

SEQ ID NO: 884875 - DNA, 15 bp, Homo sapiens
tccagaagaagagaa

SEQ ID NO: 884876 - DNA, 17 bp, Homo sapiens
tccagaagaagagaagc

SEQ ID NO: 884877 - DNA, 23 bp, Homo sapiens
tccagaagaagagaagctgctga

SEQ ID NO: 884878 - DNA, 17 bp, Homo sapiens
tccagaagaatattcag

SEQ ID NO: 884879 - DNA, 16 bp, Homo sapiens
tccagaagatgccagc

SEQ ID NO: 884880 - DNA, 19 bp, Homo sapiens
tccagaagatgccagcttc

SEQ ID NO: 884881 - DNA, 20 bp, Homo sapiens
tccagaagatgccagcttct

SEQ ID NO: 884882 - DNA, 18 bp, Homo sapiens
tccagaagatgccctcca

SEQ ID NO: 884883 - DNA, 17 bp, Homo sapiens
tccagaaggcagcaaag

SEQ ID NO: 884884 - DNA, 15 bp, Homo sapiens
tccagaaggggagct

SEQ ID NO: 884885 - DNA, 15 bp, Homo sapiens
tccagaagtccctcc

SEQ ID NO: 884886 - DNA, 18 bp, Homo sapiens
tccagaagttcaaaatca

SEQ ID NO: 884887 - DNA, 14 bp, Homo sapiens
tccagaatatctgg

SEQ ID NO: 884888 - DNA, 15 bp, Homo sapiens
tccagaatctgctgt

SEQ ID NO: 884889 - DNA, 16 bp, Homo sapiens
tccagaatctgctgtt

SEQ ID NO: 884890 - DNA, 19 bp, Homo sapiens
tccagaatctgctgttgcc

SEQ ID NO: 884891 - DNA, 21 bp, Homo sapiens
tccagaatcttgactttctga

SEQ ID NO: 884892 - DNA, 13 bp, Homo sapiens
tccagaatgctgt

SEQ ID NO: 884893 - DNA, 17 bp, Homo sapiens
tccagaatgctgtacat

SEQ ID NO: 884894 - DNA, 13 bp, Homo sapiens
tccagaatgtaag

SEQ ID NO: 884895 - DNA, 22 bp, Homo sapiens
tccagaatttattagtttaaaa

SEQ ID NO: 884896 - DNA, 12 bp, Homo sapiens
tccagacaaatt

SEQ ID NO: 884897 - DNA, 20 bp, Homo sapiens
tccagacaaatttaaaggaa

SEQ ID NO: 884898 - DNA, 13 bp, Homo sapiens
tccagacactttt

SEQ ID NO: 884899 - DNA, 12 bp, Homo sapiens
tccagacagtcg

SEQ ID NO: 884900 - DNA, 22 bp, Homo sapiens
tccagacagtcgctcagtctgt

SEQ ID NO: 884901 - DNA, 19 bp, Homo sapiens
tccagacattctcgcttcc

SEQ ID NO: 884902 - DNA, 14 bp, Homo sapiens
tccagacccagagg

SEQ ID NO: 884903 - DNA, 21 bp, Homo sapiens
tccagacccagaggccctgaa

SEQ ID NO: 884904 - DNA, 22 bp, Homo sapiens
tccagacccagaggccctgaag

SEQ ID NO: 884905 - DNA, 14 bp, Homo sapiens
tccagacccccacc

SEQ ID NO: 884906 - DNA, 17 bp, Homo sapiens
tccagacccccacccct

SEQ ID NO: 884907 - DNA, 14 bp, Homo sapiens
tccagacccccagc

SEQ ID NO: 884908 - DNA, 16 bp, Homo sapiens
tccagacccccagcaa

SEQ ID NO: 884909 - DNA, 21 bp, Homo sapiens
tccagacccccagcaaccctc

SEQ ID NO: 884910 - DNA, 15 bp, Homo sapiens
tccagaccccctgag

SEQ ID NO: 884911 - DNA, 18 bp, Homo sapiens
tccagacccctggctttt

SEQ ID NO: 884912 - DNA, 14 bp, Homo sapiens
tccagaccctgcct

SEQ ID NO: 884913 - DNA, 17 bp, Homo sapiens
tccagaccctgcctgag

SEQ ID NO: 884914 - DNA, 20 bp, Homo sapiens
tccagaccctgcctgagccc

SEQ ID NO: 884915 - DNA, 19 bp, Homo sapiens
tccagactgtaagatgttg

SEQ ID NO: 884916 - DNA, 19 bp, Homo sapiens
tccagacttccttgagaca

SEQ ID NO: 884917 - DNA, 21 bp, Homo sapiens
tccagagaactgcagacctca

SEQ ID NO: 884918 - DNA, 22 bp, Homo sapiens
tccagagaagccccgcacgggc

SEQ ID NO: 884919 - DNA, 14 bp, Homo sapiens
tccagagacaacag

SEQ ID NO: 884920 - DNA, 15 bp, Homo sapiens
tccagagacaacagg

SEQ ID NO: 884921 - DNA, 14 bp, Homo sapiens
tccagagagcagct

SEQ ID NO: 884922 - DNA, 18 bp, Homo sapiens
tccagagagcagctccct

SEQ ID NO: 884923 - DNA, 18 bp, Homo sapiens
tccagagagtcctctgga

SEQ ID NO: 884924 - DNA, 16 bp, Homo sapiens
tccagagagtggctcc

SEQ ID NO: 884925 - DNA, 19 bp, Homo sapiens
tccagagagtggctcctcc

SEQ ID NO: 884926 - DNA, 16 bp, Homo sapiens
tccagagattcatttt

SEQ ID NO: 884927 - DNA, 18 bp, Homo sapiens
tccagagattcattttct

SEQ ID NO: 884928 - DNA, 15 bp, Homo sapiens
tccagagcagagcct

SEQ ID NO: 884929 - DNA, 15 bp, Homo sapiens
tccagagcagagttt

SEQ ID NO: 884930 - DNA, 23 bp, Homo sapiens
tccagagcagagtttacgggtct

SEQ ID NO: 884931 - DNA, 10 bp, Homo sapiens
tccagagcca

SEQ ID NO: 884932 - DNA, 13 bp, Homo sapiens
tccagagccagcc

SEQ ID NO: 884933 - DNA, 15 bp, Homo sapiens
tccagagccagcctg

SEQ ID NO: 884934 - DNA, 16 bp, Homo sapiens
tccagagccagcctgg

SEQ ID NO: 884935 - DNA, 23 bp, Homo sapiens
tccagagccggcatccttgcctg

SEQ ID NO: 884936 - DNA, 13 bp, Homo sapiens
tccagagctgttt

SEQ ID NO: 884937 - DNA, 15 bp, Homo sapiens
tccagagctgtttgg

SEQ ID NO: 884938 - DNA, 13 bp, Homo sapiens
tccctctgcccca

SEQ ID NO: 884939 - DNA, 16 bp, Homo sapiens
tccctctgccccaagc

SEQ ID NO: 884940 - DNA, 20 bp, Homo sapiens
tccctctgccccaagcagcc

SEQ ID NO: 884941 - DNA, 22 bp, Homo sapiens
tccctctgccccaagcagccag

SEQ ID NO: 884942 - DNA, 17 bp, Homo sapiens
tccctctggccctgcct

SEQ ID NO: 884943 - DNA, 18 bp, Homo sapiens
tccctctggccctgcctt

SEQ ID NO: 884944 - DNA, 12 bp, Homo sapiens
tccctctggctt

SEQ ID NO: 884945 - DNA, 23 bp, Homo sapiens
tccctctgggcacgcctgctggc

SEQ ID NO: 884946 - DNA, 20 bp, Homo sapiens
tccctctgtcatcctcagga

SEQ ID NO: 884947 - DNA, 12 bp, Homo sapiens
tccctctgtctt

SEQ ID NO: 884948 - DNA, 22 bp, Homo sapiens
tccctctgtcttttctcctccg

SEQ ID NO: 884949 - DNA, 19 bp, Homo sapiens
tccctctgttaggtccatt

SEQ ID NO: 884950 - DNA, 21 bp, Homo sapiens
tccctcttagtctaggtcctt

SEQ ID NO: 884951 - DNA, 16 bp, Homo sapiens
tccctcttcactcccc

SEQ ID NO: 884952 - DNA, 21 bp, Homo sapiens
tccctcttcactgtggccaca

SEQ ID NO: 884953 - DNA, 15 bp, Homo sapiens
tccctcttcctctcc

SEQ ID NO: 884954 - DNA, 16 bp, Homo sapiens
tccctcttcctctcca

SEQ ID NO: 884955 - DNA, 15 bp, Homo sapiens
tccctcttccttccc

SEQ ID NO: 884956 - DNA, 16 bp, Homo sapiens
tccctcttccttcccc

SEQ ID NO: 884957 - DNA, 18 bp, Homo sapiens
tccctcttccttccccca

SEQ ID NO: 884958 - DNA, 15 bp, Homo sapiens
tccctcttctctcct

SEQ ID NO: 884959 - DNA, 14 bp, Homo sapiens
tccctcttctgccc

SEQ ID NO: 884960 - DNA, 13 bp, Homo sapiens
tccctcttggttt

SEQ ID NO: 884961 - DNA, 13 bp, Homo sapiens
tccctcttgtaag

SEQ ID NO: 884962 - DNA, 10 bp, Homo sapiens
tccctctttt

SEQ ID NO: 884963 - DNA, 16 bp, Homo sapiens
tccctcttttcttact

SEQ ID NO: 884964 - DNA, 15 bp, Homo sapiens
tccctgaaaacccag

SEQ ID NO: 884965 - DNA, 16 bp, Homo sapiens
tccctgaaaacccaga

SEQ ID NO: 884966 - DNA, 22 bp, Homo sapiens
tccctgaaacacgaaacttgtt

SEQ ID NO: 884967 - DNA, 13 bp, Homo sapiens
tccctgaactttt

SEQ ID NO: 884968 - DNA, 16 bp, Homo sapiens
tccctgaagagacagg

SEQ ID NO: 884969 - DNA, 17 bp, Homo sapiens
tccctgaatctgtgcct

SEQ ID NO: 884970 - DNA, 18 bp, Homo sapiens
tccctgaatctgtgcctg

SEQ ID NO: 884971 - DNA, 20 bp, Homo sapiens
tccctgaccttagcgttctg

SEQ ID NO: 884972 - DNA, 21 bp, Homo sapiens
tccctgaccttagcgttctgg

SEQ ID NO: 884973 - DNA, 22 bp, Homo sapiens
tccctgactcattctgaaggag

SEQ ID NO: 884974 - DNA, 22 bp, Homo sapiens
tccctgacttctcccccgccct

SEQ ID NO: 884975 - DNA, 23 bp, Homo sapiens
tccctgacttctcccccgccctg

SEQ ID NO: 884976 - DNA, 16 bp, Homo sapiens
tccctgacttttctgt

SEQ ID NO: 884977 - DNA, 14 bp, Homo sapiens
tccctgaggaatga

SEQ ID NO: 884978 - DNA, 15 bp, Homo sapiens
tccctgaggactgat

SEQ ID NO: 884979 - DNA, 23 bp, Homo sapiens
tccctgaggatgggtcagagcta

SEQ ID NO: 884980 - DNA, 16 bp, Homo sapiens
tccctgagtctggacc

SEQ ID NO: 884981 - DNA, 18 bp, Homo sapiens
tccctgagtctggacctc

SEQ ID NO: 884982 - DNA, 20 bp, Homo sapiens
tccctgagtctggacctcca

SEQ ID NO: 884983 - DNA, 21 bp, Homo sapiens
tccctgagtgcgggctgaggc

SEQ ID NO: 884984 - DNA, 17 bp, Homo sapiens
tccctgatcccaccccc

SEQ ID NO: 884985 - DNA, 16 bp, Homo sapiens
tccctgatggaccctc

SEQ ID NO: 884986 - DNA, 16 bp, Homo sapiens
tccctgattgacctgc

SEQ ID NO: 884987 - DNA, 19 bp, Homo sapiens
tccctgattgacctgctcc

SEQ ID NO: 884988 - DNA, 20 bp, Homo sapiens
tccctgattgacctgctccg

SEQ ID NO: 884989 - DNA, 23 bp, Homo sapiens
tccctgattgacctgctccgctg

SEQ ID NO: 884990 - DNA, 16 bp, Homo sapiens
tccctgcaaccaacta

SEQ ID NO: 884991 - DNA, 23 bp, Homo sapiens
tccctgcacagtgacttctgaga

SEQ ID NO: 884992 - DNA, 11 bp, Homo sapiens
tccctgcaccc

SEQ ID NO: 884993 - DNA, 15 bp, Homo sapiens
tccctgcaccctgga

SEQ ID NO: 884994 - DNA, 20 bp, Homo sapiens
tccctgcaccgccgcagaag

SEQ ID NO: 884995 - DNA, 22 bp, Homo sapiens
tccctgcagatgccaccctagc

SEQ ID NO: 884996 - DNA, 20 bp, Homo sapiens
tccctgcatcctgaggccag

SEQ ID NO: 884997 - DNA, 21 bp, Homo sapiens
tccctgcatctgaccagcagc

SEQ ID NO: 884998 - DNA, 21 bp, Homo sapiens
tccctgccacactcagtcccc

SEQ ID NO: 884999 - DNA, 12 bp, Homo sapiens
tccctgccactg

SEQ ID NO: 885000 - DNA, 13 bp, Homo sapiens
tccctgccactgg

SEQ ID NO: 885001 - DNA, 15 bp, Homo sapiens
tccctgccactgggc

SEQ ID NO: 885002 - DNA, 18 bp, Homo sapiens
tccctgccactgggctct

SEQ ID NO: 885003 - DNA, 22 bp, Homo sapiens
tccctgccactgggctctggac

SEQ ID NO: 885004 - DNA, 15 bp, Homo sapiens
tccctgccatccccc

SEQ ID NO: 885005 - DNA, 21 bp, Homo sapiens
tccctgccattttttaagaga

SEQ ID NO: 885006 - DNA, 21 bp, Homo sapiens
tccctgcccaaactccccttc

SEQ ID NO: 885007 - DNA, 16 bp, Homo sapiens
tccctgccccaccacg

SEQ ID NO: 885008 - DNA, 14 bp, Homo sapiens
tccctgccccgccc

SEQ ID NO: 885009 - DNA, 20 bp, Homo sapiens
tccctgccccgccccccaga

SEQ ID NO: 885010 - DNA, 18 bp, Homo sapiens
tccctgcccctcccttca

SEQ ID NO: 885011 - DNA, 14 bp, Homo sapiens
tccctgcccctgtc

SEQ ID NO: 885012 - DNA, 15 bp, Homo sapiens
tccctgcgagacgca

SEQ ID NO: 885013 - DNA, 15 bp, Homo sapiens
tccctgcgcccttga

SEQ ID NO: 885014 - DNA, 17 bp, Homo sapiens
tccctgcgcccttgagg

SEQ ID NO: 885015 - DNA, 22 bp, Homo sapiens
tccctgcggcctccacacctga

SEQ ID NO: 885016 - DNA, 10 bp, Homo sapiens
tccctgctcc

SEQ ID NO: 885017 - DNA, 14 bp, Homo sapiens
tccctgctcccctt

SEQ ID NO: 885018 - DNA, 16 bp, Homo sapiens
tccctgctcccctttg

SEQ ID NO: 885019 - DNA, 19 bp, Homo sapiens
tccctgctgtcgtcttagc

SEQ ID NO: 885020 - DNA, 22 bp, Homo sapiens
tccctgctgtgccatgctgggc

SEQ ID NO: 885021 - DNA, 18 bp, Homo sapiens
tccctgcttccaggaaac

SEQ ID NO: 885022 - DNA, 19 bp, Homo sapiens
tccctgcttgcccgctccc

SEQ ID NO: 885023 - DNA, 16 bp, Homo sapiens
tccctggacaggcagc

SEQ ID NO: 885024 - DNA, 17 bp, Homo sapiens
tccctggacaggcagcc

SEQ ID NO: 885025 - DNA, 13 bp, Homo sapiens
tccctggagccct

SEQ ID NO: 885026 - DNA, 15 bp, Homo sapiens
tccctggagccctgt

SEQ ID NO: 885027 - DNA, 11 bp, Homo sapiens
tccctggagct

SEQ ID NO: 885028 - DNA, 14 bp, Homo sapiens
tccctggagctgag

SEQ ID NO: 885029 - DNA, 15 bp, Homo sapiens
tccctggagctgagg

SEQ ID NO: 885030 - DNA, 24 bp, Homo sapiens
tccctggagtcagggtgaactgca

SEQ ID NO: 885031 - DNA, 19 bp, Homo sapiens
tccctggatctacctggag

SEQ ID NO: 885032 - DNA, 21 bp, Homo sapiens
tccctggatctacctggaggg

SEQ ID NO: 885033 - DNA, 21 bp, Homo sapiens
tccctggatgtgaagctcaca

SEQ ID NO: 885034 - DNA, 23 bp, Homo sapiens
tccctggatgtgaagctcacact

SEQ ID NO: 885035 - DNA, 15 bp, Homo sapiens
tccctggcagacaca

SEQ ID NO: 885036 - DNA, 14 bp, Homo sapiens
tccctggcatgatg

SEQ ID NO: 885037 - DNA, 18 bp, Homo sapiens
tccctggcctgttctgtt

SEQ ID NO: 885038 - DNA, 15 bp, Homo sapiens
tccctggccttgccc

SEQ ID NO: 885039 - DNA, 18 bp, Homo sapiens
tccctggctaacagtcta

SEQ ID NO: 885040 - DNA, 14 bp, Homo sapiens
tccctggctcccat

SEQ ID NO: 885041 - DNA, 13 bp, Homo sapiens
tccctggctcctc

SEQ ID NO: 885042 - DNA, 15 bp, Homo sapiens
tccctggctcctccg

SEQ ID NO: 885043 - DNA, 18 bp, Homo sapiens
tccctggctcctccgtct

SEQ ID NO: 885044 - DNA, 19 bp, Homo sapiens
tccctggctcctccgtctg

SEQ ID NO: 885045 - DNA, 20 bp, Homo sapiens
tccctggctctcagaaggta

SEQ ID NO: 885046 - DNA, 15 bp, Homo sapiens
tccctggctgccctg

SEQ ID NO: 885047 - DNA, 21 bp, Homo sapiens
tccctggcttgtaactccacc

SEQ ID NO: 885048 - DNA, 14 bp, Homo sapiens
tccctgggccacct

SEQ ID NO: 885049 - DNA, 15 bp, Homo sapiens
tccctgggccacctc

SEQ ID NO: 885050 - DNA, 19 bp, Homo sapiens
tccctgggccacctcctac

SEQ ID NO: 885051 - DNA, 18 bp, Homo sapiens
tccctgggccagggtctg

SEQ ID NO: 885052 - DNA, 15 bp, Homo sapiens
tccctgggcccctcc

SEQ ID NO: 885053 - DNA, 19 bp, Homo sapiens
tccctgggcccctccacgc

SEQ ID NO: 885054 - DNA, 14 bp, Homo sapiens
tccctgggctaagc

SEQ ID NO: 885055 - DNA, 22 bp, Homo sapiens
tccctgggctgccaccagcccc

SEQ ID NO: 885056 - DNA, 10 bp, Homo sapiens
tccctgggga

SEQ ID NO: 885057 - DNA, 15 bp, Homo sapiens
tccctggggagccct

SEQ ID NO: 885058 - DNA, 18 bp, Homo sapiens
tccctggggagccctcag

SEQ ID NO: 885059 - DNA, 23 bp, Homo sapiens
tccctggggagccctcaggctcc

SEQ ID NO: 885060 - DNA, 20 bp, Homo sapiens
tccctggggctagggggagc

SEQ ID NO: 885061 - DNA, 19 bp, Homo sapiens
tccctgggggccccaggat

SEQ ID NO: 885062 - DNA, 21 bp, Homo sapiens
tccctggtaataagtactgtg

SEQ ID NO: 885063 - DNA, 22 bp, Homo sapiens
tccctggtccctcgtccacagg

SEQ ID NO: 885064 - DNA, 18 bp, Homo sapiens
tccctggtgcctctgtgc

SEQ ID NO: 885065 - DNA, 14 bp, Homo sapiens
tccctggttcattg

SEQ ID NO: 885066 - DNA, 22 bp, Homo sapiens
tccctgtaacctcttcagaggc

SEQ ID NO: 885067 - DNA, 23 bp, Homo sapiens
tccctgtaacctcttcagaggcc

SEQ ID NO: 885068 - DNA, 14 bp, Homo sapiens
tccctgtagctcag

SEQ ID NO: 885069 - DNA, 17 bp, Homo sapiens
tccctgtagctcagtca

SEQ ID NO: 885070 - DNA, 14 bp, Homo sapiens
tccctgtagctctg

SEQ ID NO: 885071 - DNA, 16 bp, Homo sapiens
tccctgtagctctgcc

SEQ ID NO: 885072 - DNA, 20 bp, Homo sapiens
tccctgtattttctttctct

SEQ ID NO: 885073 - DNA, 15 bp, Homo sapiens
tccctgtcaccaagc

SEQ ID NO: 885074 - DNA, 22 bp, Homo sapiens
tccctgtcaccaagctcacagt

SEQ ID NO: 885075 - DNA, 15 bp, Homo sapiens
tccctgtcagaggct

SEQ ID NO: 885076 - DNA, 15 bp, Homo sapiens
tccctgtcagcctga

SEQ ID NO: 885077 - DNA, 12 bp, Homo sapiens
tccctgtcccag

SEQ ID NO: 885078 - DNA, 17 bp, Homo sapiens
tccctgtccccaggccc

SEQ ID NO: 885079 - DNA, 21 bp, Homo sapiens
tccctgtccccaggcccagcc

SEQ ID NO: 885080 - DNA, 15 bp, Homo sapiens
tccctgtcccccagc

SEQ ID NO: 885081 - DNA, 18 bp, Homo sapiens
tccctgtcccccagcatc

SEQ ID NO: 885082 - DNA, 11 bp, Homo sapiens
tccctgtccct

SEQ ID NO: 885083 - DNA, 14 bp, Homo sapiens
tccctgtccctgcc

SEQ ID NO: 885084 - DNA, 18 bp, Homo sapiens
tccctgtcccttcctttc

SEQ ID NO: 885085 - DNA, 14 bp, Homo sapiens
tccctgtcctcctc

SEQ ID NO: 885086 - DNA, 15 bp, Homo sapiens
tccctgtcctcctcg

SEQ ID NO: 885087 - DNA, 14 bp, Homo sapiens
tccctgtccttcta

SEQ ID NO: 885088 - DNA, 13 bp, Homo sapiens
tccctgtctccag

SEQ ID NO: 885089 - DNA, 17 bp, Homo sapiens
tccctgtctccagctgc

SEQ ID NO: 885090 - DNA, 18 bp, Homo sapiens
tccctgtctccagctgcc

SEQ ID NO: 885091 - DNA, 15 bp, Homo sapiens
tccctgtctcccggc

SEQ ID NO: 885092 - DNA, 14 bp, Homo sapiens
tccctgtgccccca

SEQ ID NO: 885093 - DNA, 23 bp, Homo sapiens
tccctgtgcccccagcctcagcc

SEQ ID NO: 885094 - DNA, 22 bp, Homo sapiens
tccctgtgggggtggccatccc

SEQ ID NO: 885095 - DNA, 23 bp, Homo sapiens
tccctgtgggggtggccatccct

SEQ ID NO: 885096 - DNA, 24 bp, Homo sapiens
tccgaagaattccatagtggacca

SEQ ID NO: 885097 - DNA, 22 bp, Homo sapiens
tccgaagggaattaaaaagaag

SEQ ID NO: 885098 - DNA, 21 bp, Homo sapiens
tccgaagtatgagggaaaatg

SEQ ID NO: 885099 - DNA, 23 bp, Homo sapiens
tccgacaaccgatgctccagcca

SEQ ID NO: 885100 - DNA, 17 bp, Homo sapiens
tccgacacatttaccaa

SEQ ID NO: 885101 - DNA, 20 bp, Homo sapiens
tccgacacatttaccaaatt

SEQ ID NO: 885102 - DNA, 20 bp, Homo sapiens
tccgacatcccagaccagcc

SEQ ID NO: 885103 - DNA, 18 bp, Homo sapiens
tccgaccacttccagggg

SEQ ID NO: 885104 - DNA, 18 bp, Homo sapiens
tccgaccctctgggaacc

SEQ ID NO: 885105 - DNA, 13 bp, Homo sapiens
tccgacctctctc

SEQ ID NO: 885106 - DNA, 15 bp, Homo sapiens
tccgacctctctcag

SEQ ID NO: 885107 - DNA, 17 bp, Homo sapiens
tccgacctctctcggcc

SEQ ID NO: 885108 - DNA, 19 bp, Homo sapiens
tccgactgcccctgctgtg

SEQ ID NO: 885109 - DNA, 23 bp, Homo sapiens
tccgactgcccctgctgtgctgc

SEQ ID NO: 885110 - DNA, 12 bp, Homo sapiens
tccgactgcttt

SEQ ID NO: 885111 - DNA, 17 bp, Homo sapiens
tccgacttcccctgggc

SEQ ID NO: 885112 - DNA, 21 bp, Homo sapiens
tccgacttcccctgggcaaga

SEQ ID NO: 885113 - DNA, 20 bp, Homo sapiens
tccgagagcagtgggcaggt

SEQ ID NO: 885114 - DNA, 19 bp, Homo sapiens
tccgagatccccagggcag

SEQ ID NO: 885115 - DNA, 24 bp, Homo sapiens
tccgagatccccagggcagcctgg

SEQ ID NO: 885116 - DNA, 20 bp, Homo sapiens
tccgagcattccagtaactt

SEQ ID NO: 885117 - DNA, 20 bp, Homo sapiens
tccgagcgacggctcctccc

SEQ ID NO: 885118 - DNA, 14 bp, Homo sapiens
tccgaggcagggtc

SEQ ID NO: 885119 - DNA, 16 bp, Homo sapiens
tccgaggctccccgcc

SEQ ID NO: 885120 - DNA, 20 bp, Homo sapiens
tccgatcaacatttatgacc

SEQ ID NO: 885121 - DNA, 20 bp, Homo sapiens
tccgatggatgaatctccca

SEQ ID NO: 885122 - DNA, 21 bp, Homo sapiens
tcctaagcaactaggccttca

SEQ ID NO: 885123 - DNA, 14 bp, Homo sapiens
tcctaagcctaaaa

SEQ ID NO: 885124 - DNA, 16 bp, Homo sapiens
tcctaagctattcagt

SEQ ID NO: 885125 - DNA, 20 bp, Homo sapiens
tcctaagctattcagtaata

SEQ ID NO: 885126 - DNA, 13 bp, Homo sapiens
tcctaaggaacct

SEQ ID NO: 885127 - DNA, 18 bp, Homo sapiens
tcctaaggacacactaat

SEQ ID NO: 885128 - DNA, 21 bp, Homo sapiens
tcctaaggctccccaccccga

SEQ ID NO: 885129 - DNA, 21 bp, Homo sapiens
tcctaagtatcaagtatagaa

SEQ ID NO: 885130 - DNA, 16 bp, Homo sapiens
tcctaagtcccttcct

SEQ ID NO: 885131 - DNA, 22 bp, Homo sapiens
tcctaagtctgtcatcctctgg

SEQ ID NO: 885132 - DNA, 18 bp, Homo sapiens
tcctaagtttttttcatt

SEQ ID NO: 885133 - DNA, 18 bp, Homo sapiens
tcctaataaagttctgta

SEQ ID NO: 885134 - DNA, 15 bp, Homo sapiens
tcctaatgtgatcat

SEQ ID NO: 885135 - DNA, 17 bp, Homo sapiens
tcctaattccacagctg

SEQ ID NO: 885136 - DNA, 23 bp, Homo sapiens
tcctaattttaaataatttctac

SEQ ID NO: 885137 - DNA, 15 bp, Homo sapiens
tcctacaaagatgtt

SEQ ID NO: 885138 - DNA, 17 bp, Homo sapiens
tcctacaactaaaaata

SEQ ID NO: 885139 - DNA, 15 bp, Homo sapiens
tcctacaagacacag

SEQ ID NO: 885140 - DNA, 23 bp, Homo sapiens
tcctacaagagcagcctgtggca

SEQ ID NO: 885141 - DNA, 19 bp, Homo sapiens
tcctacaagatttagaaaa

SEQ ID NO: 885142 - DNA, 19 bp, Homo sapiens
tcctacacttgagagaaaa

SEQ ID NO: 885143 - DNA, 21 bp, Homo sapiens
tcctacagaaatactgctctg

SEQ ID NO: 885144 - DNA, 13 bp, Homo sapiens
tcctacagcacta

SEQ ID NO: 885145 - DNA, 17 bp, Homo sapiens
tcctacagccccttttt

SEQ ID NO: 885146 - DNA, 13 bp, Homo sapiens
tcctacagtacaa

SEQ ID NO: 885147 - DNA, 21 bp, Homo sapiens
tcctacagtgactccctggga

SEQ ID NO: 885148 - DNA, 14 bp, Homo sapiens
tcctaccaagtcaa

SEQ ID NO: 885149 - DNA, 15 bp, Homo sapiens
tcctaccaatgcatg

SEQ ID NO: 885150 - DNA, 14 bp, Homo sapiens
tcctaccagcaaac

SEQ ID NO: 885151 - DNA, 17 bp, Homo sapiens
tcctaccagttgcccta

SEQ ID NO: 885152 - DNA, 15 bp, Homo sapiens
tcctacccaaccact

SEQ ID NO: 885153 - DNA, 21 bp, Homo sapiens
tcctacccagcgtggcccagg

SEQ ID NO: 885154 - DNA, 22 bp, Homo sapiens
tcctacccagcgtggcccaggc

SEQ ID NO: 885155 - DNA, 22 bp, Homo sapiens
tcctaccccctcttcaaagcag

SEQ ID NO: 885156 - DNA, 19 bp, Homo sapiens
tcctacccctcttccagct

SEQ ID NO: 885157 - DNA, 15 bp, Homo sapiens
tcctaccccttcctg

SEQ ID NO: 885158 - DNA, 16 bp, Homo sapiens
tcctaccccttcctgt

SEQ ID NO: 885159 - DNA, 18 bp, Homo sapiens
tcctaccccttcctgtcc

SEQ ID NO: 885160 - DNA, 23 bp, Homo sapiens
tcctaccccttcctgtcctgcct

SEQ ID NO: 885161 - DNA, 18 bp, Homo sapiens
tcctacccgcccgcgtcc

SEQ ID NO: 885162 - DNA, 14 bp, Homo sapiens
tcctaccctcccac

SEQ ID NO: 885163 - DNA, 15 bp, Homo sapiens
tcctaccctcccacc

SEQ ID NO: 885164 - DNA, 14 bp, Homo sapiens
tcctaccgtactcc

SEQ ID NO: 885165 - DNA, 15 bp, Homo sapiens
tcctacctattatcc

SEQ ID NO: 885166 - DNA, 20 bp, Homo sapiens
tcctacctcagcctcctggg

SEQ ID NO: 885167 - DNA, 14 bp, Homo sapiens
tcctacctgctgct

SEQ ID NO: 885168 - DNA, 15 bp, Homo sapiens
tcctacctgctgctg

SEQ ID NO: 885169 - DNA, 16 bp, Homo sapiens
tcctacctgctgctgc

SEQ ID NO: 885170 - DNA, 15 bp, Homo sapiens
tcctacgtccaaggt

SEQ ID NO: 885171 - DNA, 16 bp, Homo sapiens
tcctactccctcttcc

SEQ ID NO: 885172 - DNA, 17 bp, Homo sapiens
tcctactccctcttcca

SEQ ID NO: 885173 - DNA, 19 bp, Homo sapiens
tcctactcggctctgcagt

SEQ ID NO: 885174 - DNA, 22 bp, Homo sapiens
tcctactctcacactggttctc

SEQ ID NO: 885175 - DNA, 13 bp, Homo sapiens
tcctactgtcctg

SEQ ID NO: 885176 - DNA, 14 bp, Homo sapiens
tcctactgtcctgg

SEQ ID NO: 885177 - DNA, 18 bp, Homo sapiens
tcctacttataaagtaga

SEQ ID NO: 885178 - DNA, 21 bp, Homo sapiens
tcctagaaattccccaccctg

SEQ ID NO: 885179 - DNA, 22 bp, Homo sapiens
tcctagaaattccccaccctga

SEQ ID NO: 885180 - DNA, 21 bp, Homo sapiens
tcctagaagaaccaaatacct

SEQ ID NO: 885181 - DNA, 21 bp, Homo sapiens
tcctagaagcccctgtcgccc

SEQ ID NO: 885182 - DNA, 18 bp, Homo sapiens
tcctagaatgtttcattt

SEQ ID NO: 885183 - DNA, 18 bp, Homo sapiens
tcctagacttgaaagttt

SEQ ID NO: 885184 - DNA, 19 bp, Homo sapiens
tcctagacttgaaagtttt

SEQ ID NO: 885185 - DNA, 20 bp, Homo sapiens
tcctagaggtgggcagctgg

SEQ ID NO: 885186 - DNA, 13 bp, Homo sapiens
tcctagagtctta

SEQ ID NO: 885187 - DNA, 15 bp, Homo sapiens
tcctagataaaaaga

SEQ ID NO: 885188 - DNA, 16 bp, Homo sapiens
tcctagataaaaagat

SEQ ID NO: 885189 - DNA, 20 bp, Homo sapiens
tcctagcactttgggaggcc

SEQ ID NO: 885190 - DNA, 23 bp, Homo sapiens
tcctagcactttgggaggccaag

SEQ ID NO: 885191 - DNA, 17 bp, Homo sapiens
tcctagccactcaggag

SEQ ID NO: 885192 - DNA, 16 bp, Homo sapiens
tcctagcccagtgctt

SEQ ID NO: 885193 - DNA, 19 bp, Homo sapiens
tcctagcccagtgcttctc

SEQ ID NO: 885194 - DNA, 20 bp, Homo sapiens
tcctagcccctctctcacac

SEQ ID NO: 885195 - DNA, 12 bp, Homo sapiens
tcctagcccttc

SEQ ID NO: 885196 - DNA, 14 bp, Homo sapiens
tcctagcccttccc

SEQ ID NO: 885197 - DNA, 16 bp, Homo sapiens
tcctagcccttccctg

SEQ ID NO: 885198 - DNA, 17 bp, Homo sapiens
tcctagcccttccctga

SEQ ID NO: 885199 - DNA, 18 bp, Homo sapiens
tcctagccttatcctctg

SEQ ID NO: 885200 - DNA, 13 bp, Homo sapiens
tcctagctctccc

SEQ ID NO: 885201 - DNA, 18 bp, Homo sapiens
tcctagctctcccagtga

SEQ ID NO: 885202 - DNA, 12 bp, Homo sapiens
tcctagctctgg

SEQ ID NO: 885203 - DNA, 11 bp, Homo sapiens
tcctaggactt

SEQ ID NO: 885204 - DNA, 19 bp, Homo sapiens
tcctaggagagccaacctc

SEQ ID NO: 885205 - DNA, 13 bp, Homo sapiens
tcctaggccacac

SEQ ID NO: 885206 - DNA, 16 bp, Homo sapiens
tcctaggcccaggcct

SEQ ID NO: 885207 - DNA, 20 bp, Homo sapiens
tcctaggctccaccccatcc

SEQ ID NO: 885208 - DNA, 20 bp, Homo sapiens
tcctagggaaaagttcatag

SEQ ID NO: 885209 - DNA, 22 bp, Homo sapiens
tcctagggcacttctagtttca

SEQ ID NO: 885210 - DNA, 23 bp, Homo sapiens
tcctagggcattgtatctgtctt

SEQ ID NO: 885211 - DNA, 20 bp, Homo sapiens
tcctaggggaagggggtgca

SEQ ID NO: 885212 - DNA, 19 bp, Homo sapiens
tcctagtaagcatctactt

SEQ ID NO: 885213 - DNA, 22 bp, Homo sapiens
tcctagtcgggcagggcccctg

SEQ ID NO: 885214 - DNA, 17 bp, Homo sapiens
tcctagtggatgactgt

SEQ ID NO: 885215 - DNA, 18 bp, Homo sapiens
tcctagtggatgactgtt

SEQ ID NO: 885216 - DNA, 17 bp, Homo sapiens
tcctagtttcctctcct

SEQ ID NO: 885217 - DNA, 16 bp, Homo sapiens
tcctagttttcctact

SEQ ID NO: 885218 - DNA, 21 bp, Homo sapiens
tcctataataaaatggcacct

SEQ ID NO: 885219 - DNA, 19 bp, Homo sapiens
tcctataccatatgtctgc

SEQ ID NO: 885220 - DNA, 23 bp, Homo sapiens
tcctataccatatgtctgcttct

SEQ ID NO: 885221 - DNA, 14 bp, Homo sapiens
tcctatatatttct

SEQ ID NO: 885222 - DNA, 20 bp, Homo sapiens
tcctatatatttctattatt

SEQ ID NO: 885223 - DNA, 18 bp, Homo sapiens
tcctatatcattatttag

SEQ ID NO: 885224 - DNA, 13 bp, Homo sapiens
tcctatatctgtt

SEQ ID NO: 885225 - DNA, 12 bp, Homo sapiens
tcctcccagtga

SEQ ID NO: 885226 - DNA, 13 bp, Homo sapiens
tcctcccagtgag

SEQ ID NO: 885227 - DNA, 16 bp, Homo sapiens
tcctcccatcccctca

SEQ ID NO: 885228 - DNA, 19 bp, Homo sapiens
tcctcccatcccctggact

SEQ ID NO: 885229 - DNA, 16 bp, Homo sapiens
tcctccccacactcca

SEQ ID NO: 885230 - DNA, 20 bp, Homo sapiens
tcctccccacactccactct

SEQ ID NO: 885231 - DNA, 23 bp, Homo sapiens
tcctccccacactccactctgat

SEQ ID NO: 885232 - DNA, 12 bp, Homo sapiens
tcctccccacct

SEQ ID NO: 885233 - DNA, 17 bp, Homo sapiens
tcctccccacctgtagc

SEQ ID NO: 885234 - DNA, 14 bp, Homo sapiens
tcctccccaccttc

SEQ ID NO: 885235 - DNA, 20 bp, Homo sapiens
tcctctatacatctctcccc

SEQ ID NO: 885236 - DNA, 19 bp, Homo sapiens
tcctctcaactgcctcagc

SEQ ID NO: 885237 - DNA, 15 bp, Homo sapiens
tcctctcactcccca

SEQ ID NO: 885238 - DNA, 22 bp, Homo sapiens
tcctctcatcatttgcattggg

SEQ ID NO: 885239 - DNA, 14 bp, Homo sapiens
tcctctcattgtct

SEQ ID NO: 885240 - DNA, 22 bp, Homo sapiens
tcctctccaccagacgccttcc

SEQ ID NO: 885241 - DNA, 15 bp, Homo sapiens
tcctctccaccctcc

SEQ ID NO: 885242 - DNA, 15 bp, Homo sapiens
tcctctccactgcct

SEQ ID NO: 885243 - DNA, 11 bp, Homo sapiens
tcctctccagg

SEQ ID NO: 885244 - DNA, 15 bp, Homo sapiens
tcctctccaggcacc

SEQ ID NO: 885245 - DNA, 20 bp, Homo sapiens
tcctctcccacagagtgctg

SEQ ID NO: 885246 - DNA, 15 bp, Homo sapiens
tcctctcccatcccc

SEQ ID NO: 885247 - DNA, 23 bp, Homo sapiens
tcctctcccatccccctgccctc

SEQ ID NO: 885248 - DNA, 21 bp, Homo sapiens
tcctctccccctcctccaggg

SEQ ID NO: 885249 - DNA, 23 bp, Homo sapiens
tcctctcccccttcagctcctga

SEQ ID NO: 885250 - DNA, 15 bp, Homo sapiens
tcctctcccttccct

SEQ ID NO: 885251 - DNA, 19 bp, Homo sapiens
tcctctccgcgccctccga

SEQ ID NO: 885252 - DNA, 14 bp, Homo sapiens
tcctctcctaccca

SEQ ID NO: 885253 - DNA, 17 bp, Homo sapiens
tcctctcctcctcagct

SEQ ID NO: 885254 - DNA, 21 bp, Homo sapiens
tcctctccttgggctcctggc

SEQ ID NO: 885255 - DNA, 13 bp, Homo sapiens
tcctctcgagccc

SEQ ID NO: 885256 - DNA, 15 bp, Homo sapiens
tcctctcgagcccag

SEQ ID NO: 885257 - DNA, 18 bp, Homo sapiens
tcctctcgagcccagatg

SEQ ID NO: 885258 - DNA, 17 bp, Homo sapiens
tcctctcgcggccctca

SEQ ID NO: 885259 - DNA, 19 bp, Homo sapiens
tcctctcgcggccctcagt

SEQ ID NO: 885260 - DNA, 17 bp, Homo sapiens
tcctctcggctggaaga

SEQ ID NO: 885261 - DNA, 18 bp, Homo sapiens
tcctctcggctggaagaa

SEQ ID NO: 885262 - DNA, 20 bp, Homo sapiens
tcctctcggctggaagaaca

SEQ ID NO: 885263 - DNA, 16 bp, Homo sapiens
tcctctctagggcaga

SEQ ID NO: 885264 - DNA, 14 bp, Homo sapiens
tcctctctccagat

SEQ ID NO: 885265 - DNA, 21 bp, Homo sapiens
tcctctctcggagccctcaga

SEQ ID NO: 885266 - DNA, 15 bp, Homo sapiens
tcctctctctctcta

SEQ ID NO: 885267 - DNA, 12 bp, Homo sapiens
tcctctctctgt

SEQ ID NO: 885268 - DNA, 22 bp, Homo sapiens
tcctctctgaagcgactctcct

SEQ ID NO: 885269 - DNA, 16 bp, Homo sapiens
tcctctctgtctgtct

SEQ ID NO: 885270 - DNA, 17 bp, Homo sapiens
tcctctctgtctgtctc

SEQ ID NO: 885271 - DNA, 17 bp, Homo sapiens
tcctctcttcctcttcc

SEQ ID NO: 885272 - DNA, 15 bp, Homo sapiens
tcctctgactcaggg

SEQ ID NO: 885273 - DNA, 23 bp, Homo sapiens
tcctctgagccataccgaccatc

SEQ ID NO: 885274 - DNA, 13 bp, Homo sapiens
tcctctgagcctt

SEQ ID NO: 885275 - DNA, 21 bp, Homo sapiens
tcctctgaggaagcagttggg

SEQ ID NO: 885276 - DNA, 21 bp, Homo sapiens
tcctctgataatatattttca

SEQ ID NO: 885277 - DNA, 22 bp, Homo sapiens
tcctctgataatatattttcaa

SEQ ID NO: 885278 - DNA, 20 bp, Homo sapiens
tcctctgatagctgtttcaa

SEQ ID NO: 885279 - DNA, 18 bp, Homo sapiens
tcctctgatttacattca

SEQ ID NO: 885280 - DNA, 15 bp, Homo sapiens
tcctctgcagcactt

SEQ ID NO: 885281 - DNA, 14 bp, Homo sapiens
tcctctgcagtttt

SEQ ID NO: 885282 - DNA, 22 bp, Homo sapiens
tcctctgccacctcccctatcc

SEQ ID NO: 885283 - DNA, 16 bp, Homo sapiens
tcctctgcctacagcc

SEQ ID NO: 885284 - DNA, 18 bp, Homo sapiens
tcctctgcctacagccag

SEQ ID NO: 885285 - DNA, 20 bp, Homo sapiens
tcctctgcctacagccaggt

SEQ ID NO: 885286 - DNA, 11 bp, Homo sapiens
tcctctgcctg

SEQ ID NO: 885287 - DNA, 17 bp, Homo sapiens
tcctctgcctgggctct

SEQ ID NO: 885288 - DNA, 17 bp, Homo sapiens
tcctctgccttggacac

SEQ ID NO: 885289 - DNA, 23 bp, Homo sapiens
tcctctgctatgcattttcttca

SEQ ID NO: 885290 - DNA, 16 bp, Homo sapiens
tcctctgctccagcaa

SEQ ID NO: 885291 - DNA, 12 bp, Homo sapiens
tcctctgctggg

SEQ ID NO: 885292 - DNA, 14 bp, Homo sapiens
tcctctgctgggaa

SEQ ID NO: 885293 - DNA, 24 bp, Homo sapiens
tcctctggacggcaggctcactgc

SEQ ID NO: 885294 - DNA, 12 bp, Homo sapiens
tcctctggagcc

SEQ ID NO: 885295 - DNA, 17 bp, Homo sapiens
tcctctggcaggcttcc

SEQ ID NO: 885296 - DNA, 21 bp, Homo sapiens
tcctctggcaggcttccccct

SEQ ID NO: 885297 - DNA, 22 bp, Homo sapiens
tcctctggcaggcttccccctt

SEQ ID NO: 885298 - DNA, 19 bp, Homo sapiens
tcctctggccgcagaggtg

SEQ ID NO: 885299 - DNA, 14 bp, Homo sapiens
tcctctggctttcc

SEQ ID NO: 885300 - DNA, 20 bp, Homo sapiens
tcctctggctttcccaggag

SEQ ID NO: 885301 - DNA, 20 bp, Homo sapiens
tcctctgggcctggggtgca

SEQ ID NO: 885302 - DNA, 17 bp, Homo sapiens
tcctctgggtttctaag

SEQ ID NO: 885303 - DNA, 22 bp, Homo sapiens
tcctctgggtttctaagcagtt

SEQ ID NO: 885304 - DNA, 21 bp, Homo sapiens
tcctctgtcagtcacagccac

SEQ ID NO: 885305 - DNA, 13 bp, Homo sapiens
tcctctgtccagg

SEQ ID NO: 885306 - DNA, 17 bp, Homo sapiens
tcctctgtccaggcact

SEQ ID NO: 885307 - DNA, 22 bp, Homo sapiens
tcctctgtccaggcactgctgc

SEQ ID NO: 885308 - DNA, 15 bp, Homo sapiens
tcctctgttcacaaa

SEQ ID NO: 885309 - DNA, 11 bp, Homo sapiens
tcctctgttct

SEQ ID NO: 885310 - DNA, 12 bp, Homo sapiens
tcctctgttcta

SEQ ID NO: 885311 - DNA, 19 bp, Homo sapiens
tcctcttaccgtagcctcc

SEQ ID NO: 885312 - DNA, 15 bp, Homo sapiens
tcctcttagaagaat

SEQ ID NO: 885313 - DNA, 17 bp, Homo sapiens
tcctcttcccccaagat

SEQ ID NO: 885314 - DNA, 11 bp, Homo sapiens
tcctcttccct

SEQ ID NO: 885315 - DNA, 22 bp, Homo sapiens
tcctcttcccttagcctctccc

SEQ ID NO: 885316 - DNA, 14 bp, Homo sapiens
tcctcttcctgccc

SEQ ID NO: 885317 - DNA, 15 bp, Homo sapiens
tcctcttcctgccct

SEQ ID NO: 885318 - DNA, 16 bp, Homo sapiens
tcctcttcggccctca

SEQ ID NO: 885319 - DNA, 18 bp, Homo sapiens
tcctcttcggccctcaga

SEQ ID NO: 885320 - DNA, 21 bp, Homo sapiens
tcctcttcggccctcagatgt

SEQ ID NO: 885321 - DNA, 19 bp, Homo sapiens
tcctcttctattttgtaaa

SEQ ID NO: 885322 - DNA, 23 bp, Homo sapiens
tcctcttctgcttaggagagacc

SEQ ID NO: 885323 - DNA, 17 bp, Homo sapiens
tcctcttgattcctggt

SEQ ID NO: 885324 - DNA, 19 bp, Homo sapiens
tcctcttgccactgcctct

SEQ ID NO: 885325 - DNA, 18 bp, Homo sapiens
tcctcttgcctctctcag

SEQ ID NO: 885326 - DNA, 21 bp, Homo sapiens
tcctcttggcaagatgtttct

SEQ ID NO: 885327 - DNA, 22 bp, Homo sapiens
tcctcttggtgggtgtggccag

SEQ ID NO: 885328 - DNA, 20 bp, Homo sapiens
tcctcttgtaaataaagccc

SEQ ID NO: 885329 - DNA, 13 bp, Homo sapiens
tcctcttgtccta

SEQ ID NO: 885330 - DNA, 19 bp, Homo sapiens
tcctcttgtcctacaatga

SEQ ID NO: 885331 - DNA, 17 bp, Homo sapiens
tcctcttgtcctggccc

SEQ ID NO: 885332 - DNA, 15 bp, Homo sapiens
tcctctttactctgg

SEQ ID NO: 885333 - DNA, 14 bp, Homo sapiens
tcctctttcccctc

SEQ ID NO: 885334 - DNA, 16 bp, Homo sapiens
tcctctttcccctcct

SEQ ID NO: 885335 - DNA, 18 bp, Homo sapiens
tcctctttcccctccttt

SEQ ID NO: 885336 - DNA, 15 bp, Homo sapiens
tcctctttctctccc

SEQ ID NO: 885337 - DNA, 16 bp, Homo sapiens
tcctctttctctcccc

SEQ ID NO: 885338 - DNA, 20 bp, Homo sapiens
tcctctttctgctctgccat

SEQ ID NO: 885339 - DNA, 21 bp, Homo sapiens
tcctgaaaaggtttatgaaaa

SEQ ID NO: 885340 - DNA, 18 bp, Homo sapiens
tcctgaaacatgaaccca

SEQ ID NO: 885341 - DNA, 21 bp, Homo sapiens
tcctgaaacccaaagccctgg

SEQ ID NO: 885342 - DNA, 19 bp, Homo sapiens
tcctgaaacttacacacaa

SEQ ID NO: 885343 - DNA, 16 bp, Homo sapiens
tcctgaaatgccaagt

SEQ ID NO: 885344 - DNA, 22 bp, Homo sapiens
tcctgaaatgccaagtgcctgc

SEQ ID NO: 885345 - DNA, 14 bp, Homo sapiens
tcctgaaatttcag

SEQ ID NO: 885346 - DNA, 15 bp, Homo sapiens
tcctgaaatttcaga

SEQ ID NO: 885347 - DNA, 22 bp, Homo sapiens
tcctgaaccatgtggataactt

SEQ ID NO: 885348 - DNA, 20 bp, Homo sapiens
tcctgaaccgactgaccctg

SEQ ID NO: 885349 - DNA, 17 bp, Homo sapiens
tcctgaaccgcacagct

SEQ ID NO: 885350 - DNA, 18 bp, Homo sapiens
tcctgaaccgcacagctc

SEQ ID NO: 885351 - DNA, 14 bp, Homo sapiens
tcctgaagaggcgg

SEQ ID NO: 885352 - DNA, 20 bp, Homo sapiens
tcctgaagaggcgggccagc

SEQ ID NO: 885353 - DNA, 12 bp, Homo sapiens
tcctgaagccag

SEQ ID NO: 885354 - DNA, 18 bp, Homo sapiens
tcctgcccttccctctgg

SEQ ID NO: 885355 - DNA, 17 bp, Homo sapiens
tcctgcccttcctcagt

SEQ ID NO: 885356 - DNA, 23 bp, Homo sapiens
tcctgcccttgaaccccctccct

SEQ ID NO: 885357 - DNA, 13 bp, Homo sapiens
tcctgcctaaggt

SEQ ID NO: 885358 - DNA, 19 bp, Homo sapiens
tcctgcctattatctgtca

SEQ ID NO: 885359 - DNA, 16 bp, Homo sapiens
tcctgcctcagcctcc

SEQ ID NO: 885360 - DNA, 17 bp, Homo sapiens
tcctgcctcagcctccg

SEQ ID NO: 885361 - DNA, 12 bp, Homo sapiens
tcctgcctcctc

SEQ ID NO: 885362 - DNA, 14 bp, Homo sapiens
tcctgcctcctcat

SEQ ID NO: 885363 - DNA, 14 bp, Homo sapiens
tcctgcctgcccct

SEQ ID NO: 885364 - DNA, 20 bp, Homo sapiens
tcctgcctgcccctctcccg

SEQ ID NO: 885365 - DNA, 18 bp, Homo sapiens
tcctgcctgccctgcctc

SEQ ID NO: 885366 - DNA, 19 bp, Homo sapiens
tcctgcctgccctgcctca

SEQ ID NO: 885367 - DNA, 12 bp, Homo sapiens
tcctgcctggcc

SEQ ID NO: 885368 - DNA, 13 bp, Homo sapiens
tcctgcctggcca

SEQ ID NO: 885369 - DNA, 22 bp, Homo sapiens
tcctgccttcctcctgggccct

SEQ ID NO: 885370 - DNA, 22 bp, Homo sapiens
tcctgcggagtgaagaggggca

SEQ ID NO: 885371 - DNA, 20 bp, Homo sapiens
tcctgcgggcttttccccgg

SEQ ID NO: 885372 - DNA, 14 bp, Homo sapiens
tcctgcgggtttta

SEQ ID NO: 885373 - DNA, 18 bp, Homo sapiens
tcctgcgtcctcctcacc

SEQ ID NO: 885374 - DNA, 22 bp, Homo sapiens
tcctgcgttcagcccctgatct

SEQ ID NO: 885375 - DNA, 23 bp, Homo sapiens
tcctgcgttcagcccctgatctc

SEQ ID NO: 885376 - DNA, 14 bp, Homo sapiens
tcctgcgttttctc

SEQ ID NO: 885377 - DNA, 19 bp, Homo sapiens
tcctgctacaacttcagca

SEQ ID NO: 885378 - DNA, 21 bp, Homo sapiens
tcctgctacaacttcagcagt

SEQ ID NO: 885379 - DNA, 23 bp, Homo sapiens
tcctgctacctcccttgcctttc

SEQ ID NO: 885380 - DNA, 19 bp, Homo sapiens
tcctgctagcaggccccct

SEQ ID NO: 885381 - DNA, 17 bp, Homo sapiens
tcctgctagctgtagaa

SEQ ID NO: 885382 - DNA, 22 bp, Homo sapiens
tcctgctcaactctacccctgc

SEQ ID NO: 885383 - DNA, 16 bp, Homo sapiens
tcctgctcatattgtg

SEQ ID NO: 885384 - DNA, 14 bp, Homo sapiens
tcctgctccagaat

SEQ ID NO: 885385 - DNA, 20 bp, Homo sapiens
tcctgctccagaatttggaa

SEQ ID NO: 885386 - DNA, 16 bp, Homo sapiens
tcctgctccatgactg

SEQ ID NO: 885387 - DNA, 21 bp, Homo sapiens
tcctgctccatgactggctgt

SEQ ID NO: 885388 - DNA, 23 bp, Homo sapiens
tcctgctccatgactggctgtct

SEQ ID NO: 885389 - DNA, 22 bp, Homo sapiens
tcctgctccgtggactgcagtc

SEQ ID NO: 885390 - DNA, 13 bp, Homo sapiens
tcctgctcctcac

SEQ ID NO: 885391 - DNA, 18 bp, Homo sapiens
tcctgctcctcacccctg

SEQ ID NO: 885392 - DNA, 13 bp, Homo sapiens
tcctgctcctccc

SEQ ID NO: 885393 - DNA, 19 bp, Homo sapiens
tcctgctcctccctgcccc

SEQ ID NO: 885394 - DNA, 15 bp, Homo sapiens
tcctgctccttttgt

SEQ ID NO: 885395 - DNA, 15 bp, Homo sapiens
tcctgctctctgctc

SEQ ID NO: 885396 - DNA, 20 bp, Homo sapiens
tcctgctgagtccctcacgt

SEQ ID NO: 885397 - DNA, 12 bp, Homo sapiens
tcctgctgcacc

SEQ ID NO: 885398 - DNA, 14 bp, Homo sapiens
tcctgctgcaccct

SEQ ID NO: 885399 - DNA, 15 bp, Homo sapiens
tcctgctgcaccctg

SEQ ID NO: 885400 - DNA, 21 bp, Homo sapiens
tcctgctgcaccctgcgcctc

SEQ ID NO: 885401 - DNA, 15 bp, Homo sapiens
tcctgctgctggggc

SEQ ID NO: 885402 - DNA, 19 bp, Homo sapiens
tcctgctgctggggccagc

SEQ ID NO: 885403 - DNA, 22 bp, Homo sapiens
tcctgctgctgtaactgctgag

SEQ ID NO: 885404 - DNA, 23 bp, Homo sapiens
tcctgctgctgtaactgctgagc

SEQ ID NO: 885405 - DNA, 15 bp, Homo sapiens
tcctgctgggactga

SEQ ID NO: 885406 - DNA, 19 bp, Homo sapiens
tcctgctgggcgtgtgtga

SEQ ID NO: 885407 - DNA, 14 bp, Homo sapiens
tcctgctggggctg

SEQ ID NO: 885408 - DNA, 19 bp, Homo sapiens
tcctgctggggctgaacat

SEQ ID NO: 885409 - DNA, 19 bp, Homo sapiens
tcctgctgtccctgtcagg

SEQ ID NO: 885410 - DNA, 13 bp, Homo sapiens
tcctgctgtgcct

SEQ ID NO: 885411 - DNA, 17 bp, Homo sapiens
tcctgcttaaacacaag

SEQ ID NO: 885412 - DNA, 19 bp, Homo sapiens
tcctgcttaaacttgaccc

SEQ ID NO: 885413 - DNA, 12 bp, Homo sapiens
tcctgcttcccc

SEQ ID NO: 885414 - DNA, 13 bp, Homo sapiens
tcctgcttcccct

SEQ ID NO: 885415 - DNA, 17 bp, Homo sapiens
tcctgcttctctcagcc

SEQ ID NO: 885416 - DNA, 12 bp, Homo sapiens
tcctgcttgcca

SEQ ID NO: 885417 - DNA, 17 bp, Homo sapiens
tcctgcttgccaaggca

SEQ ID NO: 885418 - DNA, 19 bp, Homo sapiens
tcctgctttccatgggccc

SEQ ID NO: 885419 - DNA, 20 bp, Homo sapiens
tcctgcttttctgtcctggg

SEQ ID NO: 885420 - DNA, 21 bp, Homo sapiens
tcctggaaaagaagaaacttt

SEQ ID NO: 885421 - DNA, 13 bp, Homo sapiens
tcctggaaacagc

SEQ ID NO: 885422 - DNA, 14 bp, Homo sapiens
tcctggaaacagca

SEQ ID NO: 885423 - DNA, 15 bp, Homo sapiens
tcctggaaacagcat

SEQ ID NO: 885424 - DNA, 14 bp, Homo sapiens
tcctggaacaatat

SEQ ID NO: 885425 - DNA, 22 bp, Homo sapiens
tcctggaaccttgctgtcctga

SEQ ID NO: 885426 - DNA, 20 bp, Homo sapiens
tcctggaagcaggtgctaca

SEQ ID NO: 885427 - DNA, 17 bp, Homo sapiens
tcctggaaggacacagt

SEQ ID NO: 885428 - DNA, 14 bp, Homo sapiens
tcctggacacctcc

SEQ ID NO: 885429 - DNA, 17 bp, Homo sapiens
tcctggacacctcccag

SEQ ID NO: 885430 - DNA, 21 bp, Homo sapiens
tcctggacacctcccagggga

SEQ ID NO: 885431 - DNA, 14 bp, Homo sapiens
tcctggacctgagt

SEQ ID NO: 885432 - DNA, 22 bp, Homo sapiens
tcctggacctgagtcggcccca

SEQ ID NO: 885433 - DNA, 21 bp, Homo sapiens
tcctggactccggaggactga

SEQ ID NO: 885434 - DNA, 16 bp, Homo sapiens
tcctggactcctgcca

SEQ ID NO: 885435 - DNA, 16 bp, Homo sapiens
tcctggacttaaagaa

SEQ ID NO: 885436 - DNA, 19 bp, Homo sapiens
tcctggacttacaaaatgc

SEQ ID NO: 885437 - DNA, 16 bp, Homo sapiens
tcctggagaagcctcg

SEQ ID NO: 885438 - DNA, 22 bp, Homo sapiens
tcctggagaggtggctgcgccc

SEQ ID NO: 885439 - DNA, 19 bp, Homo sapiens
tcctggagcagaccacccc

SEQ ID NO: 885440 - DNA, 18 bp, Homo sapiens
tcctggagcatcccaggc

SEQ ID NO: 885441 - DNA, 18 bp, Homo sapiens
tcctggagcctttgaata

SEQ ID NO: 885442 - DNA, 16 bp, Homo sapiens
tcctggaggcaggggc

SEQ ID NO: 885443 - DNA, 24 bp, Homo sapiens
tcctggaggcaggggctgctgcct

SEQ ID NO: 885444 - DNA, 15 bp, Homo sapiens
tcctggaggctgcct

SEQ ID NO: 885445 - DNA, 11 bp, Homo sapiens
tcctggagggg

SEQ ID NO: 885446 - DNA, 14 bp, Homo sapiens
tcctggagtgatat

SEQ ID NO: 885447 - DNA, 23 bp, Homo sapiens
tcctggagtgatatgatccagag

SEQ ID NO: 885448 - DNA, 14 bp, Homo sapiens
tcctggagtgccct

SEQ ID NO: 885449 - DNA, 17 bp, Homo sapiens
tcctggagtgccctgca

SEQ ID NO: 885450 - DNA, 18 bp, Homo sapiens
tcctggagtgccctgcag

SEQ ID NO: 885451 - DNA, 19 bp, Homo sapiens
tcctggagtgccctgcagg

SEQ ID NO: 885452 - DNA, 18 bp, Homo sapiens
tcctggagttttgatttg

SEQ ID NO: 885453 - DNA, 20 bp, Homo sapiens
tcctggcaatagtgtgttct

SEQ ID NO: 885454 - DNA, 23 bp, Homo sapiens
tcctggcaatagtgtgttctgat

SEQ ID NO: 885455 - DNA, 18 bp, Homo sapiens
tcctggcacgccctactc

SEQ ID NO: 885456 - DNA, 15 bp, Homo sapiens
tcctggcagcccaga

SEQ ID NO: 885457 - DNA, 17 bp, Homo sapiens
tcctggcagctggacca

SEQ ID NO: 885458 - DNA, 20 bp, Homo sapiens
tcctggcagtttaaaaaaat

SEQ ID NO: 885459 - DNA, 15 bp, Homo sapiens
tcctggcatttgctg

SEQ ID NO: 885460 - DNA, 19 bp, Homo sapiens
tcctggcatttgctgattt

SEQ ID NO: 885461 - DNA, 11 bp, Homo sapiens
tcctggccatc

SEQ ID NO: 885462 - DNA, 20 bp, Homo sapiens
tcctggcccactctgtaata

SEQ ID NO: 885463 - DNA, 19 bp, Homo sapiens
tcctggcccaggccttgct

SEQ ID NO: 885464 - DNA, 18 bp, Homo sapiens
tcctggcccgccctcacc

SEQ ID NO: 885465 - DNA, 19 bp, Homo sapiens
tcctggcccgccctcacct

SEQ ID NO: 885466 - DNA, 22 bp, Homo sapiens
tcctggcccgccctcacctctg

SEQ ID NO: 885467 - DNA, 14 bp, Homo sapiens
tcctggccctgggg

SEQ ID NO: 885468 - DNA, 14 bp, Homo sapiens
tcctggcccttcag

SEQ ID NO: 885469 - DNA, 12 bp, Homo sapiens
tcctggcctcct

SEQ ID NO: 885470 - DNA, 17 bp, Homo sapiens
tcctggcctgagagtca

SEQ ID NO: 885471 - DNA, 23 bp, Homo sapiens
tcctggcctggcacatcagaaag

SEQ ID NO: 885472 - DNA, 12 bp, Homo sapiens
tcctggcgcctg

SEQ ID NO: 885473 - DNA, 17 bp, Homo sapiens
tcctggctacatcccag

SEQ ID NO: 885474 - DNA, 20 bp, Homo sapiens
tcctttcacaaccttctgtg

SEQ ID NO: 885475 - DNA, 22 bp, Homo sapiens
tcctttcagggaatttcaggaa

SEQ ID NO: 885476 - DNA, 16 bp, Homo sapiens
tcctttcatctctcta

SEQ ID NO: 885477 - DNA, 17 bp, Homo sapiens
tcctttcatctctctac

SEQ ID NO: 885478 - DNA, 19 bp, Homo sapiens
tcctttccaatagaaagaa

SEQ ID NO: 885479 - DNA, 13 bp, Homo sapiens
tcctttcccttcc

SEQ ID NO: 885480 - DNA, 14 bp, Homo sapiens
tcctttcccttcct

SEQ ID NO: 885481 - DNA, 18 bp, Homo sapiens
tcctttcctactgtcctg

SEQ ID NO: 885482 - DNA, 15 bp, Homo sapiens
tcctttcctctgcag

SEQ ID NO: 885483 - DNA, 14 bp, Homo sapiens
tcctttctaaacaa

SEQ ID NO: 885484 - DNA, 19 bp, Homo sapiens
tcctttctaatcctatctg

SEQ ID NO: 885485 - DNA, 17 bp, Homo sapiens
tcctttctcatttcttt

SEQ ID NO: 885486 - DNA, 19 bp, Homo sapiens
tcctttctcatttctttct

SEQ ID NO: 885487 - DNA, 10 bp, Homo sapiens
tcctttctcc

SEQ ID NO: 885488 - DNA, 18 bp, Homo sapiens
tcctttctccagccagca

SEQ ID NO: 885489 - DNA, 15 bp, Homo sapiens
tcctttctccaggac

SEQ ID NO: 885490 - DNA, 17 bp, Homo sapiens
tcctttctccaggacca

SEQ ID NO: 885491 - DNA, 15 bp, Homo sapiens
tcctttctcctgtga

SEQ ID NO: 885492 - DNA, 17 bp, Homo sapiens
tcctttctcctgtgaat

SEQ ID NO: 885493 - DNA, 17 bp, Homo sapiens
tcctttctgactgtccc

SEQ ID NO: 885494 - DNA, 19 bp, Homo sapiens
tcctttctgactgtccctg

SEQ ID NO: 885495 - DNA, 13 bp, Homo sapiens
tcctttctgccca

SEQ ID NO: 885496 - DNA, 14 bp, Homo sapiens
tcctttctgtgaag

SEQ ID NO: 885497 - DNA, 16 bp, Homo sapiens
tcctttctgtgcccta

SEQ ID NO: 885498 - DNA, 19 bp, Homo sapiens
tcctttcttctagtatttt

SEQ ID NO: 885499 - DNA, 20 bp, Homo sapiens
tcctttcttggttcataaat

SEQ ID NO: 885500 - DNA, 12 bp, Homo sapiens
tcctttcttttc

SEQ ID NO: 885501 - DNA, 16 bp, Homo sapiens
tcctttctttttcttc

SEQ ID NO: 885502 - DNA, 22 bp, Homo sapiens
tcctttgaagatagtaactgta

SEQ ID NO: 885503 - DNA, 17 bp, Homo sapiens
tcctttgacaaaagtaa

SEQ ID NO: 885504 - DNA, 16 bp, Homo sapiens
tcctttgatagaagat

SEQ ID NO: 885505 - DNA, 22 bp, Homo sapiens
tcctttgatcagtataattttt

SEQ ID NO: 885506 - DNA, 15 bp, Homo sapiens
tcctttgcactgagg

SEQ ID NO: 885507 - DNA, 20 bp, Homo sapiens
tcctttgcactgagggccac

SEQ ID NO: 885508 - DNA, 21 bp, Homo sapiens
tcctttggactgttcaagcaa

SEQ ID NO: 885509 - DNA, 21 bp, Homo sapiens
tcctttggggaagtttatttg

SEQ ID NO: 885510 - DNA, 17 bp, Homo sapiens
tcctttgtgcttagtta

SEQ ID NO: 885511 - DNA, 20 bp, Homo sapiens
tcctttgtgtgtactcactg

SEQ ID NO: 885512 - DNA, 18 bp, Homo sapiens
tcctttgtgtgtgtgtca

SEQ ID NO: 885513 - DNA, 22 bp, Homo sapiens
tcctttgtgtgtgtgtcagctg

SEQ ID NO: 885514 - DNA, 20 bp, Homo sapiens
tcctttgtgtttctattgac

SEQ ID NO: 885515 - DNA, 10 bp, Homo sapiens
tcctttgttc

SEQ ID NO: 885516 - DNA, 20 bp, Homo sapiens
tcctttgttttctgactaat

SEQ ID NO: 885517 - DNA, 23 bp, Homo sapiens
tccttttaaagaaaaaaattgaa

SEQ ID NO: 885518 - DNA, 12 bp, Homo sapiens
tccttttaactg

SEQ ID NO: 885519 - DNA, 16 bp, Homo sapiens
tccttttaacttggat

SEQ ID NO: 885520 - DNA, 14 bp, Homo sapiens
tccttttagcctag

SEQ ID NO: 885521 - DNA, 22 bp, Homo sapiens
tccttttatctggtgcctcctc

SEQ ID NO: 885522 - DNA, 17 bp, Homo sapiens
tccttttcaatatatat

SEQ ID NO: 885523 - DNA, 21 bp, Homo sapiens
tccttttcataggtctgaaat

SEQ ID NO: 885524 - DNA, 13 bp, Homo sapiens
tccttttcatctg

SEQ ID NO: 885525 - DNA, 13 bp, Homo sapiens
tccttttccctgc

SEQ ID NO: 885526 - DNA, 15 bp, Homo sapiens
tccttttcctctctc

SEQ ID NO: 885527 - DNA, 12 bp, Homo sapiens
tccttttgaaat

SEQ ID NO: 885528 - DNA, 13 bp, Homo sapiens
tccttttgaactt

SEQ ID NO: 885529 - DNA, 14 bp, Homo sapiens
tccttttgaccttc

SEQ ID NO: 885530 - DNA, 14 bp, Homo sapiens
tccttttgaggctt

SEQ ID NO: 885531 - DNA, 22 bp, Homo sapiens
tccttttgatggggagaaaggg

SEQ ID NO: 885532 - DNA, 13 bp, Homo sapiens
tccttttgcttga

SEQ ID NO: 885533 - DNA, 15 bp, Homo sapiens
tccttttggtgtgtt

SEQ ID NO: 885534 - DNA, 14 bp, Homo sapiens
tccttttgtcccca

SEQ ID NO: 885535 - DNA, 20 bp, Homo sapiens
tccttttgtccccagggccc

SEQ ID NO: 885536 - DNA, 13 bp, Homo sapiens
tccttttgttttg

SEQ ID NO: 885537 - DNA, 17 bp, Homo sapiens
tcctttttaaatgtgaa

SEQ ID NO: 885538 - DNA, 18 bp, Homo sapiens
tcctttttaaatgtgaat

SEQ ID NO: 885539 - DNA, 19 bp, Homo sapiens
tcctttttaaatgtgaatt

SEQ ID NO: 885540 - DNA, 22 bp, Homo sapiens
tcctttttcaaaaaccagccag

SEQ ID NO: 885541 - DNA, 21 bp, Homo sapiens
tcctttttccaatgttttatt

SEQ ID NO: 885542 - DNA, 20 bp, Homo sapiens
tcctttttctccctctggat

SEQ ID NO: 885543 - DNA, 19 bp, Homo sapiens
tcctttttctttataaact

SEQ ID NO: 885544 - DNA, 13 bp, Homo sapiens
tcctttttgttat

SEQ ID NO: 885545 - DNA, 14 bp, Homo sapiens
tcctttttgttatt

SEQ ID NO: 885546 - DNA, 14 bp, Homo sapiens
tccttttttataca

SEQ ID NO: 885547 - DNA, 17 bp, Homo sapiens
tccttttttatacagga

SEQ ID NO: 885548 - DNA, 12 bp, Homo sapiens
tccttttttgtc

SEQ ID NO: 885549 - DNA, 13 bp, Homo sapiens
tccttttttgtct

SEQ ID NO: 885550 - DNA, 18 bp, Homo sapiens
tcgaaaaaataattattt

SEQ ID NO: 885551 - DNA, 14 bp, Homo sapiens
tcgaaactgccaag

SEQ ID NO: 885552 - DNA, 15 bp, Homo sapiens
tcgaaaggccttcag

SEQ ID NO: 885553 - DNA, 16 bp, Homo sapiens
tcgaaaggccttcaga

SEQ ID NO: 885554 - DNA, 17 bp, Homo sapiens
tcgaaccaaggcagcct

SEQ ID NO: 885555 - DNA, 18 bp, Homo sapiens
tcgaaccaaggcagcctc

SEQ ID NO: 885556 - DNA, 18 bp, Homo sapiens
tcgaaccgttttgaagct

SEQ ID NO: 885557 - DNA, 12 bp, Homo sapiens
tcgaactcctga

SEQ ID NO: 885558 - DNA, 15 bp, Homo sapiens
tcgaactcctgacct

SEQ ID NO: 885559 - DNA, 22 bp, Homo sapiens
tcgaagaaacccttgctgcttt

SEQ ID NO: 885560 - DNA, 19 bp, Homo sapiens
tcgaagctcagcccacccc

SEQ ID NO: 885561 - DNA, 18 bp, Homo sapiens
tcgaaggctctctctttc

SEQ ID NO: 885562 - DNA, 20 bp, Homo sapiens
tcgaagggtttttagagaat

SEQ ID NO: 885563 - DNA, 17 bp, Homo sapiens
tcgaatagggaagtaaa

SEQ ID NO: 885564 - DNA, 17 bp, Homo sapiens
tcgaatctctgtgcctt

SEQ ID NO: 885565 - DNA, 22 bp, Homo sapiens
tcgaatctctgtgccttcgtct

SEQ ID NO: 885566 - DNA, 14 bp, Homo sapiens
tcgaatgaaaagct

SEQ ID NO: 885567 - DNA, 15 bp, Homo sapiens
tcgaattaagaatat

SEQ ID NO: 885568 - DNA, 20 bp, Homo sapiens
tcgacaaaggccacaggcag

SEQ ID NO: 885569 - DNA, 24 bp, Homo sapiens
tcgacaaaggccacaggcagtcca

SEQ ID NO: 885570 - DNA, 15 bp, Homo sapiens
tcgacatgctgccag

SEQ ID NO: 885571 - DNA, 16 bp, Homo sapiens
tcgacatgctgccagg

SEQ ID NO: 885572 - DNA, 17 bp, Homo sapiens
tcgacatgctgccagga

SEQ ID NO: 885573 - DNA, 19 bp, Homo sapiens
tcgaccccaaagccccttg

SEQ ID NO: 885574 - DNA, 18 bp, Homo sapiens
tcgacgccccgaacctca

SEQ ID NO: 885575 - DNA, 13 bp, Homo sapiens
tcgactcagcacc

SEQ ID NO: 885576 - DNA, 14 bp, Homo sapiens
tcgactcaggatcc

SEQ ID NO: 885577 - DNA, 16 bp, Homo sapiens
tcgactggtccagctc

SEQ ID NO: 885578 - DNA, 20 bp, Homo sapiens
tcggagggaattgaggtctg

SEQ ID NO: 885579 - DNA, 17 bp, Homo sapiens
tcggagggccgcagggc

SEQ ID NO: 885580 - DNA, 19 bp, Homo sapiens
tcggagggccgcagggccc

SEQ ID NO: 885581 - DNA, 21 bp, Homo sapiens
tcggagggccgcagggcccac

SEQ ID NO: 885582 - DNA, 15 bp, Homo sapiens
tcggatcctgtgagt

SEQ ID NO: 885583 - DNA, 20 bp, Homo sapiens
tcggatggaccaacctgctc

SEQ ID NO: 885584 - DNA, 21 bp, Homo sapiens
tcggatggaccaacctgctct

SEQ ID NO: 885585 - DNA, 22 bp, Homo sapiens
tcggatggaccaacctgctctg

SEQ ID NO: 885586 - DNA, 17 bp, Homo sapiens
tcggattttttccaaaa

SEQ ID NO: 885587 - DNA, 12 bp, Homo sapiens
tcggcacacact

SEQ ID NO: 885588 - DNA, 19 bp, Homo sapiens
tcggcagaactctctgtct

SEQ ID NO: 885589 - DNA, 23 bp, Homo sapiens
tcggcatgccaggacccgccagc

SEQ ID NO: 885590 - DNA, 13 bp, Homo sapiens
tcggccacaggca

SEQ ID NO: 885591 - DNA, 14 bp, Homo sapiens
tcggccactgtgtc

SEQ ID NO: 885592 - DNA, 15 bp, Homo sapiens
tcggccactgtgtct

SEQ ID NO: 885593 - DNA, 11 bp, Homo sapiens
tcggccagccc

SEQ ID NO: 885594 - DNA, 19 bp, Homo sapiens
tcggccaggcattggctca

SEQ ID NO: 885595 - DNA, 14 bp, Homo sapiens
tcggccccacatgg

SEQ ID NO: 885596 - DNA, 17 bp, Homo sapiens
tcggccccacccaccct

SEQ ID NO: 885597 - DNA, 19 bp, Homo sapiens
tcggccccctcaccccagc

SEQ ID NO: 885598 - DNA, 16 bp, Homo sapiens
tcggcccgctgcagcc

SEQ ID NO: 885599 - DNA, 13 bp, Homo sapiens
tcggccctgcgtc

SEQ ID NO: 885600 - DNA, 15 bp, Homo sapiens
tcggctcagcctccc

SEQ ID NO: 885601 - DNA, 19 bp, Homo sapiens
tcggctccccatgtgtcct

SEQ ID NO: 885602 - DNA, 23 bp, Homo sapiens
tcggctccgggcaaatggctgag

SEQ ID NO: 885603 - DNA, 13 bp, Homo sapiens
tcggctctggagg

SEQ ID NO: 885604 - DNA, 16 bp, Homo sapiens
tcggctgaccatgctc

SEQ ID NO: 885605 - DNA, 17 bp, Homo sapiens
tcggcttggatcctggg

SEQ ID NO: 885606 - DNA, 19 bp, Homo sapiens
tcggcttggatcctgggct

SEQ ID NO: 885607 - DNA, 20 bp, Homo sapiens
tcgggacacctgccctgccc

SEQ ID NO: 885608 - DNA, 14 bp, Homo sapiens
tcgggaccacatct

SEQ ID NO: 885609 - DNA, 19 bp, Homo sapiens
tcgggacttgaaaaccact

SEQ ID NO: 885610 - DNA, 15 bp, Homo sapiens
tcgggagcagtgtct

SEQ ID NO: 885611 - DNA, 15 bp, Homo sapiens
tcgggagctgcacac

SEQ ID NO: 885612 - DNA, 16 bp, Homo sapiens
tcgggagctgcacaca

SEQ ID NO: 885613 - DNA, 21 bp, Homo sapiens
tcgggagctgcacacacctgg

SEQ ID NO: 885614 - DNA, 15 bp, Homo sapiens
tcgggcaccagccag

SEQ ID NO: 885615 - DNA, 16 bp, Homo sapiens
tcgggcaccagccagc

SEQ ID NO: 885616 - DNA, 16 bp, Homo sapiens
tcgggcagccagcaga

SEQ ID NO: 885617 - DNA, 15 bp, Homo sapiens
tcgggcagtcctgtg

SEQ ID NO: 885618 - DNA, 13 bp, Homo sapiens
tcgggcccaggga

SEQ ID NO: 885619 - DNA, 13 bp, Homo sapiens
tcgggcccttccc

SEQ ID NO: 885620 - DNA, 18 bp, Homo sapiens
tcgggcgtgggtctctgg

SEQ ID NO: 885621 - DNA, 16 bp, Homo sapiens
tcgggctaaggtccct

SEQ ID NO: 885622 - DNA, 21 bp, Homo sapiens
tcgggctctctcacccagcct

SEQ ID NO: 885623 - DNA, 19 bp, Homo sapiens
tcgggctggagcctccgac

SEQ ID NO: 885624 - DNA, 19 bp, Homo sapiens
tcggggagaggctgaggac

SEQ ID NO: 885625 - DNA, 15 bp, Homo sapiens
tcggggatggggagg

SEQ ID NO: 885626 - DNA, 22 bp, Homo sapiens
tcggggcccttggggcctggct

SEQ ID NO: 885627 - DNA, 12 bp, Homo sapiens
tcggggctgctg

SEQ ID NO: 885628 - DNA, 14 bp, Homo sapiens
tcggggctgctgtg

SEQ ID NO: 885629 - DNA, 18 bp, Homo sapiens
tcgggggagcagagagag

SEQ ID NO: 885630 - DNA, 22 bp, Homo sapiens
tcgggggcccaagtggggtgct

SEQ ID NO: 885631 - DNA, 13 bp, Homo sapiens
tcgggggcctgca

SEQ ID NO: 885632 - DNA, 16 bp, Homo sapiens
tcggggtaaaaagtgg

SEQ ID NO: 885633 - DNA, 21 bp, Homo sapiens
tcggggtaaaaagtggctgcg

SEQ ID NO: 885634 - DNA, 13 bp, Homo sapiens
tcggggtccacca

SEQ ID NO: 885635 - DNA, 18 bp, Homo sapiens
tcggggtccaccagtgtg

SEQ ID NO: 885636 - DNA, 15 bp, Homo sapiens
tcgggtccagagacc

SEQ ID NO: 885637 - DNA, 15 bp, Homo sapiens
tcgggtgccaggaca

SEQ ID NO: 885638 - DNA, 22 bp, Homo sapiens
tcgggttcagaacactttttat

SEQ ID NO: 885639 - DNA, 21 bp, Homo sapiens
tcggtaagttgaatggcctgc

SEQ ID NO: 885640 - DNA, 16 bp, Homo sapiens
tcggtcagcgactgga

SEQ ID NO: 885641 - DNA, 18 bp, Homo sapiens
tcggtctcccaaagtgct

SEQ ID NO: 885642 - DNA, 20 bp, Homo sapiens
tcggtctcccttccgtccat

SEQ ID NO: 885643 - DNA, 22 bp, Homo sapiens
tcggtggccctgactgtcaggg

SEQ ID NO: 885644 - DNA, 13 bp, Homo sapiens
tcggtggctctgg

SEQ ID NO: 885645 - DNA, 17 bp, Homo sapiens
tcggtggctctggggta

SEQ ID NO: 885646 - DNA, 16 bp, Homo sapiens
tcggtgggccagagct

SEQ ID NO: 885647 - DNA, 15 bp, Homo sapiens
tcggtgtccatttat

SEQ ID NO: 885648 - DNA, 20 bp, Homo sapiens
tcgtaaaaaaatagaaaaaa

SEQ ID NO: 885649 - DNA, 13 bp, Homo sapiens
tcgtaaagatttg

SEQ ID NO: 885650 - DNA, 15 bp, Homo sapiens
tcgtaaagatttggg

SEQ ID NO: 885651 - DNA, 16 bp, Homo sapiens
tcgtaacctggtgcct

SEQ ID NO: 885652 - DNA, 15 bp, Homo sapiens
tcgtacagaaagctg

SEQ ID NO: 885653 - DNA, 19 bp, Homo sapiens
tcgtacataataagtttca

SEQ ID NO: 885654 - DNA, 15 bp, Homo sapiens
tcgtaccgcttcctt

SEQ ID NO: 885655 - DNA, 12 bp, Homo sapiens
tcgtagctttcc

SEQ ID NO: 885656 - DNA, 22 bp, Homo sapiens
tcgtagctttcccaaataaact

SEQ ID NO: 885657 - DNA, 17 bp, Homo sapiens
tcgtatgatcagtactg

SEQ ID NO: 885658 - DNA, 18 bp, Homo sapiens
tcgtcacgagcacaatgg

SEQ ID NO: 885659 - DNA, 23 bp, Homo sapiens
tcgtcactgcttaacttcacata

SEQ ID NO: 885660 - DNA, 20 bp, Homo sapiens
tcgtccacaggggcaggcct

SEQ ID NO: 885661 - DNA, 22 bp, Homo sapiens
tcgtccacaggggcaggcctgg

SEQ ID NO: 885662 - DNA, 15 bp, Homo sapiens
tcgtccagccctcct

SEQ ID NO: 885663 - DNA, 14 bp, Homo sapiens
tcgtcccatccagc

SEQ ID NO: 885664 - DNA, 13 bp, Homo sapiens
tcgtccccctccc

SEQ ID NO: 885665 - DNA, 14 bp, Homo sapiens
tcgtccttcctctc

SEQ ID NO: 885666 - DNA, 14 bp, Homo sapiens
tcgtctaaacataa

SEQ ID NO: 885667 - DNA, 15 bp, Homo sapiens
tcgtctcatcctcct

SEQ ID NO: 885668 - DNA, 17 bp, Homo sapiens
tcgtctcatcctccttt

SEQ ID NO: 885669 - DNA, 18 bp, Homo sapiens
tcgtctcatcctcctttc

SEQ ID NO: 885670 - DNA, 21 bp, Homo sapiens
tcgtctccagccccttctcag

SEQ ID NO: 885671 - DNA, 22 bp, Homo sapiens
tcgtctccctggtgcctctgtg

SEQ ID NO: 885672 - DNA, 21 bp, Homo sapiens
tcgtctcggccttcacaatct

SEQ ID NO: 885673 - DNA, 15 bp, Homo sapiens
tcgtctgactctggg

SEQ ID NO: 885674 - DNA, 17 bp, Homo sapiens
tcgtcttccgtctcccc

SEQ ID NO: 885675 - DNA, 19 bp, Homo sapiens
tcgtcttccgtctcccccg

SEQ ID NO: 885676 - DNA, 19 bp, Homo sapiens
tcgtcttgtgtttgctgca

SEQ ID NO: 885677 - DNA, 15 bp, Homo sapiens
tcgtcttgttgttat

SEQ ID NO: 885678 - DNA, 15 bp, Homo sapiens
tcgtctttgtgtatg

SEQ ID NO: 885679 - DNA, 19 bp, Homo sapiens
tcgtgacccttcagggcca

SEQ ID NO: 885680 - DNA, 14 bp, Homo sapiens
tcgtgagctgggga

SEQ ID NO: 885681 - DNA, 15 bp, Homo sapiens
tcgtgagctggggac

SEQ ID NO: 885682 - DNA, 18 bp, Homo sapiens
tcgtgagctggggactca

SEQ ID NO: 885683 - DNA, 19 bp, Homo sapiens
tcgtgagtcatttaaatgt

SEQ ID NO: 885684 - DNA, 15 bp, Homo sapiens
tcgtgatgtggagga

SEQ ID NO: 885685 - DNA, 23 bp, Homo sapiens
tcgtgatgtggaggaagagccac

SEQ ID NO: 885686 - DNA, 21 bp, Homo sapiens
tcgtgcatttgaggggccagg

SEQ ID NO: 885687 - DNA, 22 bp, Homo sapiens
tcgtgccaccccgagggctgag

SEQ ID NO: 885688 - DNA, 13 bp, Homo sapiens
tcgtgccagcagc

SEQ ID NO: 885689 - DNA, 18 bp, Homo sapiens
tcgtgccagcagcctcgc

SEQ ID NO: 885690 - DNA, 17 bp, Homo sapiens
tcgtgccatgatctgta

SEQ ID NO: 885691 - DNA, 23 bp, Homo sapiens
tcgtgccgttactctccaacctg

SEQ ID NO: 885692 - DNA, 22 bp, Homo sapiens
tcgtgctactgcactccagcct

SEQ ID NO: 885693 - DNA, 18 bp, Homo sapiens
tcgtggacacacacagac

SEQ ID NO: 885694 - DNA, 22 bp, Homo sapiens
tcgtggacacacacagactatt

SEQ ID NO: 885695 - DNA, 13 bp, Homo sapiens
tcgtggagccatt

SEQ ID NO: 885696 - DNA, 22 bp, Homo sapiens
tcgtggcagataatcagcctct

SEQ ID NO: 885697 - DNA, 15 bp, Homo sapiens
tcgtggcagcacggc

SEQ ID NO: 885698 - DNA, 12 bp, Homo sapiens
tcgtggccagcc

SEQ ID NO: 885699 - DNA, 14 bp, Homo sapiens
tcgtggccagcccg

SEQ ID NO: 885700 - DNA, 11 bp, Homo sapiens
tcgtggccttc

SEQ ID NO: 885701 - DNA, 16 bp, Homo sapiens
tcgtggtagaagccag

SEQ ID NO: 885702 - DNA, 14 bp, Homo sapiens
tcgtggtaggactg

SEQ ID NO: 885703 - DNA, 17 bp, Homo sapiens
tcgaggaaccagagcca

SEQ ID NO: 885704 - DNA, 19 bp, Homo sapiens
tcgaggcaccggcgctgca

SEQ ID NO: 885705 - DNA, 17 bp, Homo sapiens
tcgaggcatggggcatg

SEQ ID NO: 885706 - DNA, 14 bp, Homo sapiens
tcgaggcctacaga

SEQ ID NO: 885707 - DNA, 14 bp, Homo sapiens
tcgaggcctgcaaa

SEQ ID NO: 885708 - DNA, 22 bp, Homo sapiens
tcgaggcctgcaaaccttcctg

SEQ ID NO: 885709 - DNA, 14 bp, Homo sapiens
tcgaggctggtggt

SEQ ID NO: 885710 - DNA, 21 bp, Homo sapiens
tcgaggctggtggttttcaga

SEQ ID NO: 885711 - DNA, 19 bp, Homo sapiens
tcgagggccgcctgcctta

SEQ ID NO: 885712 - DNA, 14 bp, Homo sapiens
tcgaggtgtcaccc

SEQ ID NO: 885713 - DNA, 17 bp, Homo sapiens
tcgagtaaacttgaaaa

SEQ ID NO: 885714 - DNA, 16 bp, Homo sapiens
tcgagtgaatttctaa

SEQ ID NO: 885715 - DNA, 23 bp, Homo sapiens
tcgagtgcccctgtcccacctgg

SEQ ID NO: 885716 - DNA, 22 bp, Homo sapiens
tcgagttggcaaaatggggttt

SEQ ID NO: 885717 - DNA, 13 bp, Homo sapiens
tcgatatgtatat

SEQ ID NO: 885718 - DNA, 22 bp, Homo sapiens
tcgatatgtatatcattctaca

SEQ ID NO: 885719 - DNA, 15 bp, Homo sapiens
tcgatgaaggctgcc

SEQ ID NO: 885720 - DNA, 22 bp, Homo sapiens
tcgatgactgtgaactgggcat

SEQ ID NO: 885721 - DNA, 14 bp, Homo sapiens
tcgatgcactgacc

SEQ ID NO: 885722 - DNA, 18 bp, Homo sapiens
tcgatgcctttgctgttt

SEQ ID NO: 885723 - DNA, 17 bp, Homo sapiens
tcgatgcgtattctgtg

SEQ ID NO: 885724 - DNA, 24 bp, Homo sapiens
tcgatgcgtattctgtggccgcca

SEQ ID NO: 885725 - DNA, 22 bp, Homo sapiens
tcgattagactggacagcttgt

SEQ ID NO: 885726 - DNA, 17 bp, Homo sapiens
tcgattcatattgaata

SEQ ID NO: 885727 - DNA, 19 bp, Homo sapiens
tcgattgttgtaaactgtt

SEQ ID NO: 885728 - DNA, 14 bp, Homo sapiens
tcgcaaccctgcct

SEQ ID NO: 885729 - DNA, 15 bp, Homo sapiens
tcgcacaatgcatgt

SEQ ID NO: 885730 - DNA, 15 bp, Homo sapiens
tcgcacaatgtttga

SEQ ID NO: 885731 - DNA, 13 bp, Homo sapiens
tcgcacacagggc

SEQ ID NO: 885732 - DNA, 14 bp, Homo sapiens
tcgcacacagggct

SEQ ID NO: 885733 - DNA, 16 bp, Homo sapiens
tcgcacacagggctca

SEQ ID NO: 885734 - DNA, 24 bp, Homo sapiens
tcgcacacagggctcacagggcag

SEQ ID NO: 885735 - DNA, 16 bp, Homo sapiens
tcgcaccattctgact

SEQ ID NO: 885736 - DNA, 13 bp, Homo sapiens
tcgcaccggagtg

SEQ ID NO: 885737 - DNA, 22 bp, Homo sapiens
tcgcaccggagtgtctggaatt

SEQ ID NO: 885738 - DNA, 17 bp, Homo sapiens
tcgcaccttttatacca

SEQ ID NO: 885739 - DNA, 16 bp, Homo sapiens
tcgcacttgcagagga

SEQ ID NO: 885740 - DNA, 17 bp, Homo sapiens
tcgcagagcttttcaga

SEQ ID NO: 885741 - DNA, 23 bp, Homo sapiens
tcgcagcccccgcgccctccctc

SEQ ID NO: 885742 - DNA, 20 bp, Homo sapiens
tcgcaggatccgctgccacc

SEQ ID NO: 885743 - DNA, 22 bp, Homo sapiens
tcgcaggatccgctgccaccac

SEQ ID NO: 885744 - DNA, 16 bp, Homo sapiens
tcgcagggtgcaggag

SEQ ID NO: 885745 - DNA, 16 bp, Homo sapiens
tcgcatccgtcctggg

SEQ ID NO: 885746 - DNA, 18 bp, Homo sapiens
tcgcatccgtcctgggcg

SEQ ID NO: 885747 - DNA, 14 bp, Homo sapiens
tcgcattaagcaca

SEQ ID NO: 885748 - DNA, 16 bp, Homo sapiens
tcgccacgctcagtgc

SEQ ID NO: 885749 - DNA, 17 bp, Homo sapiens
tcgccacgctcagtgcc

SEQ ID NO: 885750 - DNA, 18 bp, Homo sapiens
tcgccacgctcagtgccc

SEQ ID NO: 885751 - DNA, 19 bp, Homo sapiens
tcgccacgctcagtgcccg

SEQ ID NO: 885752 - DNA, 20 bp, Homo sapiens
tcgccacgctcagtgcccgt

SEQ ID NO: 885753 - DNA, 12 bp, Homo sapiens
tcgccagcttgg

SEQ ID NO: 885754 - DNA, 14 bp, Homo sapiens
tcgccagcttggct

SEQ ID NO: 885755 - DNA, 21 bp, Homo sapiens
tcgccagtcactgctgcaagg

SEQ ID NO: 885756 - DNA, 16 bp, Homo sapiens
tcgccataggccaagg

SEQ ID NO: 885757 - DNA, 18 bp, Homo sapiens
tcgccatcaaggtccagt

SEQ ID NO: 885758 - DNA, 13 bp, Homo sapiens
tcgccatgccggg

SEQ ID NO: 885759 - DNA, 15 bp, Homo sapiens
tcgcccacccagctg

SEQ ID NO: 885760 - DNA, 17 bp, Homo sapiens
tcgcccacccagctggt

SEQ ID NO: 885761 - DNA, 21 bp, Homo sapiens
tcgcccacccgagtacctcca

SEQ ID NO: 885762 - DNA, 22 bp, Homo sapiens
tcgcccacccgagtacctccag

SEQ ID NO: 885763 - DNA, 11 bp, Homo sapiens
tcgcccagcag

SEQ ID NO: 885764 - DNA, 20 bp, Homo sapiens
tcgcccaggcctgggatgca

SEQ ID NO: 885765 - DNA, 21 bp, Homo sapiens
tcgccccaaggttccagaggc

SEQ ID NO: 885766 - DNA, 13 bp, Homo sapiens
tcgccccagactc

SEQ ID NO: 885767 - DNA, 12 bp, Homo sapiens
tcgccccagtgg

SEQ ID NO: 885768 - DNA, 12 bp, Homo sapiens
tcgccccatccc

SEQ ID NO: 885769 - DNA, 14 bp, Homo sapiens
tcgcccccaccagt

SEQ ID NO: 885770 - DNA, 19 bp, Homo sapiens
tcgcccctcccctcagcct

SEQ ID NO: 885771 - DNA, 15 bp, Homo sapiens
tcgcccgcccacacg

SEQ ID NO: 885772 - DNA, 21 bp, Homo sapiens
tcgcccgcccactgtcctggg

SEQ ID NO: 885773 - DNA, 17 bp, Homo sapiens
tcgccctcccaggctct

SEQ ID NO: 885774 - DNA, 14 bp, Homo sapiens
tcgccctcctttct

SEQ ID NO: 885775 - DNA, 16 bp, Homo sapiens
tcgccgtgtctcagcc

SEQ ID NO: 885776 - DNA, 21 bp, Homo sapiens
tcgcctgacaaccactggtct

SEQ ID NO: 885777 - DNA, 22 bp, Homo sapiens
tcgcctgacaaccactggtctg

SEQ ID NO: 885778 - DNA, 19 bp, Homo sapiens
tcgcctgtggagctcagcc

SEQ ID NO: 885779 - DNA, 12 bp, Homo sapiens
tcgccttaaact

SEQ ID NO: 885780 - DNA, 13 bp, Homo sapiens
tcgccttaaactc

SEQ ID NO: 885781 - DNA, 14 bp, Homo sapiens
tcgccttaaactct

SEQ ID NO: 885782 - DNA, 18 bp, Homo sapiens
tcgcgacatcttctcaac

SEQ ID NO: 885783 - DNA, 17 bp, Homo sapiens
tcgcgagtgtaactttc

SEQ ID NO: 885784 - DNA, 21 bp, Homo sapiens
tcgcgccagcgacctctctgc

SEQ ID NO: 885785 - DNA, 18 bp, Homo sapiens
tcgcgcgtctcccatcct

SEQ ID NO: 885786 - DNA, 17 bp, Homo sapiens
tcgcggccctcagtagt

SEQ ID NO: 885787 - DNA, 22 bp, Homo sapiens
tcgcggccctcagtagtccctg

SEQ ID NO: 885788 - DNA, 21 bp, Homo sapiens
tcgcggctgggagcctcgccc

SEQ ID NO: 885789 - DNA, 14 bp, Homo sapiens
tcgcggtcttgggc

SEQ ID NO: 885790 - DNA, 16 bp, Homo sapiens
tcgcgtgccctcgctg

SEQ ID NO: 885791 - DNA, 12 bp, Homo sapiens
tcgctagaaaaa

SEQ ID NO: 885792 - DNA, 19 bp, Homo sapiens
tcgctcaggctggagtgca

SEQ ID NO: 885793 - DNA, 22 bp, Homo sapiens
tcgctcaggtgatcaaaataaa

SEQ ID NO: 885794 - DNA, 14 bp, Homo sapiens
tcgctcagtctgtt

SEQ ID NO: 885795 - DNA, 16 bp, Homo sapiens
tcgctcagtctgttca

SEQ ID NO: 885796 - DNA, 17 bp, Homo sapiens
tcgctccatcgcccagg

SEQ ID NO: 885797 - DNA, 12 bp, Homo sapiens
tcgctcccctct

SEQ ID NO: 885798 - DNA, 23 bp, Homo sapiens
tcgctccctgtagctctgcctcc

SEQ ID NO: 885799 - DNA, 14 bp, Homo sapiens
tcgctctcagttct

SEQ ID NO: 885800 - DNA, 20 bp, Homo sapiens
tcgtggtaggactgtagaaa

SEQ ID NO: 885801 - DNA, 22 bp, Homo sapiens
tcgtggtgatcaattaaatgta

SEQ ID NO: 885802 - DNA, 19 bp, Homo sapiens
tcgtggttattagcaaggc

SEQ ID NO: 885803 - DNA, 17 bp, Homo sapiens
tcgtggttcttaaatgt

SEQ ID NO: 885804 - DNA, 17 bp, Homo sapiens
tcgtgtaattggcccaa

SEQ ID NO: 885805 - DNA, 20 bp, Homo sapiens
tcgtgtagtggaagagcagc

SEQ ID NO: 885806 - DNA, 23 bp, Homo sapiens
tcgtgtagtggaagagcagcctg

SEQ ID NO: 885807 - DNA, 22 bp, Homo sapiens
tcgtgtatcctggggctccctt

SEQ ID NO: 885808 - DNA, 16 bp, Homo sapiens
tcgtgtcccctatcct

SEQ ID NO: 885809 - DNA, 14 bp, Homo sapiens
tcgtgtctctccca

SEQ ID NO: 885810 - DNA, 21 bp, Homo sapiens
tcgtgtgatttcctacagaaa

SEQ ID NO: 885811 - DNA, 14 bp, Homo sapiens
tcgtgtggctcctg

SEQ ID NO: 885812 - DNA, 15 bp, Homo sapiens
tcgtgtggctcctgg

SEQ ID NO: 885813 - DNA, 21 bp, Homo sapiens
tcgtgtgtttctattttttga

SEQ ID NO: 885814 - DNA, 22 bp, Homo sapiens
tcgtgttttcaaggaagaaaac

SEQ ID NO: 885815 - DNA, 23 bp, Homo sapiens
tcgtgttttcaaggaagaaaacg

SEQ ID NO: 885816 - DNA, 14 bp, Homo sapiens
tcgttaactgtgta

SEQ ID NO: 885817 - DNA, 15 bp, Homo sapiens
tcgttaactgtgtat

SEQ ID NO: 885818 - DNA, 21 bp, Homo sapiens
tcgttaatagattatttcata

SEQ ID NO: 885819 - DNA, 21 bp, Homo sapiens
tcgttatttctgtttgtttaa

SEQ ID NO: 885820 - DNA, 19 bp, Homo sapiens
tcgttcattgcctttccag

SEQ ID NO: 885821 - DNA, 14 bp, Homo sapiens
tcgttccccacccc

SEQ ID NO: 885822 - DNA, 15 bp, Homo sapiens
tcgttccccacccct

SEQ ID NO: 885823 - DNA, 22 bp, Homo sapiens
tcgttcgcagagcttttcagat

SEQ ID NO: 885824 - DNA, 13 bp, Homo sapiens
tcgttctccttcc

SEQ ID NO: 885825 - DNA, 18 bp, Homo sapiens
tcgttctttttaagttaa

SEQ ID NO: 885826 - DNA, 19 bp, Homo sapiens
tcgttggatgtctgtgagt

SEQ ID NO: 885827 - DNA, 17 bp, Homo sapiens
tcgttggtagagccctc

SEQ ID NO: 885828 - DNA, 19 bp, Homo sapiens
tcgttggtagagccctcag

SEQ ID NO: 885829 - DNA, 15 bp, Homo sapiens
tcgtttccatcatgt

SEQ ID NO: 885830 - DNA, 13 bp, Homo sapiens
tcgtttctgtata

SEQ ID NO: 885831 - DNA, 21 bp, Homo sapiens
tcgtttgtgaacgctgtgatg

SEQ ID NO: 885832 - DNA, 13 bp, Homo sapiens
tcgtttgtttgtt

SEQ ID NO: 885833 - DNA, 20 bp, Homo sapiens
tcgttttcataacttgctga

SEQ ID NO: 885834 - DNA, 21 bp, Homo sapiens
tcgttttcttaaagtgccagt

SEQ ID NO: 885835 - DNA, 14 bp, Homo sapiens
tctaaaaacaccaa

SEQ ID NO: 885836 - DNA, 19 bp, Homo sapiens
tctaaaaagacctggcctt

SEQ ID NO: 885837 - DNA, 13 bp, Homo sapiens
tctaaaacaaaat

SEQ ID NO: 885838 - DNA, 17 bp, Homo sapiens
tctaaaagttttctaat

SEQ ID NO: 885839 - DNA, 21 bp, Homo sapiens
tctaaaatgcctcagtgtatt

SEQ ID NO: 885840 - DNA, 22 bp, Homo sapiens
tctaaacagacaggaatttaga

SEQ ID NO: 885841 - DNA, 22 bp, Homo sapiens
tctaaacataagtaactttaag

SEQ ID NO: 885842 - DNA, 13 bp, Homo sapiens
tctaaacattaat

SEQ ID NO: 885843 - DNA, 14 bp, Homo sapiens
tctaaacattaatc

SEQ ID NO: 885844 - DNA, 13 bp, Homo sapiens
tctaaaccaaaac

SEQ ID NO: 885845 - DNA, 19 bp, Homo sapiens
tctaaacccaatccaaatg

SEQ ID NO: 885846 - DNA, 18 bp, Homo sapiens
tctaaaccccagattctt

SEQ ID NO: 885847 - DNA, 20 bp, Homo sapiens
tctaaaccccagattcttca

SEQ ID NO: 885848 - DNA, 13 bp, Homo sapiens
tctaaactgcaaa

SEQ ID NO: 885849 - DNA, 14 bp, Homo sapiens
tctaaactgcatta

SEQ ID NO: 885850 - DNA, 15 bp, Homo sapiens
tctaaactggtacaa

SEQ ID NO: 885851 - DNA, 16 bp, Homo sapiens
tctaaactggtacaat

SEQ ID NO: 885852 - DNA, 12 bp, Homo sapiens
tctaaagaaaaa

SEQ ID NO: 885853 - DNA, 14 bp, Homo sapiens
tctaaagaaacttg

SEQ ID NO: 885854 - DNA, 22 bp, Homo sapiens
tctaaagatcaagtgggccttg

SEQ ID NO: 885855 - DNA, 22 bp, Homo sapiens
tctaaagcactggtttcaagaa

SEQ ID NO: 885856 - DNA, 17 bp, Homo sapiens
tctaaaggatggaaaaa

SEQ ID NO: 885857 - DNA, 13 bp, Homo sapiens
tctaaaggctacc

SEQ ID NO: 885858 - DNA, 16 bp, Homo sapiens
tctaaaggctaccttt

SEQ ID NO: 885859 - DNA, 19 bp, Homo sapiens
tctaaaggctacctttgta

SEQ ID NO: 885860 - DNA, 20 bp, Homo sapiens
tctaaaggggttttttggga

SEQ ID NO: 885861 - DNA, 22 bp, Homo sapiens
tctaaagtgttggtctttctaa

SEQ ID NO: 885862 - DNA, 20 bp, Homo sapiens
tctaaagttactactgattt

SEQ ID NO: 885863 - DNA, 14 bp, Homo sapiens
tctaaagttatatt

SEQ ID NO: 885864 - DNA, 16 bp, Homo sapiens
tctaaataaaaatatg

SEQ ID NO: 885865 - DNA, 22 bp, Homo sapiens
tctaaataaaaatatgtaattt

SEQ ID NO: 885866 - DNA, 14 bp, Homo sapiens
tctaaataaggaat

SEQ ID NO: 885867 - DNA, 21 bp, Homo sapiens
tctaaataggatcctggaggc

SEQ ID NO: 885868 - DNA, 23 bp, Homo sapiens
tctaaatatttccttaaactgtg

SEQ ID NO: 885869 - DNA, 19 bp, Homo sapiens
tctaaatctatttattaat

SEQ ID NO: 885870 - DNA, 13 bp, Homo sapiens
tctaaatgcagtt

SEQ ID NO: 885871 - DNA, 19 bp, Homo sapiens
tctaaatgcagttttaaga

SEQ ID NO: 885872 - DNA, 14 bp, Homo sapiens
tctaaatgcatatc

SEQ ID NO: 885873 - DNA, 23 bp, Homo sapiens
tctaacaagtcataggttaatat

SEQ ID NO: 885874 - DNA, 16 bp, Homo sapiens
tctaacaattttcaga

SEQ ID NO: 885875 - DNA, 21 bp, Homo sapiens
tctaacagccctcctctgcac

SEQ ID NO: 885876 - DNA, 12 bp, Homo sapiens
tctaacagtcct

SEQ ID NO: 885877 - DNA, 24 bp, Homo sapiens
tctaacatatgatactgatgccat

SEQ ID NO: 885878 - DNA, 19 bp, Homo sapiens
tctaaccacttaaggacct

SEQ ID NO: 885879 - DNA, 13 bp, Homo sapiens
tctaaccattcaa

SEQ ID NO: 885880 - DNA, 15 bp, Homo sapiens
tctaaccattcaaat

SEQ ID NO: 885881 - DNA, 22 bp, Homo sapiens
tctaaccccctctgctctgtcc

SEQ ID NO: 885882 - DNA, 12 bp, Homo sapiens
tctaaccctgtg

SEQ ID NO: 885883 - DNA, 16 bp, Homo sapiens
tctaaccctgtggaag

SEQ ID NO: 885884 - DNA, 15 bp, Homo sapiens
tctaacctgatggca

SEQ ID NO: 885885 - DNA, 12 bp, Homo sapiens
tctaaccttgaa

SEQ ID NO: 885886 - DNA, 20 bp, Homo sapiens
tctaaccttgaatgctgcca

SEQ ID NO: 885887 - DNA, 22 bp, Homo sapiens
tctaacctttacatgaggactc

SEQ ID NO: 885888 - DNA, 20 bp, Homo sapiens
tctataaagaagaacttgca

SEQ ID NO: 885889 - DNA, 12 bp, Homo sapiens
tctataaagcat

SEQ ID NO: 885890 - DNA, 16 bp, Homo sapiens
tctataaagcatttaa

SEQ ID NO: 885891 - DNA, 13 bp, Homo sapiens
tctataaatatat

SEQ ID NO: 885892 - DNA, 15 bp, Homo sapiens
tctataagagaatta

SEQ ID NO: 885893 - DNA, 14 bp, Homo sapiens
tctataaggccata

SEQ ID NO: 885894 - DNA, 22 bp, Homo sapiens
tctataagtagtaaatcagaaa

SEQ ID NO: 885895 - DNA, 16 bp, Homo sapiens
tctataagttgtacca

SEQ ID NO: 885896 - DNA, 13 bp, Homo sapiens
tctataatttcca

SEQ ID NO: 885897 - DNA, 22 bp, Homo sapiens
tctataatttccatttacttaa

SEQ ID NO: 885898 - DNA, 15 bp, Homo sapiens
tctatacatctctcc

SEQ ID NO: 885899 - DNA, 15 bp, Homo sapiens
tctatacctgccttt

SEQ ID NO: 885900 - DNA, 20 bp, Homo sapiens
tctatacctgtctcctttct

SEQ ID NO: 885901 - DNA, 21 bp, Homo sapiens
tctatagaaaaagtaaaagat

SEQ ID NO: 885902 - DNA, 13 bp, Homo sapiens
tctatagactcta

SEQ ID NO: 885903 - DNA, 15 bp, Homo sapiens
tctataggcagcttc

SEQ ID NO: 885904 - DNA, 20 bp, Homo sapiens
tctataggcagcttctaaga

SEQ ID NO: 885905 - DNA, 16 bp, Homo sapiens
tctatatatgtgtatg

SEQ ID NO: 885906 - DNA, 18 bp, Homo sapiens
tctatatgtacttgtcaa

SEQ ID NO: 885907 - DNA, 14 bp, Homo sapiens
tctatattaaatga

SEQ ID NO: 885908 - DNA, 18 bp, Homo sapiens
tctatattagatcaaata

SEQ ID NO: 885909 - DNA, 22 bp, Homo sapiens
tctatattattgcccatgatat

SEQ ID NO: 885910 - DNA, 20 bp, Homo sapiens
tctatcaactttaatcaagt

SEQ ID NO: 885911 - DNA, 23 bp, Homo sapiens
tctatcaactttaatcaagttgt

SEQ ID NO: 885912 - DNA, 15 bp, Homo sapiens
tctatcaagtattat

SEQ ID NO: 885913 - DNA, 22 bp, Homo sapiens
tctatcaagtattatacctttt

SEQ ID NO: 885914 - DNA, 22 bp, Homo sapiens
tctatcagacgtgctccctccc

SEQ ID NO: 885915 - DNA, 18 bp, Homo sapiens
tctatcagcattgtttca

SEQ ID NO: 885916 - DNA, 23 bp, Homo sapiens
tctatcaggggtgcattctggcc

SEQ ID NO: 885917 - DNA, 16 bp, Homo sapiens
tctatcagttatcctt

SEQ ID NO: 885918 - DNA, 16 bp, Homo sapiens
tctatcattccaattc

SEQ ID NO: 885919 - DNA, 18 bp, Homo sapiens
tctatccaaatctgaaga

SEQ ID NO: 885920 - DNA, 14 bp, Homo sapiens
tctatccatctcct

SEQ ID NO: 885921 - DNA, 17 bp, Homo sapiens
tctatccccaagctggc

SEQ ID NO: 885922 - DNA, 18 bp, Homo sapiens
tctatcccccttaaagaa

SEQ ID NO: 885923 - DNA, 13 bp, Homo sapiens
tctatcctctctc

SEQ ID NO: 885924 - DNA, 15 bp, Homo sapiens
tctatcctctctctc

SEQ ID NO: 885925 - DNA, 16 bp, Homo sapiens
tctatccttttgcctg

SEQ ID NO: 885926 - DNA, 15 bp, Homo sapiens
tctatctatttgagg

SEQ ID NO: 885927 - DNA, 12 bp, Homo sapiens
tctatctcatct

SEQ ID NO: 885928 - DNA, 17 bp, Homo sapiens
tctatcttccaaatgca

SEQ ID NO: 885929 - DNA, 18 bp, Homo sapiens
tctatgaaataatgtgaa

SEQ ID NO: 885930 - DNA, 15 bp, Homo sapiens
tctatgacaaattca

SEQ ID NO: 885931 - DNA, 14 bp, Homo sapiens
tctatgacacatgc

SEQ ID NO: 885932 - DNA, 17 bp, Homo sapiens
tctatgacacatgcaag

SEQ ID NO: 885933 - DNA, 12 bp, Homo sapiens
tctatgagaaaa

SEQ ID NO: 885934 - DNA, 22 bp, Homo sapiens
tctatgagaacaagtcacagct

SEQ ID NO: 885935 - DNA, 22 bp, Homo sapiens
tctatgcaaaatgtctgtttta

SEQ ID NO: 885936 - DNA, 21 bp, Homo sapiens
tctatgcaaagcactctctgc

SEQ ID NO: 885937 - DNA, 20 bp, Homo sapiens
tctatgcataaaaaaatgat

SEQ ID NO: 885938 - DNA, 15 bp, Homo sapiens
tctatgccaaagatc

SEQ ID NO: 885939 - DNA, 16 bp, Homo sapiens
tctatgccctgcagag

SEQ ID NO: 885940 - DNA, 14 bp, Homo sapiens
tctatgcctgcact

SEQ ID NO: 885941 - DNA, 22 bp, Homo sapiens
tctatggaaatgtgagaaatgt

SEQ ID NO: 885942 - DNA, 17 bp, Homo sapiens
tctatggagactttgct

SEQ ID NO: 885943 - DNA, 15 bp, Homo sapiens
tctatgggtttagtt

SEQ ID NO: 885944 - DNA, 17 bp, Homo sapiens
tctatgtaaattattgt

SEQ ID NO: 885945 - DNA, 20 bp, Homo sapiens
tctatgtaaattattgtaaa

SEQ ID NO: 885946 - DNA, 15 bp, Homo sapiens
tctatgtcattttta

SEQ ID NO: 885947 - DNA, 18 bp, Homo sapiens
tctatgtcatttttaatg

SEQ ID NO: 885948 - DNA, 20 bp, Homo sapiens
tctatgtcgtgttttcaagg

SEQ ID NO: 885949 - DNA, 21 bp, Homo sapiens
tctatgtcgtgttttcaagga

SEQ ID NO: 885950 - DNA, 14 bp, Homo sapiens
tctatgtctgcctt

SEQ ID NO: 885951 - DNA, 22 bp, Homo sapiens
tctatgtgctctgtactggagg

SEQ ID NO: 885952 - DNA, 17 bp, Homo sapiens
tctatgtgtttctgtaa

SEQ ID NO: 885953 - DNA, 14 bp, Homo sapiens
tctatgttaaatac

SEQ ID NO: 885954 - DNA, 15 bp, Homo sapiens
tctatgttaaatact

SEQ ID NO: 885955 - DNA, 22 bp, Homo sapiens
tctatgttaaatactgtgcaga

SEQ ID NO: 885956 - DNA, 23 bp, Homo sapiens
tctatgttaaatactgtgcagaa

SEQ ID NO: 885957 - DNA, 14 bp, Homo sapiens
tctatgttcaaaga

SEQ ID NO: 885958 - DNA, 12 bp, Homo sapiens
tctatgttggtt

SEQ ID NO: 885959 - DNA, 17 bp, Homo sapiens
tctatgttggtttcagt

SEQ ID NO: 885960 - DNA, 16 bp, Homo sapiens
tctcactgttctgcaa

SEQ ID NO: 885961 - DNA, 18 bp, Homo sapiens
tctcacttaccccgagac

SEQ ID NO: 885962 - DNA, 16 bp, Homo sapiens
tctcacttcaattaat

SEQ ID NO: 885963 - DNA, 15 bp, Homo sapiens
tctcacttctaaatt

SEQ ID NO: 885964 - DNA, 19 bp, Homo sapiens
tctcagaaatgctgtccct

SEQ ID NO: 885965 - DNA, 22 bp, Homo sapiens
tctcagaaccttgtcccagcca

SEQ ID NO: 885966 - DNA, 12 bp, Homo sapiens
tctcagaagcac

SEQ ID NO: 885967 - DNA, 14 bp, Homo sapiens
tctcagaagtactt

SEQ ID NO: 885968 - DNA, 21 bp, Homo sapiens
tctcagaatcccttaacagtt

SEQ ID NO: 885969 - DNA, 19 bp, Homo sapiens
tctcagaatctaaacgtgg

SEQ ID NO: 885970 - DNA, 19 bp, Homo sapiens
tctcagaatctacccaaag

SEQ ID NO: 885971 - DNA, 20 bp, Homo sapiens
tctcagaatttatctccctt

SEQ ID NO: 885972 - DNA, 13 bp, Homo sapiens
tctcagaccttta

SEQ ID NO: 885973 - DNA, 16 bp, Homo sapiens
tctcagactgcatgta

SEQ ID NO: 885974 - DNA, 13 bp, Homo sapiens
tctcagagcagca

SEQ ID NO: 885975 - DNA, 17 bp, Homo sapiens
tctcagagcatgtgtca

SEQ ID NO: 885976 - DNA, 15 bp, Homo sapiens
tctcagagccaagtc

SEQ ID NO: 885977 - DNA, 16 bp, Homo sapiens
tctcagagctctcgag

SEQ ID NO: 885978 - DNA, 15 bp, Homo sapiens
tctcagaggcctgct

SEQ ID NO: 885979 - DNA, 15 bp, Homo sapiens
tctcagagtccactg

SEQ ID NO: 885980 - DNA, 23 bp, Homo sapiens
tctcagatatttatatttttatt

SEQ ID NO: 885981 - DNA, 16 bp, Homo sapiens
tctcagatcttgacag

SEQ ID NO: 885982 - DNA, 17 bp, Homo sapiens
tctcagatcttgacagt

SEQ ID NO: 885983 - DNA, 21 bp, Homo sapiens
tctcagatgccccaaagtttc

SEQ ID NO: 885984 - DNA, 12 bp, Homo sapiens
tctcagattctg

SEQ ID NO: 885985 - DNA, 14 bp, Homo sapiens
tctcagatttctga

SEQ ID NO: 885986 - DNA, 21 bp, Homo sapiens
tctcagcaaagctacaggact

SEQ ID NO: 885987 - DNA, 18 bp, Homo sapiens
tctcagcatagcctgcct

SEQ ID NO: 885988 - DNA, 14 bp, Homo sapiens
tctcagccatccgc

SEQ ID NO: 885989 - DNA, 17 bp, Homo sapiens
tctcagccccatcgccc

SEQ ID NO: 885990 - DNA, 11 bp, Homo sapiens
tctcagcctcc

SEQ ID NO: 885991 - DNA, 19 bp, Homo sapiens
tctcagcctcctgagcctg

SEQ ID NO: 885992 - DNA, 15 bp, Homo sapiens
tctcagcctctgcca

SEQ ID NO: 885993 - DNA, 15 bp, Homo sapiens
tctcagctaagctca

SEQ ID NO: 885994 - DNA, 16 bp, Homo sapiens
tctcagctccaggtgg

SEQ ID NO: 885995 - DNA, 21 bp, Homo sapiens
tctcagctccaggtggctctg

SEQ ID NO: 885996 - DNA, 17 bp, Homo sapiens
tctcagctttccctgcc

SEQ ID NO: 885997 - DNA, 16 bp, Homo sapiens
tctcaggacagcatcc

SEQ ID NO: 885998 - DNA, 16 bp, Homo sapiens
tctcaggagatggagg

SEQ ID NO: 885999 - DNA, 15 bp, Homo sapiens
tctcaggagcatggg

SEQ ID NO: 886000 - DNA, 16 bp, Homo sapiens
tctcaggagcttgggc

SEQ ID NO: 886001 - DNA, 20 bp, Homo sapiens
tctcaggaggaggctgccct

SEQ ID NO: 886002 - DNA, 22 bp, Homo sapiens
tctcaggatttcaccagaagtt

SEQ ID NO: 886003 - DNA, 19 bp, Homo sapiens
tctcaggcagcaccacact

SEQ ID NO: 886004 - DNA, 12 bp, Homo sapiens
tctcagggaggg

SEQ ID NO: 886005 - DNA, 14 bp, Homo sapiens
tctcagggcctggt

SEQ ID NO: 886006 - DNA, 15 bp, Homo sapiens
tctcagggcctggtc

SEQ ID NO: 886007 - DNA, 19 bp, Homo sapiens
tctcagggcctggtcgttt

SEQ ID NO: 886008 - DNA, 20 bp, Homo sapiens
tctcagggctggagcctggg

SEQ ID NO: 886009 - DNA, 20 bp, Homo sapiens
tctcaggggccagaggaact

SEQ ID NO: 886010 - DNA, 16 bp, Homo sapiens
tctcaggggctgtttg

SEQ ID NO: 886011 - DNA, 15 bp, Homo sapiens
tctcagggtcactgt

SEQ ID NO: 886012 - DNA, 18 bp, Homo sapiens
tctcagggtcactgtcct

SEQ ID NO: 886013 - DNA, 19 bp, Homo sapiens
tctcaggtaatcattttaa

SEQ ID NO: 886014 - DNA, 22 bp, Homo sapiens
tctcaggtagaaggttgacaca

SEQ ID NO: 886015 - DNA, 21 bp, Homo sapiens
tctcaggtgccactccctgag

SEQ ID NO: 886016 - DNA, 22 bp, Homo sapiens
tctcaggtgccactccctgagc

SEQ ID NO: 886017 - DNA, 19 bp, Homo sapiens
tctcaggttggcggcagac

SEQ ID NO: 886018 - DNA, 21 bp, Homo sapiens
tctcaggtttgttttgtgaat

SEQ ID NO: 886019 - DNA, 20 bp, Homo sapiens
tctcagtaccccatggagct

SEQ ID NO: 886020 - DNA, 15 bp, Homo sapiens
tctcagtcagtaatt

SEQ ID NO: 886021 - DNA, 17 bp, Homo sapiens
tctcagtctctgagcag

SEQ ID NO: 886022 - DNA, 15 bp, Homo sapiens
tctcagtgttttgga

SEQ ID NO: 886023 - DNA, 19 bp, Homo sapiens
tctcagtgttttggactcc

SEQ ID NO: 886024 - DNA, 21 bp, Homo sapiens
tctcagttaaaatgtgaggaa

SEQ ID NO: 886025 - DNA, 18 bp, Homo sapiens
tctcagttcgtgtttgat

SEQ ID NO: 886026 - DNA, 21 bp, Homo sapiens
tctcagttcgtgtttgattcc

SEQ ID NO: 886027 - DNA, 18 bp, Homo sapiens
tctcagttctcttgcttt

SEQ ID NO: 886028 - DNA, 18 bp, Homo sapiens
tctcagttgtttgcttct

SEQ ID NO: 886029 - DNA, 13 bp, Homo sapiens
tctcagtttcact

SEQ ID NO: 886030 - DNA, 18 bp, Homo sapiens
tctcagtttgtgtgtctt

SEQ ID NO: 886031 - DNA, 16 bp, Homo sapiens
tctcataaaactgtga

SEQ ID NO: 886032 - DNA, 16 bp, Homo sapiens
tctcataggaaaagta

SEQ ID NO: 886033 - DNA, 24 bp, Homo sapiens
tctcataggaaaagtacatttaat

SEQ ID NO: 886034 - DNA, 20 bp, Homo sapiens
tctcataggttgagcaattt

SEQ ID NO: 886035 - DNA, 18 bp, Homo sapiens
tctcatcaacttaaaagt

SEQ ID NO: 886036 - DNA, 17 bp, Homo sapiens
tctcatcaccccagagg

SEQ ID NO: 886037 - DNA, 15 bp, Homo sapiens
tctcatcatattgta

SEQ ID NO: 886038 - DNA, 19 bp, Homo sapiens
tctcatcatccttgcttta

SEQ ID NO: 886039 - DNA, 10 bp, Homo sapiens
tctcatcatg

SEQ ID NO: 886040 - DNA, 13 bp, Homo sapiens
tctcatccatcat

SEQ ID NO: 886041 - DNA, 14 bp, Homo sapiens
tctcatccccaggg

SEQ ID NO: 886042 - DNA, 15 bp, Homo sapiens
tctcatccccagggg

SEQ ID NO: 886043 - DNA, 17 bp, Homo sapiens
tctcatccccccacccg

SEQ ID NO: 886044 - DNA, 18 bp, Homo sapiens
tctcatcctcctttcagt

SEQ ID NO: 886045 - DNA, 19 bp, Homo sapiens
tctcatcgccagacaactg

SEQ ID NO: 886046 - DNA, 16 bp, Homo sapiens
tctcatctcctgaccc

SEQ ID NO: 886047 - DNA, 23 bp, Homo sapiens
tctcatctcctgaccctcccact

SEQ ID NO: 886048 - DNA, 24 bp, Homo sapiens
tctcatctcctgaccctcccactc

SEQ ID NO: 886049 - DNA, 18 bp, Homo sapiens
tctcatctcttcaggttc

SEQ ID NO: 886050 - DNA, 13 bp, Homo sapiens
tctcatctgcacc

SEQ ID NO: 886051 - DNA, 23 bp, Homo sapiens
tctcatctgcacccttcttttct

SEQ ID NO: 886052 - DNA, 13 bp, Homo sapiens
tctcatctgtgat

SEQ ID NO: 886053 - DNA, 14 bp, Homo sapiens
tctcatcttctctc

SEQ ID NO: 886054 - DNA, 15 bp, Homo sapiens
tctcatcttctctca

SEQ ID NO: 886055 - DNA, 15 bp, Homo sapiens
tctcatcttgttctt

SEQ ID NO: 886056 - DNA, 14 bp, Homo sapiens
tctcatgaagcagg

SEQ ID NO: 886057 - DNA, 17 bp, Homo sapiens
tctcatgagaagccaag

SEQ ID NO: 886058 - DNA, 16 bp, Homo sapiens
tctcatgctccttaat

SEQ ID NO: 886059 - DNA, 13 bp, Homo sapiens
tctcatgtaattt

SEQ ID NO: 886060 - DNA, 17 bp, Homo sapiens
tctcatgtccctccagg

SEQ ID NO: 886061 - DNA, 15 bp, Homo sapiens
tctcatgtgtttgca

SEQ ID NO: 886062 - DNA, 17 bp, Homo sapiens
tctcatgtgtttgcata

SEQ ID NO: 886063 - DNA, 18 bp, Homo sapiens
tctcatgttccttttgaa

SEQ ID NO: 886064 - DNA, 19 bp, Homo sapiens
tctcatgttccttttgaaa

SEQ ID NO: 886065 - DNA, 17 bp, Homo sapiens
tctcatgttttcaactg

SEQ ID NO: 886066 - DNA, 17 bp, Homo sapiens
tctcattcagtattaaa

SEQ ID NO: 886067 - DNA, 16 bp, Homo sapiens
tctcattccccaggtg

SEQ ID NO: 886068 - DNA, 20 bp, Homo sapiens
tctcattctttgaacatgaa

SEQ ID NO: 886069 - DNA, 15 bp, Homo sapiens
tctcattgcttacaa

SEQ ID NO: 886070 - DNA, 14 bp, Homo sapiens
tctcattgcttctg

SEQ ID NO: 886071 - DNA, 20 bp, Homo sapiens
tctcattggacccttccatg

SEQ ID NO: 886072 - DNA, 14 bp, Homo sapiens
tctcattgtcttgt

SEQ ID NO: 886073 - DNA, 15 bp, Homo sapiens
tctcatttctcaggt

SEQ ID NO: 886074 - DNA, 18 bp, Homo sapiens
tctcattttggtctgttt

SEQ ID NO: 886075 - DNA, 20 bp, Homo sapiens
tctcattttttaaaaaagct

SEQ ID NO: 886076 - DNA, 17 bp, Homo sapiens
tctccaaaataaaactt

SEQ ID NO: 886077 - DNA, 16 bp, Homo sapiens
tctccaaactgattaa

SEQ ID NO: 886078 - DNA, 19 bp, Homo sapiens
tctccaaaggggctgctgg

SEQ ID NO: 886079 - DNA, 20 bp, Homo sapiens
tctccagggagcaagacaga

SEQ ID NO: 886080 - DNA, 20 bp, Homo sapiens
tctccaggggctgcttcctc

SEQ ID NO: 886081 - DNA, 22 bp, Homo sapiens
tctccaggggctgcttcctcct

SEQ ID NO: 886082 - DNA, 19 bp, Homo sapiens
tctccagtatccactttgc

SEQ ID NO: 886083 - DNA, 20 bp, Homo sapiens
tctccagttgggactcagga

SEQ ID NO: 886084 - DNA, 17 bp, Homo sapiens
tctccagtttttgagga

SEQ ID NO: 886085 - DNA, 23 bp, Homo sapiens
tctccagtttttgaggagccagc

SEQ ID NO: 886086 - DNA, 21 bp, Homo sapiens
tctccataaacatgaaaacac

SEQ ID NO: 886087 - DNA, 20 bp, Homo sapiens
tctccatcaccctcttcctg

SEQ ID NO: 886088 - DNA, 22 bp, Homo sapiens
tctccatcagatgtgttcctcc

SEQ ID NO: 886089 - DNA, 13 bp, Homo sapiens
tctccatcccctc

SEQ ID NO: 886090 - DNA, 19 bp, Homo sapiens
tctccatcccctccctgcc

SEQ ID NO: 886091 - DNA, 20 bp, Homo sapiens
tctccatcccctccctgcct

SEQ ID NO: 886092 - DNA, 15 bp, Homo sapiens
tctccatgaagagct

SEQ ID NO: 886093 - DNA, 17 bp, Homo sapiens
tctccatgaagagcttg

SEQ ID NO: 886094 - DNA, 15 bp, Homo sapiens
tctccatgctgcaaa

SEQ ID NO: 886095 - DNA, 12 bp, Homo sapiens
tctccatggccc

SEQ ID NO: 886096 - DNA, 15 bp, Homo sapiens
tctccatggccctgc

SEQ ID NO: 886097 - DNA, 17 bp, Homo sapiens
tctccatggcttcctcc

SEQ ID NO: 886098 - DNA, 19 bp, Homo sapiens
tctccatttggaattacaa

SEQ ID NO: 886099 - DNA, 18 bp, Homo sapiens
tctcccaaagtgctggga

SEQ ID NO: 886100 - DNA, 13 bp, Homo sapiens
tctcccaacatgg

SEQ ID NO: 886101 - DNA, 19 bp, Homo sapiens
tctcccaactcttgcacag

SEQ ID NO: 886102 - DNA, 22 bp, Homo sapiens
tctcccaactcttgcacagtca

SEQ ID NO: 886103 - DNA, 18 bp, Homo sapiens
tctcccacacccaccctt

SEQ ID NO: 886104 - DNA, 19 bp, Homo sapiens
tctcccacagagtgctgga

SEQ ID NO: 886105 - DNA, 21 bp, Homo sapiens
tctcccacagagtgctggact

SEQ ID NO: 886106 - DNA, 16 bp, Homo sapiens
tctcccacatcccact

SEQ ID NO: 886107 - DNA, 23 bp, Homo sapiens
tctcccacccggccacagctgct

SEQ ID NO: 886108 - DNA, 16 bp, Homo sapiens
tctcccaccctaaggg

SEQ ID NO: 886109 - DNA, 14 bp, Homo sapiens
tctcccacgtggga

SEQ ID NO: 886110 - DNA, 15 bp, Homo sapiens
tctcccacttcctcc

SEQ ID NO: 886111 - DNA, 13 bp, Homo sapiens
tctcccactttct

SEQ ID NO: 886112 - DNA, 16 bp, Homo sapiens
tctcccactttctgtt

SEQ ID NO: 886113 - DNA, 14 bp, Homo sapiens
tctcccagaactat

SEQ ID NO: 886114 - DNA, 18 bp, Homo sapiens
tctcccagataatgtgaa

SEQ ID NO: 886115 - DNA, 13 bp, Homo sapiens
tctcccagcactg

SEQ ID NO: 886116 - DNA, 19 bp, Homo sapiens
tctcccagcactgcctcct

SEQ ID NO: 886117 - DNA, 20 bp, Homo sapiens
tctcccagcactgcctcctg

SEQ ID NO: 886118 - DNA, 17 bp, Homo sapiens
tctcccagctctagaca

SEQ ID NO: 886119 - DNA, 16 bp, Homo sapiens
tctcccaggccccctg

SEQ ID NO: 886120 - DNA, 18 bp, Homo sapiens
tctcccaggcctgcctgc

SEQ ID NO: 886121 - DNA, 14 bp, Homo sapiens
tctcccaggctgtc

SEQ ID NO: 886122 - DNA, 21 bp, Homo sapiens
tctcccagggagtgagcagct

SEQ ID NO: 886123 - DNA, 13 bp, Homo sapiens
tctcccagtctct

SEQ ID NO: 886124 - DNA, 20 bp, Homo sapiens
tctcccagtgaactcctgcc

SEQ ID NO: 886125 - DNA, 11 bp, Homo sapiens
tctcccatccc

SEQ ID NO: 886126 - DNA, 13 bp, Homo sapiens
tctcccatccccc

SEQ ID NO: 886127 - DNA, 14 bp, Homo sapiens
tctcccatccccct

SEQ ID NO: 886128 - DNA, 19 bp, Homo sapiens
tctcccatccccctgccct

SEQ ID NO: 886129 - DNA, 18 bp, Homo sapiens
tctcccattgtccctctg

SEQ ID NO: 886130 - DNA, 16 bp, Homo sapiens
tctcccatttcaggaa

SEQ ID NO: 886131 - DNA, 18 bp, Homo sapiens
tctcccatttcctgatct

SEQ ID NO: 886132 - DNA, 20 bp, Homo sapiens
tctccccaacccccattctc

SEQ ID NO: 886133 - DNA, 23 bp, Homo sapiens
tctccccaacccccattctcatc

SEQ ID NO: 886134 - DNA, 17 bp, Homo sapiens
tctccccacccctaccc

SEQ ID NO: 886135 - DNA, 14 bp, Homo sapiens
tctagaaacaaaca

SEQ ID NO: 886136 - DNA, 16 bp, Homo sapiens
tctagaaactctggct

SEQ ID NO: 886137 - DNA, 16 bp, Homo sapiens
tctagaaagaaaagac

SEQ ID NO: 886138 - DNA, 20 bp, Homo sapiens
tctagaaagaaaagaccctg

SEQ ID NO: 886139 - DNA, 11 bp, Homo sapiens
tctagaaatgc

SEQ ID NO: 886140 - DNA, 18 bp, Homo sapiens
tctagaagatgtgtaaac

SEQ ID NO: 886141 - DNA, 19 bp, Homo sapiens
tctagaagatgtgtaaaca

SEQ ID NO: 886142 - DNA, 22 bp, Homo sapiens
tctagaagatgtgtaaacaggt

SEQ ID NO: 886143 - DNA, 23 bp, Homo sapiens
tctagaagatgtgtaaacaggta

SEQ ID NO: 886144 - DNA, 17 bp, Homo sapiens
tctagaagccaagggaa

SEQ ID NO: 886145 - DNA, 20 bp, Homo sapiens
tctagaagccaagggaaagg

SEQ ID NO: 886146 - DNA, 22 bp, Homo sapiens
tctagaatgtggatttgattca

SEQ ID NO: 886147 - DNA, 20 bp, Homo sapiens
tctagaatgtgttttctgaa

SEQ ID NO: 886148 - DNA, 17 bp, Homo sapiens
tctagacaagatattgt

SEQ ID NO: 886149 - DNA, 18 bp, Homo sapiens
tctagacaagatattgta

SEQ ID NO: 886150 - DNA, 21 bp, Homo sapiens
tctagacaagatattgtacat

SEQ ID NO: 886151 - DNA, 23 bp, Homo sapiens
tctagacaagatattgtacataa

SEQ ID NO: 886152 - DNA, 13 bp, Homo sapiens
tctagacagtatt

SEQ ID NO: 886153 - DNA, 21 bp, Homo sapiens
tctagacagtattgccacctc

SEQ ID NO: 886154 - DNA, 23 bp, Homo sapiens
tctagacagtattgccacctctg

SEQ ID NO: 886155 - DNA, 17 bp, Homo sapiens
tctagacattcttttaa

SEQ ID NO: 886156 - DNA, 17 bp, Homo sapiens
tctagactttctcagtg

SEQ ID NO: 886157 - DNA, 13 bp, Homo sapiens
tctagactttctg

SEQ ID NO: 886158 - DNA, 16 bp, Homo sapiens
tctagagaagaggctg

SEQ ID NO: 886159 - DNA, 12 bp, Homo sapiens
tctagagacaca

SEQ ID NO: 886160 - DNA, 13 bp, Homo sapiens
tctagagacacat

SEQ ID NO: 886161 - DNA, 23 bp, Homo sapiens
tctagagagatgagaagccagga

SEQ ID NO: 886162 - DNA, 13 bp, Homo sapiens
tctagagagggag

SEQ ID NO: 886163 - DNA, 18 bp, Homo sapiens
tctagagcagttggccaa

SEQ ID NO: 886164 - DNA, 14 bp, Homo sapiens
tctagagcctcgac

SEQ ID NO: 886165 - DNA, 12 bp, Homo sapiens
tctagagccttc

SEQ ID NO: 886166 - DNA, 13 bp, Homo sapiens
tctagagccttca

SEQ ID NO: 886167 - DNA, 18 bp, Homo sapiens
tctagagccttcagcctt

SEQ ID NO: 886168 - DNA, 14 bp, Homo sapiens
tctagaggcctcag

SEQ ID NO: 886169 - DNA, 15 bp, Homo sapiens
tctagaggcctcagt

SEQ ID NO: 886170 - DNA, 21 bp, Homo sapiens
tctagagtcatgtgagcctcg

SEQ ID NO: 886171 - DNA, 15 bp, Homo sapiens
tctagagtctcagaa

SEQ ID NO: 886172 - DNA, 18 bp, Homo sapiens
tctagagttatcttcttt

SEQ ID NO: 886173 - DNA, 15 bp, Homo sapiens
tctagatacaataaa

SEQ ID NO: 886174 - DNA, 22 bp, Homo sapiens
tctagatcctgcaccccagcat

SEQ ID NO: 886175 - DNA, 19 bp, Homo sapiens
tctagatgaagttttacat

SEQ ID NO: 886176 - DNA, 23 bp, Homo sapiens
tctagatgaagttttacattgtt

SEQ ID NO: 886177 - DNA, 18 bp, Homo sapiens
tctagatggctcctctca

SEQ ID NO: 886178 - DNA, 15 bp, Homo sapiens
tctagcaattttctt

SEQ ID NO: 886179 - DNA, 22 bp, Homo sapiens
tctagcaattttctttgtttct

SEQ ID NO: 886180 - DNA, 22 bp, Homo sapiens
tctagcacaatttgcactaaat

SEQ ID NO: 886181 - DNA, 12 bp, Homo sapiens
tctagcaggcag

SEQ ID NO: 886182 - DNA, 23 bp, Homo sapiens
tctagcagtaaaagataaatttg

SEQ ID NO: 886183 - DNA, 15 bp, Homo sapiens
tctagcatttatttc

SEQ ID NO: 886184 - DNA, 14 bp, Homo sapiens
tctagccactccct

SEQ ID NO: 886185 - DNA, 15 bp, Homo sapiens
tctagccactccctc

SEQ ID NO: 886186 - DNA, 16 bp, Homo sapiens
tctagcccctctggat

SEQ ID NO: 886187 - DNA, 13 bp, Homo sapiens
tctagcctggcta

SEQ ID NO: 886188 - DNA, 14 bp, Homo sapiens
tctagcctgggcca

SEQ ID NO: 886189 - DNA, 20 bp, Homo sapiens
tctagcctgggccagagaag

SEQ ID NO: 886190 - DNA, 20 bp, Homo sapiens
tctagcgaacgtatttctcc

SEQ ID NO: 886191 - DNA, 21 bp, Homo sapiens
tctagcgaacgtatttctcca

SEQ ID NO: 886192 - DNA, 23 bp, Homo sapiens
tctagcgaacgtatttctccaga

SEQ ID NO: 886193 - DNA, 16 bp, Homo sapiens
tctagctagaaatatg

SEQ ID NO: 886194 - DNA, 21 bp, Homo sapiens
tctagctagaaatatgatttt

SEQ ID NO: 886195 - DNA, 15 bp, Homo sapiens
tctagctatgctgta

SEQ ID NO: 886196 - DNA, 15 bp, Homo sapiens
tctagctggcaggac

SEQ ID NO: 886197 - DNA, 17 bp, Homo sapiens
tctagctggcaggacac

SEQ ID NO: 886198 - DNA, 18 bp, Homo sapiens
tctagctgtatgatttgt

SEQ ID NO: 886199 - DNA, 17 bp, Homo sapiens
tctagcttttctatttt

SEQ ID NO: 886200 - DNA, 22 bp, Homo sapiens
tctagctttttaattaagcaaa

SEQ ID NO: 886201 - DNA, 23 bp, Homo sapiens
tctaggaagaagacaaatgacag

SEQ ID NO: 886202 - DNA, 15 bp, Homo sapiens
tctaggaaggtgtga

SEQ ID NO: 886203 - DNA, 21 bp, Homo sapiens
tctaggacacagttcctggga

SEQ ID NO: 886204 - DNA, 18 bp, Homo sapiens
tctaggagctgggaggaa

SEQ ID NO: 886205 - DNA, 23 bp, Homo sapiens
tctaggatagctaactgtaaatc

SEQ ID NO: 886206 - DNA, 16 bp, Homo sapiens
tctaggcacaaggttg

SEQ ID NO: 886207 - DNA, 18 bp, Homo sapiens
tctaggcatcccagggga

SEQ ID NO: 886208 - DNA, 20 bp, Homo sapiens
tctaggcccattgtcctcct

SEQ ID NO: 886209 - DNA, 23 bp, Homo sapiens
tctaggccccccagaaagctgcc

SEQ ID NO: 886210 - DNA, 23 bp, Homo sapiens
tctgaagtcacatcacaggacac

SEQ ID NO: 886211 - DNA, 15 bp, Homo sapiens
tctgaagtcactgca

SEQ ID NO: 886212 - DNA, 13 bp, Homo sapiens
tctgaagtgccta

SEQ ID NO: 886213 - DNA, 22 bp, Homo sapiens
tctgaagtgcctactggggggc

SEQ ID NO: 886214 - DNA, 18 bp, Homo sapiens
tctgaagtgggaaaaaat

SEQ ID NO: 886215 - DNA, 22 bp, Homo sapiens
tctgaagtggtttgcaggtcag

SEQ ID NO: 886216 - DNA, 14 bp, Homo sapiens
tctgaagttggaca

SEQ ID NO: 886217 - DNA, 13 bp, Homo sapiens
tctgaataaaaaa

SEQ ID NO: 886218 - DNA, 19 bp, Homo sapiens
tctgaataaaaaagattct

SEQ ID NO: 886219 - DNA, 14 bp, Homo sapiens
tctgaatacacagt

SEQ ID NO: 886220 - DNA, 19 bp, Homo sapiens
tctgaatcaagcacactgt

SEQ ID NO: 886221 - DNA, 13 bp, Homo sapiens
tctgaatcactgt

SEQ ID NO: 886222 - DNA, 17 bp, Homo sapiens
tctgaatcactgttgag

SEQ ID NO: 886223 - DNA, 15 bp, Homo sapiens
tctgaatcagaaaag

SEQ ID NO: 886224 - DNA, 13 bp, Homo sapiens
tctgaatcctaag

SEQ ID NO: 886225 - DNA, 20 bp, Homo sapiens
tctgaatctgcgagtagatg

SEQ ID NO: 886226 - DNA, 19 bp, Homo sapiens
tctgaatgcttctaagtaa

SEQ ID NO: 886227 - DNA, 23 bp, Homo sapiens
tctgaatgggagccagaattcac

SEQ ID NO: 886228 - DNA, 13 bp, Homo sapiens
tctgaattcctgt

SEQ ID NO: 886229 - DNA, 15 bp, Homo sapiens
tctgaatttatttaa

SEQ ID NO: 886230 - DNA, 15 bp, Homo sapiens
tctgaatttcctttt

SEQ ID NO: 886231 - DNA, 23 bp, Homo sapiens
tctgacaaaatggggcagaagag

SEQ ID NO: 886232 - DNA, 13 bp, Homo sapiens
tctgacacaaaaa

SEQ ID NO: 886233 - DNA, 20 bp, Homo sapiens
tctgacacgcaagtgtgtga

SEQ ID NO: 886234 - DNA, 20 bp, Homo sapiens
tctgacagtccacaggggcc

SEQ ID NO: 886235 - DNA, 14 bp, Homo sapiens
tctgacatcccttc

SEQ ID NO: 886236 - DNA, 15 bp, Homo sapiens
tctgacatcccttcc

SEQ ID NO: 886237 - DNA, 19 bp, Homo sapiens
tctgacatcccttcctgga

SEQ ID NO: 886238 - DNA, 16 bp, Homo sapiens
tctgacattaacagtt

SEQ ID NO: 886239 - DNA, 22 bp, Homo sapiens
tctgacattaacagttttccat

SEQ ID NO: 886240 - DNA, 13 bp, Homo sapiens
tctgaccacactt

SEQ ID NO: 886241 - DNA, 18 bp, Homo sapiens
tctgaccacacttcctgt

SEQ ID NO: 886242 - DNA, 15 bp, Homo sapiens
tctgacccaaagcaa

SEQ ID NO: 886243 - DNA, 14 bp, Homo sapiens
tctgacccagtgag

SEQ ID NO: 886244 - DNA, 21 bp, Homo sapiens
tctgacccatagcactcttgt

SEQ ID NO: 886245 - DNA, 22 bp, Homo sapiens
tctgacccatagcactcttgtt

SEQ ID NO: 886246 - DNA, 21 bp, Homo sapiens
tctgaccctagctctttcctt

SEQ ID NO: 886247 - DNA, 17 bp, Homo sapiens
tctgaccctcccagtct

SEQ ID NO: 886248 - DNA, 23 bp, Homo sapiens
tctgaccctcccagtctcatctc

SEQ ID NO: 886249 - DNA, 19 bp, Homo sapiens
tctgaccctgcttcaaata

SEQ ID NO: 886250 - DNA, 17 bp, Homo sapiens
tctgaccctgggctttc

SEQ ID NO: 886251 - DNA, 17 bp, Homo sapiens
tctgacccttctacatt

SEQ ID NO: 886252 - DNA, 21 bp, Homo sapiens
tctgaccgttttcacttgtct

SEQ ID NO: 886253 - DNA, 18 bp, Homo sapiens
tctgacctgcactgggga

SEQ ID NO: 886254 - DNA, 14 bp, Homo sapiens
tctgacctgcaggc

SEQ ID NO: 886255 - DNA, 16 bp, Homo sapiens
tctgacctgcaggcca

SEQ ID NO: 886256 - DNA, 17 bp, Homo sapiens
tctgacgcttgtgacag

SEQ ID NO: 886257 - DNA, 17 bp, Homo sapiens
tctgacgtagaaagatc

SEQ ID NO: 886258 - DNA, 20 bp, Homo sapiens
tctgacgtgccttttgcacc

SEQ ID NO: 886259 - DNA, 23 bp, Homo sapiens
tctgactagattattatttgggg

SEQ ID NO: 886260 - DNA, 18 bp, Homo sapiens
tctgactagtagatttct

SEQ ID NO: 886261 - DNA, 13 bp, Homo sapiens
tctgactagttta

SEQ ID NO: 886262 - DNA, 17 bp, Homo sapiens
tctgactagtttaaaga

SEQ ID NO: 886263 - DNA, 13 bp, Homo sapiens
tctgactccagag

SEQ ID NO: 886264 - DNA, 16 bp, Homo sapiens
tctgactccagagtct

SEQ ID NO: 886265 - DNA, 17 bp, Homo sapiens
tctgactccagagtctg

SEQ ID NO: 886266 - DNA, 15 bp, Homo sapiens
tctgactccctcccc

SEQ ID NO: 886267 - DNA, 14 bp, Homo sapiens
tctgactctgagct

SEQ ID NO: 886268 - DNA, 13 bp, Homo sapiens
tctgactctgagt

SEQ ID NO: 886269 - DNA, 16 bp, Homo sapiens
tctgactgccaaataa

SEQ ID NO: 886270 - DNA, 20 bp, Homo sapiens
tctgactgtcacctcgtggg

SEQ ID NO: 886271 - DNA, 13 bp, Homo sapiens
tctgactgtccct

SEQ ID NO: 886272 - DNA, 19 bp, Homo sapiens
tctgacttaagcaaaagaa

SEQ ID NO: 886273 - DNA, 20 bp, Homo sapiens
tctgacttaagcaaaagaaa

SEQ ID NO: 886274 - DNA, 20 bp, Homo sapiens
tctgacttaagctgcctcaa

SEQ ID NO: 886275 - DNA, 22 bp, Homo sapiens
tctgacttccccaaacccagaa

SEQ ID NO: 886276 - DNA, 15 bp, Homo sapiens
tctgacttctgcctg

SEQ ID NO: 886277 - DNA, 17 bp, Homo sapiens
tctgacttctgcctgga

SEQ ID NO: 886278 - DNA, 13 bp, Homo sapiens
tctgacttttaca

SEQ ID NO: 886279 - DNA, 14 bp, Homo sapiens
tctgagaaactcta

SEQ ID NO: 886280 - DNA, 17 bp, Homo sapiens
tctgagaaggtccttaa

SEQ ID NO: 886281 - DNA, 20 bp, Homo sapiens
tctgagaaggtccttaatga

SEQ ID NO: 886282 - DNA, 20 bp, Homo sapiens
tctgagaattccaaggagtt

SEQ ID NO: 886283 - DNA, 22 bp, Homo sapiens
tctgagaattgttgagatactt

SEQ ID NO: 886284 - DNA, 20 bp, Homo sapiens
tctgagacccttttctcagg

SEQ ID NO: 886285 - DNA, 14 bp, Homo sapiens
tctgagactcacag

SEQ ID NO: 886286 - DNA, 16 bp, Homo sapiens
tctgagaggctctccg

SEQ ID NO: 886287 - DNA, 21 bp, Homo sapiens
tctgagaggctctccgtgcag

SEQ ID NO: 886288 - DNA, 21 bp, Homo sapiens
tctgagagttggctcaggcag

SEQ ID NO: 886289 - DNA, 24 bp, Homo sapiens
tctgagatcaaaacggttttactg

SEQ ID NO: 886290 - DNA, 14 bp, Homo sapiens
tctgagatgccccg

SEQ ID NO: 886291 - DNA, 12 bp, Homo sapiens
tctgagatgcta

SEQ ID NO: 886292 - DNA, 18 bp, Homo sapiens
tctgagatgctaatttat

SEQ ID NO: 886293 - DNA, 15 bp, Homo sapiens
tctgagatgctcact

SEQ ID NO: 886294 - DNA, 21 bp, Homo sapiens
tctgagatttttttgtgtatg

SEQ ID NO: 886295 - DNA, 16 bp, Homo sapiens
tctgagcaagagctgg

SEQ ID NO: 886296 - DNA, 18 bp, Homo sapiens
tctgagcacaggtgacag

SEQ ID NO: 886297 - DNA, 20 bp, Homo sapiens
tctgagcaccccctcattcc

SEQ ID NO: 886298 - DNA, 19 bp, Homo sapiens
tctgagccaagggagggaa

SEQ ID NO: 886299 - DNA, 21 bp, Homo sapiens
tctgagccaagggagggaagg

SEQ ID NO: 886300 - DNA, 15 bp, Homo sapiens
tctgagccacagtgg

SEQ ID NO: 886301 - DNA, 23 bp, Homo sapiens
tctgagcccatgttctgccccca

SEQ ID NO: 886302 - DNA, 13 bp, Homo sapiens
tctgagcccgggc

SEQ ID NO: 886303 - DNA, 18 bp, Homo sapiens
tctgagcccgggctgcct

SEQ ID NO: 886304 - DNA, 19 bp, Homo sapiens
tctgagcccgggctgcctg

SEQ ID NO: 886305 - DNA, 20 bp, Homo sapiens
tctgagcccgggctgcctgg

SEQ ID NO: 886306 - DNA, 21 bp, Homo sapiens
tctgagcccggtaagagcaaa

SEQ ID NO: 886307 - DNA, 17 bp, Homo sapiens
tctgagccttgagagaa

SEQ ID NO: 886308 - DNA, 14 bp, Homo sapiens
tctgagcgcctcca

SEQ ID NO: 886309 - DNA, 21 bp, Homo sapiens
tctgagcgcctccatccaagg

SEQ ID NO: 886310 - DNA, 20 bp, Homo sapiens
tctgagctccacctctggtg

SEQ ID NO: 886311 - DNA, 18 bp, Homo sapiens
tctgagctcccacctccc

SEQ ID NO: 886312 - DNA, 12 bp, Homo sapiens
tctgagctgggc

SEQ ID NO: 886313 - DNA, 15 bp, Homo sapiens
tctgagctggggagg

SEQ ID NO: 886314 - DNA, 16 bp, Homo sapiens
tctgagctggggaggt

SEQ ID NO: 886315 - DNA, 14 bp, Homo sapiens
tctgagctgtatct

SEQ ID NO: 886316 - DNA, 18 bp, Homo sapiens
tctgaggaagcagttggg

SEQ ID NO: 886317 - DNA, 12 bp, Homo sapiens
tctgaggacaga

SEQ ID NO: 886318 - DNA, 15 bp, Homo sapiens
tctgaggaccgctga

SEQ ID NO: 886319 - DNA, 14 bp, Homo sapiens
tctgaggactgtcc

SEQ ID NO: 886320 - DNA, 20 bp, Homo sapiens
tctgaggagtaagtgtacaa

SEQ ID NO: 886321 - DNA, 23 bp, Homo sapiens
tctgaggagtaagtgtacaattg

SEQ ID NO: 886322 - DNA, 15 bp, Homo sapiens
tctgaggcttccaga

SEQ ID NO: 886323 - DNA, 16 bp, Homo sapiens
tctgagggaaagtgca

SEQ ID NO: 886324 - DNA, 17 bp, Homo sapiens
tctgagggaaatgtttt

SEQ ID NO: 886325 - DNA, 22 bp, Homo sapiens
tctgagggaaatgttttgtaaa

SEQ ID NO: 886326 - DNA, 13 bp, Homo sapiens
tctgagggaggag

SEQ ID NO: 886327 - DNA, 18 bp, Homo sapiens
tctgaggggaggcacctc

SEQ ID NO: 886328 - DNA, 21 bp, Homo sapiens
tctgaggggctaccaggaaag

SEQ ID NO: 886329 - DNA, 22 bp, Homo sapiens
tctgaggggtgtccgagaggct

SEQ ID NO: 886330 - DNA, 23 bp, Homo sapiens
tctgaggtcaataaagcagagcc

SEQ ID NO: 886331 - DNA, 21 bp, Homo sapiens
tctgaggtgcctgtcccaccc

SEQ ID NO: 886332 - DNA, 21 bp, Homo sapiens
tctgagtcacaggtgtgggat

SEQ ID NO: 886333 - DNA, 18 bp, Homo sapiens
tctgagtccactgctcca

SEQ ID NO: 886334 - DNA, 13 bp, Homo sapiens
tctgcctgtaaat

SEQ ID NO: 886335 - DNA, 13 bp, Homo sapiens
tctgcctgtattt

SEQ ID NO: 886336 - DNA, 23 bp, Homo sapiens
tctgcctgtccccaaacaggaca

SEQ ID NO: 886337 - DNA, 21 bp, Homo sapiens
tctgcctgtccctctcaggca

SEQ ID NO: 886338 - DNA, 18 bp, Homo sapiens
tctgcctgtggccttgcc

SEQ ID NO: 886339 - DNA, 19 bp, Homo sapiens
tctgcctgtggccttgccc

SEQ ID NO: 886340 - DNA, 21 bp, Homo sapiens
tctgcctgtggccttgcccgc

SEQ ID NO: 886341 - DNA, 21 bp, Homo sapiens
tctgcctgttataactctgca

SEQ ID NO: 886342 - DNA, 19 bp, Homo sapiens
tctgccttcacaaatgtca

SEQ ID NO: 886343 - DNA, 20 bp, Homo sapiens
tctgccttcacaaatgtcat

SEQ ID NO: 886344 - DNA, 20 bp, Homo sapiens
tctgccttctcatgatccaa

SEQ ID NO: 886345 - DNA, 22 bp, Homo sapiens
tctgccttggttctggccaccc

SEQ ID NO: 886346 - DNA, 20 bp, Homo sapiens
tctgcctttaattttcttgt

SEQ ID NO: 886347 - DNA, 14 bp, Homo sapiens
tctgcctttatgat

SEQ ID NO: 886348 - DNA, 10 bp, Homo sapiens
tctgcctttg

SEQ ID NO: 886349 - DNA, 14 bp, Homo sapiens
tctgcgccaggcag

SEQ ID NO: 886350 - DNA, 18 bp, Homo sapiens
tctgcgcggatgtagcat

SEQ ID NO: 886351 - DNA, 17 bp, Homo sapiens
tctgcggatctcagctt

SEQ ID NO: 886352 - DNA, 15 bp, Homo sapiens
tctgcggccactgcg

SEQ ID NO: 886353 - DNA, 15 bp, Homo sapiens
tctgcgggaggctgg

SEQ ID NO: 886354 - DNA, 14 bp, Homo sapiens
tctgcgggctccct

SEQ ID NO: 886355 - DNA, 16 bp, Homo sapiens
tctgcgggctccctcc

SEQ ID NO: 886356 - DNA, 23 bp, Homo sapiens
tctgcgggctccctcctctggca

SEQ ID NO: 886357 - DNA, 16 bp, Homo sapiens
tctgcgtcatgcttgt

SEQ ID NO: 886358 - DNA, 15 bp, Homo sapiens
tctgctaaatatcac

SEQ ID NO: 886359 - DNA, 14 bp, Homo sapiens
tctgctaataaaac

SEQ ID NO: 886360 - DNA, 19 bp, Homo sapiens
tctgctacgttcctattgt

SEQ ID NO: 886361 - DNA, 21 bp, Homo sapiens
tctgctacgttcctattgtca

SEQ ID NO: 886362 - DNA, 16 bp, Homo sapiens
tctgctacttcactgt

SEQ ID NO: 886363 - DNA, 18 bp, Homo sapiens
tctgctacttcactgtca

SEQ ID NO: 886364 - DNA, 18 bp, Homo sapiens
tctgctagagcagacagg

SEQ ID NO: 886365 - DNA, 22 bp, Homo sapiens
tctgctagagcagacaggcctg

SEQ ID NO: 886366 - DNA, 20 bp, Homo sapiens
tctgctcaccgcccatcagg

SEQ ID NO: 886367 - DNA, 12 bp, Homo sapiens
tctgctcatcat

SEQ ID NO: 886368 - DNA, 18 bp, Homo sapiens
tctgctcatcattctctg

SEQ ID NO: 886369 - DNA, 22 bp, Homo sapiens
tctgctcatcattctctgtctc

SEQ ID NO: 886370 - DNA, 21 bp, Homo sapiens
tctgctccacccttggcctgt

SEQ ID NO: 886371 - DNA, 14 bp, Homo sapiens
tctgctccagcaac

SEQ ID NO: 886372 - DNA, 13 bp, Homo sapiens
tctgctcccaccc

SEQ ID NO: 886373 - DNA, 14 bp, Homo sapiens
tctgctcccacccc

SEQ ID NO: 886374 - DNA, 16 bp, Homo sapiens
tctgctcccaccccag

SEQ ID NO: 886375 - DNA, 20 bp, Homo sapiens
tctgctcccagatgccttct

SEQ ID NO: 886376 - DNA, 13 bp, Homo sapiens
tctgctccctctg

SEQ ID NO: 886377 - DNA, 12 bp, Homo sapiens
tctgctcctctc

SEQ ID NO: 886378 - DNA, 15 bp, Homo sapiens
tctgctcctctccag

SEQ ID NO: 886379 - DNA, 23 bp, Homo sapiens
tctgctcctgcttttctgtcctg

SEQ ID NO: 886380 - DNA, 23 bp, Homo sapiens
tctgctccttcactgttccctct

SEQ ID NO: 886381 - DNA, 14 bp, Homo sapiens
tctgctcggccgtc

SEQ ID NO: 886382 - DNA, 15 bp, Homo sapiens
tctgctcggccgtct

SEQ ID NO: 886383 - DNA, 22 bp, Homo sapiens
tctgctcggcttcttggacctt

SEQ ID NO: 886384 - DNA, 14 bp, Homo sapiens
tctgctctagccag

SEQ ID NO: 886385 - DNA, 15 bp, Homo sapiens
tctgctctagggaat

SEQ ID NO: 886386 - DNA, 20 bp, Homo sapiens
tctgctctagggaatctgga

SEQ ID NO: 886387 - DNA, 21 bp, Homo sapiens
tctgctctagggaatctggat

SEQ ID NO: 886388 - DNA, 20 bp, Homo sapiens
tctgctctgaggcttccaga

SEQ ID NO: 886389 - DNA, 21 bp, Homo sapiens
tctgctctgcgtgtcacctgt

SEQ ID NO: 886390 - DNA, 13 bp, Homo sapiens
tctgctctggaat

SEQ ID NO: 886391 - DNA, 13 bp, Homo sapiens
tctgctctggtgg

SEQ ID NO: 886392 - DNA, 17 bp, Homo sapiens
tctgctctggtggctta

SEQ ID NO: 886393 - DNA, 21 bp, Homo sapiens
tctgctctggttgtttctgtt

SEQ ID NO: 886394 - DNA, 23 bp, Homo sapiens
tctgctcttgtttcactccacca

SEQ ID NO: 886395 - DNA, 16 bp, Homo sapiens
tctgctctttctctgc

SEQ ID NO: 886396 - DNA, 15 bp, Homo sapiens
tctgctgacctgctg

SEQ ID NO: 886397 - DNA, 14 bp, Homo sapiens
tctgctgactgttt

SEQ ID NO: 886398 - DNA, 18 bp, Homo sapiens
tctgctgactgtttcatt

SEQ ID NO: 886399 - DNA, 19 bp, Homo sapiens
tctgctgaggcccagtgca

SEQ ID NO: 886400 - DNA, 19 bp, Homo sapiens
tctgctgagtgctgggcac

SEQ ID NO: 886401 - DNA, 19 bp, Homo sapiens
tctgctgcagttaccacag

SEQ ID NO: 886402 - DNA, 11 bp, Homo sapiens
tctgctgcccc

SEQ ID NO: 886403 - DNA, 19 bp, Homo sapiens
tctgctgcctctacacagg

SEQ ID NO: 886404 - DNA, 14 bp, Homo sapiens
tctgctgcctctgt

SEQ ID NO: 886405 - DNA, 16 bp, Homo sapiens
tctgctgcctctgtgg

SEQ ID NO: 886406 - DNA, 16 bp, Homo sapiens
tctgctgctctgacct

SEQ ID NO: 886407 - DNA, 17 bp, Homo sapiens
tctgctggaaggggcag

SEQ ID NO: 886408 - DNA, 23 bp, Homo sapiens
tctgctggaaggggcagcaggag

SEQ ID NO: 886409 - DNA, 22 bp, Homo sapiens
tctgctggaggaggggaagctg

SEQ ID NO: 886410 - DNA, 16 bp, Homo sapiens
tctgctggataaaatg

SEQ ID NO: 886411 - DNA, 22 bp, Homo sapiens
tctgctggataaaatgaggttc

SEQ ID NO: 886412 - DNA, 20 bp, Homo sapiens
tctgctggcccagccaaacc

SEQ ID NO: 886413 - DNA, 15 bp, Homo sapiens
tctgctggcctggat

SEQ ID NO: 886414 - DNA, 16 bp, Homo sapiens
tctgctggcctggatc

SEQ ID NO: 886415 - DNA, 15 bp, Homo sapiens
tctgctggcctggcc

SEQ ID NO: 886416 - DNA, 16 bp, Homo sapiens
tctgctggcctggccg

SEQ ID NO: 886417 - DNA, 18 bp, Homo sapiens
tctgctggtatttctaat

SEQ ID NO: 886418 - DNA, 12 bp, Homo sapiens
tctgctgtgtgg

SEQ ID NO: 886419 - DNA, 14 bp, Homo sapiens
tctgctgttcttca

SEQ ID NO: 886420 - DNA, 22 bp, Homo sapiens
tctgctgttcttcacttctggg

SEQ ID NO: 886421 - DNA, 22 bp, Homo sapiens
tctgcttacaattccctgctgt

SEQ ID NO: 886422 - DNA, 20 bp, Homo sapiens
tctgcttaccgttcaagagg

SEQ ID NO: 886423 - DNA, 14 bp, Homo sapiens
tctgcttagaaata

SEQ ID NO: 886424 - DNA, 17 bp, Homo sapiens
tctgcttagaaataaca

SEQ ID NO: 886425 - DNA, 22 bp, Homo sapiens
tctgcttagaaataacagaaga

SEQ ID NO: 886426 - DNA, 17 bp, Homo sapiens
tctgcttaggagagacc

SEQ ID NO: 886427 - DNA, 18 bp, Homo sapiens
tctgcttcaataaatctt

SEQ ID NO: 886428 - DNA, 13 bp, Homo sapiens
tctgcttcagtgg

SEQ ID NO: 886429 - DNA, 21 bp, Homo sapiens
tctgcttccatggcttcctga

SEQ ID NO: 886430 - DNA, 12 bp, Homo sapiens
tctgcttctcca

SEQ ID NO: 886431 - DNA, 19 bp, Homo sapiens
tctgcttctctgacttctg

SEQ ID NO: 886432 - DNA, 22 bp, Homo sapiens
tctgcttctctgacttctgcct

SEQ ID NO: 886433 - DNA, 15 bp, Homo sapiens
tctgcttctttgcct

SEQ ID NO: 886434 - DNA, 15 bp, Homo sapiens
tctgcttgcctagcc

SEQ ID NO: 886435 - DNA, 19 bp, Homo sapiens
tctgcttgcctagccccag

SEQ ID NO: 886436 - DNA, 21 bp, Homo sapiens
tctgctttaaagggcctgcct

SEQ ID NO: 886437 - DNA, 20 bp, Homo sapiens
tctgctttatcttttcataa

SEQ ID NO: 886438 - DNA, 19 bp, Homo sapiens
tctgctttccttttctctg

SEQ ID NO: 886439 - DNA, 19 bp, Homo sapiens
tctgcttttaaacttggct

SEQ ID NO: 886440 - DNA, 13 bp, Homo sapiens
tctgcttttatct

SEQ ID NO: 886441 - DNA, 15 bp, Homo sapiens
tctgcttttctgccc

SEQ ID NO: 886442 - DNA, 18 bp, Homo sapiens
tctgcttttctgccctgg

SEQ ID NO: 886443 - DNA, 19 bp, Homo sapiens
tctgcttttctgccctggc

SEQ ID NO: 886444 - DNA, 21 bp, Homo sapiens
tctggaaaaaaaatatatata

SEQ ID NO: 886445 - DNA, 23 bp, Homo sapiens
tctggaaaaaaacaaaaacagaa

SEQ ID NO: 886446 - DNA, 14 bp, Homo sapiens
tctggaaaactatt

SEQ ID NO: 886447 - DNA, 21 bp, Homo sapiens
tctggaaaactattgagcctt

SEQ ID NO: 886448 - DNA, 19 bp, Homo sapiens
tctggaaaactcaggattc

SEQ ID NO: 886449 - DNA, 22 bp, Homo sapiens
tctgagtcctgtctctgcctgc

SEQ ID NO: 886450 - DNA, 22 bp, Homo sapiens
tctgagtctatgttcaaagact

SEQ ID NO: 886451 - DNA, 13 bp, Homo sapiens
tctgagtgaacct

SEQ ID NO: 886452 - DNA, 18 bp, Homo sapiens
tctgagtgaacctgtata

SEQ ID NO: 886453 - DNA, 20 bp, Homo sapiens
tctgagtgaacctgtataag

SEQ ID NO: 886454 - DNA, 19 bp, Homo sapiens
tctgagtggaggaagccca

SEQ ID NO: 886455 - DNA, 12 bp, Homo sapiens
tctgagtggtgt

SEQ ID NO: 886456 - DNA, 24 bp, Homo sapiens
tctgagtgtttttactacagttgt

SEQ ID NO: 886457 - DNA, 14 bp, Homo sapiens
tctgagtttaccat

SEQ ID NO: 886458 - DNA, 15 bp, Homo sapiens
tctgagtttaccatt

SEQ ID NO: 886459 - DNA, 20 bp, Homo sapiens
tctgagtttaccatttgtaa

SEQ ID NO: 886460 - DNA, 22 bp, Homo sapiens
tctgagtttaccatttgtaata

SEQ ID NO: 886461 - DNA, 21 bp, Homo sapiens
tctgagtttatattctgaaag

SEQ ID NO: 886462 - DNA, 24 bp, Homo sapiens
tctgagtttcattctcctgcctgt

SEQ ID NO: 886463 - DNA, 17 bp, Homo sapiens
tctgagttttgatgctg

SEQ ID NO: 886464 - DNA, 19 bp, Homo sapiens
tctgataaaattgtgatgt

SEQ ID NO: 886465 - DNA, 22 bp, Homo sapiens
tctgataagaacccagggtgga

SEQ ID NO: 886466 - DNA, 14 bp, Homo sapiens
tctgataatttaaa

SEQ ID NO: 886467 - DNA, 20 bp, Homo sapiens
tctgatacacagtaattgtg

SEQ ID NO: 886468 - DNA, 21 bp, Homo sapiens
tctgatacacagtaattgtga

SEQ ID NO: 886469 - DNA, 14 bp, Homo sapiens
tctgatacccagag

SEQ ID NO: 886470 - DNA, 13 bp, Homo sapiens
tctgatagacttt

SEQ ID NO: 886471 - DNA, 22 bp, Homo sapiens
tctgatagactttgtgaatctg

SEQ ID NO: 886472 - DNA, 15 bp, Homo sapiens
tctgataggaacaga

SEQ ID NO: 886473 - DNA, 15 bp, Homo sapiens
tctgatattaatcaa

SEQ ID NO: 886474 - DNA, 20 bp, Homo sapiens
tctgatcacattcttcaaag

SEQ ID NO: 886475 - DNA, 21 bp, Homo sapiens
tctgatcacattcttcaaaga

SEQ ID NO: 886476 - DNA, 19 bp, Homo sapiens
tctgatcctcagcccctcc

SEQ ID NO: 886477 - DNA, 21 bp, Homo sapiens
tctgatctccatggcttcctc

SEQ ID NO: 886478 - DNA, 18 bp, Homo sapiens
tctgatctgtactttgtg

SEQ ID NO: 886479 - DNA, 22 bp, Homo sapiens
tctgatctgtactttgtgttta

SEQ ID NO: 886480 - DNA, 20 bp, Homo sapiens
tctgatctttttatacacaa

SEQ ID NO: 886481 - DNA, 20 bp, Homo sapiens
tctgatggaatgtgccacct

SEQ ID NO: 886482 - DNA, 21 bp, Homo sapiens
tctgatggaatgtgccacctg

SEQ ID NO: 886483 - DNA, 20 bp, Homo sapiens
tctgatggccttaatttcct

SEQ ID NO: 886484 - DNA, 22 bp, Homo sapiens
tctgatggccttaatttccttt

SEQ ID NO: 886485 - DNA, 20 bp, Homo sapiens
tctgatggtgagctgggaag

SEQ ID NO: 886486 - DNA, 19 bp, Homo sapiens
tctgatgtggcaaaaggcc

SEQ ID NO: 886487 - DNA, 21 bp, Homo sapiens
tctgattataccatgtgtgct

SEQ ID NO: 886488 - DNA, 22 bp, Homo sapiens
tctgattataccatgtgtgcta

SEQ ID NO: 886489 - DNA, 19 bp, Homo sapiens
tctgattcgaatgacactg

SEQ ID NO: 886490 - DNA, 22 bp, Homo sapiens
tctgattcgaatgacactgttc

SEQ ID NO: 886491 - DNA, 12 bp, Homo sapiens
tctgattgattt

SEQ ID NO: 886492 - DNA, 19 bp, Homo sapiens
tctgattgcattaagtgaa

SEQ ID NO: 886493 - DNA, 21 bp, Homo sapiens
tctgattggaatttctggcct

SEQ ID NO: 886494 - DNA, 15 bp, Homo sapiens
tctgattggacattt

SEQ ID NO: 886495 - DNA, 19 bp, Homo sapiens
tctgattggacattttctt

SEQ ID NO: 886496 - DNA, 17 bp, Homo sapiens
tctgattggctcaccca

SEQ ID NO: 886497 - DNA, 18 bp, Homo sapiens
tctgattggctcacccaa

SEQ ID NO: 886498 - DNA, 23 bp, Homo sapiens
tctgattggctggattgccttgt

SEQ ID NO: 886499 - DNA, 13 bp, Homo sapiens
tctgattgtgttg

SEQ ID NO: 886500 - DNA, 19 bp, Homo sapiens
tctgattgtgttgaagaag

SEQ ID NO: 886501 - DNA, 16 bp, Homo sapiens
tctgatttaatgtttt

SEQ ID NO: 886502 - DNA, 16 bp, Homo sapiens
tctgatttcagttttt

SEQ ID NO: 886503 - DNA, 12 bp, Homo sapiens
tctgatttgtcc

SEQ ID NO: 886504 - DNA, 13 bp, Homo sapiens
tctgatttttaat

SEQ ID NO: 886505 - DNA, 14 bp, Homo sapiens
tctgcaaaaatatt

SEQ ID NO: 886506 - DNA, 20 bp, Homo sapiens
tctgcaaaaatatttataaa

SEQ ID NO: 886507 - DNA, 21 bp, Homo sapiens
tctgcaaatagaaaacaggaa

SEQ ID NO: 886508 - DNA, 16 bp, Homo sapiens
tctgcaactgcaagaa

SEQ ID NO: 886509 - DNA, 18 bp, Homo sapiens
tctgcaagaattaaaact

SEQ ID NO: 886510 - DNA, 21 bp, Homo sapiens
tctgcaagaattgaagcagga

SEQ ID NO: 886511 - DNA, 17 bp, Homo sapiens
tctgcaaggtctttggt

SEQ ID NO: 886512 - DNA, 16 bp, Homo sapiens
tctgcaagtttctgtt

SEQ ID NO: 886513 - DNA, 19 bp, Homo sapiens
tctgcaatgggcactggga

SEQ ID NO: 886514 - DNA, 16 bp, Homo sapiens
tctgcaattcccctct

SEQ ID NO: 886515 - DNA, 21 bp, Homo sapiens
tctgcaatttgtttaaagaat

SEQ ID NO: 886516 - DNA, 16 bp, Homo sapiens
tctgcacacaaatatt

SEQ ID NO: 886517 - DNA, 10 bp, Homo sapiens
tctgcacaga

SEQ ID NO: 886518 - DNA, 21 bp, Homo sapiens
tctgcacagaaacttgaactc

SEQ ID NO: 886519 - DNA, 20 bp, Homo sapiens
tctgcacatgcagctgcacc

SEQ ID NO: 886520 - DNA, 13 bp, Homo sapiens
tctgcacccctct

SEQ ID NO: 886521 - DNA, 21 bp, Homo sapiens
tctgcacccctctgccctcat

SEQ ID NO: 886522 - DNA, 15 bp, Homo sapiens
tctgcaccccttctc

SEQ ID NO: 886523 - DNA, 18 bp, Homo sapiens
tctgcaccccttctctcc

SEQ ID NO: 886524 - DNA, 22 bp, Homo sapiens
tctgcaccccttctctcctccc

SEQ ID NO: 886525 - DNA, 24 bp, Homo sapiens
tctgcaccctggggcctggacctg

SEQ ID NO: 886526 - DNA, 20 bp, Homo sapiens
tctgcacccttcttttctca

SEQ ID NO: 886527 - DNA, 16 bp, Homo sapiens
tctgcacgctgcccag

SEQ ID NO: 886528 - DNA, 19 bp, Homo sapiens
tctgcactactcctctgca

SEQ ID NO: 886529 - DNA, 20 bp, Homo sapiens
tctgcactactcctctgcag

SEQ ID NO: 886530 - DNA, 21 bp, Homo sapiens
tctgcactactcctctgcagt

SEQ ID NO: 886531 - DNA, 18 bp, Homo sapiens
tctgcactactgacatgt

SEQ ID NO: 886532 - DNA, 21 bp, Homo sapiens
tctgcactactgacatgtggg

SEQ ID NO: 886533 - DNA, 21 bp, Homo sapiens
tctgcactccatggccacccc

SEQ ID NO: 886534 - DNA, 22 bp, Homo sapiens
tctgcactcctttatctgtaat

SEQ ID NO: 886535 - DNA, 18 bp, Homo sapiens
tctgcactctaaactgca

SEQ ID NO: 886536 - DNA, 13 bp, Homo sapiens
tctgcagaaggaa

SEQ ID NO: 886537 - DNA, 22 bp, Homo sapiens
tctgcagaaggaaaaatgtgta

SEQ ID NO: 886538 - DNA, 23 bp, Homo sapiens
tctgcagaaggaaaaatgtgtaa

SEQ ID NO: 886539 - DNA, 22 bp, Homo sapiens
tctgcagaatccctttgcacct

SEQ ID NO: 886540 - DNA, 18 bp, Homo sapiens
tctgcagaatgggccact

SEQ ID NO: 886541 - DNA, 12 bp, Homo sapiens
tctgcagagcag

SEQ ID NO: 886542 - DNA, 17 bp, Homo sapiens
tctgcagcaataaagca

SEQ ID NO: 886543 - DNA, 18 bp, Homo sapiens
tctgcagcaataaagcag

SEQ ID NO: 886544 - DNA, 20 bp, Homo sapiens
tctgcagcactttaaccctc

SEQ ID NO: 886545 - DNA, 16 bp, Homo sapiens
tctgcagccagcccag

SEQ ID NO: 886546 - DNA, 15 bp, Homo sapiens
tctgcagcccagcct

SEQ ID NO: 886547 - DNA, 20 bp, Homo sapiens
tctgcagcccagcctagtca

SEQ ID NO: 886548 - DNA, 11 bp, Homo sapiens
tctgcagccct

SEQ ID NO: 886549 - DNA, 19 bp, Homo sapiens
tctgcagcccttgggcagt

SEQ ID NO: 886550 - DNA, 21 bp, Homo sapiens
tctgcagcccttgggcagttc

SEQ ID NO: 886551 - DNA, 15 bp, Homo sapiens
tctgcagcctcggcc

SEQ ID NO: 886552 - DNA, 14 bp, Homo sapiens
tctgcagctgacct

SEQ ID NO: 886553 - DNA, 20 bp, Homo sapiens
tctgcagctgacctctgttg

SEQ ID NO: 886554 - DNA, 19 bp, Homo sapiens
tctgcaggaaataggccca

SEQ ID NO: 886555 - DNA, 13 bp, Homo sapiens
tctgcaggcagac

SEQ ID NO: 886556 - DNA, 17 bp, Homo sapiens
tctgcaggccactgtga

SEQ ID NO: 886557 - DNA, 23 bp, Homo sapiens
tctgcaggcctaggtgcagctcc

SEQ ID NO: 886558 - DNA, 18 bp, Homo sapiens
tctgcaggctggggaggt

SEQ ID NO: 886559 - DNA, 17 bp, Homo sapiens
tctgcaggggcctggag

SEQ ID NO: 886560 - DNA, 18 bp, Homo sapiens
tctgcaggggcctggagg

SEQ ID NO: 886561 - DNA, 19 bp, Homo sapiens
tctgcagggggtgtgtctg

SEQ ID NO: 886562 - DNA, 18 bp, Homo sapiens
tctgcagggtgacgcctg

SEQ ID NO: 886563 - DNA, 18 bp, Homo sapiens
tctgcaggttgaagccat

SEQ ID NO: 886564 - DNA, 16 bp, Homo sapiens
tctgcagtaaatcttt

SEQ ID NO: 886565 - DNA, 16 bp, Homo sapiens
tctgcagtagtctctg

SEQ ID NO: 886566 - DNA, 20 bp, Homo sapiens
tctgcagtagtctctgtgct

SEQ ID NO: 886567 - DNA, 13 bp, Homo sapiens
tctgcagtgcctt

SEQ ID NO: 886568 - DNA, 15 bp, Homo sapiens
tctgcatatgttgaa

SEQ ID NO: 886569 - DNA, 20 bp, Homo sapiens
tctggaagagaggaatgcct

SEQ ID NO: 886570 - DNA, 18 bp, Homo sapiens
tctggaagcccctgggcc

SEQ ID NO: 886571 - DNA, 14 bp, Homo sapiens
tctggaagcctgga

SEQ ID NO: 886572 - DNA, 14 bp, Homo sapiens
tctggaaggctggc

SEQ ID NO: 886573 - DNA, 16 bp, Homo sapiens
tctggaaggctggctg

SEQ ID NO: 886574 - DNA, 17 bp, Homo sapiens
tctggaaggctggctga

SEQ ID NO: 886575 - DNA, 19 bp, Homo sapiens
tctggaataaagttgcaga

SEQ ID NO: 886576 - DNA, 22 bp, Homo sapiens
tctggaatacatgaaatataga

SEQ ID NO: 886577 - DNA, 20 bp, Homo sapiens
tctggaatattgtgattctg

SEQ ID NO: 886578 - DNA, 19 bp, Homo sapiens
tctggaatctggagaccag

SEQ ID NO: 886579 - DNA, 16 bp, Homo sapiens
tctggaatcttcccca

SEQ ID NO: 886580 - DNA, 21 bp, Homo sapiens
tctggaatgccagtttgacct

SEQ ID NO: 886581 - DNA, 23 bp, Homo sapiens
tctggaatgtttttccctcccca

SEQ ID NO: 886582 - DNA, 21 bp, Homo sapiens
tctggaatttacctccccttt

SEQ ID NO: 886583 - DNA, 12 bp, Homo sapiens
tctggacaagcc

SEQ ID NO: 886584 - DNA, 23 bp, Homo sapiens
tctggacaagccaacttgtaaat

SEQ ID NO: 886585 - DNA, 14 bp, Homo sapiens
tctggacacttgct

SEQ ID NO: 886586 - DNA, 16 bp, Homo sapiens
tctggacagcagaagc

SEQ ID NO: 886587 - DNA, 18 bp, Homo sapiens
tctggacagcagaagcct

SEQ ID NO: 886588 - DNA, 17 bp, Homo sapiens
tctggacagccagtgac

SEQ ID NO: 886589 - DNA, 23 bp, Homo sapiens
tctggacagtacctgattgtatt

SEQ ID NO: 886590 - DNA, 22 bp, Homo sapiens
tctggaccaaccctgtttcctg

SEQ ID NO: 886591 - DNA, 19 bp, Homo sapiens
tctggaccccatctgtgaa

SEQ ID NO: 886592 - DNA, 20 bp, Homo sapiens
tctggaccccatctgtgaat

SEQ ID NO: 886593 - DNA, 23 bp, Homo sapiens
tctggaccccatctgtgaataag

SEQ ID NO: 886594 - DNA, 17 bp, Homo sapiens
tctggacccttggcctc

SEQ ID NO: 886595 - DNA, 14 bp, Homo sapiens
tctggacggcaggc

SEQ ID NO: 886596 - DNA, 19 bp, Homo sapiens
tctggacggcaggctcact

SEQ ID NO: 886597 - DNA, 21 bp, Homo sapiens
tctggacggcaggctcactgc

SEQ ID NO: 886598 - DNA, 20 bp, Homo sapiens
tctggactctgccccaatcg

SEQ ID NO: 886599 - DNA, 17 bp, Homo sapiens
tctggactgaagcctgc

SEQ ID NO: 886600 - DNA, 19 bp, Homo sapiens
tctggactgaagcctgcag

SEQ ID NO: 886601 - DNA, 20 bp, Homo sapiens
tctggactgaagcctgcagg

SEQ ID NO: 886602 - DNA, 14 bp, Homo sapiens
tctggactgacagc

SEQ ID NO: 886603 - DNA, 17 bp, Homo sapiens
tctggactgacagcatg

SEQ ID NO: 886604 - DNA, 19 bp, Homo sapiens
tctggactgccccagaaaa

SEQ ID NO: 886605 - DNA, 22 bp, Homo sapiens
tctggactggcgttcacctccc

SEQ ID NO: 886606 - DNA, 14 bp, Homo sapiens
tctggactggctag

SEQ ID NO: 886607 - DNA, 20 bp, Homo sapiens
tctggactttctctaataat

SEQ ID NO: 886608 - DNA, 15 bp, Homo sapiens
tctggagaagcagtg

SEQ ID NO: 886609 - DNA, 22 bp, Homo sapiens
tctggagaagcagtgagccgca

SEQ ID NO: 886610 - DNA, 19 bp, Homo sapiens
tctggagaagctcccagga

SEQ ID NO: 886611 - DNA, 15 bp, Homo sapiens
tctggagaccaggga

SEQ ID NO: 886612 - DNA, 19 bp, Homo sapiens
tctggagaccagggagcct

SEQ ID NO: 886613 - DNA, 20 bp, Homo sapiens
tctggagaccagggagcctt

SEQ ID NO: 886614 - DNA, 15 bp, Homo sapiens
tctggagcatttctc

SEQ ID NO: 886615 - DNA, 17 bp, Homo sapiens
tctggagcccctcctcc

SEQ ID NO: 886616 - DNA, 21 bp, Homo sapiens
tctggagccctaaccccttcc

SEQ ID NO: 886617 - DNA, 16 bp, Homo sapiens
tctggagcccttgggt

SEQ ID NO: 886618 - DNA, 14 bp, Homo sapiens
tctggaggaaaggg

SEQ ID NO: 886619 - DNA, 13 bp, Homo sapiens
tctggaggaagtt

SEQ ID NO: 886620 - DNA, 16 bp, Homo sapiens
tctggaggaagttctc

SEQ ID NO: 886621 - DNA, 22 bp, Homo sapiens
tctggaggaagttctccagctt

SEQ ID NO: 886622 - DNA, 19 bp, Homo sapiens
tctggaggcctctggccct

SEQ ID NO: 886623 - DNA, 16 bp, Homo sapiens
tctggaggccttccag

SEQ ID NO: 886624 - DNA, 17 bp, Homo sapiens
tctggaggccttccagc

SEQ ID NO: 886625 - DNA, 19 bp, Homo sapiens
tctggaggccttccagctg

SEQ ID NO: 886626 - DNA, 23 bp, Homo sapiens
tctggaggccttccagctgctgt

SEQ ID NO: 886627 - DNA, 17 bp, Homo sapiens
tctggaggctgcagagc

SEQ ID NO: 886628 - DNA, 24 bp, Homo sapiens
tctggaggctgcagagctgaccca

SEQ ID NO: 886629 - DNA, 13 bp, Homo sapiens
tctggagggctgg

SEQ ID NO: 886630 - DNA, 14 bp, Homo sapiens
tctggaggggaggg

SEQ ID NO: 886631 - DNA, 23 bp, Homo sapiens
tctggagtgatggtgtccttccc

SEQ ID NO: 886632 - DNA, 19 bp, Homo sapiens
tctggataaaccaccctct

SEQ ID NO: 886633 - DNA, 13 bp, Homo sapiens
tctggatcagtaa

SEQ ID NO: 886634 - DNA, 24 bp, Homo sapiens
tctggatcccgaggtatggcagag

SEQ ID NO: 886635 - DNA, 15 bp, Homo sapiens
tctggatcctgcact

SEQ ID NO: 886636 - DNA, 18 bp, Homo sapiens
tctggatctgaccctccc

SEQ ID NO: 886637 - DNA, 14 bp, Homo sapiens
tctggatctgggac

SEQ ID NO: 886638 - DNA, 13 bp, Homo sapiens
tctggatgcacac

SEQ ID NO: 886639 - DNA, 19 bp, Homo sapiens
tctggatggcaccagaggc

SEQ ID NO: 886640 - DNA, 15 bp, Homo sapiens
tctggatgggaggag

SEQ ID NO: 886641 - DNA, 23 bp, Homo sapiens
tctggatgggaggagagccactg

SEQ ID NO: 886642 - DNA, 15 bp, Homo sapiens
tctggattcagcctt

SEQ ID NO: 886643 - DNA, 18 bp, Homo sapiens
tctggattcagccttctt

SEQ ID NO: 886644 - DNA, 19 bp, Homo sapiens
tctggattcagccttcttt

SEQ ID NO: 886645 - DNA, 14 bp, Homo sapiens
tctggattcccttt

SEQ ID NO: 886646 - DNA, 15 bp, Homo sapiens
tctggattctgggag

SEQ ID NO: 886647 - DNA, 23 bp, Homo sapiens
tctggattgtggttccatgcagc

SEQ ID NO: 886648 - DNA, 18 bp, Homo sapiens
tctggcaaacttttcttt

SEQ ID NO: 886649 - DNA, 21 bp, Homo sapiens
tctggcaaagcttttagaaat

SEQ ID NO: 886650 - DNA, 16 bp, Homo sapiens
tctggcaacatcttta

SEQ ID NO: 886651 - DNA, 22 bp, Homo sapiens
tctggcaagagcagatactgtc

SEQ ID NO: 886652 - DNA, 23 bp, Homo sapiens
tctggcaaggactttgtacattt

SEQ ID NO: 886653 - DNA, 13 bp, Homo sapiens
tctggcacagtga

SEQ ID NO: 886654 - DNA, 13 bp, Homo sapiens
tctggcagagcct

SEQ ID NO: 886655 - DNA, 21 bp, Homo sapiens
tctggcagcctcccatccagg

SEQ ID NO: 886656 - DNA, 10 bp, Homo sapiens
tctggcagga

SEQ ID NO: 886657 - DNA, 20 bp, Homo sapiens
tctggcagggtgggatggag

SEQ ID NO: 886658 - DNA, 18 bp, Homo sapiens
tctggcattagaattatt

SEQ ID NO: 886659 - DNA, 17 bp, Homo sapiens
tctggccacatcagccc

SEQ ID NO: 886660 - DNA, 18 bp, Homo sapiens
tctggccacatcagcccc

SEQ ID NO: 886661 - DNA, 22 bp, Homo sapiens
tctggccacatcagccccacag

SEQ ID NO: 886662 - DNA, 14 bp, Homo sapiens
tctggccaccccag

SEQ ID NO: 886663 - DNA, 12 bp, Homo sapiens
tctggccaccct

SEQ ID NO: 886664 - DNA, 13 bp, Homo sapiens
tctggccaccctg

SEQ ID NO: 886665 - DNA, 15 bp, Homo sapiens
tctggccaccctggc

SEQ ID NO: 886666 - DNA, 17 bp, Homo sapiens
tctggccaggcactgcc

SEQ ID NO: 886667 - DNA, 23 bp, Homo sapiens
tctggccaggcactgccttctcc

SEQ ID NO: 886668 - DNA, 21 bp, Homo sapiens
tctggccagtgtttaaaactt

SEQ ID NO: 886669 - DNA, 16 bp, Homo sapiens
tctggcccaccagggt

SEQ ID NO: 886670 - DNA, 21 bp, Homo sapiens
tctggcccagaaagcctctct

SEQ ID NO: 886671 - DNA, 14 bp, Homo sapiens
tctggccccagcct

SEQ ID NO: 886672 - DNA, 13 bp, Homo sapiens
tctggcccctcac

SEQ ID NO: 886673 - DNA, 13 bp, Homo sapiens
tctggccctgcct

SEQ ID NO: 886674 - DNA, 10 bp, Homo sapiens
tctggccctt

SEQ ID NO: 886675 - DNA, 23 bp, Homo sapiens
tctggcccttgcttacctctcag

SEQ ID NO: 886676 - DNA, 18 bp, Homo sapiens
tctggcccttggaataaa

SEQ ID NO: 886677 - DNA, 13 bp, Homo sapiens
tctggcctccagc

SEQ ID NO: 886678 - DNA, 14 bp, Homo sapiens
tctggcctcccaca

SEQ ID NO: 886679 - DNA, 16 bp, Homo sapiens
tctggcctcccacccg

SEQ ID NO: 886680 - DNA, 14 bp, Homo sapiens
tctggcctctgctg

SEQ ID NO: 886681 - DNA, 19 bp, Homo sapiens
tctggcctgggttttgtgg

SEQ ID NO: 886682 - DNA, 15 bp, Homo sapiens
tctggcggcttcctg

SEQ ID NO: 886683 - DNA, 20 bp, Homo sapiens
tctggcgttctcaagaatct

SEQ ID NO: 886684 - DNA, 14 bp, Homo sapiens
tctggctatgcatt

SEQ ID NO: 886685 - DNA, 15 bp, Homo sapiens
tctgggttttctgaa

SEQ ID NO: 886686 - DNA, 13 bp, Homo sapiens
tctggtagcctgc

SEQ ID NO: 886687 - DNA, 14 bp, Homo sapiens
tctggtatacattg

SEQ ID NO: 886688 - DNA, 17 bp, Homo sapiens
tctggtatatgtcatta

SEQ ID NO: 886689 - DNA, 14 bp, Homo sapiens
tctggtattaaatg

SEQ ID NO: 886690 - DNA, 16 bp, Homo sapiens
tctggtatttcccctg

SEQ ID NO: 886691 - DNA, 20 bp, Homo sapiens
tctggtatttcccctgtcag

SEQ ID NO: 886692 - DNA, 13 bp, Homo sapiens
tctggtccctctt

SEQ ID NO: 886693 - DNA, 23 bp, Homo sapiens
tctggtccctcttctctcctcag

SEQ ID NO: 886694 - DNA, 14 bp, Homo sapiens
tctggtcccttgca

SEQ ID NO: 886695 - DNA, 13 bp, Homo sapiens
tctggtcctaccc

SEQ ID NO: 886696 - DNA, 17 bp, Homo sapiens
tctggtcgctcctgccc

SEQ ID NO: 886697 - DNA, 14 bp, Homo sapiens
tctggtctcgaact

SEQ ID NO: 886698 - DNA, 14 bp, Homo sapiens
tctggtgaggtggc

SEQ ID NO: 886699 - DNA, 18 bp, Homo sapiens
tctggtgaggtggcccag

SEQ ID NO: 886700 - DNA, 19 bp, Homo sapiens
tctggtgaggtggcccagg

SEQ ID NO: 886701 - DNA, 13 bp, Homo sapiens
tctggtgcacgcc

SEQ ID NO: 886702 - DNA, 13 bp, Homo sapiens
tctggtggaggag

SEQ ID NO: 886703 - DNA, 22 bp, Homo sapiens
tctggtggaggagctgagggag

SEQ ID NO: 886704 - DNA, 21 bp, Homo sapiens
tctggtggccacttcattcca

SEQ ID NO: 886705 - DNA, 20 bp, Homo sapiens
tctggtggtcagccctagga

SEQ ID NO: 886706 - DNA, 15 bp, Homo sapiens
tctggtggtcttcct

SEQ ID NO: 886707 - DNA, 12 bp, Homo sapiens
tctggttccaaa

SEQ ID NO: 886708 - DNA, 17 bp, Homo sapiens
tctggttccaaaccagt

SEQ ID NO: 886709 - DNA, 13 bp, Homo sapiens
tctggttccaggg

SEQ ID NO: 886710 - DNA, 12 bp, Homo sapiens
tctggttccatt

SEQ ID NO: 886711 - DNA, 20 bp, Homo sapiens
tctggttccatttttcctct

SEQ ID NO: 886712 - DNA, 15 bp, Homo sapiens
tctggttctgtgtcc

SEQ ID NO: 886713 - DNA, 15 bp, Homo sapiens
tctggttgaactctg

SEQ ID NO: 886714 - DNA, 15 bp, Homo sapiens
tctggttgcctcccc

SEQ ID NO: 886715 - DNA, 12 bp, Homo sapiens
tctggttgcttc

SEQ ID NO: 886716 - DNA, 16 bp, Homo sapiens
tctggttgtttctgtt

SEQ ID NO: 886717 - DNA, 17 bp, Homo sapiens
tctggttgtttctgttc

SEQ ID NO: 886718 - DNA, 18 bp, Homo sapiens
tctggttgtttctgttcc

SEQ ID NO: 886719 - DNA, 22 bp, Homo sapiens
tctggttgtttctgttccaaat

SEQ ID NO: 886720 - DNA, 13 bp, Homo sapiens
tctggtttggcat

SEQ ID NO: 886721 - DNA, 18 bp, Homo sapiens
tctggtttggcatggtga

SEQ ID NO: 886722 - DNA, 13 bp, Homo sapiens
tctggttttaaca

SEQ ID NO: 886723 - DNA, 18 bp, Homo sapiens
tctgtaaaaaatggagct

SEQ ID NO: 886724 - DNA, 19 bp, Homo sapiens
tctgtaaaaacactgaaaa

SEQ ID NO: 886725 - DNA, 13 bp, Homo sapiens
tctgtaaaataca

SEQ ID NO: 886726 - DNA, 13 bp, Homo sapiens
tctgtaaataacc

SEQ ID NO: 886727 - DNA, 23 bp, Homo sapiens
tctgtaaatatcccagagaacaa

SEQ ID NO: 886728 - DNA, 14 bp, Homo sapiens
tctgtaacccttga

SEQ ID NO: 886729 - DNA, 17 bp, Homo sapiens
tctgtaactattgggtg

SEQ ID NO: 886730 - DNA, 13 bp, Homo sapiens
tctgtaactcttt

SEQ ID NO: 886731 - DNA, 19 bp, Homo sapiens
tctgtaactgcccagcccc

SEQ ID NO: 886732 - DNA, 21 bp, Homo sapiens
tctgtaactgcccagcccctt

SEQ ID NO: 886733 - DNA, 13 bp, Homo sapiens
tctgtaagagctt

SEQ ID NO: 886734 - DNA, 18 bp, Homo sapiens
tctgtaatatttacaatg

SEQ ID NO: 886735 - DNA, 19 bp, Homo sapiens
tctgtaatatttacaatgt

SEQ ID NO: 886736 - DNA, 20 bp, Homo sapiens
tctgtaatatttacaatgta

SEQ ID NO: 886737 - DNA, 22 bp, Homo sapiens
tctgtaatatttacaatgtatt

SEQ ID NO: 886738 - DNA, 21 bp, Homo sapiens
tctgtaattacatatttgact

SEQ ID NO: 886739 - DNA, 12 bp, Homo sapiens
tctgtaattgca

SEQ ID NO: 886740 - DNA, 13 bp, Homo sapiens
tctgtaattgcaa

SEQ ID NO: 886741 - DNA, 19 bp, Homo sapiens
tctgtaattgtaattccaa

SEQ ID NO: 886742 - DNA, 22 bp, Homo sapiens
tctgtacatactggcctctgtg

SEQ ID NO: 886743 - DNA, 17 bp, Homo sapiens
tctgtacatgttcttgt

SEQ ID NO: 886744 - DNA, 22 bp, Homo sapiens
tctgtaccagttaatttttcca

SEQ ID NO: 886745 - DNA, 22 bp, Homo sapiens
tctgtactggaggctctgttct

SEQ ID NO: 886746 - DNA, 21 bp, Homo sapiens
tctgtagaaaagaaaacattt

SEQ ID NO: 886747 - DNA, 22 bp, Homo sapiens
tctgtagaaaagaaaacattta

SEQ ID NO: 886748 - DNA, 23 bp, Homo sapiens
tctgtagaaaagaaaacatttaa

SEQ ID NO: 886749 - DNA, 23 bp, Homo sapiens
tctgtagattctgtggaacaagc

SEQ ID NO: 886750 - DNA, 15 bp, Homo sapiens
tctgtagcctccttt

SEQ ID NO: 886751 - DNA, 16 bp, Homo sapiens
tctgtaggatcgtaaa

SEQ ID NO: 886752 - DNA, 19 bp, Homo sapiens
tctgtaggatcgtaaaaaa

SEQ ID NO: 886753 - DNA, 15 bp, Homo sapiens
tctgtaggtgtctct

SEQ ID NO: 886754 - DNA, 17 bp, Homo sapiens
tctgtaggtgtctctgg

SEQ ID NO: 886755 - DNA, 19 bp, Homo sapiens
tctgtagtactccttaaga

SEQ ID NO: 886756 - DNA, 23 bp, Homo sapiens
tctgtagtactccttaagaacac

SEQ ID NO: 886757 - DNA, 15 bp, Homo sapiens
tctgtagtgtattaa

SEQ ID NO: 886758 - DNA, 23 bp, Homo sapiens
tctgtagtgtattaatctctgtg

SEQ ID NO: 886759 - DNA, 24 bp, Homo sapiens
tctgtagtgtattaatctctgtgt

SEQ ID NO: 886760 - DNA, 13 bp, Homo sapiens
tctgtataaataa

SEQ ID NO: 886761 - DNA, 14 bp, Homo sapiens
tctgtataaataag

SEQ ID NO: 886762 - DNA, 21 bp, Homo sapiens
tctgtataagtaagaaaatat

SEQ ID NO: 886763 - DNA, 16 bp, Homo sapiens
tctgtatactcctgtc

SEQ ID NO: 886764 - DNA, 19 bp, Homo sapiens
tctgtatactgtaaaagtt

SEQ ID NO: 886765 - DNA, 14 bp, Homo sapiens
tctgtatatacatt

SEQ ID NO: 886766 - DNA, 14 bp, Homo sapiens
tctgtatatttgtc

SEQ ID NO: 886767 - DNA, 16 bp, Homo sapiens
tctgtatatttgtcat

SEQ ID NO: 886768 - DNA, 16 bp, Homo sapiens
tctgtatcatcagtgc

SEQ ID NO: 886769 - DNA, 19 bp, Homo sapiens
tctgtatcggagacagtga

SEQ ID NO: 886770 - DNA, 21 bp, Homo sapiens
tctgtatcggagacagtgatc

SEQ ID NO: 886771 - DNA, 19 bp, Homo sapiens
tctgtatctagaaagagat

SEQ ID NO: 886772 - DNA, 15 bp, Homo sapiens
tctgtatgcatcaga

SEQ ID NO: 886773 - DNA, 21 bp, Homo sapiens
tctgtattaatccccatcatt

SEQ ID NO: 886774 - DNA, 23 bp, Homo sapiens
tctgtattaatccccatcattac

SEQ ID NO: 886775 - DNA, 15 bp, Homo sapiens
tctgtatttcatgtg

SEQ ID NO: 886776 - DNA, 15 bp, Homo sapiens
tctgtattttaagaa

SEQ ID NO: 886777 - DNA, 16 bp, Homo sapiens
tctgtcaaaacactgt

SEQ ID NO: 886778 - DNA, 14 bp, Homo sapiens
tctgtcaatgaaaa

SEQ ID NO: 886779 - DNA, 11 bp, Homo sapiens
tctgtcacaat

SEQ ID NO: 886780 - DNA, 14 bp, Homo sapiens
tctgtcacaataaa

SEQ ID NO: 886781 - DNA, 22 bp, Homo sapiens
tctgtcacaggctgggtcaaaa

SEQ ID NO: 886782 - DNA, 20 bp, Homo sapiens
tctgtcaccagctatctgtc

SEQ ID NO: 886783 - DNA, 16 bp, Homo sapiens
tctgtcacgtgaaata

SEQ ID NO: 886784 - DNA, 18 bp, Homo sapiens
tctgtcacgtgaaatatt

SEQ ID NO: 886785 - DNA, 19 bp, Homo sapiens
tctgtcagatgagaacaaa

SEQ ID NO: 886786 - DNA, 23 bp, Homo sapiens
tctgtcagatgagaacaaagctg

SEQ ID NO: 886787 - DNA, 24 bp, Homo sapiens
tctgtcagatgagaacaaagctgt

SEQ ID NO: 886788 - DNA, 13 bp, Homo sapiens
tctgtcagctgca

SEQ ID NO: 886789 - DNA, 14 bp, Homo sapiens
tctgtcagtaaaac

SEQ ID NO: 886790 - DNA, 19 bp, Homo sapiens
tctgtcataggactctgga

SEQ ID NO: 886791 - DNA, 20 bp, Homo sapiens
tctgtcatcactccctggat

SEQ ID NO: 886792 - DNA, 18 bp, Homo sapiens
tctgtgggcatggccgct

SEQ ID NO: 886793 - DNA, 22 bp, Homo sapiens
tctgtgggcatggccgcttcta

SEQ ID NO: 886794 - DNA, 20 bp, Homo sapiens
tctgtgggctacatgctggg

SEQ ID NO: 886795 - DNA, 18 bp, Homo sapiens
tctgtgggcttcagcact

SEQ ID NO: 886796 - DNA, 19 bp, Homo sapiens
tctgtgggcttggccttgt

SEQ ID NO: 886797 - DNA, 23 bp, Homo sapiens
tctgtggggtggttccgggctgg

SEQ ID NO: 886798 - DNA, 19 bp, Homo sapiens
tctgtgggtgacccaggtc

SEQ ID NO: 886799 - DNA, 21 bp, Homo sapiens
tctgtgggtgacccaggtcct

SEQ ID NO: 886800 - DNA, 21 bp, Homo sapiens
tctgtggtgcctctcttggct

SEQ ID NO: 886801 - DNA, 17 bp, Homo sapiens
tctgtggttcctctgct

SEQ ID NO: 886802 - DNA, 18 bp, Homo sapiens
tctgtggttcctctgctc

SEQ ID NO: 886803 - DNA, 15 bp, Homo sapiens
tctgtggttctataa

SEQ ID NO: 886804 - DNA, 18 bp, Homo sapiens
tctgtggttctataataa

SEQ ID NO: 886805 - DNA, 21 bp, Homo sapiens
tctgtgtaactttaaacatct

SEQ ID NO: 886806 - DNA, 16 bp, Homo sapiens
tctgtgtacaatttta

SEQ ID NO: 886807 - DNA, 18 bp, Homo sapiens
tctgtgtaccacttctgt

SEQ ID NO: 886808 - DNA, 21 bp, Homo sapiens
tctgtgtaccacttctgtggg

SEQ ID NO: 886809 - DNA, 14 bp, Homo sapiens
tctgtgtagagaat

SEQ ID NO: 886810 - DNA, 21 bp, Homo sapiens
tctgtgtatttatataaaaat

SEQ ID NO: 886811 - DNA, 19 bp, Homo sapiens
tcttaaaatatcttccttt

SEQ ID NO: 886812 - DNA, 20 bp, Homo sapiens
tcttaaaatatcttcctttg

SEQ ID NO: 886813 - DNA, 15 bp, Homo sapiens
tcttaaacaatgtat

SEQ ID NO: 886814 - DNA, 19 bp, Homo sapiens
tcttaaacaatgtataaag

SEQ ID NO: 886815 - DNA, 22 bp, Homo sapiens
tcttaaagaaacagctttcaag

SEQ ID NO: 886816 - DNA, 22 bp, Homo sapiens
tcttaaagtattcttctcttcc

SEQ ID NO: 886817 - DNA, 18 bp, Homo sapiens
tcttaaataaaaataata

SEQ ID NO: 886818 - DNA, 14 bp, Homo sapiens
tcttaaataaaact

SEQ ID NO: 886819 - DNA, 17 bp, Homo sapiens
tcttaaataaaactatt

SEQ ID NO: 886820 - DNA, 19 bp, Homo sapiens
tcttaaataaaactattta

SEQ ID NO: 886821 - DNA, 16 bp, Homo sapiens
tcttaaataagaaact

SEQ ID NO: 886822 - DNA, 18 bp, Homo sapiens
tcttaaataagaaacttt

SEQ ID NO: 886823 - DNA, 19 bp, Homo sapiens
tcttaaataatgcttcaga

SEQ ID NO: 886824 - DNA, 24 bp, Homo sapiens
tcttaaatactttttcagttgttt

SEQ ID NO: 886825 - DNA, 12 bp, Homo sapiens
tcttaaatgaca

SEQ ID NO: 886826 - DNA, 17 bp, Homo sapiens
tcttaaatgacagtgaa

SEQ ID NO: 886827 - DNA, 17 bp, Homo sapiens
tcttaaatgctcataaa

SEQ ID NO: 886828 - DNA, 21 bp, Homo sapiens
tcttaaatgtttatactgtat

SEQ ID NO: 886829 - DNA, 14 bp, Homo sapiens
tcttaaattcattt

SEQ ID NO: 886830 - DNA, 19 bp, Homo sapiens
tcttaaattcatttctaga

SEQ ID NO: 886831 - DNA, 21 bp, Homo sapiens
tcttaacaaaccaacatcttt

SEQ ID NO: 886832 - DNA, 20 bp, Homo sapiens
tcttaacacagccttccttc

SEQ ID NO: 886833 - DNA, 22 bp, Homo sapiens
tcttaacacagccttccttctg

SEQ ID NO: 886834 - DNA, 14 bp, Homo sapiens
tcttaactgtattt

SEQ ID NO: 886835 - DNA, 13 bp, Homo sapiens
tcttaagacagag

SEQ ID NO: 886836 - DNA, 22 bp, Homo sapiens
tcttaagagcttgatctgtgat

SEQ ID NO: 886837 - DNA, 16 bp, Homo sapiens
tcttaagattaatttt

SEQ ID NO: 886838 - DNA, 13 bp, Homo sapiens
tcttaagcagcat

SEQ ID NO: 886839 - DNA, 14 bp, Homo sapiens
tcttaagcagcatg

SEQ ID NO: 886840 - DNA, 22 bp, Homo sapiens
tcttaaggaacatctctgcttt

SEQ ID NO: 886841 - DNA, 12 bp, Homo sapiens
tcttaagggcac

SEQ ID NO: 886842 - DNA, 22 bp, Homo sapiens
tcttaagtaccaatgggaagca

SEQ ID NO: 886843 - DNA, 22 bp, Homo sapiens
tcttaagtgcccacatttgatg

SEQ ID NO: 886844 - DNA, 15 bp, Homo sapiens
tcttaagtggtctag

SEQ ID NO: 886845 - DNA, 14 bp, Homo sapiens
tcttaatataaatt

SEQ ID NO: 886846 - DNA, 21 bp, Homo sapiens
tcttaatataaattcactttc

SEQ ID NO: 886847 - DNA, 19 bp, Homo sapiens
tcttaatatatacattttt

SEQ ID NO: 886848 - DNA, 18 bp, Homo sapiens
tcttaatcactactgtat

SEQ ID NO: 886849 - DNA, 20 bp, Homo sapiens
tcttaatcactactgtatgt

SEQ ID NO: 886850 - DNA, 19 bp, Homo sapiens
tcttaatcgatgaatgtaa

SEQ ID NO: 886851 - DNA, 15 bp, Homo sapiens
tcttaatctgtgtgt

SEQ ID NO: 886852 - DNA, 16 bp, Homo sapiens
tcttaattagacctag

SEQ ID NO: 886853 - DNA, 18 bp, Homo sapiens
tcttaattattataaaaa

SEQ ID NO: 886854 - DNA, 15 bp, Homo sapiens
tcttaattctttgtt

SEQ ID NO: 886855 - DNA, 17 bp, Homo sapiens
tcttaatttggataata

SEQ ID NO: 886856 - DNA, 18 bp, Homo sapiens
tcttaatttggataataa

SEQ ID NO: 886857 - DNA, 16 bp, Homo sapiens
tcttaattttaaagac

SEQ ID NO: 886858 - DNA, 19 bp, Homo sapiens
tcttaattttttttaatgt

SEQ ID NO: 886859 - DNA, 19 bp, Homo sapiens
tcttacaaaaagaaatgtc

SEQ ID NO: 886860 - DNA, 19 bp, Homo sapiens
tcttacaattgcactgctg

SEQ ID NO: 886861 - DNA, 13 bp, Homo sapiens
tcttacagagcct

SEQ ID NO: 886862 - DNA, 14 bp, Homo sapiens
tcttacagagcctt

SEQ ID NO: 886863 - DNA, 20 bp, Homo sapiens
tcttacagcacatcacctct

SEQ ID NO: 886864 - DNA, 19 bp, Homo sapiens
tcttacataaaccattttt

SEQ ID NO: 886865 - DNA, 19 bp, Homo sapiens
tcttacattttcgtcctgt

SEQ ID NO: 886866 - DNA, 23 bp, Homo sapiens
tcttaccactaagccattctgtc

SEQ ID NO: 886867 - DNA, 17 bp, Homo sapiens
tcttaccagtctcctcc

SEQ ID NO: 886868 - DNA, 14 bp, Homo sapiens
tcttacccaaagca

SEQ ID NO: 886869 - DNA, 16 bp, Homo sapiens
tcttacccaatttccc

SEQ ID NO: 886870 - DNA, 15 bp, Homo sapiens
tcttaccgtagcctc

SEQ ID NO: 886871 - DNA, 17 bp, Homo sapiens
tcttacctaaactgagc

SEQ ID NO: 886872 - DNA, 10 bp, Homo sapiens
tcttacctct

SEQ ID NO: 886873 - DNA, 18 bp, Homo sapiens
tcttacctgttatttatc

SEQ ID NO: 886874 - DNA, 19 bp, Homo sapiens
tcttacgcccaacccttcc

SEQ ID NO: 886875 - DNA, 17 bp, Homo sapiens
tcttactcctcctcttt

SEQ ID NO: 886876 - DNA, 19 bp, Homo sapiens
tcttactctgtctcccagg

SEQ ID NO: 886877 - DNA, 13 bp, Homo sapiens
tcttactgaaggt

SEQ ID NO: 886878 - DNA, 16 bp, Homo sapiens
tcttactgataatttt

SEQ ID NO: 886879 - DNA, 19 bp, Homo sapiens
tcttactgggccctgggga

SEQ ID NO: 886880 - DNA, 18 bp, Homo sapiens
tcttactgtacctgttcc

SEQ ID NO: 886881 - DNA, 21 bp, Homo sapiens
tcttagaacagtggaaactat

SEQ ID NO: 886882 - DNA, 15 bp, Homo sapiens
tcttagaagaatatt

SEQ ID NO: 886883 - DNA, 17 bp, Homo sapiens
tcttagaagaatattgt

SEQ ID NO: 886884 - DNA, 19 bp, Homo sapiens
tcttagaagtggaccagga

SEQ ID NO: 886885 - DNA, 20 bp, Homo sapiens
tcttagactacatttagaga

SEQ ID NO: 886886 - DNA, 21 bp, Homo sapiens
tcttagagccttttatctgca

SEQ ID NO: 886887 - DNA, 16 bp, Homo sapiens
tcttagagtgtagctg

SEQ ID NO: 886888 - DNA, 18 bp, Homo sapiens
tcttagagtgtagctgta

SEQ ID NO: 886889 - DNA, 20 bp, Homo sapiens
tcttagataacttcttgaaa

SEQ ID NO: 886890 - DNA, 22 bp, Homo sapiens
tcttagataacttcttgaaaaa

SEQ ID NO: 886891 - DNA, 12 bp, Homo sapiens
tcttagatgtat

SEQ ID NO: 886892 - DNA, 14 bp, Homo sapiens
tcttagatgtatat

SEQ ID NO: 886893 - DNA, 16 bp, Homo sapiens
tcttagattcagggga

SEQ ID NO: 886894 - DNA, 14 bp, Homo sapiens
tcttagattcttaa

SEQ ID NO: 886895 - DNA, 18 bp, Homo sapiens
tcttagctactgtatgca

SEQ ID NO: 886896 - DNA, 18 bp, Homo sapiens
tcttagctatccttggct

SEQ ID NO: 886897 - DNA, 22 bp, Homo sapiens
tcttagctatccttggctttca

SEQ ID NO: 886898 - DNA, 15 bp, Homo sapiens
tcttagctgtctgct

SEQ ID NO: 886899 - DNA, 13 bp, Homo sapiens
tcttagcttacag

SEQ ID NO: 886900 - DNA, 16 bp, Homo sapiens
tcttagcttacaggaa

SEQ ID NO: 886901 - DNA, 15 bp, Homo sapiens
tcttagctttgaaac

SEQ ID NO: 886902 - DNA, 22 bp, Homo sapiens
tcttaggagcaagaagaaaatg

SEQ ID NO: 886903 - DNA, 17 bp, Homo sapiens
tcttaggggagagcttt

SEQ ID NO: 886904 - DNA, 19 bp, Homo sapiens
tcttaggggagagctttct

SEQ ID NO: 886905 - DNA, 20 bp, Homo sapiens
tcttaggtttgttttttcat

SEQ ID NO: 886906 - DNA, 23 bp, Homo sapiens
tcttagtcgaatgttagattcct

SEQ ID NO: 886907 - DNA, 14 bp, Homo sapiens
tcttagtgcctgag

SEQ ID NO: 886908 - DNA, 19 bp, Homo sapiens
tcttagtgcttcagagttt

SEQ ID NO: 886909 - DNA, 17 bp, Homo sapiens
tcttagtggaagacaat

SEQ ID NO: 886910 - DNA, 16 bp, Homo sapiens
tcttagtggatgttct

SEQ ID NO: 886911 - DNA, 21 bp, Homo sapiens
tcttagttgacaacctagaat

SEQ ID NO: 886912 - DNA, 21 bp, Homo sapiens
tcttagtttggattcttatgt

SEQ ID NO: 886913 - DNA, 21 bp, Homo sapiens
tcttataaagtggaagtatgt

SEQ ID NO: 886914 - DNA, 17 bp, Homo sapiens
tcttataatactctgtt

SEQ ID NO: 886915 - DNA, 19 bp, Homo sapiens
tcttataatactctgttgt

SEQ ID NO: 886916 - DNA, 21 bp, Homo sapiens
tcttataccttctgacagccc

SEQ ID NO: 886917 - DNA, 19 bp, Homo sapiens
tcttatacgcttttctttg

SEQ ID NO: 886918 - DNA, 14 bp, Homo sapiens
tcttatactgtaca

SEQ ID NO: 886919 - DNA, 18 bp, Homo sapiens
tcttatactgtacaataa

SEQ ID NO: 886920 - DNA, 21 bp, Homo sapiens
tcttatactgtacaataaaaa

SEQ ID NO: 886921 - DNA, 20 bp, Homo sapiens
tcttatagaatatttattac

SEQ ID NO: 886922 - DNA, 21 bp, Homo sapiens
tcttatcccccccagcctggc

SEQ ID NO: 886923 - DNA, 15 bp, Homo sapiens
tcttatcctctctct

SEQ ID NO: 886924 - DNA, 17 bp, Homo sapiens
tcttatctcatcctttc

SEQ ID NO: 886925 - DNA, 14 bp, Homo sapiens
tcttatcttacgaa

SEQ ID NO: 886926 - DNA, 14 bp, Homo sapiens
tcttatgatgtttt

SEQ ID NO: 886927 - DNA, 17 bp, Homo sapiens
tcttatgattttattac

SEQ ID NO: 886928 - DNA, 11 bp, Homo sapiens
tcttatgctta

SEQ ID NO: 886929 - DNA, 14 bp, Homo sapiens
tcttatggaattga

SEQ ID NO: 886930 - DNA, 17 bp, Homo sapiens
tcttatggaattgattt

SEQ ID NO: 886931 - DNA, 19 bp, Homo sapiens
tcttcctaccctccttcca

SEQ ID NO: 886932 - DNA, 18 bp, Homo sapiens
tcttcctaggtccaagcc

SEQ ID NO: 886933 - DNA, 23 bp, Homo sapiens
tcttcctagttttctcctcccag

SEQ ID NO: 886934 - DNA, 15 bp, Homo sapiens
tcttcctcatcctgc

SEQ ID NO: 886935 - DNA, 12 bp, Homo sapiens
tcttcctcccct

SEQ ID NO: 886936 - DNA, 17 bp, Homo sapiens
tcttcctccctgggggc

SEQ ID NO: 886937 - DNA, 14 bp, Homo sapiens
tcttcctcctccat

SEQ ID NO: 886938 - DNA, 18 bp, Homo sapiens
tcttcctcctccatcacc

SEQ ID NO: 886939 - DNA, 13 bp, Homo sapiens
tcttcctctcctt

SEQ ID NO: 886940 - DNA, 16 bp, Homo sapiens
tcttcctctccttccc

SEQ ID NO: 886941 - DNA, 17 bp, Homo sapiens
tcttcctctccttccca

SEQ ID NO: 886942 - DNA, 18 bp, Homo sapiens
tcttcctctccttcccac

SEQ ID NO: 886943 - DNA, 11 bp, Homo sapiens
tcttcctctgc

SEQ ID NO: 886944 - DNA, 14 bp, Homo sapiens
tcttcctctgggca

SEQ ID NO: 886945 - DNA, 14 bp, Homo sapiens
tcttcctgagtggt

SEQ ID NO: 886946 - DNA, 15 bp, Homo sapiens
tcttcctgcccctct

SEQ ID NO: 886947 - DNA, 14 bp, Homo sapiens
tcttcctgcccttg

SEQ ID NO: 886948 - DNA, 16 bp, Homo sapiens
tcttcctgctcctttt

SEQ ID NO: 886949 - DNA, 18 bp, Homo sapiens
tcttcctggacctgagtc

SEQ ID NO: 886950 - DNA, 21 bp, Homo sapiens
tcttcctggtagactaggttt

SEQ ID NO: 886951 - DNA, 13 bp, Homo sapiens
tcttcctgtgatc

SEQ ID NO: 886952 - DNA, 21 bp, Homo sapiens
tcttccttcagggatttccaa

SEQ ID NO: 886953 - DNA, 12 bp, Homo sapiens
tcttccttcccc

SEQ ID NO: 886954 - DNA, 11 bp, Homo sapiens
tcttccttccg

SEQ ID NO: 886955 - DNA, 12 bp, Homo sapiens
tcttccttccgc

SEQ ID NO: 886956 - DNA, 22 bp, Homo sapiens
tcttccttctaccccaaggcca

SEQ ID NO: 886957 - DNA, 23 bp, Homo sapiens
tcttccttctaccccaaggccag

SEQ ID NO: 886958 - DNA, 15 bp, Homo sapiens
tcttccttgatgttt

SEQ ID NO: 886959 - DNA, 14 bp, Homo sapiens
tcttccttgtctct

SEQ ID NO: 886960 - DNA, 18 bp, Homo sapiens
tcttcctttactttccct

SEQ ID NO: 886961 - DNA, 15 bp, Homo sapiens
tcttcctttccctgg

SEQ ID NO: 886962 - DNA, 17 bp, Homo sapiens
tcttcctttctctttct

SEQ ID NO: 886963 - DNA, 18 bp, Homo sapiens
tcttcgaagccttgccta

SEQ ID NO: 886964 - DNA, 21 bp, Homo sapiens
tcttcgccctctgaaattaaa

SEQ ID NO: 886965 - DNA, 23 bp, Homo sapiens
tcttcgccctctgaaattaaaga

SEQ ID NO: 886966 - DNA, 17 bp, Homo sapiens
tcttgaaaagttcaggg

SEQ ID NO: 886967 - DNA, 16 bp, Homo sapiens
tcttgaaacagcctgg

SEQ ID NO: 886968 - DNA, 14 bp, Homo sapiens
tcttgaaagctgtg

SEQ ID NO: 886969 - DNA, 20 bp, Homo sapiens
tcttgaaattaagaaggcaa

SEQ ID NO: 886970 - DNA, 17 bp, Homo sapiens
tcttgaacctgtgctca

SEQ ID NO: 886971 - DNA, 18 bp, Homo sapiens
tcttgaagaataaattct

SEQ ID NO: 886972 - DNA, 23 bp, Homo sapiens
tcttgaagcatttcaaagccctg

SEQ ID NO: 886973 - DNA, 19 bp, Homo sapiens
tcttgaagcccccagccct

SEQ ID NO: 886974 - DNA, 14 bp, Homo sapiens
tcttgaagctgggc

SEQ ID NO: 886975 - DNA, 22 bp, Homo sapiens
tcttgaagctgggctgtctctc

SEQ ID NO: 886976 - DNA, 20 bp, Homo sapiens
tcttgaagtcagccacactg

SEQ ID NO: 886977 - DNA, 22 bp, Homo sapiens
tcttgaagtcagccacactggg

SEQ ID NO: 886978 - DNA, 15 bp, Homo sapiens
tcttgaattgttatg

SEQ ID NO: 886979 - DNA, 19 bp, Homo sapiens
tcttgaattgttatgaaaa

SEQ ID NO: 886980 - DNA, 13 bp, Homo sapiens
tcttgacaaaacc

SEQ ID NO: 886981 - DNA, 21 bp, Homo sapiens
tcttgacaagctgacttggca

SEQ ID NO: 886982 - DNA, 22 bp, Homo sapiens
tcttgacaagctgacttggcac

SEQ ID NO: 886983 - DNA, 23 bp, Homo sapiens
tcttgacaagctgacttggcact

SEQ ID NO: 886984 - DNA, 14 bp, Homo sapiens
tcttgacagtctga

SEQ ID NO: 886985 - DNA, 14 bp, Homo sapiens
tcttgaccctgcac

SEQ ID NO: 886986 - DNA, 16 bp, Homo sapiens
tcttgaccctgcaccc

SEQ ID NO: 886987 - DNA, 19 bp, Homo sapiens
tcttgaccctgcaccctcc

SEQ ID NO: 886988 - DNA, 20 bp, Homo sapiens
tcttgactaggtattgtcta

SEQ ID NO: 886989 - DNA, 19 bp, Homo sapiens
tcttgactcatggcagctg

SEQ ID NO: 886990 - DNA, 14 bp, Homo sapiens
tcttgactctaaat

SEQ ID NO: 886991 - DNA, 21 bp, Homo sapiens
tcttgactctaaatgcagttt

SEQ ID NO: 886992 - DNA, 13 bp, Homo sapiens
tcttgactttctg

SEQ ID NO: 886993 - DNA, 12 bp, Homo sapiens
tcttgagcagac

SEQ ID NO: 886994 - DNA, 12 bp, Homo sapiens
tcttgagccaca

SEQ ID NO: 886995 - DNA, 13 bp, Homo sapiens
tcttgagcctggg

SEQ ID NO: 886996 - DNA, 16 bp, Homo sapiens
tcttgagcctgggagg

SEQ ID NO: 886997 - DNA, 12 bp, Homo sapiens
tcttgagctggc

SEQ ID NO: 886998 - DNA, 23 bp, Homo sapiens
tcttgagctggcctctctagcac

SEQ ID NO: 886999 - DNA, 22 bp, Homo sapiens
tcttgaggagcattaaggtatt

SEQ ID NO: 887000 - DNA, 18 bp, Homo sapiens
tcttgaggcctgtgctct

SEQ ID NO: 887001 - DNA, 15 bp, Homo sapiens
tcttgaggggaagct

SEQ ID NO: 887002 - DNA, 22 bp, Homo sapiens
tcttgaggggaagctagtcttt

SEQ ID NO: 887003 - DNA, 17 bp, Homo sapiens
tcttgagttcctctgca

SEQ ID NO: 887004 - DNA, 19 bp, Homo sapiens
tcttgagttcctctgcagt

SEQ ID NO: 887005 - DNA, 14 bp, Homo sapiens
tcttgagtttgtcg

SEQ ID NO: 887006 - DNA, 20 bp, Homo sapiens
tcttttagggtaagaagttt

SEQ ID NO: 887007 - DNA, 16 bp, Homo sapiens
tcttttagttttagtt

SEQ ID NO: 887008 - DNA, 18 bp, Homo sapiens
tcttttagttttagttgc

SEQ ID NO: 887009 - DNA, 18 bp, Homo sapiens
tcttttatagacgctctt

SEQ ID NO: 887010 - DNA, 22 bp, Homo sapiens
tcttttattatcagttaaaatc

SEQ ID NO: 887011 - DNA, 19 bp, Homo sapiens
tcttttattctgttatata

SEQ ID NO: 887012 - DNA, 16 bp, Homo sapiens
tcttttatttaacaaa

SEQ ID NO: 887013 - DNA, 18 bp, Homo sapiens
tcttttatttaacaaaaa

SEQ ID NO: 887014 - DNA, 23 bp, Homo sapiens
tcttttcaagtaattttcatatt

SEQ ID NO: 887015 - DNA, 14 bp, Homo sapiens
tcttttcagaagca

SEQ ID NO: 887016 - DNA, 22 bp, Homo sapiens
tcttttcagaagcaagccagac

SEQ ID NO: 887017 - DNA, 23 bp, Homo sapiens
tcttttcataaagggttgaaaat

SEQ ID NO: 887018 - DNA, 18 bp, Homo sapiens
tcttttcatctgggaaag

SEQ ID NO: 887019 - DNA, 19 bp, Homo sapiens
tcttttcatctgggaaaga

SEQ ID NO: 887020 - DNA, 16 bp, Homo sapiens
tcttttcattgaacag

SEQ ID NO: 887021 - DNA, 17 bp, Homo sapiens
tcttttccaagctcctt

SEQ ID NO: 887022 - DNA, 20 bp, Homo sapiens
tcttttccactcctatggaa

SEQ ID NO: 887023 - DNA, 20 bp, Homo sapiens
tcttttcccatttatctaaa

SEQ ID NO: 887024 - DNA, 19 bp, Homo sapiens
tcttttcccctttcctgtc

SEQ ID NO: 887025 - DNA, 15 bp, Homo sapiens
tcttttccctctcta

SEQ ID NO: 887026 - DNA, 14 bp, Homo sapiens
tcttttcccttaaa

SEQ ID NO: 887027 - DNA, 20 bp, Homo sapiens
tcttttcctgggaatggaat

SEQ ID NO: 887028 - DNA, 22 bp, Homo sapiens
tcttttcctgggaatggaataa

SEQ ID NO: 887029 - DNA, 17 bp, Homo sapiens
tcttttctacacattga

SEQ ID NO: 887030 - DNA, 11 bp, Homo sapiens
tcttttctaga

SEQ ID NO: 887031 - DNA, 23 bp, Homo sapiens
tcttttctgcatcatctgtagat

SEQ ID NO: 887032 - DNA, 19 bp, Homo sapiens
tcttttctggaatgtaatc

SEQ ID NO: 887033 - DNA, 13 bp, Homo sapiens
tcttttctgttat

SEQ ID NO: 887034 - DNA, 18 bp, Homo sapiens
tcttttcttactcctcct

SEQ ID NO: 887035 - DNA, 12 bp, Homo sapiens
tcttttctttac

SEQ ID NO: 887036 - DNA, 22 bp, Homo sapiens
tcttttgaactgttagatgctg

SEQ ID NO: 887037 - DNA, 20 bp, Homo sapiens
tcttttgaatccatgcttgg

SEQ ID NO: 887038 - DNA, 16 bp, Homo sapiens
tcttttgacaccttag

SEQ ID NO: 887039 - DNA, 14 bp, Homo sapiens
tcttttgacatgtg

SEQ ID NO: 887040 - DNA, 17 bp, Homo sapiens
tcttttgacatgtggaa

SEQ ID NO: 887041 - DNA, 15 bp, Homo sapiens
tcttttgagtggtaa

SEQ ID NO: 887042 - DNA, 16 bp, Homo sapiens
tcttttgattatgttt

SEQ ID NO: 887043 - DNA, 12 bp, Homo sapiens
tcttttgattct

SEQ ID NO: 887044 - DNA, 21 bp, Homo sapiens
tcttttgcccttcacagtgtt

SEQ ID NO: 887045 - DNA, 19 bp, Homo sapiens
tcttttgccgttattaaaa

SEQ ID NO: 887046 - DNA, 12 bp, Homo sapiens
tcttttggcctt

SEQ ID NO: 887047 - DNA, 13 bp, Homo sapiens
tcttttggccttg

SEQ ID NO: 887048 - DNA, 16 bp, Homo sapiens
tcttttggggaagtga

SEQ ID NO: 887049 - DNA, 14 bp, Homo sapiens
tcttttgggtaaaa

SEQ ID NO: 887050 - DNA, 22 bp, Homo sapiens
tcttttgggtaaaatctgtaat

SEQ ID NO: 887051 - DNA, 22 bp, Homo sapiens
tcttttggtaaagactggcttt

SEQ ID NO: 887052 - DNA, 20 bp, Homo sapiens
tcttttggttatgaatactt

SEQ ID NO: 887053 - DNA, 15 bp, Homo sapiens
tcttttgtaatttaa

SEQ ID NO: 887054 - DNA, 11 bp, Homo sapiens
tcttttgtatg

SEQ ID NO: 887055 - DNA, 13 bp, Homo sapiens
tcttttgtctccc

SEQ ID NO: 887056 - DNA, 22 bp, Homo sapiens
tcttttgtgttcctatggaaac

SEQ ID NO: 887057 - DNA, 20 bp, Homo sapiens
tcttttgttcgcatggtcac

SEQ ID NO: 887058 - DNA, 15 bp, Homo sapiens
tcttttgttctctga

SEQ ID NO: 887059 - DNA, 21 bp, Homo sapiens
tctttttaaaaactcttcagt

SEQ ID NO: 887060 - DNA, 21 bp, Homo sapiens
tctttttaaagtttgttcact

SEQ ID NO: 887061 - DNA, 15 bp, Homo sapiens
tctttttaagttaat

SEQ ID NO: 887062 - DNA, 11 bp, Homo sapiens
tctttttaatt

SEQ ID NO: 887063 - DNA, 19 bp, Homo sapiens
tctttttacctttcataca

SEQ ID NO: 887064 - DNA, 14 bp, Homo sapiens
tctttttatgcaaa

SEQ ID NO: 887065 - DNA, 14 bp, Homo sapiens
tctttttattgaat

SEQ ID NO: 887066 - DNA, 18 bp, Homo sapiens
tctttttatttaaatgtg

SEQ ID NO: 887067 - DNA, 14 bp, Homo sapiens
tctttttcctactc

SEQ ID NO: 887068 - DNA, 13 bp, Homo sapiens
tctttttcctcct

SEQ ID NO: 887069 - DNA, 15 bp, Homo sapiens
tctttttcctcctgg

SEQ ID NO: 887070 - DNA, 15 bp, Homo sapiens
tctttttctggaaat

SEQ ID NO: 887071 - DNA, 13 bp, Homo sapiens
tgaaccacagaaa

SEQ ID NO: 887072 - DNA, 19 bp, Homo sapiens
tgaaccacgaggctgcccc

SEQ ID NO: 887073 - DNA, 23 bp, Homo sapiens
tgaaccacttccctcatctctcc

SEQ ID NO: 887074 - DNA, 20 bp, Homo sapiens
tgaaccagagggtgtggctt

SEQ ID NO: 887075 - DNA, 16 bp, Homo sapiens
tgaaccagctcatctc

SEQ ID NO: 887076 - DNA, 20 bp, Homo sapiens
tgaaccattccctagtcatt

SEQ ID NO: 887077 - DNA, 15 bp, Homo sapiens
tgaacccacacctgg

SEQ ID NO: 887078 - DNA, 22 bp, Homo sapiens
tgaacccaggacgcttctgaat

SEQ ID NO: 887079 - DNA, 15 bp, Homo sapiens
tgaaccccatgggct

SEQ ID NO: 887080 - DNA, 16 bp, Homo sapiens
tgaaccccatgggctt

SEQ ID NO: 887081 - DNA, 22 bp, Homo sapiens
tgaaccccctccctgtcccagg

SEQ ID NO: 887082 - DNA, 17 bp, Homo sapiens
tgaacccctggccagct

SEQ ID NO: 887083 - DNA, 20 bp, Homo sapiens
tgaacccctggccagctctg

SEQ ID NO: 887084 - DNA, 23 bp, Homo sapiens
tgaaccctcttgccatcctgatg

SEQ ID NO: 887085 - DNA, 14 bp, Homo sapiens
tgaaccctggggcc

SEQ ID NO: 887086 - DNA, 15 bp, Homo sapiens
tgaaccctgtgctgg

SEQ ID NO: 887087 - DNA, 19 bp, Homo sapiens
tgaaccctgtgctggtgtc

SEQ ID NO: 887088 - DNA, 16 bp, Homo sapiens
tgaacccttgtgcttg

SEQ ID NO: 887089 - DNA, 22 bp, Homo sapiens
tgaaccgcaccccatcccacca

SEQ ID NO: 887090 - DNA, 14 bp, Homo sapiens
tgaacctatccttc

SEQ ID NO: 887091 - DNA, 17 bp, Homo sapiens
tgaacctatgaagcaat

SEQ ID NO: 887092 - DNA, 15 bp, Homo sapiens
tgaacctattttcat

SEQ ID NO: 887093 - DNA, 18 bp, Homo sapiens
tgaacctattttcatttg

SEQ ID NO: 887094 - DNA, 12 bp, Homo sapiens
tgaacctgggaa

SEQ ID NO: 887095 - DNA, 13 bp, Homo sapiens
tgaacctgtgctc

SEQ ID NO: 887096 - DNA, 20 bp, Homo sapiens
tgaacctttttttttgaaac

SEQ ID NO: 887097 - DNA, 21 bp, Homo sapiens
tgaacctttttttttgaaaca

SEQ ID NO: 887098 - DNA, 23 bp, Homo sapiens
tgaacctttttttttgaaacagc

SEQ ID NO: 887099 - DNA, 20 bp, Homo sapiens
tgaacgatatgtagcagaaa

SEQ ID NO: 887100 - DNA, 21 bp, Homo sapiens
tgaacgatatgtagcagaaag

SEQ ID NO: 887101 - DNA, 17 bp, Homo sapiens
tgaacgctgtgatgctg

SEQ ID NO: 887102 - DNA, 15 bp, Homo sapiens
tgaacggggagaaaa

SEQ ID NO: 887103 - DNA, 16 bp, Homo sapiens
tgaacggggagaaaag

SEQ ID NO: 887104 - DNA, 17 bp, Homo sapiens
tgaacgttttaataatt

SEQ ID NO: 887105 - DNA, 13 bp, Homo sapiens
tgaacgttttctt

SEQ ID NO: 887106 - DNA, 23 bp, Homo sapiens
tgaacgttttcttctttccctgg

SEQ ID NO: 887107 - DNA, 21 bp, Homo sapiens
tgaactacgcttgctcatttt

SEQ ID NO: 887108 - DNA, 17 bp, Homo sapiens
tgaactaggctgagcaa

SEQ ID NO: 887109 - DNA, 19 bp, Homo sapiens
tgaactatatcagtagtgt

SEQ ID NO: 887110 - DNA, 18 bp, Homo sapiens
tgaactatgaacactgtc

SEQ ID NO: 887111 - DNA, 17 bp, Homo sapiens
tgaactatgactggagt

SEQ ID NO: 887112 - DNA, 21 bp, Homo sapiens
tgaactatgtcgatgcacagt

SEQ ID NO: 887113 - DNA, 14 bp, Homo sapiens
tgaactcaaactga

SEQ ID NO: 887114 - DNA, 16 bp, Homo sapiens
tgaactcaaactgagg

SEQ ID NO: 887115 - DNA, 17 bp, Homo sapiens
tgaactcagaccacttg

SEQ ID NO: 887116 - DNA, 21 bp, Homo sapiens
tgaactccaccgaccaactgc

SEQ ID NO: 887117 - DNA, 19 bp, Homo sapiens
tgaactccatacagcctct

SEQ ID NO: 887118 - DNA, 22 bp, Homo sapiens
tgaactccatcgccatcttctt

SEQ ID NO: 887119 - DNA, 13 bp, Homo sapiens
tgaactcctgcca

SEQ ID NO: 887120 - DNA, 16 bp, Homo sapiens
tgaactcctggcctca

SEQ ID NO: 887121 - DNA, 11 bp, Homo sapiens
tgaactctcaa

SEQ ID NO: 887122 - DNA, 12 bp, Homo sapiens
tgaactctcaaa

SEQ ID NO: 887123 - DNA, 12 bp, Homo sapiens
tgaactcttaga

SEQ ID NO: 887124 - DNA, 22 bp, Homo sapiens
tgaactcttagtgattgagact

SEQ ID NO: 887125 - DNA, 15 bp, Homo sapiens
tgaactcttcaatct

SEQ ID NO: 887126 - DNA, 19 bp, Homo sapiens
tgaactcttctgcaaaaat

SEQ ID NO: 887127 - DNA, 14 bp, Homo sapiens
tgaactctttcaaa

SEQ ID NO: 887128 - DNA, 19 bp, Homo sapiens
tgaactgaaacttttctaa

SEQ ID NO: 887129 - DNA, 22 bp, Homo sapiens
tgaactgaacaccattgaaggc

SEQ ID NO: 887130 - DNA, 15 bp, Homo sapiens
tgaactgaagtttca

SEQ ID NO: 887131 - DNA, 15 bp, Homo sapiens
tgaactgacaatgaa

SEQ ID NO: 887132 - DNA, 13 bp, Homo sapiens
tgaactgagaagg

SEQ ID NO: 887133 - DNA, 16 bp, Homo sapiens
tgaactgaggccctgt

SEQ ID NO: 887134 - DNA, 16 bp, Homo sapiens
tgaactgaggccttgt

SEQ ID NO: 887135 - DNA, 13 bp, Homo sapiens
tgaactgataaag

SEQ ID NO: 887136 - DNA, 12 bp, Homo sapiens
tgaactgattca

SEQ ID NO: 887137 - DNA, 17 bp, Homo sapiens
tgaactgcaacactgga

SEQ ID NO: 887138 - DNA, 12 bp, Homo sapiens
tgaactgctcta

SEQ ID NO: 887139 - DNA, 14 bp, Homo sapiens
tgaactgctttcaa

SEQ ID NO: 887140 - DNA, 11 bp, Homo sapiens
tgaactgggca

SEQ ID NO: 887141 - DNA, 18 bp, Homo sapiens
tgaactgggcacagattg

SEQ ID NO: 887142 - DNA, 12 bp, Homo sapiens
tgaactgggctc

SEQ ID NO: 887143 - DNA, 17 bp, Homo sapiens
tgaactgtggtgccaca

SEQ ID NO: 887144 - DNA, 22 bp, Homo sapiens
tgaacttaataactgtgtactg

SEQ ID NO: 887145 - DNA, 18 bp, Homo sapiens
tgaacttgagatctgtat

SEQ ID NO: 887146 - DNA, 21 bp, Homo sapiens
tgaacttgagctctgtaactt

SEQ ID NO: 887147 - DNA, 22 bp, Homo sapiens
tgaacttgagctctgtaactta

SEQ ID NO: 887148 - DNA, 16 bp, Homo sapiens
tgaacttgctcttttt

SEQ ID NO: 887149 - DNA, 11 bp, Homo sapiens
tgaacttgtca

SEQ ID NO: 887150 - DNA, 22 bp, Homo sapiens
tgaactttctcttcatactttt

SEQ ID NO: 887151 - DNA, 11 bp, Homo sapiens
tgaactttgac

SEQ ID NO: 887152 - DNA, 20 bp, Homo sapiens
tgaactttgacctctgcagc

SEQ ID NO: 887153 - DNA, 23 bp, Homo sapiens
tgaacttttacagaatgcattaa

SEQ ID NO: 887154 - DNA, 13 bp, Homo sapiens
tgaacttttgtaa

SEQ ID NO: 887155 - DNA, 16 bp, Homo sapiens
tgaacttttgtaattt

SEQ ID NO: 887156 - DNA, 18 bp, Homo sapiens
tgaacttttgtaatttga

SEQ ID NO: 887157 - DNA, 21 bp, Homo sapiens
tgaacttttgtaatttgaatt

SEQ ID NO: 887158 - DNA, 15 bp, Homo sapiens
tgaacttttgtactg

SEQ ID NO: 887159 - DNA, 18 bp, Homo sapiens
tgaacttttgtactgaat

SEQ ID NO: 887160 - DNA, 14 bp, Homo sapiens
tgaactttttattt

SEQ ID NO: 887161 - DNA, 17 bp, Homo sapiens
tgaactttttatttgag

SEQ ID NO: 887162 - DNA, 13 bp, Homo sapiens
tgaactttttgta

SEQ ID NO: 887163 - DNA, 14 bp, Homo sapiens
tgaagaaaaaatca

SEQ ID NO: 887164 - DNA, 21 bp, Homo sapiens
tgaagaaaaagacctgcattt

SEQ ID NO: 887165 - DNA, 13 bp, Homo sapiens
tgaagaaaacaaa

SEQ ID NO: 887166 - DNA, 20 bp, Homo sapiens
tgaagaaaagaaaaaacaac

SEQ ID NO: 887167 - DNA, 18 bp, Homo sapiens
tgaagaaaagtgggccag

SEQ ID NO: 887168 - DNA, 21 bp, Homo sapiens
tgaagaaaatcacttaggaaa

SEQ ID NO: 887169 - DNA, 17 bp, Homo sapiens
tgaagaaaatgacttta

SEQ ID NO: 887170 - DNA, 21 bp, Homo sapiens
tgaagaaagccagacaacttc

SEQ ID NO: 887171 - DNA, 14 bp, Homo sapiens
tgaagaaagcccct

SEQ ID NO: 887172 - DNA, 19 bp, Homo sapiens
tgaagaaagggaggcccag

SEQ ID NO: 887173 - DNA, 20 bp, Homo sapiens
tgaagaaagtcaaaaaatta

SEQ ID NO: 887174 - DNA, 21 bp, Homo sapiens
tgaagaaagtcaaaaaattat

SEQ ID NO: 887175 - DNA, 22 bp, Homo sapiens
tgaagaaagtcaaaaaattatt

SEQ ID NO: 887176 - DNA, 15 bp, Homo sapiens
tgaagaaatgatgga

SEQ ID NO: 887177 - DNA, 17 bp, Homo sapiens
tgaagaaattgtggggg

SEQ ID NO: 887178 - DNA, 17 bp, Homo sapiens
tgaagaaatttatgaag

SEQ ID NO: 887179 - DNA, 22 bp, Homo sapiens
tgaagaacacagcatgtgccaa

SEQ ID NO: 887180 - DNA, 15 bp, Homo sapiens
tgaagaacagtaact

SEQ ID NO: 887181 - DNA, 14 bp, Homo sapiens
tgaagaactgcact

SEQ ID NO: 887182 - DNA, 16 bp, Homo sapiens
tgaagaactgcaggcc

SEQ ID NO: 887183 - DNA, 20 bp, Homo sapiens
tgaagaagaaccagcccagc

SEQ ID NO: 887184 - DNA, 22 bp, Homo sapiens
tgaagaagaaccagcccagcct

SEQ ID NO: 887185 - DNA, 15 bp, Homo sapiens
tgaagaagatgagcc

SEQ ID NO: 887186 - DNA, 22 bp, Homo sapiens
tgaagaagctaaatcctttact

SEQ ID NO: 887187 - DNA, 15 bp, Homo sapiens
tgaagaatctgcccc

SEQ ID NO: 887188 - DNA, 17 bp, Homo sapiens
tgaagaattatgtaata

SEQ ID NO: 887189 - DNA, 13 bp, Homo sapiens
tgaataacttgaa

SEQ ID NO: 887190 - DNA, 15 bp, Homo sapiens
tgaataacttgaaga

SEQ ID NO: 887191 - DNA, 22 bp, Homo sapiens
tgaataagccattctgactcat

SEQ ID NO: 887192 - DNA, 20 bp, Homo sapiens
tgaataagctttctctcaga

SEQ ID NO: 887193 - DNA, 21 bp, Homo sapiens
tgaataagtaaagaattactt

SEQ ID NO: 887194 - DNA, 20 bp, Homo sapiens
tgaataataagcaggatgtt

SEQ ID NO: 887195 - DNA, 14 bp, Homo sapiens
tgaataatgaaaat

SEQ ID NO: 887196 - DNA, 22 bp, Homo sapiens
tgaataatgaaaataaaacaca

SEQ ID NO: 887197 - DNA, 16 bp, Homo sapiens
tgaataatgctaccag

SEQ ID NO: 887198 - DNA, 18 bp, Homo sapiens
tgaataatgctaccagga

SEQ ID NO: 887199 - DNA, 14 bp, Homo sapiens
tgaataatggaaaa

SEQ ID NO: 887200 - DNA, 13 bp, Homo sapiens
tgaataatttctt

SEQ ID NO: 887201 - DNA, 18 bp, Homo sapiens
tgaatacaattaaaggtc

SEQ ID NO: 887202 - DNA, 17 bp, Homo sapiens
tgaatacacttacagtt

SEQ ID NO: 887203 - DNA, 19 bp, Homo sapiens
tgaatacagggcatgcatt

SEQ ID NO: 887204 - DNA, 20 bp, Homo sapiens
tgaatacattttataatttc

SEQ ID NO: 887205 - DNA, 16 bp, Homo sapiens
tgaataccactctgta

SEQ ID NO: 887206 - DNA, 19 bp, Homo sapiens
tgaataccactctgtaatt

SEQ ID NO: 887207 - DNA, 17 bp, Homo sapiens
tgaataccattaaaact

SEQ ID NO: 887208 - DNA, 21 bp, Homo sapiens
tgaataccattaaaactgctt

SEQ ID NO: 887209 - DNA, 23 bp, Homo sapiens
tgaataccattaaaactgctttt

SEQ ID NO: 887210 - DNA, 15 bp, Homo sapiens
tgaatactatccatg

SEQ ID NO: 887211 - DNA, 13 bp, Homo sapiens
tgaatactgtgaa

SEQ ID NO: 887212 - DNA, 13 bp, Homo sapiens
tgaatacttattt

SEQ ID NO: 887213 - DNA, 20 bp, Homo sapiens
tgaatacttattttcagtgc

SEQ ID NO: 887214 - DNA, 17 bp, Homo sapiens
tgaatagaagttttcct

SEQ ID NO: 887215 - DNA, 19 bp, Homo sapiens
tgaatagattttctctgga

SEQ ID NO: 887216 - DNA, 14 bp, Homo sapiens
tgaatagcctggcc

SEQ ID NO: 887217 - DNA, 11 bp, Homo sapiens
tgaatagcttg

SEQ ID NO: 887218 - DNA, 21 bp, Homo sapiens
tgaatagcttgtttctgtcaa

SEQ ID NO: 887219 - DNA, 15 bp, Homo sapiens
tgaatagtattgtgt

SEQ ID NO: 887220 - DNA, 22 bp, Homo sapiens
tgaatagtcttttgcatgtcgc

SEQ ID NO: 887221 - DNA, 21 bp, Homo sapiens
tgaatagttgcttaattttga

SEQ ID NO: 887222 - DNA, 14 bp, Homo sapiens
tgaatataaatgtg

SEQ ID NO: 887223 - DNA, 19 bp, Homo sapiens
tgaatataaatgtgtgtat

SEQ ID NO: 887224 - DNA, 21 bp, Homo sapiens
tgaatataaatgtgtgtatgt

SEQ ID NO: 887225 - DNA, 15 bp, Homo sapiens
tgaatatactcatta

SEQ ID NO: 887226 - DNA, 22 bp, Homo sapiens
tgaatatatttaagcaacatct

SEQ ID NO: 887227 - DNA, 14 bp, Homo sapiens
tgaatatcattgat

SEQ ID NO: 887228 - DNA, 16 bp, Homo sapiens
tgaatatctattaata

SEQ ID NO: 887229 - DNA, 18 bp, Homo sapiens
tgaatatctattaatata

SEQ ID NO: 887230 - DNA, 20 bp, Homo sapiens
tgaatatctgccccagtagt

SEQ ID NO: 887231 - DNA, 19 bp, Homo sapiens
tgaatatggttggagagcc

SEQ ID NO: 887232 - DNA, 21 bp, Homo sapiens
tgaatatggttggagagccct

SEQ ID NO: 887233 - DNA, 19 bp, Homo sapiens
tgaatattaaagctcttca

SEQ ID NO: 887234 - DNA, 16 bp, Homo sapiens
tgaatattactctcaa

SEQ ID NO: 887235 - DNA, 16 bp, Homo sapiens
tgaatattcctttatt

SEQ ID NO: 887236 - DNA, 18 bp, Homo sapiens
tgaatattgccattatgc

SEQ ID NO: 887237 - DNA, 23 bp, Homo sapiens
tgaatattggtaattaaaagact

SEQ ID NO: 887238 - DNA, 19 bp, Homo sapiens
tgaatatttatatttcact

SEQ ID NO: 887239 - DNA, 15 bp, Homo sapiens
tgaatattttggaaa

SEQ ID NO: 887240 - DNA, 16 bp, Homo sapiens
tgaatattttggaaac

SEQ ID NO: 887241 - DNA, 18 bp, Homo sapiens
tgaatattttggaaactg

SEQ ID NO: 887242 - DNA, 19 bp, Homo sapiens
tgaatattttggaaactgc

SEQ ID NO: 887243 - DNA, 24 bp, Homo sapiens
tgaatattttttatttctaagtat

SEQ ID NO: 887244 - DNA, 15 bp, Homo sapiens
tgaatattttttgaa

SEQ ID NO: 887245 - DNA, 19 bp, Homo sapiens
tgaatattttttgaaggtt

SEQ ID NO: 887246 - DNA, 13 bp, Homo sapiens
tgaatcaaagaca

SEQ ID NO: 887247 - DNA, 12 bp, Homo sapiens
tgaatcaaagtg

SEQ ID NO: 887248 - DNA, 17 bp, Homo sapiens
tgaatcaagcacactgt

SEQ ID NO: 887249 - DNA, 20 bp, Homo sapiens
tgaatcaataatatattttc

SEQ ID NO: 887250 - DNA, 14 bp, Homo sapiens
tgaatcaatgaaaa

SEQ ID NO: 887251 - DNA, 21 bp, Homo sapiens
tgaatcagaaaagctattaaa

SEQ ID NO: 887252 - DNA, 16 bp, Homo sapiens
tgaatcagaccctacc

SEQ ID NO: 887253 - DNA, 18 bp, Homo sapiens
tgaatcagaccctacccc

SEQ ID NO: 887254 - DNA, 16 bp, Homo sapiens
tgaatcaggaaactca

SEQ ID NO: 887255 - DNA, 20 bp, Homo sapiens
tgaatcagtataaacaaagt

SEQ ID NO: 887256 - DNA, 22 bp, Homo sapiens
tgaatcagtttccaattatttg

SEQ ID NO: 887257 - DNA, 19 bp, Homo sapiens
tgaatcagttttggaatct

SEQ ID NO: 887258 - DNA, 13 bp, Homo sapiens
tgaatcatgagcc

SEQ ID NO: 887259 - DNA, 18 bp, Homo sapiens
tgaatcatgagcctgctg

SEQ ID NO: 887260 - DNA, 12 bp, Homo sapiens
tgaatcatttct

SEQ ID NO: 887261 - DNA, 14 bp, Homo sapiens
tgaatcatttctta

SEQ ID NO: 887262 - DNA, 23 bp, Homo sapiens
tgaatcatttcttataccttctg

SEQ ID NO: 887263 - DNA, 18 bp, Homo sapiens
tgaatccaaatctgtcct

SEQ ID NO: 887264 - DNA, 15 bp, Homo sapiens
tgaatcccatcaggc

SEQ ID NO: 887265 - DNA, 22 bp, Homo sapiens
tgaatccccgacccccctaccc

SEQ ID NO: 887266 - DNA, 11 bp, Homo sapiens
tgaatccctgg

SEQ ID NO: 887267 - DNA, 16 bp, Homo sapiens
tgaatccttttaatct

SEQ ID NO: 887268 - DNA, 14 bp, Homo sapiens
tgaatctaaggata

SEQ ID NO: 887269 - DNA, 15 bp, Homo sapiens
tgaatctatgccaaa

SEQ ID NO: 887270 - DNA, 16 bp, Homo sapiens
tgaatctatttaagta

SEQ ID NO: 887271 - DNA, 19 bp, Homo sapiens
tgaatctgagagatgctgt

SEQ ID NO: 887272 - DNA, 23 bp, Homo sapiens
tgaatctgatctttttatacaca

SEQ ID NO: 887273 - DNA, 14 bp, Homo sapiens
tgaatctgtacatg

SEQ ID NO: 887274 - DNA, 22 bp, Homo sapiens
tgaatcttaatcgatgaatgta

SEQ ID NO: 887275 - DNA, 19 bp, Homo sapiens
tgaatcttcacgacaatgt

SEQ ID NO: 887276 - DNA, 12 bp, Homo sapiens
tgaatcttctgg

SEQ ID NO: 887277 - DNA, 14 bp, Homo sapiens
tgaatcttgttcaa

SEQ ID NO: 887278 - DNA, 18 bp, Homo sapiens
tgaatctttcatacatat

SEQ ID NO: 887279 - DNA, 19 bp, Homo sapiens
tgaatctttcatacatata

SEQ ID NO: 887280 - DNA, 19 bp, Homo sapiens
tgaatctttccaataaacc

SEQ ID NO: 887281 - DNA, 17 bp, Homo sapiens
tgaatctttctcctggt

SEQ ID NO: 887282 - DNA, 13 bp, Homo sapiens
tgaatctttgtgc

SEQ ID NO: 887283 - DNA, 23 bp, Homo sapiens
tgaatctttttatcccatttagt

SEQ ID NO: 887284 - DNA, 12 bp, Homo sapiens
tgaatgaaaaca

SEQ ID NO: 887285 - DNA, 13 bp, Homo sapiens
tgaatgaaaacat

SEQ ID NO: 887286 - DNA, 12 bp, Homo sapiens
tgaatgaacact

SEQ ID NO: 887287 - DNA, 16 bp, Homo sapiens
tgaatgaagcagtatt

SEQ ID NO: 887288 - DNA, 21 bp, Homo sapiens
tgaatgaccagcagcagcttt

SEQ ID NO: 887289 - DNA, 21 bp, Homo sapiens
tgaatgagacctggaacaaat

SEQ ID NO: 887290 - DNA, 16 bp, Homo sapiens
tgaatgagccaaaatg

SEQ ID NO: 887291 - DNA, 19 bp, Homo sapiens
tgaatgaggtcccaggcag

SEQ ID NO: 887292 - DNA, 16 bp, Homo sapiens
tgaatgatcttgtgta

SEQ ID NO: 887293 - DNA, 18 bp, Homo sapiens
tgaatgatttgtgtttct

SEQ ID NO: 887294 - DNA, 19 bp, Homo sapiens
tgaatgatttttctttaca

SEQ ID NO: 887295 - DNA, 23 bp, Homo sapiens
tgaatgcaaaattgttttcactt

SEQ ID NO: 887296 - DNA, 18 bp, Homo sapiens
tgaatgcataatgtttaa

SEQ ID NO: 887297 - DNA, 15 bp, Homo sapiens
tgaatgccactgcct

SEQ ID NO: 887298 - DNA, 23 bp, Homo sapiens
tgaatgcccacaggcaaatgcat

SEQ ID NO: 887299 - DNA, 20 bp, Homo sapiens
tgaatgcccccagctggccc

SEQ ID NO: 887300 - DNA, 17 bp, Homo sapiens
tgaatgcctcaatgtga

SEQ ID NO: 887301 - DNA, 16 bp, Homo sapiens
tgaatgcctcctgtgg

SEQ ID NO: 887302 - DNA, 18 bp, Homo sapiens
tgaatgcctcctgtgggg

SEQ ID NO: 887303 - DNA, 17 bp, Homo sapiens
tgaatgcgctttattgc

SEQ ID NO: 887304 - DNA, 16 bp, Homo sapiens
tgaatgctagacagaa

SEQ ID NO: 887305 - DNA, 12 bp, Homo sapiens
tgaatgctgcca

SEQ ID NO: 887306 - DNA, 13 bp, Homo sapiens
tgaatgctgccac

SEQ ID NO: 887307 - DNA, 22 bp, Homo sapiens
tgaatgctgccagtgtggagtg

SEQ ID NO: 887308 - DNA, 13 bp, Homo sapiens
tgaatgctgggac

SEQ ID NO: 887309 - DNA, 14 bp, Homo sapiens
tgaatgctgggact

SEQ ID NO: 887310 - DNA, 19 bp, Homo sapiens
tgaatgctgggactcagcc

SEQ ID NO: 887311 - DNA, 17 bp, Homo sapiens
tgaatgcttctaagtaa

SEQ ID NO: 887312 - DNA, 14 bp, Homo sapiens
tgaatgcttttagt

SEQ ID NO: 887313 - DNA, 17 bp, Homo sapiens
tgaatgggtccattttg

SEQ ID NO: 887314 - DNA, 20 bp, Homo sapiens
tgaattaacacagtgtttca

SEQ ID NO: 887315 - DNA, 22 bp, Homo sapiens
tgaattaacacagtgtttcaat

SEQ ID NO: 887316 - DNA, 16 bp, Homo sapiens
tgaattaatatcccta

SEQ ID NO: 887317 - DNA, 22 bp, Homo sapiens
tgaattaatatccctacatgta

SEQ ID NO: 887318 - DNA, 17 bp, Homo sapiens
tgaattacctggatgtt

SEQ ID NO: 887319 - DNA, 14 bp, Homo sapiens
tgaattagaaaatt

SEQ ID NO: 887320 - DNA, 19 bp, Homo sapiens
tgaattagacctttatttt

SEQ ID NO: 887321 - DNA, 21 bp, Homo sapiens
tgaattagacctttatttttc

SEQ ID NO: 887322 - DNA, 18 bp, Homo sapiens
tgaattaggctaaaaggt

SEQ ID NO: 887323 - DNA, 22 bp, Homo sapiens
tgaattaggctgtaactacttt

SEQ ID NO: 887324 - DNA, 18 bp, Homo sapiens
tgaattagtgagtatagt

SEQ ID NO: 887325 - DNA, 15 bp, Homo sapiens
tgaattataacagtt

SEQ ID NO: 887326 - DNA, 19 bp, Homo sapiens
tgaattataactagacatc

SEQ ID NO: 887327 - DNA, 18 bp, Homo sapiens
tgaattatcagcaaagaa

SEQ ID NO: 887328 - DNA, 19 bp, Homo sapiens
tgaattatcagcaaagaaa

SEQ ID NO: 887329 - DNA, 19 bp, Homo sapiens
tgaattatgttttgacaca

SEQ ID NO: 887330 - DNA, 17 bp, Homo sapiens
tgaattattgacactga

SEQ ID NO: 887331 - DNA, 14 bp, Homo sapiens
tgaattcagttgct

SEQ ID NO: 887332 - DNA, 16 bp, Homo sapiens
tgaattcccagactct

SEQ ID NO: 887333 - DNA, 19 bp, Homo sapiens
tgaattcccagactctgcc

SEQ ID NO: 887334 - DNA, 20 bp, Homo sapiens
tgaattcccagactctgcct

SEQ ID NO: 887335 - DNA, 15 bp, Homo sapiens
tgaattcccttttaa

SEQ ID NO: 887336 - DNA, 17 bp, Homo sapiens
tgaattcttcctctcct

SEQ ID NO: 887337 - DNA, 19 bp, Homo sapiens
tgaattcttcctctccttc

SEQ ID NO: 887338 - DNA, 20 bp, Homo sapiens
tgaattcttcctctccttcc

SEQ ID NO: 887339 - DNA, 14 bp, Homo sapiens
tgaattcttgatct

SEQ ID NO: 887340 - DNA, 13 bp, Homo sapiens
tgaattgagaata

SEQ ID NO: 887341 - DNA, 18 bp, Homo sapiens
tgaattgagctgcagaaa

SEQ ID NO: 887342 - DNA, 18 bp, Homo sapiens
tgaattgtacctatttct

SEQ ID NO: 887343 - DNA, 20 bp, Homo sapiens
tgaattgtacctatttctga

SEQ ID NO: 887344 - DNA, 23 bp, Homo sapiens
tgaattgtacctatttctgatga

SEQ ID NO: 887345 - DNA, 13 bp, Homo sapiens
tgaattgtgaaat

SEQ ID NO: 887346 - DNA, 22 bp, Homo sapiens
tgaattgtgtattgatgcaata

SEQ ID NO: 887347 - DNA, 14 bp, Homo sapiens
tgaatttaaatata

SEQ ID NO: 887348 - DNA, 15 bp, Homo sapiens
tgaatttaaatataa

SEQ ID NO: 887349 - DNA, 20 bp, Homo sapiens
tgaatttaaatataattctg

SEQ ID NO: 887350 - DNA, 19 bp, Homo sapiens
tgaatttaataatctgtag

SEQ ID NO: 887351 - DNA, 11 bp, Homo sapiens
tgaatttagaa

SEQ ID NO: 887352 - DNA, 17 bp, Homo sapiens
tgaatttataaagtacc

SEQ ID NO: 887353 - DNA, 17 bp, Homo sapiens
tgaatttatctttacca

SEQ ID NO: 887354 - DNA, 19 bp, Homo sapiens
tgaatttatctttaccaaa

SEQ ID NO: 887355 - DNA, 20 bp, Homo sapiens
tgaatttatgagatttactg

SEQ ID NO: 887356 - DNA, 20 bp, Homo sapiens
tgaatttattgcacattgtt

SEQ ID NO: 887357 - DNA, 12 bp, Homo sapiens
tgaatttcaaaa

SEQ ID NO: 887358 - DNA, 13 bp, Homo sapiens
tgaatttcactgt

SEQ ID NO: 887359 - DNA, 13 bp, Homo sapiens
tgaatttctaaaa

SEQ ID NO: 887360 - DNA, 20 bp, Homo sapiens
tgaatttcttcactgttgaa

SEQ ID NO: 887361 - DNA, 18 bp, Homo sapiens
tgaatttcttcttttcct

SEQ ID NO: 887362 - DNA, 18 bp, Homo sapiens
tgaatttgaatgaaaaat

SEQ ID NO: 887363 - DNA, 21 bp, Homo sapiens
tgaatttgctaagaaatgtta

SEQ ID NO: 887364 - DNA, 16 bp, Homo sapiens
tgaatttggaatgttc

SEQ ID NO: 887365 - DNA, 15 bp, Homo sapiens
tgaatttggagactc

SEQ ID NO: 887366 - DNA, 21 bp, Homo sapiens
tgaatttgtaagcaacttgct

SEQ ID NO: 887367 - DNA, 16 bp, Homo sapiens
tgaatttgtattaaaa

SEQ ID NO: 887368 - DNA, 13 bp, Homo sapiens
tgaatttgtccaa

SEQ ID NO: 887369 - DNA, 12 bp, Homo sapiens
tgaatttgttag

SEQ ID NO: 887370 - DNA, 14 bp, Homo sapiens
tgaattttaaagta

SEQ ID NO: 887371 - DNA, 19 bp, Homo sapiens
tgaattttcaaggccttca

SEQ ID NO: 887372 - DNA, 22 bp, Homo sapiens
tgaattttctaaaagctttcat

SEQ ID NO: 887373 - DNA, 13 bp, Homo sapiens
tgaattttctgtg

SEQ ID NO: 887374 - DNA, 13 bp, Homo sapiens
tgaattttgggga

SEQ ID NO: 887375 - DNA, 20 bp, Homo sapiens
tgaattttggggattttcaa

SEQ ID NO: 887376 - DNA, 18 bp, Homo sapiens
tgaattttgttctctggg

SEQ ID NO: 887377 - DNA, 21 bp, Homo sapiens
tgaattttgtttttattttca

SEQ ID NO: 887378 - DNA, 23 bp, Homo sapiens
tgaatttttaaacaagtatttgt

SEQ ID NO: 887379 - DNA, 12 bp, Homo sapiens
tgaatttttaat

SEQ ID NO: 887380 - DNA, 16 bp, Homo sapiens
tgaatttttacatttg

SEQ ID NO: 887381 - DNA, 17 bp, Homo sapiens
tgaattttttgaaatgg

SEQ ID NO: 887382 - DNA, 19 bp, Homo sapiens
tgaattttttgaaatgggc

SEQ ID NO: 887383 - DNA, 21 bp, Homo sapiens
tgaatttttttcatcttctct

SEQ ID NO: 887384 - DNA, 19 bp, Homo sapiens
tgaatttttttttcctagc

SEQ ID NO: 887385 - DNA, 21 bp, Homo sapiens
tgacaaaaaaaaaatagagag

SEQ ID NO: 887386 - DNA, 13 bp, Homo sapiens
tgacaaaagtaaa

SEQ ID NO: 887387 - DNA, 15 bp, Homo sapiens
tgacaaaatgggagg

SEQ ID NO: 887388 - DNA, 18 bp, Homo sapiens
tgacaaaatgggaggagg

SEQ ID NO: 887389 - DNA, 19 bp, Homo sapiens
tgacaaaatgggaggagga

SEQ ID NO: 887390 - DNA, 10 bp, Homo sapiens
tgacaaaatt

SEQ ID NO: 887391 - DNA, 14 bp, Homo sapiens
tgacaaaccatttc

SEQ ID NO: 887392 - DNA, 17 bp, Homo sapiens
tgacaaaccatttccaa

SEQ ID NO: 887393 - DNA, 16 bp, Homo sapiens
tgacaaacctagcttt

SEQ ID NO: 887394 - DNA, 19 bp, Homo sapiens
tgacaaagaaacccaagtg

SEQ ID NO: 887395 - DNA, 15 bp, Homo sapiens
tgacaaagactcctc

SEQ ID NO: 887396 - DNA, 19 bp, Homo sapiens
tgacaaagactgagtacgt

SEQ ID NO: 887397 - DNA, 14 bp, Homo sapiens
tgacaaagatggct

SEQ ID NO: 887398 - DNA, 16 bp, Homo sapiens
tgacaaagatggctca

SEQ ID NO: 887399 - DNA, 16 bp, Homo sapiens
tgacaaagccattctt

SEQ ID NO: 887400 - DNA, 17 bp, Homo sapiens
tgacaaagccattcttt

SEQ ID NO: 887401 - DNA, 21 bp, Homo sapiens
tgacaaaggagccttgataat

SEQ ID NO: 887402 - DNA, 15 bp, Homo sapiens
tgacaaaggatgaag

SEQ ID NO: 887403 - DNA, 20 bp, Homo sapiens
tgacaaagtgccgtgataat

SEQ ID NO: 887404 - DNA, 13 bp, Homo sapiens
tgacaaagtgcct

SEQ ID NO: 887405 - DNA, 16 bp, Homo sapiens
tgacaaagtgttgaaa

SEQ ID NO: 887406 - DNA, 21 bp, Homo sapiens
tgacaaagtgttgaaaatgta

SEQ ID NO: 887407 - DNA, 12 bp, Homo sapiens
tgacaacagaaa

SEQ ID NO: 887408 - DNA, 14 bp, Homo sapiens
tgacaacagaaaaa

SEQ ID NO: 887409 - DNA, 19 bp, Homo sapiens
tgacaacagaaaaacaatc

SEQ ID NO: 887410 - DNA, 16 bp, Homo sapiens
tgacagggccagtgca

SEQ ID NO: 887411 - DNA, 22 bp, Homo sapiens
tgacaggtgatgctctggcttg

SEQ ID NO: 887412 - DNA, 15 bp, Homo sapiens
tgacaggtgcctgtc

SEQ ID NO: 887413 - DNA, 20 bp, Homo sapiens
tgacaggtgcctgtccttga

SEQ ID NO: 887414 - DNA, 16 bp, Homo sapiens
tgacaggtgtgagcca

SEQ ID NO: 887415 - DNA, 19 bp, Homo sapiens
tgacagtattccatttctg

SEQ ID NO: 887416 - DNA, 22 bp, Homo sapiens
tgacagtcataaatactgtcaa

SEQ ID NO: 887417 - DNA, 24 bp, Homo sapiens
tgacagtcataaatactgtcaaac

SEQ ID NO: 887418 - DNA, 11 bp, Homo sapiens
tgacagtcatc

SEQ ID NO: 887419 - DNA, 18 bp, Homo sapiens
tgacagtcatcatcaggg

SEQ ID NO: 887420 - DNA, 20 bp, Homo sapiens
tgacagtcatcatcagggcc

SEQ ID NO: 887421 - DNA, 22 bp, Homo sapiens
tgacagtcatcatcagggcctg

SEQ ID NO: 887422 - DNA, 15 bp, Homo sapiens
tgacagtccacaggg

SEQ ID NO: 887423 - DNA, 18 bp, Homo sapiens
tgacagtccacaggggcc

SEQ ID NO: 887424 - DNA, 22 bp, Homo sapiens
tgacagtccgtcaaaacagatt

SEQ ID NO: 887425 - DNA, 15 bp, Homo sapiens
tgacagtcttgtgct

SEQ ID NO: 887426 - DNA, 21 bp, Homo sapiens
tgacagtgacacccagaggga

SEQ ID NO: 887427 - DNA, 17 bp, Homo sapiens
tgacagtgcctcttcca

SEQ ID NO: 887428 - DNA, 14 bp, Homo sapiens
tgacagtgcctggg

SEQ ID NO: 887429 - DNA, 20 bp, Homo sapiens
tgacagtgcctgggaatgta

SEQ ID NO: 887430 - DNA, 21 bp, Homo sapiens
tgacagtgcctgggaatgtat

SEQ ID NO: 887431 - DNA, 12 bp, Homo sapiens
tgacagtgcctt

SEQ ID NO: 887432 - DNA, 20 bp, Homo sapiens
tgacagtgcttgcatcctat

SEQ ID NO: 887433 - DNA, 16 bp, Homo sapiens
tgaccaggatcccaag

SEQ ID NO: 887434 - DNA, 19 bp, Homo sapiens
tgaccaggcccaaggaggg

SEQ ID NO: 887435 - DNA, 18 bp, Homo sapiens
tgaccagggaagtgtgtg

SEQ ID NO: 887436 - DNA, 17 bp, Homo sapiens
tgaccagggatgctggg

SEQ ID NO: 887437 - DNA, 21 bp, Homo sapiens
tgaccagggatgctgggctgg

SEQ ID NO: 887438 - DNA, 23 bp, Homo sapiens
tgaccagggatgctgggctgggc

SEQ ID NO: 887439 - DNA, 16 bp, Homo sapiens
tgaccagtctgaccct

SEQ ID NO: 887440 - DNA, 19 bp, Homo sapiens
tgaccatccactctaccct

SEQ ID NO: 887441 - DNA, 15 bp, Homo sapiens
tgaccatgaaagact

SEQ ID NO: 887442 - DNA, 16 bp, Homo sapiens
tgaccatgaaagactt

SEQ ID NO: 887443 - DNA, 18 bp, Homo sapiens
tgaccatgcactatattt

SEQ ID NO: 887444 - DNA, 23 bp, Homo sapiens
tgaccatgcactatatttgtata

SEQ ID NO: 887445 - DNA, 18 bp, Homo sapiens
tgaccatgctcatctgct

SEQ ID NO: 887446 - DNA, 21 bp, Homo sapiens
tgaccatggttttggctctcc

SEQ ID NO: 887447 - DNA, 12 bp, Homo sapiens
tgaccatgtact

SEQ ID NO: 887448 - DNA, 18 bp, Homo sapiens
tgaccatgttcattataa

SEQ ID NO: 887449 - DNA, 13 bp, Homo sapiens
tgaccattattca

SEQ ID NO: 887450 - DNA, 19 bp, Homo sapiens
tgaccattgagtccctgct

SEQ ID NO: 887451 - DNA, 21 bp, Homo sapiens
tgaccattttgttaaaatcta

SEQ ID NO: 887452 - DNA, 19 bp, Homo sapiens
tgacccaaagcaaaacatc

SEQ ID NO: 887453 - DNA, 16 bp, Homo sapiens
tgacccaactgggggc

SEQ ID NO: 887454 - DNA, 11 bp, Homo sapiens
tgacccacagc

SEQ ID NO: 887455 - DNA, 14 bp, Homo sapiens
tgacccacagctct

SEQ ID NO: 887456 - DNA, 15 bp, Homo sapiens
tgacccacagctctg

SEQ ID NO: 887457 - DNA, 16 bp, Homo sapiens
tgacccacagctctgg

SEQ ID NO: 887458 - DNA, 19 bp, Homo sapiens
tgacccacagctctgggcc

SEQ ID NO: 887459 - DNA, 20 bp, Homo sapiens
tgacccacagctctgggcct

SEQ ID NO: 887460 - DNA, 23 bp, Homo sapiens
tgacccacagctctgggcctctt

SEQ ID NO: 887461 - DNA, 11 bp, Homo sapiens
tgacccacccc

SEQ ID NO: 887462 - DNA, 16 bp, Homo sapiens
tgacccacccctgtgc

SEQ ID NO: 887463 - DNA, 15 bp, Homo sapiens
tgacccacctgcgct

SEQ ID NO: 887464 - DNA, 21 bp, Homo sapiens
tgacccagacccaactcgcct

SEQ ID NO: 887465 - DNA, 16 bp, Homo sapiens
tgacccagagccacca

SEQ ID NO: 887466 - DNA, 14 bp, Homo sapiens
tgacccagcctgaa

SEQ ID NO: 887467 - DNA, 15 bp, Homo sapiens
tgacccagcctgaaa

SEQ ID NO: 887468 - DNA, 14 bp, Homo sapiens
tgacccagctactg

SEQ ID NO: 887469 - DNA, 14 bp, Homo sapiens
tgacccaggccgca

SEQ ID NO: 887470 - DNA, 15 bp, Homo sapiens
tgacccaggccgcag

SEQ ID NO: 887471 - DNA, 16 bp, Homo sapiens
tgacccaggccgcagc

SEQ ID NO: 887472 - DNA, 14 bp, Homo sapiens
tgacccagtccctg

SEQ ID NO: 887473 - DNA, 22 bp, Homo sapiens
tgaccccaggagggaggcaggg

SEQ ID NO: 887474 - DNA, 16 bp, Homo sapiens
tgaccccagggcctgt

SEQ ID NO: 887475 - DNA, 21 bp, Homo sapiens
tgaccccaggtcagccctgtg

SEQ ID NO: 887476 - DNA, 20 bp, Homo sapiens
tgaccccagtggaaaacaaa

SEQ ID NO: 887477 - DNA, 21 bp, Homo sapiens
tgaccccagtggaaaacaaag

SEQ ID NO: 887478 - DNA, 18 bp, Homo sapiens
tgacccccatctgagctg

SEQ ID NO: 887479 - DNA, 20 bp, Homo sapiens
tgacccccatctgagctggg

SEQ ID NO: 887480 - DNA, 17 bp, Homo sapiens
tgaccccgagaagtgct

SEQ ID NO: 887481 - DNA, 17 bp, Homo sapiens
tgacccctaccccctca

SEQ ID NO: 887482 - DNA, 20 bp, Homo sapiens
tgacccctgcctgttggcag

SEQ ID NO: 887483 - DNA, 18 bp, Homo sapiens
tgacccgtgaatgtgcct

SEQ ID NO: 887484 - DNA, 15 bp, Homo sapiens
tgaccctcagctgtc

SEQ ID NO: 887485 - DNA, 16 bp, Homo sapiens
tgaccctcccactccc

SEQ ID NO: 887486 - DNA, 17 bp, Homo sapiens
tgaccctcccactccca

SEQ ID NO: 887487 - DNA, 12 bp, Homo sapiens
tgaccctcccag

SEQ ID NO: 887488 - DNA, 13 bp, Homo sapiens
tgaccctcccagt

SEQ ID NO: 887489 - DNA, 13 bp, Homo sapiens
tgaccctccttct

SEQ ID NO: 887490 - DNA, 22 bp, Homo sapiens
tgaccctccttctattttccct

SEQ ID NO: 887491 - DNA, 22 bp, Homo sapiens
tgaccctctgaatggtccaggg

SEQ ID NO: 887492 - DNA, 13 bp, Homo sapiens
tgaccctctgtcc

SEQ ID NO: 887493 - DNA, 15 bp, Homo sapiens
tgaccctctgtcccc

SEQ ID NO: 887494 - DNA, 17 bp, Homo sapiens
tgaccctctgtccccag

SEQ ID NO: 887495 - DNA, 20 bp, Homo sapiens
tgaccctgcgaaggggccct

SEQ ID NO: 887496 - DNA, 21 bp, Homo sapiens
tgaccctgcgaaggggccctg

SEQ ID NO: 887497 - DNA, 13 bp, Homo sapiens
tgaccctgggcaa

SEQ ID NO: 887498 - DNA, 20 bp, Homo sapiens
tgaccctgtatatagcccag

SEQ ID NO: 887499 - DNA, 14 bp, Homo sapiens
tgacccttcagggc

SEQ ID NO: 887500 - DNA, 16 bp, Homo sapiens
tgacccttcagggcca

SEQ ID NO: 887501 - DNA, 18 bp, Homo sapiens
tgacccttctccaaaggc

SEQ ID NO: 887502 - DNA, 15 bp, Homo sapiens
tgacccttgaaccaa

SEQ ID NO: 887503 - DNA, 12 bp, Homo sapiens
tgaccctttcct

SEQ ID NO: 887504 - DNA, 20 bp, Homo sapiens
tgacccttttctgatcgtct

SEQ ID NO: 887505 - DNA, 20 bp, Homo sapiens
tgaccgactaccccagtccc

SEQ ID NO: 887506 - DNA, 13 bp, Homo sapiens
tgaccgcccagct

SEQ ID NO: 887507 - DNA, 18 bp, Homo sapiens
tgaccgcccagctctccc

SEQ ID NO: 887508 - DNA, 20 bp, Homo sapiens
tgaccgtactctcacatgtg

SEQ ID NO: 887509 - DNA, 13 bp, Homo sapiens
tgaccgtgtacaa

SEQ ID NO: 887510 - DNA, 17 bp, Homo sapiens
tgacctaagtcaggtaa

SEQ ID NO: 887511 - DNA, 21 bp, Homo sapiens
tgacctaagtcaggtaatata

SEQ ID NO: 887512 - DNA, 19 bp, Homo sapiens
tgacctacagtgctgtgta

SEQ ID NO: 887513 - DNA, 19 bp, Homo sapiens
tgacctaggcaagtttgtt

SEQ ID NO: 887514 - DNA, 21 bp, Homo sapiens
tgacctagttcagatacaggg

SEQ ID NO: 887515 - DNA, 20 bp, Homo sapiens
tgacctcaagtgatccaccc

SEQ ID NO: 887516 - DNA, 21 bp, Homo sapiens
tgacctcaagtgatctgtcca

SEQ ID NO: 887517 - DNA, 14 bp, Homo sapiens
tgacctcaatggag

SEQ ID NO: 887518 - DNA, 16 bp, Homo sapiens
tgacctcagctgcaca

SEQ ID NO: 887519 - DNA, 20 bp, Homo sapiens
tgacctcaggtgatccgccc

SEQ ID NO: 887520 - DNA, 20 bp, Homo sapiens
tgacctcaggtgatccgcct

SEQ ID NO: 887521 - DNA, 18 bp, Homo sapiens
tgacctcagtcaggcact

SEQ ID NO: 887522 - DNA, 13 bp, Homo sapiens
tgacctccatttc

SEQ ID NO: 887523 - DNA, 18 bp, Homo sapiens
tgacctcccctccccagc

SEQ ID NO: 887524 - DNA, 22 bp, Homo sapiens
tgacctcccctccccagcccaa

SEQ ID NO: 887525 - DNA, 18 bp, Homo sapiens
tgacctcgtgatccgccc

SEQ ID NO: 887526 - DNA, 21 bp, Homo sapiens
tgacctctgctgagtgctggg

SEQ ID NO: 887527 - DNA, 17 bp, Homo sapiens
tgacctctgttgtcctc

SEQ ID NO: 887528 - DNA, 18 bp, Homo sapiens
tgacctctgttgtcctcc

SEQ ID NO: 887529 - DNA, 16 bp, Homo sapiens
tgacctcttgctgtct

SEQ ID NO: 887530 - DNA, 19 bp, Homo sapiens
tgacctcttgctgtctctg

SEQ ID NO: 887531 - DNA, 23 bp, Homo sapiens
tgacctcttgctgtctctgctcg

SEQ ID NO: 887532 - DNA, 19 bp, Homo sapiens
tgacctgaaataatatatt

SEQ ID NO: 887533 - DNA, 15 bp, Homo sapiens
tgacctgaggctgtg

SEQ ID NO: 887534 - DNA, 17 bp, Homo sapiens
tgacctgaggctgtggt

SEQ ID NO: 887535 - DNA, 17 bp, Homo sapiens
tgacctgcattgtaaat

SEQ ID NO: 887536 - DNA, 20 bp, Homo sapiens
tgacctgccccgcccagctg

SEQ ID NO: 887537 - DNA, 12 bp, Homo sapiens
tgacctgctccg

SEQ ID NO: 887538 - DNA, 17 bp, Homo sapiens
tgacctgctccgccagg

SEQ ID NO: 887539 - DNA, 18 bp, Homo sapiens
tgacaacatcccacagtg

SEQ ID NO: 887540 - DNA, 16 bp, Homo sapiens
tgacaaccactggtct

SEQ ID NO: 887541 - DNA, 19 bp, Homo sapiens
tgacaaccatgagaccact

SEQ ID NO: 887542 - DNA, 13 bp, Homo sapiens
tgacaaccctggc

SEQ ID NO: 887543 - DNA, 17 bp, Homo sapiens
tgacaaccctggcctca

SEQ ID NO: 887544 - DNA, 17 bp, Homo sapiens
tgacaacctagaatgtc

SEQ ID NO: 887545 - DNA, 13 bp, Homo sapiens
tgacaacctccat

SEQ ID NO: 887546 - DNA, 21 bp, Homo sapiens
tgacaactgcacatgaaagtt

SEQ ID NO: 887547 - DNA, 14 bp, Homo sapiens
tgacaactgtgact

SEQ ID NO: 887548 - DNA, 16 bp, Homo sapiens
tgacaacttagctcag

SEQ ID NO: 887549 - DNA, 18 bp, Homo sapiens
tgacaacttagctcaggt

SEQ ID NO: 887550 - DNA, 20 bp, Homo sapiens
tgacaagaataattttggaa

SEQ ID NO: 887551 - DNA, 15 bp, Homo sapiens
tgacaagccccaggc

SEQ ID NO: 887552 - DNA, 22 bp, Homo sapiens
tgacaagctcctggtcttgaga

SEQ ID NO: 887553 - DNA, 17 bp, Homo sapiens
tgacaaggccccagaga

SEQ ID NO: 887554 - DNA, 18 bp, Homo sapiens
tgacaaggccccagagac

SEQ ID NO: 887555 - DNA, 15 bp, Homo sapiens
tgacaagttcctagg

SEQ ID NO: 887556 - DNA, 13 bp, Homo sapiens
tgacaataaaaca

SEQ ID NO: 887557 - DNA, 14 bp, Homo sapiens
tgacaataaaacat

SEQ ID NO: 887558 - DNA, 20 bp, Homo sapiens
tgacaatagggctaaatgtt

SEQ ID NO: 887559 - DNA, 21 bp, Homo sapiens
tgacaatagggctaaatgttt

SEQ ID NO: 887560 - DNA, 23 bp, Homo sapiens
tgacaatagttatgcctgtacta

SEQ ID NO: 887561 - DNA, 13 bp, Homo sapiens
tgacaatcaaaga

SEQ ID NO: 887562 - DNA, 15 bp, Homo sapiens
tgacaatcaactcta

SEQ ID NO: 887563 - DNA, 18 bp, Homo sapiens
tgacaatcaactctaata

SEQ ID NO: 887564 - DNA, 18 bp, Homo sapiens
tgacaatccgagcagtgg

SEQ ID NO: 887565 - DNA, 12 bp, Homo sapiens
tgacaatgaagg

SEQ ID NO: 887566 - DNA, 13 bp, Homo sapiens
tgacaatgatgat

SEQ ID NO: 887567 - DNA, 14 bp, Homo sapiens
tgacaattgggagc

SEQ ID NO: 887568 - DNA, 17 bp, Homo sapiens
tgacaatttctggcaga

SEQ ID NO: 887569 - DNA, 18 bp, Homo sapiens
tgacctgctccgccagga

SEQ ID NO: 887570 - DNA, 22 bp, Homo sapiens
tgacctggataacttaggtggc

SEQ ID NO: 887571 - DNA, 11 bp, Homo sapiens
tgacctgggcc

SEQ ID NO: 887572 - DNA, 12 bp, Homo sapiens
tgacctgggccc

SEQ ID NO: 887573 - DNA, 18 bp, Homo sapiens
tgacctgggcccacagag

SEQ ID NO: 887574 - DNA, 17 bp, Homo sapiens
tgacctgggtatcccct

SEQ ID NO: 887575 - DNA, 18 bp, Homo sapiens
tgacctgggtatcccctg

SEQ ID NO: 887576 - DNA, 21 bp, Homo sapiens
tgacctgggtatcccctgcct

SEQ ID NO: 887577 - DNA, 20 bp, Homo sapiens
tgacctgtcatgcccccctc

SEQ ID NO: 887578 - DNA, 13 bp, Homo sapiens
tgacctgtccagg

SEQ ID NO: 887579 - DNA, 11 bp, Homo sapiens
tgacctgtgca

SEQ ID NO: 887580 - DNA, 22 bp, Homo sapiens
tgacctgtggggatttctccca

SEQ ID NO: 887581 - DNA, 22 bp, Homo sapiens
tgacctgtgtttcacttaatgt

SEQ ID NO: 887582 - DNA, 19 bp, Homo sapiens
tgacctgttgccagcagat

SEQ ID NO: 887583 - DNA, 15 bp, Homo sapiens
tgacctgtttctctg

SEQ ID NO: 887584 - DNA, 13 bp, Homo sapiens
tgaccttcatttc

SEQ ID NO: 887585 - DNA, 15 bp, Homo sapiens
tgaccttccagagcc

SEQ ID NO: 887586 - DNA, 14 bp, Homo sapiens
tgaccttctgggaa

SEQ ID NO: 887587 - DNA, 13 bp, Homo sapiens
tgaccttggagga

SEQ ID NO: 887588 - DNA, 18 bp, Homo sapiens
tgaccttggctgactggg

SEQ ID NO: 887589 - DNA, 21 bp, Homo sapiens
tgaccttggctgactggggct

SEQ ID NO: 887590 - DNA, 16 bp, Homo sapiens
tgacctttaggtatta

SEQ ID NO: 887591 - DNA, 19 bp, Homo sapiens
tgacgaaactggccccgga

SEQ ID NO: 887592 - DNA, 15 bp, Homo sapiens
tgacgaagacgccaa

SEQ ID NO: 887593 - DNA, 20 bp, Homo sapiens
tgacgacaagtgctgaacag

SEQ ID NO: 887594 - DNA, 21 bp, Homo sapiens
tgacgacatacatgctacttt

SEQ ID NO: 887595 - DNA, 18 bp, Homo sapiens
tgacgatgggtgttgctg

SEQ ID NO: 887596 - DNA, 20 bp, Homo sapiens
tgacgatgggtgttgctgtt

SEQ ID NO: 887597 - DNA, 16 bp, Homo sapiens
tgacgcaccactgcca

SEQ ID NO: 887598 - DNA, 13 bp, Homo sapiens
tgacgcccagctc

SEQ ID NO: 887599 - DNA, 12 bp, Homo sapiens
tgacgccctgcg

SEQ ID NO: 887600 - DNA, 21 bp, Homo sapiens
tgacgccctgcgttggagcca

SEQ ID NO: 887601 - DNA, 13 bp, Homo sapiens
tgacgcctgagac

SEQ ID NO: 887602 - DNA, 17 bp, Homo sapiens
tgacgcctgagacagca

SEQ ID NO: 887603 - DNA, 19 bp, Homo sapiens
tgacgcctgccctccccag

SEQ ID NO: 887604 - DNA, 20 bp, Homo sapiens
tgacggccctcatctatgag

SEQ ID NO: 887605 - DNA, 19 bp, Homo sapiens
tgacggcgcccccagtgtg

SEQ ID NO: 887606 - DNA, 20 bp, Homo sapiens
tgacggcgcccccagtgtgc

SEQ ID NO: 887607 - DNA, 15 bp, Homo sapiens
tgacgggccgcagga

SEQ ID NO: 887608 - DNA, 21 bp, Homo sapiens
tgacggtcctttaggcagcct

SEQ ID NO: 887609 - DNA, 23 bp, Homo sapiens
tgacggtcctttaggcagcctgc

SEQ ID NO: 887610 - DNA, 18 bp, Homo sapiens
tgacgtagaaagatcctt

SEQ ID NO: 887611 - DNA, 21 bp, Homo sapiens
tgacgtattatctgttgcctt

SEQ ID NO: 887612 - DNA, 21 bp, Homo sapiens
tgacgtcaacccaagctctgg

SEQ ID NO: 887613 - DNA, 21 bp, Homo sapiens
tgacgtcagcgcaccaaaact

SEQ ID NO: 887614 - DNA, 22 bp, Homo sapiens
tgacgtgaccggacttttctgc

SEQ ID NO: 887615 - DNA, 17 bp, Homo sapiens
tgacgttgttgtcattg

SEQ ID NO: 887616 - DNA, 20 bp, Homo sapiens
tgacgttgttgtcattgtcc

SEQ ID NO: 887617 - DNA, 18 bp, Homo sapiens
tgacgtttcttctttcta

SEQ ID NO: 887618 - DNA, 15 bp, Homo sapiens
tgactaaaaaacaaa

SEQ ID NO: 887619 - DNA, 12 bp, Homo sapiens
tgactaaacttt

SEQ ID NO: 887620 - DNA, 16 bp, Homo sapiens
tgactaaagagagaat

SEQ ID NO: 887621 - DNA, 14 bp, Homo sapiens
tgactaaagctatg

SEQ ID NO: 887622 - DNA, 16 bp, Homo sapiens
tgactaaagctatgtt

SEQ ID NO: 887623 - DNA, 14 bp, Homo sapiens
tgactaaattttct

SEQ ID NO: 887624 - DNA, 18 bp, Homo sapiens
tgactaaattttctttta

SEQ ID NO: 887625 - DNA, 23 bp, Homo sapiens
tgactaaattttcttttaagcat

SEQ ID NO: 887626 - DNA, 17 bp, Homo sapiens
tgactaacaggccaaag

SEQ ID NO: 887627 - DNA, 17 bp, Homo sapiens
tgactaactatgcaata

SEQ ID NO: 887628 - DNA, 15 bp, Homo sapiens
tgactaagaaattct

SEQ ID NO: 887629 - DNA, 20 bp, Homo sapiens
tgactacagacattaaataa

SEQ ID NO: 887630 - DNA, 18 bp, Homo sapiens
tgactacagtcaggaaag

SEQ ID NO: 887631 - DNA, 13 bp, Homo sapiens
tgactacctcaga

SEQ ID NO: 887632 - DNA, 20 bp, Homo sapiens
tgactactaacaaatgtaaa

SEQ ID NO: 887633 - DNA, 21 bp, Homo sapiens
tgactactaacaaatgtaaaa

SEQ ID NO: 887634 - DNA, 18 bp, Homo sapiens
tgactactactctgccaa

SEQ ID NO: 887635 - DNA, 17 bp, Homo sapiens
tgactagaggcagggag

SEQ ID NO: 887636 - DNA, 18 bp, Homo sapiens
tgactagcgcctggcctt

SEQ ID NO: 887637 - DNA, 21 bp, Homo sapiens
tgactagggattcaggctgct

SEQ ID NO: 887638 - DNA, 15 bp, Homo sapiens
tgactagtttaaaga

SEQ ID NO: 887639 - DNA, 23 bp, Homo sapiens
tgactatataatttatttccact

SEQ ID NO: 887640 - DNA, 14 bp, Homo sapiens
tgactatatagaga

SEQ ID NO: 887641 - DNA, 22 bp, Homo sapiens
tgactatcacacactttctctt

SEQ ID NO: 887642 - DNA, 18 bp, Homo sapiens
tgactatgtccagattgg

SEQ ID NO: 887643 - DNA, 16 bp, Homo sapiens
tgactcaaatctccag

SEQ ID NO: 887644 - DNA, 23 bp, Homo sapiens
tgactcaacatgttactgaccag

SEQ ID NO: 887645 - DNA, 12 bp, Homo sapiens
tgactcaagaag

SEQ ID NO: 887646 - DNA, 14 bp, Homo sapiens
tgactcaagaagtg

SEQ ID NO: 887647 - DNA, 20 bp, Homo sapiens
tgactcacaagaagaccaga

SEQ ID NO: 887648 - DNA, 18 bp, Homo sapiens
tgactcacacttactgca

SEQ ID NO: 887649 - DNA, 21 bp, Homo sapiens
tgactcacaggccctggagaa

SEQ ID NO: 887650 - DNA, 22 bp, Homo sapiens
tgactcacaggccctggagaag

SEQ ID NO: 887651 - DNA, 11 bp, Homo sapiens
tgactcaccca

SEQ ID NO: 887652 - DNA, 13 bp, Homo sapiens
tgactcacccaag

SEQ ID NO: 887653 - DNA, 14 bp, Homo sapiens
tgactcacccaagc

SEQ ID NO: 887654 - DNA, 17 bp, Homo sapiens
tgactcacttcaatgtg

SEQ ID NO: 887655 - DNA, 19 bp, Homo sapiens
tgactcacttcaatgtgtc

SEQ ID NO: 887656 - DNA, 14 bp, Homo sapiens
tgactcagggctcc

SEQ ID NO: 887657 - DNA, 15 bp, Homo sapiens
tgactcagggctcct

SEQ ID NO: 887658 - DNA, 17 bp, Homo sapiens
tgactcagggctcctgg

SEQ ID NO: 887659 - DNA, 18 bp, Homo sapiens
tgactcagggctcctggg

SEQ ID NO: 887660 - DNA, 22 bp, Homo sapiens
tgactcagtgtctgcctttaaa

SEQ ID NO: 887661 - DNA, 16 bp, Homo sapiens
tgactcatggcagctg

SEQ ID NO: 887662 - DNA, 22 bp, Homo sapiens
tgactccaaccattcaaaaatt

SEQ ID NO: 887663 - DNA, 15 bp, Homo sapiens
tgactccagagtctg

SEQ ID NO: 887664 - DNA, 20 bp, Homo sapiens
tgactccctccccacccaag

SEQ ID NO: 887665 - DNA, 13 bp, Homo sapiens
tgactccctggga

SEQ ID NO: 887666 - DNA, 22 bp, Homo sapiens
tgactcccttaaaatagaaata

SEQ ID NO: 887667 - DNA, 14 bp, Homo sapiens
tgactcctctggct

SEQ ID NO: 887668 - DNA, 19 bp, Homo sapiens
tgactcctctggctttccc

SEQ ID NO: 887669 - DNA, 20 bp, Homo sapiens
tgactcctctggctttccca

SEQ ID NO: 887670 - DNA, 20 bp, Homo sapiens
tgactcctgaagggaaggca

SEQ ID NO: 887671 - DNA, 11 bp, Homo sapiens
tgactcctgga

SEQ ID NO: 887672 - DNA, 15 bp, Homo sapiens
tgactcctggactcc

SEQ ID NO: 887673 - DNA, 18 bp, Homo sapiens
tgactcctggactccgga

SEQ ID NO: 887674 - DNA, 20 bp, Homo sapiens
tgactcctggactccggagg

SEQ ID NO: 887675 - DNA, 15 bp, Homo sapiens
tgactcgaaactgac

SEQ ID NO: 887676 - DNA, 22 bp, Homo sapiens
tgactcgacaaaggccacaggc

SEQ ID NO: 887677 - DNA, 18 bp, Homo sapiens
tgactcgagtcacactca

SEQ ID NO: 887678 - DNA, 18 bp, Homo sapiens
tgactcggtttctccaaa

SEQ ID NO: 887679 - DNA, 15 bp, Homo sapiens
tgactcgtgctgcat

SEQ ID NO: 887680 - DNA, 16 bp, Homo sapiens
tgactctcacactgaa

SEQ ID NO: 887681 - DNA, 14 bp, Homo sapiens
tgactctcactagg

SEQ ID NO: 887682 - DNA, 14 bp, Homo sapiens
tgactctcctgcct

SEQ ID NO: 887683 - DNA, 21 bp, Homo sapiens
tgactctgagaaaatgcgaga

SEQ ID NO: 887684 - DNA, 22 bp, Homo sapiens
tgactctggcaaagcttttaga

SEQ ID NO: 887685 - DNA, 14 bp, Homo sapiens
tgactctgggcagg

SEQ ID NO: 887686 - DNA, 21 bp, Homo sapiens
tgactctgggttcgttgggga

SEQ ID NO: 887687 - DNA, 11 bp, Homo sapiens
tgactcttgga

SEQ ID NO: 887688 - DNA, 18 bp, Homo sapiens
tgactcttggagcctctt

SEQ ID NO: 887689 - DNA, 23 bp, Homo sapiens
tgactcttggagcctctttttcc

SEQ ID NO: 887690 - DNA, 20 bp, Homo sapiens
tgactctttattgtctgtaa

SEQ ID NO: 887691 - DNA, 21 bp, Homo sapiens
tgactctttattgtctgtaaa

SEQ ID NO: 887692 - DNA, 18 bp, Homo sapiens
tgactctttcctaaagcc

SEQ ID NO: 887693 - DNA, 16 bp, Homo sapiens
tgagaaagcttttatt

SEQ ID NO: 887694 - DNA, 16 bp, Homo sapiens
tgagaaagggagagga

SEQ ID NO: 887695 - DNA, 21 bp, Homo sapiens
tgagaaatatggacacttaat

SEQ ID NO: 887696 - DNA, 14 bp, Homo sapiens
tgagaaatgaaata

SEQ ID NO: 887697 - DNA, 15 bp, Homo sapiens
tgagaaatgaataat

SEQ ID NO: 887698 - DNA, 20 bp, Homo sapiens
tgagaaatgaataatttccc

SEQ ID NO: 887699 - DNA, 18 bp, Homo sapiens
tgagaacaagtcacagct

SEQ ID NO: 887700 - DNA, 19 bp, Homo sapiens
tgagaacaagtcacagctg

SEQ ID NO: 887701 - DNA, 19 bp, Homo sapiens
tgagaacacgttgccaggg

SEQ ID NO: 887702 - DNA, 17 bp, Homo sapiens
tgagaaccagtctcctc

SEQ ID NO: 887703 - DNA, 18 bp, Homo sapiens
tgagaaccagtctcctca

SEQ ID NO: 887704 - DNA, 16 bp, Homo sapiens
tgagaactctctccct

SEQ ID NO: 887705 - DNA, 20 bp, Homo sapiens
tgagaactctctccctggtc

SEQ ID NO: 887706 - DNA, 17 bp, Homo sapiens
tgagaactgcatatgtt

SEQ ID NO: 887707 - DNA, 17 bp, Homo sapiens
tgagaactgcttctaag

SEQ ID NO: 887708 - DNA, 14 bp, Homo sapiens
tgagaacttccaac

SEQ ID NO: 887709 - DNA, 15 bp, Homo sapiens
tgagaacttccaaca

SEQ ID NO: 887710 - DNA, 17 bp, Homo sapiens
tgagaagagggcctgtg

SEQ ID NO: 887711 - DNA, 20 bp, Homo sapiens
tgagaagataatcattgctt

SEQ ID NO: 887712 - DNA, 16 bp, Homo sapiens
tgagaagattgtgaat

SEQ ID NO: 887713 - DNA, 13 bp, Homo sapiens
tgagaagccttca

SEQ ID NO: 887714 - DNA, 20 bp, Homo sapiens
tgagaagccttcagctccag

SEQ ID NO: 887715 - DNA, 20 bp, Homo sapiens
tgagaagcggtcatgagcac

SEQ ID NO: 887716 - DNA, 17 bp, Homo sapiens
tgagaagcgtttttaac

SEQ ID NO: 887717 - DNA, 16 bp, Homo sapiens
tgagaagctgaggcct

SEQ ID NO: 887718 - DNA, 13 bp, Homo sapiens
tgagaagctgctc

SEQ ID NO: 887719 - DNA, 20 bp, Homo sapiens
tgagaagctgctccaggcct

SEQ ID NO: 887720 - DNA, 12 bp, Homo sapiens
tgagaaggaaat

SEQ ID NO: 887721 - DNA, 22 bp, Homo sapiens
tgagaaggagtcagaaactgtt

SEQ ID NO: 887722 - DNA, 15 bp, Homo sapiens
tgagaaggcaggcct

SEQ ID NO: 887723 - DNA, 21 bp, Homo sapiens
tgagaaggcagtagttttcaa

SEQ ID NO: 887724 - DNA, 16 bp, Homo sapiens
tgagaaggtccttaat

SEQ ID NO: 887725 - DNA, 11 bp, Homo sapiens
tgagaaggtta

SEQ ID NO: 887726 - DNA, 11 bp, Homo sapiens
tgagaagtact

SEQ ID NO: 887727 - DNA, 18 bp, Homo sapiens
tgagaagtgaatgctggg

SEQ ID NO: 887728 - DNA, 13 bp, Homo sapiens
tgagaagtgtctt

SEQ ID NO: 887729 - DNA, 19 bp, Homo sapiens
tgagaatataccttattta

SEQ ID NO: 887730 - DNA, 22 bp, Homo sapiens
tgagaatcacggtggtaaagaa

SEQ ID NO: 887731 - DNA, 17 bp, Homo sapiens
tgagaatcagatcattt

SEQ ID NO: 887732 - DNA, 14 bp, Homo sapiens
tgagaatcatttag

SEQ ID NO: 887733 - DNA, 19 bp, Homo sapiens
tgagaatcatttagcatgt

SEQ ID NO: 887734 - DNA, 21 bp, Homo sapiens
tgagaatcctctcctttctta

SEQ ID NO: 887735 - DNA, 17 bp, Homo sapiens
tgagaatcctgcctctc

SEQ ID NO: 887736 - DNA, 21 bp, Homo sapiens
tgagaatctacccccagatcc

SEQ ID NO: 887737 - DNA, 18 bp, Homo sapiens
tgagaatctatatttaac

SEQ ID NO: 887738 - DNA, 14 bp, Homo sapiens
tgagaatctggggg

SEQ ID NO: 887739 - DNA, 21 bp, Homo sapiens
tgagaatctgggggtgaggag

SEQ ID NO: 887740 - DNA, 19 bp, Homo sapiens
tgagaatctttattgagaa

SEQ ID NO: 887741 - DNA, 15 bp, Homo sapiens
tgagaatgagtggga

SEQ ID NO: 887742 - DNA, 18 bp, Homo sapiens
tgagaatgagtgggaatc

SEQ ID NO: 887743 - DNA, 15 bp, Homo sapiens
tgagaattccaagga

SEQ ID NO: 887744 - DNA, 16 bp, Homo sapiens
tgagaattccaaggag

SEQ ID NO: 887745 - DNA, 13 bp, Homo sapiens
tgagaattttaaa

SEQ ID NO: 887746 - DNA, 23 bp, Homo sapiens
tgagaattttaaattataactta

SEQ ID NO: 887747 - DNA, 12 bp, Homo sapiens
tgagacaagccc

SEQ ID NO: 887748 - DNA, 19 bp, Homo sapiens
tgagacaatgttttcttca

SEQ ID NO: 887749 - DNA, 20 bp, Homo sapiens
tgagacaatgttttcttcaa

SEQ ID NO: 887750 - DNA, 14 bp, Homo sapiens
tgagacagaatctc

SEQ ID NO: 887751 - DNA, 22 bp, Homo sapiens
tgagacagcaccactgctgagg

SEQ ID NO: 887752 - DNA, 22 bp, Homo sapiens
tgagacaggaaaaaccaacagg

SEQ ID NO: 887753 - DNA, 19 bp, Homo sapiens
tgagacagggtcttgctct

SEQ ID NO: 887754 - DNA, 22 bp, Homo sapiens
tgagacagggtcttgctctgtc

SEQ ID NO: 887755 - DNA, 14 bp, Homo sapiens
tgagacagtctgga

SEQ ID NO: 887756 - DNA, 13 bp, Homo sapiens
tgagacagtggga

SEQ ID NO: 887757 - DNA, 15 bp, Homo sapiens
tgagacagtgggaaa

SEQ ID NO: 887758 - DNA, 22 bp, Homo sapiens
tgagaccagtggtctggaaaca

SEQ ID NO: 887759 - DNA, 23 bp, Homo sapiens
tgagaccagttgggagcactgga

SEQ ID NO: 887760 - DNA, 15 bp, Homo sapiens
tgagacccccacacc

SEQ ID NO: 887761 - DNA, 22 bp, Homo sapiens
tgagacccccacacctcagttc

SEQ ID NO: 887762 - DNA, 15 bp, Homo sapiens
tgagaccctgggaga

SEQ ID NO: 887763 - DNA, 16 bp, Homo sapiens
tgagacccttttctca

SEQ ID NO: 887764 - DNA, 20 bp, Homo sapiens
tgagacctaatctctgtaaa

SEQ ID NO: 887765 - DNA, 19 bp, Homo sapiens
tgagacctacaggctgacg

SEQ ID NO: 887766 - DNA, 13 bp, Homo sapiens
tgagacctcagcc

SEQ ID NO: 887767 - DNA, 15 bp, Homo sapiens
tgagacctggaacca

SEQ ID NO: 887768 - DNA, 20 bp, Homo sapiens
tgagactataaagcagtaga

SEQ ID NO: 887769 - DNA, 22 bp, Homo sapiens
tgagactataaagcagtagaca

SEQ ID NO: 887770 - DNA, 21 bp, Homo sapiens
tgagactcacactctctgcag

SEQ ID NO: 887771 - DNA, 16 bp, Homo sapiens
tgagactccacctcaa

SEQ ID NO: 887772 - DNA, 16 bp, Homo sapiens
tgagactgatccctgg

SEQ ID NO: 887773 - DNA, 19 bp, Homo sapiens
tgagactgcaggtgggctg

SEQ ID NO: 887774 - DNA, 22 bp, Homo sapiens
tgagactggggccactacattt

SEQ ID NO: 887775 - DNA, 16 bp, Homo sapiens
tgagactgtaaaacaa

SEQ ID NO: 887776 - DNA, 12 bp, Homo sapiens
tgagacttccaa

SEQ ID NO: 887777 - DNA, 22 bp, Homo sapiens
tgagacttgttcttggttcctg

SEQ ID NO: 887778 - DNA, 13 bp, Homo sapiens
tgagactttaaaa

SEQ ID NO: 887779 - DNA, 14 bp, Homo sapiens
tgagactttaaaag

SEQ ID NO: 887780 - DNA, 15 bp, Homo sapiens
tgagactttctgctg

SEQ ID NO: 887781 - DNA, 16 bp, Homo sapiens
tgagagaagccacgct

SEQ ID NO: 887782 - DNA, 22 bp, Homo sapiens
tgagagaagccacgctgtcctc

SEQ ID NO: 887783 - DNA, 19 bp, Homo sapiens
tgagagaatggaaaacaga

SEQ ID NO: 887784 - DNA, 16 bp, Homo sapiens
tgagagaatggagaca

SEQ ID NO: 887785 - DNA, 18 bp, Homo sapiens
tgagagaattgtatcatt

SEQ ID NO: 887786 - DNA, 19 bp, Homo sapiens
tgagagacattaactcatt

SEQ ID NO: 887787 - DNA, 20 bp, Homo sapiens
tgagagacccaaggaggaaa

SEQ ID NO: 887788 - DNA, 21 bp, Homo sapiens
tgagagacccaaggaggaaaa

SEQ ID NO: 887789 - DNA, 17 bp, Homo sapiens
tgagagacctctgccta

SEQ ID NO: 887790 - DNA, 22 bp, Homo sapiens
tgagagacgccactccctggga

SEQ ID NO: 887791 - DNA, 18 bp, Homo sapiens
tgagagacgccctatttc

SEQ ID NO: 887792 - DNA, 19 bp, Homo sapiens
tgagagacgccctatttct

SEQ ID NO: 887793 - DNA, 12 bp, Homo sapiens
tgagagactttt

SEQ ID NO: 887794 - DNA, 19 bp, Homo sapiens
tgagagagaatagagctgc

SEQ ID NO: 887795 - DNA, 15 bp, Homo sapiens
tgagagaggaggcct

SEQ ID NO: 887796 - DNA, 17 bp, Homo sapiens
tgagagaggaggcctgg

SEQ ID NO: 887797 - DNA, 23 bp, Homo sapiens
tgagagatgctgtagacatctgt

SEQ ID NO: 887798 - DNA, 13 bp, Homo sapiens
tgagagccagcag

SEQ ID NO: 887799 - DNA, 14 bp, Homo sapiens
tgagagccagtggc

SEQ ID NO: 887800 - DNA, 15 bp, Homo sapiens
tgagagccccagctg

SEQ ID NO: 887801 - DNA, 22 bp, Homo sapiens
tgagagccccagctgacatgga

SEQ ID NO: 887802 - DNA, 14 bp, Homo sapiens
tgagagcctttgcc

SEQ ID NO: 887803 - DNA, 16 bp, Homo sapiens
tgagagcgacacagac

SEQ ID NO: 887804 - DNA, 18 bp, Homo sapiens
tgagagcgacacagacgt

SEQ ID NO: 887805 - DNA, 23 bp, Homo sapiens
tgagaggagaaatgcaataactc

SEQ ID NO: 887806 - DNA, 23 bp, Homo sapiens
tgagaggatgaatgtatgtgcac

SEQ ID NO: 887807 - DNA, 20 bp, Homo sapiens
tgagaggcaatgattgttaa

SEQ ID NO: 887808 - DNA, 14 bp, Homo sapiens
tgagaggcagaagt

SEQ ID NO: 887809 - DNA, 12 bp, Homo sapiens
tgagaggcagct

SEQ ID NO: 887810 - DNA, 19 bp, Homo sapiens
tgagaggcagctatctgca

SEQ ID NO: 887811 - DNA, 12 bp, Homo sapiens
tgagaggcaggc

SEQ ID NO: 887812 - DNA, 22 bp, Homo sapiens
tgagaggcgagtcaccctcctc

SEQ ID NO: 887813 - DNA, 19 bp, Homo sapiens
tgagaggctgggaatggag

SEQ ID NO: 887814 - DNA, 11 bp, Homo sapiens
tgagagggcaa

SEQ ID NO: 887815 - DNA, 17 bp, Homo sapiens
tgagagggcatgcgcac

SEQ ID NO: 887816 - DNA, 23 bp, Homo sapiens
tgagccaagaaacactgcctgcc

SEQ ID NO: 887817 - DNA, 21 bp, Homo sapiens
tgagccaagggagggaagggc

SEQ ID NO: 887818 - DNA, 17 bp, Homo sapiens
tgagccaccgtgcctgg

SEQ ID NO: 887819 - DNA, 12 bp, Homo sapiens
tgagccactgcg

SEQ ID NO: 887820 - DNA, 20 bp, Homo sapiens
tgagccactgtgcttggcca

SEQ ID NO: 887821 - DNA, 14 bp, Homo sapiens
tgagccagacaaat

SEQ ID NO: 887822 - DNA, 16 bp, Homo sapiens
tgagccagcttagcaa

SEQ ID NO: 887823 - DNA, 14 bp, Homo sapiens
tgagccaggcctgg

SEQ ID NO: 887824 - DNA, 18 bp, Homo sapiens
tgagccagtaatctttat

SEQ ID NO: 887825 - DNA, 16 bp, Homo sapiens
tgagccagtcccaggg

SEQ ID NO: 887826 - DNA, 22 bp, Homo sapiens
tgagccataggtctaaatagga

SEQ ID NO: 887827 - DNA, 15 bp, Homo sapiens
tgaggcctcttggac

SEQ ID NO: 887828 - DNA, 20 bp, Homo sapiens
tgaggcctgccccctgggct

SEQ ID NO: 887829 - DNA, 21 bp, Homo sapiens
tgaggcctgccccctgggctg

SEQ ID NO: 887830 - DNA, 21 bp, Homo sapiens
tgaggcctgccctcagggatc

SEQ ID NO: 887831 - DNA, 11 bp, Homo sapiens
tgaggcctgga

SEQ ID NO: 887832 - DNA, 17 bp, Homo sapiens
tgaggcctggactttcc

SEQ ID NO: 887833 - DNA, 15 bp, Homo sapiens
tgaggcctggccagg

SEQ ID NO: 887834 - DNA, 12 bp, Homo sapiens
tgaggcctgtgc

SEQ ID NO: 887835 - DNA, 21 bp, Homo sapiens
tgaggccttctcttgaggcct

SEQ ID NO: 887836 - DNA, 14 bp, Homo sapiens
tgaggcggaggctg

SEQ ID NO: 887837 - DNA, 23 bp, Homo sapiens
tgaggcgggtggatcacctgagg

SEQ ID NO: 887838 - DNA, 20 bp, Homo sapiens
tgaggctatggagggtcctc

SEQ ID NO: 887839 - DNA, 13 bp, Homo sapiens
tgaggctgcagcg

SEQ ID NO: 887840 - DNA, 14 bp, Homo sapiens
tgaggctggcacag

SEQ ID NO: 887841 - DNA, 12 bp, Homo sapiens
tgaggctgggaa

SEQ ID NO: 887842 - DNA, 13 bp, Homo sapiens
tgaggctgtcctg

SEQ ID NO: 887843 - DNA, 18 bp, Homo sapiens
tgaggctgtcctgtacat

SEQ ID NO: 887844 - DNA, 16 bp, Homo sapiens
tgaggcttccagagag

SEQ ID NO: 887845 - DNA, 14 bp, Homo sapiens
tgaggcttccaggc

SEQ ID NO: 887846 - DNA, 18 bp, Homo sapiens
tgaggcttccaggctctt

SEQ ID NO: 887847 - DNA, 22 bp, Homo sapiens
tgaggcttccaggctcttcctg

SEQ ID NO: 887848 - DNA, 19 bp, Homo sapiens
tgaggcttctccttctcct

SEQ ID NO: 887849 - DNA, 16 bp, Homo sapiens
tgaggctttaaaaaga

SEQ ID NO: 887850 - DNA, 21 bp, Homo sapiens
tgagggaaatctgtaaagcca

SEQ ID NO: 887851 - DNA, 20 bp, Homo sapiens
tgagggaacagacaggagaa

SEQ ID NO: 887852 - DNA, 15 bp, Homo sapiens
tgagggaagcgaagg

SEQ ID NO: 887853 - DNA, 21 bp, Homo sapiens
tgagggaaggagcccagccag

SEQ ID NO: 887854 - DNA, 14 bp, Homo sapiens
tgagggacagagcc

SEQ ID NO: 887855 - DNA, 17 bp, Homo sapiens
tgagggacagagcccca

SEQ ID NO: 887856 - DNA, 13 bp, Homo sapiens
tgagggacatgct

SEQ ID NO: 887857 - DNA, 22 bp, Homo sapiens
tgagggaccaaaaaaggacgta

SEQ ID NO: 887858 - DNA, 15 bp, Homo sapiens
tgagggaggacctgg

SEQ ID NO: 887859 - DNA, 19 bp, Homo sapiens
tgagggaggacctggggca

SEQ ID NO: 887860 - DNA, 23 bp, Homo sapiens
tgagggaggaggccacctctcca

SEQ ID NO: 887861 - DNA, 20 bp, Homo sapiens
tgagggagggagccatggaa

SEQ ID NO: 887862 - DNA, 16 bp, Homo sapiens
tgagggagggctgggc

SEQ ID NO: 887863 - DNA, 22 bp, Homo sapiens
tgagggagggggcgctcaggac

SEQ ID NO: 887864 - DNA, 22 bp, Homo sapiens
tgagggagtgcagaacacctgg

SEQ ID NO: 887865 - DNA, 22 bp, Homo sapiens
tgagggatctgagtaggtctgg

SEQ ID NO: 887866 - DNA, 20 bp, Homo sapiens
tgagggattttagcctcttc

SEQ ID NO: 887867 - DNA, 18 bp, Homo sapiens
tgagggcatgtgcggctg

SEQ ID NO: 887868 - DNA, 23 bp, Homo sapiens
tgagggcatgtgcggctgaactg

SEQ ID NO: 887869 - DNA, 14 bp, Homo sapiens
tgagggccagtgat

SEQ ID NO: 887870 - DNA, 12 bp, Homo sapiens
tgagggcccaga

SEQ ID NO: 887871 - DNA, 13 bp, Homo sapiens
tgagggcccagag

SEQ ID NO: 887872 - DNA, 20 bp, Homo sapiens
tgagggcccagagcaggaag

SEQ ID NO: 887873 - DNA, 21 bp, Homo sapiens
tgagggcccagagcaggaagc

SEQ ID NO: 887874 - DNA, 17 bp, Homo sapiens
tgagggcccagccagga

SEQ ID NO: 887875 - DNA, 19 bp, Homo sapiens
tgagggcccagccaggagc

SEQ ID NO: 887876 - DNA, 22 bp, Homo sapiens
tgagggcccagccaggagcaga

SEQ ID NO: 887877 - DNA, 14 bp, Homo sapiens
tgagggcccctctg

SEQ ID NO: 887878 - DNA, 16 bp, Homo sapiens
tgagggcccctctgcc

SEQ ID NO: 887879 - DNA, 21 bp, Homo sapiens
tgagggcccctctgcccagct

SEQ ID NO: 887880 - DNA, 13 bp, Homo sapiens
tgagggcctcaga

SEQ ID NO: 887881 - DNA, 15 bp, Homo sapiens
tgagggcctcagagc

SEQ ID NO: 887882 - DNA, 22 bp, Homo sapiens
tgagggcctcagagcctgacct

SEQ ID NO: 887883 - DNA, 15 bp, Homo sapiens
tgagggcctgctgga

SEQ ID NO: 887884 - DNA, 20 bp, Homo sapiens
tgagggcctgctggaggcct

SEQ ID NO: 887885 - DNA, 20 bp, Homo sapiens
tgagggctaattctgggaag

SEQ ID NO: 887886 - DNA, 17 bp, Homo sapiens
tgagggctctgtttgtg

SEQ ID NO: 887887 - DNA, 13 bp, Homo sapiens
tgaggggaggagg

SEQ ID NO: 887888 - DNA, 14 bp, Homo sapiens
tgaggggaggaggc

SEQ ID NO: 887889 - DNA, 21 bp, Homo sapiens
tgaggggaggatcactggagc

SEQ ID NO: 887890 - DNA, 17 bp, Homo sapiens
tgaggggaggggcctcc

SEQ ID NO: 887891 - DNA, 16 bp, Homo sapiens
tgaggggattctctac

SEQ ID NO: 887892 - DNA, 13 bp, Homo sapiens
tgaggggcaggac

SEQ ID NO: 887893 - DNA, 17 bp, Homo sapiens
tgaggggcatctgcccc

SEQ ID NO: 887894 - DNA, 22 bp, Homo sapiens
tgaggggccaccccgtgcccct

SEQ ID NO: 887895 - DNA, 17 bp, Homo sapiens
tgaggggccccagcgtc

SEQ ID NO: 887896 - DNA, 18 bp, Homo sapiens
tgaggggcctgcgcccag

SEQ ID NO: 887897 - DNA, 22 bp, Homo sapiens
tgaggggctccgggtcactgct

SEQ ID NO: 887898 - DNA, 14 bp, Homo sapiens
tgaggggctggcct

SEQ ID NO: 887899 - DNA, 16 bp, Homo sapiens
tgaggggctggggagg

SEQ ID NO: 887900 - DNA, 19 bp, Homo sapiens
tgaggggctggggaggggg

SEQ ID NO: 887901 - DNA, 13 bp, Homo sapiens
tgaggggctttct

SEQ ID NO: 887902 - DNA, 11 bp, Homo sapiens
tgaggggtctc

SEQ ID NO: 887903 - DNA, 16 bp, Homo sapiens
tgaggggtctcggatg

SEQ ID NO: 887904 - DNA, 20 bp, Homo sapiens
tgaggggtgtccgagaggct

SEQ ID NO: 887905 - DNA, 22 bp, Homo sapiens
tgaggggtgtccgagaggctgg

SEQ ID NO: 887906 - DNA, 17 bp, Homo sapiens
tgaggggttacctccct

SEQ ID NO: 887907 - DNA, 19 bp, Homo sapiens
tgaggggttacctccctcg

SEQ ID NO: 887908 - DNA, 22 bp, Homo sapiens
tgagggtcattctttattcttt

SEQ ID NO: 887909 - DNA, 15 bp, Homo sapiens
tgagggtcctgcagc

SEQ ID NO: 887910 - DNA, 21 bp, Homo sapiens
tgagggtcctgcagcctgcag

SEQ ID NO: 887911 - DNA, 19 bp, Homo sapiens
tgagggtcttcttacatgc

SEQ ID NO: 887912 - DNA, 12 bp, Homo sapiens
tgagggtgactg

SEQ ID NO: 887913 - DNA, 20 bp, Homo sapiens
tgagggtgcccttttccagc

SEQ ID NO: 887914 - DNA, 20 bp, Homo sapiens
tgagggtggtttatgattaa

SEQ ID NO: 887915 - DNA, 14 bp, Homo sapiens
tgagggtttctgat

SEQ ID NO: 887916 - DNA, 21 bp, Homo sapiens
tgagggtttctgatctgtact

SEQ ID NO: 887917 - DNA, 15 bp, Homo sapiens
tgagggttttctcat

SEQ ID NO: 887918 - DNA, 15 bp, Homo sapiens
tgaggtaagtggaat

SEQ ID NO: 887919 - DNA, 15 bp, Homo sapiens
tgaggtaagtttttt

SEQ ID NO: 887920 - DNA, 22 bp, Homo sapiens
tgaggtaccagttgtatttaat

SEQ ID NO: 887921 - DNA, 16 bp, Homo sapiens
tgaggtcaataaagca

SEQ ID NO: 887922 - DNA, 17 bp, Homo sapiens
tgaggtcaataaagcag

SEQ ID NO: 887923 - DNA, 22 bp, Homo sapiens
tgaggtcaataaagcagagcca

SEQ ID NO: 887924 - DNA, 12 bp, Homo sapiens
tgaggtcaggga

SEQ ID NO: 887925 - DNA, 16 bp, Homo sapiens
tgaggtcagggagtgc

SEQ ID NO: 887926 - DNA, 12 bp, Homo sapiens
tgaggtccacag

SEQ ID NO: 887927 - DNA, 17 bp, Homo sapiens
tgaggtccaccggcccc

SEQ ID NO: 887928 - DNA, 21 bp, Homo sapiens
tgaggtccaccggcccctggc

SEQ ID NO: 887929 - DNA, 17 bp, Homo sapiens
tgaggtcccaggcagag

SEQ ID NO: 887930 - DNA, 19 bp, Homo sapiens
tgaggtcccaggcagagaa

SEQ ID NO: 887931 - DNA, 15 bp, Homo sapiens
tgaggtcctcaggtc

SEQ ID NO: 887932 - DNA, 17 bp, Homo sapiens
tgaggtcctcaggtcag

SEQ ID NO: 887933 - DNA, 23 bp, Homo sapiens
tgaggtctgctcggccgtcttca

SEQ ID NO: 887934 - DNA, 14 bp, Homo sapiens
tgaggtctgtttaa

SEQ ID NO: 887935 - DNA, 13 bp, Homo sapiens
tgaggtctttaaa

SEQ ID NO: 887936 - DNA, 15 bp, Homo sapiens
tgaggtgaaagggag

SEQ ID NO: 887937 - DNA, 18 bp, Homo sapiens
tgaggtgaaatgggagat

SEQ ID NO: 887938 - DNA, 16 bp, Homo sapiens
tgaggtgaatttcatt

SEQ ID NO: 887939 - DNA, 22 bp, Homo sapiens
tgaggtgagttgggggtatcta

SEQ ID NO: 887940 - DNA, 23 bp, Homo sapiens
tgaggtgatatttttatgtgcag

SEQ ID NO: 887941 - DNA, 20 bp, Homo sapiens
tgaggtgcaaggagtgtaaa

SEQ ID NO: 887942 - DNA, 23 bp, Homo sapiens
tgagtaagagctggtgtctgatt

SEQ ID NO: 887943 - DNA, 17 bp, Homo sapiens
tgagtaatcaatacaga

SEQ ID NO: 887944 - DNA, 21 bp, Homo sapiens
tgagtaatcaatacagacaag

SEQ ID NO: 887945 - DNA, 17 bp, Homo sapiens
tgagtaatggtgtagaa

SEQ ID NO: 887946 - DNA, 18 bp, Homo sapiens
tgagtaatggtgtagaac

SEQ ID NO: 887947 - DNA, 17 bp, Homo sapiens
tgagtaattttggattt

SEQ ID NO: 887948 - DNA, 19 bp, Homo sapiens
tgagtacagtgaggagggt

SEQ ID NO: 887949 - DNA, 21 bp, Homo sapiens
tgagtacgtgctttgagaaaa

SEQ ID NO: 887950 - DNA, 23 bp, Homo sapiens
tgagtacgtgctttgagaaaaca

SEQ ID NO: 887951 - DNA, 19 bp, Homo sapiens
tgagtacgttgtgcatttg

SEQ ID NO: 887952 - DNA, 20 bp, Homo sapiens
tgagtacgttgtgcatttgg

SEQ ID NO: 887953 - DNA, 13 bp, Homo sapiens
tgagtagctggat

SEQ ID NO: 887954 - DNA, 13 bp, Homo sapiens
tgagtagctgggc

SEQ ID NO: 887955 - DNA, 15 bp, Homo sapiens
tgagtagctgggcct

SEQ ID NO: 887956 - DNA, 16 bp, Homo sapiens
tgagtagctgggcctg

SEQ ID NO: 887957 - DNA, 13 bp, Homo sapiens
tgagtaggctggg

SEQ ID NO: 887958 - DNA, 19 bp, Homo sapiens
tgagtataaaaacttgaaa

SEQ ID NO: 887959 - DNA, 14 bp, Homo sapiens
tgagtatctgtggg

SEQ ID NO: 887960 - DNA, 15 bp, Homo sapiens
tgagtatctgtggga

SEQ ID NO: 887961 - DNA, 20 bp, Homo sapiens
tgagtattccatgagctgct

SEQ ID NO: 887962 - DNA, 22 bp, Homo sapiens
tgagtattggaagacttgggtt

SEQ ID NO: 887963 - DNA, 19 bp, Homo sapiens
tgagtatttatttaaataa

SEQ ID NO: 887964 - DNA, 16 bp, Homo sapiens
tgagtatttttaaaaa

SEQ ID NO: 887965 - DNA, 15 bp, Homo sapiens
tgagtcaactggagc

SEQ ID NO: 887966 - DNA, 16 bp, Homo sapiens
tgagtcaactggagca

SEQ ID NO: 887967 - DNA, 18 bp, Homo sapiens
tgagtcaagttgttcctt

SEQ ID NO: 887968 - DNA, 16 bp, Homo sapiens
tgagtcaatcagcctt

SEQ ID NO: 887969 - DNA, 17 bp, Homo sapiens
tgagtcaatcagccttt

SEQ ID NO: 887970 - DNA, 13 bp, Homo sapiens
tgagtcaatgtgc

SEQ ID NO: 887971 - DNA, 17 bp, Homo sapiens
tgagtcacctgctccag

SEQ ID NO: 887972 - DNA, 19 bp, Homo sapiens
tgagtcacctgctccagaa

SEQ ID NO: 887973 - DNA, 22 bp, Homo sapiens
tgagtcagaatgtgaaaaagga

SEQ ID NO: 887974 - DNA, 20 bp, Homo sapiens
tgagtcagcaccttggccca

SEQ ID NO: 887975 - DNA, 22 bp, Homo sapiens
tgagtcaggcaattgattgtga

SEQ ID NO: 887976 - DNA, 14 bp, Homo sapiens
tgagtcagtgaagt

SEQ ID NO: 887977 - DNA, 20 bp, Homo sapiens
tgagtcatgatctccctgcc

SEQ ID NO: 887978 - DNA, 22 bp, Homo sapiens
tgagtcatgatctccctgccgc

SEQ ID NO: 887979 - DNA, 18 bp, Homo sapiens
tgagtcatttgtttaaac

SEQ ID NO: 887980 - DNA, 23 bp, Homo sapiens
tgagtcatttgtttaaacaatct

SEQ ID NO: 887981 - DNA, 13 bp, Homo sapiens
tgagtccagaagt

SEQ ID NO: 887982 - DNA, 14 bp, Homo sapiens
tgagtccatgaaaa

SEQ ID NO: 887983 - DNA, 19 bp, Homo sapiens
tgagtccattctcccaggt

SEQ ID NO: 887984 - DNA, 20 bp, Homo sapiens
tgagtccattctcccaggta

SEQ ID NO: 887985 - DNA, 22 bp, Homo sapiens
tgagtccattctcccaggtacc

SEQ ID NO: 887986 - DNA, 16 bp, Homo sapiens
tgagtcccaggagctg

SEQ ID NO: 887987 - DNA, 21 bp, Homo sapiens
tgagtcccaggagctgcccag

SEQ ID NO: 887988 - DNA, 14 bp, Homo sapiens
tgagtcccctactc

SEQ ID NO: 887989 - DNA, 15 bp, Homo sapiens
tgagtcccctactcc

SEQ ID NO: 887990 - DNA, 22 bp, Homo sapiens
tgagtccctcacgtttcttccc

SEQ ID NO: 887991 - DNA, 15 bp, Homo sapiens
tgagtccgcctgcgc

SEQ ID NO: 887992 - DNA, 17 bp, Homo sapiens
tgagtccgcctgcgcct

SEQ ID NO: 887993 - DNA, 21 bp, Homo sapiens
tgagtccgcctgcgcctccat

SEQ ID NO: 887994 - DNA, 19 bp, Homo sapiens
tgagtcctgtctctgcctg

SEQ ID NO: 887995 - DNA, 20 bp, Homo sapiens
tgagtcgagattgcactgct

SEQ ID NO: 887996 - DNA, 19 bp, Homo sapiens
tgagtcggccccacatggg

SEQ ID NO: 887997 - DNA, 16 bp, Homo sapiens
tgagtctacctgagca

SEQ ID NO: 887998 - DNA, 15 bp, Homo sapiens
tgagtctatgttcaa

SEQ ID NO: 887999 - DNA, 20 bp, Homo sapiens
tgagtctatgttcaaagact

SEQ ID NO: 888000 - DNA, 16 bp, Homo sapiens
tgagtctcaagggtgg

SEQ ID NO: 888001 - DNA, 17 bp, Homo sapiens
tgagtctcaagggtggc

SEQ ID NO: 888002 - DNA, 19 bp, Homo sapiens
tgagtctcaagggtggcag

SEQ ID NO: 888003 - DNA, 18 bp, Homo sapiens
tgagtctgagtcctgtct

SEQ ID NO: 888004 - DNA, 17 bp, Homo sapiens
tgagtctggacctccat

SEQ ID NO: 888005 - DNA, 23 bp, Homo sapiens
tgagtcttaactgtatttcagta

SEQ ID NO: 888006 - DNA, 15 bp, Homo sapiens
tgagtcttggcggca

SEQ ID NO: 888007 - DNA, 16 bp, Homo sapiens
tgagtcttggcggcag

SEQ ID NO: 888008 - DNA, 20 bp, Homo sapiens
tgagtcttggttctaaaggt

SEQ ID NO: 888009 - DNA, 23 bp, Homo sapiens
tgagtgaaaatttttacattcat

SEQ ID NO: 888010 - DNA, 15 bp, Homo sapiens
tgagtgaatagcttt

SEQ ID NO: 888011 - DNA, 14 bp, Homo sapiens
tgagtgacagcttt

SEQ ID NO: 888012 - DNA, 16 bp, Homo sapiens
tgagtgacagctttct

SEQ ID NO: 888013 - DNA, 17 bp, Homo sapiens
tgagtgacagctttctg

SEQ ID NO: 888014 - DNA, 23 bp, Homo sapiens
tgagtgacagctttctgggatgt

SEQ ID NO: 888015 - DNA, 19 bp, Homo sapiens
tgagtgacatagcctcatg

SEQ ID NO: 888016 - DNA, 15 bp, Homo sapiens
tgagtgagttttact

SEQ ID NO: 888017 - DNA, 14 bp, Homo sapiens
tgagtgatcactgg

SEQ ID NO: 888018 - DNA, 15 bp, Homo sapiens
tgagtgatcctccaa

SEQ ID NO: 888019 - DNA, 15 bp, Homo sapiens
tgagtgcactgactg

SEQ ID NO: 888020 - DNA, 15 bp, Homo sapiens
tgagtgcagccaaag

SEQ ID NO: 888021 - DNA, 14 bp, Homo sapiens
tgagtgccatgctt

SEQ ID NO: 888022 - DNA, 15 bp, Homo sapiens
tgagtgccatgcttt

SEQ ID NO: 888023 - DNA, 21 bp, Homo sapiens
tgagtgcgcagatctgtgcct

SEQ ID NO: 888024 - DNA, 19 bp, Homo sapiens
tgagtgcgggctgaggcca

SEQ ID NO: 888025 - DNA, 22 bp, Homo sapiens
tgagtgcgggctgaggccagag

SEQ ID NO: 888026 - DNA, 12 bp, Homo sapiens
tgagtgctctga

SEQ ID NO: 888027 - DNA, 14 bp, Homo sapiens
tgagtgctgggcac

SEQ ID NO: 888028 - DNA, 17 bp, Homo sapiens
tgagtgctgggggaggc

SEQ ID NO: 888029 - DNA, 20 bp, Homo sapiens
tgagtgcttgttagagagaa

SEQ ID NO: 888030 - DNA, 17 bp, Homo sapiens
tgagtggaatgcaggga

SEQ ID NO: 888031 - DNA, 18 bp, Homo sapiens
tgagtggaatgcagggaa

SEQ ID NO: 888032 - DNA, 14 bp, Homo sapiens
tgagtggataatca

SEQ ID NO: 888033 - DNA, 13 bp, Homo sapiens
tgagtggcagcca

SEQ ID NO: 888034 - DNA, 14 bp, Homo sapiens
tgagtggcagccat

SEQ ID NO: 888035 - DNA, 13 bp, Homo sapiens
tgagtggcagggg

SEQ ID NO: 888036 - DNA, 20 bp, Homo sapiens
tgagtggccagcgccagggc

SEQ ID NO: 888037 - DNA, 12 bp, Homo sapiens
tgagtgggaagc

SEQ ID NO: 888038 - DNA, 21 bp, Homo sapiens
tgagtgggaggcgtgcccccc

SEQ ID NO: 888039 - DNA, 14 bp, Homo sapiens
tgagtgggccctgc

SEQ ID NO: 888040 - DNA, 23 bp, Homo sapiens
tgagtgggggatcacagcctctg

SEQ ID NO: 888041 - DNA, 22 bp, Homo sapiens
tgagtggggttatctctgtgtt

SEQ ID NO: 888042 - DNA, 18 bp, Homo sapiens
tgagtggtcactggtcag

SEQ ID NO: 888043 - DNA, 20 bp, Homo sapiens
tgagtggtcactggtcaggg

SEQ ID NO: 888044 - DNA, 23 bp, Homo sapiens
tgagtggtcactggtcagggcag

SEQ ID NO: 888045 - DNA, 23 bp, Homo sapiens
tgagtgtaaataattttaaataa

SEQ ID NO: 888046 - DNA, 15 bp, Homo sapiens
tgagtgtaagtgtga

SEQ ID NO: 888047 - DNA, 16 bp, Homo sapiens
tgagtgtacagatttt

SEQ ID NO: 888048 - DNA, 18 bp, Homo sapiens
tgagtgtacagattttat

SEQ ID NO: 888049 - DNA, 11 bp, Homo sapiens
tgagtgtacca

SEQ ID NO: 888050 - DNA, 18 bp, Homo sapiens
tgagtgtactgtgcctgg

SEQ ID NO: 888051 - DNA, 16 bp, Homo sapiens
tgagtgtatatatatt

SEQ ID NO: 888052 - DNA, 12 bp, Homo sapiens
tgagtgtatgtg

SEQ ID NO: 888053 - DNA, 14 bp, Homo sapiens
tgagtgtgagggca

SEQ ID NO: 888054 - DNA, 16 bp, Homo sapiens
tgagtgtgagggcagc

SEQ ID NO: 888055 - DNA, 12 bp, Homo sapiens
tgagtgtggaag

SEQ ID NO: 888056 - DNA, 15 bp, Homo sapiens
tgagtgtggaagccg

SEQ ID NO: 888057 - DNA, 17 bp, Homo sapiens
tgagtgtggctcccctc

SEQ ID NO: 888058 - DNA, 17 bp, Homo sapiens
tgagtgtgtccaagtgt

SEQ ID NO: 888059 - DNA, 17 bp, Homo sapiens
tgagtgtgtgtgcatgg

SEQ ID NO: 888060 - DNA, 23 bp, Homo sapiens
tgagtgttcattttagtgactgt

SEQ ID NO: 888061 - DNA, 14 bp, Homo sapiens
tgagtgtttggggg

SEQ ID NO: 888062 - DNA, 22 bp, Homo sapiens
tgagtgtttttactacagttgt

SEQ ID NO: 888063 - DNA, 18 bp, Homo sapiens
tgagttacttagaatgcc

SEQ ID NO: 888064 - DNA, 19 bp, Homo sapiens
tgagttacttagaatgcca

SEQ ID NO: 888065 - DNA, 18 bp, Homo sapiens
tgagttacttgtctgagg

SEQ ID NO: 888066 - DNA, 20 bp, Homo sapiens
tgagttacttgtctgaggcc

SEQ ID NO: 888067 - DNA, 23 bp, Homo sapiens
tgagttagactcaagggggtgac

SEQ ID NO: 888068 - DNA, 20 bp, Homo sapiens
tgagttcaagggctgtaggt

SEQ ID NO: 888069 - DNA, 18 bp, Homo sapiens
tgagttccagaaagtaaa

SEQ ID NO: 888070 - DNA, 13 bp, Homo sapiens
tgagttcctctgc

SEQ ID NO: 888071 - DNA, 15 bp, Homo sapiens
tgagttcctctgcag

SEQ ID NO: 888072 - DNA, 17 bp, Homo sapiens
tgagttcctctgcagtt

SEQ ID NO: 888073 - DNA, 20 bp, Homo sapiens
tgagttctatcagttatcct

SEQ ID NO: 888074 - DNA, 14 bp, Homo sapiens
tgagttctgggttt

SEQ ID NO: 888075 - DNA, 15 bp, Homo sapiens
tgagttctgtgtatt

SEQ ID NO: 888076 - DNA, 17 bp, Homo sapiens
tgagttcttcctgtaat

SEQ ID NO: 888077 - DNA, 12 bp, Homo sapiens
tgagttgcagtt

SEQ ID NO: 888078 - DNA, 13 bp, Homo sapiens
tgagttgcagttt

SEQ ID NO: 888079 - DNA, 13 bp, Homo sapiens
tgagttgcatttg

SEQ ID NO: 888080 - DNA, 17 bp, Homo sapiens
tgagttgccaagacaaa

SEQ ID NO: 888081 - DNA, 18 bp, Homo sapiens
tgagttgccaagacaaat

SEQ ID NO: 888082 - DNA, 18 bp, Homo sapiens
tgagttgggggagggaag

SEQ ID NO: 888083 - DNA, 13 bp, Homo sapiens
tgagttgttctaa

SEQ ID NO: 888084 - DNA, 14 bp, Homo sapiens
tgagttgttctaac

SEQ ID NO: 888085 - DNA, 18 bp, Homo sapiens
tgagtttaccatttgtaa

SEQ ID NO: 888086 - DNA, 19 bp, Homo sapiens
tgagtttaccatttgtaat

SEQ ID NO: 888087 - DNA, 16 bp, Homo sapiens
tgagtttaccttgtat

SEQ ID NO: 888088 - DNA, 14 bp, Homo sapiens
tgagtttattctga

SEQ ID NO: 888089 - DNA, 19 bp, Homo sapiens
tgagtttcattctcctgcc

SEQ ID NO: 888090 - DNA, 19 bp, Homo sapiens
tgagtttccagcctgctag

SEQ ID NO: 888091 - DNA, 19 bp, Homo sapiens
tgagtttctggggaaaaaa

SEQ ID NO: 888092 - DNA, 13 bp, Homo sapiens
tgagtttgcctca

SEQ ID NO: 888093 - DNA, 18 bp, Homo sapiens
tgagtttggtctggactg

SEQ ID NO: 888094 - DNA, 15 bp, Homo sapiens
tgagtttgtattatt

SEQ ID NO: 888095 - DNA, 19 bp, Homo sapiens
tgagtttgtcgctcatgtg

SEQ ID NO: 888096 - DNA, 19 bp, Homo sapiens
tgagttttactcttaaatc

SEQ ID NO: 888097 - DNA, 23 bp, Homo sapiens
tgagttttgatgctgtatttgct

SEQ ID NO: 888098 - DNA, 21 bp, Homo sapiens
tgagttttgtgtttgttgtag

SEQ ID NO: 888099 - DNA, 20 bp, Homo sapiens
tgagttttgttttaaaatta

SEQ ID NO: 888100 - DNA, 19 bp, Homo sapiens
tgagtttttatggggctga

SEQ ID NO: 888101 - DNA, 15 bp, Homo sapiens
tgagtttttcctccc

SEQ ID NO: 888102 - DNA, 18 bp, Homo sapiens
tgagtttttcctcccagt

SEQ ID NO: 888103 - DNA, 19 bp, Homo sapiens
tgagtttttcctcccagtg

SEQ ID NO: 888104 - DNA, 18 bp, Homo sapiens
tgagttttttaaattttt

SEQ ID NO: 888105 - DNA, 15 bp, Homo sapiens
tgagttttttattcc

SEQ ID NO: 888106 - DNA, 14 bp, Homo sapiens
tgataaaaactcag

SEQ ID NO: 888107 - DNA, 16 bp, Homo sapiens
tgataaaaccatgtag

SEQ ID NO: 888108 - DNA, 15 bp, Homo sapiens
tgataaaagttttga

SEQ ID NO: 888109 - DNA, 16 bp, Homo sapiens
tgataaaataaataat

SEQ ID NO: 888110 - DNA, 17 bp, Homo sapiens
tgataaaataaataatt

SEQ ID NO: 888111 - DNA, 12 bp, Homo sapiens
tgataaaatatg

SEQ ID NO: 888112 - DNA, 17 bp, Homo sapiens
tgataaaatgtaaattt

SEQ ID NO: 888113 - DNA, 21 bp, Homo sapiens
tgataaaattgtgatgttttg

SEQ ID NO: 888114 - DNA, 21 bp, Homo sapiens
tgataaagaggcatcttttct

SEQ ID NO: 888115 - DNA, 18 bp, Homo sapiens
tgataaagtaataatgtg

SEQ ID NO: 888116 - DNA, 16 bp, Homo sapiens
tgataaagttccttaa

SEQ ID NO: 888117 - DNA, 13 bp, Homo sapiens
tgataaatatata

SEQ ID NO: 888118 - DNA, 11 bp, Homo sapiens
tgataaatatt

SEQ ID NO: 888119 - DNA, 18 bp, Homo sapiens
tgataaatatttatgctt

SEQ ID NO: 888120 - DNA, 19 bp, Homo sapiens
tgataaattccactggact

SEQ ID NO: 888121 - DNA, 23 bp, Homo sapiens
tgataacaagcaaggatatcaga

SEQ ID NO: 888122 - DNA, 18 bp, Homo sapiens
tgataacacttaaaattg

SEQ ID NO: 888123 - DNA, 15 bp, Homo sapiens
tgataacttggggag

SEQ ID NO: 888124 - DNA, 20 bp, Homo sapiens
tgataagactgtttttaagt

SEQ ID NO: 888125 - DNA, 14 bp, Homo sapiens
tgataagaggaatt

SEQ ID NO: 888126 - DNA, 15 bp, Homo sapiens
tgataagcattgact

SEQ ID NO: 888127 - DNA, 18 bp, Homo sapiens
tgataagggaaaagataa

SEQ ID NO: 888128 - DNA, 13 bp, Homo sapiens
tgataaggggcct

SEQ ID NO: 888129 - DNA, 21 bp, Homo sapiens
tgataaggggccttgctctga

SEQ ID NO: 888130 - DNA, 22 bp, Homo sapiens
tgataatacttgacctctgtga

SEQ ID NO: 888131 - DNA, 11 bp, Homo sapiens
tgataatcttc

SEQ ID NO: 888132 - DNA, 23 bp, Homo sapiens
tgataatcttcaggtgaacactt

SEQ ID NO: 888133 - DNA, 18 bp, Homo sapiens
tgataatgaacagaacat

SEQ ID NO: 888134 - DNA, 18 bp, Homo sapiens
tgataatgatgatgacga

SEQ ID NO: 888135 - DNA, 13 bp, Homo sapiens
tgataattttaaa

SEQ ID NO: 888136 - DNA, 16 bp, Homo sapiens
tgatacaatgaacact

SEQ ID NO: 888137 - DNA, 15 bp, Homo sapiens
tgatacaatgctgtg

SEQ ID NO: 888138 - DNA, 20 bp, Homo sapiens
tgatacaatgctgtgcccta

SEQ ID NO: 888139 - DNA, 21 bp, Homo sapiens
tgatacaatgctgtgccctaa

SEQ ID NO: 888140 - DNA, 23 bp, Homo sapiens
tgatacactatgaagatgtttca

SEQ ID NO: 888141 - DNA, 14 bp, Homo sapiens
tgatacatttacat

SEQ ID NO: 888142 - DNA, 13 bp, Homo sapiens
tgatacatttctg

SEQ ID NO: 888143 - DNA, 22 bp, Homo sapiens
tgataccacctttactgtgctt

SEQ ID NO: 888144 - DNA, 18 bp, Homo sapiens
tgataccagaagggaaag

SEQ ID NO: 888145 - DNA, 18 bp, Homo sapiens
tgatacccatagcttcca

SEQ ID NO: 888146 - DNA, 18 bp, Homo sapiens
tgatacccccctctgtct

SEQ ID NO: 888147 - DNA, 21 bp, Homo sapiens
tgatacgtccgtgtgtcccag

SEQ ID NO: 888148 - DNA, 14 bp, Homo sapiens
tgatactaagcatt

SEQ ID NO: 888149 - DNA, 16 bp, Homo sapiens
tgatactaagcattga

SEQ ID NO: 888150 - DNA, 14 bp, Homo sapiens
tgatactaataaac

SEQ ID NO: 888151 - DNA, 15 bp, Homo sapiens
tgatctacccgtgcc

SEQ ID NO: 888152 - DNA, 21 bp, Homo sapiens
tgatctacccgtgcctgggcc

SEQ ID NO: 888153 - DNA, 21 bp, Homo sapiens
tgatctaccttgaattgatat

SEQ ID NO: 888154 - DNA, 22 bp, Homo sapiens
tgatctacttcatagctccttg

SEQ ID NO: 888155 - DNA, 23 bp, Homo sapiens
tgatctacttcatagctccttgg

SEQ ID NO: 888156 - DNA, 18 bp, Homo sapiens
tgatctacttctgtaatt

SEQ ID NO: 888157 - DNA, 21 bp, Homo sapiens
tgatctacttctgtaattgtg

SEQ ID NO: 888158 - DNA, 17 bp, Homo sapiens
tgatctacttgcctcat

SEQ ID NO: 888159 - DNA, 15 bp, Homo sapiens
tgatctcagggcaga

SEQ ID NO: 888160 - DNA, 21 bp, Homo sapiens
tgatctccatatgttacacta

SEQ ID NO: 888161 - DNA, 17 bp, Homo sapiens
tgatctccatggcttcc

SEQ ID NO: 888162 - DNA, 18 bp, Homo sapiens
tgatctcggatgaccaaa

SEQ ID NO: 888163 - DNA, 20 bp, Homo sapiens
tgatctctactaccacaagg

SEQ ID NO: 888164 - DNA, 23 bp, Homo sapiens
tgatctctactaccacaaggaaa

SEQ ID NO: 888165 - DNA, 13 bp, Homo sapiens
tgatctcttcctg

SEQ ID NO: 888166 - DNA, 21 bp, Homo sapiens
tgatctgcatatttctgtata

SEQ ID NO: 888167 - DNA, 15 bp, Homo sapiens
tgatctgcccgcctc

SEQ ID NO: 888168 - DNA, 18 bp, Homo sapiens
tgatctgcccttctctgc

SEQ ID NO: 888169 - DNA, 20 bp, Homo sapiens
tgatctgcccttctctgcct

SEQ ID NO: 888170 - DNA, 15 bp, Homo sapiens
tgatctggacttcct

SEQ ID NO: 888171 - DNA, 20 bp, Homo sapiens
tgatctgtactttgtgttta

SEQ ID NO: 888172 - DNA, 22 bp, Homo sapiens
tgatctgtatttaatggttttt

SEQ ID NO: 888173 - DNA, 17 bp, Homo sapiens
tgatctgtgatttcttc

SEQ ID NO: 888174 - DNA, 15 bp, Homo sapiens
tgatctgtgtacaat

SEQ ID NO: 888175 - DNA, 11 bp, Homo sapiens
tgatcttaaag

SEQ ID NO: 888176 - DNA, 13 bp, Homo sapiens
tgatcttaaagat

SEQ ID NO: 888177 - DNA, 18 bp, Homo sapiens
tgatcttaaagatcgtgt

SEQ ID NO: 888178 - DNA, 20 bp, Homo sapiens
tgatcttctttataattcta

SEQ ID NO: 888179 - DNA, 21 bp, Homo sapiens
tgatcttggcttactgcagcc

SEQ ID NO: 888180 - DNA, 14 bp, Homo sapiens
tgatcttgtgacat

SEQ ID NO: 888181 - DNA, 15 bp, Homo sapiens
tgatcttgtgctcag

SEQ ID NO: 888182 - DNA, 23 bp, Homo sapiens
tgatcttgttactgtgatatttt

SEQ ID NO: 888183 - DNA, 15 bp, Homo sapiens
tgatctttgagccca

SEQ ID NO: 888184 - DNA, 16 bp, Homo sapiens
tgatctttgagcccat

SEQ ID NO: 888185 - DNA, 14 bp, Homo sapiens
tgatctttgtttaa

SEQ ID NO: 888186 - DNA, 21 bp, Homo sapiens
tgatctttgtttaaatgccaa

SEQ ID NO: 888187 - DNA, 22 bp, Homo sapiens
tgatctttgtttaaatgccaaa

SEQ ID NO: 888188 - DNA, 23 bp, Homo sapiens
tgatctttgtttaaatgccaaaa

SEQ ID NO: 888189 - DNA, 19 bp, Homo sapiens
tgatcttttaaagtgttac

SEQ ID NO: 888190 - DNA, 21 bp, Homo sapiens
tgatcttttaaagtgttactt

SEQ ID NO: 888191 - DNA, 16 bp, Homo sapiens
tgatctttttatacac

SEQ ID NO: 888192 - DNA, 19 bp, Homo sapiens
tgatgaaaactaaggattt

SEQ ID NO: 888193 - DNA, 19 bp, Homo sapiens
tgattaatgttttcattat

SEQ ID NO: 888194 - DNA, 20 bp, Homo sapiens
tgattaatgttttcattatg

SEQ ID NO: 888195 - DNA, 15 bp, Homo sapiens
tgattaatttgagaa

SEQ ID NO: 888196 - DNA, 18 bp, Homo sapiens
tgattacataatcaaagc

SEQ ID NO: 888197 - DNA, 19 bp, Homo sapiens
tgattacatagatcagcca

SEQ ID NO: 888198 - DNA, 21 bp, Homo sapiens
tgattacatagatcagccatt

SEQ ID NO: 888199 - DNA, 22 bp, Homo sapiens
tgattacatagatcagccatta

SEQ ID NO: 888200 - DNA, 21 bp, Homo sapiens
tgattacgtgtatgtttcttc

SEQ ID NO: 888201 - DNA, 22 bp, Homo sapiens
tgattacgtgtatgtttcttct

SEQ ID NO: 888202 - DNA, 14 bp, Homo sapiens
tgattactctttga

SEQ ID NO: 888203 - DNA, 14 bp, Homo sapiens
tgattactgtcaat

SEQ ID NO: 888204 - DNA, 17 bp, Homo sapiens
tgattactgtcaataaa

SEQ ID NO: 888205 - DNA, 19 bp, Homo sapiens
tgattactgtcaataaaca

SEQ ID NO: 888206 - DNA, 20 bp, Homo sapiens
tgattagagtgcaaaagtga

SEQ ID NO: 888207 - DNA, 20 bp, Homo sapiens
tgattagagtggttattcat

SEQ ID NO: 888208 - DNA, 11 bp, Homo sapiens
tgattagatga

SEQ ID NO: 888209 - DNA, 17 bp, Homo sapiens
tgattagtataatattt

SEQ ID NO: 888210 - DNA, 14 bp, Homo sapiens
tgattagttgaaag

SEQ ID NO: 888211 - DNA, 15 bp, Homo sapiens
tgattataaatgttt

SEQ ID NO: 888212 - DNA, 23 bp, Homo sapiens
tgattataagccctgcataatgt

SEQ ID NO: 888213 - DNA, 19 bp, Homo sapiens
tgattataccatgtgtgct

SEQ ID NO: 888214 - DNA, 22 bp, Homo sapiens
tgattataccatgtgtgctaat

SEQ ID NO: 888215 - DNA, 20 bp, Homo sapiens
tgattatagcaactaatgtt

SEQ ID NO: 888216 - DNA, 21 bp, Homo sapiens
tgattatagcaactaatgttt

SEQ ID NO: 888217 - DNA, 14 bp, Homo sapiens
tgattatatattgt

SEQ ID NO: 888218 - DNA, 18 bp, Homo sapiens
tgattatcttcagcccag

SEQ ID NO: 888219 - DNA, 17 bp, Homo sapiens
tgattattatgtttatt

SEQ ID NO: 888220 - DNA, 15 bp, Homo sapiens
tgattattcaacaca

SEQ ID NO: 888221 - DNA, 16 bp, Homo sapiens
tgattattcaacacat

SEQ ID NO: 888222 - DNA, 14 bp, Homo sapiens
tgattattcagtgt

SEQ ID NO: 888223 - DNA, 16 bp, Homo sapiens
tgattattcagtgtca

SEQ ID NO: 888224 - DNA, 22 bp, Homo sapiens
tgattatttaagactaaaagtt

SEQ ID NO: 888225 - DNA, 16 bp, Homo sapiens
tgattatttatcacat

SEQ ID NO: 888226 - DNA, 17 bp, Homo sapiens
tgattatttatcacata

SEQ ID NO: 888227 - DNA, 16 bp, Homo sapiens
tgattatttattattt

SEQ ID NO: 888228 - DNA, 15 bp, Homo sapiens
tgattatttcacttt

SEQ ID NO: 888229 - DNA, 23 bp, Homo sapiens
tgattatttcactttagatgctg

SEQ ID NO: 888230 - DNA, 12 bp, Homo sapiens
tgattatttgca

SEQ ID NO: 888231 - DNA, 13 bp, Homo sapiens
tgattattttctt

SEQ ID NO: 888232 - DNA, 17 bp, Homo sapiens
tgattcaaaatatttaa

SEQ ID NO: 888233 - DNA, 19 bp, Homo sapiens
tgattcaaaatatttaaaa

SEQ ID NO: 888234 - DNA, 23 bp, Homo sapiens
tgattcaaagtgttgtgttcctg

SEQ ID NO: 888235 - DNA, 14 bp, Homo sapiens
tgattcaaatgttt

SEQ ID NO: 888236 - DNA, 19 bp, Homo sapiens
tgattcaaattgctgcttg

SEQ ID NO: 888237 - DNA, 12 bp, Homo sapiens
tgattcaagcca

SEQ ID NO: 888238 - DNA, 16 bp, Homo sapiens
tgattcaatctgtaaa

SEQ ID NO: 888239 - DNA, 15 bp, Homo sapiens
tgattcacctcttcc

SEQ ID NO: 888240 - DNA, 16 bp, Homo sapiens
tgattcacctcttcct

SEQ ID NO: 888241 - DNA, 19 bp, Homo sapiens
tgattcacctcttcctctg

SEQ ID NO: 888242 - DNA, 12 bp, Homo sapiens
tgattcactgca

SEQ ID NO: 888243 - DNA, 13 bp, Homo sapiens
tgattcactgcat

SEQ ID NO: 888244 - DNA, 18 bp, Homo sapiens
tgattcagaaaatgttct

SEQ ID NO: 888245 - DNA, 21 bp, Homo sapiens
tgattcagaaaatgttctgtt

SEQ ID NO: 888246 - DNA, 15 bp, Homo sapiens
tgattcagcaaaaat

SEQ ID NO: 888247 - DNA, 19 bp, Homo sapiens
tgattcagctcattatgaa

SEQ ID NO: 888248 - DNA, 17 bp, Homo sapiens
tgatgaaaataattttc

SEQ ID NO: 888249 - DNA, 12 bp, Homo sapiens
tgatgaaatctg

SEQ ID NO: 888250 - DNA, 18 bp, Homo sapiens
tgatgaactcttaatcaa

SEQ ID NO: 888251 - DNA, 14 bp, Homo sapiens
tgatgaactttctc

SEQ ID NO: 888252 - DNA, 15 bp, Homo sapiens
tgatgaagaaattta

SEQ ID NO: 888253 - DNA, 16 bp, Homo sapiens
tgatgaagcaaggaag

SEQ ID NO: 888254 - DNA, 23 bp, Homo sapiens
tgatgaagcaaggaagatataca

SEQ ID NO: 888255 - DNA, 12 bp, Homo sapiens
tgatgaagtata

SEQ ID NO: 888256 - DNA, 15 bp, Homo sapiens
tgatgaagtatactt

SEQ ID NO: 888257 - DNA, 20 bp, Homo sapiens
tgatgaatcaatgaaaaatg

SEQ ID NO: 888258 - DNA, 16 bp, Homo sapiens
tgatgaattcttcctc

SEQ ID NO: 888259 - DNA, 18 bp, Homo sapiens
tgatgacaaaaaatgttt

SEQ ID NO: 888260 - DNA, 14 bp, Homo sapiens
tgatgaccaaagtc

SEQ ID NO: 888261 - DNA, 21 bp, Homo sapiens
tgatgactacctcagaacata

SEQ ID NO: 888262 - DNA, 21 bp, Homo sapiens
tgatgactcaaggccaataat

SEQ ID NO: 888263 - DNA, 16 bp, Homo sapiens
tgatgactgctgattt

SEQ ID NO: 888264 - DNA, 18 bp, Homo sapiens
tgatgacttcagtgaaat

SEQ ID NO: 888265 - DNA, 15 bp, Homo sapiens
tgatgactttctgtt

SEQ ID NO: 888266 - DNA, 17 bp, Homo sapiens
tgatgagacagtgaagt

SEQ ID NO: 888267 - DNA, 12 bp, Homo sapiens
tgatgagcacat

SEQ ID NO: 888268 - DNA, 20 bp, Homo sapiens
tgatgagcatttagcacaat

SEQ ID NO: 888269 - DNA, 22 bp, Homo sapiens
tgatgagccatattaattgcct

SEQ ID NO: 888270 - DNA, 22 bp, Homo sapiens
tgatgaggccgcggcctccccg

SEQ ID NO: 888271 - DNA, 17 bp, Homo sapiens
tgatgaggcctcttgga

SEQ ID NO: 888272 - DNA, 18 bp, Homo sapiens
tgatgaggcctcttggac

SEQ ID NO: 888273 - DNA, 12 bp, Homo sapiens
tgatgaggctgg

SEQ ID NO: 888274 - DNA, 16 bp, Homo sapiens
tgatgaggtatttttt

SEQ ID NO: 888275 - DNA, 21 bp, Homo sapiens
tgatgagtaaactgaggccca

SEQ ID NO: 888276 - DNA, 18 bp, Homo sapiens
tgatgagtttcactgtac

SEQ ID NO: 888277 - DNA, 19 bp, Homo sapiens
tgatgataacacttaaaat

SEQ ID NO: 888278 - DNA, 15 bp, Homo sapiens
tgatgatacaagatt

SEQ ID NO: 888279 - DNA, 19 bp, Homo sapiens
tgatgatccagaacagtgg

SEQ ID NO: 888280 - DNA, 15 bp, Homo sapiens
tgatgatgaaaacta

SEQ ID NO: 888281 - DNA, 16 bp, Homo sapiens
tgatgatgatgaaaac

SEQ ID NO: 888282 - DNA, 16 bp, Homo sapiens
tgatgatgatgatgat

SEQ ID NO: 888283 - DNA, 17 bp, Homo sapiens
tgatgatgctgtgacaa

SEQ ID NO: 888284 - DNA, 23 bp, Homo sapiens
tgatgatggggtgggagactttc

SEQ ID NO: 888285 - DNA, 21 bp, Homo sapiens
tgatgatgtctacagaaaatg

SEQ ID NO: 888286 - DNA, 15 bp, Homo sapiens
tgatgatgtctcttg

SEQ ID NO: 888287 - DNA, 16 bp, Homo sapiens
tgatgattttcatttc

SEQ ID NO: 888288 - DNA, 17 bp, Homo sapiens
tgatgattttcatttca

SEQ ID NO: 888289 - DNA, 21 bp, Homo sapiens
tgatgattttcatttcatgaa

SEQ ID NO: 888290 - DNA, 18 bp, Homo sapiens
tgatgcacagagaagctg

SEQ ID NO: 888291 - DNA, 11 bp, Homo sapiens
tgatgcagaaa

SEQ ID NO: 888292 - DNA, 16 bp, Homo sapiens
tgatgcagataaaata

SEQ ID NO: 888293 - DNA, 18 bp, Homo sapiens
tgatgcagataaaatatt

SEQ ID NO: 888294 - DNA, 16 bp, Homo sapiens
tgatgcagcctgtggc

SEQ ID NO: 888295 - DNA, 20 bp, Homo sapiens
tgatgcatacagttttctag

SEQ ID NO: 888296 - DNA, 22 bp, Homo sapiens
tgatgcatacagttttctagca

SEQ ID NO: 888297 - DNA, 18 bp, Homo sapiens
tgatgcatgcactgttcc

SEQ ID NO: 888298 - DNA, 16 bp, Homo sapiens
tgatgcatgtctttta

SEQ ID NO: 888299 - DNA, 17 bp, Homo sapiens
tgatgcattaaaagaaa

SEQ ID NO: 888300 - DNA, 21 bp, Homo sapiens
tgatgcattaaaagaaaataa

SEQ ID NO: 888301 - DNA, 21 bp, Homo sapiens
tgatgccaaaaaaaaatacat

SEQ ID NO: 888302 - DNA, 17 bp, Homo sapiens
tgatgccaaagatgttt

SEQ ID NO: 888303 - DNA, 14 bp, Homo sapiens
tgatgccagagggc

SEQ ID NO: 888304 - DNA, 23 bp, Homo sapiens
tgatgccctcccctcagcgcagg

SEQ ID NO: 888305 - DNA, 12 bp, Homo sapiens
tgatgccctctt

SEQ ID NO: 888306 - DNA, 17 bp, Homo sapiens
tgatgccctcttctcct

SEQ ID NO: 888307 - DNA, 18 bp, Homo sapiens
tgatgccctcttctcctt

SEQ ID NO: 888308 - DNA, 21 bp, Homo sapiens
tgatgccgaacattaggaatt

SEQ ID NO: 888309 - DNA, 20 bp, Homo sapiens
tgatgccgggcgccaggaca

SEQ ID NO: 888310 - DNA, 16 bp, Homo sapiens
tgatgccgtcctgctg

SEQ ID NO: 888311 - DNA, 15 bp, Homo sapiens
tgatgccgtgatcct

SEQ ID NO: 888312 - DNA, 15 bp, Homo sapiens
tgatgcgctgggatc

SEQ ID NO: 888313 - DNA, 18 bp, Homo sapiens
tgatgctatttatgcaag

SEQ ID NO: 888314 - DNA, 14 bp, Homo sapiens
tgatgctccctccc

SEQ ID NO: 888315 - DNA, 17 bp, Homo sapiens
tgatgctccctcccctg

SEQ ID NO: 888316 - DNA, 20 bp, Homo sapiens
tgatgctcccttgatggggt

SEQ ID NO: 888317 - DNA, 14 bp, Homo sapiens
tgatgctcctccgg

SEQ ID NO: 888318 - DNA, 14 bp, Homo sapiens
tgatgctctggctt

SEQ ID NO: 888319 - DNA, 15 bp, Homo sapiens
tgatgctctggcttg

SEQ ID NO: 888320 - DNA, 21 bp, Homo sapiens
tgatgctctggcttgccccag

SEQ ID NO: 888321 - DNA, 11 bp, Homo sapiens
tgatgctgccc

SEQ ID NO: 888322 - DNA, 15 bp, Homo sapiens
tgatgctggagaggt

SEQ ID NO: 888323 - DNA, 15 bp, Homo sapiens
tgatgctgtatttgc

SEQ ID NO: 888324 - DNA, 14 bp, Homo sapiens
tgatgctgtgacaa

SEQ ID NO: 888325 - DNA, 21 bp, Homo sapiens
tgatgcttgtaacaagaaaac

SEQ ID NO: 888326 - DNA, 16 bp, Homo sapiens
tgatgcttttgctgct

SEQ ID NO: 888327 - DNA, 19 bp, Homo sapiens
tgatgcttttgctgctgct

SEQ ID NO: 888328 - DNA, 21 bp, Homo sapiens
tgatgcttttgctgctgctta

SEQ ID NO: 888329 - DNA, 15 bp, Homo sapiens
tgatggaaaatacca

SEQ ID NO: 888330 - DNA, 19 bp, Homo sapiens
tgatggaaaataccagtgt

SEQ ID NO: 888331 - DNA, 24 bp, Homo sapiens
tgatggaaaataccagtgttgggt

SEQ ID NO: 888332 - DNA, 22 bp, Homo sapiens
tgatggaaacgcacttacaagt

SEQ ID NO: 888333 - DNA, 18 bp, Homo sapiens
tgatggaaatatttattt

SEQ ID NO: 888334 - DNA, 21 bp, Homo sapiens
tgatggaagatggtccgtgcc

SEQ ID NO: 888335 - DNA, 19 bp, Homo sapiens
tgatggaaggatctctcca

SEQ ID NO: 888336 - DNA, 22 bp, Homo sapiens
tgatggaagtaaagcctcaacc

SEQ ID NO: 888337 - DNA, 17 bp, Homo sapiens
tgatggaagtgttcaga

SEQ ID NO: 888338 - DNA, 17 bp, Homo sapiens
tgatggaattaaatgtg

SEQ ID NO: 888339 - DNA, 16 bp, Homo sapiens
tgatggacactccagg

SEQ ID NO: 888340 - DNA, 18 bp, Homo sapiens
tgatggaccgggtgggcc

SEQ ID NO: 888341 - DNA, 15 bp, Homo sapiens
tgatggacctgcccc

SEQ ID NO: 888342 - DNA, 15 bp, Homo sapiens
tgatggagaggacag

SEQ ID NO: 888343 - DNA, 15 bp, Homo sapiens
tgatggaggaaaaag

SEQ ID NO: 888344 - DNA, 17 bp, Homo sapiens
tgatggagggtggaaat

SEQ ID NO: 888345 - DNA, 17 bp, Homo sapiens
tgatggaggtatttgaa

SEQ ID NO: 888346 - DNA, 21 bp, Homo sapiens
tgatggagtgtgcagacagcc

SEQ ID NO: 888347 - DNA, 14 bp, Homo sapiens
tgatggcaaaaaaa

SEQ ID NO: 888348 - DNA, 20 bp, Homo sapiens
tgatggcaaaaaaaaaaaag

SEQ ID NO: 888349 - DNA, 17 bp, Homo sapiens
tgatggcaattttgtaa

SEQ ID NO: 888350 - DNA, 17 bp, Homo sapiens
tgatggcacagaaggat

SEQ ID NO: 888351 - DNA, 22 bp, Homo sapiens
tgatggcaccactgcactccag

SEQ ID NO: 888352 - DNA, 15 bp, Homo sapiens
tgatggcagagccag

SEQ ID NO: 888353 - DNA, 15 bp, Homo sapiens
tgatggccaaggggg

SEQ ID NO: 888354 - DNA, 15 bp, Homo sapiens
tgatggccagcccct

SEQ ID NO: 888355 - DNA, 14 bp, Homo sapiens
tgatggccatttct

SEQ ID NO: 888356 - DNA, 16 bp, Homo sapiens
tgatggccttaatttc

SEQ ID NO: 888357 - DNA, 18 bp, Homo sapiens
tgatggccttaatttcct

SEQ ID NO: 888358 - DNA, 16 bp, Homo sapiens
tgatggcctttggacc

SEQ ID NO: 888359 - DNA, 18 bp, Homo sapiens
tgatggcgcgggaggcac

SEQ ID NO: 888360 - DNA, 16 bp, Homo sapiens
tgatggcgggcactgg

SEQ ID NO: 888361 - DNA, 22 bp, Homo sapiens
tgatggctgctagattttaatt

SEQ ID NO: 888362 - DNA, 17 bp, Homo sapiens
tgatggcttatgatagc

SEQ ID NO: 888363 - DNA, 12 bp, Homo sapiens
tgatggcttgac

SEQ ID NO: 888364 - DNA, 13 bp, Homo sapiens
tgatgggaaaact

SEQ ID NO: 888365 - DNA, 16 bp, Homo sapiens
tgatgggaaaatagta

SEQ ID NO: 888366 - DNA, 20 bp, Homo sapiens
tgatgggaaaatatttcctg

SEQ ID NO: 888367 - DNA, 15 bp, Homo sapiens
tgatgggaaggaggg

SEQ ID NO: 888368 - DNA, 12 bp, Homo sapiens
tgatggggagaa

SEQ ID NO: 888369 - DNA, 14 bp, Homo sapiens
tgatggggagaaag

SEQ ID NO: 888370 - DNA, 19 bp, Homo sapiens
tgatggggagaaagggcaa

SEQ ID NO: 888371 - DNA, 18 bp, Homo sapiens
tgatggggtccagagagc

SEQ ID NO: 888372 - DNA, 14 bp, Homo sapiens
tgatggtcagaggg

SEQ ID NO: 888373 - DNA, 20 bp, Homo sapiens
tgattcagctcattatgaaa

SEQ ID NO: 888374 - DNA, 13 bp, Homo sapiens
tgattcagctctg

SEQ ID NO: 888375 - DNA, 21 bp, Homo sapiens
tgattcagtgttaaatgtgat

SEQ ID NO: 888376 - DNA, 13 bp, Homo sapiens
tgattcatctctg

SEQ ID NO: 888377 - DNA, 19 bp, Homo sapiens
tgattcattttcctgttca

SEQ ID NO: 888378 - DNA, 23 bp, Homo sapiens
tgattcattttcctgttcagtga

SEQ ID NO: 888379 - DNA, 13 bp, Homo sapiens
tgattccaaataa

SEQ ID NO: 888380 - DNA, 16 bp, Homo sapiens
tgattccaaataaaac

SEQ ID NO: 888381 - DNA, 15 bp, Homo sapiens
tgattccacttttat

SEQ ID NO: 888382 - DNA, 23 bp, Homo sapiens
tgattccattccatggaaataaa

SEQ ID NO: 888383 - DNA, 17 bp, Homo sapiens
tgattccctcctgctac

SEQ ID NO: 888384 - DNA, 18 bp, Homo sapiens
tgattccctcctgctact

SEQ ID NO: 888385 - DNA, 15 bp, Homo sapiens
tgattccctgattta

SEQ ID NO: 888386 - DNA, 18 bp, Homo sapiens
tgattcctacaacgaaat

SEQ ID NO: 888387 - DNA, 13 bp, Homo sapiens
tgattcctacccc

SEQ ID NO: 888388 - DNA, 15 bp, Homo sapiens
tgattcctacccctc

SEQ ID NO: 888389 - DNA, 19 bp, Homo sapiens
tgattcctacccctcttcc

SEQ ID NO: 888390 - DNA, 21 bp, Homo sapiens
tgattcctggctctaccctgt

SEQ ID NO: 888391 - DNA, 13 bp, Homo sapiens
tgattcctttaaa

SEQ ID NO: 888392 - DNA, 21 bp, Homo sapiens
tgattccttttgatggggaga

SEQ ID NO: 888393 - DNA, 16 bp, Homo sapiens
tgattcgcccaaagcc

SEQ ID NO: 888394 - DNA, 22 bp, Homo sapiens
tgattcgcccaaagccagacag

SEQ ID NO: 888395 - DNA, 19 bp, Homo sapiens
tgattcggacggccaatgg

SEQ ID NO: 888396 - DNA, 15 bp, Homo sapiens
tgattcgggggctga

SEQ ID NO: 888397 - DNA, 17 bp, Homo sapiens
tgattcgtatgatcagt

SEQ ID NO: 888398 - DNA, 15 bp, Homo sapiens
tgattctaatgtctt

SEQ ID NO: 888399 - DNA, 14 bp, Homo sapiens
tgattctattatat

SEQ ID NO: 888400 - DNA, 15 bp, Homo sapiens
tgattctattatata

SEQ ID NO: 888401 - DNA, 21 bp, Homo sapiens
tgattctatttatatgtacat

SEQ ID NO: 888402 - DNA, 22 bp, Homo sapiens
tgattctatttatatgtacatg

SEQ ID NO: 888403 - DNA, 15 bp, Homo sapiens
tgattctcagggctg

SEQ ID NO: 888404 - DNA, 13 bp, Homo sapiens
tgattctcctgcc

SEQ ID NO: 888405 - DNA, 20 bp, Homo sapiens
tgattctcctgcctcagcct

SEQ ID NO: 888406 - DNA, 21 bp, Homo sapiens
tgattctcctgcctcagcctt

SEQ ID NO: 888407 - DNA, 17 bp, Homo sapiens
tgattctcgactgcttt

SEQ ID NO: 888408 - DNA, 12 bp, Homo sapiens
tgattctctgtg

SEQ ID NO: 888409 - DNA, 14 bp, Homo sapiens
tgattctctgtggt

SEQ ID NO: 888410 - DNA, 15 bp, Homo sapiens
tgattctctgtggtt

SEQ ID NO: 888411 - DNA, 19 bp, Homo sapiens
tgattctctgtggtttttt

SEQ ID NO: 888412 - DNA, 16 bp, Homo sapiens
tgattctgaaattttt

SEQ ID NO: 888413 - DNA, 22 bp, Homo sapiens
tgattctgaaatttttttccta

SEQ ID NO: 888414 - DNA, 23 bp, Homo sapiens
tgattctgaaatttttttcctaa

SEQ ID NO: 888415 - DNA, 16 bp, Homo sapiens
tgattctgcagtaaat

SEQ ID NO: 888416 - DNA, 22 bp, Homo sapiens
tgattctgcagtaaatctttta

SEQ ID NO: 888417 - DNA, 21 bp, Homo sapiens
tgattcttaacacagccttcc

SEQ ID NO: 888418 - DNA, 19 bp, Homo sapiens
tgattcttgattcctggct

SEQ ID NO: 888419 - DNA, 21 bp, Homo sapiens
tgattcttgattcctggctct

SEQ ID NO: 888420 - DNA, 21 bp, Homo sapiens
tgattcttgattttcaagctt

SEQ ID NO: 888421 - DNA, 18 bp, Homo sapiens
tgattcttgtaaatcttt

SEQ ID NO: 888422 - DNA, 21 bp, Homo sapiens
tgattcttgtaaatctttttg

SEQ ID NO: 888423 - DNA, 23 bp, Homo sapiens
tgattctttaatagaagttttat

SEQ ID NO: 888424 - DNA, 18 bp, Homo sapiens
tgattctttttaaagtgt

SEQ ID NO: 888425 - DNA, 14 bp, Homo sapiens
tgattgaaccagct

SEQ ID NO: 888426 - DNA, 13 bp, Homo sapiens
tgattgacagctt

SEQ ID NO: 888427 - DNA, 16 bp, Homo sapiens
tgattgacctgctccg

SEQ ID NO: 888428 - DNA, 20 bp, Homo sapiens
tgattgaggagctgcactga

SEQ ID NO: 888429 - DNA, 15 bp, Homo sapiens
tgattgatgaccctt

SEQ ID NO: 888430 - DNA, 15 bp, Homo sapiens
tgattgatgtacaga

SEQ ID NO: 888431 - DNA, 16 bp, Homo sapiens
tgattgattcagtatc

SEQ ID NO: 888432 - DNA, 12 bp, Homo sapiens
tgattgatttga

SEQ ID NO: 888433 - DNA, 20 bp, Homo sapiens
tgattgatttttttctcctt

SEQ ID NO: 888434 - DNA, 12 bp, Homo sapiens
tgattgcacaga

SEQ ID NO: 888435 - DNA, 17 bp, Homo sapiens
tgattgcacagaatttg

SEQ ID NO: 888436 - DNA, 14 bp, Homo sapiens
tgattttaacaata

SEQ ID NO: 888437 - DNA, 17 bp, Homo sapiens
tgattttaacaataact

SEQ ID NO: 888438 - DNA, 18 bp, Homo sapiens
tgattttaacaataacta

SEQ ID NO: 888439 - DNA, 12 bp, Homo sapiens
tgattttaagag

SEQ ID NO: 888440 - DNA, 15 bp, Homo sapiens
tgattttaattttat

SEQ ID NO: 888441 - DNA, 16 bp, Homo sapiens
tgattttatctgtgaa

SEQ ID NO: 888442 - DNA, 13 bp, Homo sapiens
tgattttcattgc

SEQ ID NO: 888443 - DNA, 17 bp, Homo sapiens
tgattttcatttcatga

SEQ ID NO: 888444 - DNA, 12 bp, Homo sapiens
tgattttcctcc

SEQ ID NO: 888445 - DNA, 12 bp, Homo sapiens
tgattttctcac

SEQ ID NO: 888446 - DNA, 13 bp, Homo sapiens
tgattttctgttg

SEQ ID NO: 888447 - DNA, 16 bp, Homo sapiens
tgattttgaacttttt

SEQ ID NO: 888448 - DNA, 22 bp, Homo sapiens
tgattttgcaaaatgagttgtg

SEQ ID NO: 888449 - DNA, 18 bp, Homo sapiens
tgattttgccccctgagg

SEQ ID NO: 888450 - DNA, 20 bp, Homo sapiens
tgattttgccctcctgccca

SEQ ID NO: 888451 - DNA, 13 bp, Homo sapiens
tgattttggcatg

SEQ ID NO: 888452 - DNA, 19 bp, Homo sapiens
tgattttgtaattcttatg

SEQ ID NO: 888453 - DNA, 20 bp, Homo sapiens
tgattttgtaattcttatga

SEQ ID NO: 888454 - DNA, 12 bp, Homo sapiens
tgatttttcggc

SEQ ID NO: 888455 - DNA, 15 bp, Homo sapiens
tgatttttctcttca

SEQ ID NO: 888456 - DNA, 15 bp, Homo sapiens
tgatttttctttaca

SEQ ID NO: 888457 - DNA, 19 bp, Homo sapiens
tgatttttggtatttatgt

SEQ ID NO: 888458 - DNA, 13 bp, Homo sapiens
tgatttttgtctc

SEQ ID NO: 888459 - DNA, 18 bp, Homo sapiens
tgattttttgaaagttaa

SEQ ID NO: 888460 - DNA, 15 bp, Homo sapiens
tgatttttttaaagt

SEQ ID NO: 888461 - DNA, 18 bp, Homo sapiens
tgatttttttaaagtagt

SEQ ID NO: 888462 - DNA, 19 bp, Homo sapiens
tgatttttttaaagtagtt

SEQ ID NO: 888463 - DNA, 17 bp, Homo sapiens
tgattttttttaattac

SEQ ID NO: 888464 - DNA, 15 bp, Homo sapiens
tgatttttttttcca

SEQ ID NO: 888465 - DNA, 17 bp, Homo sapiens
tgcaaaaaaaaacttaa

SEQ ID NO: 888466 - DNA, 17 bp, Homo sapiens
tgcaaaaaaagcctcca

SEQ ID NO: 888467 - DNA, 21 bp, Homo sapiens
tgcaaaaaacatacttacatt

SEQ ID NO: 888468 - DNA, 21 bp, Homo sapiens
tgcaaaaaattctttagagat

SEQ ID NO: 888469 - DNA, 18 bp, Homo sapiens
tgcaaaaagaaaaaaaga

SEQ ID NO: 888470 - DNA, 19 bp, Homo sapiens
tgcaaaaagaaaaaaagaa

SEQ ID NO: 888471 - DNA, 15 bp, Homo sapiens
tgcaaaaagtagact

SEQ ID NO: 888472 - DNA, 17 bp, Homo sapiens
tgcaaaaataatcatga

SEQ ID NO: 888473 - DNA, 13 bp, Homo sapiens
tgcaaaaatataa

SEQ ID NO: 888474 - DNA, 22 bp, Homo sapiens
tgcaaaaatatttataaaactt

SEQ ID NO: 888475 - DNA, 17 bp, Homo sapiens
tgcaaaaatccttctcc

SEQ ID NO: 888476 - DNA, 16 bp, Homo sapiens
tgcaaaaccttttact

SEQ ID NO: 888477 - DNA, 19 bp, Homo sapiens
tgcaaaagcagctaaatgt

SEQ ID NO: 888478 - DNA, 22 bp, Homo sapiens
tgcaaaaggactctcaggacca

SEQ ID NO: 888479 - DNA, 14 bp, Homo sapiens
tgcaaaagttctca

SEQ ID NO: 888480 - DNA, 11 bp, Homo sapiens
tgcaaaataag

SEQ ID NO: 888481 - DNA, 15 bp, Homo sapiens
tgcaaaatacatgaa

SEQ ID NO: 888482 - DNA, 18 bp, Homo sapiens
tgcaaaatgaggaatgta

SEQ ID NO: 888483 - DNA, 21 bp, Homo sapiens
tgcaaaatgaggaatgtatat

SEQ ID NO: 888484 - DNA, 19 bp, Homo sapiens
tgcaaaatggtcagtatta

SEQ ID NO: 888485 - DNA, 22 bp, Homo sapiens
tgcaaaattaaatctagacatt

SEQ ID NO: 888486 - DNA, 18 bp, Homo sapiens
tgcaaaattgttttcact

SEQ ID NO: 888487 - DNA, 22 bp, Homo sapiens
tgcaaaattgttttcacttgta

SEQ ID NO: 888488 - DNA, 14 bp, Homo sapiens
tgcaaaatttccag

SEQ ID NO: 888489 - DNA, 23 bp, Homo sapiens
tgcaaacacacaaaggtataatt

SEQ ID NO: 888490 - DNA, 19 bp, Homo sapiens
tgcaaaccacttctccatg

SEQ ID NO: 888491 - DNA, 22 bp, Homo sapiens
tgcaaaccctggtggtatttta

SEQ ID NO: 888492 - DNA, 15 bp, Homo sapiens
tgcaaaccctttgta

SEQ ID NO: 888493 - DNA, 17 bp, Homo sapiens
tgcaaacctcatctttc

SEQ ID NO: 888494 - DNA, 13 bp, Homo sapiens
tgcaacttctgcc

SEQ ID NO: 888495 - DNA, 17 bp, Homo sapiens
tgcaacttctttttatt

SEQ ID NO: 888496 - DNA, 14 bp, Homo sapiens
tgcaacttgtgaac

SEQ ID NO: 888497 - DNA, 22 bp, Homo sapiens
tgcaagaacactggacctttgg

SEQ ID NO: 888498 - DNA, 17 bp, Homo sapiens
tgcaagaattaaaactg

SEQ ID NO: 888499 - DNA, 22 bp, Homo sapiens
tgcaagacctagtcccctttcc

SEQ ID NO: 888500 - DNA, 23 bp, Homo sapiens
tgcaagagccttggtgtccacct

SEQ ID NO: 888501 - DNA, 20 bp, Homo sapiens
tgcaagagtgattgcagctt

SEQ ID NO: 888502 - DNA, 17 bp, Homo sapiens
tgcaagatacaggaaaa

SEQ ID NO: 888503 - DNA, 15 bp, Homo sapiens
tgcaagatgcttggt

SEQ ID NO: 888504 - DNA, 18 bp, Homo sapiens
tgcaagatgtgaattatt

SEQ ID NO: 888505 - DNA, 15 bp, Homo sapiens
tgcaagcacagccct

SEQ ID NO: 888506 - DNA, 12 bp, Homo sapiens
tgcaagccataa

SEQ ID NO: 888507 - DNA, 15 bp, Homo sapiens
tgcaagccataacgt

SEQ ID NO: 888508 - DNA, 23 bp, Homo sapiens
tgcaagccataacgtgcccccag

SEQ ID NO: 888509 - DNA, 18 bp, Homo sapiens
tgcaagccccagggcctg

SEQ ID NO: 888510 - DNA, 18 bp, Homo sapiens
tgcaagcttggtcaaact

SEQ ID NO: 888511 - DNA, 12 bp, Homo sapiens
tgcaaggaagga

SEQ ID NO: 888512 - DNA, 16 bp, Homo sapiens
tgcaaggaaggaaaga

SEQ ID NO: 888513 - DNA, 19 bp, Homo sapiens
tgcaaggatttttccatgt

SEQ ID NO: 888514 - DNA, 21 bp, Homo sapiens
tgcaaggatttttccatgtgt

SEQ ID NO: 888515 - DNA, 14 bp, Homo sapiens
tgcaaggcaaatgt

SEQ ID NO: 888516 - DNA, 24 bp, Homo sapiens
tgcaaggccgctgttcacccacag

SEQ ID NO: 888517 - DNA, 16 bp, Homo sapiens
tgcaagggcccagagt

SEQ ID NO: 888518 - DNA, 17 bp, Homo sapiens
tgcaagggcccagagtg

SEQ ID NO: 888519 - DNA, 16 bp, Homo sapiens
tgcaaggtactctggt

SEQ ID NO: 888520 - DNA, 15 bp, Homo sapiens
tgcaaggtcattttt

SEQ ID NO: 888521 - DNA, 19 bp, Homo sapiens
tgcaaggtggcctctgcct

SEQ ID NO: 888522 - DNA, 21 bp, Homo sapiens
tgcaaggtggcctctgcctgg

SEQ ID NO: 888523 - DNA, 22 bp, Homo sapiens
tgcaaggtggcctctgcctggg

SEQ ID NO: 888524 - DNA, 14 bp, Homo sapiens
tgcaaggtggcctt

SEQ ID NO: 888525 - DNA, 23 bp, Homo sapiens
tgcaaggtttaggctggtggccc

SEQ ID NO: 888526 - DNA, 15 bp, Homo sapiens
tgcaagtactgctgt

SEQ ID NO: 888527 - DNA, 22 bp, Homo sapiens
tgcaagtatgtgagtgtgtcca

SEQ ID NO: 888528 - DNA, 17 bp, Homo sapiens
tgcaagtcaggaatcat

SEQ ID NO: 888529 - DNA, 17 bp, Homo sapiens
tgcaagtctgtggcccc

SEQ ID NO: 888530 - DNA, 13 bp, Homo sapiens
tgcaagtgaaggt

SEQ ID NO: 888531 - DNA, 13 bp, Homo sapiens
tgcaagtgctgga

SEQ ID NO: 888532 - DNA, 19 bp, Homo sapiens
tgcaagtgtgtatgtgcgt

SEQ ID NO: 888533 - DNA, 18 bp, Homo sapiens
tgcaagtgtgtgcatgtg

SEQ ID NO: 888534 - DNA, 21 bp, Homo sapiens
tgcaagttatattagtgaaga

SEQ ID NO: 888535 - DNA, 22 bp, Homo sapiens
tgcaagtttctgtttcaaagca

SEQ ID NO: 888536 - DNA, 16 bp, Homo sapiens
tgcaataaagtataat

SEQ ID NO: 888537 - DNA, 15 bp, Homo sapiens
tgcaataactctggg

SEQ ID NO: 888538 - DNA, 14 bp, Homo sapiens
tgcaataacttcta

SEQ ID NO: 888539 - DNA, 21 bp, Homo sapiens
tgcaataagaatttagggaga

SEQ ID NO: 888540 - DNA, 17 bp, Homo sapiens
tgcaataataataaatt

SEQ ID NO: 888541 - DNA, 23 bp, Homo sapiens
tgcaataatatcaaaacaagtac

SEQ ID NO: 888542 - DNA, 19 bp, Homo sapiens
tgcaataatccacccccag

SEQ ID NO: 888543 - DNA, 20 bp, Homo sapiens
tgcaataatccacccccagg

SEQ ID NO: 888544 - DNA, 18 bp, Homo sapiens
tgcaataatttgtacaat

SEQ ID NO: 888545 - DNA, 22 bp, Homo sapiens
tgcaatagattactgatgtgat

SEQ ID NO: 888546 - DNA, 19 bp, Homo sapiens
aaaaagtacaatgaactgc

SEQ ID NO: 888547 - DNA, 14 bp, Homo sapiens
aaaaagtcaacaaa

SEQ ID NO: 888548 - DNA, 19 bp, Homo sapiens
aaaaagtcagagacagata

SEQ ID NO: 888549 - DNA, 14 bp, Homo sapiens
aaaaagtcagatgt

SEQ ID NO: 888550 - DNA, 15 bp, Homo sapiens
aaaaagtctgtatgg

SEQ ID NO: 888551 - DNA, 21 bp, Homo sapiens
aaaaagtgaacttttgtaatt

SEQ ID NO: 888552 - DNA, 23 bp, Homo sapiens
aaaaagtgacacagcagcttcac

SEQ ID NO: 888553 - DNA, 18 bp, Homo sapiens
aaaaagtgcttcattctt

SEQ ID NO: 888554 - DNA, 13 bp, Homo sapiens
aaaaagtggctgc

SEQ ID NO: 888555 - DNA, 12 bp, Homo sapiens
aaaaagtgtctc

SEQ ID NO: 888556 - DNA, 14 bp, Homo sapiens
aaaaagtgtctcaa

SEQ ID NO: 888557 - DNA, 16 bp, Homo sapiens
aaaaagtgtctcaaag

SEQ ID NO: 888558 - DNA, 22 bp, Homo sapiens
aaaaagtgttgatcaaccattc

SEQ ID NO: 888559 - DNA, 13 bp, Homo sapiens
aaaaagttcagag

SEQ ID NO: 888560 - DNA, 15 bp, Homo sapiens
aaaaagttgcagctg

SEQ ID NO: 888561 - DNA, 20 bp, Homo sapiens
aaaaagttgcagctgttttg

SEQ ID NO: 888562 - DNA, 17 bp, Homo sapiens
aaaaagtttacaagtgt

SEQ ID NO: 888563 - DNA, 17 bp, Homo sapiens
aaaaagtttgccagaag

SEQ ID NO: 888564 - DNA, 16 bp, Homo sapiens
aaaaagttttagtttt

SEQ ID NO: 888565 - DNA, 21 bp, Homo sapiens
aaaaataaaaactaatttcat

SEQ ID NO: 888566 - DNA, 20 bp, Homo sapiens
aaaaataaaataattataaa

SEQ ID NO: 888567 - DNA, 12 bp, Homo sapiens
aaaaataaaatt

SEQ ID NO: 888568 - DNA, 16 bp, Homo sapiens
aaaaataaaattacct

SEQ ID NO: 888569 - DNA, 15 bp, Homo sapiens
aaaacattcagagga

SEQ ID NO: 888570 - DNA, 12 bp, Homo sapiens
aaaacattctat

SEQ ID NO: 888571 - DNA, 15 bp, Homo sapiens
aaaacatttcttaaa

SEQ ID NO: 888572 - DNA, 12 bp, Homo sapiens
aaaacatttgaa

SEQ ID NO: 888573 - DNA, 15 bp, Homo sapiens
aaaaccaaacttgtt

SEQ ID NO: 888574 - DNA, 21 bp, Homo sapiens
aaaaccaatgttctctcttct

SEQ ID NO: 888575 - DNA, 15 bp, Homo sapiens
aaaaccacacaaaga

SEQ ID NO: 888576 - DNA, 18 bp, Homo sapiens
aaaaccacagctgggcag

SEQ ID NO: 888577 - DNA, 20 bp, Homo sapiens
aaaaccatccatccctagaa

SEQ ID NO: 888578 - DNA, 20 bp, Homo sapiens
aaaaccatgcctggtatttt

SEQ ID NO: 888579 - DNA, 16 bp, Homo sapiens
aaaaccattgcttcac

SEQ ID NO: 888580 - DNA, 13 bp, Homo sapiens
aaaaccatttgaa

SEQ ID NO: 888581 - DNA, 12 bp, Homo sapiens
aaaacccagaga

SEQ ID NO: 888582 - DNA, 13 bp, Homo sapiens
aaaacccagagag

SEQ ID NO: 888583 - DNA, 16 bp, Homo sapiens
aaaacccttgggccag

SEQ ID NO: 888584 - DNA, 20 bp, Homo sapiens
aaaacctaagtcctttatgt

SEQ ID NO: 888585 - DNA, 20 bp, Homo sapiens
aaaacctacacacatacctt

SEQ ID NO: 888586 - DNA, 20 bp, Homo sapiens
aaaacctacgcacatacctt

SEQ ID NO: 888587 - DNA, 19 bp, Homo sapiens
aaaaccttagtcatcagat

SEQ ID NO: 888588 - DNA, 14 bp, Homo sapiens
aaaaccttttgaaa

SEQ ID NO: 888589 - DNA, 16 bp, Homo sapiens
aaaacgagtctttcat

SEQ ID NO: 888590 - DNA, 17 bp, Homo sapiens
aaaacgcaaagggctga

SEQ ID NO: 888591 - DNA, 13 bp, Homo sapiens
aaaacgcatggag

SEQ ID NO: 888592 - DNA, 13 bp, Homo sapiens
aaaacgcctcttt

SEQ ID NO: 888593 - DNA, 21 bp, Homo sapiens
aaaacgggttactaagatgaa

SEQ ID NO: 888594 - DNA, 17 bp, Homo sapiens
aaaacgtgatgttttga

SEQ ID NO: 888595 - DNA, 20 bp, Homo sapiens
aaaactaaggatttttcaag

SEQ ID NO: 888596 - DNA, 23 bp, Homo sapiens
aaaactaaggcttttatttctgt

SEQ ID NO: 888597 - DNA, 13 bp, Homo sapiens
aaaactaatttca

SEQ ID NO: 888598 - DNA, 18 bp, Homo sapiens
aaaactataaaaaagaaa

SEQ ID NO: 888599 - DNA, 21 bp, Homo sapiens
aaaactatgtgttcaatgaaa

SEQ ID NO: 888600 - DNA, 18 bp, Homo sapiens
aaaactcaggcaaagaaa

SEQ ID NO: 888601 - DNA, 23 bp, Homo sapiens
aaaactcaggcaaagaaaatgaa

SEQ ID NO: 888602 - DNA, 12 bp, Homo sapiens
aaaactcatgat

SEQ ID NO: 888603 - DNA, 22 bp, Homo sapiens
aaaactcccaatacaaagatga

SEQ ID NO: 888604 - DNA, 13 bp, Homo sapiens
aaaactcttcagt

SEQ ID NO: 888605 - DNA, 19 bp, Homo sapiens
aaaactgaaaatctaatat

SEQ ID NO: 888606 - DNA, 23 bp, Homo sapiens
aaaactgaaagtgaaagtccaga

SEQ ID NO: 888607 - DNA, 16 bp, Homo sapiens
aaaactgaagaatttt

SEQ ID NO: 888608 - DNA, 12 bp, Homo sapiens
aaaactgaaggt

SEQ ID NO: 888609 - DNA, 14 bp, Homo sapiens
aaaactgaaggttt

SEQ ID NO: 888610 - DNA, 13 bp, Homo sapiens
aaaactgaatctc

SEQ ID NO: 888611 - DNA, 20 bp, Homo sapiens
aaaactgagtccatgaaaat

SEQ ID NO: 888612 - DNA, 18 bp, Homo sapiens
aaaactgcacagtgctgt

SEQ ID NO: 888613 - DNA, 20 bp, Homo sapiens
aaaactgcgaggacatcaaa

SEQ ID NO: 888614 - DNA, 22 bp, Homo sapiens
aaaactgcgaggacatcaaagt

SEQ ID NO: 888615 - DNA, 19 bp, Homo sapiens
aaaactgcgttaaaggctc

SEQ ID NO: 888616 - DNA, 22 bp, Homo sapiens
aaaactgctgactgttttctct

SEQ ID NO: 888617 - DNA, 17 bp, Homo sapiens
aaaactgctttgtgcat

SEQ ID NO: 888618 - DNA, 12 bp, Homo sapiens
aaaactgctttt

SEQ ID NO: 888619 - DNA, 23 bp, Homo sapiens
aaaactgcttttttttttccagc

SEQ ID NO: 888620 - DNA, 13 bp, Homo sapiens
aaaactggcctga

SEQ ID NO: 888621 - DNA, 20 bp, Homo sapiens
aaaactgtacatttaaaatt

SEQ ID NO: 888622 - DNA, 14 bp, Homo sapiens
aaaactgtactgtg

SEQ ID NO: 888623 - DNA, 19 bp, Homo sapiens
aaaactgtgaccaagtata

SEQ ID NO: 888624 - DNA, 12 bp, Homo sapiens
aaaactgtgtaa

SEQ ID NO: 888625 - DNA, 20 bp, Homo sapiens
aaaactgtgtatcattaaaa

SEQ ID NO: 888626 - DNA, 23 bp, Homo sapiens
aaaactgtgtatcattaaaatat

SEQ ID NO: 888627 - DNA, 17 bp, Homo sapiens
aaaactgtgttgccaca

SEQ ID NO: 888628 - DNA, 16 bp, Homo sapiens
aaaactgttcttttgc

SEQ ID NO: 888629 - DNA, 16 bp, Homo sapiens
aaaacttaaaagtatt

SEQ ID NO: 888630 - DNA, 15 bp, Homo sapiens
aaaacttaaagcaaa

SEQ ID NO: 888631 - DNA, 19 bp, Homo sapiens
aaaacttaaagcaaaatag

SEQ ID NO: 888632 - DNA, 24 bp, Homo sapiens
aaaacttaaagcaaaatagtattg

SEQ ID NO: 888633 - DNA, 17 bp, Homo sapiens
aaaacttattttatcct

SEQ ID NO: 888634 - DNA, 13 bp, Homo sapiens
aaaacttcagaag

SEQ ID NO: 888635 - DNA, 17 bp, Homo sapiens
aaaacttcatgtaattt

SEQ ID NO: 888636 - DNA, 21 bp, Homo sapiens
aaaacttcattctaaaccaaa

SEQ ID NO: 888637 - DNA, 18 bp, Homo sapiens
aaaacttcattctcgtga

SEQ ID NO: 888638 - DNA, 14 bp, Homo sapiens
aaaacttgaaagaa

SEQ ID NO: 888639 - DNA, 18 bp, Homo sapiens
aaaacttgagcccactcc

SEQ ID NO: 888640 - DNA, 17 bp, Homo sapiens
aaaacttggatggactt

SEQ ID NO: 888641 - DNA, 17 bp, Homo sapiens
aaaacttgtaaatgctg

SEQ ID NO: 888642 - DNA, 22 bp, Homo sapiens
aaaacttgtactatgttaataa

SEQ ID NO: 888643 - DNA, 17 bp, Homo sapiens
aaaacttgtgctataaa

SEQ ID NO: 888644 - DNA, 13 bp, Homo sapiens
aaaactttaaaag

SEQ ID NO: 888645 - DNA, 17 bp, Homo sapiens
aaaactttaaaaggcaa

SEQ ID NO: 888646 - DNA, 14 bp, Homo sapiens
aaaactttaaagat

SEQ ID NO: 888647 - DNA, 15 bp, Homo sapiens
aaaactttattttat

SEQ ID NO: 888648 - DNA, 14 bp, Homo sapiens
aaaactttcagaga

SEQ ID NO: 888649 - DNA, 11 bp, Homo sapiens
aaaactttgga

SEQ ID NO: 888650 - DNA, 17 bp, Homo sapiens
aaaactttggaaccaga

SEQ ID NO: 888651 - DNA, 19 bp, Homo sapiens
aaaactttggaaccagact

SEQ ID NO: 888652 - DNA, 20 bp, Homo sapiens
aaaacttttgtaaattattg

SEQ ID NO: 888653 - DNA, 9 bp, Homo sapiens
aaaagaaaa

SEQ ID NO: 888654 - DNA, 19 bp, Homo sapiens
aaaagaaaaaaaaagaaaa

SEQ ID NO: 888655 - DNA, 14 bp, Homo sapiens
aaaagaaaaaaaga

SEQ ID NO: 888656 - DNA, 15 bp, Homo sapiens
aaaagaaaaaaagaa

SEQ ID NO: 888657 - DNA, 12 bp, Homo sapiens
aaaagaaaaaat

SEQ ID NO: 888658 - DNA, 15 bp, Homo sapiens
aaaagaaaaaatcat

SEQ ID NO: 888659 - DNA, 11 bp, Homo sapiens
aaaagaaaaag

SEQ ID NO: 888660 - DNA, 10 bp, Homo sapiens
aaaagaaacc

SEQ ID NO: 888661 - DNA, 12 bp, Homo sapiens
aaaagaaacttt

SEQ ID NO: 888662 - DNA, 13 bp, Homo sapiens
aaaagaaagaaaa

SEQ ID NO: 888663 - DNA, 15 bp, Homo sapiens
aaaagaaatatacag

SEQ ID NO: 888664 - DNA, 16 bp, Homo sapiens
aaaagaaatatatttt

SEQ ID NO: 888665 - DNA, 23 bp, Homo sapiens
aaaagaaatatattttttgttat

SEQ ID NO: 888666 - DNA, 14 bp, Homo sapiens
aaaagaaatcaata

SEQ ID NO: 888667 - DNA, 15 bp, Homo sapiens
aaaagaaatcttgtc

SEQ ID NO: 888668 - DNA, 16 bp, Homo sapiens
aaaagaaatgtcaatt

SEQ ID NO: 888669 - DNA, 11 bp, Homo sapiens
aaaagaacatg

SEQ ID NO: 888670 - DNA, 19 bp, Homo sapiens
aaaagaagcactttgattg

SEQ ID NO: 888671 - DNA, 11 bp, Homo sapiens
aaaagaaggaa

SEQ ID NO: 888672 - DNA, 24 bp, Homo sapiens
aaaagaaggtatttttccaatcac

SEQ ID NO: 888673 - DNA, 11 bp, Homo sapiens
aaaagaagtaa

SEQ ID NO: 888674 - DNA, 23 bp, Homo sapiens
aaaagaatgacgtttacatataa

SEQ ID NO: 888675 - DNA, 16 bp, Homo sapiens
aaaagaccaaatctca

SEQ ID NO: 888676 - DNA, 15 bp, Homo sapiens
aaaagacctgcattt

SEQ ID NO: 888677 - DNA, 17 bp, Homo sapiens
aaaagactgcagctgct

SEQ ID NO: 888678 - DNA, 24 bp, Homo sapiens
aaaagactggtttgtttgcttaat

SEQ ID NO: 888679 - DNA, 14 bp, Homo sapiens
aaaagactgtcaaa

SEQ ID NO: 888680 - DNA, 15 bp, Homo sapiens
aaacttctgaagact

SEQ ID NO: 888681 - DNA, 11 bp, Homo sapiens
aaacttgaaaa

SEQ ID NO: 888682 - DNA, 14 bp, Homo sapiens
aaacttgaaaatat

SEQ ID NO: 888683 - DNA, 12 bp, Homo sapiens
aaacttgaaata

SEQ ID NO: 888684 - DNA, 13 bp, Homo sapiens
aaacttgaagcag

SEQ ID NO: 888685 - DNA, 22 bp, Homo sapiens
aaacttgatgtgttatctctta

SEQ ID NO: 888686 - DNA, 23 bp, Homo sapiens
aaacttgcagcttggtattgcag

SEQ ID NO: 888687 - DNA, 19 bp, Homo sapiens
aaacttggacccttggaaa

SEQ ID NO: 888688 - DNA, 13 bp, Homo sapiens
aaacttggatact

SEQ ID NO: 888689 - DNA, 19 bp, Homo sapiens
aaacttggatacttggatt

SEQ ID NO: 888690 - DNA, 24 bp, Homo sapiens
aaacttggctcgaatctctgtgcc

SEQ ID NO: 888691 - DNA, 12 bp, Homo sapiens
aaacttgggcac

SEQ ID NO: 888692 - DNA, 14 bp, Homo sapiens
aaacttgttattgt

SEQ ID NO: 888693 - DNA, 18 bp, Homo sapiens
aaacttgttattgtgaat

SEQ ID NO: 888694 - DNA, 12 bp, Homo sapiens
aaacttgttcat

SEQ ID NO: 888695 - DNA, 15 bp, Homo sapiens
aaacttgttcattta

SEQ ID NO: 888696 - DNA, 15 bp, Homo sapiens
aaactttaaaaggca

SEQ ID NO: 888697 - DNA, 16 bp, Homo sapiens
aaactttaaaaggcaa

SEQ ID NO: 888698 - DNA, 14 bp, Homo sapiens
aaactttaaaatgc

SEQ ID NO: 888699 - DNA, 14 bp, Homo sapiens
aaactttaaacctg

SEQ ID NO: 888700 - DNA, 22 bp, Homo sapiens
aaactttaaacctgtagaatca

SEQ ID NO: 888701 - DNA, 12 bp, Homo sapiens
aaactttaaaga

SEQ ID NO: 888702 - DNA, 13 bp, Homo sapiens
aaactttaatata

SEQ ID NO: 888703 - DNA, 20 bp, Homo sapiens
aaactttacccaaaaactaa

SEQ ID NO: 888704 - DNA, 15 bp, Homo sapiens
aaactttagacttcc

SEQ ID NO: 888705 - DNA, 16 bp, Homo sapiens
aaactttaggtttttt

SEQ ID NO: 888706 - DNA, 24 bp, Homo sapiens
aaactttaggtttttttaatgata

SEQ ID NO: 888707 - DNA, 16 bp, Homo sapiens
aaactttatgtactgc

SEQ ID NO: 888708 - DNA, 11 bp, Homo sapiens
aaactttattg

SEQ ID NO: 888709 - DNA, 19 bp, Homo sapiens
aaactttatttaaatgcat

SEQ ID NO: 888710 - DNA, 20 bp, Homo sapiens
aaactttatttaaatgcatg

SEQ ID NO: 888711 - DNA, 15 bp, Homo sapiens
aaactttattttata

SEQ ID NO: 888712 - DNA, 23 bp, Homo sapiens
aaactttattttatataataaag

SEQ ID NO: 888713 - DNA, 12 bp, Homo sapiens
aaactttgtagt

SEQ ID NO: 888714 - DNA, 15 bp, Homo sapiens
aaactttgtgccttt

SEQ ID NO: 888715 - DNA, 14 bp, Homo sapiens
aaacttttaggacc

SEQ ID NO: 888716 - DNA, 17 bp, Homo sapiens
aaacttttataaattaa

SEQ ID NO: 888717 - DNA, 21 bp, Homo sapiens
aaacttttataaattaaatat

SEQ ID NO: 888718 - DNA, 15 bp, Homo sapiens
aaacttttctaaagt

SEQ ID NO: 888719 - DNA, 19 bp, Homo sapiens
aaacttttgttttttgggg

SEQ ID NO: 888720 - DNA, 17 bp, Homo sapiens
aaactttttccagcaaa

SEQ ID NO: 888721 - DNA, 16 bp, Homo sapiens
aaacttttttatatct

SEQ ID NO: 888722 - DNA, 17 bp, Homo sapiens
aaacttttttatatctt

SEQ ID NO: 888723 - DNA, 17 bp, Homo sapiens
aaacttttttatttaaa

SEQ ID NO: 888724 - DNA, 11 bp, Homo sapiens
aaagaaaaaaa

SEQ ID NO: 888725 - DNA, 17 bp, Homo sapiens
aaagaaaaaaaaaagat

SEQ ID NO: 888726 - DNA, 23 bp, Homo sapiens
aaagaaaaaaaaccatcaagttg

SEQ ID NO: 888727 - DNA, 18 bp, Homo sapiens
aaagaaaaaaaagaaagc

SEQ ID NO: 888728 - DNA, 15 bp, Homo sapiens
aaagaaaaaaagaaa

SEQ ID NO: 888729 - DNA, 15 bp, Homo sapiens
aaagaaaaaaattga

SEQ ID NO: 888730 - DNA, 19 bp, Homo sapiens
aaagaaaaatgcctgtctc

SEQ ID NO: 888731 - DNA, 9 bp, Homo sapiens
aaagaaaag

SEQ ID NO: 888732 - DNA, 16 bp, Homo sapiens
aaagaaaagaaaattt

SEQ ID NO: 888733 - DNA, 16 bp, Homo sapiens
aaagaaaagacatttt

SEQ ID NO: 888734 - DNA, 12 bp, Homo sapiens
aaagaaaaggca

SEQ ID NO: 888735 - DNA, 20 bp, Homo sapiens
aaagaaaagtattgtttgga

SEQ ID NO: 888736 - DNA, 23 bp, Homo sapiens
aaagaaaataatggagaatcact

SEQ ID NO: 888737 - DNA, 22 bp, Homo sapiens
aaagaaaataggggatggtcca

SEQ ID NO: 888738 - DNA, 12 bp, Homo sapiens
aaagaaaatatt

SEQ ID NO: 888739 - DNA, 13 bp, Homo sapiens
aaagaaaatggct

SEQ ID NO: 888740 - DNA, 13 bp, Homo sapiens
aaagaaaattgca

SEQ ID NO: 888741 - DNA, 22 bp, Homo sapiens
aaagaaaattgcatgaaactag

SEQ ID NO: 888742 - DNA, 12 bp, Homo sapiens
aaagaaaatttt

SEQ ID NO: 888743 - DNA, 18 bp, Homo sapiens
aaagaaacaagctgtgca

SEQ ID NO: 888744 - DNA, 15 bp, Homo sapiens
aaagaaacagctttc

SEQ ID NO: 888745 - DNA, 16 bp, Homo sapiens
aaagaaaccatgacaa

SEQ ID NO: 888746 - DNA, 21 bp, Homo sapiens
aaagaaacttaccaattgatg

SEQ ID NO: 888747 - DNA, 10 bp, Homo sapiens
aaagaaagaa

SEQ ID NO: 888748 - DNA, 12 bp, Homo sapiens
aaagaaagtgta

SEQ ID NO: 888749 - DNA, 13 bp, Homo sapiens
aaagaaagtgtat

SEQ ID NO: 888750 - DNA, 16 bp, Homo sapiens
aaagaaagtgtatttg

SEQ ID NO: 888751 - DNA, 15 bp, Homo sapiens
aaagaaatatacagt

SEQ ID NO: 888752 - DNA, 17 bp, Homo sapiens
aaagaaatatacagttt

SEQ ID NO: 888753 - DNA, 13 bp, Homo sapiens
aaagaaatatatt

SEQ ID NO: 888754 - DNA, 19 bp, Homo sapiens
aaagaaatatattattcat

SEQ ID NO: 888755 - DNA, 19 bp, Homo sapiens
aaagaaatctgtttcaaca

SEQ ID NO: 888756 - DNA, 20 bp, Homo sapiens
aaagaaatcttgtcttacca

SEQ ID NO: 888757 - DNA, 13 bp, Homo sapiens
aaagaaatgcaaa

SEQ ID NO: 888758 - DNA, 14 bp, Homo sapiens
aaagaaatgggcct

SEQ ID NO: 888759 - DNA, 16 bp, Homo sapiens
aaagaaatgggcctgc

SEQ ID NO: 888760 - DNA, 18 bp, Homo sapiens
aaagaaatgggcctgcct

SEQ ID NO: 888761 - DNA, 16 bp, Homo sapiens
aaagaacaaaaaaatc

SEQ ID NO: 888762 - DNA, 14 bp, Homo sapiens
aaagaacaaacaaa

SEQ ID NO: 888763 - DNA, 18 bp, Homo sapiens
aaagaacaaacaaaactt

SEQ ID NO: 888764 - DNA, 14 bp, Homo sapiens
aaagaacaaagctg

SEQ ID NO: 888765 - DNA, 21 bp, Homo sapiens
aaagaacatggacttgtatat

SEQ ID NO: 888766 - DNA, 22 bp, Homo sapiens
aaagaaccaaaagttttcctga

SEQ ID NO: 888767 - DNA, 23 bp, Homo sapiens
aaagaaccaacaacctcaactgc

SEQ ID NO: 888768 - DNA, 18 bp, Homo sapiens
aaagaacgctgatttaaa

SEQ ID NO: 888769 - DNA, 17 bp, Homo sapiens
aaagaacttactgatta

SEQ ID NO: 888770 - DNA, 18 bp, Homo sapiens
aaagaacttgatttgcat

SEQ ID NO: 888771 - DNA, 11 bp, Homo sapiens
aaagaagaaac

SEQ ID NO: 888772 - DNA, 17 bp, Homo sapiens
aaagaagaacttgcatg

SEQ ID NO: 888773 - DNA, 18 bp, Homo sapiens
aaagatctctgtcacatc

SEQ ID NO: 888774 - DNA, 17 bp, Homo sapiens
aaagatgaatttgtcca

SEQ ID NO: 888775 - DNA, 15 bp, Homo sapiens
aaagatgagtaattt

SEQ ID NO: 888776 - DNA, 15 bp, Homo sapiens
aaagatgagtgagca

SEQ ID NO: 888777 - DNA, 20 bp, Homo sapiens
aaagatgcaaggaccaggac

SEQ ID NO: 888778 - DNA, 17 bp, Homo sapiens
aaagatgccccattcct

SEQ ID NO: 888779 - DNA, 22 bp, Homo sapiens
aaagatgccccattccttgcgc

SEQ ID NO: 888780 - DNA, 19 bp, Homo sapiens
aaagatgcgtttgcctcct

SEQ ID NO: 888781 - DNA, 20 bp, Homo sapiens
aaagatgcgtttgcctcctg

SEQ ID NO: 888782 - DNA, 21 bp, Homo sapiens
aaagatgcgtttgcctcctgg

SEQ ID NO: 888783 - DNA, 18 bp, Homo sapiens
aaagatgctagaaaaatg

SEQ ID NO: 888784 - DNA, 17 bp, Homo sapiens
aaagatgctcttctgtg

SEQ ID NO: 888785 - DNA, 17 bp, Homo sapiens
aaagatgcttctcactg

SEQ ID NO: 888786 - DNA, 19 bp, Homo sapiens
aaagatgcttctcactgcc

SEQ ID NO: 888787 - DNA, 13 bp, Homo sapiens
aaagatggataaa

SEQ ID NO: 888788 - DNA, 21 bp, Homo sapiens
aaagatggataaactgagcct

SEQ ID NO: 888789 - DNA, 18 bp, Homo sapiens
aaagatggctcagagggg

SEQ ID NO: 888790 - DNA, 17 bp, Homo sapiens
aaagatggcttatgtca

SEQ ID NO: 888791 - DNA, 18 bp, Homo sapiens
aaagatggcttatgtcat

SEQ ID NO: 888792 - DNA, 16 bp, Homo sapiens
aaagatggttgtagca

SEQ ID NO: 888793 - DNA, 19 bp, Homo sapiens
aaagatgttaaatggaatt

SEQ ID NO: 888794 - DNA, 23 bp, Homo sapiens
aaagatgttaaatggaattcgtg

SEQ ID NO: 888795 - DNA, 19 bp, Homo sapiens
aaagatgttaagcatttat

SEQ ID NO: 888796 - DNA, 16 bp, Homo sapiens
aaagatgttctggata

SEQ ID NO: 888797 - DNA, 12 bp, Homo sapiens
aaagatgtttga

SEQ ID NO: 888798 - DNA, 14 bp, Homo sapiens
aaagatgtttgaaa

SEQ ID NO: 888799 - DNA, 15 bp, Homo sapiens
aaagatgtttgaaaa

SEQ ID NO: 888800 - DNA, 16 bp, Homo sapiens
aaagatgtttgaaaat

SEQ ID NO: 888801 - DNA, 21 bp, Homo sapiens
aaagatgtttgaaaatgctct

SEQ ID NO: 888802 - DNA, 20 bp, Homo sapiens
aaagatgtttgtcagatatg

SEQ ID NO: 888803 - DNA, 21 bp, Homo sapiens
aaagatgtttgtcagatatga

SEQ ID NO: 888804 - DNA, 19 bp, Homo sapiens
aaagattaaatgtgtcatt

SEQ ID NO: 888805 - DNA, 19 bp, Homo sapiens
aaagattacttagaggaaa

SEQ ID NO: 888806 - DNA, 20 bp, Homo sapiens
aaagattatctgattccttt

SEQ ID NO: 888807 - DNA, 23 bp, Homo sapiens
aaagattatgatgcatacagttt

SEQ ID NO: 888808 - DNA, 19 bp, Homo sapiens
aaagattctggggctgtgt

SEQ ID NO: 888809 - DNA, 23 bp, Homo sapiens
aaagattgaagtattttgctgga

SEQ ID NO: 888810 - DNA, 21 bp, Homo sapiens
aaagattgctgaaattttata

SEQ ID NO: 888811 - DNA, 15 bp, Homo sapiens
aaacagatttttaca

SEQ ID NO: 888812 - DNA, 16 bp, Homo sapiens
aaacagcagtttgtga

SEQ ID NO: 888813 - DNA, 12 bp, Homo sapiens
aaacagcatgaa

SEQ ID NO: 888814 - DNA, 19 bp, Homo sapiens
aaacagcatgaataaaaca

SEQ ID NO: 888815 - DNA, 14 bp, Homo sapiens
aaacagcattgctt

SEQ ID NO: 888816 - DNA, 17 bp, Homo sapiens
aaacagcattgctttct

SEQ ID NO: 888817 - DNA, 14 bp, Homo sapiens
aaacagccagcaag

SEQ ID NO: 888818 - DNA, 15 bp, Homo sapiens
aaacagccatgtcca

SEQ ID NO: 888819 - DNA, 21 bp, Homo sapiens
aaacagccccagtcttccttg

SEQ ID NO: 888820 - DNA, 21 bp, Homo sapiens
aaacagctattatatcagctt

SEQ ID NO: 888821 - DNA, 19 bp, Homo sapiens
aaacagctgaaagaggagg

SEQ ID NO: 888822 - DNA, 13 bp, Homo sapiens
aaacagctgcttc

SEQ ID NO: 888823 - DNA, 14 bp, Homo sapiens
aaacagctggtcct

SEQ ID NO: 888824 - DNA, 22 bp, Homo sapiens
aaacagcttcatgcctttgtaa

SEQ ID NO: 888825 - DNA, 14 bp, Homo sapiens
aaacagctttcaag

SEQ ID NO: 888826 - DNA, 19 bp, Homo sapiens
aaacagctttcaagtgcct

SEQ ID NO: 888827 - DNA, 14 bp, Homo sapiens
aaacaggaaaaaaa

SEQ ID NO: 888828 - DNA, 15 bp, Homo sapiens
aaacaggaaaaaaac

SEQ ID NO: 888829 - DNA, 14 bp, Homo sapiens
aaacaggaatttta

SEQ ID NO: 888830 - DNA, 16 bp, Homo sapiens
aaacaggaattttatt

SEQ ID NO: 888831 - DNA, 21 bp, Homo sapiens
aaacaggacttaaaatgacat

SEQ ID NO: 888832 - DNA, 16 bp, Homo sapiens
aaacaggagacaggaa

SEQ ID NO: 888833 - DNA, 21 bp, Homo sapiens
aaacaggagcaaatggcgttt

SEQ ID NO: 888834 - DNA, 13 bp, Homo sapiens
aaacaggcaaagt

SEQ ID NO: 888835 - DNA, 19 bp, Homo sapiens
aaacaggcaaagttttaca

SEQ ID NO: 888836 - DNA, 23 bp, Homo sapiens
aaacaggcaaagttttacagaga

SEQ ID NO: 888837 - DNA, 15 bp, Homo sapiens
aaacaggcccagcat

SEQ ID NO: 888838 - DNA, 17 bp, Homo sapiens
aaacagggtctcactct

SEQ ID NO: 888839 - DNA, 21 bp, Homo sapiens
aaacaggtatttttttaaatc

SEQ ID NO: 888840 - DNA, 13 bp, Homo sapiens
aaacagtacagaa

SEQ ID NO: 888841 - DNA, 20 bp, Homo sapiens
aaacagtagttgtattcttc

SEQ ID NO: 888842 - DNA, 23 bp, Homo sapiens
aaacagtagttgtattcttctgt

SEQ ID NO: 888843 - DNA, 17 bp, Homo sapiens
aaacagtctaaagaaga

SEQ ID NO: 888844 - DNA, 19 bp, Homo sapiens
aaacagtcttactctgtct

SEQ ID NO: 888845 - DNA, 18 bp, Homo sapiens
aaacagtgggagccctga

SEQ ID NO: 888846 - DNA, 20 bp, Homo sapiens
aaacagtgggagccctgacc

SEQ ID NO: 888847 - DNA, 18 bp, Homo sapiens
aaacagttgcatgtagta

SEQ ID NO: 888848 - DNA, 19 bp, Homo sapiens
aaacagttgcatgtagtaa

SEQ ID NO: 888849 - DNA, 23 bp, Homo sapiens
aaacagttgctgtgaactttcat

SEQ ID NO: 888850 - DNA, 20 bp, Homo sapiens
aaacataatcttctgccttc

SEQ ID NO: 888851 - DNA, 12 bp, Homo sapiens
aaacataattgt

SEQ ID NO: 888852 - DNA, 16 bp, Homo sapiens
aaacataattgtggat

SEQ ID NO: 888853 - DNA, 20 bp, Homo sapiens
aaacatacttacatttcaga

SEQ ID NO: 888854 - DNA, 21 bp, Homo sapiens
aaacatagaaatggaaatttt

SEQ ID NO: 888855 - DNA, 17 bp, Homo sapiens
aaacatatttttatact

SEQ ID NO: 888856 - DNA, 19 bp, Homo sapiens
aaacatatttttatacttt

SEQ ID NO: 888857 - DNA, 16 bp, Homo sapiens
aaacatcaaataaatt

SEQ ID NO: 888858 - DNA, 16 bp, Homo sapiens
aaacatcagacctgtc

SEQ ID NO: 888859 - DNA, 20 bp, Homo sapiens
aaacatcagttactctgaag

SEQ ID NO: 888860 - DNA, 17 bp, Homo sapiens
aaacatccaatattttc

SEQ ID NO: 888861 - DNA, 19 bp, Homo sapiens
aaacatccacttaagttct

SEQ ID NO: 888862 - DNA, 19 bp, Homo sapiens
aaacatcccaaactttaaa

SEQ ID NO: 888863 - DNA, 21 bp, Homo sapiens
aaacatcccaaactttaaaat

SEQ ID NO: 888864 - DNA, 23 bp, Homo sapiens
aaacatctcatcatgtctattgt

SEQ ID NO: 888865 - DNA, 12 bp, Homo sapiens
aaacatctctgg

SEQ ID NO: 888866 - DNA, 12 bp, Homo sapiens
aaacatgaaact

SEQ ID NO: 888867 - DNA, 20 bp, Homo sapiens
aaacatgactctttattgtc

SEQ ID NO: 888868 - DNA, 12 bp, Homo sapiens
aaacatgcacac

SEQ ID NO: 888869 - DNA, 20 bp, Homo sapiens
aaacatggaaaacagagtat

SEQ ID NO: 888870 - DNA, 18 bp, Homo sapiens
aaacatggatacttcctg

SEQ ID NO: 888871 - DNA, 22 bp, Homo sapiens
aaacatggatacttcctgggtc

SEQ ID NO: 888872 - DNA, 22 bp, Homo sapiens
aaacatggggttggctgggccc

SEQ ID NO: 888873 - DNA, 15 bp, Homo sapiens
aaacatggttacaat

SEQ ID NO: 888874 - DNA, 19 bp, Homo sapiens
aaacatgtaaatacaaatt

SEQ ID NO: 888875 - DNA, 18 bp, Homo sapiens
aaacatgtacaaaatcga

SEQ ID NO: 888876 - DNA, 13 bp, Homo sapiens
aaacatgtatgtg

SEQ ID NO: 888877 - DNA, 16 bp, Homo sapiens
aaacatgttagaagca

SEQ ID NO: 888878 - DNA, 12 bp, Homo sapiens
aaacatgtttaa

SEQ ID NO: 888879 - DNA, 22 bp, Homo sapiens
aaacatgtttaaatagcctaaa

SEQ ID NO: 888880 - DNA, 14 bp, Homo sapiens
aaacattaaaatat

SEQ ID NO: 888881 - DNA, 18 bp, Homo sapiens
aaacattaaacactgtaa

SEQ ID NO: 888882 - DNA, 16 bp, Homo sapiens
aaacattaagaaaatc

SEQ ID NO: 888883 - DNA, 18 bp, Homo sapiens
aaacattaagaaaatcat

SEQ ID NO: 888884 - DNA, 19 bp, Homo sapiens
aaacattaagaaaatcata

SEQ ID NO: 888885 - DNA, 20 bp, Homo sapiens
aaacattaagattgaggcct

SEQ ID NO: 888886 - DNA, 18 bp, Homo sapiens
aaacattaattttgtgca

SEQ ID NO: 888887 - DNA, 19 bp, Homo sapiens
aaacattaattttgtgcat

SEQ ID NO: 888888 - DNA, 20 bp, Homo sapiens
aaacattaattttgtgcatt

SEQ ID NO: 888889 - DNA, 23 bp, Homo sapiens
aaacattcacacagggctctttg

SEQ ID NO: 888890 - DNA, 17 bp, Homo sapiens
aaacattcatgtaactc

SEQ ID NO: 888891 - DNA, 22 bp, Homo sapiens
aaacattcatgtaactctccag

SEQ ID NO: 888892 - DNA, 17 bp, Homo sapiens
aaacattcgtgagctgg

SEQ ID NO: 888893 - DNA, 23 bp, Homo sapiens
aaacattcttttaacttctttct

SEQ ID NO: 888894 - DNA, 20 bp, Homo sapiens
aaacattgaagtaatgaatt

SEQ ID NO: 888895 - DNA, 18 bp, Homo sapiens
aaacattgcctttgaatg

SEQ ID NO: 888896 - DNA, 19 bp, Homo sapiens
aaacattgcctttgaatgt

SEQ ID NO: 888897 - DNA, 14 bp, Homo sapiens
aaacattgcttttg

SEQ ID NO: 888898 - DNA, 11 bp, Homo sapiens
aaacattgtaa

SEQ ID NO: 888899 - DNA, 13 bp, Homo sapiens
aaacattgtaaat

SEQ ID NO: 888900 - DNA, 16 bp, Homo sapiens
aaacatttaaactttt

SEQ ID NO: 888901 - DNA, 12 bp, Homo sapiens
aaacatttaaca

SEQ ID NO: 888902 - DNA, 15 bp, Homo sapiens
aaacatttaacataa

SEQ ID NO: 888903 - DNA, 22 bp, Homo sapiens
aaacatttacaataaatattct

SEQ ID NO: 888904 - DNA, 14 bp, Homo sapiens
aaacatttattttg

SEQ ID NO: 888905 - DNA, 23 bp, Homo sapiens
aaacatttattttttttaaagaa

SEQ ID NO: 888906 - DNA, 15 bp, Homo sapiens
aaacatttgccaagt

SEQ ID NO: 888907 - DNA, 14 bp, Homo sapiens
aaacattttaaaaa

SEQ ID NO: 888908 - DNA, 19 bp, Homo sapiens
aaacattttaaatgaaagt

SEQ ID NO: 888909 - DNA, 23 bp, Homo sapiens
aaacattttatttttaaaatatt

SEQ ID NO: 888910 - DNA, 16 bp, Homo sapiens
aaacattttctggcca

SEQ ID NO: 888911 - DNA, 13 bp, Homo sapiens
aaacattttgact

SEQ ID NO: 888912 - DNA, 15 bp, Homo sapiens
aaacattttgtatca

SEQ ID NO: 888913 - DNA, 22 bp, Homo sapiens
aaacattttttaaggagggaga

SEQ ID NO: 888914 - DNA, 20 bp, Homo sapiens
aaacattttttagtctgtaa

SEQ ID NO: 888915 - DNA, 12 bp, Homo sapiens
aaaccaaaaaga

SEQ ID NO: 888916 - DNA, 11 bp, Homo sapiens
aaaccaaaaca

SEQ ID NO: 888917 - DNA, 15 bp, Homo sapiens
aaaccaaacccagcc

SEQ ID NO: 888918 - DNA, 16 bp, Homo sapiens
aaacgttttattgtgt

SEQ ID NO: 888919 - DNA, 17 bp, Homo sapiens
aaactaaaaaaaaaaag

SEQ ID NO: 888920 - DNA, 19 bp, Homo sapiens
aaactaaaaaaaaaaaggc

SEQ ID NO: 888921 - DNA, 20 bp, Homo sapiens
aaactaaaaaaaaaaaggcc

SEQ ID NO: 888922 - DNA, 20 bp, Homo sapiens
aaactaaataatgaataaac

SEQ ID NO: 888923 - DNA, 13 bp, Homo sapiens
aaactaaatatat

SEQ ID NO: 888924 - DNA, 14 bp, Homo sapiens
aaactaaattactg

SEQ ID NO: 888925 - DNA, 21 bp, Homo sapiens
aaactaaccagcattccctac

SEQ ID NO: 888926 - DNA, 15 bp, Homo sapiens
aaactaagattcttt

SEQ ID NO: 888927 - DNA, 12 bp, Homo sapiens
aaactaatacgt

SEQ ID NO: 888928 - DNA, 11 bp, Homo sapiens
aaactaatcca

SEQ ID NO: 888929 - DNA, 16 bp, Homo sapiens
aaactaatgagtatga

SEQ ID NO: 888930 - DNA, 15 bp, Homo sapiens
aaactaatgtactgt

SEQ ID NO: 888931 - DNA, 19 bp, Homo sapiens
aaactaatgtactgtacat

SEQ ID NO: 888932 - DNA, 12 bp, Homo sapiens
aaactacaaata

SEQ ID NO: 888933 - DNA, 17 bp, Homo sapiens
aaactacagaataatgt

SEQ ID NO: 888934 - DNA, 15 bp, Homo sapiens
aaactacatattgta

SEQ ID NO: 888935 - DNA, 16 bp, Homo sapiens
aaactacatcttgaaa

SEQ ID NO: 888936 - DNA, 14 bp, Homo sapiens
aaactacctctgga

SEQ ID NO: 888937 - DNA, 12 bp, Homo sapiens
aaactactcttt

SEQ ID NO: 888938 - DNA, 19 bp, Homo sapiens
aaactactgcctttagaaa

SEQ ID NO: 888939 - DNA, 15 bp, Homo sapiens
aaactactgtacatt

SEQ ID NO: 888940 - DNA, 19 bp, Homo sapiens
aaactactgtacatttttt

SEQ ID NO: 888941 - DNA, 16 bp, Homo sapiens
aaccagaacagtatga

SEQ ID NO: 888942 - DNA, 21 bp, Homo sapiens
aaccagaattgtcctcaaggc

SEQ ID NO: 888943 - DNA, 14 bp, Homo sapiens
aaccagactcttgc

SEQ ID NO: 888944 - DNA, 15 bp, Homo sapiens
aaccagactttgaaa

SEQ ID NO: 888945 - DNA, 19 bp, Homo sapiens
aaccagcaagtcccagaca

SEQ ID NO: 888946 - DNA, 23 bp, Homo sapiens
aaccagcaagtcccagacaagga

SEQ ID NO: 888947 - DNA, 18 bp, Homo sapiens
aaccagcatctcagcgcc

SEQ ID NO: 888948 - DNA, 19 bp, Homo sapiens
aaccagcatctcagcgcca

SEQ ID NO: 888949 - DNA, 14 bp, Homo sapiens
aaccagcattccct

SEQ ID NO: 888950 - DNA, 15 bp, Homo sapiens
aaccagccaggcaga

SEQ ID NO: 888951 - DNA, 12 bp, Homo sapiens
aaccagcccagc

SEQ ID NO: 888952 - DNA, 14 bp, Homo sapiens
aaccagcccagcct

SEQ ID NO: 888953 - DNA, 14 bp, Homo sapiens
aaccagctaagaaa

SEQ ID NO: 888954 - DNA, 14 bp, Homo sapiens
aaccagctcatctc

SEQ ID NO: 888955 - DNA, 20 bp, Homo sapiens
aaccagctcgtgggctggga

SEQ ID NO: 888956 - DNA, 16 bp, Homo sapiens
aaccagctggaaggta

SEQ ID NO: 888957 - DNA, 13 bp, Homo sapiens
aaccaggaaaaaa

SEQ ID NO: 888958 - DNA, 18 bp, Homo sapiens
aaccaggcacctcttcct

SEQ ID NO: 888959 - DNA, 11 bp, Homo sapiens
aaccaggcagc

SEQ ID NO: 888960 - DNA, 14 bp, Homo sapiens
aaccaggcagctga

SEQ ID NO: 888961 - DNA, 17 bp, Homo sapiens
aaccaggccccagcctc

SEQ ID NO: 888962 - DNA, 22 bp, Homo sapiens
aaccaggccccagcctccaggc

SEQ ID NO: 888963 - DNA, 23 bp, Homo sapiens
aaccaggccctgccattggcctc

SEQ ID NO: 888964 - DNA, 21 bp, Homo sapiens
aaccagggagcccctttgatg

SEQ ID NO: 888965 - DNA, 21 bp, Homo sapiens
aaccagggcctccctgttcac

SEQ ID NO: 888966 - DNA, 19 bp, Homo sapiens
aaccaggtcagtctgtctc

SEQ ID NO: 888967 - DNA, 19 bp, Homo sapiens
aaccagtctcctcactctg

SEQ ID NO: 888968 - DNA, 14 bp, Homo sapiens
aaccagtgtagcct

SEQ ID NO: 888969 - DNA, 16 bp, Homo sapiens
aaccagttaaagccac

SEQ ID NO: 888970 - DNA, 14 bp, Homo sapiens
aaccagttatgtga

SEQ ID NO: 888971 - DNA, 18 bp, Homo sapiens
aaccagtttcaggtgttt

SEQ ID NO: 888972 - DNA, 15 bp, Homo sapiens
aaccatcacagctgg

SEQ ID NO: 888973 - DNA, 18 bp, Homo sapiens
aaccatcagatatttctt

SEQ ID NO: 888974 - DNA, 16 bp, Homo sapiens
aaccatcctgtttgaa

SEQ ID NO: 888975 - DNA, 19 bp, Homo sapiens
aaccatcttgtgtctttgg

SEQ ID NO: 888976 - DNA, 15 bp, Homo sapiens
aaccatgaagacagg

SEQ ID NO: 888977 - DNA, 16 bp, Homo sapiens
aaccatgaagacagga

SEQ ID NO: 888978 - DNA, 21 bp, Homo sapiens
aaccatgacaaacctagcttt

SEQ ID NO: 888979 - DNA, 12 bp, Homo sapiens
aaccatgactgt

SEQ ID NO: 888980 - DNA, 15 bp, Homo sapiens
aaccatgactgtgac

SEQ ID NO: 888981 - DNA, 20 bp, Homo sapiens
aaccatgcctggtattttca

SEQ ID NO: 888982 - DNA, 16 bp, Homo sapiens
aaccatggctgaagga

SEQ ID NO: 888983 - DNA, 13 bp, Homo sapiens
aaccattaaagtc

SEQ ID NO: 888984 - DNA, 15 bp, Homo sapiens
aaccattaaagtcag

SEQ ID NO: 888985 - DNA, 23 bp, Homo sapiens
aaccattccatttccaagcactt

SEQ ID NO: 888986 - DNA, 13 bp, Homo sapiens
aaccattgcttca

SEQ ID NO: 888987 - DNA, 14 bp, Homo sapiens
aaccattgcttcac

SEQ ID NO: 888988 - DNA, 13 bp, Homo sapiens
aaccattggacag

SEQ ID NO: 888989 - DNA, 16 bp, Homo sapiens
aaccattggacagatt

SEQ ID NO: 888990 - DNA, 14 bp, Homo sapiens
aaccattgttctga

SEQ ID NO: 888991 - DNA, 23 bp, Homo sapiens
aaccatttgaagtgtacctgtgt

SEQ ID NO: 888992 - DNA, 22 bp, Homo sapiens
aaccatttgggatggagaagca

SEQ ID NO: 888993 - DNA, 18 bp, Homo sapiens
aaccattttattttttgg

SEQ ID NO: 888994 - DNA, 21 bp, Homo sapiens
aaccattttattttttgggcc

SEQ ID NO: 888995 - DNA, 21 bp, Homo sapiens
aaccattttcccatcatcctt

SEQ ID NO: 888996 - DNA, 14 bp, Homo sapiens
aaccatttttgtta

SEQ ID NO: 888997 - DNA, 22 bp, Homo sapiens
aaccatttttgttactctcttc

SEQ ID NO: 888998 - DNA, 11 bp, Homo sapiens
aacccaacagt

SEQ ID NO: 888999 - DNA, 15 bp, Homo sapiens
aacccaagacatcat

SEQ ID NO: 889000 - DNA, 16 bp, Homo sapiens
aacccaagcaacattt

SEQ ID NO: 889001 - DNA, 14 bp, Homo sapiens
aacccaagctcctc

SEQ ID NO: 889002 - DNA, 17 bp, Homo sapiens
aacccaaggagcacagg

SEQ ID NO: 889003 - DNA, 20 bp, Homo sapiens
aacccaaggagcacaggtcc

SEQ ID NO: 889004 - DNA, 21 bp, Homo sapiens
aacccaaggagcacaggtccc

SEQ ID NO: 889005 - DNA, 22 bp, Homo sapiens
aacccaaggagcacaggtccca

SEQ ID NO: 889006 - DNA, 22 bp, Homo sapiens
aacccaaggtgggtagatcacg

SEQ ID NO: 889007 - DNA, 14 bp, Homo sapiens
aacccaagtgcctc

SEQ ID NO: 889008 - DNA, 14 bp, Homo sapiens
aacccaagtgctgc

SEQ ID NO: 889009 - DNA, 16 bp, Homo sapiens
aacccaatccctctcc

SEQ ID NO: 889010 - DNA, 17 bp, Homo sapiens
aacccaatccctctcca

SEQ ID NO: 889011 - DNA, 17 bp, Homo sapiens
aacccacaagctgcctc

SEQ ID NO: 889012 - DNA, 22 bp, Homo sapiens
aacccacaagctgcctctgaca

SEQ ID NO: 889013 - DNA, 18 bp, Homo sapiens
aacccacaccgtcttcct

SEQ ID NO: 889014 - DNA, 19 bp, Homo sapiens
aacccacaccgtcttcctt

SEQ ID NO: 889015 - DNA, 14 bp, Homo sapiens
aacccacacctggg

SEQ ID NO: 889016 - DNA, 14 bp, Homo sapiens
aacccacctgctga

SEQ ID NO: 889017 - DNA, 20 bp, Homo sapiens
aacccacttctggcctccag

SEQ ID NO: 889018 - DNA, 19 bp, Homo sapiens
aacccagacaaccaaaaca

SEQ ID NO: 889019 - DNA, 22 bp, Homo sapiens
aacccagacctgttagcagaca

SEQ ID NO: 889020 - DNA, 11 bp, Homo sapiens
aacccagagag

SEQ ID NO: 889021 - DNA, 13 bp, Homo sapiens
aacccagattttg

SEQ ID NO: 889022 - DNA, 17 bp, Homo sapiens
aacccagcaacagaaaa

SEQ ID NO: 889023 - DNA, 22 bp, Homo sapiens
aacccagcggcttagccaagcc

SEQ ID NO: 889024 - DNA, 23 bp, Homo sapiens
aacccagcggcttagccaagccc

SEQ ID NO: 889025 - DNA, 11 bp, Homo sapiens
aacccaggagg

SEQ ID NO: 889026 - DNA, 21 bp, Homo sapiens
aacccagggctctgccccagt

SEQ ID NO: 889027 - DNA, 21 bp, Homo sapiens
aacccagtcttgtggatggaa

SEQ ID NO: 889028 - DNA, 12 bp, Homo sapiens
aacccagttact

SEQ ID NO: 889029 - DNA, 15 bp, Homo sapiens
aacccagttgccatc

SEQ ID NO: 889030 - DNA, 16 bp, Homo sapiens
aacccatacaatgtat

SEQ ID NO: 889031 - DNA, 22 bp, Homo sapiens
aacccatacaatgtatgtacaa

SEQ ID NO: 889032 - DNA, 21 bp, Homo sapiens
aacccatcggtaggcaaagga

SEQ ID NO: 889033 - DNA, 11 bp, Homo sapiens
aaccccagccc

SEQ ID NO: 889034 - DNA, 12 bp, Homo sapiens
aaccccagttct

SEQ ID NO: 889035 - DNA, 21 bp, Homo sapiens
aacgggcatgggcctctctgg

SEQ ID NO: 889036 - DNA, 15 bp, Homo sapiens
aacgggctgccctgc

SEQ ID NO: 889037 - DNA, 15 bp, Homo sapiens
aacggggtggggagg

SEQ ID NO: 889038 - DNA, 23 bp, Homo sapiens
aacggtatcctccctgcccatcc

SEQ ID NO: 889039 - DNA, 18 bp, Homo sapiens
aacggtgcccatcctgcc

SEQ ID NO: 889040 - DNA, 14 bp, Homo sapiens
aacggtgctaaaaa

SEQ ID NO: 889041 - DNA, 20 bp, Homo sapiens
aacggtgctaaaaatgaaaa

SEQ ID NO: 889042 - DNA, 17 bp, Homo sapiens
aacgtaaccacggaaaa

SEQ ID NO: 889043 - DNA, 18 bp, Homo sapiens
aacgtatgcatgtgaaga

SEQ ID NO: 889044 - DNA, 22 bp, Homo sapiens
aacgtattcagagttagatatt

SEQ ID NO: 889045 - DNA, 18 bp, Homo sapiens
aacgtgaaacttatagtt

SEQ ID NO: 889046 - DNA, 20 bp, Homo sapiens
aacgtgatgatcagctgttt

SEQ ID NO: 889047 - DNA, 15 bp, Homo sapiens
aacgtgatgtgccac

SEQ ID NO: 889048 - DNA, 14 bp, Homo sapiens
aacgtgcccccaga

SEQ ID NO: 889049 - DNA, 19 bp, Homo sapiens
aacgtggattttaaaaaat

SEQ ID NO: 889050 - DNA, 22 bp, Homo sapiens
aacgtggattttaaaaaatcaa

SEQ ID NO: 889051 - DNA, 22 bp, Homo sapiens
aacgtggctccaccttgatggg

SEQ ID NO: 889052 - DNA, 15 bp, Homo sapiens
aacgtggctctgctg

SEQ ID NO: 889053 - DNA, 17 bp, Homo sapiens
aacgtggctctgctggc

SEQ ID NO: 889054 - DNA, 20 bp, Homo sapiens
aacgtgggcttaaagcagaa

SEQ ID NO: 889055 - DNA, 23 bp, Homo sapiens
aacgtgtcagaatcctttacatt

SEQ ID NO: 889056 - DNA, 15 bp, Homo sapiens
aacgttgccacacca

SEQ ID NO: 889057 - DNA, 13 bp, Homo sapiens
aacgttttattgt

SEQ ID NO: 889058 - DNA, 17 bp, Homo sapiens
aacgttttcttctttcc

SEQ ID NO: 889059 - DNA, 18 bp, Homo sapiens
aacgttttcttctttccc

SEQ ID NO: 889060 - DNA, 19 bp, Homo sapiens
aacgttttcttctttccct

SEQ ID NO: 889061 - DNA, 20 bp, Homo sapiens
aacgttttgaactaataaaa

SEQ ID NO: 889062 - DNA, 17 bp, Homo sapiens
aactaaaaataaattaa

SEQ ID NO: 889063 - DNA, 12 bp, Homo sapiens
aactaaaatgta

SEQ ID NO: 889064 - DNA, 20 bp, Homo sapiens
aactaaataaacagatgtat

SEQ ID NO: 889065 - DNA, 13 bp, Homo sapiens
aactaaatatatg

SEQ ID NO: 889066 - DNA, 22 bp, Homo sapiens
aactaaatgctcatacacagtt

SEQ ID NO: 889067 - DNA, 21 bp, Homo sapiens
aactaaatgtgcaatagaagg

SEQ ID NO: 889068 - DNA, 12 bp, Homo sapiens
aactaaattact

SEQ ID NO: 889069 - DNA, 14 bp, Homo sapiens
aactaaattactgt

SEQ ID NO: 889070 - DNA, 14 bp, Homo sapiens
aactaaattttaaa

SEQ ID NO: 889071 - DNA, 18 bp, Homo sapiens
aactaaattttaaagcca

SEQ ID NO: 889072 - DNA, 18 bp, Homo sapiens
aactaaatttttcataga

SEQ ID NO: 889073 - DNA, 14 bp, Homo sapiens
aactaacatgtcct

SEQ ID NO: 889074 - DNA, 18 bp, Homo sapiens
aactaacctggtatttta

SEQ ID NO: 889075 - DNA, 14 bp, Homo sapiens
aactaagactcccg

SEQ ID NO: 889076 - DNA, 17 bp, Homo sapiens
aactccaggggcaccta

SEQ ID NO: 889077 - DNA, 18 bp, Homo sapiens
aactccagggtcccctgc

SEQ ID NO: 889078 - DNA, 20 bp, Homo sapiens
aactccatcgccatcttctt

SEQ ID NO: 889079 - DNA, 17 bp, Homo sapiens
aactccccttccctggg

SEQ ID NO: 889080 - DNA, 22 bp, Homo sapiens
aactccccttccctggggagcc

SEQ ID NO: 889081 - DNA, 23 bp, Homo sapiens
aactccccttccctggggagccc

SEQ ID NO: 889082 - DNA, 19 bp, Homo sapiens
aactccccttcctcactgc

SEQ ID NO: 889083 - DNA, 16 bp, Homo sapiens
aactccctccaccagc

SEQ ID NO: 889084 - DNA, 13 bp, Homo sapiens
aactccgagagca

SEQ ID NO: 889085 - DNA, 16 bp, Homo sapiens
aactccgcccagcctc

SEQ ID NO: 889086 - DNA, 17 bp, Homo sapiens
aactccgcccagcctct

SEQ ID NO: 889087 - DNA, 13 bp, Homo sapiens
aactcctaatttt

SEQ ID NO: 889088 - DNA, 17 bp, Homo sapiens
aactcctaattttaaat

SEQ ID NO: 889089 - DNA, 22 bp, Homo sapiens
aactcctcacacaccctgaggt

SEQ ID NO: 889090 - DNA, 17 bp, Homo sapiens
aactcctgaaattcaga

SEQ ID NO: 889091 - DNA, 16 bp, Homo sapiens
aactcctgacagtctt

SEQ ID NO: 889092 - DNA, 18 bp, Homo sapiens
aactcctgagaaatgtta

SEQ ID NO: 889093 - DNA, 18 bp, Homo sapiens
aactcctggaaatatcag

SEQ ID NO: 889094 - DNA, 17 bp, Homo sapiens
aactccttcctggcctg

SEQ ID NO: 889095 - DNA, 24 bp, Homo sapiens
aactccttgttagcccttcagatt

SEQ ID NO: 889096 - DNA, 19 bp, Homo sapiens
aactccttttgctgtcttt

SEQ ID NO: 889097 - DNA, 20 bp, Homo sapiens
aactccttttgctgtctttc

SEQ ID NO: 889098 - DNA, 17 bp, Homo sapiens
aactcgatgcactgacc

SEQ ID NO: 889099 - DNA, 19 bp, Homo sapiens
aactctaaaagatcctttt

SEQ ID NO: 889100 - DNA, 15 bp, Homo sapiens
aactctaatagtgct

SEQ ID NO: 889101 - DNA, 19 bp, Homo sapiens
aactctagctgggggtggg

SEQ ID NO: 889102 - DNA, 17 bp, Homo sapiens
aactctagggatataaa

SEQ ID NO: 889103 - DNA, 21 bp, Homo sapiens
aactctatcagcattgtttca

SEQ ID NO: 889104 - DNA, 22 bp, Homo sapiens
aactctattaatgaggtcttta

SEQ ID NO: 889105 - DNA, 19 bp, Homo sapiens
aactctcaagctaagtaaa

SEQ ID NO: 889106 - DNA, 11 bp, Homo sapiens
aactctcactc

SEQ ID NO: 889107 - DNA, 19 bp, Homo sapiens
aactctccccagtgcctgc

SEQ ID NO: 889108 - DNA, 23 bp, Homo sapiens
aactctccccagtgcctgccact

SEQ ID NO: 889109 - DNA, 20 bp, Homo sapiens
aactctccttttccttacca

SEQ ID NO: 889110 - DNA, 12 bp, Homo sapiens
aactctctccac

SEQ ID NO: 889111 - DNA, 22 bp, Homo sapiens
aactctctccaccctatatgta

SEQ ID NO: 889112 - DNA, 12 bp, Homo sapiens
aactctctgaac

SEQ ID NO: 889113 - DNA, 20 bp, Homo sapiens
aactctctggaagcccctgg

SEQ ID NO: 889114 - DNA, 16 bp, Homo sapiens
aactctctgtcttctc

SEQ ID NO: 889115 - DNA, 19 bp, Homo sapiens
aactctctgtcttctctcc

SEQ ID NO: 889116 - DNA, 13 bp, Homo sapiens
aactctctttcct

SEQ ID NO: 889117 - DNA, 13 bp, Homo sapiens
aactctgaagcta

SEQ ID NO: 889118 - DNA, 11 bp, Homo sapiens
aactctgaagg

SEQ ID NO: 889119 - DNA, 18 bp, Homo sapiens
aactctgagcccatactt

SEQ ID NO: 889120 - DNA, 20 bp, Homo sapiens
aactctgcactccatggcca

SEQ ID NO: 889121 - DNA, 22 bp, Homo sapiens
aactctgcactccatggccacc

SEQ ID NO: 889122 - DNA, 16 bp, Homo sapiens
aactctgcattctagt

SEQ ID NO: 889123 - DNA, 16 bp, Homo sapiens
aactctgcccaccctc

SEQ ID NO: 889124 - DNA, 22 bp, Homo sapiens
aactctgcctttatgatgctaa

SEQ ID NO: 889125 - DNA, 13 bp, Homo sapiens
aactctgcggata

SEQ ID NO: 889126 - DNA, 17 bp, Homo sapiens
aactctggcttccaggt

SEQ ID NO: 889127 - DNA, 21 bp, Homo sapiens
aactctgggctgctacccaga

SEQ ID NO: 889128 - DNA, 22 bp, Homo sapiens
aactctgggctgctacccagaa

SEQ ID NO: 889129 - DNA, 14 bp, Homo sapiens
aactctggggcttg

SEQ ID NO: 889130 - DNA, 12 bp, Homo sapiens
aactctgggtct

SEQ ID NO: 889131 - DNA, 19 bp, Homo sapiens
aactctggtgataaaaata

SEQ ID NO: 889132 - DNA, 18 bp, Homo sapiens
aactctgtattacagctt

SEQ ID NO: 889133 - DNA, 15 bp, Homo sapiens
aactctgttccccca

SEQ ID NO: 889134 - DNA, 18 bp, Homo sapiens
aactcttaaatacttttt

SEQ ID NO: 889135 - DNA, 17 bp, Homo sapiens
aactcttaatctgtgtg

SEQ ID NO: 889136 - DNA, 18 bp, Homo sapiens
aactcttaggcacatcaa

SEQ ID NO: 889137 - DNA, 18 bp, Homo sapiens
aactcttcacaaaatctg

SEQ ID NO: 889138 - DNA, 14 bp, Homo sapiens
aactcttcctcccc

SEQ ID NO: 889139 - DNA, 18 bp, Homo sapiens
aactcttcctcccctctc

SEQ ID NO: 889140 - DNA, 19 bp, Homo sapiens
aactcttcctcccctctca

SEQ ID NO: 889141 - DNA, 16 bp, Homo sapiens
aactcttctttgctgc

SEQ ID NO: 889142 - DNA, 13 bp, Homo sapiens
aactctttcaaaa

SEQ ID NO: 889143 - DNA, 18 bp, Homo sapiens
aactctttcaaattatat

SEQ ID NO: 889144 - DNA, 15 bp, Homo sapiens
aactctttgttattt

SEQ ID NO: 889145 - DNA, 16 bp, Homo sapiens
aactgaaaaatgtcag

SEQ ID NO: 889146 - DNA, 19 bp, Homo sapiens
aactgaaaatctaatatta

SEQ ID NO: 889147 - DNA, 14 bp, Homo sapiens
aactgaaaatgtaa

SEQ ID NO: 889148 - DNA, 17 bp, Homo sapiens
aactgaaaattatttaa

SEQ ID NO: 889149 - DNA, 13 bp, Homo sapiens
aacttattatttt

SEQ ID NO: 889150 - DNA, 13 bp, Homo sapiens
aacttattctgta

SEQ ID NO: 889151 - DNA, 19 bp, Homo sapiens
aacttatttaaaaatattt

SEQ ID NO: 889152 - DNA, 21 bp, Homo sapiens
aacttatttaaaaatatttca

SEQ ID NO: 889153 - DNA, 14 bp, Homo sapiens
aacttatttttcac

SEQ ID NO: 889154 - DNA, 19 bp, Homo sapiens
aacttcaaagctgaatatt

SEQ ID NO: 889155 - DNA, 13 bp, Homo sapiens
aacttcaagaagt

SEQ ID NO: 889156 - DNA, 22 bp, Homo sapiens
aacttcacatattgatttccgt

SEQ ID NO: 889157 - DNA, 22 bp, Homo sapiens
aacttcaccatattaccacaga

SEQ ID NO: 889158 - DNA, 14 bp, Homo sapiens
aacttcagaaagac

SEQ ID NO: 889159 - DNA, 22 bp, Homo sapiens
aacttcagagggaaagtaaata

SEQ ID NO: 889160 - DNA, 17 bp, Homo sapiens
aacttcagctgtacttc

SEQ ID NO: 889161 - DNA, 20 bp, Homo sapiens
aacttcagtaggatttatgt

SEQ ID NO: 889162 - DNA, 14 bp, Homo sapiens
aacttcatgtaatt

SEQ ID NO: 889163 - DNA, 16 bp, Homo sapiens
aacttcatgtaatttt

SEQ ID NO: 889164 - DNA, 20 bp, Homo sapiens
aacttcatgtcaacttctgg

SEQ ID NO: 889165 - DNA, 13 bp, Homo sapiens
aacttcatttgac

SEQ ID NO: 889166 - DNA, 22 bp, Homo sapiens
aacttcatttgacacaaagctt

SEQ ID NO: 889167 - DNA, 14 bp, Homo sapiens
aacttccaaagaaa

SEQ ID NO: 889168 - DNA, 16 bp, Homo sapiens
aacttccaaagaaagt

SEQ ID NO: 889169 - DNA, 17 bp, Homo sapiens
aacttccaaagaaagtt

SEQ ID NO: 889170 - DNA, 10 bp, Homo sapiens
aacttccaag

SEQ ID NO: 889171 - DNA, 15 bp, Homo sapiens
aacttccacaagagt

SEQ ID NO: 889172 - DNA, 18 bp, Homo sapiens
aacttccccatcttctaa

SEQ ID NO: 889173 - DNA, 23 bp, Homo sapiens
aacttcccgtcccatatcctgcc

SEQ ID NO: 889174 - DNA, 22 bp, Homo sapiens
aacttcctcccttacagagcat

SEQ ID NO: 889175 - DNA, 11 bp, Homo sapiens
aacttcctgct

SEQ ID NO: 889176 - DNA, 19 bp, Homo sapiens
aacttcctgctgcaccctg

SEQ ID NO: 889177 - DNA, 17 bp, Homo sapiens
aacttcctgtgcctttc

SEQ ID NO: 889178 - DNA, 18 bp, Homo sapiens
aacttcctgtgcctttcc

SEQ ID NO: 889179 - DNA, 19 bp, Homo sapiens
aacttcctgtgcctttcct

SEQ ID NO: 889180 - DNA, 16 bp, Homo sapiens
aacttcgctagaaaaa

SEQ ID NO: 889181 - DNA, 20 bp, Homo sapiens
aacttctatgttggtttcag

SEQ ID NO: 889182 - DNA, 19 bp, Homo sapiens
aacttctcctgaatgcatc

SEQ ID NO: 889183 - DNA, 21 bp, Homo sapiens
aacttctccttagacactttg

SEQ ID NO: 889184 - DNA, 19 bp, Homo sapiens
aacttcttatggaattgat

SEQ ID NO: 889185 - DNA, 12 bp, Homo sapiens
aacttcttcata

SEQ ID NO: 889186 - DNA, 22 bp, Homo sapiens
aacttcttgcttctttctagaa

SEQ ID NO: 889187 - DNA, 22 bp, Homo sapiens
aacttctttctatttgacttgt

SEQ ID NO: 889188 - DNA, 15 bp, Homo sapiens
aacttgaaaatagta

SEQ ID NO: 889189 - DNA, 22 bp, Homo sapiens
aacttgaaaatatatgatggct

SEQ ID NO: 889190 - DNA, 14 bp, Homo sapiens
aacttgaactgatt

SEQ ID NO: 889191 - DNA, 16 bp, Homo sapiens
aacttgaatgtgtcag

SEQ ID NO: 889192 - DNA, 16 bp, Homo sapiens
aacttgagatctgtat

SEQ ID NO: 889193 - DNA, 17 bp, Homo sapiens
aacttgagatctgtata

SEQ ID NO: 889194 - DNA, 20 bp, Homo sapiens
aacttgagatctgtataaat

SEQ ID NO: 889195 - DNA, 22 bp, Homo sapiens
aacttgagatctgtataaataa

SEQ ID NO: 889196 - DNA, 22 bp, Homo sapiens
aacttgagatgtatgaaggctt

SEQ ID NO: 889197 - DNA, 19 bp, Homo sapiens
aacttgagggcccagagca

SEQ ID NO: 889198 - DNA, 20 bp, Homo sapiens
aacttgagggcccagagcag

SEQ ID NO: 889199 - DNA, 14 bp, Homo sapiens
aacttgatgtgaaa

SEQ ID NO: 889200 - DNA, 15 bp, Homo sapiens
aacttgatttgcatg

SEQ ID NO: 889201 - DNA, 21 bp, Homo sapiens
aacttgcaatataacattcta

SEQ ID NO: 889202 - DNA, 21 bp, Homo sapiens
aacttgcatccaactccagga

SEQ ID NO: 889203 - DNA, 18 bp, Homo sapiens
aacttgccccaagggttt

SEQ ID NO: 889204 - DNA, 14 bp, Homo sapiens
aacttgctcttttt

SEQ ID NO: 889205 - DNA, 14 bp, Homo sapiens
aacttgcttaaatt

SEQ ID NO: 889206 - DNA, 21 bp, Homo sapiens
aacttgcttaaatttcttatg

SEQ ID NO: 889207 - DNA, 17 bp, Homo sapiens
aacttgcttctaaatgc

SEQ ID NO: 889208 - DNA, 22 bp, Homo sapiens
aagacaatatgaacaaactatg

SEQ ID NO: 889209 - DNA, 15 bp, Homo sapiens
aagacaatgacatac

SEQ ID NO: 889210 - DNA, 22 bp, Homo sapiens
aagacaatgacttactgtacat

SEQ ID NO: 889211 - DNA, 15 bp, Homo sapiens
aagacacagaaccaa

SEQ ID NO: 889212 - DNA, 17 bp, Homo sapiens
aagacacagcctccccc

SEQ ID NO: 889213 - DNA, 22 bp, Homo sapiens
aagacacatcttattgaataaa

SEQ ID NO: 889214 - DNA, 11 bp, Homo sapiens
aagacacattg

SEQ ID NO: 889215 - DNA, 21 bp, Homo sapiens
aagacaccttctgagtattct

SEQ ID NO: 889216 - DNA, 14 bp, Homo sapiens
aagacactgtgaga

SEQ ID NO: 889217 - DNA, 21 bp, Homo sapiens
aagacactgtgagagttgtct

SEQ ID NO: 889218 - DNA, 13 bp, Homo sapiens
aagacacttcaga

SEQ ID NO: 889219 - DNA, 16 bp, Homo sapiens
aagacagaaaagtgcc

SEQ ID NO: 889220 - DNA, 20 bp, Homo sapiens
aagacagaaaagtgcctgag

SEQ ID NO: 889221 - DNA, 13 bp, Homo sapiens
aagacagaatggt

SEQ ID NO: 889222 - DNA, 16 bp, Homo sapiens
aagacagaatgtcacc

SEQ ID NO: 889223 - DNA, 17 bp, Homo sapiens
aagacagaatgtcacca

SEQ ID NO: 889224 - DNA, 17 bp, Homo sapiens
aagacagagtgaatttc

SEQ ID NO: 889225 - DNA, 17 bp, Homo sapiens
aagacagatgccccaga

SEQ ID NO: 889226 - DNA, 22 bp, Homo sapiens
aagacagatgccccagagctgt

SEQ ID NO: 889227 - DNA, 12 bp, Homo sapiens
aagacagccttc

SEQ ID NO: 889228 - DNA, 14 bp, Homo sapiens
aagacaggagacaa

SEQ ID NO: 889229 - DNA, 19 bp, Homo sapiens
aagacaggagagattattt

SEQ ID NO: 889230 - DNA, 21 bp, Homo sapiens
aagacagggctgataagctaa

SEQ ID NO: 889231 - DNA, 19 bp, Homo sapiens
aagacaggtctagactttc

SEQ ID NO: 889232 - DNA, 22 bp, Homo sapiens
aagacaggttacgaagacaaag

SEQ ID NO: 889233 - DNA, 23 bp, Homo sapiens
aagacatagccgattctctgccc

SEQ ID NO: 889234 - DNA, 18 bp, Homo sapiens
aagacatgaatgcacact

SEQ ID NO: 889235 - DNA, 20 bp, Homo sapiens
aagacatgatttccttgaat

SEQ ID NO: 889236 - DNA, 14 bp, Homo sapiens
aagacatgcagcct

SEQ ID NO: 889237 - DNA, 19 bp, Homo sapiens
aagacatggagactcctgc

SEQ ID NO: 889238 - DNA, 13 bp, Homo sapiens
aagacatgtctgt

SEQ ID NO: 889239 - DNA, 17 bp, Homo sapiens
aagacatgtgaggagga

SEQ ID NO: 889240 - DNA, 20 bp, Homo sapiens
aagacatgtgaggaggaaaa

SEQ ID NO: 889241 - DNA, 21 bp, Homo sapiens
aagacatgtgaggaggaaaag

SEQ ID NO: 889242 - DNA, 15 bp, Homo sapiens
aagacatttgctgaa

SEQ ID NO: 889243 - DNA, 18 bp, Homo sapiens
aagacatttgctgaactc

SEQ ID NO: 889244 - DNA, 11 bp, Homo sapiens
aagacatttgt

SEQ ID NO: 889245 - DNA, 22 bp, Homo sapiens
aagacattttaagtttgtagta

SEQ ID NO: 889246 - DNA, 20 bp, Homo sapiens
aagacattttgttacataag

SEQ ID NO: 889247 - DNA, 15 bp, Homo sapiens
aagacattttttgct

SEQ ID NO: 889248 - DNA, 15 bp, Homo sapiens
aagaccacgtttcta

SEQ ID NO: 889249 - DNA, 17 bp, Homo sapiens
aagaccacgtttctaaa

SEQ ID NO: 889250 - DNA, 12 bp, Homo sapiens
aagaccagggct

SEQ ID NO: 889251 - DNA, 17 bp, Homo sapiens
aagaccattctgtgacc

SEQ ID NO: 889252 - DNA, 14 bp, Homo sapiens
aagacccaacttgc

SEQ ID NO: 889253 - DNA, 18 bp, Homo sapiens
aagacccaacttgccaaa

SEQ ID NO: 889254 - DNA, 13 bp, Homo sapiens
aagaaaacatctt

SEQ ID NO: 889255 - DNA, 17 bp, Homo sapiens
aagaaaacatctttaag

SEQ ID NO: 889256 - DNA, 12 bp, Homo sapiens
aagaaaacattt

SEQ ID NO: 889257 - DNA, 17 bp, Homo sapiens
aagaaaacatttaacat

SEQ ID NO: 889258 - DNA, 15 bp, Homo sapiens
aagaaaacccgaggg

SEQ ID NO: 889259 - DNA, 16 bp, Homo sapiens
aagaaaacccgaggga

SEQ ID NO: 889260 - DNA, 15 bp, Homo sapiens
aagaaaagacatttt

SEQ ID NO: 889261 - DNA, 13 bp, Homo sapiens
aagaaaagatgaa

SEQ ID NO: 889262 - DNA, 13 bp, Homo sapiens
aagaaaaggacaa

SEQ ID NO: 889263 - DNA, 20 bp, Homo sapiens
aagaaaaggcaaaagactgg

SEQ ID NO: 889264 - DNA, 16 bp, Homo sapiens
aagaaaagtaatgaag

SEQ ID NO: 889265 - DNA, 22 bp, Homo sapiens
aagaaaagtaggtttacattca

SEQ ID NO: 889266 - DNA, 20 bp, Homo sapiens
aagaaaagtgcatatttatc

SEQ ID NO: 889267 - DNA, 13 bp, Homo sapiens
aagaaaataaaaa

SEQ ID NO: 889268 - DNA, 18 bp, Homo sapiens
aagaaaataaaaaaaaga

SEQ ID NO: 889269 - DNA, 21 bp, Homo sapiens
aagaaaataaaaaaaagaaaa

SEQ ID NO: 889270 - DNA, 22 bp, Homo sapiens
aagaaaataaaaaaaagaaaaa

SEQ ID NO: 889271 - DNA, 16 bp, Homo sapiens
aagaaaatacaataaa

SEQ ID NO: 889272 - DNA, 12 bp, Homo sapiens
aagaaaatagat

SEQ ID NO: 889273 - DNA, 21 bp, Homo sapiens
aagaaaatagtggtgtgattt

SEQ ID NO: 889274 - DNA, 22 bp, Homo sapiens
aagaaaatagtggtgtgatttg

SEQ ID NO: 889275 - DNA, 23 bp, Homo sapiens
aagaaaatcagatggagcatgaa

SEQ ID NO: 889276 - DNA, 17 bp, Homo sapiens
aagaaaatcatattgct

SEQ ID NO: 889277 - DNA, 20 bp, Homo sapiens
aagaaaatcatattgcttct

SEQ ID NO: 889278 - DNA, 14 bp, Homo sapiens
aagaaaatgacttt

SEQ ID NO: 889279 - DNA, 17 bp, Homo sapiens
aagaaaatgactttatt

SEQ ID NO: 889280 - DNA, 18 bp, Homo sapiens
aagaaaatgactttattt

SEQ ID NO: 889281 - DNA, 13 bp, Homo sapiens
aagaaaatgtctt

SEQ ID NO: 889282 - DNA, 13 bp, Homo sapiens
aagaaaatgtggc

SEQ ID NO: 889283 - DNA, 22 bp, Homo sapiens
aagaaaatgttacggcatcaca

SEQ ID NO: 889284 - DNA, 15 bp, Homo sapiens
aagaaaattcctata

SEQ ID NO: 889285 - DNA, 15 bp, Homo sapiens
aagaaaattgcatga

SEQ ID NO: 889286 - DNA, 19 bp, Homo sapiens
aagaaaatttttgtagtag

SEQ ID NO: 889287 - DNA, 15 bp, Homo sapiens
aagaaacaagctgtg

SEQ ID NO: 889288 - DNA, 20 bp, Homo sapiens
aagaaacaagctgtgcaggc

SEQ ID NO: 889289 - DNA, 16 bp, Homo sapiens
aagaaacaaggttttc

SEQ ID NO: 889290 - DNA, 16 bp, Homo sapiens
aagaaacactgcctgc

SEQ ID NO: 889291 - DNA, 13 bp, Homo sapiens
aagaaacatttcc

SEQ ID NO: 889292 - DNA, 14 bp, Homo sapiens
aagaaaccatgaca

SEQ ID NO: 889293 - DNA, 16 bp, Homo sapiens
aagaaaccatgacaaa

SEQ ID NO: 889294 - DNA, 11 bp, Homo sapiens
aagaaacccaa

SEQ ID NO: 889295 - DNA, 17 bp, Homo sapiens
aagaaacccttgctgct

SEQ ID NO: 889296 - DNA, 18 bp, Homo sapiens
aagaaacccttgctgctt

SEQ ID NO: 889297 - DNA, 21 bp, Homo sapiens
aagaaacgtctatgtgtacag

SEQ ID NO: 889298 - DNA, 15 bp, Homo sapiens
aagaaactatttttg

SEQ ID NO: 889299 - DNA, 14 bp, Homo sapiens
aagaaactgaatga

SEQ ID NO: 889300 - DNA, 21 bp, Homo sapiens
aagaaactgacatgccctccc

SEQ ID NO: 889301 - DNA, 20 bp, Homo sapiens
aagaaactgaggaattttct

SEQ ID NO: 889302 - DNA, 19 bp, Homo sapiens
aagaaacttggctggaatt

SEQ ID NO: 889303 - DNA, 15 bp, Homo sapiens
aagaaagaacatttt

SEQ ID NO: 889304 - DNA, 15 bp, Homo sapiens
aagaaagaaggaagt

SEQ ID NO: 889305 - DNA, 14 bp, Homo sapiens
aagaaagagaatga

SEQ ID NO: 889306 - DNA, 18 bp, Homo sapiens
aagaaagagaatgaactg

SEQ ID NO: 889307 - DNA, 22 bp, Homo sapiens
aagaaagagggtcccagggctg

SEQ ID NO: 889308 - DNA, 16 bp, Homo sapiens
aagaaagcatagacat

SEQ ID NO: 889309 - DNA, 22 bp, Homo sapiens
aagaaagcttcaaactgcatga

SEQ ID NO: 889310 - DNA, 17 bp, Homo sapiens
aagaagttttttacttt

SEQ ID NO: 889311 - DNA, 18 bp, Homo sapiens
aagaataaaatgttgaaa

SEQ ID NO: 889312 - DNA, 20 bp, Homo sapiens
aagaataaaatgttgaaaag

SEQ ID NO: 889313 - DNA, 23 bp, Homo sapiens
aagaataaaatgttgaaaagtca

SEQ ID NO: 889314 - DNA, 14 bp, Homo sapiens
aagaataataaaat

SEQ ID NO: 889315 - DNA, 16 bp, Homo sapiens
aagaatacttctcatt

SEQ ID NO: 889316 - DNA, 17 bp, Homo sapiens
aagaatacttctcattt

SEQ ID NO: 889317 - DNA, 22 bp, Homo sapiens
aagaatacttctcattttttaa

SEQ ID NO: 889318 - DNA, 13 bp, Homo sapiens
aagaatagaaaca

SEQ ID NO: 889319 - DNA, 15 bp, Homo sapiens
aagaatagaaacaag

SEQ ID NO: 889320 - DNA, 19 bp, Homo sapiens
aagaatatctgtaatggta

SEQ ID NO: 889321 - DNA, 12 bp, Homo sapiens
aagaatattgca

SEQ ID NO: 889322 - DNA, 19 bp, Homo sapiens
aagaatattgcaaaataca

SEQ ID NO: 889323 - DNA, 14 bp, Homo sapiens
aagaatatttagaa

SEQ ID NO: 889324 - DNA, 16 bp, Homo sapiens
aagaatccaatactgc

SEQ ID NO: 889325 - DNA, 12 bp, Homo sapiens
aagaatctactt

SEQ ID NO: 889326 - DNA, 13 bp, Homo sapiens
aagaatctactta

SEQ ID NO: 889327 - DNA, 16 bp, Homo sapiens
aagaatctagaagatg

SEQ ID NO: 889328 - DNA, 18 bp, Homo sapiens
aagaatctattagatttt

SEQ ID NO: 889329 - DNA, 14 bp, Homo sapiens
aagaatctgcccct

SEQ ID NO: 889330 - DNA, 18 bp, Homo sapiens
aagaatcttaatgcttgt

SEQ ID NO: 889331 - DNA, 15 bp, Homo sapiens
aagaatctttagaga

SEQ ID NO: 889332 - DNA, 19 bp, Homo sapiens
aagaatgaaaaatataatg

SEQ ID NO: 889333 - DNA, 17 bp, Homo sapiens
aagaatgcacaagaatg

SEQ ID NO: 889334 - DNA, 18 bp, Homo sapiens
aagaatgcacaagaatgg

SEQ ID NO: 889335 - DNA, 21 bp, Homo sapiens
aagaatgcacaagaatggatc

SEQ ID NO: 889336 - DNA, 14 bp, Homo sapiens
aagaatgcattcaa

SEQ ID NO: 889337 - DNA, 15 bp, Homo sapiens
aagaatgcattcaaa

SEQ ID NO: 889338 - DNA, 15 bp, Homo sapiens
aagaatgccatttct

SEQ ID NO: 889339 - DNA, 18 bp, Homo sapiens
aagaatgctggttttcct

SEQ ID NO: 889340 - DNA, 22 bp, Homo sapiens
aagaatgctgttctgatttact

SEQ ID NO: 889341 - DNA, 18 bp, Homo sapiens
aagaatggtttgtaaaat

SEQ ID NO: 889342 - DNA, 18 bp, Homo sapiens
aagaatgtcgattaaaat

SEQ ID NO: 889343 - DNA, 17 bp, Homo sapiens
aagaatgttactgcctt

SEQ ID NO: 889344 - DNA, 15 bp, Homo sapiens
aagaatgtttatagc

SEQ ID NO: 889345 - DNA, 15 bp, Homo sapiens
aagaatgtttctgga

SEQ ID NO: 889346 - DNA, 14 bp, Homo sapiens
aagaattaaaaact

SEQ ID NO: 889347 - DNA, 11 bp, Homo sapiens
aagaattacag

SEQ ID NO: 889348 - DNA, 13 bp, Homo sapiens
aagaattacagta

SEQ ID NO: 889349 - DNA, 14 bp, Homo sapiens
aagaattacagtac

SEQ ID NO: 889350 - DNA, 22 bp, Homo sapiens
aagaattagaagtctttcagtg

SEQ ID NO: 889351 - DNA, 15 bp, Homo sapiens
aagaattagacatct

SEQ ID NO: 889352 - DNA, 20 bp, Homo sapiens
aagaattattcagtgaattt

SEQ ID NO: 889353 - DNA, 16 bp, Homo sapiens
aagaattccaaagcaa

SEQ ID NO: 889354 - DNA, 13 bp, Homo sapiens
aagaattcctgaa

SEQ ID NO: 889355 - DNA, 20 bp, Homo sapiens
aagaattcctgaagccagat

SEQ ID NO: 889356 - DNA, 19 bp, Homo sapiens
aagaattgaacccaggagg

SEQ ID NO: 889357 - DNA, 20 bp, Homo sapiens
aagaattgaacccaggaggt

SEQ ID NO: 889358 - DNA, 20 bp, Homo sapiens
aagaattgaccatctgcttt

SEQ ID NO: 889359 - DNA, 22 bp, Homo sapiens
aagaattgaccatctgctttta

SEQ ID NO: 889360 - DNA, 16 bp, Homo sapiens
aagaattgagtaatgg

SEQ ID NO: 889361 - DNA, 14 bp, Homo sapiens
aagaattgagtatc

SEQ ID NO: 889362 - DNA, 14 bp, Homo sapiens
aagaattgtcttgc

SEQ ID NO: 889363 - DNA, 15 bp, Homo sapiens
aagaattgtcttgca

SEQ ID NO: 889364 - DNA, 20 bp, Homo sapiens
aagaatttcttggtaagaag

SEQ ID NO: 889365 - DNA, 23 bp, Homo sapiens
aagaatttcttggtaagaagccg

SEQ ID NO: 889366 - DNA, 20 bp, Homo sapiens
aagaattttcagaccccagc

SEQ ID NO: 889367 - DNA, 19 bp, Homo sapiens
aagaattttgttttacttt

SEQ ID NO: 889368 - DNA, 13 bp, Homo sapiens
aagaatttttaaa

SEQ ID NO: 889369 - DNA, 17 bp, Homo sapiens
aagacaaaaagccttga

SEQ ID NO: 889370 - DNA, 20 bp, Homo sapiens
aagacaaaaagccttgaaga

SEQ ID NO: 889371 - DNA, 13 bp, Homo sapiens
aagacaaaaatca

SEQ ID NO: 889372 - DNA, 22 bp, Homo sapiens
aagacaaaaatcaaagaacaga

SEQ ID NO: 889373 - DNA, 15 bp, Homo sapiens
aagacaaaagaaact

SEQ ID NO: 889374 - DNA, 16 bp, Homo sapiens
aagacaaaagaaactt

SEQ ID NO: 889375 - DNA, 17 bp, Homo sapiens
aagacaaaggttttcct

SEQ ID NO: 889376 - DNA, 18 bp, Homo sapiens
aagacaaagtcccagaat

SEQ ID NO: 889377 - DNA, 21 bp, Homo sapiens
aagacaaagtcccagaattgt

SEQ ID NO: 889378 - DNA, 20 bp, Homo sapiens
aagacaaatattcctttgca

SEQ ID NO: 889379 - DNA, 13 bp, Homo sapiens
aagacaaatgaca

SEQ ID NO: 889380 - DNA, 15 bp, Homo sapiens
aagacaagacttcag

SEQ ID NO: 889381 - DNA, 16 bp, Homo sapiens
aagacaagtatgaata

SEQ ID NO: 889382 - DNA, 17 bp, Homo sapiens
aagacaagtatgaatat

SEQ ID NO: 889383 - DNA, 22 bp, Homo sapiens
aagacaatagcacttaaattcc

SEQ ID NO: 889384 - DNA, 15 bp, Homo sapiens
aagatgtgaattatt

SEQ ID NO: 889385 - DNA, 23 bp, Homo sapiens
aagatgtgaattattgacactga

SEQ ID NO: 889386 - DNA, 15 bp, Homo sapiens
aagatgtgtcttcaa

SEQ ID NO: 889387 - DNA, 17 bp, Homo sapiens
aagatgtgtcttcaatt

SEQ ID NO: 889388 - DNA, 17 bp, Homo sapiens
aagatgtgttcttattt

SEQ ID NO: 889389 - DNA, 14 bp, Homo sapiens
aagatgttaaaatc

SEQ ID NO: 889390 - DNA, 15 bp, Homo sapiens
aagatgttaaatgga

SEQ ID NO: 889391 - DNA, 17 bp, Homo sapiens
aagatgttaagcattta

SEQ ID NO: 889392 - DNA, 16 bp, Homo sapiens
aagatgttatggtgtt

SEQ ID NO: 889393 - DNA, 15 bp, Homo sapiens
aagatgttccagtga

SEQ ID NO: 889394 - DNA, 15 bp, Homo sapiens
aagatgttctcctga

SEQ ID NO: 889395 - DNA, 20 bp, Homo sapiens
aagatgttctggataccatt

SEQ ID NO: 889396 - DNA, 14 bp, Homo sapiens
aagatgtttacatt

SEQ ID NO: 889397 - DNA, 15 bp, Homo sapiens
aagattaaaggaagg

SEQ ID NO: 889398 - DNA, 18 bp, Homo sapiens
aagattaaaggaaggaaa

SEQ ID NO: 889399 - DNA, 19 bp, Homo sapiens
aagattaaaggaaggaaaa

SEQ ID NO: 889400 - DNA, 20 bp, Homo sapiens
aagattactcagtaatttgt

SEQ ID NO: 889401 - DNA, 18 bp, Homo sapiens
aagattacttagaggaaa

SEQ ID NO: 889402 - DNA, 11 bp, Homo sapiens
aagattagaag

SEQ ID NO: 889403 - DNA, 13 bp, Homo sapiens
aagattagaagct

SEQ ID NO: 889404 - DNA, 19 bp, Homo sapiens
aagattaggagaaacacat

SEQ ID NO: 889405 - DNA, 21 bp, Homo sapiens
aagattaggtcgttttccaaa

SEQ ID NO: 889406 - DNA, 16 bp, Homo sapiens
aagattagtttcaatg

SEQ ID NO: 889407 - DNA, 23 bp, Homo sapiens
aagattatctgattcctttaaaa

SEQ ID NO: 889408 - DNA, 20 bp, Homo sapiens
aagattattgtgacttcact

SEQ ID NO: 889409 - DNA, 19 bp, Homo sapiens
aagattcacacctgactct

SEQ ID NO: 889410 - DNA, 14 bp, Homo sapiens
aagattcccagaga

SEQ ID NO: 889411 - DNA, 13 bp, Homo sapiens
aagattctaaagc

SEQ ID NO: 889412 - DNA, 13 bp, Homo sapiens
aagattctactaa

SEQ ID NO: 889413 - DNA, 16 bp, Homo sapiens
aagattcttttaaatt

SEQ ID NO: 889414 - DNA, 17 bp, Homo sapiens
aagattcttttaaatta

SEQ ID NO: 889415 - DNA, 19 bp, Homo sapiens
aagattgagctctctgccc

SEQ ID NO: 889416 - DNA, 12 bp, Homo sapiens
aagattgctgaa

SEQ ID NO: 889417 - DNA, 13 bp, Homo sapiens
aagattggagctg

SEQ ID NO: 889418 - DNA, 21 bp, Homo sapiens
aagattggtgggattttttgt

SEQ ID NO: 889419 - DNA, 13 bp, Homo sapiens
aagattgtactta

SEQ ID NO: 889420 - DNA, 22 bp, Homo sapiens
aagattgtacttagccagttca

SEQ ID NO: 889421 - DNA, 18 bp, Homo sapiens
aagattgtccttttctcc

SEQ ID NO: 889422 - DNA, 20 bp, Homo sapiens
aagattgttattaaatgtag

SEQ ID NO: 889423 - DNA, 14 bp, Homo sapiens
aagatttacattcc

SEQ ID NO: 889424 - DNA, 22 bp, Homo sapiens
aagatttaccttttctgttgta

SEQ ID NO: 889425 - DNA, 17 bp, Homo sapiens
aagatttcagagctgag

SEQ ID NO: 889426 - DNA, 20 bp, Homo sapiens
aagatttcagagctgaggct

SEQ ID NO: 889427 - DNA, 14 bp, Homo sapiens
aagatttgaccaaa

SEQ ID NO: 889428 - DNA, 23 bp, Homo sapiens
aagatttgatgctggagaggtta

SEQ ID NO: 889429 - DNA, 20 bp, Homo sapiens
aagatttggaagctcttctt

SEQ ID NO: 889430 - DNA, 20 bp, Homo sapiens
aagatttgttactgtatttt

SEQ ID NO: 889431 - DNA, 21 bp, Homo sapiens
aagatttgttttgtcaagtgt

SEQ ID NO: 889432 - DNA, 20 bp, Homo sapiens
aagatttgtttttaaactgt

SEQ ID NO: 889433 - DNA, 16 bp, Homo sapiens
aagattttaaagacat

SEQ ID NO: 889434 - DNA, 17 bp, Homo sapiens
aagattttaatcaagtt

SEQ ID NO: 889435 - DNA, 22 bp, Homo sapiens
aagattttagggcttttatttt

SEQ ID NO: 889436 - DNA, 15 bp, Homo sapiens
aagattttattgtat

SEQ ID NO: 889437 - DNA, 19 bp, Homo sapiens
aagattttcctcttgtgat

SEQ ID NO: 889438 - DNA, 20 bp, Homo sapiens
aagattttcctcttgtgatt

SEQ ID NO: 889439 - DNA, 13 bp, Homo sapiens
aagattttttaat

SEQ ID NO: 889440 - DNA, 20 bp, Homo sapiens
aagcaaaaaaggtaactaac

SEQ ID NO: 889441 - DNA, 20 bp, Homo sapiens
aagcaaaaagaacaaagctg

SEQ ID NO: 889442 - DNA, 21 bp, Homo sapiens
aagcaaaacatctctgcagtt

SEQ ID NO: 889443 - DNA, 16 bp, Homo sapiens
aagcaaaactttcctc

SEQ ID NO: 889444 - DNA, 14 bp, Homo sapiens
aagcaaaagaaaaa

SEQ ID NO: 889445 - DNA, 13 bp, Homo sapiens
aagcaaaatatta

SEQ ID NO: 889446 - DNA, 14 bp, Homo sapiens
aagcaaaatattat

SEQ ID NO: 889447 - DNA, 13 bp, Homo sapiens
aagcaaacatcaa

SEQ ID NO: 889448 - DNA, 14 bp, Homo sapiens
aagcaaacatcaaa

SEQ ID NO: 889449 - DNA, 22 bp, Homo sapiens
aagcaaactatgatttattttg

SEQ ID NO: 889450 - DNA, 21 bp, Homo sapiens
aagcaaactctaaaattataa

SEQ ID NO: 889451 - DNA, 13 bp, Homo sapiens
aagcaaagacaaa

SEQ ID NO: 889452 - DNA, 22 bp, Homo sapiens
aagcaaagacaaaagaaactta

SEQ ID NO: 889453 - DNA, 16 bp, Homo sapiens
aagcaaagatttcagt

SEQ ID NO: 889454 - DNA, 14 bp, Homo sapiens
aagcaaagggctcc

SEQ ID NO: 889455 - DNA, 12 bp, Homo sapiens
aagcaaagggga

SEQ ID NO: 889456 - DNA, 15 bp, Homo sapiens
aagcaaaggggggag

SEQ ID NO: 889457 - DNA, 17 bp, Homo sapiens
aagcaaaggggggaggt

SEQ ID NO: 889458 - DNA, 17 bp, Homo sapiens
aagcaaatcgaatgaaa

SEQ ID NO: 889459 - DNA, 18 bp, Homo sapiens
aagcaaatcgaatgaaat

SEQ ID NO: 889460 - DNA, 20 bp, Homo sapiens
aagcaaattttgtattattg

SEQ ID NO: 889461 - DNA, 20 bp, Homo sapiens
aagcaacattcatagtcttt

SEQ ID NO: 889462 - DNA, 20 bp, Homo sapiens
aagcaacccgctggagccca

SEQ ID NO: 889463 - DNA, 15 bp, Homo sapiens
aagcaacctcagtaa

SEQ ID NO: 889464 - DNA, 20 bp, Homo sapiens
aagcaacctcagtaatttag

SEQ ID NO: 889465 - DNA, 19 bp, Homo sapiens
aagcaactacaacttctcc

SEQ ID NO: 889466 - DNA, 16 bp, Homo sapiens
aagcaacttcatttga

SEQ ID NO: 889467 - DNA, 16 bp, Homo sapiens
aagcaacttgatggaa

SEQ ID NO: 889468 - DNA, 13 bp, Homo sapiens
aagcaagaaacag

SEQ ID NO: 889469 - DNA, 23 bp, Homo sapiens
aagcaagaaagagggtcccaggg

SEQ ID NO: 889470 - DNA, 18 bp, Homo sapiens
aagcaagatgagctgtgc

SEQ ID NO: 889471 - DNA, 17 bp, Homo sapiens
aagcaagggctccagca

SEQ ID NO: 889472 - DNA, 15 bp, Homo sapiens
aagcaagggggtgat

SEQ ID NO: 889473 - DNA, 16 bp, Homo sapiens
aagcaagtagctttcc

SEQ ID NO: 889474 - DNA, 19 bp, Homo sapiens
aagcaagttcgtctgttgt

SEQ ID NO: 889475 - DNA, 11 bp, Homo sapiens
aagcaataact

SEQ ID NO: 889476 - DNA, 20 bp, Homo sapiens
aagcaataactccaagcaga

SEQ ID NO: 889477 - DNA, 22 bp, Homo sapiens
aagcaataatggtcccatccag

SEQ ID NO: 889478 - DNA, 14 bp, Homo sapiens
aagcaataattgtt

SEQ ID NO: 889479 - DNA, 15 bp, Homo sapiens
aagcaatacaacttt

SEQ ID NO: 889480 - DNA, 14 bp, Homo sapiens
aagcaatcatttta

SEQ ID NO: 889481 - DNA, 15 bp, Homo sapiens
aagcaatccacctgc

SEQ ID NO: 889482 - DNA, 20 bp, Homo sapiens
aagcaatccacctgccttgg

SEQ ID NO: 889483 - DNA, 14 bp, Homo sapiens
aagcaatcctcctg

SEQ ID NO: 889484 - DNA, 21 bp, Homo sapiens
aagcaatcctcctgcctcagc

SEQ ID NO: 889485 - DNA, 17 bp, Homo sapiens
aagcaatggatatttgt

SEQ ID NO: 889486 - DNA, 21 bp, Homo sapiens
aagcaatggggaatacaagtt

SEQ ID NO: 889487 - DNA, 13 bp, Homo sapiens
aagcaatggttga

SEQ ID NO: 889488 - DNA, 13 bp, Homo sapiens
aagcaatgtgttt

SEQ ID NO: 889489 - DNA, 12 bp, Homo sapiens
aagcaattctga

SEQ ID NO: 889490 - DNA, 16 bp, Homo sapiens
aagcacaaagttctca

SEQ ID NO: 889491 - DNA, 15 bp, Homo sapiens
aagcacaagtacttt

SEQ ID NO: 889492 - DNA, 17 bp, Homo sapiens
aagcacaagtacttttg

SEQ ID NO: 889493 - DNA, 23 bp, Homo sapiens
aagcacaatcactaaactttatt

SEQ ID NO: 889494 - DNA, 11 bp, Homo sapiens
aagcacacaca

SEQ ID NO: 889495 - DNA, 18 bp, Homo sapiens
aagcacacacatctggcc

SEQ ID NO: 889496 - DNA, 19 bp, Homo sapiens
aagcacactcatcccctca

SEQ ID NO: 889497 - DNA, 14 bp, Homo sapiens
aagcacacttgtag

SEQ ID NO: 889498 - DNA, 15 bp, Homo sapiens
aagcacagaatattt

SEQ ID NO: 889499 - DNA, 17 bp, Homo sapiens
aagcacagagcctggcc

SEQ ID NO: 889500 - DNA, 21 bp, Homo sapiens
aagcacagagcctggccccag

SEQ ID NO: 889501 - DNA, 16 bp, Homo sapiens
aagcacagcagcctgg

SEQ ID NO: 889502 - DNA, 13 bp, Homo sapiens
aagcacagccctt

SEQ ID NO: 889503 - DNA, 11 bp, Homo sapiens
aagcacagctg

SEQ ID NO: 889504 - DNA, 19 bp, Homo sapiens
aagcacagcttgggtcagg

SEQ ID NO: 889505 - DNA, 17 bp, Homo sapiens
aagcacataactggatt

SEQ ID NO: 889506 - DNA, 21 bp, Homo sapiens
aagcacatattagtgcagcca

SEQ ID NO: 889507 - DNA, 16 bp, Homo sapiens
aagcacatctgcattt

SEQ ID NO: 889508 - DNA, 16 bp, Homo sapiens
aagcacatgtttattt

SEQ ID NO: 889509 - DNA, 14 bp, Homo sapiens
aaaggtcaataagg

SEQ ID NO: 889510 - DNA, 16 bp, Homo sapiens
aaaggtcatccaaaga

SEQ ID NO: 889511 - DNA, 19 bp, Homo sapiens
aaaggtccttgcctcctgg

SEQ ID NO: 889512 - DNA, 18 bp, Homo sapiens
aaaggtgaaaatgtttta

SEQ ID NO: 889513 - DNA, 16 bp, Homo sapiens
aaaggtgaaggaatat

SEQ ID NO: 889514 - DNA, 22 bp, Homo sapiens
aaaggtgaccttgcaacttcat

SEQ ID NO: 889515 - DNA, 22 bp, Homo sapiens
aaaggtgagtttgagctgcctt

SEQ ID NO: 889516 - DNA, 16 bp, Homo sapiens
aaaggtggaataaaca

SEQ ID NO: 889517 - DNA, 18 bp, Homo sapiens
aaaggtggagtttctctg

SEQ ID NO: 889518 - DNA, 17 bp, Homo sapiens
aaaggtgtagaaaaggt

SEQ ID NO: 889519 - DNA, 19 bp, Homo sapiens
aaaggtgtgagactgggaa

SEQ ID NO: 889520 - DNA, 19 bp, Homo sapiens
aaaggttagagaataaatt

SEQ ID NO: 889521 - DNA, 14 bp, Homo sapiens
aaaggttaggagag

SEQ ID NO: 889522 - DNA, 17 bp, Homo sapiens
aaaggttcactaaagca

SEQ ID NO: 889523 - DNA, 16 bp, Homo sapiens
aaaggttgaataatat

SEQ ID NO: 889524 - DNA, 19 bp, Homo sapiens
aaaggttgctgtttcacaa

SEQ ID NO: 889525 - DNA, 19 bp, Homo sapiens
aaaggttgttttgaaactg

SEQ ID NO: 889526 - DNA, 14 bp, Homo sapiens
aaaggtttaaagtt

SEQ ID NO: 889527 - DNA, 21 bp, Homo sapiens
aaaggtttggaaggagcagaa

SEQ ID NO: 889528 - DNA, 14 bp, Homo sapiens
aaaggttttcctct

SEQ ID NO: 889529 - DNA, 22 bp, Homo sapiens
aaaggttttctctaacttctca

SEQ ID NO: 889530 - DNA, 12 bp, Homo sapiens
aaaggttttgta

SEQ ID NO: 889531 - DNA, 12 bp, Homo sapiens
aaaggttttttt

SEQ ID NO: 889532 - DNA, 14 bp, Homo sapiens
aaagtaaaaattaa

SEQ ID NO: 889533 - DNA, 14 bp, Homo sapiens
aaagtaaaaattga

SEQ ID NO: 889534 - DNA, 13 bp, Homo sapiens
aaagtaaaatgaa

SEQ ID NO: 889535 - DNA, 11 bp, Homo sapiens
aaagtaaatgg

SEQ ID NO: 889536 - DNA, 15 bp, Homo sapiens
aaagtaaatgggagg

SEQ ID NO: 889537 - DNA, 18 bp, Homo sapiens
aaagtaactcatttgtta

SEQ ID NO: 889538 - DNA, 13 bp, Homo sapiens
aaagtaagacatc

SEQ ID NO: 889539 - DNA, 14 bp, Homo sapiens
aaagtaaggtgcag

SEQ ID NO: 889540 - DNA, 13 bp, Homo sapiens
aaagtaagttaat

SEQ ID NO: 889541 - DNA, 17 bp, Homo sapiens
aaagtaagttaataatg

SEQ ID NO: 889542 - DNA, 18 bp, Homo sapiens
aaagtaagttaataatgt

SEQ ID NO: 889543 - DNA, 21 bp, Homo sapiens
aaagtaagttaataatgtatt

SEQ ID NO: 889544 - DNA, 17 bp, Homo sapiens
aaagtaataatgtgcaa

SEQ ID NO: 889545 - DNA, 15 bp, Homo sapiens
aaagtaatctactgt

SEQ ID NO: 889546 - DNA, 16 bp, Homo sapiens
aaagtaatctttaaac

SEQ ID NO: 889547 - DNA, 23 bp, Homo sapiens
aaagtaatgatgaaatctttctt

SEQ ID NO: 889548 - DNA, 15 bp, Homo sapiens
aaagtacaaatgaag

SEQ ID NO: 889549 - DNA, 17 bp, Homo sapiens
aaagtacactctgctgt

SEQ ID NO: 889550 - DNA, 18 bp, Homo sapiens
aaagtacactgtttcaaa

SEQ ID NO: 889551 - DNA, 13 bp, Homo sapiens
aaagtacagaata

SEQ ID NO: 889552 - DNA, 16 bp, Homo sapiens
aaagtacatgttaaac

SEQ ID NO: 889553 - DNA, 14 bp, Homo sapiens
aaagtacattgctt

SEQ ID NO: 889554 - DNA, 15 bp, Homo sapiens
aaagtacattgctta

SEQ ID NO: 889555 - DNA, 12 bp, Homo sapiens
aaagtacattta

SEQ ID NO: 889556 - DNA, 17 bp, Homo sapiens
aaagtaccacacaaact

SEQ ID NO: 889557 - DNA, 14 bp, Homo sapiens
aaagtaccacactg

SEQ ID NO: 889558 - DNA, 15 bp, Homo sapiens
aaagtaccacactga

SEQ ID NO: 889559 - DNA, 19 bp, Homo sapiens
aaagtaccacactgagttc

SEQ ID NO: 889560 - DNA, 15 bp, Homo sapiens
aaagtacctttatgt

SEQ ID NO: 889561 - DNA, 14 bp, Homo sapiens
aaagtactctttaa

SEQ ID NO: 889562 - DNA, 21 bp, Homo sapiens
aaagtactctttaacatacaa

SEQ ID NO: 889563 - DNA, 23 bp, Homo sapiens
aaagtagaactcttaaatacttt

SEQ ID NO: 889564 - DNA, 22 bp, Homo sapiens
aaagtagaagtcttagatgtat

SEQ ID NO: 889565 - DNA, 12 bp, Homo sapiens
aaagtagggggc

SEQ ID NO: 889566 - DNA, 12 bp, Homo sapiens
aaagtagtactt

SEQ ID NO: 889567 - DNA, 19 bp, Homo sapiens
aaagtagtacttcttctgt

SEQ ID NO: 889568 - DNA, 20 bp, Homo sapiens
aaagtagtacttcttctgta

SEQ ID NO: 889569 - DNA, 16 bp, Homo sapiens
aaagtagtcctgtgaa

SEQ ID NO: 889570 - DNA, 10 bp, Homo sapiens
aaagtagttc

SEQ ID NO: 889571 - DNA, 22 bp, Homo sapiens
aaagtataatgtttattaaatg

SEQ ID NO: 889572 - DNA, 17 bp, Homo sapiens
aaagtatatatagaatc

SEQ ID NO: 889573 - DNA, 15 bp, Homo sapiens
aaagtatattttcct

SEQ ID NO: 889574 - DNA, 21 bp, Homo sapiens
aaagtatcctgcttctgatat

SEQ ID NO: 889575 - DNA, 19 bp, Homo sapiens
aaagtatgcaaaataaaga

SEQ ID NO: 889576 - DNA, 20 bp, Homo sapiens
aaagtatgcaaaataaagaa

SEQ ID NO: 889577 - DNA, 19 bp, Homo sapiens
aaagtatgtaaagtatgta

SEQ ID NO: 889578 - DNA, 19 bp, Homo sapiens
aaagtatgtattatttaca

SEQ ID NO: 889579 - DNA, 19 bp, Homo sapiens
aaagtatgttctaaccttt

SEQ ID NO: 889580 - DNA, 14 bp, Homo sapiens
aaagtattcagaaa

SEQ ID NO: 889581 - DNA, 20 bp, Homo sapiens
aaagtattccaccttaaatt

SEQ ID NO: 889582 - DNA, 21 bp, Homo sapiens
aaagtattccaccttaaatta

SEQ ID NO: 889583 - DNA, 23 bp, Homo sapiens
aaagtattcgttacatcttgtag

SEQ ID NO: 889584 - DNA, 14 bp, Homo sapiens
aaagtattctccat

SEQ ID NO: 889585 - DNA, 22 bp, Homo sapiens
aaagtattcttctcttcctttt

SEQ ID NO: 889586 - DNA, 15 bp, Homo sapiens
aaagtattctttttc

SEQ ID NO: 889587 - DNA, 16 bp, Homo sapiens
aaagtattggcattca

SEQ ID NO: 889588 - DNA, 16 bp, Homo sapiens
aaagtattgtaaatta

SEQ ID NO: 889589 - DNA, 15 bp, Homo sapiens
aaagtcaaatgccaa

SEQ ID NO: 889590 - DNA, 16 bp, Homo sapiens
aaagtcaaatgccaaa

SEQ ID NO: 889591 - DNA, 18 bp, Homo sapiens
aaagtcaaggacgaattt

SEQ ID NO: 889592 - DNA, 23 bp, Homo sapiens
aaagtcaataaaagagctgtctg

SEQ ID NO: 889593 - DNA, 16 bp, Homo sapiens
aaagtcaatgtacttg

SEQ ID NO: 889594 - DNA, 19 bp, Homo sapiens
aaagtcaatgtacttgttt

SEQ ID NO: 889595 - DNA, 17 bp, Homo sapiens
aaagtcaccaaatagtg

SEQ ID NO: 889596 - DNA, 13 bp, Homo sapiens
aaagtcagaagtt

SEQ ID NO: 889597 - DNA, 20 bp, Homo sapiens
aaagtcagctttcagagcca

SEQ ID NO: 889598 - DNA, 18 bp, Homo sapiens
aaagtcagtatcatatta

SEQ ID NO: 889599 - DNA, 20 bp, Homo sapiens
aaagtccctccctgcctgag

SEQ ID NO: 889600 - DNA, 15 bp, Homo sapiens
aaagtcccttcctgc

SEQ ID NO: 889601 - DNA, 21 bp, Homo sapiens
aaagtcccttcctgcttcctg

SEQ ID NO: 889602 - DNA, 16 bp, Homo sapiens
aaagtcctctgctcca

SEQ ID NO: 889603 - DNA, 15 bp, Homo sapiens
aaagtcgaattaata

SEQ ID NO: 889604 - DNA, 16 bp, Homo sapiens
aaagtctaaactgtta

SEQ ID NO: 889605 - DNA, 13 bp, Homo sapiens
aaagtctgagaaa

SEQ ID NO: 889606 - DNA, 15 bp, Homo sapiens
aaagtctgagaaata

SEQ ID NO: 889607 - DNA, 21 bp, Homo sapiens
aaagtctgtatggcatgacaa

SEQ ID NO: 889608 - DNA, 18 bp, Homo sapiens
aaagtctgtctttcctga

SEQ ID NO: 889609 - DNA, 22 bp, Homo sapiens
aaagtctgtgtgatgaactttc

SEQ ID NO: 889610 - DNA, 18 bp, Homo sapiens
aaagtctgttgattaaag

SEQ ID NO: 889611 - DNA, 20 bp, Homo sapiens
aaagtctgttgattaaagat

SEQ ID NO: 889612 - DNA, 17 bp, Homo sapiens
aaagtgaaaaaaagaaa

SEQ ID NO: 889613 - DNA, 19 bp, Homo sapiens
aaagtgaacttttgtaatt

SEQ ID NO: 889614 - DNA, 23 bp, Homo sapiens
aaagtgaacttttgtaatttgaa

SEQ ID NO: 889615 - DNA, 13 bp, Homo sapiens
aaagtgaagcaaa

SEQ ID NO: 889616 - DNA, 14 bp, Homo sapiens
aaagtgaaggaaat

SEQ ID NO: 889617 - DNA, 15 bp, Homo sapiens
aaagtgaaggaaata

SEQ ID NO: 889618 - DNA, 19 bp, Homo sapiens
aaagtgaaggaaataaagg

SEQ ID NO: 889619 - DNA, 20 bp, Homo sapiens
aaagtgaagtgaatctgatt

SEQ ID NO: 889620 - DNA, 15 bp, Homo sapiens
aaagtgaatttgaat

SEQ ID NO: 889621 - DNA, 17 bp, Homo sapiens
aaagtgaatttgaatga

SEQ ID NO: 889622 - DNA, 19 bp, Homo sapiens
aaagtgaatttgaatgaaa

SEQ ID NO: 889623 - DNA, 14 bp, Homo sapiens
aaagtgacacagca

SEQ ID NO: 889624 - DNA, 11 bp, Homo sapiens
aaagtgacttt

SEQ ID NO: 889625 - DNA, 21 bp, Homo sapiens
aaagtgactttaaaagaaaat

SEQ ID NO: 889626 - DNA, 21 bp, Homo sapiens
aaagtgataatttctggaatt

SEQ ID NO: 889627 - DNA, 23 bp, Homo sapiens
aaagtgatcaataaaatgtgatt

SEQ ID NO: 889628 - DNA, 17 bp, Homo sapiens
aaagtgatgtattttca

SEQ ID NO: 889629 - DNA, 21 bp, Homo sapiens
aaagtgatgtttgtgtgtttt

SEQ ID NO: 889630 - DNA, 21 bp, Homo sapiens
aaagtgattatctctttgatc

SEQ ID NO: 889631 - DNA, 21 bp, Homo sapiens
aaagttgcgtttaagttgtat

SEQ ID NO: 889632 - DNA, 15 bp, Homo sapiens
aaagttgcttttatt

SEQ ID NO: 889633 - DNA, 22 bp, Homo sapiens
aaagttgtaaaatagaaaaagt

SEQ ID NO: 889634 - DNA, 23 bp, Homo sapiens
aaagttgtagttcttgtgcatgt

SEQ ID NO: 889635 - DNA, 13 bp, Homo sapiens
aaagttgtatcca

SEQ ID NO: 889636 - DNA, 17 bp, Homo sapiens
aaagttgtatccattaa

SEQ ID NO: 889637 - DNA, 14 bp, Homo sapiens
aaagttgtcttaaa

SEQ ID NO: 889638 - DNA, 13 bp, Homo sapiens
aaagttgttgtaa

SEQ ID NO: 889639 - DNA, 15 bp, Homo sapiens
aaagtttaataaatt

SEQ ID NO: 889640 - DNA, 15 bp, Homo sapiens
aaagtttaatcagag

SEQ ID NO: 889641 - DNA, 21 bp, Homo sapiens
aaagtttacaacttgattttt

SEQ ID NO: 889642 - DNA, 19 bp, Homo sapiens
aaagtttacaagtgtatat

SEQ ID NO: 889643 - DNA, 18 bp, Homo sapiens
aaagtttataaaagtgaa

SEQ ID NO: 889644 - DNA, 13 bp, Homo sapiens
aaagtttccatat

SEQ ID NO: 889645 - DNA, 11 bp, Homo sapiens
aaagtttgttg

SEQ ID NO: 889646 - DNA, 14 bp, Homo sapiens
aaagtttgtttgct

SEQ ID NO: 889647 - DNA, 14 bp, Homo sapiens
aaagttttacagag

SEQ ID NO: 889648 - DNA, 22 bp, Homo sapiens
aaagttttacagagaggataca

SEQ ID NO: 889649 - DNA, 16 bp, Homo sapiens
aaagttttccagtatt

SEQ ID NO: 889650 - DNA, 13 bp, Homo sapiens
aaagttttgcaac

SEQ ID NO: 889651 - DNA, 18 bp, Homo sapiens
aaagttttgtaaaagaaa

SEQ ID NO: 889652 - DNA, 19 bp, Homo sapiens
aaataaaaaaaaaaggatg

SEQ ID NO: 889653 - DNA, 22 bp, Homo sapiens
aaataaaaaaaaaaggatgaaa

SEQ ID NO: 889654 - DNA, 13 bp, Homo sapiens
aaataaaaaaaag

SEQ ID NO: 889655 - DNA, 21 bp, Homo sapiens
aaataaaaaagctcttttaat

SEQ ID NO: 889656 - DNA, 13 bp, Homo sapiens
aaataaaaagaaa

SEQ ID NO: 889657 - DNA, 19 bp, Homo sapiens
aaataaaaagtaatgactt

SEQ ID NO: 889658 - DNA, 19 bp, Homo sapiens
aaataaaaagtatgttgta

SEQ ID NO: 889659 - DNA, 14 bp, Homo sapiens
aaataaaaagtgac

SEQ ID NO: 889660 - DNA, 20 bp, Homo sapiens
aaataaaaagtgacacagca

SEQ ID NO: 889661 - DNA, 17 bp, Homo sapiens
aaataaaaatatgtaat

SEQ ID NO: 889662 - DNA, 15 bp, Homo sapiens
aaataaaaatggata

SEQ ID NO: 889663 - DNA, 13 bp, Homo sapiens
aaataaaaattct

SEQ ID NO: 889664 - DNA, 16 bp, Homo sapiens
aaataaaaattctgaa

SEQ ID NO: 889665 - DNA, 17 bp, Homo sapiens
aaataaaacacacctcg

SEQ ID NO: 889666 - DNA, 20 bp, Homo sapiens
aaataaaacccaatactttt

SEQ ID NO: 889667 - DNA, 15 bp, Homo sapiens
aaataaaacctttca

SEQ ID NO: 889668 - DNA, 13 bp, Homo sapiens
aaataaaactgaa

SEQ ID NO: 889669 - DNA, 18 bp, Homo sapiens
aaataaaacttgagccca

SEQ ID NO: 889670 - DNA, 13 bp, Homo sapiens
aaataaaactttt

SEQ ID NO: 889671 - DNA, 19 bp, Homo sapiens
aaataaaactttttaaaat

SEQ ID NO: 889672 - DNA, 18 bp, Homo sapiens
aaataaaaggaagccaaa

SEQ ID NO: 889673 - DNA, 18 bp, Homo sapiens
aaataaaatactttttat

SEQ ID NO: 889674 - DNA, 21 bp, Homo sapiens
aaataaaatcaccaaaaacat

SEQ ID NO: 889675 - DNA, 21 bp, Homo sapiens
aaataaaatgaaaattgtatt

SEQ ID NO: 889676 - DNA, 20 bp, Homo sapiens
aaataaaatgaacatctctt

SEQ ID NO: 889677 - DNA, 23 bp, Homo sapiens
aaataaaatgccatagtttgtga

SEQ ID NO: 889678 - DNA, 17 bp, Homo sapiens
aaataaaatgtgtacag

SEQ ID NO: 889679 - DNA, 23 bp, Homo sapiens
aaataaaatgtgtacagtgaatt

SEQ ID NO: 889680 - DNA, 16 bp, Homo sapiens
aaataaaatgtttcat

SEQ ID NO: 889681 - DNA, 20 bp, Homo sapiens
aaataaaatgtttcattatg

SEQ ID NO: 889682 - DNA, 16 bp, Homo sapiens
aaataaacaataagac

SEQ ID NO: 889683 - DNA, 23 bp, Homo sapiens
aaataaacacatagattcacctg

SEQ ID NO: 889684 - DNA, 19 bp, Homo sapiens
aaataaacagatgtattat

SEQ ID NO: 889685 - DNA, 16 bp, Homo sapiens
aaataaacatcagttt

SEQ ID NO: 889686 - DNA, 14 bp, Homo sapiens
aaataaaccactgt

SEQ ID NO: 889687 - DNA, 18 bp, Homo sapiens
aaataaacctgcactgaa

SEQ ID NO: 889688 - DNA, 21 bp, Homo sapiens
aaataaacgtggattttaaaa

SEQ ID NO: 889689 - DNA, 12 bp, Homo sapiens
aaataaactcat

SEQ ID NO: 889690 - DNA, 17 bp, Homo sapiens
aaataaactgttttcaa

SEQ ID NO: 889691 - DNA, 18 bp, Homo sapiens
aaataaactgttttcaag

SEQ ID NO: 889692 - DNA, 11 bp, Homo sapiens
aaataaagaaa

SEQ ID NO: 889693 - DNA, 18 bp, Homo sapiens
aaataaagaaatttggta

SEQ ID NO: 889694 - DNA, 14 bp, Homo sapiens
aaataaagaagtat

SEQ ID NO: 889695 - DNA, 19 bp, Homo sapiens
aaataaagaatatgccgtt

SEQ ID NO: 889696 - DNA, 16 bp, Homo sapiens
aaataaaggataactc

SEQ ID NO: 889697 - DNA, 15 bp, Homo sapiens
aaataaagtatatat

SEQ ID NO: 889698 - DNA, 20 bp, Homo sapiens
aaataaagtatatatagaat

SEQ ID NO: 889699 - DNA, 18 bp, Homo sapiens
aaataaagtatcatgcat

SEQ ID NO: 889700 - DNA, 19 bp, Homo sapiens
aaataaagtatcatgcatt

SEQ ID NO: 889701 - DNA, 22 bp, Homo sapiens
aaataaagtttcagcggaacac

SEQ ID NO: 889702 - DNA, 20 bp, Homo sapiens
aaataaagtttgcttagaaa

SEQ ID NO: 889703 - DNA, 15 bp, Homo sapiens
aaataaatagaaaga

SEQ ID NO: 889704 - DNA, 11 bp, Homo sapiens
aaataaatata

SEQ ID NO: 889705 - DNA, 12 bp, Homo sapiens
aaataaatattt

SEQ ID NO: 889706 - DNA, 15 bp, Homo sapiens
aaataaatgaaactt

SEQ ID NO: 889707 - DNA, 19 bp, Homo sapiens
aaataaatgattatattca

SEQ ID NO: 889708 - DNA, 21 bp, Homo sapiens
aaataaatgtatcatagaaat

SEQ ID NO: 889709 - DNA, 15 bp, Homo sapiens
aaataaatgtttcaa

SEQ ID NO: 889710 - DNA, 17 bp, Homo sapiens
aaataaatgtttcaaat

SEQ ID NO: 889711 - DNA, 19 bp, Homo sapiens
aaataaatgtttcaaatgc

SEQ ID NO: 889712 - DNA, 12 bp, Homo sapiens
aaataaattagt

SEQ ID NO: 889713 - DNA, 14 bp, Homo sapiens
aaataaattcctaa

SEQ ID NO: 889714 - DNA, 15 bp, Homo sapiens
aaataaattcctaca

SEQ ID NO: 889715 - DNA, 21 bp, Homo sapiens
aaataaatttaactttaacca

SEQ ID NO: 889716 - DNA, 13 bp, Homo sapiens
aaataaatttccc

SEQ ID NO: 889717 - DNA, 14 bp, Homo sapiens
aaataaatttctgg

SEQ ID NO: 889718 - DNA, 16 bp, Homo sapiens
aaataacaaaattttt

SEQ ID NO: 889719 - DNA, 17 bp, Homo sapiens
aaataacaatgtgctct

SEQ ID NO: 889720 - DNA, 21 bp, Homo sapiens
aaataacacacatataaacat

SEQ ID NO: 889721 - DNA, 15 bp, Homo sapiens
aaataacacagagag

SEQ ID NO: 889722 - DNA, 23 bp, Homo sapiens
aaataacacagagagacagactt

SEQ ID NO: 889723 - DNA, 20 bp, Homo sapiens
aaataacaggcatttgttca

SEQ ID NO: 889724 - DNA, 15 bp, Homo sapiens
aaataacattctgaa

SEQ ID NO: 889725 - DNA, 15 bp, Homo sapiens
aaataacattgcact

SEQ ID NO: 889726 - DNA, 12 bp, Homo sapiens
aaataaccacaa

SEQ ID NO: 889727 - DNA, 16 bp, Homo sapiens
aaataaccacaaggtc

SEQ ID NO: 889728 - DNA, 14 bp, Homo sapiens
aaataacctatttt

SEQ ID NO: 889729 - DNA, 17 bp, Homo sapiens
aaataacctctggccct

SEQ ID NO: 889730 - DNA, 19 bp, Homo sapiens
aaataacctctggcccttg

SEQ ID NO: 889731 - DNA, 15 bp, Homo sapiens
aaataactaaaatgt

SEQ ID NO: 889732 - DNA, 15 bp, Homo sapiens
aaataactaagagat

SEQ ID NO: 889733 - DNA, 18 bp, Homo sapiens
aaataactgaatttggag

SEQ ID NO: 889734 - DNA, 20 bp, Homo sapiens
aaataactggaaaacagaac

SEQ ID NO: 889735 - DNA, 21 bp, Homo sapiens
aaataactggaaaacagaaca

SEQ ID NO: 889736 - DNA, 20 bp, Homo sapiens
aaataactggaacaaattat

SEQ ID NO: 889737 - DNA, 16 bp, Homo sapiens
aaataacttcaagcaa

SEQ ID NO: 889738 - DNA, 18 bp, Homo sapiens
aaataacttcaagcaaac

SEQ ID NO: 889739 - DNA, 14 bp, Homo sapiens
aaataacttcagtc

SEQ ID NO: 889740 - DNA, 16 bp, Homo sapiens
aaataacttcagtcct

SEQ ID NO: 889741 - DNA, 12 bp, Homo sapiens
aaataagaaaag

SEQ ID NO: 889742 - DNA, 13 bp, Homo sapiens
aaataagaaaaga

SEQ ID NO: 889743 - DNA, 22 bp, Homo sapiens
aaataagaaaagatgtagattt

SEQ ID NO: 889744 - DNA, 24 bp, Homo sapiens
aaataagaaacaactctttgagaa

SEQ ID NO: 889745 - DNA, 17 bp, Homo sapiens
aaataagaatagaaata

SEQ ID NO: 889746 - DNA, 12 bp, Homo sapiens
aaataagagaga

SEQ ID NO: 889747 - DNA, 14 bp, Homo sapiens
aaataagagatttg

SEQ ID NO: 889748 - DNA, 15 bp, Homo sapiens
aaataagagttgctt

SEQ ID NO: 889749 - DNA, 15 bp, Homo sapiens
aaataagcaggtgga

SEQ ID NO: 889750 - DNA, 22 bp, Homo sapiens
aaataagcaggtggatctattt

SEQ ID NO: 889751 - DNA, 17 bp, Homo sapiens
aaataaggaatttcctc

SEQ ID NO: 889752 - DNA, 16 bp, Homo sapiens
aaataaggtaaaattt

SEQ ID NO: 889753 - DNA, 12 bp, Homo sapiens
aaataagtattt

SEQ ID NO: 889754 - DNA, 18 bp, Homo sapiens
aaataagtcaacagtaaa

SEQ ID NO: 889755 - DNA, 21 bp, Homo sapiens
aaataagtcaacagtaaacca

SEQ ID NO: 889756 - DNA, 15 bp, Homo sapiens
aaataagttaaaggc

SEQ ID NO: 889757 - DNA, 17 bp, Homo sapiens
aaataagtttttcttta

SEQ ID NO: 889758 - DNA, 17 bp, Homo sapiens
aaataataaaatgcaaa

SEQ ID NO: 889759 - DNA, 19 bp, Homo sapiens
aaataataaagatgctctt

SEQ ID NO: 889760 - DNA, 14 bp, Homo sapiens
aaataataataaag

SEQ ID NO: 889761 - DNA, 18 bp, Homo sapiens
aaataataataaagtgtt

SEQ ID NO: 889762 - DNA, 17 bp, Homo sapiens
aaataatatatttcttc

SEQ ID NO: 889763 - DNA, 14 bp, Homo sapiens
aaataatcaagatt

SEQ ID NO: 889764 - DNA, 19 bp, Homo sapiens
aaataatgaatacatttcc

SEQ ID NO: 889765 - DNA, 13 bp, Homo sapiens
aaataatgctgtt

SEQ ID NO: 889766 - DNA, 17 bp, Homo sapiens
aaataatgcttcagata

SEQ ID NO: 889767 - DNA, 13 bp, Homo sapiens
aaataatgtgaaa

SEQ ID NO: 889768 - DNA, 22 bp, Homo sapiens
aaataattatataactgtattt

SEQ ID NO: 889769 - DNA, 23 bp, Homo sapiens
aaataattatataactgtatttg

SEQ ID NO: 889770 - DNA, 16 bp, Homo sapiens
aaataattattttatt

SEQ ID NO: 889771 - DNA, 13 bp, Homo sapiens
aaataattgttgt

SEQ ID NO: 889772 - DNA, 18 bp, Homo sapiens
aaataattgttgtgtgta

SEQ ID NO: 889773 - DNA, 15 bp, Homo sapiens
aaataattgttgttc

SEQ ID NO: 889774 - DNA, 17 bp, Homo sapiens
aaataattgttgttctg

SEQ ID NO: 889775 - DNA, 14 bp, Homo sapiens
aaataatttgcact

SEQ ID NO: 889776 - DNA, 13 bp, Homo sapiens
aaataatttgtgt

SEQ ID NO: 889777 - DNA, 21 bp, Homo sapiens
aaataatttgtgtctgtgttt

SEQ ID NO: 889778 - DNA, 20 bp, Homo sapiens
aaataattttccaagtaaag

SEQ ID NO: 889779 - DNA, 15 bp, Homo sapiens
aaatacaaaacttcc

SEQ ID NO: 889780 - DNA, 15 bp, Homo sapiens
aaatacaaattttgt

SEQ ID NO: 889781 - DNA, 13 bp, Homo sapiens
aaatacaagactg

SEQ ID NO: 889782 - DNA, 12 bp, Homo sapiens
aaatacaataaa

SEQ ID NO: 889783 - DNA, 13 bp, Homo sapiens
aaatacaattttt

SEQ ID NO: 889784 - DNA, 22 bp, Homo sapiens
aaatacaccacctcactcctgt

SEQ ID NO: 889785 - DNA, 20 bp, Homo sapiens
aaatacactgaattgaatct

SEQ ID NO: 889786 - DNA, 14 bp, Homo sapiens
aaatacacttcttt

SEQ ID NO: 889787 - DNA, 22 bp, Homo sapiens
aaatacagacactaagttatag

SEQ ID NO: 889788 - DNA, 11 bp, Homo sapiens
aaatacagata

SEQ ID NO: 889789 - DNA, 22 bp, Homo sapiens
aaatacagataattcatttgta

SEQ ID NO: 889790 - DNA, 23 bp, Homo sapiens
aaatacagataattcatttgtat

SEQ ID NO: 889791 - DNA, 17 bp, Homo sapiens
aaatacagatagatata

SEQ ID NO: 889792 - DNA, 15 bp, Homo sapiens
aaatacagctggcta

SEQ ID NO: 889793 - DNA, 22 bp, Homo sapiens
aaatacagtcttccatttgcaa

SEQ ID NO: 889794 - DNA, 23 bp, Homo sapiens
aaatacagtcttccatttgcaag

SEQ ID NO: 889795 - DNA, 13 bp, Homo sapiens
aaatacatctttt

SEQ ID NO: 889796 - DNA, 19 bp, Homo sapiens
aaatacatgcatataatga

SEQ ID NO: 889797 - DNA, 11 bp, Homo sapiens
aaatacatgta

SEQ ID NO: 889798 - DNA, 17 bp, Homo sapiens
aaatacatttaaaacat

SEQ ID NO: 889799 - DNA, 14 bp, Homo sapiens
aaatacatttgtaa

SEQ ID NO: 889800 - DNA, 15 bp, Homo sapiens
aaataccaagagcaa

SEQ ID NO: 889801 - DNA, 15 bp, Homo sapiens
aaataccattgaaat

SEQ ID NO: 889802 - DNA, 15 bp, Homo sapiens
aaatatactatgaaa

SEQ ID NO: 889803 - DNA, 13 bp, Homo sapiens
aaatatactttta

SEQ ID NO: 889804 - DNA, 20 bp, Homo sapiens
aaatatagctgtacaaatat

SEQ ID NO: 889805 - DNA, 15 bp, Homo sapiens
aaatataggaactta

SEQ ID NO: 889806 - DNA, 14 bp, Homo sapiens
aaatatataaatat

SEQ ID NO: 889807 - DNA, 12 bp, Homo sapiens
aaatatataata

SEQ ID NO: 889808 - DNA, 20 bp, Homo sapiens
aaatatatatatatataaaa

SEQ ID NO: 889809 - DNA, 19 bp, Homo sapiens
aaatatatatgatcattga

SEQ ID NO: 889810 - DNA, 14 bp, Homo sapiens
aaatatatatgtca

SEQ ID NO: 889811 - DNA, 18 bp, Homo sapiens
aaatatatattatatatt

SEQ ID NO: 889812 - DNA, 21 bp, Homo sapiens
aaatatatattcacctagcaa

SEQ ID NO: 889813 - DNA, 12 bp, Homo sapiens
aaatatatattt

SEQ ID NO: 889814 - DNA, 18 bp, Homo sapiens
aaatatatatttttcaaa

SEQ ID NO: 889815 - DNA, 22 bp, Homo sapiens
aaatatatatttttcaaataga

SEQ ID NO: 889816 - DNA, 14 bp, Homo sapiens
aaatatatgcttac

SEQ ID NO: 889817 - DNA, 11 bp, Homo sapiens
aaatatatgta

SEQ ID NO: 889818 - DNA, 15 bp, Homo sapiens
aaatatatgtatgta

SEQ ID NO: 889819 - DNA, 16 bp, Homo sapiens
aaatatatgtatgtaa

SEQ ID NO: 889820 - DNA, 15 bp, Homo sapiens
aaatatatgtattta

SEQ ID NO: 889821 - DNA, 22 bp, Homo sapiens
aaatatatgtatttttatataa

SEQ ID NO: 889822 - DNA, 19 bp, Homo sapiens
aaatatattacttaactgt

SEQ ID NO: 889823 - DNA, 20 bp, Homo sapiens
aaatatatttaagataatta

SEQ ID NO: 889824 - DNA, 22 bp, Homo sapiens
aaatatatttaagataattata

SEQ ID NO: 889825 - DNA, 13 bp, Homo sapiens
aaatatatttgta

SEQ ID NO: 889826 - DNA, 14 bp, Homo sapiens
aaatatatttgtaa

SEQ ID NO: 889827 - DNA, 14 bp, Homo sapiens
aaatatcaaagtca

SEQ ID NO: 889828 - DNA, 22 bp, Homo sapiens
aaatatcaaagtcattaaagac

SEQ ID NO: 889829 - DNA, 19 bp, Homo sapiens
aaatatcagacaagcacta

SEQ ID NO: 889830 - DNA, 21 bp, Homo sapiens
aaatatccaaagactgtactg

SEQ ID NO: 889831 - DNA, 17 bp, Homo sapiens
aaatatccacagtactc

SEQ ID NO: 889832 - DNA, 13 bp, Homo sapiens
aaatatcccagag

SEQ ID NO: 889833 - DNA, 19 bp, Homo sapiens
aaatatccccttcttacaa

SEQ ID NO: 889834 - DNA, 13 bp, Homo sapiens
aaatatctctaaa

SEQ ID NO: 889835 - DNA, 21 bp, Homo sapiens
aaatatctgaaaatgtatgtg

SEQ ID NO: 889836 - DNA, 21 bp, Homo sapiens
aaatatctgtgaaatatcatc

SEQ ID NO: 889837 - DNA, 17 bp, Homo sapiens
aaatatcttcctttggg

SEQ ID NO: 889838 - DNA, 14 bp, Homo sapiens
aaatatcttggcct

SEQ ID NO: 889839 - DNA, 15 bp, Homo sapiens
aaatatctttctctt

SEQ ID NO: 889840 - DNA, 17 bp, Homo sapiens
aaatatgaaaaatgtaa

SEQ ID NO: 889841 - DNA, 17 bp, Homo sapiens
aaatcacgctttttgaa

SEQ ID NO: 889842 - DNA, 18 bp, Homo sapiens
aaatcactattgaaaaat

SEQ ID NO: 889843 - DNA, 15 bp, Homo sapiens
aaatcactgtattta

SEQ ID NO: 889844 - DNA, 12 bp, Homo sapiens
aaatcactgtga

SEQ ID NO: 889845 - DNA, 21 bp, Homo sapiens
aaatcactgtgaaatttcatg

SEQ ID NO: 889846 - DNA, 12 bp, Homo sapiens
aaatcactgttt

SEQ ID NO: 889847 - DNA, 13 bp, Homo sapiens
aaatcacttcaga

SEQ ID NO: 889848 - DNA, 14 bp, Homo sapiens
aaatcacttcagat

SEQ ID NO: 889849 - DNA, 13 bp, Homo sapiens
aaatcagaaagta

SEQ ID NO: 889850 - DNA, 16 bp, Homo sapiens
aaatcagaaagtaaca

SEQ ID NO: 889851 - DNA, 14 bp, Homo sapiens
aaatcagaaagttt

SEQ ID NO: 889852 - DNA, 16 bp, Homo sapiens
aaatcagagacaaaat

SEQ ID NO: 889853 - DNA, 18 bp, Homo sapiens
aaatcagagagcaaggca

SEQ ID NO: 889854 - DNA, 20 bp, Homo sapiens
aaatcagaggagagacggtg

SEQ ID NO: 889855 - DNA, 15 bp, Homo sapiens
aaatcagcatgacaa

SEQ ID NO: 889856 - DNA, 16 bp, Homo sapiens
aaatcagcatgacaaa

SEQ ID NO: 889857 - DNA, 18 bp, Homo sapiens
aaatcagcccccagcctt

SEQ ID NO: 889858 - DNA, 18 bp, Homo sapiens
aaatcagcctgctccagc

SEQ ID NO: 889859 - DNA, 23 bp, Homo sapiens
aaatcagcctgctccagctgttc

SEQ ID NO: 889860 - DNA, 18 bp, Homo sapiens
aaatcagctattttgtga

SEQ ID NO: 889861 - DNA, 19 bp, Homo sapiens
aaatcagctattttgtgaa

SEQ ID NO: 889862 - DNA, 22 bp, Homo sapiens
aaatcaggcttttgtttccttt

SEQ ID NO: 889863 - DNA, 17 bp, Homo sapiens
aaatcaggggccagaga

SEQ ID NO: 889864 - DNA, 22 bp, Homo sapiens
aaatcaggtagaccatattcta

SEQ ID NO: 889865 - DNA, 16 bp, Homo sapiens
aaatcaggtgttttaa

SEQ ID NO: 889866 - DNA, 16 bp, Homo sapiens
aaatcaggttttcttt

SEQ ID NO: 889867 - DNA, 11 bp, Homo sapiens
aaatcagtaag

SEQ ID NO: 889868 - DNA, 15 bp, Homo sapiens
aaatcagtatcagaa

SEQ ID NO: 889869 - DNA, 22 bp, Homo sapiens
aaatcagtcttccttgtggaat

SEQ ID NO: 889870 - DNA, 13 bp, Homo sapiens
aaatcagtgatct

SEQ ID NO: 889871 - DNA, 23 bp, Homo sapiens
aaatcagtgcctggtgttctgaa

SEQ ID NO: 889872 - DNA, 14 bp, Homo sapiens
aaatcatcaagaag

SEQ ID NO: 889873 - DNA, 19 bp, Homo sapiens
aaatcatcaagaagggctg

SEQ ID NO: 889874 - DNA, 16 bp, Homo sapiens
aaatcatctcaccttg

SEQ ID NO: 889875 - DNA, 12 bp, Homo sapiens
aaatgaacaaaa

SEQ ID NO: 889876 - DNA, 22 bp, Homo sapiens
aaatgaacgatatgtagcagaa

SEQ ID NO: 889877 - DNA, 23 bp, Homo sapiens
aaatgaacgatatgtagcagaaa

SEQ ID NO: 889878 - DNA, 15 bp, Homo sapiens
aaatgaacttttaca

SEQ ID NO: 889879 - DNA, 18 bp, Homo sapiens
aaatgaacttttacagaa

SEQ ID NO: 889880 - DNA, 22 bp, Homo sapiens
aaatgaacttttacagaatgca

SEQ ID NO: 889881 - DNA, 19 bp, Homo sapiens
aaatgaaggttaggattta

SEQ ID NO: 889882 - DNA, 17 bp, Homo sapiens
aaatgaataagctttct

SEQ ID NO: 889883 - DNA, 18 bp, Homo sapiens
aaatgaataatttattat

SEQ ID NO: 889884 - DNA, 20 bp, Homo sapiens
aaatgaataatttattatta

SEQ ID NO: 889885 - DNA, 15 bp, Homo sapiens
aaatgaataatttcc

SEQ ID NO: 889886 - DNA, 17 bp, Homo sapiens
aaatgaataatttccca

SEQ ID NO: 889887 - DNA, 14 bp, Homo sapiens
aaatgaatagcttg

SEQ ID NO: 889888 - DNA, 18 bp, Homo sapiens
aaatgaatagcttgtttc

SEQ ID NO: 889889 - DNA, 16 bp, Homo sapiens
aaatgaatatctatta

SEQ ID NO: 889890 - DNA, 18 bp, Homo sapiens
aaatgaatatctattaat

SEQ ID NO: 889891 - DNA, 11 bp, Homo sapiens
aaatgaatgag

SEQ ID NO: 889892 - DNA, 21 bp, Homo sapiens
aaatgaatgtcacttctggat

SEQ ID NO: 889893 - DNA, 15 bp, Homo sapiens
aaatgaatgttgtct

SEQ ID NO: 889894 - DNA, 19 bp, Homo sapiens
aaatgaatttcatgtgaat

SEQ ID NO: 889895 - DNA, 22 bp, Homo sapiens
aaatgacaaagccattctttta

SEQ ID NO: 889896 - DNA, 23 bp, Homo sapiens
aaatgacaacagaaaaacaatct

SEQ ID NO: 889897 - DNA, 16 bp, Homo sapiens
aaatgacacccagacc

SEQ ID NO: 889898 - DNA, 17 bp, Homo sapiens
aaatgacacccagacct

SEQ ID NO: 889899 - DNA, 16 bp, Homo sapiens
aaatgacagattctga

SEQ ID NO: 889900 - DNA, 13 bp, Homo sapiens
aaatgacagtgaa

SEQ ID NO: 889901 - DNA, 22 bp, Homo sapiens
aaatgacatgttcctttaaggt

SEQ ID NO: 889902 - DNA, 15 bp, Homo sapiens
aaatgacctttttac

SEQ ID NO: 889903 - DNA, 18 bp, Homo sapiens
aaatgactcataggtccc

SEQ ID NO: 889904 - DNA, 16 bp, Homo sapiens
aaatgacttatttctg

SEQ ID NO: 889905 - DNA, 20 bp, Homo sapiens
aaatgacttatttctgctct

SEQ ID NO: 889906 - DNA, 19 bp, Homo sapiens
aaatgacttgattgtactt

SEQ ID NO: 889907 - DNA, 17 bp, Homo sapiens
aaatgactttatacaac

SEQ ID NO: 889908 - DNA, 13 bp, Homo sapiens
aaatgactttgaa

SEQ ID NO: 889909 - DNA, 14 bp, Homo sapiens
aaatgactttgaac

SEQ ID NO: 889910 - DNA, 15 bp, Homo sapiens
aaatgactttgaact

SEQ ID NO: 889911 - DNA, 15 bp, Homo sapiens
aaatgacttttctta

SEQ ID NO: 889912 - DNA, 17 bp, Homo sapiens
aaatgagaggagaacag

SEQ ID NO: 889913 - DNA, 20 bp, Homo sapiens
aaatgagagggcagtgtttc

SEQ ID NO: 889914 - DNA, 11 bp, Homo sapiens
aaatgagccct

SEQ ID NO: 889915 - DNA, 23 bp, Homo sapiens
aaatgagctcgcatttgtcaatg

SEQ ID NO: 889916 - DNA, 18 bp, Homo sapiens
aaatgagcttgattaaat

SEQ ID NO: 889917 - DNA, 21 bp, Homo sapiens
aaatgaggaatagcaaaattc

SEQ ID NO: 889918 - DNA, 21 bp, Homo sapiens
aaatgaggaatccaaaagaca

SEQ ID NO: 889919 - DNA, 22 bp, Homo sapiens
aaatgaggaatccaaaagacaa

SEQ ID NO: 889920 - DNA, 14 bp, Homo sapiens
aaatgaggaatgta

SEQ ID NO: 889921 - DNA, 18 bp, Homo sapiens
aaatgaggaatgtatatg

SEQ ID NO: 889922 - DNA, 14 bp, Homo sapiens
aaatgaggacatgt

SEQ ID NO: 889923 - DNA, 16 bp, Homo sapiens
aaatgaggacatgttt

SEQ ID NO: 889924 - DNA, 23 bp, Homo sapiens
aaatgaggtactctcctggaaat

SEQ ID NO: 889925 - DNA, 13 bp, Homo sapiens
aaatgagtaaaaa

SEQ ID NO: 889926 - DNA, 15 bp, Homo sapiens
aaatgagtaacattt

SEQ ID NO: 889927 - DNA, 20 bp, Homo sapiens
aaatgagtcaggcaattgat

SEQ ID NO: 889928 - DNA, 21 bp, Homo sapiens
aaatgagtcaggcaattgatt

SEQ ID NO: 889929 - DNA, 20 bp, Homo sapiens
aaatgagttgtgatgaatca

SEQ ID NO: 889930 - DNA, 17 bp, Homo sapiens
aaatgataaagactttt

SEQ ID NO: 889931 - DNA, 19 bp, Homo sapiens
aaatgataaagacttttat

SEQ ID NO: 889932 - DNA, 15 bp, Homo sapiens
aaatgatatttaggt

SEQ ID NO: 889933 - DNA, 13 bp, Homo sapiens
aaatgatcatgaa

SEQ ID NO: 889934 - DNA, 22 bp, Homo sapiens
aaatgatccccaagtgtgaaca

SEQ ID NO: 889935 - DNA, 23 bp, Homo sapiens
aaatgatccccagctgtttatgc

SEQ ID NO: 889936 - DNA, 19 bp, Homo sapiens
aaatgatctgagtcccagg

SEQ ID NO: 889937 - DNA, 22 bp, Homo sapiens
aaatgatgatgtggaagaactt

SEQ ID NO: 889938 - DNA, 22 bp, Homo sapiens
aaatgatgcagctgttgagaaa

SEQ ID NO: 889939 - DNA, 17 bp, Homo sapiens
aaatgatggggagtgag

SEQ ID NO: 889940 - DNA, 15 bp, Homo sapiens
aaatgattagaagta

SEQ ID NO: 889941 - DNA, 22 bp, Homo sapiens
aaatgattataagccctgcata

SEQ ID NO: 889942 - DNA, 19 bp, Homo sapiens
aaatgattatattcacaga

SEQ ID NO: 889943 - DNA, 13 bp, Homo sapiens
aaatgattctcta

SEQ ID NO: 889944 - DNA, 15 bp, Homo sapiens
aaatgattgtaaaat

SEQ ID NO: 889945 - DNA, 17 bp, Homo sapiens
aaatgattgtgcctctg

SEQ ID NO: 889946 - DNA, 21 bp, Homo sapiens
aaatgatttaaatttaagtaa

SEQ ID NO: 889947 - DNA, 16 bp, Homo sapiens
aaatgatttgtggaaa

SEQ ID NO: 889948 - DNA, 13 bp, Homo sapiens
aaatgattttaat

SEQ ID NO: 889949 - DNA, 21 bp, Homo sapiens
aaatgcaaacacacaaaggta

SEQ ID NO: 889950 - DNA, 20 bp, Homo sapiens
aaatgcaaatgaatcattgt

SEQ ID NO: 889951 - DNA, 15 bp, Homo sapiens
aaatgcaataatttt

SEQ ID NO: 889952 - DNA, 15 bp, Homo sapiens
aaatgcaatttaaaa

SEQ ID NO: 889953 - DNA, 22 bp, Homo sapiens
aaatgcacctggaatatataac

SEQ ID NO: 889954 - DNA, 10 bp, Homo sapiens
aaatgcagaa

SEQ ID NO: 889955 - DNA, 12 bp, Homo sapiens
aaatgcagaaat

SEQ ID NO: 889956 - DNA, 17 bp, Homo sapiens
aaatgcagtatataggt

SEQ ID NO: 889957 - DNA, 14 bp, Homo sapiens
aaatgcagtatatt

SEQ ID NO: 889958 - DNA, 18 bp, Homo sapiens
aaatgcagtatatttctt

SEQ ID NO: 889959 - DNA, 20 bp, Homo sapiens
aaatgcagtcctgaggagag

SEQ ID NO: 889960 - DNA, 16 bp, Homo sapiens
aaatgcatactgttga

SEQ ID NO: 889961 - DNA, 19 bp, Homo sapiens
aaatgcatatcctgagcca

SEQ ID NO: 889962 - DNA, 22 bp, Homo sapiens
aaatgcatccattcctcaggga

SEQ ID NO: 889963 - DNA, 20 bp, Homo sapiens
aaatgcatgattttgtaacc

SEQ ID NO: 889964 - DNA, 14 bp, Homo sapiens
aaatgcatgtctta

SEQ ID NO: 889965 - DNA, 16 bp, Homo sapiens
aaatgcatgtcttaaa

SEQ ID NO: 889966 - DNA, 11 bp, Homo sapiens
aaatgccaaaa

SEQ ID NO: 889967 - DNA, 18 bp, Homo sapiens
aaatgccaagtgcctgct

SEQ ID NO: 889968 - DNA, 15 bp, Homo sapiens
aaatgccactcccta

SEQ ID NO: 889969 - DNA, 15 bp, Homo sapiens
aaatgccagaaacag

SEQ ID NO: 889970 - DNA, 23 bp, Homo sapiens
aaatgcccaaaagaggtgtcatg

SEQ ID NO: 889971 - DNA, 16 bp, Homo sapiens
aaatgtattgattcaa

SEQ ID NO: 889972 - DNA, 23 bp, Homo sapiens
aaatgtatttaattaaatctcaa

SEQ ID NO: 889973 - DNA, 15 bp, Homo sapiens
aaatgtcaaattgat

SEQ ID NO: 889974 - DNA, 16 bp, Homo sapiens
aaatgtcagttctgat

SEQ ID NO: 889975 - DNA, 13 bp, Homo sapiens
aaatgtccctcca

SEQ ID NO: 889976 - DNA, 15 bp, Homo sapiens
aaatgtcctgcatgg

SEQ ID NO: 889977 - DNA, 22 bp, Homo sapiens
aaatgtcgatcaagagaatcaa

SEQ ID NO: 889978 - DNA, 12 bp, Homo sapiens
aaatgtctgctg

SEQ ID NO: 889979 - DNA, 21 bp, Homo sapiens
aaatgtctgctggtatttcta

SEQ ID NO: 889980 - DNA, 18 bp, Homo sapiens
aaatgtctgtaataatag

SEQ ID NO: 889981 - DNA, 12 bp, Homo sapiens
aaatgtcttgct

SEQ ID NO: 889982 - DNA, 22 bp, Homo sapiens
aaatgtcttgctgttgacatat

SEQ ID NO: 889983 - DNA, 13 bp, Homo sapiens
aaatgtcttgtgt

SEQ ID NO: 889984 - DNA, 21 bp, Homo sapiens
aaatgtctttccaaattattt

SEQ ID NO: 889985 - DNA, 18 bp, Homo sapiens
aaatgtcttttagaagat

SEQ ID NO: 889986 - DNA, 12 bp, Homo sapiens
aaatgtgaattt

SEQ ID NO: 889987 - DNA, 22 bp, Homo sapiens
aaatgtgaatttcaacttttga

SEQ ID NO: 889988 - DNA, 20 bp, Homo sapiens
aaattattctataatttcca

SEQ ID NO: 889989 - DNA, 19 bp, Homo sapiens
aaattattgatgattttgt

SEQ ID NO: 889990 - DNA, 13 bp, Homo sapiens
aaattattgtaaa

SEQ ID NO: 889991 - DNA, 17 bp, Homo sapiens
aaattattgtaaacttt

SEQ ID NO: 889992 - DNA, 19 bp, Homo sapiens
aaattattgtaaacttttt

SEQ ID NO: 889993 - DNA, 23 bp, Homo sapiens
aaattattgtaaactttttcaat

SEQ ID NO: 889994 - DNA, 15 bp, Homo sapiens
aaattatttaataaa

SEQ ID NO: 889995 - DNA, 16 bp, Homo sapiens
aaattatttattactt

SEQ ID NO: 889996 - DNA, 15 bp, Homo sapiens
aaattatttcttaat

SEQ ID NO: 889997 - DNA, 13 bp, Homo sapiens
aaattatttgaaa

SEQ ID NO: 889998 - DNA, 17 bp, Homo sapiens
aaattatttgattattt

SEQ ID NO: 889999 - DNA, 16 bp, Homo sapiens
aaattatttgtaagat

SEQ ID NO: 890000 - DNA, 21 bp, Homo sapiens
aaattatttgtaagatatttg

SEQ ID NO: 890001 - DNA, 16 bp, Homo sapiens
aaattattttaaacaa

SEQ ID NO: 890002 - DNA, 17 bp, Homo sapiens
aaattattttaatattt

SEQ ID NO: 890003 - DNA, 22 bp, Homo sapiens
aaattattttaatattttgtat

SEQ ID NO: 890004 - DNA, 14 bp, Homo sapiens
aaattcaaaaagtg

SEQ ID NO: 890005 - DNA, 16 bp, Homo sapiens
aaattcaaaagtattg

SEQ ID NO: 890006 - DNA, 15 bp, Homo sapiens
aaattcaattgtaaa

SEQ ID NO: 890007 - DNA, 20 bp, Homo sapiens
aaattcaattgtaaattgaa

SEQ ID NO: 890008 - DNA, 23 bp, Homo sapiens
aaattcaattgtaaattgaatca

SEQ ID NO: 890009 - DNA, 15 bp, Homo sapiens
aaattcacaaacttt

SEQ ID NO: 890010 - DNA, 18 bp, Homo sapiens
aaattcacaagttgtgtt

SEQ ID NO: 890011 - DNA, 13 bp, Homo sapiens
aaattcactgttt

SEQ ID NO: 890012 - DNA, 19 bp, Homo sapiens
aaattcactgtttcactga

SEQ ID NO: 890013 - DNA, 22 bp, Homo sapiens
aaattcactgtttcactgaaat

SEQ ID NO: 890014 - DNA, 15 bp, Homo sapiens
aaattcactttcatt

SEQ ID NO: 890015 - DNA, 19 bp, Homo sapiens
aaattcagagcaagttcct

SEQ ID NO: 890016 - DNA, 22 bp, Homo sapiens
aaattcagatcaaaatgccttt

SEQ ID NO: 890017 - DNA, 21 bp, Homo sapiens
aaattcagatttttacaagtc

SEQ ID NO: 890018 - DNA, 13 bp, Homo sapiens
aaattcagcattt

SEQ ID NO: 890019 - DNA, 17 bp, Homo sapiens
aaattcagtcctaagaa

SEQ ID NO: 890020 - DNA, 16 bp, Homo sapiens
aaattcatattctgtc

SEQ ID NO: 890021 - DNA, 14 bp, Homo sapiens
aaattcattttatt

SEQ ID NO: 890022 - DNA, 13 bp, Homo sapiens
aaattcattttta

SEQ ID NO: 890023 - DNA, 19 bp, Homo sapiens
aaattcattttttaaattc

SEQ ID NO: 890024 - DNA, 18 bp, Homo sapiens
aaattccaactcctgatg

SEQ ID NO: 890025 - DNA, 22 bp, Homo sapiens
aaattccaagtcctgaagtaga

SEQ ID NO: 890026 - DNA, 21 bp, Homo sapiens
aaattccagaaaggatattta

SEQ ID NO: 890027 - DNA, 17 bp, Homo sapiens
aaattccagaggactct

SEQ ID NO: 890028 - DNA, 19 bp, Homo sapiens
aaattccagaggactctgc

SEQ ID NO: 890029 - DNA, 19 bp, Homo sapiens
aaattccagcaataagaaa

SEQ ID NO: 890030 - DNA, 20 bp, Homo sapiens
aaattccagcaataagaaat

SEQ ID NO: 890031 - DNA, 11 bp, Homo sapiens
aaattccagta

SEQ ID NO: 890032 - DNA, 16 bp, Homo sapiens
aaattccatctatcag

SEQ ID NO: 890033 - DNA, 22 bp, Homo sapiens
aaattcctactccctcttccaa

SEQ ID NO: 890034 - DNA, 19 bp, Homo sapiens
aaattcctcaacagtgttt

SEQ ID NO: 890035 - DNA, 17 bp, Homo sapiens
aaattcctccttccccc

SEQ ID NO: 890036 - DNA, 22 bp, Homo sapiens
aaattccttagcttagacctca

SEQ ID NO: 890037 - DNA, 23 bp, Homo sapiens
aaattccttagcttagacctcag

SEQ ID NO: 890038 - DNA, 14 bp, Homo sapiens
aaattcgctttcta

SEQ ID NO: 890039 - DNA, 15 bp, Homo sapiens
aaattcgtagcaaat

SEQ ID NO: 890040 - DNA, 16 bp, Homo sapiens
aaattctatgttaaat

SEQ ID NO: 890041 - DNA, 16 bp, Homo sapiens
aaattctcctggaggt

SEQ ID NO: 890042 - DNA, 17 bp, Homo sapiens
aaattctgacttatgaa

SEQ ID NO: 890043 - DNA, 20 bp, Homo sapiens
aaattctgcaagtttctgtt

SEQ ID NO: 890044 - DNA, 15 bp, Homo sapiens
aaattctgctcagat

SEQ ID NO: 890045 - DNA, 21 bp, Homo sapiens
aaattctgggtgaaacccttt

SEQ ID NO: 890046 - DNA, 17 bp, Homo sapiens
aaattcttgaagttcat

SEQ ID NO: 890047 - DNA, 18 bp, Homo sapiens
aaattcttgcaaagtatc

SEQ ID NO: 890048 - DNA, 11 bp, Homo sapiens
aaattcttttt

SEQ ID NO: 890049 - DNA, 13 bp, Homo sapiens
aaattgaaaaaag

SEQ ID NO: 890050 - DNA, 23 bp, Homo sapiens
aaattgaaaaaagtggaaaacat

SEQ ID NO: 890051 - DNA, 16 bp, Homo sapiens
aaattgaaaatgacca

SEQ ID NO: 890052 - DNA, 23 bp, Homo sapiens
aaattgaaaggcattctctgaag

SEQ ID NO: 890053 - DNA, 17 bp, Homo sapiens
aaattgaaagtattcag

SEQ ID NO: 890054 - DNA, 19 bp, Homo sapiens
aaattgaaagtattcagaa

SEQ ID NO: 890055 - DNA, 20 bp, Homo sapiens
aaattgaaagtattcagaaa

SEQ ID NO: 890056 - DNA, 13 bp, Homo sapiens
aaattgaaatgta

SEQ ID NO: 890057 - DNA, 20 bp, Homo sapiens
aaattgaaatgtaaggctgt

SEQ ID NO: 890058 - DNA, 14 bp, Homo sapiens
aaattgaagtgtct

SEQ ID NO: 890059 - DNA, 14 bp, Homo sapiens
aaattgaatgcaaa

SEQ ID NO: 890060 - DNA, 20 bp, Homo sapiens
aaattgacacaagtggacct

SEQ ID NO: 890061 - DNA, 21 bp, Homo sapiens
aaattgacttagatattaaaa

SEQ ID NO: 890062 - DNA, 13 bp, Homo sapiens
aaattgagagaat

SEQ ID NO: 890063 - DNA, 15 bp, Homo sapiens
aaattgatcctttga

SEQ ID NO: 890064 - DNA, 19 bp, Homo sapiens
aaattgcaaatcttgaaat

SEQ ID NO: 890065 - DNA, 15 bp, Homo sapiens
aaattgcaacatatt

SEQ ID NO: 890066 - DNA, 16 bp, Homo sapiens
aaattgcaacatatta

SEQ ID NO: 890067 - DNA, 15 bp, Homo sapiens
aaattgcagaattca

SEQ ID NO: 890068 - DNA, 19 bp, Homo sapiens
aaattgcagtttcatgtat

SEQ ID NO: 890069 - DNA, 22 bp, Homo sapiens
aaattgctcctaagcttcaaat

SEQ ID NO: 890070 - DNA, 13 bp, Homo sapiens
aaattgctccttg

SEQ ID NO: 890071 - DNA, 14 bp, Homo sapiens
aaattgctccttga

SEQ ID NO: 890072 - DNA, 13 bp, Homo sapiens
aaattgcttctag

SEQ ID NO: 890073 - DNA, 13 bp, Homo sapiens
aaattgcttttgt

SEQ ID NO: 890074 - DNA, 18 bp, Homo sapiens
aaattgcttttgttgtga

SEQ ID NO: 890075 - DNA, 16 bp, Homo sapiens
aaattggaacagaatg

SEQ ID NO: 890076 - DNA, 15 bp, Homo sapiens
aaattggcaccatgt

SEQ ID NO: 890077 - DNA, 16 bp, Homo sapiens
aaattggcatggaaat

SEQ ID NO: 890078 - DNA, 21 bp, Homo sapiens
aaattggcatggaaatttaaa

SEQ ID NO: 890079 - DNA, 15 bp, Homo sapiens
aaattgggaaaggag

SEQ ID NO: 890080 - DNA, 20 bp, Homo sapiens
aaattgggaaaggagtagaa

SEQ ID NO: 890081 - DNA, 17 bp, Homo sapiens
aaattgggacaacagtg

SEQ ID NO: 890082 - DNA, 22 bp, Homo sapiens
aaattgggacaacagtgctttg

SEQ ID NO: 890083 - DNA, 19 bp, Homo sapiens
aaattgggctggattgtgc

SEQ ID NO: 890084 - DNA, 15 bp, Homo sapiens
aaattggtacatagg

SEQ ID NO: 890085 - DNA, 15 bp, Homo sapiens
aaattggtctgaaag

SEQ ID NO: 890086 - DNA, 17 bp, Homo sapiens
aaattgtaaattttaga

SEQ ID NO: 890087 - DNA, 15 bp, Homo sapiens
aaattgtacatattt

SEQ ID NO: 890088 - DNA, 15 bp, Homo sapiens
aaattgtacattttg

SEQ ID NO: 890089 - DNA, 20 bp, Homo sapiens
aaattgtatacattttgtta

SEQ ID NO: 890090 - DNA, 13 bp, Homo sapiens
aaattgtatattg

SEQ ID NO: 890091 - DNA, 22 bp, Homo sapiens
aaattgtatctagtgcagctga

SEQ ID NO: 890092 - DNA, 14 bp, Homo sapiens
aaattgtatgaaaa

SEQ ID NO: 890093 - DNA, 19 bp, Homo sapiens
aaattgtatgaaaatcctt

SEQ ID NO: 890094 - DNA, 19 bp, Homo sapiens
aaattgtcgggggagagag

SEQ ID NO: 890095 - DNA, 18 bp, Homo sapiens
aaattgtctaaaatgtca

SEQ ID NO: 890096 - DNA, 22 bp, Homo sapiens
aaattgtctttaaaaactgttt

SEQ ID NO: 890097 - DNA, 16 bp, Homo sapiens
aaattgttatcaaaat

SEQ ID NO: 890098 - DNA, 17 bp, Homo sapiens
aaattgttctacttgaa

SEQ ID NO: 890099 - DNA, 17 bp, Homo sapiens
aaattgttctcttaaat

SEQ ID NO: 890100 - DNA, 23 bp, Homo sapiens
aaattgtttatgtgttatgaaca

SEQ ID NO: 890101 - DNA, 17 bp, Homo sapiens
aaattgtttcatatctg

SEQ ID NO: 890102 - DNA, 23 bp, Homo sapiens
aaattgtttgacggcaaggttta

SEQ ID NO: 890103 - DNA, 15 bp, Homo sapiens
aaattgtttgtacag

SEQ ID NO: 890104 - DNA, 18 bp, Homo sapiens
aaattgttttaccagctc

SEQ ID NO: 890105 - DNA, 12 bp, Homo sapiens
aaattgttttca

SEQ ID NO: 890106 - DNA, 21 bp, Homo sapiens
aaattgttttcacttgtattg

SEQ ID NO: 890107 - DNA, 16 bp, Homo sapiens
aaatttaaaattacgt

SEQ ID NO: 890108 - DNA, 19 bp, Homo sapiens
aaatttaaactataagcaa

SEQ ID NO: 890109 - DNA, 17 bp, Homo sapiens
aaatttaagcattgttt

SEQ ID NO: 890110 - DNA, 18 bp, Homo sapiens
aacaacctcaactgccta

SEQ ID NO: 890111 - DNA, 14 bp, Homo sapiens
aacaacctgaatct

SEQ ID NO: 890112 - DNA, 18 bp, Homo sapiens
aacaacctgaatcttttt

SEQ ID NO: 890113 - DNA, 12 bp, Homo sapiens
aacaactgggtc

SEQ ID NO: 890114 - DNA, 22 bp, Homo sapiens
aacaacttaatgttctgaataa

SEQ ID NO: 890115 - DNA, 17 bp, Homo sapiens
aacaacttgtagcagct

SEQ ID NO: 890116 - DNA, 23 bp, Homo sapiens
aacaactttagcatcagaaggtt

SEQ ID NO: 890117 - DNA, 14 bp, Homo sapiens
actttttttgtatg

SEQ ID NO: 890118 - DNA, 18 bp, Homo sapiens
acttttttttagttcaat

SEQ ID NO: 890119 - DNA, 15 bp, Homo sapiens
acttttttttgagaa

SEQ ID NO: 890120 - DNA, 17 bp, Homo sapiens
acttttttttgtatgtt

SEQ ID NO: 890121 - DNA, 18 bp, Homo sapiens
actttttttttttttccc

SEQ ID NO: 890122 - DNA, 13 bp, Homo sapiens
agaaaaaaaaaga

SEQ ID NO: 890123 - DNA, 14 bp, Homo sapiens
agaaaaaaaaagaa

SEQ ID NO: 890124 - DNA, 16 bp, Homo sapiens
agaaaaaaaaagaaaa

SEQ ID NO: 890125 - DNA, 17 bp, Homo sapiens
agaaaaaaaaagaaaaa

SEQ ID NO: 890126 - DNA, 19 bp, Homo sapiens
agaaaaaaaaattcacatg

SEQ ID NO: 890127 - DNA, 12 bp, Homo sapiens
agaaaaaaacaa

SEQ ID NO: 890128 - DNA, 14 bp, Homo sapiens
agaaaaaaagaaaa

SEQ ID NO: 890129 - DNA, 15 bp, Homo sapiens
agaaaaaaagaaaaa

SEQ ID NO: 890130 - DNA, 21 bp, Homo sapiens
agaaaaaaagaaaaaaaaaga

SEQ ID NO: 890131 - DNA, 17 bp, Homo sapiens
agaaaaaaagggagaat

SEQ ID NO: 890132 - DNA, 19 bp, Homo sapiens
agaaaaaaattactaattt

SEQ ID NO: 890133 - DNA, 16 bp, Homo sapiens
agaaaaaaattgaaat

SEQ ID NO: 890134 - DNA, 18 bp, Homo sapiens
agaaaaaaattgaaatgt

SEQ ID NO: 890135 - DNA, 18 bp, Homo sapiens
agaaaaaataacacacat

SEQ ID NO: 890136 - DNA, 19 bp, Homo sapiens
agaaaaaatattttcccta

SEQ ID NO: 890137 - DNA, 13 bp, Homo sapiens
agaaaaaatcaga

SEQ ID NO: 890138 - DNA, 12 bp, Homo sapiens
agaaaaacaaag

SEQ ID NO: 890139 - DNA, 13 bp, Homo sapiens
agaaaaacaaagt

SEQ ID NO: 890140 - DNA, 19 bp, Homo sapiens
agaaaaacaagttttagaa

SEQ ID NO: 890141 - DNA, 12 bp, Homo sapiens
agaaaaacattt

SEQ ID NO: 890142 - DNA, 19 bp, Homo sapiens
agaaaaagacctgcatttg

SEQ ID NO: 890143 - DNA, 20 bp, Homo sapiens
agaaaaagctcctgtcctcc

SEQ ID NO: 890144 - DNA, 14 bp, Homo sapiens
agaaaaagtacaat

SEQ ID NO: 890145 - DNA, 19 bp, Homo sapiens
agaaaaataaaaatctctt

SEQ ID NO: 890146 - DNA, 13 bp, Homo sapiens
agaaaaataaaat

SEQ ID NO: 890147 - DNA, 23 bp, Homo sapiens
agaaaaataagctcgagtgaatt

SEQ ID NO: 890148 - DNA, 12 bp, Homo sapiens
agaaaaatcttg

SEQ ID NO: 890149 - DNA, 14 bp, Homo sapiens
agaaaaatgaaaac

SEQ ID NO: 890150 - DNA, 17 bp, Homo sapiens
agaaaaatgagcctggc

SEQ ID NO: 890151 - DNA, 16 bp, Homo sapiens
agaaaacaaaggagca

SEQ ID NO: 890152 - DNA, 17 bp, Homo sapiens
agaaaacaagtatataa

SEQ ID NO: 890153 - DNA, 19 bp, Homo sapiens
agaaaacccttgggccaga

SEQ ID NO: 890154 - DNA, 20 bp, Homo sapiens
agaaaacccttgggccagaa

SEQ ID NO: 890155 - DNA, 22 bp, Homo sapiens
agaaaacccttgggccagaagt

SEQ ID NO: 890156 - DNA, 20 bp, Homo sapiens
agaaaacgaagtctttttca

SEQ ID NO: 890157 - DNA, 18 bp, Homo sapiens
agaaaactcccaatacaa

SEQ ID NO: 890158 - DNA, 14 bp, Homo sapiens
agaaaagaaaaaga

SEQ ID NO: 890159 - DNA, 17 bp, Homo sapiens
agaaaagaaaacattta

SEQ ID NO: 890160 - DNA, 13 bp, Homo sapiens
agaaaagaccctg

SEQ ID NO: 890161 - DNA, 16 bp, Homo sapiens
agaaaagagacttctc

SEQ ID NO: 890162 - DNA, 23 bp, Homo sapiens
agaaaagagacttctctgtaagt

SEQ ID NO: 890163 - DNA, 13 bp, Homo sapiens
agaaaagagagaa

SEQ ID NO: 890164 - DNA, 19 bp, Homo sapiens
agaaaagagatattttaaa

SEQ ID NO: 890165 - DNA, 18 bp, Homo sapiens
agaaaagaggagaccctg

SEQ ID NO: 890166 - DNA, 16 bp, Homo sapiens
agaaaagataaagatg

SEQ ID NO: 890167 - DNA, 12 bp, Homo sapiens
agaaaagatttt

SEQ ID NO: 890168 - DNA, 15 bp, Homo sapiens
agaaaagattttaat

SEQ ID NO: 890169 - DNA, 17 bp, Homo sapiens
agaaaagcaatactgtt

SEQ ID NO: 890170 - DNA, 18 bp, Homo sapiens
agaaaagcacctgccgac

SEQ ID NO: 890171 - DNA, 20 bp, Homo sapiens
agaaaagcagtcccattcat

SEQ ID NO: 890172 - DNA, 13 bp, Homo sapiens
agaaaagcatttt

SEQ ID NO: 890173 - DNA, 13 bp, Homo sapiens
agaaaagccaagc

SEQ ID NO: 890174 - DNA, 21 bp, Homo sapiens
agaaaagctcagagtaggtgg

SEQ ID NO: 890175 - DNA, 13 bp, Homo sapiens
agaaaaggcaaaa

SEQ ID NO: 890176 - DNA, 21 bp, Homo sapiens
agaaaagggaaaaaagaaaga

SEQ ID NO: 890177 - DNA, 15 bp, Homo sapiens
agaaaagtaattttg

SEQ ID NO: 890178 - DNA, 20 bp, Homo sapiens
agaaaagtaattttgtcaca

SEQ ID NO: 890179 - DNA, 21 bp, Homo sapiens
agaaaagtattgtttggagga

SEQ ID NO: 890180 - DNA, 14 bp, Homo sapiens
agaaaagtgggctg

SEQ ID NO: 890181 - DNA, 11 bp, Homo sapiens
agaaaagttat

SEQ ID NO: 890182 - DNA, 16 bp, Homo sapiens
agaaaagttgcagatg

SEQ ID NO: 890183 - DNA, 15 bp, Homo sapiens
agaaaagtttataaa

SEQ ID NO: 890184 - DNA, 17 bp, Homo sapiens
agaaaataaaaaaaaga

SEQ ID NO: 890185 - DNA, 17 bp, Homo sapiens
agaaaatacaataaact

SEQ ID NO: 890186 - DNA, 15 bp, Homo sapiens
agaaaatatatgtat

SEQ ID NO: 890187 - DNA, 20 bp, Homo sapiens
agaaaatatcactgtaatga

SEQ ID NO: 890188 - DNA, 14 bp, Homo sapiens
agaaaatattctct

SEQ ID NO: 890189 - DNA, 19 bp, Homo sapiens
agaaaatattttgtctaaa

SEQ ID NO: 890190 - DNA, 19 bp, Homo sapiens
agaaaatcatattgcttct

SEQ ID NO: 890191 - DNA, 12 bp, Homo sapiens
agaaaatcatca

SEQ ID NO: 890192 - DNA, 13 bp, Homo sapiens
agaaaatcatcaa

SEQ ID NO: 890193 - DNA, 17 bp, Homo sapiens
agaaaatctttgttgaa

SEQ ID NO: 890194 - DNA, 13 bp, Homo sapiens
agaaaatgaattt

SEQ ID NO: 890195 - DNA, 15 bp, Homo sapiens
agaaaatgaatttgg

SEQ ID NO: 890196 - DNA, 16 bp, Homo sapiens
agaaaatgactttatt

SEQ ID NO: 890197 - DNA, 21 bp, Homo sapiens
agaaaatgcctcaattcacat

SEQ ID NO: 890198 - DNA, 19 bp, Homo sapiens
agaaaatgcgagactctga

SEQ ID NO: 890199 - DNA, 13 bp, Homo sapiens
agaaaatgctggc

SEQ ID NO: 890200 - DNA, 22 bp, Homo sapiens
agaaaatggctaataaactgta

SEQ ID NO: 890201 - DNA, 23 bp, Homo sapiens
agaaaatggctaataaactgtat

SEQ ID NO: 890202 - DNA, 18 bp, Homo sapiens
agaaaatgttctgtttgc

SEQ ID NO: 890203 - DNA, 16 bp, Homo sapiens
agaaaatgttgagaat

SEQ ID NO: 890204 - DNA, 17 bp, Homo sapiens
agaaaattaattatatt

SEQ ID NO: 890205 - DNA, 20 bp, Homo sapiens
agaaaattaattatatttct

SEQ ID NO: 890206 - DNA, 15 bp, Homo sapiens
agaaaattagactgt

SEQ ID NO: 890207 - DNA, 14 bp, Homo sapiens
agaaaattcctata

SEQ ID NO: 890208 - DNA, 14 bp, Homo sapiens
agaaaattgcatga

SEQ ID NO: 890209 - DNA, 18 bp, Homo sapiens
agaaaattgcatgaaact

SEQ ID NO: 890210 - DNA, 14 bp, Homo sapiens
agaaaattgctgtg

SEQ ID NO: 890211 - DNA, 20 bp, Homo sapiens
agaaaatttagccctttaaa

SEQ ID NO: 890212 - DNA, 23 bp, Homo sapiens
agaaaatttagccctttaaaacg

SEQ ID NO: 890213 - DNA, 20 bp, Homo sapiens
agaaaatttttgtagtagcg

SEQ ID NO: 890214 - DNA, 18 bp, Homo sapiens
agaaacaacaatttctac

SEQ ID NO: 890215 - DNA, 13 bp, Homo sapiens
agaaacaagctgt

SEQ ID NO: 890216 - DNA, 14 bp, Homo sapiens
agaaacaagctgtg

SEQ ID NO: 890217 - DNA, 22 bp, Homo sapiens
agaaacaagtggacctcgtccc

SEQ ID NO: 890218 - DNA, 17 bp, Homo sapiens
agaaacaatactgttct

SEQ ID NO: 890219 - DNA, 15 bp, Homo sapiens
agaaacaatttgact

SEQ ID NO: 890220 - DNA, 10 bp, Homo sapiens
agaaacacaa

SEQ ID NO: 890221 - DNA, 20 bp, Homo sapiens
agaaacaccacccatttcta

SEQ ID NO: 890222 - DNA, 15 bp, Homo sapiens
agaaacaccattcat

SEQ ID NO: 890223 - DNA, 22 bp, Homo sapiens
agaaacacccctctgtctagga

SEQ ID NO: 890224 - DNA, 14 bp, Homo sapiens
agaaacagagacag

SEQ ID NO: 890225 - DNA, 17 bp, Homo sapiens
agaaacagagtggcctc

SEQ ID NO: 890226 - DNA, 13 bp, Homo sapiens
agaaacagctgct

SEQ ID NO: 890227 - DNA, 19 bp, Homo sapiens
agaaacagctgcttctccc

SEQ ID NO: 890228 - DNA, 22 bp, Homo sapiens
agaaacagctgcttctcccccc

SEQ ID NO: 890229 - DNA, 11 bp, Homo sapiens
agaaacagctt

SEQ ID NO: 890230 - DNA, 15 bp, Homo sapiens
agaaacagctttcaa

SEQ ID NO: 890231 - DNA, 17 bp, Homo sapiens
agaaacagctttcaagt

SEQ ID NO: 890232 - DNA, 15 bp, Homo sapiens
agaaacagggcagca

SEQ ID NO: 890233 - DNA, 12 bp, Homo sapiens
agaaacagtgtg

SEQ ID NO: 890234 - DNA, 14 bp, Homo sapiens
agaaacatcagtta

SEQ ID NO: 890235 - DNA, 16 bp, Homo sapiens
agaaacatcagttact

SEQ ID NO: 890236 - DNA, 11 bp, Homo sapiens
agaaacatctc

SEQ ID NO: 890237 - DNA, 13 bp, Homo sapiens
agaaacattgtaa

SEQ ID NO: 890238 - DNA, 16 bp, Homo sapiens
agaaacattgtaaata

SEQ ID NO: 890239 - DNA, 21 bp, Homo sapiens
agaaaccagttatgtgaatga

SEQ ID NO: 890240 - DNA, 16 bp, Homo sapiens
agaaaccatgacaaac

SEQ ID NO: 890241 - DNA, 15 bp, Homo sapiens
agaaacccaagctcc

SEQ ID NO: 890242 - DNA, 20 bp, Homo sapiens
agaaacccaagctcctcctc

SEQ ID NO: 890243 - DNA, 22 bp, Homo sapiens
actttttgtattttttccttaa

SEQ ID NO: 890244 - DNA, 13 bp, Homo sapiens
acttttttaaact

SEQ ID NO: 890245 - DNA, 16 bp, Homo sapiens
acttttttaaatattt

SEQ ID NO: 890246 - DNA, 18 bp, Homo sapiens
acttttttaaatattttc

SEQ ID NO: 890247 - DNA, 23 bp, Homo sapiens
acttttttatttaaaaaactaaa

SEQ ID NO: 890248 - DNA, 14 bp, Homo sapiens
acttttttctgcct

SEQ ID NO: 890249 - DNA, 14 bp, Homo sapiens
acttttttgattaa

SEQ ID NO: 890250 - DNA, 12 bp, Homo sapiens
acttttttgtgt

SEQ ID NO: 890251 - DNA, 13 bp, Homo sapiens
acttttttgtgta

SEQ ID NO: 890252 - DNA, 14 bp, Homo sapiens
acttttttgtgtat

SEQ ID NO: 890253 - DNA, 19 bp, Homo sapiens
actttttttctgtgacatt

SEQ ID NO: 890254 - DNA, 19 bp, Homo sapiens
actttttttggtataatgt

SEQ ID NO: 890255 - DNA, 13 bp, Homo sapiens
actttttttgtat

SEQ ID NO: 890256 - DNA, 12 bp, Homo sapiens
acttatttaaaa

SEQ ID NO: 890257 - DNA, 21 bp, Homo sapiens
acttatttaaaaatatttcag

SEQ ID NO: 890258 - DNA, 22 bp, Homo sapiens
acttatttaaaaatatttcaga

SEQ ID NO: 890259 - DNA, 15 bp, Homo sapiens
acttatttatataaa

SEQ ID NO: 890260 - DNA, 17 bp, Homo sapiens
acttatttatgaacctg

SEQ ID NO: 890261 - DNA, 20 bp, Homo sapiens
acttattttgtcttattctt

SEQ ID NO: 890262 - DNA, 22 bp, Homo sapiens
acttattttgtcttattcttaa

SEQ ID NO: 890263 - DNA, 14 bp, Homo sapiens
acttatttttcaag

SEQ ID NO: 890264 - DNA, 16 bp, Homo sapiens
acttcaaaaataatgt

SEQ ID NO: 890265 - DNA, 23 bp, Homo sapiens
acttcaaaaatgttaaaccctta

SEQ ID NO: 890266 - DNA, 23 bp, Homo sapiens
acttcaagcatggctattttata

SEQ ID NO: 890267 - DNA, 18 bp, Homo sapiens
acttcaagggagaatata

SEQ ID NO: 890268 - DNA, 20 bp, Homo sapiens
acttctcattttttaaaaaa

SEQ ID NO: 890269 - DNA, 16 bp, Homo sapiens
acttctccatgctgca

SEQ ID NO: 890270 - DNA, 17 bp, Homo sapiens
acttctcccccgccctg

SEQ ID NO: 890271 - DNA, 16 bp, Homo sapiens
acttctccccgcagcc

SEQ ID NO: 890272 - DNA, 21 bp, Homo sapiens
acttctctacccatcttaaaa

SEQ ID NO: 890273 - DNA, 21 bp, Homo sapiens
acttctctataaaaaatatgt

SEQ ID NO: 890274 - DNA, 16 bp, Homo sapiens
acttctctctaaggag

SEQ ID NO: 890275 - DNA, 22 bp, Homo sapiens
acttctctctaaggagaatggc

SEQ ID NO: 890276 - DNA, 20 bp, Homo sapiens
acttctctggaaagggggga

SEQ ID NO: 890277 - DNA, 14 bp, Homo sapiens
acttctctgtgtgc

SEQ ID NO: 890278 - DNA, 18 bp, Homo sapiens
acttctcttaagtggtct

SEQ ID NO: 890279 - DNA, 16 bp, Homo sapiens
acttctcttgctttct

SEQ ID NO: 890280 - DNA, 13 bp, Homo sapiens
acttctgaagact

SEQ ID NO: 890281 - DNA, 18 bp, Homo sapiens
acttctgacttactgtca

SEQ ID NO: 890282 - DNA, 20 bp, Homo sapiens
acttctgagatctgttgatt

SEQ ID NO: 890283 - DNA, 16 bp, Homo sapiens
acttctgagtaattaa

SEQ ID NO: 890284 - DNA, 21 bp, Homo sapiens
acttctgagtaattaataaag

SEQ ID NO: 890285 - DNA, 19 bp, Homo sapiens
acttctgcgggctccctcc

SEQ ID NO: 890286 - DNA, 22 bp, Homo sapiens
acttctgcgggctccctcctct

SEQ ID NO: 890287 - DNA, 18 bp, Homo sapiens
acttctgctttcacttaa

SEQ ID NO: 890288 - DNA, 20 bp, Homo sapiens
acttctggaaggctggctga

SEQ ID NO: 890289 - DNA, 23 bp, Homo sapiens
acttctggagatggatccttcca

SEQ ID NO: 890290 - DNA, 12 bp, Homo sapiens
acttctggcatg

SEQ ID NO: 890291 - DNA, 20 bp, Homo sapiens
acttctggccacatcagccc

SEQ ID NO: 890292 - DNA, 18 bp, Homo sapiens
acttctggcctccagcct

SEQ ID NO: 890293 - DNA, 15 bp, Homo sapiens
acttctggctcctca

SEQ ID NO: 890294 - DNA, 14 bp, Homo sapiens
acttctggtcccct

SEQ ID NO: 890295 - DNA, 15 bp, Homo sapiens
acttctggtcccctg

SEQ ID NO: 890296 - DNA, 16 bp, Homo sapiens
acttctggtcccctgt

SEQ ID NO: 890297 - DNA, 15 bp, Homo sapiens
acttctggttgtatt

SEQ ID NO: 890298 - DNA, 22 bp, Homo sapiens
acttctggttgtatttctatat

SEQ ID NO: 890299 - DNA, 21 bp, Homo sapiens
acttctgtaattgtgtggatt

SEQ ID NO: 890300 - DNA, 16 bp, Homo sapiens
acttctgtgggcatgg

SEQ ID NO: 890301 - DNA, 21 bp, Homo sapiens
acttctgtgggcatggccgct

SEQ ID NO: 890302 - DNA, 13 bp, Homo sapiens
acttctgtgttca

SEQ ID NO: 890303 - DNA, 15 bp, Homo sapiens
acttctgtgttcatt

SEQ ID NO: 890304 - DNA, 21 bp, Homo sapiens
acttcttacccaaagcacatg

SEQ ID NO: 890305 - DNA, 22 bp, Homo sapiens
acttcttacgacttttttgaga

SEQ ID NO: 890306 - DNA, 23 bp, Homo sapiens
acttcttattgcaaggcagtctc

SEQ ID NO: 890307 - DNA, 15 bp, Homo sapiens
acttcttcacctctt

SEQ ID NO: 890308 - DNA, 19 bp, Homo sapiens
acttcttcacctcttccac

SEQ ID NO: 890309 - DNA, 19 bp, Homo sapiens
acttcttcataattttagt

SEQ ID NO: 890310 - DNA, 15 bp, Homo sapiens
acttcttccactgtg

SEQ ID NO: 890311 - DNA, 17 bp, Homo sapiens
acttcttcctttctctt

SEQ ID NO: 890312 - DNA, 18 bp, Homo sapiens
acttcttctcttagattc

SEQ ID NO: 890313 - DNA, 16 bp, Homo sapiens
acttcttctgtaatat

SEQ ID NO: 890314 - DNA, 19 bp, Homo sapiens
acttcttgaaaaagatggc

SEQ ID NO: 890315 - DNA, 19 bp, Homo sapiens
acttcttgctggtctagtc

SEQ ID NO: 890316 - DNA, 20 bp, Homo sapiens
acttcttgcttctttctaga

SEQ ID NO: 890317 - DNA, 16 bp, Homo sapiens
acttcttggttcctgg

SEQ ID NO: 890318 - DNA, 17 bp, Homo sapiens
acttcttggttcctggg

SEQ ID NO: 890319 - DNA, 18 bp, Homo sapiens
acttcttggttcctggga

SEQ ID NO: 890320 - DNA, 19 bp, Homo sapiens
acttcttggtttggggaga

SEQ ID NO: 890321 - DNA, 22 bp, Homo sapiens
acttcttggtttggggagaaat

SEQ ID NO: 890322 - DNA, 22 bp, Homo sapiens
acttcttggttttctctctgga

SEQ ID NO: 890323 - DNA, 23 bp, Homo sapiens
acttcttggttttctctctggat

SEQ ID NO: 890324 - DNA, 20 bp, Homo sapiens
acttctttactaacactggc

SEQ ID NO: 890325 - DNA, 23 bp, Homo sapiens
acttctttagcatttttatgcag

SEQ ID NO: 890326 - DNA, 14 bp, Homo sapiens
acttctttctattt

SEQ ID NO: 890327 - DNA, 19 bp, Homo sapiens
acttcttttgctcttagct

SEQ ID NO: 890328 - DNA, 21 bp, Homo sapiens
acttcttttttcaaaagaaag

SEQ ID NO: 890329 - DNA, 15 bp, Homo sapiens
acttgaaaagaaaac

SEQ ID NO: 890330 - DNA, 12 bp, Homo sapiens
acttgaaagaaa

SEQ ID NO: 890331 - DNA, 20 bp, Homo sapiens
acttgaaagcatccatgtgt

SEQ ID NO: 890332 - DNA, 19 bp, Homo sapiens
acttgaaataccagtgaac

SEQ ID NO: 890333 - DNA, 14 bp, Homo sapiens
acttgaaatatata

SEQ ID NO: 890334 - DNA, 14 bp, Homo sapiens
acttgaaatgttag

SEQ ID NO: 890335 - DNA, 13 bp, Homo sapiens
acttgaactgatt

SEQ ID NO: 890336 - DNA, 21 bp, Homo sapiens
acttgaactgattcacatctc

SEQ ID NO: 890337 - DNA, 23 bp, Homo sapiens
acttgaagaaacagagtggcctc

SEQ ID NO: 890338 - DNA, 13 bp, Homo sapiens
acttgaagcagtc

SEQ ID NO: 890339 - DNA, 11 bp, Homo sapiens
acttgaaggat

SEQ ID NO: 890340 - DNA, 16 bp, Homo sapiens
acttgaaggattgcat

SEQ ID NO: 890341 - DNA, 20 bp, Homo sapiens
acttgaagttgttactaact

SEQ ID NO: 890342 - DNA, 22 bp, Homo sapiens
acttgaagttgttactaactaa

SEQ ID NO: 890343 - DNA, 23 bp, Homo sapiens
acttgaatatggaacatatgcac

SEQ ID NO: 890344 - DNA, 14 bp, Homo sapiens
acttgaatttcaaa

SEQ ID NO: 890345 - DNA, 16 bp, Homo sapiens
acttgaattttttgaa

SEQ ID NO: 890346 - DNA, 19 bp, Homo sapiens
acttgaattttttgaaatg

SEQ ID NO: 890347 - DNA, 13 bp, Homo sapiens
acttgacagtgga

SEQ ID NO: 890348 - DNA, 14 bp, Homo sapiens
acttgacagtggaa

SEQ ID NO: 890349 - DNA, 13 bp, Homo sapiens
acttgacattcct

SEQ ID NO: 890350 - DNA, 14 bp, Homo sapiens
acttgacattcctt

SEQ ID NO: 890351 - DNA, 21 bp, Homo sapiens
acttgactccatttcatcatt

SEQ ID NO: 890352 - DNA, 20 bp, Homo sapiens
acttgagaaccagtctcctc

SEQ ID NO: 890353 - DNA, 21 bp, Homo sapiens
acttgagaaccagtctcctca

SEQ ID NO: 890354 - DNA, 22 bp, Homo sapiens
acttgagaagtctaattcacag

SEQ ID NO: 890355 - DNA, 12 bp, Homo sapiens
acttgagaggat

SEQ ID NO: 890356 - DNA, 20 bp, Homo sapiens
acttgagcaccgtcatggct

SEQ ID NO: 890357 - DNA, 11 bp, Homo sapiens
acttgagccca

SEQ ID NO: 890358 - DNA, 11 bp, Homo sapiens
acttgagcctg

SEQ ID NO: 890359 - DNA, 17 bp, Homo sapiens
acttgagggcccagagc

SEQ ID NO: 890360 - DNA, 19 bp, Homo sapiens
acttgagggcccagagcag

SEQ ID NO: 890361 - DNA, 19 bp, Homo sapiens
acttgagtaaatctaaaga

SEQ ID NO: 890362 - DNA, 15 bp, Homo sapiens
acttgagtgttcctt

SEQ ID NO: 890363 - DNA, 21 bp, Homo sapiens
acttgagttacaccagacctg

SEQ ID NO: 890364 - DNA, 19 bp, Homo sapiens
acttgatacgtccgtgtgt

SEQ ID NO: 890365 - DNA, 14 bp, Homo sapiens
acttgatgatgtgg

SEQ ID NO: 890366 - DNA, 21 bp, Homo sapiens
acttgatggggcctgggtttg

SEQ ID NO: 890367 - DNA, 16 bp, Homo sapiens
acttgatgtgccattt

SEQ ID NO: 890368 - DNA, 19 bp, Homo sapiens
acttgatgtgccattttaa

SEQ ID NO: 890369 - DNA, 14 bp, Homo sapiens
acttgatgtttgtt

SEQ ID NO: 890370 - DNA, 15 bp, Homo sapiens
acttgatgtttgtta

SEQ ID NO: 890371 - DNA, 16 bp, Homo sapiens
acttgattcatctctg

SEQ ID NO: 890372 - DNA, 15 bp, Homo sapiens
acttgattgagaaag

SEQ ID NO: 890373 - DNA, 21 bp, Homo sapiens
acttgattgtacttggagtaa

SEQ ID NO: 890374 - DNA, 15 bp, Homo sapiens
acttgatttgcatgg

SEQ ID NO: 890375 - DNA, 14 bp, Homo sapiens
acttgattttttca

SEQ ID NO: 890376 - DNA, 23 bp, Homo sapiens
acttgcaaaaagtagacttggtg

SEQ ID NO: 890377 - DNA, 16 bp, Homo sapiens
acttgcaactaaggac

SEQ ID NO: 890378 - DNA, 18 bp, Homo sapiens
acttgcaactaaggacaa

SEQ ID NO: 890379 - DNA, 21 bp, Homo sapiens
acttgcaactaaggacaaatt

SEQ ID NO: 890380 - DNA, 22 bp, Homo sapiens
acttgcaactaaggacaaatta

SEQ ID NO: 890381 - DNA, 19 bp, Homo sapiens
acttgcacgcccatgtgtg

SEQ ID NO: 890382 - DNA, 12 bp, Homo sapiens
acttgcagagga

SEQ ID NO: 890383 - DNA, 20 bp, Homo sapiens
acttgcagctgatgttggaa

SEQ ID NO: 890384 - DNA, 22 bp, Homo sapiens
acttgcagtcttgtagctagaa

SEQ ID NO: 890385 - DNA, 18 bp, Homo sapiens
acttgcagttgtgatata

SEQ ID NO: 890386 - DNA, 23 bp, Homo sapiens
actgaggagatgaccagggatgc

SEQ ID NO: 890387 - DNA, 23 bp, Homo sapiens
actgaggatattcagatgtatgt

SEQ ID NO: 890388 - DNA, 13 bp, Homo sapiens
actgaggcagaca

SEQ ID NO: 890389 - DNA, 19 bp, Homo sapiens
actgaggccatcagggccc

SEQ ID NO: 890390 - DNA, 23 bp, Homo sapiens
actgaggccatcagggccctgcc

SEQ ID NO: 890391 - DNA, 23 bp, Homo sapiens
actgaggcccaaagcacttgctt

SEQ ID NO: 890392 - DNA, 14 bp, Homo sapiens
actgaggccttgtg

SEQ ID NO: 890393 - DNA, 20 bp, Homo sapiens
actgaggccttgtgtgtcag

SEQ ID NO: 890394 - DNA, 17 bp, Homo sapiens
actgaggcttagagaga

SEQ ID NO: 890395 - DNA, 20 bp, Homo sapiens
actgagggaccaactgggcc

SEQ ID NO: 890396 - DNA, 22 bp, Homo sapiens
actgagggaccaactgggccca

SEQ ID NO: 890397 - DNA, 23 bp, Homo sapiens
actgagggcagtcgatagagctg

SEQ ID NO: 890398 - DNA, 19 bp, Homo sapiens
actgagggctctgtttgtg

SEQ ID NO: 890399 - DNA, 18 bp, Homo sapiens
actgaggggattctctac

SEQ ID NO: 890400 - DNA, 14 bp, Homo sapiens
actgaggtataaag

SEQ ID NO: 890401 - DNA, 17 bp, Homo sapiens
actgaggtataaagaca

SEQ ID NO: 890402 - DNA, 16 bp, Homo sapiens
actgaggtatggccat

SEQ ID NO: 890403 - DNA, 20 bp, Homo sapiens
actgaggtatggccatgccc

SEQ ID NO: 890404 - DNA, 22 bp, Homo sapiens
actgaggtatggccatgcccta

SEQ ID NO: 890405 - DNA, 24 bp, Homo sapiens
actgaggtatggccatgccctaga

SEQ ID NO: 890406 - DNA, 12 bp, Homo sapiens
actgaggtgcct

SEQ ID NO: 890407 - DNA, 15 bp, Homo sapiens
actgaggtgcctgct

SEQ ID NO: 890408 - DNA, 16 bp, Homo sapiens
actgaggtgcctgctc

SEQ ID NO: 890409 - DNA, 23 bp, Homo sapiens
actgaggtgcctgctcaggtgct

SEQ ID NO: 890410 - DNA, 18 bp, Homo sapiens
actgagtacgttgtgcat

SEQ ID NO: 890411 - DNA, 19 bp, Homo sapiens
actgagtacgttgtgcatt

SEQ ID NO: 890412 - DNA, 21 bp, Homo sapiens
actgagtacgttgtgcatttg

SEQ ID NO: 890413 - DNA, 20 bp, Homo sapiens
actgagtagctctcctgact

SEQ ID NO: 890414 - DNA, 20 bp, Homo sapiens
actgagtccatgaaaatacc

SEQ ID NO: 890415 - DNA, 21 bp, Homo sapiens
actgagtccatgaaaatacca

SEQ ID NO: 890416 - DNA, 15 bp, Homo sapiens
actgagtgggaagcc

SEQ ID NO: 890417 - DNA, 23 bp, Homo sapiens
actgagtgtgggagtgcagagaa

SEQ ID NO: 890418 - DNA, 21 bp, Homo sapiens
actgagttaaattatactgga

SEQ ID NO: 890419 - DNA, 19 bp, Homo sapiens
actgataaaagttttgata

SEQ ID NO: 890420 - DNA, 21 bp, Homo sapiens
actgataacttggggaggcaa

SEQ ID NO: 890421 - DNA, 16 bp, Homo sapiens
actgataagactgttt

SEQ ID NO: 890422 - DNA, 18 bp, Homo sapiens
actgataattttacaatt

SEQ ID NO: 890423 - DNA, 19 bp, Homo sapiens
actgataattttacaattt

SEQ ID NO: 890424 - DNA, 15 bp, Homo sapiens
actgatacataaaaa

SEQ ID NO: 890425 - DNA, 18 bp, Homo sapiens
actgatagcttacactga

SEQ ID NO: 890426 - DNA, 17 bp, Homo sapiens
actgatatattttacaa

SEQ ID NO: 890427 - DNA, 15 bp, Homo sapiens
actgatcatgcattg

SEQ ID NO: 890428 - DNA, 21 bp, Homo sapiens
actgatcatgtttatgagaaa

SEQ ID NO: 890429 - DNA, 17 bp, Homo sapiens
actgatccctggccact

SEQ ID NO: 890430 - DNA, 21 bp, Homo sapiens
actgatgaaatctgctagaaa

SEQ ID NO: 890431 - DNA, 16 bp, Homo sapiens
actgatgaactagtga

SEQ ID NO: 890432 - DNA, 21 bp, Homo sapiens
actgatgaactagtgatgtag

SEQ ID NO: 890433 - DNA, 13 bp, Homo sapiens
actgatgatgtgt

SEQ ID NO: 890434 - DNA, 22 bp, Homo sapiens
actgatggaccgggtgggcctg

SEQ ID NO: 890435 - DNA, 19 bp, Homo sapiens
actgatggctcaagacaag

SEQ ID NO: 890436 - DNA, 23 bp, Homo sapiens
agaagctcttggacaacagctct

SEQ ID NO: 890437 - DNA, 15 bp, Homo sapiens
agaagctgaagcccc

SEQ ID NO: 890438 - DNA, 13 bp, Homo sapiens
agaagctgaggcc

SEQ ID NO: 890439 - DNA, 22 bp, Homo sapiens
agaagctgaggctagttccaga

SEQ ID NO: 890440 - DNA, 13 bp, Homo sapiens
agaagctgctcca

SEQ ID NO: 890441 - DNA, 11 bp, Homo sapiens
agaagctgctg

SEQ ID NO: 890442 - DNA, 16 bp, Homo sapiens
agaagctgctgaccaa

SEQ ID NO: 890443 - DNA, 19 bp, Homo sapiens
agaagcttcatgccaggtt

SEQ ID NO: 890444 - DNA, 19 bp, Homo sapiens
agaagcttccacaaaatta

SEQ ID NO: 890445 - DNA, 22 bp, Homo sapiens
agaagcttccacaaaattagaa

SEQ ID NO: 890446 - DNA, 23 bp, Homo sapiens
agaagctttagcttcattttact

SEQ ID NO: 890447 - DNA, 18 bp, Homo sapiens
agaaggaaaaatgtgtaa

SEQ ID NO: 890448 - DNA, 14 bp, Homo sapiens
agaaggaaatgatg

SEQ ID NO: 890449 - DNA, 15 bp, Homo sapiens
agaaggaaggaggca

SEQ ID NO: 890450 - DNA, 17 bp, Homo sapiens
agaaggaaggaggcaga

SEQ ID NO: 890451 - DNA, 14 bp, Homo sapiens
agaaggaagggcag

SEQ ID NO: 890452 - DNA, 17 bp, Homo sapiens
agaaggaagtgaagagg

SEQ ID NO: 890453 - DNA, 22 bp, Homo sapiens
agaaggaattctaggcatccca

SEQ ID NO: 890454 - DNA, 20 bp, Homo sapiens
agaaggacggtgccaagggc

SEQ ID NO: 890455 - DNA, 15 bp, Homo sapiens
agaaggagggcagag

SEQ ID NO: 890456 - DNA, 19 bp, Homo sapiens
agaaggagggcagagccat

SEQ ID NO: 890457 - DNA, 19 bp, Homo sapiens
agaaggatgggtcccctcc

SEQ ID NO: 890458 - DNA, 17 bp, Homo sapiens
agaaggatgtacatttc

SEQ ID NO: 890459 - DNA, 11 bp, Homo sapiens
agaaggcaaaa

SEQ ID NO: 890460 - DNA, 14 bp, Homo sapiens
agaaggcaaagttt

SEQ ID NO: 890461 - DNA, 22 bp, Homo sapiens
agaaggcaagtttctagctaga

SEQ ID NO: 890462 - DNA, 21 bp, Homo sapiens
agaaggcaattttagtgtatt

SEQ ID NO: 890463 - DNA, 21 bp, Homo sapiens
agaaggcagcaaagaggggcg

SEQ ID NO: 890464 - DNA, 15 bp, Homo sapiens
agaaggcaggcctcc

SEQ ID NO: 890465 - DNA, 16 bp, Homo sapiens
agaaggcaggcctccg

SEQ ID NO: 890466 - DNA, 16 bp, Homo sapiens
agaaggcatgagaaag

SEQ ID NO: 890467 - DNA, 19 bp, Homo sapiens
agaaggcatggacttctgg

SEQ ID NO: 890468 - DNA, 14 bp, Homo sapiens
agaaggccacatgt

SEQ ID NO: 890469 - DNA, 18 bp, Homo sapiens
agaaggccccagagagac

SEQ ID NO: 890470 - DNA, 19 bp, Homo sapiens
agaaggcctcttgtgctca

SEQ ID NO: 890471 - DNA, 15 bp, Homo sapiens
agaaggcgaggagag

SEQ ID NO: 890472 - DNA, 17 bp, Homo sapiens
agaaggcgaggagagtg

SEQ ID NO: 890473 - DNA, 17 bp, Homo sapiens
agaaggcttaagaactg

SEQ ID NO: 890474 - DNA, 16 bp, Homo sapiens
agaaggcttctctcca

SEQ ID NO: 890475 - DNA, 22 bp, Homo sapiens
agaaggcttctctccacagtgt

SEQ ID NO: 890476 - DNA, 23 bp, Homo sapiens
actttggagtcccctcacctcct

SEQ ID NO: 890477 - DNA, 17 bp, Homo sapiens
actttggctgaactaca

SEQ ID NO: 890478 - DNA, 12 bp, Homo sapiens
actttgggaggc

SEQ ID NO: 890479 - DNA, 19 bp, Homo sapiens
actttgggaggccaaggtg

SEQ ID NO: 890480 - DNA, 21 bp, Homo sapiens
actttgggaggccgaggcggg

SEQ ID NO: 890481 - DNA, 15 bp, Homo sapiens
actttggggaaggga

SEQ ID NO: 890482 - DNA, 22 bp, Homo sapiens
actttggggacagggggtggga

SEQ ID NO: 890483 - DNA, 12 bp, Homo sapiens
agaagaaacttt

SEQ ID NO: 890484 - DNA, 21 bp, Homo sapiens
agaagaaactttgcctcaaga

SEQ ID NO: 890485 - DNA, 12 bp, Homo sapiens
agaagaaagatg

SEQ ID NO: 890486 - DNA, 13 bp, Homo sapiens
agaagaaagatgt

SEQ ID NO: 890487 - DNA, 20 bp, Homo sapiens
agaagaaatagcagagccta

SEQ ID NO: 890488 - DNA, 17 bp, Homo sapiens
agaagaaccaaatacct

SEQ ID NO: 890489 - DNA, 17 bp, Homo sapiens
agaagaaccagcccagc

SEQ ID NO: 890490 - DNA, 19 bp, Homo sapiens
agaagaaccagcccagcct

SEQ ID NO: 890491 - DNA, 22 bp, Homo sapiens
agaagaaccagcccagcctgcc

SEQ ID NO: 890492 - DNA, 20 bp, Homo sapiens
agaagaactgtgtttcaagt

SEQ ID NO: 890493 - DNA, 16 bp, Homo sapiens
agaagaagagaagctg

SEQ ID NO: 890494 - DNA, 18 bp, Homo sapiens
agaagaagaggaagaaat

SEQ ID NO: 890495 - DNA, 14 bp, Homo sapiens
agaagaagtgggag

SEQ ID NO: 890496 - DNA, 17 bp, Homo sapiens
agaagaagtgggagcag

SEQ ID NO: 890497 - DNA, 16 bp, Homo sapiens
agaagaatatcaaata

SEQ ID NO: 890498 - DNA, 15 bp, Homo sapiens
agaagaatattcagg

SEQ ID NO: 890499 - DNA, 16 bp, Homo sapiens
agaagaatattgtatt

SEQ ID NO: 890500 - DNA, 22 bp, Homo sapiens
agaagaatctcatctcagtgaa

SEQ ID NO: 890501 - DNA, 14 bp, Homo sapiens
agaagaatggcttt

SEQ ID NO: 890502 - DNA, 18 bp, Homo sapiens
agaagaatggctttcaat

SEQ ID NO: 890503 - DNA, 19 bp, Homo sapiens
agaagaattgaacccagga

SEQ ID NO: 890504 - DNA, 15 bp, Homo sapiens
agaagaatttgaaga

SEQ ID NO: 890505 - DNA, 22 bp, Homo sapiens
agaagaatttgaagacttcaaa

SEQ ID NO: 890506 - DNA, 13 bp, Homo sapiens
agaagacaaaaag

SEQ ID NO: 890507 - DNA, 12 bp, Homo sapiens
agaagacaaaat

SEQ ID NO: 890508 - DNA, 15 bp, Homo sapiens
agaagacaaactttg

SEQ ID NO: 890509 - DNA, 16 bp, Homo sapiens
agaagacaaatgacag

SEQ ID NO: 890510 - DNA, 18 bp, Homo sapiens
agaagacatactgcttga

SEQ ID NO: 890511 - DNA, 16 bp, Homo sapiens
agaagacatgaaccaa

SEQ ID NO: 890512 - DNA, 15 bp, Homo sapiens
agaagacattttgtt

SEQ ID NO: 890513 - DNA, 21 bp, Homo sapiens
agaagaccacaaaaattgact

SEQ ID NO: 890514 - DNA, 15 bp, Homo sapiens
agaagagaaatacag

SEQ ID NO: 890515 - DNA, 19 bp, Homo sapiens
agaagagaaatacagctgg

SEQ ID NO: 890516 - DNA, 15 bp, Homo sapiens
agaagagaattcagt

SEQ ID NO: 890517 - DNA, 16 bp, Homo sapiens
agaagagaattcagta

SEQ ID NO: 890518 - DNA, 16 bp, Homo sapiens
agaagggagaagaaag

SEQ ID NO: 890519 - DNA, 19 bp, Homo sapiens
agaagggctctttctctct

SEQ ID NO: 890520 - DNA, 15 bp, Homo sapiens
agaagggctgcatga

SEQ ID NO: 890521 - DNA, 20 bp, Homo sapiens
agaagggctgcatgatgttt

SEQ ID NO: 890522 - DNA, 12 bp, Homo sapiens
agaagggcttca

SEQ ID NO: 890523 - DNA, 21 bp, Homo sapiens
agaagggcttcaaagatatag

SEQ ID NO: 890524 - DNA, 14 bp, Homo sapiens
agaaggggagaagt

SEQ ID NO: 890525 - DNA, 13 bp, Homo sapiens
agaaggggagctt

SEQ ID NO: 890526 - DNA, 23 bp, Homo sapiens
agaagggggattggagggaagac

SEQ ID NO: 890527 - DNA, 16 bp, Homo sapiens
agaagggggctctgcc

SEQ ID NO: 890528 - DNA, 17 bp, Homo sapiens
agaagggggctctgccc

SEQ ID NO: 890529 - DNA, 19 bp, Homo sapiens
agaagggggtctctgttaa

SEQ ID NO: 890530 - DNA, 13 bp, Homo sapiens
agaagggggtgac

SEQ ID NO: 890531 - DNA, 14 bp, Homo sapiens
agaagggtggatga

SEQ ID NO: 890532 - DNA, 23 bp, Homo sapiens
agaagggtggatgacagggcaga

SEQ ID NO: 890533 - DNA, 18 bp, Homo sapiens
agaagggttctgccctgc

SEQ ID NO: 890534 - DNA, 19 bp, Homo sapiens
agaagggttctgccctgcc

SEQ ID NO: 890535 - DNA, 22 bp, Homo sapiens
agaagggttctgccctgcctga

SEQ ID NO: 890536 - DNA, 22 bp, Homo sapiens
agaagggttttccaccctggaa

SEQ ID NO: 890537 - DNA, 15 bp, Homo sapiens
agaaggtatcagtta

SEQ ID NO: 890538 - DNA, 18 bp, Homo sapiens
agaaggtatttttccaat

SEQ ID NO: 890539 - DNA, 14 bp, Homo sapiens
agaaggtctccaag

SEQ ID NO: 890540 - DNA, 22 bp, Homo sapiens
agaaggtggggacctgggggga

SEQ ID NO: 890541 - DNA, 13 bp, Homo sapiens
agaaggtggtttg

SEQ ID NO: 890542 - DNA, 17 bp, Homo sapiens
agaaggttgacacagtt

SEQ ID NO: 890543 - DNA, 16 bp, Homo sapiens
agaaggttgctctaga

SEQ ID NO: 890544 - DNA, 20 bp, Homo sapiens
agaaggttgctctagattga

SEQ ID NO: 890545 - DNA, 19 bp, Homo sapiens
agaaggttggcgtgccctg

SEQ ID NO: 890546 - DNA, 20 bp, Homo sapiens
agaaggtttgtgtttttctg

SEQ ID NO: 890547 - DNA, 23 bp, Homo sapiens
agaagtaagtttatccaaatctt

SEQ ID NO: 890548 - DNA, 19 bp, Homo sapiens
agaagtagattaagagcca

SEQ ID NO: 890549 - DNA, 20 bp, Homo sapiens
agaagtagattaagagccat

SEQ ID NO: 890550 - DNA, 14 bp, Homo sapiens
agaagtaggaggaa

SEQ ID NO: 890551 - DNA, 13 bp, Homo sapiens
agaagtagtttta

SEQ ID NO: 890552 - DNA, 13 bp, Homo sapiens
agaagtatacata

SEQ ID NO: 890553 - DNA, 16 bp, Homo sapiens
agaagtatttttgtct

SEQ ID NO: 890554 - DNA, 14 bp, Homo sapiens
agaagtcaaagtaa

SEQ ID NO: 890555 - DNA, 22 bp, Homo sapiens
agaagtcatcttgctaccagta

SEQ ID NO: 890556 - DNA, 13 bp, Homo sapiens
agaagtccctccc

SEQ ID NO: 890557 - DNA, 20 bp, Homo sapiens
agaagtctggaaaaaaacaa

SEQ ID NO: 890558 - DNA, 18 bp, Homo sapiens
agaagtctgtctttctat

SEQ ID NO: 890559 - DNA, 15 bp, Homo sapiens
agaagtcttagactt

SEQ ID NO: 890560 - DNA, 17 bp, Homo sapiens
agaagtcttagatgtat

SEQ ID NO: 890561 - DNA, 19 bp, Homo sapiens
agaagtgaatgctgggact

SEQ ID NO: 890562 - DNA, 18 bp, Homo sapiens
agaagtgagcccccccct

SEQ ID NO: 890563 - DNA, 19 bp, Homo sapiens
agaagtgagctttgctgct

SEQ ID NO: 890564 - DNA, 15 bp, Homo sapiens
agaagtgagggaagg

SEQ ID NO: 890565 - DNA, 14 bp, Homo sapiens
agaagtgcccctgc

SEQ ID NO: 890566 - DNA, 19 bp, Homo sapiens
agaagtgcccctgctgcct

SEQ ID NO: 890567 - DNA, 14 bp, Homo sapiens
agaagtgctcttgg

SEQ ID NO: 890568 - DNA, 21 bp, Homo sapiens
agaagtgctcttggctgaccc

SEQ ID NO: 890569 - DNA, 15 bp, Homo sapiens
agaagtggaccagga

SEQ ID NO: 890570 - DNA, 19 bp, Homo sapiens
agaagtggaccaggacagg

SEQ ID NO: 890571 - DNA, 14 bp, Homo sapiens
agaagtggctgcca

SEQ ID NO: 890572 - DNA, 15 bp, Homo sapiens
agaagtgggagcagc

SEQ ID NO: 890573 - DNA, 23 bp, Homo sapiens
agaagtgggccaggacaggcccg

SEQ ID NO: 890574 - DNA, 18 bp, Homo sapiens
agaagtgggggcagccca

SEQ ID NO: 890575 - DNA, 17 bp, Homo sapiens
agaagtgtcaccctgtg

SEQ ID NO: 890576 - DNA, 20 bp, Homo sapiens
agaagtgtcaccctgtgggt

SEQ ID NO: 890577 - DNA, 19 bp, Homo sapiens
agaagtgtccgagaactaa

SEQ ID NO: 890578 - DNA, 22 bp, Homo sapiens
agaagttattttcttgtttaac

SEQ ID NO: 890579 - DNA, 21 bp, Homo sapiens
agaagttcagtttttactgag

SEQ ID NO: 890580 - DNA, 15 bp, Homo sapiens
agaagttctagtgtt

SEQ ID NO: 890581 - DNA, 17 bp, Homo sapiens
agaagttctagtgtttt

SEQ ID NO: 890582 - DNA, 21 bp, Homo sapiens
agaagttgaactatgactgga

SEQ ID NO: 890583 - DNA, 19 bp, Homo sapiens
agaagtttcgaggggtcct

SEQ ID NO: 890584 - DNA, 15 bp, Homo sapiens
agaagtttgtcaagt

SEQ ID NO: 890585 - DNA, 13 bp, Homo sapiens
agaagtttgtggt

SEQ ID NO: 890586 - DNA, 16 bp, Homo sapiens
agaagttttaaatttt

SEQ ID NO: 890587 - DNA, 17 bp, Homo sapiens
agaagttttaaattttg

SEQ ID NO: 890588 - DNA, 23 bp, Homo sapiens
agaagttttaacttccagtggct

SEQ ID NO: 890589 - DNA, 17 bp, Homo sapiens
agaagttttttactttg

SEQ ID NO: 890590 - DNA, 18 bp, Homo sapiens
agaataaaagttcctctc

SEQ ID NO: 890591 - DNA, 17 bp, Homo sapiens
agaataaacgaggaaaa

SEQ ID NO: 890592 - DNA, 14 bp, Homo sapiens
agaataaaggcagt

SEQ ID NO: 890593 - DNA, 21 bp, Homo sapiens
agaataaaggcagttttctaa

SEQ ID NO: 890594 - DNA, 22 bp, Homo sapiens
agaataaatccttgggagtcat

SEQ ID NO: 890595 - DNA, 13 bp, Homo sapiens
agaataaatgaag

SEQ ID NO: 890596 - DNA, 20 bp, Homo sapiens
agaataaatggtttctcatt

SEQ ID NO: 890597 - DNA, 21 bp, Homo sapiens
agaataaattctacctccttg

SEQ ID NO: 890598 - DNA, 15 bp, Homo sapiens
agaataaattgattt

SEQ ID NO: 890599 - DNA, 20 bp, Homo sapiens
agaataacaagaagcccagt

SEQ ID NO: 890600 - DNA, 17 bp, Homo sapiens
agaataagaatttgcat

SEQ ID NO: 890601 - DNA, 16 bp, Homo sapiens
agaataaggcaggcat

SEQ ID NO: 890602 - DNA, 13 bp, Homo sapiens
agaataagtgtct

SEQ ID NO: 890603 - DNA, 16 bp, Homo sapiens
agaataagttattgca

SEQ ID NO: 890604 - DNA, 19 bp, Homo sapiens
agaataagttattgcagtt

SEQ ID NO: 890605 - DNA, 20 bp, Homo sapiens
agaataatcacgctttcctg

SEQ ID NO: 890606 - DNA, 16 bp, Homo sapiens
agaataatctttgggt

SEQ ID NO: 890607 - DNA, 13 bp, Homo sapiens
agaataatggaaa

SEQ ID NO: 890608 - DNA, 14 bp, Homo sapiens
agaataatggaaac

SEQ ID NO: 890609 - DNA, 18 bp, Homo sapiens
agaatacagtaagctgct

SEQ ID NO: 890610 - DNA, 16 bp, Homo sapiens
agaatacggaagagca

SEQ ID NO: 890611 - DNA, 15 bp, Homo sapiens
agaatactggtctca

SEQ ID NO: 890612 - DNA, 17 bp, Homo sapiens
agaatactggtctcagg

SEQ ID NO: 890613 - DNA, 16 bp, Homo sapiens
agaatacttgcactct

SEQ ID NO: 890614 - DNA, 18 bp, Homo sapiens
agaatagagctgccactg

SEQ ID NO: 890615 - DNA, 16 bp, Homo sapiens
agaatagatgctgact

SEQ ID NO: 890616 - DNA, 17 bp, Homo sapiens
agaatagccacatttgg

SEQ ID NO: 890617 - DNA, 19 bp, Homo sapiens
agaatagccacatttggaa

SEQ ID NO: 890618 - DNA, 21 bp, Homo sapiens
agaatagccacatttggaata

SEQ ID NO: 890619 - DNA, 13 bp, Homo sapiens
agaatagctgttt

SEQ ID NO: 890620 - DNA, 22 bp, Homo sapiens
agaatagctgttttgtgtatat

SEQ ID NO: 890621 - DNA, 23 bp, Homo sapiens
agaatagctgttttgtgtatatt

SEQ ID NO: 890622 - DNA, 15 bp, Homo sapiens
agaatagcttccaat

SEQ ID NO: 890623 - DNA, 14 bp, Homo sapiens
agaataggaaaaca

SEQ ID NO: 890624 - DNA, 18 bp, Homo sapiens
agaataggcactttaaaa

SEQ ID NO: 890625 - DNA, 20 bp, Homo sapiens
agaataggcactttaaaaca

SEQ ID NO: 890626 - DNA, 14 bp, Homo sapiens
agaatataacatgt

SEQ ID NO: 890627 - DNA, 13 bp, Homo sapiens
agaatataatact

SEQ ID NO: 890628 - DNA, 17 bp, Homo sapiens
agaatataattatcgga

SEQ ID NO: 890629 - DNA, 12 bp, Homo sapiens
agaatatacctt

SEQ ID NO: 890630 - DNA, 17 bp, Homo sapiens
agaatataccttattta

SEQ ID NO: 890631 - DNA, 14 bp, Homo sapiens
agaatataggtctc

SEQ ID NO: 890632 - DNA, 15 bp, Homo sapiens
agaatatatgctttt

SEQ ID NO: 890633 - DNA, 17 bp, Homo sapiens
agaatatccatgaccta

SEQ ID NO: 890634 - DNA, 11 bp, Homo sapiens
agaatatctgg

SEQ ID NO: 890635 - DNA, 16 bp, Homo sapiens
agaatatgacttttta

SEQ ID NO: 890636 - DNA, 13 bp, Homo sapiens
agaatatgataaa

SEQ ID NO: 890637 - DNA, 16 bp, Homo sapiens
agaatatggaggctgg

SEQ ID NO: 890638 - DNA, 19 bp, Homo sapiens
agaatatgtaatacttaaa

SEQ ID NO: 890639 - DNA, 23 bp, Homo sapiens
agaatatgtaatacttaaataaa

SEQ ID NO: 890640 - DNA, 13 bp, Homo sapiens
agaatatgtttcc

SEQ ID NO: 890641 - DNA, 19 bp, Homo sapiens
agaatattagctttactgt

SEQ ID NO: 890642 - DNA, 21 bp, Homo sapiens
agaatattagctttactgttt

SEQ ID NO: 890643 - DNA, 21 bp, Homo sapiens
actctgagtttaccatttgta

SEQ ID NO: 890644 - DNA, 21 bp, Homo sapiens
actctgatggaatgtgccacc

SEQ ID NO: 890645 - DNA, 22 bp, Homo sapiens
actctgatggaatgtgccacct

SEQ ID NO: 890646 - DNA, 23 bp, Homo sapiens
actctgatggaatgtgccacctg

SEQ ID NO: 890647 - DNA, 20 bp, Homo sapiens
actctgattcacctcttcct

SEQ ID NO: 890648 - DNA, 14 bp, Homo sapiens
actctgcaaaggcc

SEQ ID NO: 890649 - DNA, 16 bp, Homo sapiens
actctgcaaaggcctg

SEQ ID NO: 890650 - DNA, 14 bp, Homo sapiens
actctgcactactc

SEQ ID NO: 890651 - DNA, 21 bp, Homo sapiens
actctgcactccatggccacc

SEQ ID NO: 890652 - DNA, 23 bp, Homo sapiens
actctgcactccatggccacccc

SEQ ID NO: 890653 - DNA, 15 bp, Homo sapiens
actctgcatccagag

SEQ ID NO: 890654 - DNA, 16 bp, Homo sapiens
actctgccagccacat

SEQ ID NO: 890655 - DNA, 19 bp, Homo sapiens
actctgcccctggacctgg

SEQ ID NO: 890656 - DNA, 17 bp, Homo sapiens
actctgccctctagagc

SEQ ID NO: 890657 - DNA, 22 bp, Homo sapiens
actctgccctctgctgctgccc

SEQ ID NO: 890658 - DNA, 23 bp, Homo sapiens
actctgccctctgctgctgcccg

SEQ ID NO: 890659 - DNA, 16 bp, Homo sapiens
actctgcctcctcttc

SEQ ID NO: 890660 - DNA, 15 bp, Homo sapiens
actctgcctcctggt

SEQ ID NO: 890661 - DNA, 16 bp, Homo sapiens
actctgcctcctggtt

SEQ ID NO: 890662 - DNA, 15 bp, Homo sapiens
actctgcctttatga

SEQ ID NO: 890663 - DNA, 19 bp, Homo sapiens
actctgcctttatgatgct

SEQ ID NO: 890664 - DNA, 15 bp, Homo sapiens
actctgcctttctaa

SEQ ID NO: 890665 - DNA, 19 bp, Homo sapiens
actctgcggcccgggccga

SEQ ID NO: 890666 - DNA, 18 bp, Homo sapiens
actctgcgggaggctggg

SEQ ID NO: 890667 - DNA, 19 bp, Homo sapiens
actctgcgggaggctgggg

SEQ ID NO: 890668 - DNA, 20 bp, Homo sapiens
actctgcgggaggctggggc

SEQ ID NO: 890669 - DNA, 14 bp, Homo sapiens
actctgctctgccc

SEQ ID NO: 890670 - DNA, 15 bp, Homo sapiens
actctgctgcttaga

SEQ ID NO: 890671 - DNA, 14 bp, Homo sapiens
actctgctgtttga

SEQ ID NO: 890672 - DNA, 12 bp, Homo sapiens
actctgcttaaa

SEQ ID NO: 890673 - DNA, 17 bp, Homo sapiens
actctgcttaaacaaag

SEQ ID NO: 890674 - DNA, 15 bp, Homo sapiens
actctgcttctctga

SEQ ID NO: 890675 - DNA, 16 bp, Homo sapiens
actctgcttctctgac

SEQ ID NO: 890676 - DNA, 17 bp, Homo sapiens
actctgcttctctgact

SEQ ID NO: 890677 - DNA, 18 bp, Homo sapiens
actctgcttctctgactt

SEQ ID NO: 890678 - DNA, 16 bp, Homo sapiens
actctgcttgattttt

SEQ ID NO: 890679 - DNA, 22 bp, Homo sapiens
actctggaatgtttttccctcc

SEQ ID NO: 890680 - DNA, 16 bp, Homo sapiens
actctggactttctct

SEQ ID NO: 890681 - DNA, 21 bp, Homo sapiens
actctggactttctctaataa

SEQ ID NO: 890682 - DNA, 23 bp, Homo sapiens
actctggactttctctaataata

SEQ ID NO: 890683 - DNA, 14 bp, Homo sapiens
actctggattttga

SEQ ID NO: 890684 - DNA, 17 bp, Homo sapiens
actctggcaaagctttt

SEQ ID NO: 890685 - DNA, 11 bp, Homo sapiens
actctggcaca

SEQ ID NO: 890686 - DNA, 15 bp, Homo sapiens
actctggcacttcca

SEQ ID NO: 890687 - DNA, 13 bp, Homo sapiens
actctggccctgg

SEQ ID NO: 890688 - DNA, 19 bp, Homo sapiens
actctggcggtggccacag

SEQ ID NO: 890689 - DNA, 14 bp, Homo sapiens
actctggctcagcc

SEQ ID NO: 890690 - DNA, 14 bp, Homo sapiens
actctggcttccag

SEQ ID NO: 890691 - DNA, 15 bp, Homo sapiens
actctggcttccagg

SEQ ID NO: 890692 - DNA, 22 bp, Homo sapiens
actctgggcagaagtgagcccc

SEQ ID NO: 890693 - DNA, 14 bp, Homo sapiens
actctgggcaggga

SEQ ID NO: 890694 - DNA, 18 bp, Homo sapiens
actctgggctatggacac

SEQ ID NO: 890695 - DNA, 20 bp, Homo sapiens
actctgggctatggacacag

SEQ ID NO: 890696 - DNA, 12 bp, Homo sapiens
actctgggctgt

SEQ ID NO: 890697 - DNA, 23 bp, Homo sapiens
actctgggctgtaacgtggcact

SEQ ID NO: 890698 - DNA, 19 bp, Homo sapiens
actctgggtccctcggagc

SEQ ID NO: 890699 - DNA, 18 bp, Homo sapiens
actctgggttcgttgggg

SEQ ID NO: 890700 - DNA, 21 bp, Homo sapiens
actctgggttcgttggggaca

SEQ ID NO: 890701 - DNA, 20 bp, Homo sapiens
actctggtgagtcaccactt

SEQ ID NO: 890702 - DNA, 13 bp, Homo sapiens
actctggtggcca

SEQ ID NO: 890703 - DNA, 13 bp, Homo sapiens
actctgtaattgc

SEQ ID NO: 890704 - DNA, 14 bp, Homo sapiens
actctgtaattgca

SEQ ID NO: 890705 - DNA, 17 bp, Homo sapiens
actgaatgttttattta

SEQ ID NO: 890706 - DNA, 15 bp, Homo sapiens
actgaattaaacatg

SEQ ID NO: 890707 - DNA, 21 bp, Homo sapiens
actgaattaatcatctataaa

SEQ ID NO: 890708 - DNA, 16 bp, Homo sapiens
actgaattctgccttg

SEQ ID NO: 890709 - DNA, 19 bp, Homo sapiens
actgaattctgccttggtt

SEQ ID NO: 890710 - DNA, 23 bp, Homo sapiens
actgaatttcttttgccgttatt

SEQ ID NO: 890711 - DNA, 17 bp, Homo sapiens
actgaatttttttgtaa

SEQ ID NO: 890712 - DNA, 18 bp, Homo sapiens
actgaatttttttgtaat

SEQ ID NO: 890713 - DNA, 20 bp, Homo sapiens
actgaatttttttgtaataa

SEQ ID NO: 890714 - DNA, 23 bp, Homo sapiens
actgacaccctgggatggaacct

SEQ ID NO: 890715 - DNA, 17 bp, Homo sapiens
actgacagccttgccca

SEQ ID NO: 890716 - DNA, 21 bp, Homo sapiens
actgacaggcagcctggacat

SEQ ID NO: 890717 - DNA, 16 bp, Homo sapiens
actgacatgccctccc

SEQ ID NO: 890718 - DNA, 21 bp, Homo sapiens
actgacattcctaagagtgga

SEQ ID NO: 890719 - DNA, 15 bp, Homo sapiens
actgaccagcctcca

SEQ ID NO: 890720 - DNA, 18 bp, Homo sapiens
actgacccaactgggggc

SEQ ID NO: 890721 - DNA, 20 bp, Homo sapiens
actgacccccatctgagctg

SEQ ID NO: 890722 - DNA, 21 bp, Homo sapiens
actgaccccccccattagaat

SEQ ID NO: 890723 - DNA, 18 bp, Homo sapiens
actgaccctgaggaggcc

SEQ ID NO: 890724 - DNA, 20 bp, Homo sapiens
actgaccgggatccagttcc

SEQ ID NO: 890725 - DNA, 13 bp, Homo sapiens
actgacctacctc

SEQ ID NO: 890726 - DNA, 21 bp, Homo sapiens
actgacctgtcatgcccccct

SEQ ID NO: 890727 - DNA, 19 bp, Homo sapiens
actgacgctggagatgcaa

SEQ ID NO: 890728 - DNA, 14 bp, Homo sapiens
actgactccttaga

SEQ ID NO: 890729 - DNA, 14 bp, Homo sapiens
actgactctgttat

SEQ ID NO: 890730 - DNA, 23 bp, Homo sapiens
actgactgaaggaaaagcaagaa

SEQ ID NO: 890731 - DNA, 21 bp, Homo sapiens
actgactggattcattctcat

SEQ ID NO: 890732 - DNA, 15 bp, Homo sapiens
actgacttcagtggg

SEQ ID NO: 890733 - DNA, 20 bp, Homo sapiens
actgacttcatttgtgccac

SEQ ID NO: 890734 - DNA, 13 bp, Homo sapiens
actgacttgctgt

SEQ ID NO: 890735 - DNA, 20 bp, Homo sapiens
actgacttgtttgtcttcca

SEQ ID NO: 890736 - DNA, 24 bp, Homo sapiens
actgacttgtttgtcttccattcc

SEQ ID NO: 890737 - DNA, 15 bp, Homo sapiens
actgactttctgatt

SEQ ID NO: 890738 - DNA, 13 bp, Homo sapiens
actgactttgctt

SEQ ID NO: 890739 - DNA, 18 bp, Homo sapiens
actgagaaggcaggcctc

SEQ ID NO: 890740 - DNA, 23 bp, Homo sapiens
actgagaccaaggctttctctac

SEQ ID NO: 890741 - DNA, 12 bp, Homo sapiens
actgagacttgt

SEQ ID NO: 890742 - DNA, 23 bp, Homo sapiens
actgagacttgttcttggttcct

SEQ ID NO: 890743 - DNA, 23 bp, Homo sapiens
actgagagggcaatctttgcctt

SEQ ID NO: 890744 - DNA, 16 bp, Homo sapiens
actgagatgctgggct

SEQ ID NO: 890745 - DNA, 17 bp, Homo sapiens
actgagatgttttacca

SEQ ID NO: 890746 - DNA, 21 bp, Homo sapiens
actgagcaagaccctgtctct

SEQ ID NO: 890747 - DNA, 16 bp, Homo sapiens
actgagcagccgccag

SEQ ID NO: 890748 - DNA, 18 bp, Homo sapiens
actgagcaggctgtgggg

SEQ ID NO: 890749 - DNA, 15 bp, Homo sapiens
actgagcataagtcc

SEQ ID NO: 890750 - DNA, 15 bp, Homo sapiens
actgagcatttgcac

SEQ ID NO: 890751 - DNA, 14 bp, Homo sapiens
actgagccccacct

SEQ ID NO: 890752 - DNA, 11 bp, Homo sapiens
actgagccccc

SEQ ID NO: 890753 - DNA, 13 bp, Homo sapiens
actgagccccccc

SEQ ID NO: 890754 - DNA, 15 bp, Homo sapiens
actgagcccccccaa

SEQ ID NO: 890755 - DNA, 21 bp, Homo sapiens
actgagccctctcactccagc

SEQ ID NO: 890756 - DNA, 10 bp, Homo sapiens
actgagcctg

SEQ ID NO: 890757 - DNA, 14 bp, Homo sapiens
actgagccttgtaa

SEQ ID NO: 890758 - DNA, 22 bp, Homo sapiens
actgagcgtgttttataaaaaa

SEQ ID NO: 890759 - DNA, 23 bp, Homo sapiens
actgagctccatgtgccccctct

SEQ ID NO: 890760 - DNA, 18 bp, Homo sapiens
actgagctccccagatct

SEQ ID NO: 890761 - DNA, 13 bp, Homo sapiens
actgagctcctct

SEQ ID NO: 890762 - DNA, 14 bp, Homo sapiens
actgagctcctctg

SEQ ID NO: 890763 - DNA, 21 bp, Homo sapiens
actgagctcctctgggcagga

SEQ ID NO: 890764 - DNA, 18 bp, Homo sapiens
actgagctcgcagccccc

SEQ ID NO: 890765 - DNA, 15 bp, Homo sapiens
actgagctctccagg

SEQ ID NO: 890766 - DNA, 16 bp, Homo sapiens
actgagctctccaggc

SEQ ID NO: 890767 - DNA, 17 bp, Homo sapiens
actgagctctccaggcc

SEQ ID NO: 890768 - DNA, 15 bp, Homo sapiens
actgagcttctgaga

SEQ ID NO: 890769 - DNA, 16 bp, Homo sapiens
actgagcttctgagac

SEQ ID NO: 890770 - DNA, 21 bp, Homo sapiens
actgaggaaatatttccatta

SEQ ID NO: 890771 - DNA, 18 bp, Homo sapiens
actgaggaatgatgaagc

SEQ ID NO: 890772 - DNA, 15 bp, Homo sapiens
actgaggaccagcca

SEQ ID NO: 890773 - DNA, 16 bp, Homo sapiens
actccaggcccaaggc

SEQ ID NO: 890774 - DNA, 17 bp, Homo sapiens
actccaggcccaaggct

SEQ ID NO: 890775 - DNA, 19 bp, Homo sapiens
actccaggcccaaggctcc

SEQ ID NO: 890776 - DNA, 15 bp, Homo sapiens
actccaggccctcct

SEQ ID NO: 890777 - DNA, 18 bp, Homo sapiens
actccaggccctcctctc

SEQ ID NO: 890778 - DNA, 16 bp, Homo sapiens
actccaggctttctgg

SEQ ID NO: 890779 - DNA, 19 bp, Homo sapiens
actccaggctttctggagt

SEQ ID NO: 890780 - DNA, 24 bp, Homo sapiens
actccagggacacacagcctagca

SEQ ID NO: 890781 - DNA, 17 bp, Homo sapiens
actccagtagctcctgg

SEQ ID NO: 890782 - DNA, 17 bp, Homo sapiens
actccatcattcatcca

SEQ ID NO: 890783 - DNA, 21 bp, Homo sapiens
actccatctctcatcctccag

SEQ ID NO: 890784 - DNA, 17 bp, Homo sapiens
actccatcttggtagtt

SEQ ID NO: 890785 - DNA, 14 bp, Homo sapiens
actccatgagaagc

SEQ ID NO: 890786 - DNA, 13 bp, Homo sapiens
actccatgagcac

SEQ ID NO: 890787 - DNA, 17 bp, Homo sapiens
actccatgagcacccca

SEQ ID NO: 890788 - DNA, 21 bp, Homo sapiens
actccatgcttagtcactgcc

SEQ ID NO: 890789 - DNA, 12 bp, Homo sapiens
actccattctcc

SEQ ID NO: 890790 - DNA, 12 bp, Homo sapiens
actccattgtcg

SEQ ID NO: 890791 - DNA, 15 bp, Homo sapiens
actccatttctttct

SEQ ID NO: 890792 - DNA, 19 bp, Homo sapiens
actccatttctttcttcca

SEQ ID NO: 890793 - DNA, 21 bp, Homo sapiens
actcccaagggacagcaagtg

SEQ ID NO: 890794 - DNA, 19 bp, Homo sapiens
actcccaaggttggagccc

SEQ ID NO: 890795 - DNA, 16 bp, Homo sapiens
actcccaatacaaaga

SEQ ID NO: 890796 - DNA, 16 bp, Homo sapiens
actcccacacccaaga

SEQ ID NO: 890797 - DNA, 14 bp, Homo sapiens
actcccaccacagg

SEQ ID NO: 890798 - DNA, 14 bp, Homo sapiens
actcccagcagagc

SEQ ID NO: 890799 - DNA, 15 bp, Homo sapiens
actcccagcagagcc

SEQ ID NO: 890800 - DNA, 20 bp, Homo sapiens
actccccacatcccatcgtc

SEQ ID NO: 890801 - DNA, 14 bp, Homo sapiens
actccccacgggaa

SEQ ID NO: 890802 - DNA, 16 bp, Homo sapiens
actccccactccccca

SEQ ID NO: 890803 - DNA, 18 bp, Homo sapiens
actccccagagctgtgcc

SEQ ID NO: 890804 - DNA, 20 bp, Homo sapiens
actccccagagctgtgccag

SEQ ID NO: 890805 - DNA, 17 bp, Homo sapiens
actccccagcctgggcc

SEQ ID NO: 890806 - DNA, 19 bp, Homo sapiens
actccccaggccaggccac

SEQ ID NO: 890807 - DNA, 21 bp, Homo sapiens
actccccattggagcaagctt

SEQ ID NO: 890808 - DNA, 22 bp, Homo sapiens
actcccccacccatggggagga

SEQ ID NO: 890809 - DNA, 14 bp, Homo sapiens
actcccccaggtgg

SEQ ID NO: 890810 - DNA, 21 bp, Homo sapiens
actccccctaaacccctgtcc

SEQ ID NO: 890811 - DNA, 16 bp, Homo sapiens
actccccttccctggg

SEQ ID NO: 890812 - DNA, 17 bp, Homo sapiens
actccccttccctgggg

SEQ ID NO: 890813 - DNA, 22 bp, Homo sapiens
actcccgccccgggctggccct

SEQ ID NO: 890814 - DNA, 14 bp, Homo sapiens
actcccgctgcaca

SEQ ID NO: 890815 - DNA, 23 bp, Homo sapiens
actcccgctgcacacagacggcc

SEQ ID NO: 890816 - DNA, 21 bp, Homo sapiens
actcccgggccaagacagatg

SEQ ID NO: 890817 - DNA, 21 bp, Homo sapiens
actccctaatttatgtgctat

SEQ ID NO: 890818 - DNA, 13 bp, Homo sapiens
actccctccacca

SEQ ID NO: 890819 - DNA, 20 bp, Homo sapiens
actccctccaccagcctgct

SEQ ID NO: 890820 - DNA, 22 bp, Homo sapiens
actccctcctcacctctggact

SEQ ID NO: 890821 - DNA, 12 bp, Homo sapiens
actccctctgca

SEQ ID NO: 890822 - DNA, 23 bp, Homo sapiens
actccctcttcactgtggccaca

SEQ ID NO: 890823 - DNA, 12 bp, Homo sapiens
actccctgagct

SEQ ID NO: 890824 - DNA, 17 bp, Homo sapiens
actccctgagtctggac

SEQ ID NO: 890825 - DNA, 22 bp, Homo sapiens
actccctgagtctggacctcca

SEQ ID NO: 890826 - DNA, 17 bp, Homo sapiens
actccctgcagatgcca

SEQ ID NO: 890827 - DNA, 18 bp, Homo sapiens
actccctgccccccagcc

SEQ ID NO: 890828 - DNA, 12 bp, Homo sapiens
actccctgccta

SEQ ID NO: 890829 - DNA, 16 bp, Homo sapiens
actccctgctccacga

SEQ ID NO: 890830 - DNA, 21 bp, Homo sapiens
actccctggatgtgtggggca

SEQ ID NO: 890831 - DNA, 12 bp, Homo sapiens
actccctggcct

SEQ ID NO: 890832 - DNA, 15 bp, Homo sapiens
actccctggccttgc

SEQ ID NO: 890833 - DNA, 22 bp, Homo sapiens
actcccttaaggtctccaaacc

SEQ ID NO: 890834 - DNA, 11 bp, Homo sapiens
actcccttcct

SEQ ID NO: 890835 - DNA, 18 bp, Homo sapiens
actcccttcctggcctca

SEQ ID NO: 890836 - DNA, 14 bp, Homo sapiens
actcccttctgtag

SEQ ID NO: 890837 - DNA, 22 bp, Homo sapiens
actcccttgctggccccagccc

SEQ ID NO: 890838 - DNA, 19 bp, Homo sapiens
actcccttggtggcaagag

SEQ ID NO: 890839 - DNA, 14 bp, Homo sapiens
actccgaagaaaag

SEQ ID NO: 890840 - DNA, 15 bp, Homo sapiens
actccgaagaaaaga

SEQ ID NO: 890841 - DNA, 17 bp, Homo sapiens
actccgcatcacctcac

SEQ ID NO: 890842 - DNA, 17 bp, Homo sapiens
actccgcccagcctctc

SEQ ID NO: 890843 - DNA, 12 bp, Homo sapiens
actccgccccca

SEQ ID NO: 890844 - DNA, 15 bp, Homo sapiens
actccgcccccagcc

SEQ ID NO: 890845 - DNA, 23 bp, Homo sapiens
actccgcggagtgatcatggaaa

SEQ ID NO: 890846 - DNA, 11 bp, Homo sapiens
acggaaacaga

SEQ ID NO: 890847 - DNA, 16 bp, Homo sapiens
acggaaacatacagag

SEQ ID NO: 890848 - DNA, 17 bp, Homo sapiens
acggaacgttggacttt

SEQ ID NO: 890849 - DNA, 23 bp, Homo sapiens
actacccccacagacctgctctg

SEQ ID NO: 890850 - DNA, 14 bp, Homo sapiens
actaccctccagag

SEQ ID NO: 890851 - DNA, 16 bp, Homo sapiens
actaccgaatgtgtct

SEQ ID NO: 890852 - DNA, 15 bp, Homo sapiens
actaccgcaggcccg

SEQ ID NO: 890853 - DNA, 17 bp, Homo sapiens
actacctataggaaagt

SEQ ID NO: 890854 - DNA, 23 bp, Homo sapiens
actacctctggacagttgtgttg

SEQ ID NO: 890855 - DNA, 14 bp, Homo sapiens
actacctcttttga

SEQ ID NO: 890856 - DNA, 22 bp, Homo sapiens
actacctgtaatgacaggcctg

SEQ ID NO: 890857 - DNA, 16 bp, Homo sapiens
actatctaaatgttga

SEQ ID NO: 890858 - DNA, 21 bp, Homo sapiens
actatctaaatgttgaaagat

SEQ ID NO: 890859 - DNA, 13 bp, Homo sapiens
actatctacaaaa

SEQ ID NO: 890860 - DNA, 14 bp, Homo sapiens
actatctgtctggt

SEQ ID NO: 890861 - DNA, 20 bp, Homo sapiens
actatcttactatttcacaa

SEQ ID NO: 890862 - DNA, 21 bp, Homo sapiens
actatgaaaagctagaattga

SEQ ID NO: 890863 - DNA, 11 bp, Homo sapiens
actatgaaata

SEQ ID NO: 890864 - DNA, 15 bp, Homo sapiens
actatgaacactgtc

SEQ ID NO: 890865 - DNA, 18 bp, Homo sapiens
actatgaactacaaagct

SEQ ID NO: 890866 - DNA, 17 bp, Homo sapiens
actatgacaatcttatt

SEQ ID NO: 890867 - DNA, 21 bp, Homo sapiens
actatgataaagttgtaaata

SEQ ID NO: 890868 - DNA, 19 bp, Homo sapiens
actatgatgggcttctgtt

SEQ ID NO: 890869 - DNA, 23 bp, Homo sapiens
actatgcgtggctggaaccacat

SEQ ID NO: 890870 - DNA, 17 bp, Homo sapiens
actatggaaaatcagct

SEQ ID NO: 890871 - DNA, 23 bp, Homo sapiens
acgatttctgtttagataataca

SEQ ID NO: 890872 - DNA, 18 bp, Homo sapiens
acgattttctccagctca

SEQ ID NO: 890873 - DNA, 17 bp, Homo sapiens
acgcaaatacactccag

SEQ ID NO: 890874 - DNA, 18 bp, Homo sapiens
acgcaagggcatcaggca

SEQ ID NO: 890875 - DNA, 16 bp, Homo sapiens
acgcaagtgtgtgagt

SEQ ID NO: 890876 - DNA, 18 bp, Homo sapiens
acgcaattttacctagtt

SEQ ID NO: 890877 - DNA, 18 bp, Homo sapiens
acgcacacacacacacag

SEQ ID NO: 890878 - DNA, 20 bp, Homo sapiens
acgcacacacacacacagga

SEQ ID NO: 890879 - DNA, 15 bp, Homo sapiens
acgcacacacacata

SEQ ID NO: 890880 - DNA, 21 bp, Homo sapiens
acccgtgcctgggcccctccc

SEQ ID NO: 890881 - DNA, 22 bp, Homo sapiens
acccgttctgctggcctggatc

SEQ ID NO: 890882 - DNA, 14 bp, Homo sapiens
accctaaaatttta

SEQ ID NO: 890883 - DNA, 21 bp, Homo sapiens
accctaaagcaaatctgccac

SEQ ID NO: 890884 - DNA, 18 bp, Homo sapiens
accctaagggcagccctc

SEQ ID NO: 890885 - DNA, 21 bp, Homo sapiens
accctaatagactaaatgaaa

SEQ ID NO: 890886 - DNA, 19 bp, Homo sapiens
accctaccaactttactgt

SEQ ID NO: 890887 - DNA, 14 bp, Homo sapiens
accctaccagctcc

SEQ ID NO: 890888 - DNA, 15 bp, Homo sapiens
accctaccccaccac

SEQ ID NO: 890889 - DNA, 13 bp, Homo sapiens
accctactgtggg

SEQ ID NO: 890890 - DNA, 15 bp, Homo sapiens
accctactgtgggga

SEQ ID NO: 890891 - DNA, 20 bp, Homo sapiens
accctactgtggggagagat

SEQ ID NO: 890892 - DNA, 14 bp, Homo sapiens
accctacttctttt

SEQ ID NO: 890893 - DNA, 21 bp, Homo sapiens
accctactttgcttccgccac

SEQ ID NO: 890894 - DNA, 17 bp, Homo sapiens
accctagaagaaaaccc

SEQ ID NO: 890895 - DNA, 18 bp, Homo sapiens
accctagaagaaaacccg

SEQ ID NO: 890896 - DNA, 17 bp, Homo sapiens
accctagaaggtgggga

SEQ ID NO: 890897 - DNA, 16 bp, Homo sapiens
accctagccagagaat

SEQ ID NO: 890898 - DNA, 17 bp, Homo sapiens
accctagccagagaata

SEQ ID NO: 890899 - DNA, 19 bp, Homo sapiens
accctagccagagaataga

SEQ ID NO: 890900 - DNA, 15 bp, Homo sapiens
accctagccttgctt

SEQ ID NO: 890901 - DNA, 19 bp, Homo sapiens
accctaggttccctgttct

SEQ ID NO: 890902 - DNA, 22 bp, Homo sapiens
accctaggttccctgttcttcc

SEQ ID NO: 890903 - DNA, 15 bp, Homo sapiens
accctagttctacct

SEQ ID NO: 890904 - DNA, 23 bp, Homo sapiens
accctatagagagggggctctcc

SEQ ID NO: 890905 - DNA, 14 bp, Homo sapiens
accctatctcctga

SEQ ID NO: 890906 - DNA, 15 bp, Homo sapiens
accctatctgtgatt

SEQ ID NO: 890907 - DNA, 22 bp, Homo sapiens
accctatctgtgattcccccaa

SEQ ID NO: 890908 - DNA, 13 bp, Homo sapiens
accctattcccta

SEQ ID NO: 890909 - DNA, 23 bp, Homo sapiens
accctattctatccatctcctgg

SEQ ID NO: 890910 - DNA, 16 bp, Homo sapiens
accctcaaatgtcaga

SEQ ID NO: 890911 - DNA, 21 bp, Homo sapiens
accctcaaatgtcagagctat

SEQ ID NO: 890912 - DNA, 14 bp, Homo sapiens
accctcacacacac

SEQ ID NO: 890913 - DNA, 17 bp, Homo sapiens
accctcacacacacagc

SEQ ID NO: 890914 - DNA, 9 bp, Homo sapiens
accctcact

SEQ ID NO: 890915 - DNA, 21 bp, Homo sapiens
accctcactggctctcctggc

SEQ ID NO: 890916 - DNA, 18 bp, Homo sapiens
accctcagagccacccct

SEQ ID NO: 890917 - DNA, 12 bp, Homo sapiens
accctcagccct

SEQ ID NO: 890918 - DNA, 13 bp, Homo sapiens
accctcagccctg

SEQ ID NO: 890919 - DNA, 19 bp, Homo sapiens
accctcagccctggccttt

SEQ ID NO: 890920 - DNA, 22 bp, Homo sapiens
accctcagccctggcctttttc

SEQ ID NO: 890921 - DNA, 16 bp, Homo sapiens
accctcagctgtcacc

SEQ ID NO: 890922 - DNA, 19 bp, Homo sapiens
accctcaggcataggcctg

SEQ ID NO: 890923 - DNA, 18 bp, Homo sapiens
accctcaggccaccctcc

SEQ ID NO: 890924 - DNA, 17 bp, Homo sapiens
accctcagggagcctcc

SEQ ID NO: 890925 - DNA, 20 bp, Homo sapiens
accctcattgctgtcttgcc

SEQ ID NO: 890926 - DNA, 21 bp, Homo sapiens
accctcattgctgtcttgccc

SEQ ID NO: 890927 - DNA, 14 bp, Homo sapiens
accctccacctctc

SEQ ID NO: 890928 - DNA, 15 bp, Homo sapiens
accctccacctctca

SEQ ID NO: 890929 - DNA, 15 bp, Homo sapiens
accctccaccttcca

SEQ ID NO: 890930 - DNA, 13 bp, Homo sapiens
accctccactcac

SEQ ID NO: 890931 - DNA, 21 bp, Homo sapiens
accctccactcagctgtcctg

SEQ ID NO: 890932 - DNA, 13 bp, Homo sapiens
accctcccacccc

SEQ ID NO: 890933 - DNA, 13 bp, Homo sapiens
accctcccactcc

SEQ ID NO: 890934 - DNA, 14 bp, Homo sapiens
accctcccactccc

SEQ ID NO: 890935 - DNA, 19 bp, Homo sapiens
accctcccagaaacatctc

SEQ ID NO: 890936 - DNA, 15 bp, Homo sapiens
accctcccagtctca

SEQ ID NO: 890937 - DNA, 19 bp, Homo sapiens
accctcccagtctcatctc

SEQ ID NO: 890938 - DNA, 22 bp, Homo sapiens
accctcccagtctcatctcctg

SEQ ID NO: 890939 - DNA, 17 bp, Homo sapiens
accttgcttttgcttct

SEQ ID NO: 890940 - DNA, 13 bp, Homo sapiens
accttggactcct

SEQ ID NO: 890941 - DNA, 21 bp, Homo sapiens
accttggaggaatgacaataa

SEQ ID NO: 890942 - DNA, 14 bp, Homo sapiens
accttggaggagga

SEQ ID NO: 890943 - DNA, 14 bp, Homo sapiens
accttggcccagga

SEQ ID NO: 890944 - DNA, 16 bp, Homo sapiens
accttggcccaggagc

SEQ ID NO: 890945 - DNA, 22 bp, Homo sapiens
accttggcccaggagctctgcg

SEQ ID NO: 890946 - DNA, 16 bp, Homo sapiens
accttggcttgttatt

SEQ ID NO: 890947 - DNA, 15 bp, Homo sapiens
accttgggaccaaag

SEQ ID NO: 890948 - DNA, 14 bp, Homo sapiens
accttgggccctgg

SEQ ID NO: 890949 - DNA, 18 bp, Homo sapiens
accttggtccctctcaga

SEQ ID NO: 890950 - DNA, 14 bp, Homo sapiens
accttgtaaaaaaa

SEQ ID NO: 890951 - DNA, 18 bp, Homo sapiens
accttgtgcccagggttt

SEQ ID NO: 890952 - DNA, 23 bp, Homo sapiens
accttgtgcccagggttttgccc

SEQ ID NO: 890953 - DNA, 13 bp, Homo sapiens
accttgtgctact

SEQ ID NO: 890954 - DNA, 13 bp, Homo sapiens
acctgtggatatt

SEQ ID NO: 890955 - DNA, 14 bp, Homo sapiens
acctgtggctcagg

SEQ ID NO: 890956 - DNA, 17 bp, Homo sapiens
acctgtggctcagggga

SEQ ID NO: 890957 - DNA, 19 bp, Homo sapiens
acctgtgtgagagaattta

SEQ ID NO: 890958 - DNA, 20 bp, Homo sapiens
acctgtgtttttttctaaaa

SEQ ID NO: 890959 - DNA, 18 bp, Homo sapiens
acctgttaaaatgtacac

SEQ ID NO: 890960 - DNA, 19 bp, Homo sapiens
acctgttaatttttatact

SEQ ID NO: 890961 - DNA, 19 bp, Homo sapiens
acctgttagctccctgtgg

SEQ ID NO: 890962 - DNA, 22 bp, Homo sapiens
acctgttcacagaaaaagcatg

SEQ ID NO: 890963 - DNA, 19 bp, Homo sapiens
acctgttcagtactctaca

SEQ ID NO: 890964 - DNA, 17 bp, Homo sapiens
acctgttcagtgtcccg

SEQ ID NO: 890965 - DNA, 22 bp, Homo sapiens
acctgttcagtgtcccgggccc

SEQ ID NO: 890966 - DNA, 13 bp, Homo sapiens
acctgttccattg

SEQ ID NO: 890967 - DNA, 13 bp, Homo sapiens
acctgttcctccc

SEQ ID NO: 890968 - DNA, 14 bp, Homo sapiens
acctgttgaagatt

SEQ ID NO: 890969 - DNA, 13 bp, Homo sapiens
acctgtttaaata

SEQ ID NO: 890970 - DNA, 21 bp, Homo sapiens
acctgtttatgagatgctggt

SEQ ID NO: 890971 - DNA, 22 bp, Homo sapiens
acctgtttcccgggcaatttaa

SEQ ID NO: 890972 - DNA, 15 bp, Homo sapiens
acctgttttctgaaa

SEQ ID NO: 890973 - DNA, 19 bp, Homo sapiens
acctgttttctgaaacaca

SEQ ID NO: 890974 - DNA, 19 bp, Homo sapiens
acctgtttttaagctgttt

SEQ ID NO: 890975 - DNA, 12 bp, Homo sapiens
accttaaattaa

SEQ ID NO: 890976 - DNA, 14 bp, Homo sapiens
accttaaattaaac

SEQ ID NO: 890977 - DNA, 16 bp, Homo sapiens
accttaaattaaacaa

SEQ ID NO: 890978 - DNA, 22 bp, Homo sapiens
accttaaattaaacaatttatt

SEQ ID NO: 890979 - DNA, 16 bp, Homo sapiens
accttaagacactgtg

SEQ ID NO: 890980 - DNA, 21 bp, Homo sapiens
accttaagacactgtgagagt

SEQ ID NO: 890981 - DNA, 13 bp, Homo sapiens
accttaatgacaa

SEQ ID NO: 890982 - DNA, 17 bp, Homo sapiens
accttaccaactttctg

SEQ ID NO: 890983 - DNA, 19 bp, Homo sapiens
accttaccaactttctgta

SEQ ID NO: 890984 - DNA, 20 bp, Homo sapiens
accttaccaactttctgtaa

SEQ ID NO: 890985 - DNA, 14 bp, Homo sapiens
accttagaatacag

SEQ ID NO: 890986 - DNA, 20 bp, Homo sapiens
accttagataatatttctga

SEQ ID NO: 890987 - DNA, 16 bp, Homo sapiens
accttagcgttctgga

SEQ ID NO: 890988 - DNA, 18 bp, Homo sapiens
accttagcttattgatcc

SEQ ID NO: 890989 - DNA, 21 bp, Homo sapiens
accttaggccttcctctctcc

SEQ ID NO: 890990 - DNA, 18 bp, Homo sapiens
accttaggctttgtatga

SEQ ID NO: 890991 - DNA, 20 bp, Homo sapiens
accttaggctttgtatgaca

SEQ ID NO: 890992 - DNA, 22 bp, Homo sapiens
accttagtcatcagatatgctt

SEQ ID NO: 890993 - DNA, 20 bp, Homo sapiens
accttagttgaaatgatagc

SEQ ID NO: 890994 - DNA, 19 bp, Homo sapiens
accttatagttactgtgta

SEQ ID NO: 890995 - DNA, 22 bp, Homo sapiens
accttatagttactgtgtaatt

SEQ ID NO: 890996 - DNA, 14 bp, Homo sapiens
accttatcaaggat

SEQ ID NO: 890997 - DNA, 16 bp, Homo sapiens
accttatcaggatggt

SEQ ID NO: 890998 - DNA, 18 bp, Homo sapiens
accttatgagaaactgca

SEQ ID NO: 890999 - DNA, 22 bp, Homo sapiens
accttattgtacctctcttata

SEQ ID NO: 891000 - DNA, 13 bp, Homo sapiens
accttatttattt

SEQ ID NO: 891001 - DNA, 19 bp, Homo sapiens
accttatttatttttgtgt

SEQ ID NO: 891002 - DNA, 16 bp, Homo sapiens
accttattttttccca

SEQ ID NO: 891003 - DNA, 19 bp, Homo sapiens
accttcaaaatgttctatt

SEQ ID NO: 891004 - DNA, 19 bp, Homo sapiens
accttcaaactagggccaa

SEQ ID NO: 891005 - DNA, 14 bp, Homo sapiens
accttcaatgaatt

SEQ ID NO: 891006 - DNA, 22 bp, Homo sapiens
accttcaatgaattaattcaga

SEQ ID NO: 891007 - DNA, 13 bp, Homo sapiens
accttcagccctg

SEQ ID NO: 891008 - DNA, 16 bp, Homo sapiens
accttcagccctggcc

SEQ ID NO: 891009 - DNA, 14 bp, Homo sapiens
accttcatccagat

SEQ ID NO: 891010 - DNA, 15 bp, Homo sapiens
accttcatccagatt

SEQ ID NO: 891011 - DNA, 13 bp, Homo sapiens
accttccagctcc

SEQ ID NO: 891012 - DNA, 14 bp, Homo sapiens
accttccagctcct

SEQ ID NO: 891013 - DNA, 22 bp, Homo sapiens
accttccatacacagaggagtg

SEQ ID NO: 891014 - DNA, 19 bp, Homo sapiens
accttccatgtcaggccag

SEQ ID NO: 891015 - DNA, 19 bp, Homo sapiens
accttcccaaacgcctccc

SEQ ID NO: 891016 - DNA, 11 bp, Homo sapiens
accttcccagc

SEQ ID NO: 891017 - DNA, 18 bp, Homo sapiens
accttcccagctctccct

SEQ ID NO: 891018 - DNA, 19 bp, Homo sapiens
accttcccagctctccctc

SEQ ID NO: 891019 - DNA, 15 bp, Homo sapiens
accttccccaaagga

SEQ ID NO: 891020 - DNA, 12 bp, Homo sapiens
accttcctcact

SEQ ID NO: 891021 - DNA, 15 bp, Homo sapiens
accttcctcctgcag

SEQ ID NO: 891022 - DNA, 12 bp, Homo sapiens
accttcctgctg

SEQ ID NO: 891023 - DNA, 23 bp, Homo sapiens
accttcctgggaggacaggcagg

SEQ ID NO: 891024 - DNA, 19 bp, Homo sapiens
accttcctgtccctgaggt

SEQ ID NO: 891025 - DNA, 19 bp, Homo sapiens
accttccttccctgggctg

SEQ ID NO: 891026 - DNA, 16 bp, Homo sapiens
accttccttcctgctt

SEQ ID NO: 891027 - DNA, 15 bp, Homo sapiens
accttctaaaagcca

SEQ ID NO: 891028 - DNA, 18 bp, Homo sapiens
accttctagtcttggcca

SEQ ID NO: 891029 - DNA, 23 bp, Homo sapiens
accttctagtgagcctgggccag

SEQ ID NO: 891030 - DNA, 12 bp, Homo sapiens
accttctctgga

SEQ ID NO: 891031 - DNA, 22 bp, Homo sapiens
accttctctggagccaagtcca

SEQ ID NO: 891032 - DNA, 19 bp, Homo sapiens
accttctggcttccttctc

SEQ ID NO: 891033 - DNA, 22 bp, Homo sapiens
accttctgtccccagccctgtc

SEQ ID NO: 891034 - DNA, 18 bp, Homo sapiens
accttcttatttaatctt

SEQ ID NO: 891035 - DNA, 14 bp, Homo sapiens
accttcttggcttc

SEQ ID NO: 891036 - DNA, 20 bp, Homo sapiens
accttcttggcttctgggac

SEQ ID NO: 891037 - DNA, 14 bp, Homo sapiens
accttctttctgga

SEQ ID NO: 891038 - DNA, 14 bp, Homo sapiens
accttgaaggtctg

SEQ ID NO: 891039 - DNA, 15 bp, Homo sapiens
accttgaatgctgcc

SEQ ID NO: 891040 - DNA, 20 bp, Homo sapiens
accttgaccatcgtccttcc

SEQ ID NO: 891041 - DNA, 20 bp, Homo sapiens
accttgacgtttcttctttc

SEQ ID NO: 891042 - DNA, 14 bp, Homo sapiens
accttgagggtggg

SEQ ID NO: 891043 - DNA, 19 bp, Homo sapiens
accttgagggtgggccagc

SEQ ID NO: 891044 - DNA, 18 bp, Homo sapiens
accttgagtcagaaaaca

SEQ ID NO: 891045 - DNA, 15 bp, Homo sapiens
accttgcaacacaca

SEQ ID NO: 891046 - DNA, 19 bp, Homo sapiens
accttgcaacacacagaca

SEQ ID NO: 891047 - DNA, 13 bp, Homo sapiens
accttgcactcct

SEQ ID NO: 891048 - DNA, 17 bp, Homo sapiens
accttgccaattagtaa

SEQ ID NO: 891049 - DNA, 21 bp, Homo sapiens
accttgccacccattcttccc

SEQ ID NO: 891050 - DNA, 16 bp, Homo sapiens
accttgccagggcagg

SEQ ID NO: 891051 - DNA, 21 bp, Homo sapiens
accttgccagggcagggtctg

SEQ ID NO: 891052 - DNA, 19 bp, Homo sapiens
accttgctagctagccagc

SEQ ID NO: 891053 - DNA, 20 bp, Homo sapiens
accttgctcttctttctgag

SEQ ID NO: 891054 - DNA, 12 bp, Homo sapiens
accttgctgtcc

SEQ ID NO: 891055 - DNA, 15 bp, Homo sapiens
accttgctgtgtgac

SEQ ID NO: 891056 - DNA, 22 bp, Homo sapiens
accttgcttcttactgataatt

SEQ ID NO: 891057 - DNA, 15 bp, Homo sapiens
accttgcttttgctt

SEQ ID NO: 891058 - DNA, 17 bp, Homo sapiens
acccaagcctgatccag

SEQ ID NO: 891059 - DNA, 19 bp, Homo sapiens
acccaagcctgctggctgc

SEQ ID NO: 891060 - DNA, 13 bp, Homo sapiens
acccaagctcctc

SEQ ID NO: 891061 - DNA, 15 bp, Homo sapiens
acccaagctcctcct

SEQ ID NO: 891062 - DNA, 13 bp, Homo sapiens
acccaagctgtgg

SEQ ID NO: 891063 - DNA, 15 bp, Homo sapiens
acccaagcttagaac

SEQ ID NO: 891064 - DNA, 14 bp, Homo sapiens
acccaagcttggca

SEQ ID NO: 891065 - DNA, 19 bp, Homo sapiens
acccaaggagcacaggtcc

SEQ ID NO: 891066 - DNA, 15 bp, Homo sapiens
acccaaggaggaaaa

SEQ ID NO: 891067 - DNA, 14 bp, Homo sapiens
acccaagtcttctc

SEQ ID NO: 891068 - DNA, 16 bp, Homo sapiens
acccaagtttatttct

SEQ ID NO: 891069 - DNA, 18 bp, Homo sapiens
acccaagtttatttctct

SEQ ID NO: 891070 - DNA, 15 bp, Homo sapiens
acccaatcagatgcc

SEQ ID NO: 891071 - DNA, 16 bp, Homo sapiens
acccaatccctctcca

SEQ ID NO: 891072 - DNA, 20 bp, Homo sapiens
acccaatccctctccactct

SEQ ID NO: 891073 - DNA, 19 bp, Homo sapiens
acccaatgggaccgtgccc

SEQ ID NO: 891074 - DNA, 19 bp, Homo sapiens
acccaatgtctcccacacc

SEQ ID NO: 891075 - DNA, 17 bp, Homo sapiens
acccacaagagcatcag

SEQ ID NO: 891076 - DNA, 17 bp, Homo sapiens
acccacaagctgcctct

SEQ ID NO: 891077 - DNA, 17 bp, Homo sapiens
acccacaagtgccactg

SEQ ID NO: 891078 - DNA, 17 bp, Homo sapiens
acccacaccgtcttcct

SEQ ID NO: 891079 - DNA, 11 bp, Homo sapiens
acccacactgc

SEQ ID NO: 891080 - DNA, 22 bp, Homo sapiens
acccacagctctgggcctcttt

SEQ ID NO: 891081 - DNA, 20 bp, Homo sapiens
acccacagtgagaggggagg

SEQ ID NO: 891082 - DNA, 23 bp, Homo sapiens
acccacagtgagaggggagggct

SEQ ID NO: 891083 - DNA, 14 bp, Homo sapiens
acccaccagctcca

SEQ ID NO: 891084 - DNA, 16 bp, Homo sapiens
acccaccagctccaca

SEQ ID NO: 891085 - DNA, 20 bp, Homo sapiens
acccaccagctccacacatt

SEQ ID NO: 891086 - DNA, 13 bp, Homo sapiens
acccacccagccc

SEQ ID NO: 891087 - DNA, 16 bp, Homo sapiens
acccacccagcccctc

SEQ ID NO: 891088 - DNA, 23 bp, Homo sapiens
acccacccatcttcctgctgctg

SEQ ID NO: 891089 - DNA, 12 bp, Homo sapiens
acccaccccaac

SEQ ID NO: 891090 - DNA, 15 bp, Homo sapiens
acccaccccaactct

SEQ ID NO: 891091 - DNA, 19 bp, Homo sapiens
acccaccccaactctcccc

SEQ ID NO: 891092 - DNA, 12 bp, Homo sapiens
acccaccccagc

SEQ ID NO: 891093 - DNA, 10 bp, Homo sapiens
acccaccccc

SEQ ID NO: 891094 - DNA, 14 bp, Homo sapiens
acccacccctgtgc

SEQ ID NO: 891095 - DNA, 16 bp, Homo sapiens
acccacccctgtgctc

SEQ ID NO: 891096 - DNA, 18 bp, Homo sapiens
acccatggaaaaatgcca

SEQ ID NO: 891097 - DNA, 12 bp, Homo sapiens
acccatggggag

SEQ ID NO: 891098 - DNA, 13 bp, Homo sapiens
acccatggggagg

SEQ ID NO: 891099 - DNA, 17 bp, Homo sapiens
acccatggggaggagac

SEQ ID NO: 891100 - DNA, 20 bp, Homo sapiens
acccatggggaggagacctt

SEQ ID NO: 891101 - DNA, 22 bp, Homo sapiens
acccatgtaatccttttgttta

SEQ ID NO: 891102 - DNA, 17 bp, Homo sapiens
acccatgtgccaaggtg

SEQ ID NO: 891103 - DNA, 15 bp, Homo sapiens
acccattatctggaa

SEQ ID NO: 891104 - DNA, 16 bp, Homo sapiens
acccattcactacagg

SEQ ID NO: 891105 - DNA, 18 bp, Homo sapiens
acccattcactacaggtg

SEQ ID NO: 891106 - DNA, 19 bp, Homo sapiens
acccattccagtacagtat

SEQ ID NO: 891107 - DNA, 18 bp, Homo sapiens
acccattccttagctatt

SEQ ID NO: 891108 - DNA, 21 bp, Homo sapiens
acccattctgttttcccccag

SEQ ID NO: 891109 - DNA, 23 bp, Homo sapiens
acccattctgttttcccccagca

SEQ ID NO: 891110 - DNA, 22 bp, Homo sapiens
acccattgccccagacctggaa

SEQ ID NO: 891111 - DNA, 17 bp, Homo sapiens
acccattgttgtcaagg

SEQ ID NO: 891112 - DNA, 20 bp, Homo sapiens
acccatttaaatttttttcc

SEQ ID NO: 891113 - DNA, 18 bp, Homo sapiens
acccatttaatcaccatg

SEQ ID NO: 891114 - DNA, 16 bp, Homo sapiens
accccaaacaccttcc

SEQ ID NO: 891115 - DNA, 20 bp, Homo sapiens
accccaaacaccttccagct

SEQ ID NO: 891116 - DNA, 17 bp, Homo sapiens
accccaaaccccagccc

SEQ ID NO: 891117 - DNA, 20 bp, Homo sapiens
accccaaaccccagccccaa

SEQ ID NO: 891118 - DNA, 18 bp, Homo sapiens
accccaaagccccttgct

SEQ ID NO: 891119 - DNA, 12 bp, Homo sapiens
accccaacccaa

SEQ ID NO: 891120 - DNA, 16 bp, Homo sapiens
accccaactctcccca

SEQ ID NO: 891121 - DNA, 17 bp, Homo sapiens
accccaacttggcagct

SEQ ID NO: 891122 - DNA, 13 bp, Homo sapiens
accccaagagaac

SEQ ID NO: 891123 - DNA, 16 bp, Homo sapiens
accccaagagaactcg

SEQ ID NO: 891124 - DNA, 21 bp, Homo sapiens
accccaagctgcctctgggcc

SEQ ID NO: 891125 - DNA, 14 bp, Homo sapiens
accccaatcccagc

SEQ ID NO: 891126 - DNA, 16 bp, Homo sapiens
accccaatccctgcca

SEQ ID NO: 891127 - DNA, 15 bp, Homo sapiens
accccacaccccagc

SEQ ID NO: 891128 - DNA, 16 bp, Homo sapiens
accccacaccccagcc

SEQ ID NO: 891129 - DNA, 14 bp, Homo sapiens
accccacagaacct

SEQ ID NO: 891130 - DNA, 20 bp, Homo sapiens
accccacagaaccttcaacc

SEQ ID NO: 891131 - DNA, 21 bp, Homo sapiens
accccacatccttctcactgc

SEQ ID NO: 891132 - DNA, 22 bp, Homo sapiens
accccaccacgatgtggccctg

SEQ ID NO: 891133 - DNA, 14 bp, Homo sapiens
accccacccagctc

SEQ ID NO: 891134 - DNA, 15 bp, Homo sapiens
accccaccctcagca

SEQ ID NO: 891135 - DNA, 21 bp, Homo sapiens
accccaccctcagcacccctt

SEQ ID NO: 891136 - DNA, 19 bp, Homo sapiens
accccacccttcccctcct

SEQ ID NO: 891137 - DNA, 14 bp, Homo sapiens
accccactcccaca

SEQ ID NO: 891138 - DNA, 20 bp, Homo sapiens
accccactgggccagccctg

SEQ ID NO: 891139 - DNA, 22 bp, Homo sapiens
accccactgggccagccctgca

SEQ ID NO: 891140 - DNA, 17 bp, Homo sapiens
accccacttatgctgct

SEQ ID NO: 891141 - DNA, 18 bp, Homo sapiens
accccacttatgctgctg

SEQ ID NO: 891142 - DNA, 19 bp, Homo sapiens
accccacttatgctgctgt

SEQ ID NO: 891143 - DNA, 20 bp, Homo sapiens
accccacttatgctgctgtg

SEQ ID NO: 891144 - DNA, 23 bp, Homo sapiens
accccacttcccatctccaggga

SEQ ID NO: 891145 - DNA, 14 bp, Homo sapiens
accccagaaatcac

SEQ ID NO: 891146 - DNA, 16 bp, Homo sapiens
accccagaaatcactg

SEQ ID NO: 891147 - DNA, 14 bp, Homo sapiens
accccagacactgg

SEQ ID NO: 891148 - DNA, 23 bp, Homo sapiens
accccagagtgggagaggctggg

SEQ ID NO: 891149 - DNA, 15 bp, Homo sapiens
accccagcacagcca

SEQ ID NO: 891150 - DNA, 16 bp, Homo sapiens
accccagcattccagc

SEQ ID NO: 891151 - DNA, 20 bp, Homo sapiens
accccagcattccagctctg

SEQ ID NO: 891152 - DNA, 21 bp, Homo sapiens
accccagcattccagctctgc

SEQ ID NO: 891153 - DNA, 11 bp, Homo sapiens
accccagccca

SEQ ID NO: 891154 - DNA, 21 bp, Homo sapiens
accccagcccaccctgctcct

SEQ ID NO: 891155 - DNA, 12 bp, Homo sapiens
accccagcctca

SEQ ID NO: 891156 - DNA, 13 bp, Homo sapiens
accccagcctcat

SEQ ID NO: 891157 - DNA, 14 bp, Homo sapiens
accccagcctcatt

SEQ ID NO: 891158 - DNA, 21 bp, Homo sapiens
accccagcctcattgtgccaa

SEQ ID NO: 891159 - DNA, 12 bp, Homo sapiens
accccagcctga

SEQ ID NO: 891160 - DNA, 21 bp, Homo sapiens
accccagcctgacctgagact

SEQ ID NO: 891161 - DNA, 21 bp, Homo sapiens
accccagctccgacctctctc

SEQ ID NO: 891162 - DNA, 10 bp, Homo sapiens
accccagctg

SEQ ID NO: 891163 - DNA, 14 bp, Homo sapiens
accccagctgggag

SEQ ID NO: 891164 - DNA, 17 bp, Homo sapiens
accccagctgggaggca

SEQ ID NO: 891165 - DNA, 18 bp, Homo sapiens
accccaggacagtttatc

SEQ ID NO: 891166 - DNA, 15 bp, Homo sapiens
accccaggcactgtt

SEQ ID NO: 891167 - DNA, 12 bp, Homo sapiens
accccagggcct

SEQ ID NO: 891168 - DNA, 15 bp, Homo sapiens
accccagtcccaggg

SEQ ID NO: 891169 - DNA, 17 bp, Homo sapiens
accccagtcccagggaa

SEQ ID NO: 891170 - DNA, 16 bp, Homo sapiens
accccagttctgctcc

SEQ ID NO: 891171 - DNA, 17 bp, Homo sapiens
accccagttctgctcct

SEQ ID NO: 891172 - DNA, 19 bp, Homo sapiens
accccagttctgctcctct

SEQ ID NO: 891173 - DNA, 18 bp, Homo sapiens
acccctaagactgccttc

SEQ ID NO: 891174 - DNA, 19 bp, Homo sapiens
acccctaagactgccttca

SEQ ID NO: 891175 - DNA, 16 bp, Homo sapiens
acccctacatgaaaca

SEQ ID NO: 891176 - DNA, 16 bp, Homo sapiens
acccctaccccctcat

SEQ ID NO: 891177 - DNA, 19 bp, Homo sapiens
acccctaccgatggtccca

SEQ ID NO: 891178 - DNA, 23 bp, Homo sapiens
acccctaccgatggtcccaggaa

SEQ ID NO: 891179 - DNA, 17 bp, Homo sapiens
acccctagaaaggagag

SEQ ID NO: 891180 - DNA, 14 bp, Homo sapiens
acccctagcatgaa

SEQ ID NO: 891181 - DNA, 13 bp, Homo sapiens
acccctcaccacc

SEQ ID NO: 891182 - DNA, 22 bp, Homo sapiens
acccctcaccttgcaacacaca

SEQ ID NO: 891183 - DNA, 14 bp, Homo sapiens
acccctcactcccc

SEQ ID NO: 891184 - DNA, 17 bp, Homo sapiens
acccctcactctggcct

SEQ ID NO: 891185 - DNA, 21 bp, Homo sapiens
acccctccacgtgtccgtcca

SEQ ID NO: 891186 - DNA, 14 bp, Homo sapiens
acccctcccaacct

SEQ ID NO: 891187 - DNA, 18 bp, Homo sapiens
acccctccctccctcttt

SEQ ID NO: 891188 - DNA, 11 bp, Homo sapiens
acccctccctg

SEQ ID NO: 891189 - DNA, 19 bp, Homo sapiens
acccctccctgcaggggct

SEQ ID NO: 891190 - DNA, 21 bp, Homo sapiens
acccctccctgcttgcacact

SEQ ID NO: 891191 - DNA, 22 bp, Homo sapiens
acccctcccttgctcagtgcct

SEQ ID NO: 891192 - DNA, 21 bp, Homo sapiens
acccctccgtgtggagcacgt

SEQ ID NO: 891193 - DNA, 15 bp, Homo sapiens
acccctcgactcagc

SEQ ID NO: 891194 - DNA, 18 bp, Homo sapiens
acccctcgactcagcacc

SEQ ID NO: 891195 - DNA, 17 bp, Homo sapiens
acccctcgcaaccctgc

SEQ ID NO: 891196 - DNA, 22 bp, Homo sapiens
acccctcgcaaccctgcctgtc

SEQ ID NO: 891197 - DNA, 11 bp, Homo sapiens
acccctctggt

SEQ ID NO: 891198 - DNA, 19 bp, Homo sapiens
acccctcttctgctcctta

SEQ ID NO: 891199 - DNA, 10 bp, Homo sapiens
acccctgccc

SEQ ID NO: 891200 - DNA, 15 bp, Homo sapiens
acccctgctcccagc

SEQ ID NO: 891201 - DNA, 19 bp, Homo sapiens
acccctgctcccagcctgc

SEQ ID NO: 891202 - DNA, 19 bp, Homo sapiens
acccctgctcccattcctc

SEQ ID NO: 891203 - DNA, 23 bp, Homo sapiens
acccctggaagagcccagtctgt

SEQ ID NO: 891204 - DNA, 19 bp, Homo sapiens
acccctggaccaccagccc

SEQ ID NO: 891205 - DNA, 12 bp, Homo sapiens
acccctggccag

SEQ ID NO: 891206 - DNA, 15 bp, Homo sapiens
acccctggctctggg

SEQ ID NO: 891207 - DNA, 15 bp, Homo sapiens
acccctggcttttca

SEQ ID NO: 891208 - DNA, 16 bp, Homo sapiens
acccctgggggctctc

SEQ ID NO: 891209 - DNA, 17 bp, Homo sapiens
acccctggggtggccag

SEQ ID NO: 891210 - DNA, 18 bp, Homo sapiens
acccctggggtggccagg

SEQ ID NO: 891211 - DNA, 21 bp, Homo sapiens
acccctggggtggccagggct

SEQ ID NO: 891212 - DNA, 23 bp, Homo sapiens
acccctggggtggccagggcttc

SEQ ID NO: 891213 - DNA, 12 bp, Homo sapiens
acccctgtaccc

SEQ ID NO: 891214 - DNA, 19 bp, Homo sapiens
acccctgtacccagctcct

SEQ ID NO: 891215 - DNA, 16 bp, Homo sapiens
acccctgtaggcctca

SEQ ID NO: 891216 - DNA, 15 bp, Homo sapiens
acccctgtagggaaa

SEQ ID NO: 891217 - DNA, 21 bp, Homo sapiens
acccctgtagggaaaccttgg

SEQ ID NO: 891218 - DNA, 22 bp, Homo sapiens
acccctgtagggaaaccttgga

SEQ ID NO: 891219 - DNA, 22 bp, Homo sapiens
acccctgtgctcccctgccaca

SEQ ID NO: 891220 - DNA, 13 bp, Homo sapiens
acccctgtttctg

SEQ ID NO: 891221 - DNA, 18 bp, Homo sapiens
accccttaatcttgcttt

SEQ ID NO: 891222 - DNA, 15 bp, Homo sapiens
accccttagcctccc

SEQ ID NO: 891223 - DNA, 17 bp, Homo sapiens
accccttatccaggact

SEQ ID NO: 891224 - DNA, 19 bp, Homo sapiens
accccttattgctgccaaa

SEQ ID NO: 891225 - DNA, 22 bp, Homo sapiens
accccttattgctgccaaaacc

SEQ ID NO: 891226 - DNA, 13 bp, Homo sapiens
accactagaactc

SEQ ID NO: 891227 - DNA, 20 bp, Homo sapiens
accactagaactctccatct

SEQ ID NO: 891228 - DNA, 16 bp, Homo sapiens
accactagagctgaga

SEQ ID NO: 891229 - DNA, 22 bp, Homo sapiens
accactatagtgtaataatgtt

SEQ ID NO: 891230 - DNA, 15 bp, Homo sapiens
accactatgaagcta

SEQ ID NO: 891231 - DNA, 14 bp, Homo sapiens
accactatttaagt

SEQ ID NO: 891232 - DNA, 15 bp, Homo sapiens
accactcagccccta

SEQ ID NO: 891233 - DNA, 12 bp, Homo sapiens
accactcaggcc

SEQ ID NO: 891234 - DNA, 14 bp, Homo sapiens
accactcaggccac

SEQ ID NO: 891235 - DNA, 13 bp, Homo sapiens
accactccagaga

SEQ ID NO: 891236 - DNA, 14 bp, Homo sapiens
accactcctctccc

SEQ ID NO: 891237 - DNA, 17 bp, Homo sapiens
accactcgtgcatccct

SEQ ID NO: 891238 - DNA, 20 bp, Homo sapiens
accactctatcaagtattat

SEQ ID NO: 891239 - DNA, 23 bp, Homo sapiens
accactcttctttaagccataga

SEQ ID NO: 891240 - DNA, 17 bp, Homo sapiens
accactgaaaaaatata

SEQ ID NO: 891241 - DNA, 12 bp, Homo sapiens
accactgatatc

SEQ ID NO: 891242 - DNA, 17 bp, Homo sapiens
accactgcactccagcc

SEQ ID NO: 891243 - DNA, 18 bp, Homo sapiens
accactgcactccagcct

SEQ ID NO: 891244 - DNA, 14 bp, Homo sapiens
accactgccctgcc

SEQ ID NO: 891245 - DNA, 17 bp, Homo sapiens
accactgccctgcctgc

SEQ ID NO: 891246 - DNA, 20 bp, Homo sapiens
accactgccctgcctgccca

SEQ ID NO: 891247 - DNA, 14 bp, Homo sapiens
accactgctgagga

SEQ ID NO: 891248 - DNA, 17 bp, Homo sapiens
accactggccaccaggc

SEQ ID NO: 891249 - DNA, 18 bp, Homo sapiens
accactggccaccaggct

SEQ ID NO: 891250 - DNA, 14 bp, Homo sapiens
accacacaaagaca

SEQ ID NO: 891251 - DNA, 17 bp, Homo sapiens
accacacagaggctgcc

SEQ ID NO: 891252 - DNA, 18 bp, Homo sapiens
accacacagtcacccctc

SEQ ID NO: 891253 - DNA, 21 bp, Homo sapiens
accacacagtcacccctccct

SEQ ID NO: 891254 - DNA, 14 bp, Homo sapiens
accacacattttat

SEQ ID NO: 891255 - DNA, 16 bp, Homo sapiens
accacacccaggtctc

SEQ ID NO: 891256 - DNA, 20 bp, Homo sapiens
accacacccaggtctcttcc

SEQ ID NO: 891257 - DNA, 21 bp, Homo sapiens
accacacccgaagtcctgtca

SEQ ID NO: 891258 - DNA, 11 bp, Homo sapiens
accacactgaa

SEQ ID NO: 891259 - DNA, 13 bp, Homo sapiens
accacactgagtt

SEQ ID NO: 891260 - DNA, 13 bp, Homo sapiens
accacactggact

SEQ ID NO: 891261 - DNA, 16 bp, Homo sapiens
accacacttcctgtcc

SEQ ID NO: 891262 - DNA, 14 bp, Homo sapiens
accacacttcttga

SEQ ID NO: 891263 - DNA, 24 bp, Homo sapiens
accacagacacaatatgtatgctt

SEQ ID NO: 891264 - DNA, 15 bp, Homo sapiens
accacagacacacac

SEQ ID NO: 891265 - DNA, 15 bp, Homo sapiens
accacagagctgtca

SEQ ID NO: 891266 - DNA, 22 bp, Homo sapiens
acatgaccctctgtccccaggc

SEQ ID NO: 891267 - DNA, 22 bp, Homo sapiens
acatgacgccagataaaatgtt

SEQ ID NO: 891268 - DNA, 15 bp, Homo sapiens
accaaaagaacaaga

SEQ ID NO: 891269 - DNA, 13 bp, Homo sapiens
accaaaagaagta

SEQ ID NO: 891270 - DNA, 20 bp, Homo sapiens
accaaaagggaggctctctg

SEQ ID NO: 891271 - DNA, 18 bp, Homo sapiens
accaaaataagaaaagat

SEQ ID NO: 891272 - DNA, 16 bp, Homo sapiens
accaaaatgacaatga

SEQ ID NO: 891273 - DNA, 21 bp, Homo sapiens
accaaaatgatacttactgaa

SEQ ID NO: 891274 - DNA, 19 bp, Homo sapiens
accaaaattactaataaat

SEQ ID NO: 891275 - DNA, 14 bp, Homo sapiens
accaaaattttaaa

SEQ ID NO: 891276 - DNA, 14 bp, Homo sapiens
accaaacccagcca

SEQ ID NO: 891277 - DNA, 15 bp, Homo sapiens
accaaactacttcat

SEQ ID NO: 891278 - DNA, 20 bp, Homo sapiens
accaaactacttcattttct

SEQ ID NO: 891279 - DNA, 17 bp, Homo sapiens
acaggtctagactttct

SEQ ID NO: 891280 - DNA, 20 bp, Homo sapiens
acaggtgaggggcaggacct

SEQ ID NO: 891281 - DNA, 14 bp, Homo sapiens
acaggtgccttttt

SEQ ID NO: 891282 - DNA, 23 bp, Homo sapiens
acaggtgcgcgccaccgtgcctg

SEQ ID NO: 891283 - DNA, 20 bp, Homo sapiens
acaggtgcgggaccatctga

SEQ ID NO: 891284 - DNA, 18 bp, Homo sapiens
acaggtggacacacaagg

SEQ ID NO: 891285 - DNA, 16 bp, Homo sapiens
acaggtggcaggacca

SEQ ID NO: 891286 - DNA, 20 bp, Homo sapiens
acaggtggcaggaccaggac

SEQ ID NO: 891287 - DNA, 22 bp, Homo sapiens
acaggtgggaggaaagggcctg

SEQ ID NO: 891288 - DNA, 14 bp, Homo sapiens
acaggtgggcctgg

SEQ ID NO: 891289 - DNA, 23 bp, Homo sapiens
acaggtgggcctggcggcctgtg

SEQ ID NO: 891290 - DNA, 15 bp, Homo sapiens
acaggtgggcctggg

SEQ ID NO: 891291 - DNA, 18 bp, Homo sapiens
acaggtggggcctcagcc

SEQ ID NO: 891292 - DNA, 20 bp, Homo sapiens
acaggtggggcctcagcctg

SEQ ID NO: 891293 - DNA, 21 bp, Homo sapiens
acaggtggggcctcagcctgg

SEQ ID NO: 891294 - DNA, 14 bp, Homo sapiens
acaggtgtctgcct

SEQ ID NO: 891295 - DNA, 19 bp, Homo sapiens
acaggtgtggggacacagc

SEQ ID NO: 891296 - DNA, 17 bp, Homo sapiens
acaggtgtgtgtgaact

SEQ ID NO: 891297 - DNA, 18 bp, Homo sapiens
acaggttacgaagacaaa

SEQ ID NO: 891298 - DNA, 22 bp, Homo sapiens
acaggttgtgaaataattttta

SEQ ID NO: 891299 - DNA, 18 bp, Homo sapiens
acaggtttatctgaagga

SEQ ID NO: 891300 - DNA, 22 bp, Homo sapiens
acaggtttggggagggggaaga

SEQ ID NO: 891301 - DNA, 19 bp, Homo sapiens
acaggtttttgattttgaa

SEQ ID NO: 891302 - DNA, 20 bp, Homo sapiens
acagtaaaaacttgtactat

SEQ ID NO: 891303 - DNA, 20 bp, Homo sapiens
acagtaaaagccttattcta

SEQ ID NO: 891304 - DNA, 12 bp, Homo sapiens
acagtaaacatt

SEQ ID NO: 891305 - DNA, 16 bp, Homo sapiens
acagtaaaccactgaa

SEQ ID NO: 891306 - DNA, 17 bp, Homo sapiens
acagtaaaccactgaaa

SEQ ID NO: 891307 - DNA, 17 bp, Homo sapiens
acagtaaagaaagcaga

SEQ ID NO: 891308 - DNA, 17 bp, Homo sapiens
acagtaagtcatttaac

SEQ ID NO: 891309 - DNA, 13 bp, Homo sapiens
acagtaataaatg

SEQ ID NO: 891310 - DNA, 19 bp, Homo sapiens
acagtaatatgtttaatgt

SEQ ID NO: 891311 - DNA, 13 bp, Homo sapiens
acagtaatcagag

SEQ ID NO: 891312 - DNA, 20 bp, Homo sapiens
acagtaatctatgtgtttct

SEQ ID NO: 891313 - DNA, 13 bp, Homo sapiens
acagtaatgaaat

SEQ ID NO: 891314 - DNA, 17 bp, Homo sapiens
acagtacagcatgtgcc

SEQ ID NO: 891315 - DNA, 17 bp, Homo sapiens
acagtacctagctgtaa

SEQ ID NO: 891316 - DNA, 21 bp, Homo sapiens
acagtacctatgactttttta

SEQ ID NO: 891317 - DNA, 18 bp, Homo sapiens
acagtactttattgtaca

SEQ ID NO: 891318 - DNA, 18 bp, Homo sapiens
acagtagaactgtctgtg

SEQ ID NO: 891319 - DNA, 14 bp, Homo sapiens
acagtagagccagc

SEQ ID NO: 891320 - DNA, 18 bp, Homo sapiens
acagtagagtagggtaga

SEQ ID NO: 891321 - DNA, 13 bp, Homo sapiens
acagtaggagccc

SEQ ID NO: 891322 - DNA, 14 bp, Homo sapiens
acagtaggagccca

SEQ ID NO: 891323 - DNA, 16 bp, Homo sapiens
acagtaggattgctgt

SEQ ID NO: 891324 - DNA, 16 bp, Homo sapiens
acagtatactcagcta

SEQ ID NO: 891325 - DNA, 23 bp, Homo sapiens
acagtatattttatttcaatgta

SEQ ID NO: 891326 - DNA, 21 bp, Homo sapiens
acagtatgagtcaatgtgcag

SEQ ID NO: 891327 - DNA, 16 bp, Homo sapiens
acagtatgatgaaaat

SEQ ID NO: 891328 - DNA, 19 bp, Homo sapiens
acagtatgatgaaaataat

SEQ ID NO: 891329 - DNA, 23 bp, Homo sapiens
acagtatgatgaaaataattttc

SEQ ID NO: 891330 - DNA, 22 bp, Homo sapiens
acagtatgggggttgtaaattg

SEQ ID NO: 891331 - DNA, 12 bp, Homo sapiens
acagtattctgt

SEQ ID NO: 891332 - DNA, 12 bp, Homo sapiens
acagtattgcca

SEQ ID NO: 891333 - DNA, 15 bp, Homo sapiens
acagtatttcattgc

SEQ ID NO: 891334 - DNA, 17 bp, Homo sapiens
acagtatttgtaattaa

SEQ ID NO: 891335 - DNA, 18 bp, Homo sapiens
acagtatttgtaattaaa

SEQ ID NO: 891336 - DNA, 17 bp, Homo sapiens
acagtattttggttctt

SEQ ID NO: 891337 - DNA, 13 bp, Homo sapiens
acagtcaaaataa

SEQ ID NO: 891338 - DNA, 16 bp, Homo sapiens
acagtcaaaataattc

SEQ ID NO: 891339 - DNA, 13 bp, Homo sapiens
acagtcactggat

SEQ ID NO: 891340 - DNA, 19 bp, Homo sapiens
acagtcaggggctgggcat

SEQ ID NO: 891341 - DNA, 17 bp, Homo sapiens
acagtcatcatcagggc

SEQ ID NO: 891342 - DNA, 20 bp, Homo sapiens
acagtcatcatcagggcctg

SEQ ID NO: 891343 - DNA, 13 bp, Homo sapiens
acagtccacagct

SEQ ID NO: 891344 - DNA, 16 bp, Homo sapiens
acagtccacaggggcc

SEQ ID NO: 891345 - DNA, 17 bp, Homo sapiens
acagtccacaggggcca

SEQ ID NO: 891346 - DNA, 18 bp, Homo sapiens
acagtccacaggggccac

SEQ ID NO: 891347 - DNA, 18 bp, Homo sapiens
acagtcccccacccacct

SEQ ID NO: 891348 - DNA, 19 bp, Homo sapiens
acagtcccccacccacctc

SEQ ID NO: 891349 - DNA, 20 bp, Homo sapiens
acagtcccccacccacctcc

SEQ ID NO: 891350 - DNA, 21 bp, Homo sapiens
acagtccgtcaaaacagattg

SEQ ID NO: 891351 - DNA, 12 bp, Homo sapiens
acagtcctggga

SEQ ID NO: 891352 - DNA, 20 bp, Homo sapiens
acagtcgctcagtctgttca

SEQ ID NO: 891353 - DNA, 16 bp, Homo sapiens
acagtctaaaaattga

SEQ ID NO: 891354 - DNA, 16 bp, Homo sapiens
acagtctaaagaagag

SEQ ID NO: 891355 - DNA, 14 bp, Homo sapiens
acagtctcactctg

SEQ ID NO: 891356 - DNA, 16 bp, Homo sapiens
acagtctctttcttcc

SEQ ID NO: 891357 - DNA, 23 bp, Homo sapiens
acagtctggctaggttaaaggcc

SEQ ID NO: 891358 - DNA, 12 bp, Homo sapiens
acagtctgttat

SEQ ID NO: 891359 - DNA, 23 bp, Homo sapiens
acagtcttactctgtctcccagg

SEQ ID NO: 891360 - DNA, 23 bp, Homo sapiens
acagtcttcattttttttaattg

SEQ ID NO: 891361 - DNA, 15 bp, Homo sapiens
acagtcttgtattaa

SEQ ID NO: 891362 - DNA, 14 bp, Homo sapiens
acagtgaagcaaat

SEQ ID NO: 891363 - DNA, 20 bp, Homo sapiens
acagtgaagcagcactgtga

SEQ ID NO: 891364 - DNA, 15 bp, Homo sapiens
acagtgaattgtctt

SEQ ID NO: 891365 - DNA, 16 bp, Homo sapiens
acagtgaattgtcttt

SEQ ID NO: 891366 - DNA, 14 bp, Homo sapiens
acagtgacttctga

SEQ ID NO: 891367 - DNA, 20 bp, Homo sapiens
acagtgactttacaggaggt

SEQ ID NO: 891368 - DNA, 22 bp, Homo sapiens
acagtgagaaagggcatacatc

SEQ ID NO: 891369 - DNA, 12 bp, Homo sapiens
acagtgagagac

SEQ ID NO: 891370 - DNA, 23 bp, Homo sapiens
acagtgagagactccatagtttg

SEQ ID NO: 891371 - DNA, 23 bp, Homo sapiens
acagtgagaggggagggctcctg

SEQ ID NO: 891372 - DNA, 13 bp, Homo sapiens
acagtgagccaag

SEQ ID NO: 891373 - DNA, 12 bp, Homo sapiens
acagtgagcctg

SEQ ID NO: 891374 - DNA, 17 bp, Homo sapiens
acagtgaggcaggagaa

SEQ ID NO: 891375 - DNA, 15 bp, Homo sapiens
acagtgatctccata

SEQ ID NO: 891376 - DNA, 21 bp, Homo sapiens
acagtgatctccatatgttac

SEQ ID NO: 891377 - DNA, 14 bp, Homo sapiens
acagtgatgaatgt

SEQ ID NO: 891378 - DNA, 21 bp, Homo sapiens
acagtgatgaatgtactatgt

SEQ ID NO: 891379 - DNA, 14 bp, Homo sapiens
acagtgatgccggg

SEQ ID NO: 891380 - DNA, 13 bp, Homo sapiens
acagtgatttttt

SEQ ID NO: 891381 - DNA, 14 bp, Homo sapiens
acagtgcagacagg

SEQ ID NO: 891382 - DNA, 15 bp, Homo sapiens
acagtgcagacaggc

SEQ ID NO: 891383 - DNA, 17 bp, Homo sapiens
acagtgcagacaggcca

SEQ ID NO: 891384 - DNA, 20 bp, Homo sapiens
acagtgcagagccttctcag

SEQ ID NO: 891385 - DNA, 16 bp, Homo sapiens
acagtgcagaggctct

SEQ ID NO: 891386 - DNA, 21 bp, Homo sapiens
acagtgcagcttgcagtccgt

SEQ ID NO: 891387 - DNA, 11 bp, Homo sapiens
acagtgcagtt

SEQ ID NO: 891388 - DNA, 17 bp, Homo sapiens
acagtgcatctcagccc

SEQ ID NO: 891389 - DNA, 19 bp, Homo sapiens
acagtgccatccccacctt

SEQ ID NO: 891390 - DNA, 17 bp, Homo sapiens
acagtgcctcttccagt

SEQ ID NO: 891391 - DNA, 23 bp, Homo sapiens
acagtgcctcttccagtgaacat

SEQ ID NO: 891392 - DNA, 14 bp, Homo sapiens
acagtgcctgggaa

SEQ ID NO: 891393 - DNA, 21 bp, Homo sapiens
acagtgcctgggaatgtatta

SEQ ID NO: 891394 - DNA, 23 bp, Homo sapiens
acagtgcgttgagtgtacagatt

SEQ ID NO: 891395 - DNA, 16 bp, Homo sapiens
acagtgctcttttctc

SEQ ID NO: 891396 - DNA, 21 bp, Homo sapiens
acagtgctgccccttgcaagc

SEQ ID NO: 891397 - DNA, 23 bp, Homo sapiens
acagtgctgccccttgcaagcca

SEQ ID NO: 891398 - DNA, 24 bp, Homo sapiens
acagtgctgccctgcgaagtggct

SEQ ID NO: 891399 - DNA, 12 bp, Homo sapiens
acagtgctgctt

SEQ ID NO: 891400 - DNA, 13 bp, Homo sapiens
acagtgctgtgtg

SEQ ID NO: 891401 - DNA, 14 bp, Homo sapiens
acagtgcttcagcc

SEQ ID NO: 891402 - DNA, 15 bp, Homo sapiens
acagtgcttcagcct

SEQ ID NO: 891403 - DNA, 18 bp, Homo sapiens
acagtgcttcagcctgag

SEQ ID NO: 891404 - DNA, 18 bp, Homo sapiens
acaggaagtagttctaaa

SEQ ID NO: 891405 - DNA, 17 bp, Homo sapiens
acaggaagtcttcaggg

SEQ ID NO: 891406 - DNA, 14 bp, Homo sapiens
acaggaattttatt

SEQ ID NO: 891407 - DNA, 15 bp, Homo sapiens
acaggacagaatgtg

SEQ ID NO: 891408 - DNA, 14 bp, Homo sapiens
acaggaccccagct

SEQ ID NO: 891409 - DNA, 18 bp, Homo sapiens
acaggaccccagctctgc

SEQ ID NO: 891410 - DNA, 17 bp, Homo sapiens
acaggacccccttcccc

SEQ ID NO: 891411 - DNA, 21 bp, Homo sapiens
acaggacgctgaccgtggagc

SEQ ID NO: 891412 - DNA, 16 bp, Homo sapiens
acaggactctgcctcc

SEQ ID NO: 891413 - DNA, 16 bp, Homo sapiens
acaggactgagccctc

SEQ ID NO: 891414 - DNA, 18 bp, Homo sapiens
acaggactgagccctctc

SEQ ID NO: 891415 - DNA, 20 bp, Homo sapiens
acaggagaatggggttcctg

SEQ ID NO: 891416 - DNA, 21 bp, Homo sapiens
acaggagaatggggttcctgc

SEQ ID NO: 891417 - DNA, 22 bp, Homo sapiens
acaggagaatggggttcctgct

SEQ ID NO: 891418 - DNA, 15 bp, Homo sapiens
acaggagaggcagca

SEQ ID NO: 891419 - DNA, 17 bp, Homo sapiens
acaggagaggcagcatg

SEQ ID NO: 891420 - DNA, 18 bp, Homo sapiens
acaggagaggcagcatgc

SEQ ID NO: 891421 - DNA, 14 bp, Homo sapiens
acaggaggaggaga

SEQ ID NO: 891422 - DNA, 12 bp, Homo sapiens
acaggagggcca

SEQ ID NO: 891423 - DNA, 12 bp, Homo sapiens
acaggagggccc

SEQ ID NO: 891424 - DNA, 23 bp, Homo sapiens
acaggaggtggatttggagaccg

SEQ ID NO: 891425 - DNA, 20 bp, Homo sapiens
acaggagtcttcagacccag

SEQ ID NO: 891426 - DNA, 15 bp, Homo sapiens
acaggatattagaca

SEQ ID NO: 891427 - DNA, 19 bp, Homo sapiens
acaggatcagttaactatt

SEQ ID NO: 891428 - DNA, 21 bp, Homo sapiens
acaggatcctattctcaccag

SEQ ID NO: 891429 - DNA, 22 bp, Homo sapiens
acaggatcctattctcaccagg

SEQ ID NO: 891430 - DNA, 21 bp, Homo sapiens
acaggatgaggtggtggagtg

SEQ ID NO: 891431 - DNA, 17 bp, Homo sapiens
acaggatggtgggcagg

SEQ ID NO: 891432 - DNA, 22 bp, Homo sapiens
acatcatataaaaagcagcaga

SEQ ID NO: 891433 - DNA, 22 bp, Homo sapiens
acatcatattctattgtttact

SEQ ID NO: 891434 - DNA, 19 bp, Homo sapiens
acatcatcactttttttga

SEQ ID NO: 891435 - DNA, 14 bp, Homo sapiens
acatcatgttattt

SEQ ID NO: 891436 - DNA, 15 bp, Homo sapiens
acatcattcattttt

SEQ ID NO: 891437 - DNA, 15 bp, Homo sapiens
acatccaaagcagac

SEQ ID NO: 891438 - DNA, 17 bp, Homo sapiens
acatccaaagcagacag

SEQ ID NO: 891439 - DNA, 18 bp, Homo sapiens
acatccaaagcagacagc

SEQ ID NO: 891440 - DNA, 21 bp, Homo sapiens
acatccaactggaaattccag

SEQ ID NO: 891441 - DNA, 22 bp, Homo sapiens
acatccaaggagaaacagagac

SEQ ID NO: 891442 - DNA, 13 bp, Homo sapiens
acatccactgttt

SEQ ID NO: 891443 - DNA, 15 bp, Homo sapiens
acatccactgtttgc

SEQ ID NO: 891444 - DNA, 18 bp, Homo sapiens
acatccacttaagttctt

SEQ ID NO: 891445 - DNA, 16 bp, Homo sapiens
acatccagaaagctga

SEQ ID NO: 891446 - DNA, 19 bp, Homo sapiens
acatccagaaagctgagga

SEQ ID NO: 891447 - DNA, 18 bp, Homo sapiens
acatccagagatgactat

SEQ ID NO: 891448 - DNA, 14 bp, Homo sapiens
acatccagctgccc

SEQ ID NO: 891449 - DNA, 12 bp, Homo sapiens
acatccagcttg

SEQ ID NO: 891450 - DNA, 15 bp, Homo sapiens
acatccataaagaag

SEQ ID NO: 891451 - DNA, 17 bp, Homo sapiens
acatccataaagaagca

SEQ ID NO: 891452 - DNA, 11 bp, Homo sapiens
acatccatcta

SEQ ID NO: 891453 - DNA, 18 bp, Homo sapiens
acatccatgtttgtaaaa

SEQ ID NO: 891454 - DNA, 20 bp, Homo sapiens
acatccatttcatctatttc

SEQ ID NO: 891455 - DNA, 23 bp, Homo sapiens
acatcccaaactttaaaatgcga

SEQ ID NO: 891456 - DNA, 16 bp, Homo sapiens
acatcccactgactgt

SEQ ID NO: 891457 - DNA, 18 bp, Homo sapiens
acatcccactggatctgg

SEQ ID NO: 891458 - DNA, 18 bp, Homo sapiens
acatcccattgccctggt

SEQ ID NO: 891459 - DNA, 18 bp, Homo sapiens
acatccccccgccaaaag

SEQ ID NO: 891460 - DNA, 18 bp, Homo sapiens
acatcccggcctcttcca

SEQ ID NO: 891461 - DNA, 19 bp, Homo sapiens
acatccctcccccagcaga

SEQ ID NO: 891462 - DNA, 13 bp, Homo sapiens
acatccctgggca

SEQ ID NO: 891463 - DNA, 15 bp, Homo sapiens
acatcccttcctgga

SEQ ID NO: 891464 - DNA, 23 bp, Homo sapiens
acatcccttcctggaaacagcat

SEQ ID NO: 891465 - DNA, 15 bp, Homo sapiens
acatcctacaagaca

SEQ ID NO: 891466 - DNA, 12 bp, Homo sapiens
acatcctctcca

SEQ ID NO: 891467 - DNA, 14 bp, Homo sapiens
acatcctctccagg

SEQ ID NO: 891468 - DNA, 16 bp, Homo sapiens
acatcctgtataagca

SEQ ID NO: 891469 - DNA, 19 bp, Homo sapiens
acatcctgtataagcactg

SEQ ID NO: 891470 - DNA, 13 bp, Homo sapiens
acatccttccttc

SEQ ID NO: 891471 - DNA, 15 bp, Homo sapiens
acatccttccttccc

SEQ ID NO: 891472 - DNA, 18 bp, Homo sapiens
acatccttctcactgcca

SEQ ID NO: 891473 - DNA, 20 bp, Homo sapiens
acatccttctcactgccatg

SEQ ID NO: 891474 - DNA, 17 bp, Homo sapiens
acatcctttctaaacaa

SEQ ID NO: 891475 - DNA, 18 bp, Homo sapiens
acatcgatatgtatatca

SEQ ID NO: 891476 - DNA, 22 bp, Homo sapiens
acatcgcaatagttttttactt

SEQ ID NO: 891477 - DNA, 14 bp, Homo sapiens
acatcggaaaaata

SEQ ID NO: 891478 - DNA, 15 bp, Homo sapiens
acatcggaaaaataa

SEQ ID NO: 891479 - DNA, 17 bp, Homo sapiens
acatcgtgaaaccctgt

SEQ ID NO: 891480 - DNA, 20 bp, Homo sapiens
acatcgtgaaaccctgtctc

SEQ ID NO: 891481 - DNA, 17 bp, Homo sapiens
acatcgttgagacatca

SEQ ID NO: 891482 - DNA, 15 bp, Homo sapiens
acatctaaagcttta

SEQ ID NO: 891483 - DNA, 17 bp, Homo sapiens
acatctaaagctttatc

SEQ ID NO: 891484 - DNA, 16 bp, Homo sapiens
acatctaacctcatct

SEQ ID NO: 891485 - DNA, 18 bp, Homo sapiens
acatctaataagtatata

SEQ ID NO: 891486 - DNA, 16 bp, Homo sapiens
acatctagcagtaaat

SEQ ID NO: 891487 - DNA, 20 bp, Homo sapiens
acatctagcagtaaatactt

SEQ ID NO: 891488 - DNA, 20 bp, Homo sapiens
acatctagtagttgttctga

SEQ ID NO: 891489 - DNA, 23 bp, Homo sapiens
acatctattttggattgtatatt

SEQ ID NO: 891490 - DNA, 12 bp, Homo sapiens
acatctcagacc

SEQ ID NO: 891491 - DNA, 17 bp, Homo sapiens
acatctccagtgtgcca

SEQ ID NO: 891492 - DNA, 21 bp, Homo sapiens
acatctcctccatactcagga

SEQ ID NO: 891493 - DNA, 20 bp, Homo sapiens
acatctcgagccccctggat

SEQ ID NO: 891494 - DNA, 12 bp, Homo sapiens
acatctcgggag

SEQ ID NO: 891495 - DNA, 16 bp, Homo sapiens
acatctctctggcttc

SEQ ID NO: 891496 - DNA, 12 bp, Homo sapiens
acatctctgaat

SEQ ID NO: 891497 - DNA, 16 bp, Homo sapiens
acatctctgactttct

SEQ ID NO: 891498 - DNA, 12 bp, Homo sapiens
acatctctggag

SEQ ID NO: 891499 - DNA, 17 bp, Homo sapiens
acatctctggagccaga

SEQ ID NO: 891500 - DNA, 13 bp, Homo sapiens
acatctcttgaaa

SEQ ID NO: 891501 - DNA, 17 bp, Homo sapiens
acatctctttgaatttt

SEQ ID NO: 891502 - DNA, 23 bp, Homo sapiens
acatctgaggttttatttcattt

SEQ ID NO: 891503 - DNA, 22 bp, Homo sapiens
acatctgcactcctgaacacac

SEQ ID NO: 891504 - DNA, 23 bp, Homo sapiens
acatctgcactcctgaacacacc

SEQ ID NO: 891505 - DNA, 15 bp, Homo sapiens
acatctgccagacct

SEQ ID NO: 891506 - DNA, 13 bp, Homo sapiens
acatctgcctcct

SEQ ID NO: 891507 - DNA, 17 bp, Homo sapiens
acatctgcctgtaatta

SEQ ID NO: 891508 - DNA, 22 bp, Homo sapiens
acatctgcctgtaattaaacta

SEQ ID NO: 891509 - DNA, 11 bp, Homo sapiens
acatctgcctt

SEQ ID NO: 891510 - DNA, 14 bp, Homo sapiens
acatctggcatggc

SEQ ID NO: 891511 - DNA, 21 bp, Homo sapiens
acatctggctgcacaggctga

SEQ ID NO: 891512 - DNA, 18 bp, Homo sapiens
acatctgggatcatgata

SEQ ID NO: 891513 - DNA, 15 bp, Homo sapiens
acatctgtaaagaaa

SEQ ID NO: 891514 - DNA, 22 bp, Homo sapiens
acatctgtagggaattcttctg

SEQ ID NO: 891515 - DNA, 17 bp, Homo sapiens
acatctgtcctcaccct

SEQ ID NO: 891516 - DNA, 22 bp, Homo sapiens
acatctgtcctcaccctgtggg

SEQ ID NO: 891517 - DNA, 17 bp, Homo sapiens
acatctgttttaaattt

SEQ ID NO: 891518 - DNA, 13 bp, Homo sapiens
acatcttacctct

SEQ ID NO: 891519 - DNA, 19 bp, Homo sapiens
acatcttattgaataaaga

SEQ ID NO: 891520 - DNA, 13 bp, Homo sapiens
acatcttctcaac

SEQ ID NO: 891521 - DNA, 20 bp, Homo sapiens
acatcttgaaaatattgaag

SEQ ID NO: 891522 - DNA, 22 bp, Homo sapiens
acatcttgactaggtattgtct

SEQ ID NO: 891523 - DNA, 19 bp, Homo sapiens
acatcttggtcagatttga

SEQ ID NO: 891524 - DNA, 15 bp, Homo sapiens
acatcttgtcaacat

SEQ ID NO: 891525 - DNA, 19 bp, Homo sapiens
acatcttgtcaacatgcat

SEQ ID NO: 891526 - DNA, 15 bp, Homo sapiens
acatctttacgtact

SEQ ID NO: 891527 - DNA, 13 bp, Homo sapiens
acatctttcacat

SEQ ID NO: 891528 - DNA, 15 bp, Homo sapiens
acatctttcacattg

SEQ ID NO: 891529 - DNA, 13 bp, Homo sapiens
acatctttcccta

SEQ ID NO: 891530 - DNA, 18 bp, Homo sapiens
acatctttccctaaagaa

SEQ ID NO: 891531 - DNA, 18 bp, Homo sapiens
acatctttcctcaagtat

SEQ ID NO: 891532 - DNA, 14 bp, Homo sapiens
acatctttcctgtc

SEQ ID NO: 891533 - DNA, 15 bp, Homo sapiens
acatctttgttttta

SEQ ID NO: 891534 - DNA, 20 bp, Homo sapiens
acatctttgtttttaaaata

SEQ ID NO: 891535 - DNA, 16 bp, Homo sapiens
acatgaaaacacattt

SEQ ID NO: 891536 - DNA, 17 bp, Homo sapiens
acatgaaaacacatttt

SEQ ID NO: 891537 - DNA, 19 bp, Homo sapiens
acatgaaaacacatttttc

SEQ ID NO: 891538 - DNA, 15 bp, Homo sapiens
acatgaaaattttaa

SEQ ID NO: 891539 - DNA, 13 bp, Homo sapiens
acatgaaacagaa

SEQ ID NO: 891540 - DNA, 18 bp, Homo sapiens
acatgaaacctacacact

SEQ ID NO: 891541 - DNA, 18 bp, Homo sapiens
acatgaaatgcttccaag

SEQ ID NO: 891542 - DNA, 19 bp, Homo sapiens
acatgaacacccttagaaa

SEQ ID NO: 891543 - DNA, 13 bp, Homo sapiens
acatgaagaagct

SEQ ID NO: 891544 - DNA, 18 bp, Homo sapiens
acatgaagaatagaaaca

SEQ ID NO: 891545 - DNA, 15 bp, Homo sapiens
acatgaagattcttt

SEQ ID NO: 891546 - DNA, 17 bp, Homo sapiens
acatgaagattctttcc

SEQ ID NO: 891547 - DNA, 16 bp, Homo sapiens
acatgaatactatcca

SEQ ID NO: 891548 - DNA, 21 bp, Homo sapiens
acatgaatactatccatgtaa

SEQ ID NO: 891549 - DNA, 22 bp, Homo sapiens
acatgaatatggttggagagcc

SEQ ID NO: 891550 - DNA, 15 bp, Homo sapiens
acatgaatgcacact

SEQ ID NO: 891551 - DNA, 17 bp, Homo sapiens
acatgaatttagaaata

SEQ ID NO: 891552 - DNA, 13 bp, Homo sapiens
acatgacagatat

SEQ ID NO: 891553 - DNA, 21 bp, Homo sapiens
acatgacatccagagatgact

SEQ ID NO: 891554 - DNA, 17 bp, Homo sapiens
acatgacattcttagct

SEQ ID NO: 891555 - DNA, 16 bp, Homo sapiens
acatgacccagcctga

SEQ ID NO: 891556 - DNA, 15 bp, Homo sapiens
acatgaccctctgtc

SEQ ID NO: 891557 - DNA, 16 bp, Homo sapiens
acataatttttgtaca

SEQ ID NO: 891558 - DNA, 18 bp, Homo sapiens
acataatttttgtacatc

SEQ ID NO: 891559 - DNA, 15 bp, Homo sapiens
acatacaaaagaatt

SEQ ID NO: 891560 - DNA, 22 bp, Homo sapiens
acatacactgtatgttatagaa

SEQ ID NO: 891561 - DNA, 14 bp, Homo sapiens
acatacagacacat

SEQ ID NO: 891562 - DNA, 12 bp, Homo sapiens
acatacagattt

SEQ ID NO: 891563 - DNA, 12 bp, Homo sapiens
acatacagtata

SEQ ID NO: 891564 - DNA, 14 bp, Homo sapiens
acatacatacacat

SEQ ID NO: 891565 - DNA, 14 bp, Homo sapiens
acatacatacatac

SEQ ID NO: 891566 - DNA, 14 bp, Homo sapiens
acatacatatatat

SEQ ID NO: 891567 - DNA, 15 bp, Homo sapiens
acatacatatatatc

SEQ ID NO: 891568 - DNA, 17 bp, Homo sapiens
acatacatgatacattt

SEQ ID NO: 891569 - DNA, 20 bp, Homo sapiens
acacactggaccccactggc

SEQ ID NO: 891570 - DNA, 22 bp, Homo sapiens
acacactggaccccactggctg

SEQ ID NO: 891571 - DNA, 17 bp, Homo sapiens
acacactggtacttaga

SEQ ID NO: 891572 - DNA, 20 bp, Homo sapiens
acacactgtacacataagcc

SEQ ID NO: 891573 - DNA, 16 bp, Homo sapiens
acacactgtctggggc

SEQ ID NO: 891574 - DNA, 20 bp, Homo sapiens
acacactgttacacgtgcct

SEQ ID NO: 891575 - DNA, 14 bp, Homo sapiens
acacactttttaag

SEQ ID NO: 891576 - DNA, 19 bp, Homo sapiens
acacagaaaatgttgagaa

SEQ ID NO: 891577 - DNA, 20 bp, Homo sapiens
acacagaaaatgttgagaat

SEQ ID NO: 891578 - DNA, 19 bp, Homo sapiens
acacagaaacctttttaaa

SEQ ID NO: 891579 - DNA, 21 bp, Homo sapiens
acacagaaacctttttaaaaa

SEQ ID NO: 891580 - DNA, 17 bp, Homo sapiens
acacagaaatgctgctg

SEQ ID NO: 891581 - DNA, 18 bp, Homo sapiens
acacagaaatgctgctgg

SEQ ID NO: 891582 - DNA, 23 bp, Homo sapiens
acacagaattatagatgtctgag

SEQ ID NO: 891583 - DNA, 15 bp, Homo sapiens
acacagacggcctag

SEQ ID NO: 891584 - DNA, 20 bp, Homo sapiens
acacagactggcaataaact

SEQ ID NO: 891585 - DNA, 21 bp, Homo sapiens
acacagactggcaataaactc

SEQ ID NO: 891586 - DNA, 19 bp, Homo sapiens
acacagagaaatacaaaat

SEQ ID NO: 891587 - DNA, 13 bp, Homo sapiens
acacagaggaaga

SEQ ID NO: 891588 - DNA, 19 bp, Homo sapiens
acacagaggctgcctctcc

SEQ ID NO: 891589 - DNA, 19 bp, Homo sapiens
acacagagtggtctttctg

SEQ ID NO: 891590 - DNA, 16 bp, Homo sapiens
acacagatacacacac

SEQ ID NO: 891591 - DNA, 17 bp, Homo sapiens
acacagatacacacaca

SEQ ID NO: 891592 - DNA, 13 bp, Homo sapiens
acacagatattgt

SEQ ID NO: 891593 - DNA, 19 bp, Homo sapiens
acacagcacaccagccgct

SEQ ID NO: 891594 - DNA, 22 bp, Homo sapiens
acacagcacaccagccgctgca

SEQ ID NO: 891595 - DNA, 13 bp, Homo sapiens
acacagcagcccc

SEQ ID NO: 891596 - DNA, 22 bp, Homo sapiens
acacagcagcttcaccagagca

SEQ ID NO: 891597 - DNA, 13 bp, Homo sapiens
acacagcagtatt

SEQ ID NO: 891598 - DNA, 15 bp, Homo sapiens
acacagcatgtgcca

SEQ ID NO: 891599 - DNA, 14 bp, Homo sapiens
acacagcatgtgta

SEQ ID NO: 891600 - DNA, 15 bp, Homo sapiens
acacagcatgtgtat

SEQ ID NO: 891601 - DNA, 20 bp, Homo sapiens
acacagcccctatagcactg

SEQ ID NO: 891602 - DNA, 23 bp, Homo sapiens
acacagcctatatcaaacatgca

SEQ ID NO: 891603 - DNA, 16 bp, Homo sapiens
acacagcctccctgag

SEQ ID NO: 891604 - DNA, 11 bp, Homo sapiens
acacagcctct

SEQ ID NO: 891605 - DNA, 17 bp, Homo sapiens
acacagcggtttgcaga

SEQ ID NO: 891606 - DNA, 14 bp, Homo sapiens
acacagctgagcac

SEQ ID NO: 891607 - DNA, 11 bp, Homo sapiens
acacagctgcc

SEQ ID NO: 891608 - DNA, 12 bp, Homo sapiens
acacagctgccc

SEQ ID NO: 891609 - DNA, 14 bp, Homo sapiens
acacagctgcccta

SEQ ID NO: 891610 - DNA, 12 bp, Homo sapiens
acacagctgggc

SEQ ID NO: 891611 - DNA, 14 bp, Homo sapiens
acacagctgggcaa

SEQ ID NO: 891612 - DNA, 15 bp, Homo sapiens
acacaggaaaaataa

SEQ ID NO: 891613 - DNA, 18 bp, Homo sapiens
acacaggaaaaataaacg

SEQ ID NO: 891614 - DNA, 18 bp, Homo sapiens
acacaggacccccttccc

SEQ ID NO: 891615 - DNA, 21 bp, Homo sapiens
acacaggactgaaaagggaat

SEQ ID NO: 891616 - DNA, 21 bp, Homo sapiens
acacaggagtcttcagaccca

SEQ ID NO: 891617 - DNA, 22 bp, Homo sapiens
acacaggagtcttcagacccag

SEQ ID NO: 891618 - DNA, 15 bp, Homo sapiens
acacaggcaactgag

SEQ ID NO: 891619 - DNA, 21 bp, Homo sapiens
acacaggcaactgaggcagac

SEQ ID NO: 891620 - DNA, 11 bp, Homo sapiens
acacaggcctt

SEQ ID NO: 891621 - DNA, 16 bp, Homo sapiens
acacaggccttctgtg

SEQ ID NO: 891622 - DNA, 12 bp, Homo sapiens
acacaggctggc

SEQ ID NO: 891623 - DNA, 13 bp, Homo sapiens
acacagggctcac

SEQ ID NO: 891624 - DNA, 16 bp, Homo sapiens
acacagggctcacagg

SEQ ID NO: 891625 - DNA, 22 bp, Homo sapiens
acacagggctcacagggcaggc

SEQ ID NO: 891626 - DNA, 15 bp, Homo sapiens
acacaggggccctgt

SEQ ID NO: 891627 - DNA, 14 bp, Homo sapiens
acacaggtcagggc

SEQ ID NO: 891628 - DNA, 15 bp, Homo sapiens
acacaggtcagggct

SEQ ID NO: 891629 - DNA, 20 bp, Homo sapiens
acacaggtcagggctcagag

SEQ ID NO: 891630 - DNA, 20 bp, Homo sapiens
acacaggtctcattgcttct

SEQ ID NO: 891631 - DNA, 14 bp, Homo sapiens
acacaggtctttcc

SEQ ID NO: 891632 - DNA, 24 bp, Homo sapiens
acacagtaaaaacttgtactatgt

SEQ ID NO: 891633 - DNA, 19 bp, Homo sapiens
acacagtaccatttaatgg

SEQ ID NO: 891634 - DNA, 14 bp, Homo sapiens
acacagtactttat

SEQ ID NO: 891635 - DNA, 17 bp, Homo sapiens
acaccgtcccagggctc

SEQ ID NO: 891636 - DNA, 14 bp, Homo sapiens
acaccgtccctcag

SEQ ID NO: 891637 - DNA, 19 bp, Homo sapiens
acaccgtgtaaaccaaagc

SEQ ID NO: 891638 - DNA, 20 bp, Homo sapiens
acaccgtgtaaaccaaagcc

SEQ ID NO: 891639 - DNA, 22 bp, Homo sapiens
acacctaaaggtgtatttaaac

SEQ ID NO: 891640 - DNA, 13 bp, Homo sapiens
acacctagattat

SEQ ID NO: 891641 - DNA, 23 bp, Homo sapiens
acacctagccagctgtcaagggc

SEQ ID NO: 891642 - DNA, 20 bp, Homo sapiens
acacctcagaggctgttctt

SEQ ID NO: 891643 - DNA, 21 bp, Homo sapiens
acacctcagaggctgttcttg

SEQ ID NO: 891644 - DNA, 17 bp, Homo sapiens
acacctcagtgggaaga

SEQ ID NO: 891645 - DNA, 22 bp, Homo sapiens
acacctcagttcccttggcctc

SEQ ID NO: 891646 - DNA, 23 bp, Homo sapiens
acacctcagttcccttggcctca

SEQ ID NO: 891647 - DNA, 12 bp, Homo sapiens
acacctcccagg

SEQ ID NO: 891648 - DNA, 18 bp, Homo sapiens
acacctcccaggggactg

SEQ ID NO: 891649 - DNA, 12 bp, Homo sapiens
acacctccccct

SEQ ID NO: 891650 - DNA, 17 bp, Homo sapiens
acacctccccctaccca

SEQ ID NO: 891651 - DNA, 13 bp, Homo sapiens
acacctccccctt

SEQ ID NO: 891652 - DNA, 14 bp, Homo sapiens
acacctccctactc

SEQ ID NO: 891653 - DNA, 22 bp, Homo sapiens
acacctccctactcccctgggc

SEQ ID NO: 891654 - DNA, 22 bp, Homo sapiens
acacctccctgaaccatccctg

SEQ ID NO: 891655 - DNA, 18 bp, Homo sapiens
acacctcctctcactccc

SEQ ID NO: 891656 - DNA, 21 bp, Homo sapiens
acacctctgcacaagctgcac

SEQ ID NO: 891657 - DNA, 12 bp, Homo sapiens
acacctctgggc

SEQ ID NO: 891658 - DNA, 17 bp, Homo sapiens
acacctgaatcagctgg

SEQ ID NO: 891659 - DNA, 21 bp, Homo sapiens
acacctgaatcagctggacat

SEQ ID NO: 891660 - DNA, 18 bp, Homo sapiens
acacctgactctgaaatc

SEQ ID NO: 891661 - DNA, 18 bp, Homo sapiens
acacctgccttctaccct

SEQ ID NO: 891662 - DNA, 19 bp, Homo sapiens
acacctgcggggccaccca

SEQ ID NO: 891663 - DNA, 12 bp, Homo sapiens
acacctgctgcg

SEQ ID NO: 891664 - DNA, 13 bp, Homo sapiens
acacctggactga

SEQ ID NO: 891665 - DNA, 17 bp, Homo sapiens
acacctggactgagcca

SEQ ID NO: 891666 - DNA, 21 bp, Homo sapiens
acacctggcatggtgcaggga

SEQ ID NO: 891667 - DNA, 19 bp, Homo sapiens
acacctggctgaggttcct

SEQ ID NO: 891668 - DNA, 22 bp, Homo sapiens
acacctgttcacagaaaaagca

SEQ ID NO: 891669 - DNA, 19 bp, Homo sapiens
acaccttagagaagctacc

SEQ ID NO: 891670 - DNA, 16 bp, Homo sapiens
acaccttcatccagat

SEQ ID NO: 891671 - DNA, 20 bp, Homo sapiens
acaccttccagctcctgtaa

SEQ ID NO: 891672 - DNA, 15 bp, Homo sapiens
acaccttcctcctgc

SEQ ID NO: 891673 - DNA, 20 bp, Homo sapiens
acaccttcctcctgcagaca

SEQ ID NO: 891674 - DNA, 13 bp, Homo sapiens
acaccttctctgg

SEQ ID NO: 891675 - DNA, 20 bp, Homo sapiens
acaccttcttggcttctggg

SEQ ID NO: 891676 - DNA, 19 bp, Homo sapiens
acaccttggggtccctcca

SEQ ID NO: 891677 - DNA, 23 bp, Homo sapiens
acaccttggggtccctccacccc

SEQ ID NO: 891678 - DNA, 15 bp, Homo sapiens
acaccttttaactca

SEQ ID NO: 891679 - DNA, 21 bp, Homo sapiens
acaccttttattgacacagaa

SEQ ID NO: 891680 - DNA, 23 bp, Homo sapiens
acaccttttccccaaccacagag

SEQ ID NO: 891681 - DNA, 13 bp, Homo sapiens
acacgaaacttgt

SEQ ID NO: 891682 - DNA, 14 bp, Homo sapiens
acacgaaagaaatg

SEQ ID NO: 891683 - DNA, 15 bp, Homo sapiens
acacgaaagaaatgt

SEQ ID NO: 891684 - DNA, 17 bp, Homo sapiens
acacgagcaaacccaga

SEQ ID NO: 891685 - DNA, 12 bp, Homo sapiens
acacgagccaca

SEQ ID NO: 891686 - DNA, 14 bp, Homo sapiens
acacgatgcattta

SEQ ID NO: 891687 - DNA, 19 bp, Homo sapiens
acacgatgcatttaataaa

SEQ ID NO: 891688 - DNA, 20 bp, Homo sapiens
acacgatgcatttaataaag

SEQ ID NO: 891689 - DNA, 14 bp, Homo sapiens
acacgattttattg

SEQ ID NO: 891690 - DNA, 22 bp, Homo sapiens
acacgcaagggcatcaggcact

SEQ ID NO: 891691 - DNA, 14 bp, Homo sapiens
acacgcacacacac

SEQ ID NO: 891692 - DNA, 13 bp, Homo sapiens
acacgcacctgcc

SEQ ID NO: 891693 - DNA, 14 bp, Homo sapiens
acacgcacgcacac

SEQ ID NO: 891694 - DNA, 19 bp, Homo sapiens
acacgcaggaactcccagc

SEQ ID NO: 891695 - DNA, 23 bp, Homo sapiens
acacgcaggcggccagggcggcc

SEQ ID NO: 891696 - DNA, 13 bp, Homo sapiens
acacgccagctcc

SEQ ID NO: 891697 - DNA, 22 bp, Homo sapiens
acacgccagctcctctctgaag

SEQ ID NO: 891698 - DNA, 21 bp, Homo sapiens
acacgcctgagagtggcactg

SEQ ID NO: 891699 - DNA, 14 bp, Homo sapiens
aattttgtacaaat

SEQ ID NO: 891700 - DNA, 13 bp, Homo sapiens
aattttgtacata

SEQ ID NO: 891701 - DNA, 14 bp, Homo sapiens
aattttgtacatac

SEQ ID NO: 891702 - DNA, 15 bp, Homo sapiens
aattttgtataactt

SEQ ID NO: 891703 - DNA, 21 bp, Homo sapiens
aattttgtatattgtaggaat

SEQ ID NO: 891704 - DNA, 20 bp, Homo sapiens
aattttgtattaatttctga

SEQ ID NO: 891705 - DNA, 12 bp, Homo sapiens
aattttgtcttt

SEQ ID NO: 891706 - DNA, 14 bp, Homo sapiens
aattttgtgcattc

SEQ ID NO: 891707 - DNA, 17 bp, Homo sapiens
aattttgtgtaagaaat

SEQ ID NO: 891708 - DNA, 22 bp, Homo sapiens
aattttgtgtaagaaatacaga

SEQ ID NO: 891709 - DNA, 15 bp, Homo sapiens
aattttgttctctgg

SEQ ID NO: 891710 - DNA, 22 bp, Homo sapiens
aattttgttgaaaatggtttca

SEQ ID NO: 891711 - DNA, 13 bp, Homo sapiens
aattttgttgctg

SEQ ID NO: 891712 - DNA, 15 bp, Homo sapiens
aattttgtttcagaa

SEQ ID NO: 891713 - DNA, 13 bp, Homo sapiens
aattttgttttac

SEQ ID NO: 891714 - DNA, 14 bp, Homo sapiens
aattttgtttttat

SEQ ID NO: 891715 - DNA, 20 bp, Homo sapiens
aatttttaaagtatatattt

SEQ ID NO: 891716 - DNA, 22 bp, Homo sapiens
aatttttaaagtatatatttat

SEQ ID NO: 891717 - DNA, 12 bp, Homo sapiens
aatttttaactt

SEQ ID NO: 891718 - DNA, 12 bp, Homo sapiens
aatttttaatgt

SEQ ID NO: 891719 - DNA, 14 bp, Homo sapiens
aatttttacattca

SEQ ID NO: 891720 - DNA, 15 bp, Homo sapiens
aatttttatttttga

SEQ ID NO: 891721 - DNA, 12 bp, Homo sapiens
aatttttcatag

SEQ ID NO: 891722 - DNA, 20 bp, Homo sapiens
aatttttccaactactaata

SEQ ID NO: 891723 - DNA, 14 bp, Homo sapiens
aatttttcctgcat

SEQ ID NO: 891724 - DNA, 16 bp, Homo sapiens
aatttttcctgcatgt

SEQ ID NO: 891725 - DNA, 20 bp, Homo sapiens
aatttttctctaactcagaa

SEQ ID NO: 891726 - DNA, 17 bp, Homo sapiens
aatttttgaaaaatatt

SEQ ID NO: 891727 - DNA, 12 bp, Homo sapiens
aatttttgacac

SEQ ID NO: 891728 - DNA, 14 bp, Homo sapiens
aatttttgtacatc

SEQ ID NO: 891729 - DNA, 13 bp, Homo sapiens
aatttttgtagta

SEQ ID NO: 891730 - DNA, 12 bp, Homo sapiens
aatttttgtatt

SEQ ID NO: 891731 - DNA, 21 bp, Homo sapiens
aattttttaaaaaaaatttgt

SEQ ID NO: 891732 - DNA, 23 bp, Homo sapiens
aattttttaaaaaaaatttgtgt

SEQ ID NO: 891733 - DNA, 14 bp, Homo sapiens
aattttttaatttc

SEQ ID NO: 891734 - DNA, 18 bp, Homo sapiens
aattttttatcatgcatg

SEQ ID NO: 891735 - DNA, 21 bp, Homo sapiens
aattttttgatgtcagccttg

SEQ ID NO: 891736 - DNA, 20 bp, Homo sapiens
aattttttggtacaaaaata

SEQ ID NO: 891737 - DNA, 15 bp, Homo sapiens
aatttttttaaattt

SEQ ID NO: 891738 - DNA, 19 bp, Homo sapiens
aatttttttaaccaaaggt

SEQ ID NO: 891739 - DNA, 20 bp, Homo sapiens
aatttttttaaccaaaggtg

SEQ ID NO: 891740 - DNA, 22 bp, Homo sapiens
aatttttttatcgtcactgctt

SEQ ID NO: 891741 - DNA, 15 bp, Homo sapiens
aatttttttattact

SEQ ID NO: 891742 - DNA, 19 bp, Homo sapiens
aatttttttcaatatttat

SEQ ID NO: 891743 - DNA, 13 bp, Homo sapiens
aatttttttcacc

SEQ ID NO: 891744 - DNA, 21 bp, Homo sapiens
aatttttttcatcttctctgg

SEQ ID NO: 891745 - DNA, 16 bp, Homo sapiens
aatttttttgtaataa

SEQ ID NO: 891746 - DNA, 16 bp, Homo sapiens
aatttttttgtcttta

SEQ ID NO: 891747 - DNA, 15 bp, Homo sapiens
aattttttttaaaga

SEQ ID NO: 891748 - DNA, 22 bp, Homo sapiens
acaaaaaaaaaatagagagaga

SEQ ID NO: 891749 - DNA, 21 bp, Homo sapiens
acaaaaaaaaagttttatttt

SEQ ID NO: 891750 - DNA, 22 bp, Homo sapiens
acaaaaaaaaagttttattttt

SEQ ID NO: 891751 - DNA, 13 bp, Homo sapiens
acaaaaaaactat

SEQ ID NO: 891752 - DNA, 19 bp, Homo sapiens
acaaaaaaagttgaaggcc

SEQ ID NO: 891753 - DNA, 13 bp, Homo sapiens
acaaaaaaatctg

SEQ ID NO: 891754 - DNA, 16 bp, Homo sapiens
acaaaaaaatctgcag

SEQ ID NO: 891755 - DNA, 19 bp, Homo sapiens
acaaaaaaatctgcagaag

SEQ ID NO: 891756 - DNA, 17 bp, Homo sapiens
acaaaaaacagattcta

SEQ ID NO: 891757 - DNA, 18 bp, Homo sapiens
acaaaaaacagattctat

SEQ ID NO: 891758 - DNA, 14 bp, Homo sapiens
acaaaaaaccacaa

SEQ ID NO: 891759 - DNA, 21 bp, Homo sapiens
acaaaaaacggggagaaataa

SEQ ID NO: 891760 - DNA, 15 bp, Homo sapiens
acaaaaaactcccct

SEQ ID NO: 891761 - DNA, 12 bp, Homo sapiens
acaaaaaagaag

SEQ ID NO: 891762 - DNA, 14 bp, Homo sapiens
acaaaaaatgtaat

SEQ ID NO: 891763 - DNA, 17 bp, Homo sapiens
acaaaaacaaaaaaact

SEQ ID NO: 891764 - DNA, 18 bp, Homo sapiens
acaaaaacagaatttgag

SEQ ID NO: 891765 - DNA, 13 bp, Homo sapiens
acaaaaacaggta

SEQ ID NO: 891766 - DNA, 22 bp, Homo sapiens
acaaaaacaggtatatactttg

SEQ ID NO: 891767 - DNA, 16 bp, Homo sapiens
acaaaaagaaatgtca

SEQ ID NO: 891768 - DNA, 17 bp, Homo sapiens
acaaaaagaaatgtcaa

SEQ ID NO: 891769 - DNA, 23 bp, Homo sapiens
acaaaaagtaacacagtggactt

SEQ ID NO: 891770 - DNA, 12 bp, Homo sapiens
acaaaaataaaa

SEQ ID NO: 891771 - DNA, 14 bp, Homo sapiens
acaaaaataaattt

SEQ ID NO: 891772 - DNA, 14 bp, Homo sapiens
acaaaaataacact

SEQ ID NO: 891773 - DNA, 20 bp, Homo sapiens
acaaaacacaggttttttca

SEQ ID NO: 891774 - DNA, 14 bp, Homo sapiens
acaaaacattcatg

SEQ ID NO: 891775 - DNA, 13 bp, Homo sapiens
acaaaaccaagcc

SEQ ID NO: 891776 - DNA, 18 bp, Homo sapiens
acaaaaccctcagcactg

SEQ ID NO: 891777 - DNA, 19 bp, Homo sapiens
acaaaaccctcagcactgt

SEQ ID NO: 891778 - DNA, 20 bp, Homo sapiens
acaaaactacttttctaaaa

SEQ ID NO: 891779 - DNA, 12 bp, Homo sapiens
acaaaactgtaa

SEQ ID NO: 891780 - DNA, 22 bp, Homo sapiens
acaaaactgtaaataaaatgtg

SEQ ID NO: 891781 - DNA, 11 bp, Homo sapiens
acaaaactgtt

SEQ ID NO: 891782 - DNA, 22 bp, Homo sapiens
acaaaactgttcttttgcattt

SEQ ID NO: 891783 - DNA, 19 bp, Homo sapiens
acaaaacttaaaagtattc

SEQ ID NO: 891784 - DNA, 23 bp, Homo sapiens
acaaaacttaaaagtattcatac

SEQ ID NO: 891785 - DNA, 13 bp, Homo sapiens
acaaaacttgaaa

SEQ ID NO: 891786 - DNA, 9 bp, Homo sapiens
acaaaagac

SEQ ID NO: 891787 - DNA, 13 bp, Homo sapiens
acaaaagagcagt

SEQ ID NO: 891788 - DNA, 13 bp, Homo sapiens
acaaaagcagata

SEQ ID NO: 891789 - DNA, 14 bp, Homo sapiens
acaaaagggccagg

SEQ ID NO: 891790 - DNA, 22 bp, Homo sapiens
acaaatgcaaatttctataaat

SEQ ID NO: 891791 - DNA, 21 bp, Homo sapiens
acaaatgggcgcccccccctc

SEQ ID NO: 891792 - DNA, 18 bp, Homo sapiens
acaaatgtctagtttcta

SEQ ID NO: 891793 - DNA, 23 bp, Homo sapiens
acaaatgtggagtgtctgcgtcc

SEQ ID NO: 891794 - DNA, 20 bp, Homo sapiens
acaaatgtgtttttctatat

SEQ ID NO: 891795 - DNA, 22 bp, Homo sapiens
acaaatgtgtttttctatatag

SEQ ID NO: 891796 - DNA, 13 bp, Homo sapiens
acaaatgttttgc

SEQ ID NO: 891797 - DNA, 14 bp, Homo sapiens
acaaatgttttgct

SEQ ID NO: 891798 - DNA, 14 bp, Homo sapiens
acaaattagaggag

SEQ ID NO: 891799 - DNA, 15 bp, Homo sapiens
acaaattcaaataat

SEQ ID NO: 891800 - DNA, 18 bp, Homo sapiens
acaaattctactttaata

SEQ ID NO: 891801 - DNA, 16 bp, Homo sapiens
acaaatttatgcattt

SEQ ID NO: 891802 - DNA, 17 bp, Homo sapiens
acaaatttatgcatttc

SEQ ID NO: 891803 - DNA, 18 bp, Homo sapiens
acaaatttatgcatttca

SEQ ID NO: 891804 - DNA, 17 bp, Homo sapiens
acaaatttggccttaag

SEQ ID NO: 891805 - DNA, 17 bp, Homo sapiens
acaaattttcaagttta

SEQ ID NO: 891806 - DNA, 18 bp, Homo sapiens
acaaattttcaagtttac

SEQ ID NO: 891807 - DNA, 19 bp, Homo sapiens
acaaattttcaagtttaca

SEQ ID NO: 891808 - DNA, 16 bp, Homo sapiens
acaaattttgtataac

SEQ ID NO: 891809 - DNA, 21 bp, Homo sapiens
acaaatttttatttctaaaat

SEQ ID NO: 891810 - DNA, 15 bp, Homo sapiens
acaaatttttcaaat

SEQ ID NO: 891811 - DNA, 17 bp, Homo sapiens
acaaattttttaatttc

SEQ ID NO: 891812 - DNA, 10 bp, Homo sapiens
acaacaaaaa

SEQ ID NO: 891813 - DNA, 13 bp, Homo sapiens
acaacaaaaggac

SEQ ID NO: 891814 - DNA, 21 bp, Homo sapiens
acaacaactattttttaagaa

SEQ ID NO: 891815 - DNA, 14 bp, Homo sapiens
acaacacaaagaga

SEQ ID NO: 891816 - DNA, 17 bp, Homo sapiens
acaacaccttcctcctg

SEQ ID NO: 891817 - DNA, 21 bp, Homo sapiens
acaacacgcctaaaactcaaa

SEQ ID NO: 891818 - DNA, 10 bp, Homo sapiens
acaacactga

SEQ ID NO: 891819 - DNA, 19 bp, Homo sapiens
acaacagaagcttcagaag

SEQ ID NO: 891820 - DNA, 14 bp, Homo sapiens
acaacagcctgggg

SEQ ID NO: 891821 - DNA, 16 bp, Homo sapiens
acaacagctgaagcac

SEQ ID NO: 891822 - DNA, 18 bp, Homo sapiens
acaacaggcaggggccca

SEQ ID NO: 891823 - DNA, 22 bp, Homo sapiens
acaacaggcccttgggtgaaag

SEQ ID NO: 891824 - DNA, 18 bp, Homo sapiens
acaacataaggagaatgt

SEQ ID NO: 891825 - DNA, 12 bp, Homo sapiens
acaacatcagaa

SEQ ID NO: 891826 - DNA, 21 bp, Homo sapiens
acaacatcgcaatagtttttt

SEQ ID NO: 891827 - DNA, 14 bp, Homo sapiens
acaacatttctata

SEQ ID NO: 891828 - DNA, 22 bp, Homo sapiens
acaacatttctatagccaaaaa

SEQ ID NO: 891829 - DNA, 21 bp, Homo sapiens
acaaccaatttacactgccat

SEQ ID NO: 891830 - DNA, 15 bp, Homo sapiens
acaaccaccgctccc

SEQ ID NO: 891831 - DNA, 13 bp, Homo sapiens
aatttataatgta

SEQ ID NO: 891832 - DNA, 16 bp, Homo sapiens
aatttataatgtattt

SEQ ID NO: 891833 - DNA, 15 bp, Homo sapiens
aatttatacaatatc

SEQ ID NO: 891834 - DNA, 20 bp, Homo sapiens
aatttatatcaggtgtataa

SEQ ID NO: 891835 - DNA, 23 bp, Homo sapiens
aatttatatcaggtgtataaatg

SEQ ID NO: 891836 - DNA, 22 bp, Homo sapiens
aatttatatgcttcacatagca

SEQ ID NO: 891837 - DNA, 16 bp, Homo sapiens
aatttatattatccat

SEQ ID NO: 891838 - DNA, 18 bp, Homo sapiens
aatttatccaattttgat

SEQ ID NO: 891839 - DNA, 18 bp, Homo sapiens
aatttatcctataagatg

SEQ ID NO: 891840 - DNA, 16 bp, Homo sapiens
aatttatctttaccaa

SEQ ID NO: 891841 - DNA, 19 bp, Homo sapiens
aatttatctttaccaaaaa

SEQ ID NO: 891842 - DNA, 20 bp, Homo sapiens
aatttatgaagcagatttat

SEQ ID NO: 891843 - DNA, 21 bp, Homo sapiens
aatttatgaattgaattatct

SEQ ID NO: 891844 - DNA, 16 bp, Homo sapiens
aatttatgagtttttg

SEQ ID NO: 891845 - DNA, 20 bp, Homo sapiens
aatttatgagtttttgatag

SEQ ID NO: 891846 - DNA, 13 bp, Homo sapiens
aatttatgcattt

SEQ ID NO: 891847 - DNA, 21 bp, Homo sapiens
aatttatgcatttcattcaaa

SEQ ID NO: 891848 - DNA, 16 bp, Homo sapiens
aatttattaagtctgg

SEQ ID NO: 891849 - DNA, 20 bp, Homo sapiens
aatttattagccctgcattt

SEQ ID NO: 891850 - DNA, 21 bp, Homo sapiens
aatttattagtttaaaatgca

SEQ ID NO: 891851 - DNA, 12 bp, Homo sapiens
aatttattatag

SEQ ID NO: 891852 - DNA, 21 bp, Homo sapiens
aatttattatatatttacaga

SEQ ID NO: 891853 - DNA, 17 bp, Homo sapiens
aatttattatggcacat

SEQ ID NO: 891854 - DNA, 13 bp, Homo sapiens
aatttattattaa

SEQ ID NO: 891855 - DNA, 16 bp, Homo sapiens
aatttattattgaaat

SEQ ID NO: 891856 - DNA, 18 bp, Homo sapiens
aatttattattgaaattg

SEQ ID NO: 891857 - DNA, 12 bp, Homo sapiens
aatttattcaat

SEQ ID NO: 891858 - DNA, 18 bp, Homo sapiens
aatttattgcacattgtt

SEQ ID NO: 891859 - DNA, 12 bp, Homo sapiens
aatttattggca

SEQ ID NO: 891860 - DNA, 22 bp, Homo sapiens
aatttattggcagccaaggaat

SEQ ID NO: 891861 - DNA, 17 bp, Homo sapiens
aatttatttattaagat

SEQ ID NO: 891862 - DNA, 16 bp, Homo sapiens
aatttatttcatccag

SEQ ID NO: 891863 - DNA, 14 bp, Homo sapiens
aatttatttccact

SEQ ID NO: 891864 - DNA, 17 bp, Homo sapiens
aatttatttcttaacct

SEQ ID NO: 891865 - DNA, 20 bp, Homo sapiens
aatttatttcttaacctttg

SEQ ID NO: 891866 - DNA, 16 bp, Homo sapiens
aatttattttataaga

SEQ ID NO: 891867 - DNA, 23 bp, Homo sapiens
aatttattttataagaaaaactt

SEQ ID NO: 891868 - DNA, 20 bp, Homo sapiens
aatttattttattttagcag

SEQ ID NO: 891869 - DNA, 22 bp, Homo sapiens
aatttattttattttagcagtt

SEQ ID NO: 891870 - DNA, 17 bp, Homo sapiens
aatttattttgctccct

SEQ ID NO: 891871 - DNA, 18 bp, Homo sapiens
aatttattttgctccctc

SEQ ID NO: 891872 - DNA, 19 bp, Homo sapiens
aatttattttgctccctct

SEQ ID NO: 891873 - DNA, 20 bp, Homo sapiens
aatttattttgctccctctg

SEQ ID NO: 891874 - DNA, 21 bp, Homo sapiens
aatttattttgctccctctgt

SEQ ID NO: 891875 - DNA, 16 bp, Homo sapiens
aatttcaaaaatataa

SEQ ID NO: 891876 - DNA, 15 bp, Homo sapiens
aatttcaaaatacat

SEQ ID NO: 891877 - DNA, 16 bp, Homo sapiens
aatttcaaaatacatt

SEQ ID NO: 891878 - DNA, 14 bp, Homo sapiens
aatttcacagttct

SEQ ID NO: 891879 - DNA, 19 bp, Homo sapiens
aatttcacagttctgtaat

SEQ ID NO: 891880 - DNA, 16 bp, Homo sapiens
aatttcacctgtaaac

SEQ ID NO: 891881 - DNA, 23 bp, Homo sapiens
aatttcactgtctttaattctgt

SEQ ID NO: 891882 - DNA, 13 bp, Homo sapiens
aatttcaggaaaa

SEQ ID NO: 891883 - DNA, 21 bp, Homo sapiens
aatttcaggcattttgttcta

SEQ ID NO: 891884 - DNA, 12 bp, Homo sapiens
aatttcagggtg

SEQ ID NO: 891885 - DNA, 22 bp, Homo sapiens
aatttcaggttttgtaaagatg

SEQ ID NO: 891886 - DNA, 15 bp, Homo sapiens
aatttcagtcaattc

SEQ ID NO: 891887 - DNA, 20 bp, Homo sapiens
aatttcagtcaattctgatg

SEQ ID NO: 891888 - DNA, 19 bp, Homo sapiens
aatttcagtgtaaagtgtg

SEQ ID NO: 891889 - DNA, 17 bp, Homo sapiens
aatttcataattctgaa

SEQ ID NO: 891890 - DNA, 16 bp, Homo sapiens
aatttcatgattggct

SEQ ID NO: 891891 - DNA, 18 bp, Homo sapiens
aatttccaggaaaaaata

SEQ ID NO: 891892 - DNA, 17 bp, Homo sapiens
aatttccagtacctttg

SEQ ID NO: 891893 - DNA, 20 bp, Homo sapiens
aatttccagtacctttgtca

SEQ ID NO: 891894 - DNA, 21 bp, Homo sapiens
aatttcccggagccatcaccc

SEQ ID NO: 891895 - DNA, 12 bp, Homo sapiens
aatttcctcact

SEQ ID NO: 891896 - DNA, 16 bp, Homo sapiens
aatttcctcactgcct

SEQ ID NO: 891897 - DNA, 22 bp, Homo sapiens
aatttcctcactgcctggtaaa

SEQ ID NO: 891898 - DNA, 20 bp, Homo sapiens
aatttcctcccaattcatgg

SEQ ID NO: 891899 - DNA, 14 bp, Homo sapiens
aatttcctctccac

SEQ ID NO: 891900 - DNA, 18 bp, Homo sapiens
aatttcctctccactgct

SEQ ID NO: 891901 - DNA, 21 bp, Homo sapiens
aatttcctctccactgctgga

SEQ ID NO: 891902 - DNA, 22 bp, Homo sapiens
aatttcctggtgtgaaggtcct

SEQ ID NO: 891903 - DNA, 20 bp, Homo sapiens
aatttccttctgttaagaaa

SEQ ID NO: 891904 - DNA, 17 bp, Homo sapiens
aatttcctttttgacac

SEQ ID NO: 891905 - DNA, 18 bp, Homo sapiens
aatttcctttttgacact

SEQ ID NO: 891906 - DNA, 20 bp, Homo sapiens
aatttcctttttgacactga

SEQ ID NO: 891907 - DNA, 17 bp, Homo sapiens
aatttcgccttaaactc

SEQ ID NO: 891908 - DNA, 23 bp, Homo sapiens
aatttcgccttaaactctggaca

SEQ ID NO: 891909 - DNA, 19 bp, Homo sapiens
aatttcgcttcttagaaca

SEQ ID NO: 891910 - DNA, 17 bp, Homo sapiens
aatttcggattttttcc

SEQ ID NO: 891911 - DNA, 22 bp, Homo sapiens
aatttctaaaaaacagaggcca

SEQ ID NO: 891912 - DNA, 19 bp, Homo sapiens
aatttctaaagtaaaattg

SEQ ID NO: 891913 - DNA, 20 bp, Homo sapiens
aatttctaagaagttacttt

SEQ ID NO: 891914 - DNA, 11 bp, Homo sapiens
aatttctacta

SEQ ID NO: 891915 - DNA, 21 bp, Homo sapiens
aatttctagacagtattgcca

SEQ ID NO: 891916 - DNA, 21 bp, Homo sapiens
aatttctataaatttaagaaa

SEQ ID NO: 891917 - DNA, 22 bp, Homo sapiens
aatttctataaatttaagaaaa

SEQ ID NO: 891918 - DNA, 15 bp, Homo sapiens
aatttctattaatat

SEQ ID NO: 891919 - DNA, 16 bp, Homo sapiens
aatttctctctttctt

SEQ ID NO: 891920 - DNA, 19 bp, Homo sapiens
aatttctgaaagatgagta

SEQ ID NO: 891921 - DNA, 20 bp, Homo sapiens
aatttctgccatttcatgtc

SEQ ID NO: 891922 - DNA, 20 bp, Homo sapiens
aatttctgcctttcccccct

SEQ ID NO: 891923 - DNA, 18 bp, Homo sapiens
aatttctgctaaatatca

SEQ ID NO: 891924 - DNA, 19 bp, Homo sapiens
aatttctgggatatttaac

SEQ ID NO: 891925 - DNA, 12 bp, Homo sapiens
aatttcttaact

SEQ ID NO: 891926 - DNA, 16 bp, Homo sapiens
aatttcttaacttctt

SEQ ID NO: 891927 - DNA, 20 bp, Homo sapiens
aatttcttactaaacatttt

SEQ ID NO: 891928 - DNA, 21 bp, Homo sapiens
aatttcttactaaacattttg

SEQ ID NO: 891929 - DNA, 19 bp, Homo sapiens
aattaagatcctaaactct

SEQ ID NO: 891930 - DNA, 23 bp, Homo sapiens
aattaagcattttgaaacaaagt

SEQ ID NO: 891931 - DNA, 16 bp, Homo sapiens
aattaagtactatgta

SEQ ID NO: 891932 - DNA, 14 bp, Homo sapiens
aattaagtagaaca

SEQ ID NO: 891933 - DNA, 18 bp, Homo sapiens
aattaagttgaaaaagga

SEQ ID NO: 891934 - DNA, 17 bp, Homo sapiens
aattaataaagaaaaag

SEQ ID NO: 891935 - DNA, 15 bp, Homo sapiens
aattaataatcttat

SEQ ID NO: 891936 - DNA, 15 bp, Homo sapiens
aattaatacagagta

SEQ ID NO: 891937 - DNA, 13 bp, Homo sapiens
aattaatagcttt

SEQ ID NO: 891938 - DNA, 19 bp, Homo sapiens
aattaatagcttttgatta

SEQ ID NO: 891939 - DNA, 14 bp, Homo sapiens
aattaatagtttgt

SEQ ID NO: 891940 - DNA, 13 bp, Homo sapiens
aattaatcaagta

SEQ ID NO: 891941 - DNA, 16 bp, Homo sapiens
aattaatgcttagtga

SEQ ID NO: 891942 - DNA, 23 bp, Homo sapiens
aattaattcctgtttgtctacat

SEQ ID NO: 891943 - DNA, 15 bp, Homo sapiens
aattaattgtaatct

SEQ ID NO: 891944 - DNA, 13 bp, Homo sapiens
aattaatttgtga

SEQ ID NO: 891945 - DNA, 17 bp, Homo sapiens
aattaatttgtgaattt

SEQ ID NO: 891946 - DNA, 21 bp, Homo sapiens
aattaatttgtgaatttgcaa

SEQ ID NO: 891947 - DNA, 23 bp, Homo sapiens
aattacaattgtcatttataaaa

SEQ ID NO: 891948 - DNA, 19 bp, Homo sapiens
aattacactgtgccttttc

SEQ ID NO: 891949 - DNA, 16 bp, Homo sapiens
aattacagggtgactc

SEQ ID NO: 891950 - DNA, 23 bp, Homo sapiens
aattacatatttgactctttcaa

SEQ ID NO: 891951 - DNA, 21 bp, Homo sapiens
aattaccatgcttcacaatgt

SEQ ID NO: 891952 - DNA, 13 bp, Homo sapiens
aattaccattaat

SEQ ID NO: 891953 - DNA, 18 bp, Homo sapiens
aattaccattaattacat

SEQ ID NO: 891954 - DNA, 23 bp, Homo sapiens
aattaccatttgttaatatcact

SEQ ID NO: 891955 - DNA, 19 bp, Homo sapiens
aattaccctttcattcagc

SEQ ID NO: 891956 - DNA, 17 bp, Homo sapiens
aattacccttttgcagg

SEQ ID NO: 891957 - DNA, 18 bp, Homo sapiens
aattacctggatgttctt

SEQ ID NO: 891958 - DNA, 21 bp, Homo sapiens
aattaccttgagccagtaatt

SEQ ID NO: 891959 - DNA, 15 bp, Homo sapiens
aattacgtttaaagt

SEQ ID NO: 891960 - DNA, 16 bp, Homo sapiens
aattacgtttgttatt

SEQ ID NO: 891961 - DNA, 14 bp, Homo sapiens
aattactaataaat

SEQ ID NO: 891962 - DNA, 13 bp, Homo sapiens
aattactaatttt

SEQ ID NO: 891963 - DNA, 23 bp, Homo sapiens
aattactattcttggttcttatt

SEQ ID NO: 891964 - DNA, 14 bp, Homo sapiens
aattactcaggttt

SEQ ID NO: 891965 - DNA, 14 bp, Homo sapiens
aattactgtatata

SEQ ID NO: 891966 - DNA, 20 bp, Homo sapiens
aattactgtatataaactcc

SEQ ID NO: 891967 - DNA, 15 bp, Homo sapiens
aattactgtgtaaat

SEQ ID NO: 891968 - DNA, 18 bp, Homo sapiens
aattacttgtgttacttg

SEQ ID NO: 891969 - DNA, 21 bp, Homo sapiens
aattacttgtgttacttgcca

SEQ ID NO: 891970 - DNA, 14 bp, Homo sapiens
aattactttcctcc

SEQ ID NO: 891971 - DNA, 20 bp, Homo sapiens
aattagaaaagttaacattt

SEQ ID NO: 891972 - DNA, 14 bp, Homo sapiens
aattagaaaatatt

SEQ ID NO: 891973 - DNA, 18 bp, Homo sapiens
aattagaaaatattctct

SEQ ID NO: 891974 - DNA, 15 bp, Homo sapiens
aattagaagacattt

SEQ ID NO: 891975 - DNA, 22 bp, Homo sapiens
aattagaatgaatttatcttta

SEQ ID NO: 891976 - DNA, 16 bp, Homo sapiens
aattagacactttgga

SEQ ID NO: 891977 - DNA, 17 bp, Homo sapiens
aattagacactttggaa

SEQ ID NO: 891978 - DNA, 17 bp, Homo sapiens
aattagataaattgtag

SEQ ID NO: 891979 - DNA, 19 bp, Homo sapiens
aattagatgattatatatt

SEQ ID NO: 891980 - DNA, 16 bp, Homo sapiens
aattagattatttctg

SEQ ID NO: 891981 - DNA, 18 bp, Homo sapiens
aattagattatttctgta

SEQ ID NO: 891982 - DNA, 21 bp, Homo sapiens
aattagattatttctgtattt

SEQ ID NO: 891983 - DNA, 13 bp, Homo sapiens
aattagcatgcaa

SEQ ID NO: 891984 - DNA, 17 bp, Homo sapiens
aattaggaagtgattat

SEQ ID NO: 891985 - DNA, 21 bp, Homo sapiens
aattaggaagtgtaacagctg

SEQ ID NO: 891986 - DNA, 20 bp, Homo sapiens
aattaggcaaggctatgtga

SEQ ID NO: 891987 - DNA, 19 bp, Homo sapiens
aattagggatgctcaaacg

SEQ ID NO: 891988 - DNA, 20 bp, Homo sapiens
aattaggggttgctaagaag

SEQ ID NO: 891989 - DNA, 15 bp, Homo sapiens
aattagtatgtctgt

SEQ ID NO: 891990 - DNA, 17 bp, Homo sapiens
aattagtatgtctgttt

SEQ ID NO: 891991 - DNA, 17 bp, Homo sapiens
aattagtatttatttaa

SEQ ID NO: 891992 - DNA, 18 bp, Homo sapiens
aattagtatttatttaat

SEQ ID NO: 891993 - DNA, 19 bp, Homo sapiens
aattagtgaccattattca

SEQ ID NO: 891994 - DNA, 20 bp, Homo sapiens
aattagtgccacttaatgta

SEQ ID NO: 891995 - DNA, 18 bp, Homo sapiens
aattagtggtcataaaat

SEQ ID NO: 891996 - DNA, 21 bp, Homo sapiens
aattagtgtgacagtttccaa

SEQ ID NO: 891997 - DNA, 17 bp, Homo sapiens
aattagttccagtttct

SEQ ID NO: 891998 - DNA, 19 bp, Homo sapiens
aattagttccagtttctcc

SEQ ID NO: 891999 - DNA, 23 bp, Homo sapiens
aattagtttacctcatccatgca

SEQ ID NO: 892000 - DNA, 12 bp, Homo sapiens
aattataaatgt

SEQ ID NO: 892001 - DNA, 13 bp, Homo sapiens
aattataaatgtg

SEQ ID NO: 892002 - DNA, 22 bp, Homo sapiens
aattataaatgtgtttatagct

SEQ ID NO: 892003 - DNA, 20 bp, Homo sapiens
aattataactgtaaagatgt

SEQ ID NO: 892004 - DNA, 19 bp, Homo sapiens
aattataccccctgcaaag

SEQ ID NO: 892005 - DNA, 14 bp, Homo sapiens
aattatactacttt

SEQ ID NO: 892006 - DNA, 21 bp, Homo sapiens
aattataggaatatcaatata

SEQ ID NO: 892007 - DNA, 21 bp, Homo sapiens
aattatataactgtatttgaa

SEQ ID NO: 892008 - DNA, 20 bp, Homo sapiens
aattatataggttgtgcaaa

SEQ ID NO: 892009 - DNA, 17 bp, Homo sapiens
aattatatatttctaac

SEQ ID NO: 892010 - DNA, 17 bp, Homo sapiens
aattatatctattatgt

SEQ ID NO: 892011 - DNA, 13 bp, Homo sapiens
aattatatgctaa

SEQ ID NO: 892012 - DNA, 13 bp, Homo sapiens
aattatatttgaa

SEQ ID NO: 892013 - DNA, 20 bp, Homo sapiens
aattatatttgtgctatagt

SEQ ID NO: 892014 - DNA, 22 bp, Homo sapiens
aattatatttgtgctatagtat

SEQ ID NO: 892015 - DNA, 15 bp, Homo sapiens
aattatcatgcgttt

SEQ ID NO: 892016 - DNA, 18 bp, Homo sapiens
aattatcatgcgttttat

SEQ ID NO: 892017 - DNA, 16 bp, Homo sapiens
aattatcatgggaaaa

SEQ ID NO: 892018 - DNA, 21 bp, Homo sapiens
aattatcctgaactcttctgc

SEQ ID NO: 892019 - DNA, 20 bp, Homo sapiens
aattatcggaagcagtgcct

SEQ ID NO: 892020 - DNA, 14 bp, Homo sapiens
aattatctatacat

SEQ ID NO: 892021 - DNA, 16 bp, Homo sapiens
aattatctatacatat

SEQ ID NO: 892022 - DNA, 22 bp, Homo sapiens
aattatctatacatatctttat

SEQ ID NO: 892023 - DNA, 23 bp, Homo sapiens
aattatctatagctaagtacaca

SEQ ID NO: 892024 - DNA, 18 bp, Homo sapiens
aattatcttgatacattc

SEQ ID NO: 892025 - DNA, 21 bp, Homo sapiens
aattatcttgatacattcaaa

SEQ ID NO: 892026 - DNA, 12 bp, Homo sapiens
aattatgacaat

SEQ ID NO: 892027 - DNA, 15 bp, Homo sapiens
aattatgacagttat

SEQ ID NO: 892028 - DNA, 13 bp, Homo sapiens
aattatgggaaac

SEQ ID NO: 892029 - DNA, 18 bp, Homo sapiens
aattatgtcgtaagtcac

SEQ ID NO: 892030 - DNA, 14 bp, Homo sapiens
aattatgtctcttg

SEQ ID NO: 892031 - DNA, 20 bp, Homo sapiens
aattatgtgacattttacat

SEQ ID NO: 892032 - DNA, 19 bp, Homo sapiens
aattatgttttaaacacat

SEQ ID NO: 892033 - DNA, 17 bp, Homo sapiens
aattatgttttgacaca

SEQ ID NO: 892034 - DNA, 17 bp, Homo sapiens
aattattaattgtcctg

SEQ ID NO: 892035 - DNA, 14 bp, Homo sapiens
aattattacagtgt

SEQ ID NO: 892036 - DNA, 20 bp, Homo sapiens
aattattagaacattcactt

SEQ ID NO: 892037 - DNA, 13 bp, Homo sapiens
aattattatttat

SEQ ID NO: 892038 - DNA, 13 bp, Homo sapiens
aattattcaaaga

SEQ ID NO: 892039 - DNA, 14 bp, Homo sapiens
aattattgacactg

SEQ ID NO: 892040 - DNA, 15 bp, Homo sapiens
aattattgacactga

SEQ ID NO: 892041 - DNA, 17 bp, Homo sapiens
aattattgacactgaac

SEQ ID NO: 892042 - DNA, 12 bp, Homo sapiens
aattattgctta

SEQ ID NO: 892043 - DNA, 13 bp, Homo sapiens
aattattgtaaac

SEQ ID NO: 892044 - DNA, 15 bp, Homo sapiens
aattattgtaaactt

SEQ ID NO: 892045 - DNA, 16 bp, Homo sapiens
aattattgtaaacttt

SEQ ID NO: 892046 - DNA, 15 bp, Homo sapiens
aattattgtagacat

SEQ ID NO: 892047 - DNA, 14 bp, Homo sapiens
aattatttaaagaa

SEQ ID NO: 892048 - DNA, 17 bp, Homo sapiens
aattatttaaagaaagt

SEQ ID NO: 892049 - DNA, 17 bp, Homo sapiens
aattatttaaataaaat

SEQ ID NO: 892050 - DNA, 19 bp, Homo sapiens
aattatttaaataaaatca

SEQ ID NO: 892051 - DNA, 15 bp, Homo sapiens
aattatttaagattt

SEQ ID NO: 892052 - DNA, 14 bp, Homo sapiens
aattatttaataaa

SEQ ID NO: 892053 - DNA, 16 bp, Homo sapiens
aattatttaattgtcc

SEQ ID NO: 892054 - DNA, 16 bp, Homo sapiens
aatgtatgtgtggctg

SEQ ID NO: 892055 - DNA, 23 bp, Homo sapiens
aatgtattaagcccacagtatat

SEQ ID NO: 892056 - DNA, 15 bp, Homo sapiens
aatgtattaatctgt

SEQ ID NO: 892057 - DNA, 17 bp, Homo sapiens
aatgtattaatctgttt

SEQ ID NO: 892058 - DNA, 19 bp, Homo sapiens
aatgtattagtatggttca

SEQ ID NO: 892059 - DNA, 14 bp, Homo sapiens
aatgtgtcctatct

SEQ ID NO: 892060 - DNA, 23 bp, Homo sapiens
aatgtgtcctatctatcttccaa

SEQ ID NO: 892061 - DNA, 20 bp, Homo sapiens
aatgtgtctctgctttcctt

SEQ ID NO: 892062 - DNA, 11 bp, Homo sapiens
aatgtgtcttt

SEQ ID NO: 892063 - DNA, 16 bp, Homo sapiens
aatgtgtggtggcctc

SEQ ID NO: 892064 - DNA, 19 bp, Homo sapiens
aatgtgtgtgtgtggcagg

SEQ ID NO: 892065 - DNA, 23 bp, Homo sapiens
aatgtgttagcactgatagtcct

SEQ ID NO: 892066 - DNA, 20 bp, Homo sapiens
aatgtgttcttttctccttt

SEQ ID NO: 892067 - DNA, 16 bp, Homo sapiens
aatgtgttggaaactg

SEQ ID NO: 892068 - DNA, 13 bp, Homo sapiens
aatgtgtttcaaa

SEQ ID NO: 892069 - DNA, 22 bp, Homo sapiens
aatgtgtttcttgctgccatga

SEQ ID NO: 892070 - DNA, 17 bp, Homo sapiens
aatgttaactacatatt

SEQ ID NO: 892071 - DNA, 14 bp, Homo sapiens
aatgttaagaattg

SEQ ID NO: 892072 - DNA, 21 bp, Homo sapiens
aatgttaatggatttcagaag

SEQ ID NO: 892073 - DNA, 16 bp, Homo sapiens
aatgttacattattat

SEQ ID NO: 892074 - DNA, 20 bp, Homo sapiens
aatgttacggcatcacactt

SEQ ID NO: 892075 - DNA, 23 bp, Homo sapiens
aatgttacggcatcacacttata

SEQ ID NO: 892076 - DNA, 21 bp, Homo sapiens
aatgttactgatcatgcattg

SEQ ID NO: 892077 - DNA, 16 bp, Homo sapiens
aatgttagtcattgtt

SEQ ID NO: 892078 - DNA, 19 bp, Homo sapiens
aatgttatcttatactgta

SEQ ID NO: 892079 - DNA, 22 bp, Homo sapiens
aatgttatcttatactgtacaa

SEQ ID NO: 892080 - DNA, 23 bp, Homo sapiens
aatgttatgaggacgtgtctgtt

SEQ ID NO: 892081 - DNA, 21 bp, Homo sapiens
aatgttatgggatgtaaacaa

SEQ ID NO: 892082 - DNA, 23 bp, Homo sapiens
aatgttattattactctacactg

SEQ ID NO: 892083 - DNA, 15 bp, Homo sapiens
aatgttattattctt

SEQ ID NO: 892084 - DNA, 23 bp, Homo sapiens
aatgttcatatttattgattaaa

SEQ ID NO: 892085 - DNA, 22 bp, Homo sapiens
aatgttcatcccatgatgtagt

SEQ ID NO: 892086 - DNA, 21 bp, Homo sapiens
aatgttcattgtaatgttact

SEQ ID NO: 892087 - DNA, 14 bp, Homo sapiens
aatgttcattttct

SEQ ID NO: 892088 - DNA, 12 bp, Homo sapiens
aatgttccagac

SEQ ID NO: 892089 - DNA, 21 bp, Homo sapiens
aatgttcctcaaagcttggat

SEQ ID NO: 892090 - DNA, 22 bp, Homo sapiens
aatgttcctcaaagcttggatt

SEQ ID NO: 892091 - DNA, 15 bp, Homo sapiens
aatgttccttttgct

SEQ ID NO: 892092 - DNA, 15 bp, Homo sapiens
aatgttctgaatttc

SEQ ID NO: 892093 - DNA, 11 bp, Homo sapiens
aatgttctttg

SEQ ID NO: 892094 - DNA, 16 bp, Homo sapiens
aatgttgaaaagtcaa

SEQ ID NO: 892095 - DNA, 21 bp, Homo sapiens
aatgttgatcagcaaatttaa

SEQ ID NO: 892096 - DNA, 12 bp, Homo sapiens
aatgttgcttta

SEQ ID NO: 892097 - DNA, 14 bp, Homo sapiens
aatgttggaatgtt

SEQ ID NO: 892098 - DNA, 13 bp, Homo sapiens
aatgttggataag

SEQ ID NO: 892099 - DNA, 19 bp, Homo sapiens
aatgttggatttataaatg

SEQ ID NO: 892100 - DNA, 22 bp, Homo sapiens
aatgttgggactgctaaataaa

SEQ ID NO: 892101 - DNA, 23 bp, Homo sapiens
aatgttggtcattttatgttaag

SEQ ID NO: 892102 - DNA, 22 bp, Homo sapiens
aatgttgtagttacctactgag

SEQ ID NO: 892103 - DNA, 17 bp, Homo sapiens
aatgttgtatttaattt

SEQ ID NO: 892104 - DNA, 21 bp, Homo sapiens
aatgttgtccaacaataaaca

SEQ ID NO: 892105 - DNA, 16 bp, Homo sapiens
aatgtttaaatcatgt

SEQ ID NO: 892106 - DNA, 19 bp, Homo sapiens
aatgtttaaatcatgtatg

SEQ ID NO: 892107 - DNA, 21 bp, Homo sapiens
aatgtttaaatcatgtatgtt

SEQ ID NO: 892108 - DNA, 22 bp, Homo sapiens
aatgtttaaatcatgtatgtta

SEQ ID NO: 892109 - DNA, 14 bp, Homo sapiens
aatgtttaagtatt

SEQ ID NO: 892110 - DNA, 23 bp, Homo sapiens
aatgtttacactctttgtaagag

SEQ ID NO: 892111 - DNA, 20 bp, Homo sapiens
aatgtttactaagtggactg

SEQ ID NO: 892112 - DNA, 14 bp, Homo sapiens
aatgtttatactgt

SEQ ID NO: 892113 - DNA, 16 bp, Homo sapiens
aatgtttatgagccag

SEQ ID NO: 892114 - DNA, 18 bp, Homo sapiens
aatgtttatgagccagac

SEQ ID NO: 892115 - DNA, 22 bp, Homo sapiens
aatgtttatgagccagacaaat

SEQ ID NO: 892116 - DNA, 16 bp, Homo sapiens
aatgtttattaaatgc

SEQ ID NO: 892117 - DNA, 23 bp, Homo sapiens
aatgtttattatttacatcactt

SEQ ID NO: 892118 - DNA, 20 bp, Homo sapiens
aatgtttattcctgataata

SEQ ID NO: 892119 - DNA, 15 bp, Homo sapiens
aatgtttattccttg

SEQ ID NO: 892120 - DNA, 19 bp, Homo sapiens
aatgtttatttagctctga

SEQ ID NO: 892121 - DNA, 15 bp, Homo sapiens
aatgtttcaaatgca

SEQ ID NO: 892122 - DNA, 10 bp, Homo sapiens
aatgtttcct

SEQ ID NO: 892123 - DNA, 23 bp, Homo sapiens
aatgtttcctccaaatctgattt

SEQ ID NO: 892124 - DNA, 22 bp, Homo sapiens
aatgtttcttctaggttctaaa

SEQ ID NO: 892125 - DNA, 13 bp, Homo sapiens
aatgtttcttttc

SEQ ID NO: 892126 - DNA, 22 bp, Homo sapiens
aatgtttgggggaaaaaaaaga

SEQ ID NO: 892127 - DNA, 23 bp, Homo sapiens
aatgtttgggggaaaaaaaagaa

SEQ ID NO: 892128 - DNA, 18 bp, Homo sapiens
aatgtttgtctcatccca

SEQ ID NO: 892129 - DNA, 15 bp, Homo sapiens
aatgtttgtgagaag

SEQ ID NO: 892130 - DNA, 23 bp, Homo sapiens
aatgttttaaagtttaatgccta

SEQ ID NO: 892131 - DNA, 14 bp, Homo sapiens
aatgttttaaattc

SEQ ID NO: 892132 - DNA, 15 bp, Homo sapiens
aatgttttaaattct

SEQ ID NO: 892133 - DNA, 19 bp, Homo sapiens
aatgttttatttatcaaaa

SEQ ID NO: 892134 - DNA, 12 bp, Homo sapiens
aatgttttcatt

SEQ ID NO: 892135 - DNA, 21 bp, Homo sapiens
aatgtttttccctccccagaa

SEQ ID NO: 892136 - DNA, 15 bp, Homo sapiens
aatgtttttctgcca

SEQ ID NO: 892137 - DNA, 23 bp, Homo sapiens
aatgttttttaaaatggttatgt

SEQ ID NO: 892138 - DNA, 19 bp, Homo sapiens
aatgttttttcatgtgttt

SEQ ID NO: 892139 - DNA, 16 bp, Homo sapiens
aattaaaaaaaaattg

SEQ ID NO: 892140 - DNA, 17 bp, Homo sapiens
aattaaaaaaaaattgt

SEQ ID NO: 892141 - DNA, 18 bp, Homo sapiens
aattaaaaaaaaattgta

SEQ ID NO: 892142 - DNA, 17 bp, Homo sapiens
aattaaaaaatgaaatt

SEQ ID NO: 892143 - DNA, 12 bp, Homo sapiens
aattaaaaactt

SEQ ID NO: 892144 - DNA, 14 bp, Homo sapiens
aattaaaaactttc

SEQ ID NO: 892145 - DNA, 15 bp, Homo sapiens
aattaaaacaaaaca

SEQ ID NO: 892146 - DNA, 14 bp, Homo sapiens
aattaaaacaaata

SEQ ID NO: 892147 - DNA, 12 bp, Homo sapiens
aattaaaactga

SEQ ID NO: 892148 - DNA, 13 bp, Homo sapiens
aattaaaactgag

SEQ ID NO: 892149 - DNA, 22 bp, Homo sapiens
aattaaaactgagtccatgaaa

SEQ ID NO: 892150 - DNA, 22 bp, Homo sapiens
aattaaaagaaatatacagttt

SEQ ID NO: 892151 - DNA, 16 bp, Homo sapiens
aattaaaagcaaatca

SEQ ID NO: 892152 - DNA, 20 bp, Homo sapiens
aattaaaagcaaatcatttg

SEQ ID NO: 892153 - DNA, 13 bp, Homo sapiens
aattaaaagtttg

SEQ ID NO: 892154 - DNA, 13 bp, Homo sapiens
aattaaaatacta

SEQ ID NO: 892155 - DNA, 11 bp, Homo sapiens
aattaaaatat

SEQ ID NO: 892156 - DNA, 15 bp, Homo sapiens
aattaaaatattatt

SEQ ID NO: 892157 - DNA, 17 bp, Homo sapiens
aattaaaatattatttg

SEQ ID NO: 892158 - DNA, 21 bp, Homo sapiens
aattaaaatattatttgatat

SEQ ID NO: 892159 - DNA, 13 bp, Homo sapiens
aattaaaatctgg

SEQ ID NO: 892160 - DNA, 15 bp, Homo sapiens
aattaaaatctggaa

SEQ ID NO: 892161 - DNA, 17 bp, Homo sapiens
aattaaaatctggaaat

SEQ ID NO: 892162 - DNA, 16 bp, Homo sapiens
aattaaacagctggtc

SEQ ID NO: 892163 - DNA, 18 bp, Homo sapiens
aattaaacagctggtcct

SEQ ID NO: 892164 - DNA, 16 bp, Homo sapiens
aattaaaccgcatgtg

SEQ ID NO: 892165 - DNA, 16 bp, Homo sapiens
aattaaactagtttaa

SEQ ID NO: 892166 - DNA, 16 bp, Homo sapiens
aattaaacttccaaag

SEQ ID NO: 892167 - DNA, 12 bp, Homo sapiens
aattaaagaaat

SEQ ID NO: 892168 - DNA, 14 bp, Homo sapiens
aattaaagtatgca

SEQ ID NO: 892169 - DNA, 16 bp, Homo sapiens
aattaaataaactgtt

SEQ ID NO: 892170 - DNA, 23 bp, Homo sapiens
aattaaatatatgtatgtaaaaa

SEQ ID NO: 892171 - DNA, 17 bp, Homo sapiens
aattaaatccaataaaa

SEQ ID NO: 892172 - DNA, 14 bp, Homo sapiens
aattaacacagtgt

SEQ ID NO: 892173 - DNA, 20 bp, Homo sapiens
aattaacacagtgtttcaat

SEQ ID NO: 892174 - DNA, 21 bp, Homo sapiens
aattaacacagtgtttcaatt

SEQ ID NO: 892175 - DNA, 15 bp, Homo sapiens
aattaaccatttaat

SEQ ID NO: 892176 - DNA, 23 bp, Homo sapiens
aattaactgtaaacttggaatca

SEQ ID NO: 892177 - DNA, 16 bp, Homo sapiens
aattaacttttataaa

SEQ ID NO: 892178 - DNA, 16 bp, Homo sapiens
aattaagaagaaacta

SEQ ID NO: 892179 - DNA, 14 bp, Homo sapiens
aattaagacagcat

SEQ ID NO: 892180 - DNA, 22 bp, Homo sapiens
aatgggggcaggaaagccacat

SEQ ID NO: 892181 - DNA, 20 bp, Homo sapiens
aatgggggctttcggggagg

SEQ ID NO: 892182 - DNA, 21 bp, Homo sapiens
aatgggggctttcggggaggg

SEQ ID NO: 892183 - DNA, 19 bp, Homo sapiens
aatggggggcgggccaggg

SEQ ID NO: 892184 - DNA, 21 bp, Homo sapiens
aatggggggcgggccagggtg

SEQ ID NO: 892185 - DNA, 17 bp, Homo sapiens
aatgggggtgcatttga

SEQ ID NO: 892186 - DNA, 15 bp, Homo sapiens
aatggggtgggccca

SEQ ID NO: 892187 - DNA, 13 bp, Homo sapiens
aatggggttcctg

SEQ ID NO: 892188 - DNA, 17 bp, Homo sapiens
aatggggttcctgctgt

SEQ ID NO: 892189 - DNA, 16 bp, Homo sapiens
aagcatttcaaagccc

SEQ ID NO: 892190 - DNA, 20 bp, Homo sapiens
aagcatttcaaagccctgcc

SEQ ID NO: 892191 - DNA, 12 bp, Homo sapiens
aagcatttgtat

SEQ ID NO: 892192 - DNA, 13 bp, Homo sapiens
aagcatttgtata

SEQ ID NO: 892193 - DNA, 19 bp, Homo sapiens
aagcatttgtttctacttt

SEQ ID NO: 892194 - DNA, 12 bp, Homo sapiens
aagcattttgaa

SEQ ID NO: 892195 - DNA, 22 bp, Homo sapiens
aagcattttgggatccttcagc

SEQ ID NO: 892196 - DNA, 19 bp, Homo sapiens
aagcattttgtaagttgaa

SEQ ID NO: 892197 - DNA, 23 bp, Homo sapiens
aagcattttgtaagttgaagcaa

SEQ ID NO: 892198 - DNA, 14 bp, Homo sapiens
aagcattttgtaat

SEQ ID NO: 892199 - DNA, 15 bp, Homo sapiens
aagcattttttaaaa

SEQ ID NO: 892200 - DNA, 16 bp, Homo sapiens
aagcattttttaaaag

SEQ ID NO: 892201 - DNA, 20 bp, Homo sapiens
aagcattttttaaaagcatg

SEQ ID NO: 892202 - DNA, 16 bp, Homo sapiens
aagccaaaactgagca

SEQ ID NO: 892203 - DNA, 16 bp, Homo sapiens
aagccaaactctgcca

SEQ ID NO: 892204 - DNA, 14 bp, Homo sapiens
aagccaaagaaaca

SEQ ID NO: 892205 - DNA, 17 bp, Homo sapiens
aagccaaagaaacaagc

SEQ ID NO: 892206 - DNA, 16 bp, Homo sapiens
aaccgaacatatcatt

SEQ ID NO: 892207 - DNA, 17 bp, Homo sapiens
aaccgaacatatcattt

SEQ ID NO: 892208 - DNA, 15 bp, Homo sapiens
aaccgagcaaagatc

SEQ ID NO: 892209 - DNA, 20 bp, Homo sapiens
aaccgaggggctcaggaaaa

SEQ ID NO: 892210 - DNA, 23 bp, Homo sapiens
aaccgagtagaaaatgtgaccct

SEQ ID NO: 892211 - DNA, 21 bp, Homo sapiens
aaccgatgctccagccaaccc

SEQ ID NO: 892212 - DNA, 13 bp, Homo sapiens
aaccgcacagctc

SEQ ID NO: 892213 - DNA, 18 bp, Homo sapiens
aaccgcactcacccatgt

SEQ ID NO: 892214 - DNA, 19 bp, Homo sapiens
aaccgccctgcagcatccc

SEQ ID NO: 892215 - DNA, 18 bp, Homo sapiens
aaccgccggccacactgg

SEQ ID NO: 892216 - DNA, 12 bp, Homo sapiens
aaccgcttttgg

SEQ ID NO: 892217 - DNA, 23 bp, Homo sapiens
aaccgtcctgctgtccctgtcag

SEQ ID NO: 892218 - DNA, 20 bp, Homo sapiens
aaccgtggtacccccccttt

SEQ ID NO: 892219 - DNA, 13 bp, Homo sapiens
aacctaaaaaaga

SEQ ID NO: 892220 - DNA, 16 bp, Homo sapiens
aacctaaaaaagatat

SEQ ID NO: 892221 - DNA, 18 bp, Homo sapiens
aacctaaaagtattattc

SEQ ID NO: 892222 - DNA, 21 bp, Homo sapiens
aacctaaaataattggttctt

SEQ ID NO: 892223 - DNA, 21 bp, Homo sapiens
aacctaacacattaaatgtgg

SEQ ID NO: 892224 - DNA, 15 bp, Homo sapiens
aacctaacccctttc

SEQ ID NO: 892225 - DNA, 21 bp, Homo sapiens
aacctacacacgtaccttcat

SEQ ID NO: 892226 - DNA, 15 bp, Homo sapiens
aacctaccagccaga

SEQ ID NO: 892227 - DNA, 18 bp, Homo sapiens
aacctacctcccacactc

SEQ ID NO: 892228 - DNA, 21 bp, Homo sapiens
aacctacgcacataccttcat

SEQ ID NO: 892229 - DNA, 19 bp, Homo sapiens
aacctactgcccacatttg

SEQ ID NO: 892230 - DNA, 18 bp, Homo sapiens
aacctactgttcctttca

SEQ ID NO: 892231 - DNA, 21 bp, Homo sapiens
aacctactgttcctttcagat

SEQ ID NO: 892232 - DNA, 13 bp, Homo sapiens
aacctagaatgtc

SEQ ID NO: 892233 - DNA, 15 bp, Homo sapiens
aacctagatgtttaa

SEQ ID NO: 892234 - DNA, 15 bp, Homo sapiens
aacctagcacacctg

SEQ ID NO: 892235 - DNA, 15 bp, Homo sapiens
aacctagcttttaaa

SEQ ID NO: 892236 - DNA, 21 bp, Homo sapiens
aacctagcttttaaaaaatat

SEQ ID NO: 892237 - DNA, 22 bp, Homo sapiens
aacctagcttttaaaaaatatt

SEQ ID NO: 892238 - DNA, 21 bp, Homo sapiens
aacctagtaaaaccttgttct

SEQ ID NO: 892239 - DNA, 21 bp, Homo sapiens
aacctagtactctctgctcta

SEQ ID NO: 892240 - DNA, 17 bp, Homo sapiens
aacctagtactgccccc

SEQ ID NO: 892241 - DNA, 21 bp, Homo sapiens
aacctagttaaagaaaggaaa

SEQ ID NO: 892242 - DNA, 16 bp, Homo sapiens
aacctatatgatttat

SEQ ID NO: 892243 - DNA, 14 bp, Homo sapiens
aacctatccttcca

SEQ ID NO: 892244 - DNA, 13 bp, Homo sapiens
aacctatctcagg

SEQ ID NO: 892245 - DNA, 17 bp, Homo sapiens
aacctattttcatttgt

SEQ ID NO: 892246 - DNA, 18 bp, Homo sapiens
aacctattttcatttgta

SEQ ID NO: 892247 - DNA, 12 bp, Homo sapiens
aacctcaaacca

SEQ ID NO: 892248 - DNA, 17 bp, Homo sapiens
aacctcaactgcctact

SEQ ID NO: 892249 - DNA, 15 bp, Homo sapiens
aacctcaatgccctg

SEQ ID NO: 892250 - DNA, 12 bp, Homo sapiens
aacctcaccatt

SEQ ID NO: 892251 - DNA, 23 bp, Homo sapiens
aacctcactgccctccctcggcc

SEQ ID NO: 892252 - DNA, 19 bp, Homo sapiens
aacctcagacttaccagga

SEQ ID NO: 892253 - DNA, 22 bp, Homo sapiens
aacctcagacttaccaggaagc

SEQ ID NO: 892254 - DNA, 13 bp, Homo sapiens
aacctcagctctg

SEQ ID NO: 892255 - DNA, 21 bp, Homo sapiens
aacctcagctctgggagagga

SEQ ID NO: 892256 - DNA, 13 bp, Homo sapiens
aacctcagggctg

SEQ ID NO: 892257 - DNA, 18 bp, Homo sapiens
aacctcagggctgtccca

SEQ ID NO: 892258 - DNA, 22 bp, Homo sapiens
aacctcagggctgtcccagccc

SEQ ID NO: 892259 - DNA, 20 bp, Homo sapiens
aacctcagtatttatgtaat

SEQ ID NO: 892260 - DNA, 17 bp, Homo sapiens
aacctcatggtcatgga

SEQ ID NO: 892261 - DNA, 23 bp, Homo sapiens
aacctccagcctccctgtctcca

SEQ ID NO: 892262 - DNA, 18 bp, Homo sapiens
aacctccatactcaagct

SEQ ID NO: 892263 - DNA, 22 bp, Homo sapiens
aacctccattctattttagaat

SEQ ID NO: 892264 - DNA, 13 bp, Homo sapiens
aacctcccagagg

SEQ ID NO: 892265 - DNA, 21 bp, Homo sapiens
aacctcccagaggtccagccc

SEQ ID NO: 892266 - DNA, 23 bp, Homo sapiens
aacctcccagaggtccagcccat

SEQ ID NO: 892267 - DNA, 18 bp, Homo sapiens
aacctctcacttcaccct

SEQ ID NO: 892268 - DNA, 17 bp, Homo sapiens
aacctctctaagccaca

SEQ ID NO: 892269 - DNA, 22 bp, Homo sapiens
aacctctctgaactgcaacact

SEQ ID NO: 892270 - DNA, 15 bp, Homo sapiens
aacctctctgatctt

SEQ ID NO: 892271 - DNA, 10 bp, Homo sapiens
aacctctggc

SEQ ID NO: 892272 - DNA, 15 bp, Homo sapiens
aacctctttttcctc

SEQ ID NO: 892273 - DNA, 16 bp, Homo sapiens
aacctctttttcctcc

SEQ ID NO: 892274 - DNA, 19 bp, Homo sapiens
aacctctttttcctcctgg

SEQ ID NO: 892275 - DNA, 11 bp, Homo sapiens
aacctgaaaaa

SEQ ID NO: 892276 - DNA, 14 bp, Homo sapiens
aacctgaagatgtc

SEQ ID NO: 892277 - DNA, 13 bp, Homo sapiens
aacctgaatcttt

SEQ ID NO: 892278 - DNA, 14 bp, Homo sapiens
aacctgaatctttt

SEQ ID NO: 892279 - DNA, 19 bp, Homo sapiens
aacctgacaaaaaaaaagt

SEQ ID NO: 892280 - DNA, 16 bp, Homo sapiens
aacctgacccctgctc

SEQ ID NO: 892281 - DNA, 17 bp, Homo sapiens
aacctgacccctgctca

SEQ ID NO: 892282 - DNA, 17 bp, Homo sapiens
aacctgagatggagctg

SEQ ID NO: 892283 - DNA, 16 bp, Homo sapiens
aacctgatcacttttc

SEQ ID NO: 892284 - DNA, 13 bp, Homo sapiens
aacctgcactgaa

SEQ ID NO: 892285 - DNA, 11 bp, Homo sapiens
aacctgccctg

SEQ ID NO: 892286 - DNA, 13 bp, Homo sapiens
aacctgccctgcc

SEQ ID NO: 892287 - DNA, 15 bp, Homo sapiens
aacctgccctgcctg

SEQ ID NO: 892288 - DNA, 15 bp, Homo sapiens
aacctgctctcctct

SEQ ID NO: 892289 - DNA, 20 bp, Homo sapiens
aacctgctctcctcttgcca

SEQ ID NO: 892290 - DNA, 15 bp, Homo sapiens
aacctgctggatggg

SEQ ID NO: 892291 - DNA, 13 bp, Homo sapiens
aacctgcttcctt

SEQ ID NO: 892292 - DNA, 22 bp, Homo sapiens
aacctgctttcaagacccctgt

SEQ ID NO: 892293 - DNA, 19 bp, Homo sapiens
aacctggaaaaattccaga

SEQ ID NO: 892294 - DNA, 17 bp, Homo sapiens
aacctggacctggaact

SEQ ID NO: 892295 - DNA, 19 bp, Homo sapiens
aggtggcaggaccaggact

SEQ ID NO: 892296 - DNA, 12 bp, Homo sapiens
aggtggccatgc

SEQ ID NO: 892297 - DNA, 15 bp, Homo sapiens
aggtggccatgttat

SEQ ID NO: 892298 - DNA, 20 bp, Homo sapiens
aggtggccatgttatgctgg

SEQ ID NO: 892299 - DNA, 20 bp, Homo sapiens
aggtggccgcccctgaggct

SEQ ID NO: 892300 - DNA, 17 bp, Homo sapiens
aggtggccgctcctccc

SEQ ID NO: 892301 - DNA, 23 bp, Homo sapiens
aggtggcctcctggcccgccctc

SEQ ID NO: 892302 - DNA, 22 bp, Homo sapiens
aggtggcctttgtgctgcgcct

SEQ ID NO: 892303 - DNA, 14 bp, Homo sapiens
aggtggctctccag

SEQ ID NO: 892304 - DNA, 14 bp, Homo sapiens
aggtggctgagccc

SEQ ID NO: 892305 - DNA, 21 bp, Homo sapiens
aggtgggacttagcagtgagt

SEQ ID NO: 892306 - DNA, 13 bp, Homo sapiens
aggtgggagctga

SEQ ID NO: 892307 - DNA, 12 bp, Homo sapiens
aggtgggaggat

SEQ ID NO: 892308 - DNA, 17 bp, Homo sapiens
aggtgggcatgccaccc

SEQ ID NO: 892309 - DNA, 17 bp, Homo sapiens
aggtgggccagcccctc

SEQ ID NO: 892310 - DNA, 18 bp, Homo sapiens
aggtgggccagcccctcc

SEQ ID NO: 892311 - DNA, 19 bp, Homo sapiens
aggtgggccagcccctccc

SEQ ID NO: 892312 - DNA, 13 bp, Homo sapiens
aggtgggcccagg

SEQ ID NO: 892313 - DNA, 14 bp, Homo sapiens
aggtgggcccagga

SEQ ID NO: 892314 - DNA, 16 bp, Homo sapiens
aggtgggcccaggacc

SEQ ID NO: 892315 - DNA, 22 bp, Homo sapiens
aggtgggcccaggaccagctgg

SEQ ID NO: 892316 - DNA, 22 bp, Homo sapiens
aggtgggccttgctacctcaag

SEQ ID NO: 892317 - DNA, 15 bp, Homo sapiens
aggtgggcggacaaa

SEQ ID NO: 892318 - DNA, 14 bp, Homo sapiens
aggtgggcggtgtg

SEQ ID NO: 892319 - DNA, 14 bp, Homo sapiens
aggtgggctgcctg

SEQ ID NO: 892320 - DNA, 21 bp, Homo sapiens
aggtgggctgggccctctctt

SEQ ID NO: 892321 - DNA, 16 bp, Homo sapiens
aggtgggctgtattca

SEQ ID NO: 892322 - DNA, 18 bp, Homo sapiens
aggtgggcttcagtaagt

SEQ ID NO: 892323 - DNA, 14 bp, Homo sapiens
aggtggggaaggag

SEQ ID NO: 892324 - DNA, 23 bp, Homo sapiens
aggtggggacctggggggaggga

SEQ ID NO: 892325 - DNA, 18 bp, Homo sapiens
aggtggggagactgggct

SEQ ID NO: 892326 - DNA, 19 bp, Homo sapiens
aggtggggagactgggctg

SEQ ID NO: 892327 - DNA, 22 bp, Homo sapiens
aggtggggagggggtttggggg

SEQ ID NO: 892328 - DNA, 12 bp, Homo sapiens
aggttggggaga

SEQ ID NO: 892329 - DNA, 15 bp, Homo sapiens
aggttggtgaagtgt

SEQ ID NO: 892330 - DNA, 14 bp, Homo sapiens
aggttggtgactga

SEQ ID NO: 892331 - DNA, 20 bp, Homo sapiens
aggttggtgactgaaacatt

SEQ ID NO: 892332 - DNA, 15 bp, Homo sapiens
aggttggtttcccct

SEQ ID NO: 892333 - DNA, 16 bp, Homo sapiens
aggttgtctgaagtca

SEQ ID NO: 892334 - DNA, 12 bp, Homo sapiens
aggttgtgcatg

SEQ ID NO: 892335 - DNA, 14 bp, Homo sapiens
aggttgtgcatgtt

SEQ ID NO: 892336 - DNA, 14 bp, Homo sapiens
aggttgtggggagg

SEQ ID NO: 892337 - DNA, 19 bp, Homo sapiens
aggtttaagtagatttcat

SEQ ID NO: 892338 - DNA, 18 bp, Homo sapiens
aggtttacaatttacaaa

SEQ ID NO: 892339 - DNA, 13 bp, Homo sapiens
aggtttcatttct

SEQ ID NO: 892340 - DNA, 15 bp, Homo sapiens
aggtttcatttctta

SEQ ID NO: 892341 - DNA, 16 bp, Homo sapiens
aggtttccattctgca

SEQ ID NO: 892342 - DNA, 15 bp, Homo sapiens
aggtttcctgctcca

SEQ ID NO: 892343 - DNA, 14 bp, Homo sapiens
aggtttctctccct

SEQ ID NO: 892344 - DNA, 13 bp, Homo sapiens
aggtttgcctgtg

SEQ ID NO: 892345 - DNA, 17 bp, Homo sapiens
aggtttggtccagcctg

SEQ ID NO: 892346 - DNA, 22 bp, Homo sapiens
aggtttggtgtgtggagatgca

SEQ ID NO: 892347 - DNA, 20 bp, Homo sapiens
aggtttggtttttttgtaca

SEQ ID NO: 892348 - DNA, 13 bp, Homo sapiens
aggtttgtatatt

SEQ ID NO: 892349 - DNA, 22 bp, Homo sapiens
aggtttgtcccagtcagaaata

SEQ ID NO: 892350 - DNA, 22 bp, Homo sapiens
aggtttgtgagagcgaggctga

SEQ ID NO: 892351 - DNA, 17 bp, Homo sapiens
aggttttaatgtctgtt

SEQ ID NO: 892352 - DNA, 15 bp, Homo sapiens
aggttttattcatat

SEQ ID NO: 892353 - DNA, 20 bp, Homo sapiens
aggttttgaataaaaagtga

SEQ ID NO: 892354 - DNA, 24 bp, Homo sapiens
aggttttgaataaaaagtgaactt

SEQ ID NO: 892355 - DNA, 23 bp, Homo sapiens
aggttttggatcttgaatgtggt

SEQ ID NO: 892356 - DNA, 13 bp, Homo sapiens
aggttttggttat

SEQ ID NO: 892357 - DNA, 15 bp, Homo sapiens
aggttttgtaaagat

SEQ ID NO: 892358 - DNA, 16 bp, Homo sapiens
aggttttgttgtgttc

SEQ ID NO: 892359 - DNA, 17 bp, Homo sapiens
aggttttgttgttttat

SEQ ID NO: 892360 - DNA, 23 bp, Homo sapiens
aggtttttaaacactaaaatata

SEQ ID NO: 892361 - DNA, 13 bp, Homo sapiens
aggtttttattag

SEQ ID NO: 892362 - DNA, 15 bp, Homo sapiens
aggtttttattagta

SEQ ID NO: 892363 - DNA, 19 bp, Homo sapiens
aggtttttgtttgtttcct

SEQ ID NO: 892364 - DNA, 14 bp, Homo sapiens
aggtttttttaatg

SEQ ID NO: 892365 - DNA, 22 bp, Homo sapiens
agtaaaaacactacctcttttg

SEQ ID NO: 892366 - DNA, 17 bp, Homo sapiens
agtaaaaatatgtcatc

SEQ ID NO: 892367 - DNA, 17 bp, Homo sapiens
agtaaaaattaaaaaat

SEQ ID NO: 892368 - DNA, 16 bp, Homo sapiens
agtaaaacattttatt

SEQ ID NO: 892369 - DNA, 13 bp, Homo sapiens
agtaaaagacatt

SEQ ID NO: 892370 - DNA, 22 bp, Homo sapiens
agtaaaagtggtctctgctggg

SEQ ID NO: 892371 - DNA, 16 bp, Homo sapiens
agtaaaataggtcccg

SEQ ID NO: 892372 - DNA, 14 bp, Homo sapiens
agtaaaattcagtt

SEQ ID NO: 892373 - DNA, 13 bp, Homo sapiens
agtaaactggtga

SEQ ID NO: 892374 - DNA, 15 bp, Homo sapiens
agtaaacttgtgtat

SEQ ID NO: 892375 - DNA, 18 bp, Homo sapiens
agtaaacttgtgtattga

SEQ ID NO: 892376 - DNA, 14 bp, Homo sapiens
agtaaactttttgt

SEQ ID NO: 892377 - DNA, 16 bp, Homo sapiens
agtaaagaaagcagaa

SEQ ID NO: 892378 - DNA, 22 bp, Homo sapiens
agtaaagaacgtggtcagagta

SEQ ID NO: 892379 - DNA, 23 bp, Homo sapiens
agtaaaggaaataagagcagtca

SEQ ID NO: 892380 - DNA, 20 bp, Homo sapiens
agtaaaggcctcatctcctt

SEQ ID NO: 892381 - DNA, 15 bp, Homo sapiens
agtaaagtggcaatt

SEQ ID NO: 892382 - DNA, 14 bp, Homo sapiens
agtaaagtttgttg

SEQ ID NO: 892383 - DNA, 15 bp, Homo sapiens
agtaaataattggaa

SEQ ID NO: 892384 - DNA, 21 bp, Homo sapiens
agtaaatatatatgtcaatat

SEQ ID NO: 892385 - DNA, 15 bp, Homo sapiens
agtaaatatattata

SEQ ID NO: 892386 - DNA, 16 bp, Homo sapiens
agtaaatatgtgaaga

SEQ ID NO: 892387 - DNA, 14 bp, Homo sapiens
agtaaatatttcag

SEQ ID NO: 892388 - DNA, 21 bp, Homo sapiens
agtaaatcagaaagtaacaat

SEQ ID NO: 892389 - DNA, 24 bp, Homo sapiens
agtaaatcagaaagtaacaatcta

SEQ ID NO: 892390 - DNA, 21 bp, Homo sapiens
agtaaatcctcatttgaggaa

SEQ ID NO: 892391 - DNA, 17 bp, Homo sapiens
agtaaatctaaagaaat

SEQ ID NO: 892392 - DNA, 15 bp, Homo sapiens
agtaaatcttttaca

SEQ ID NO: 892393 - DNA, 18 bp, Homo sapiens
agtaaatgggggtgcatt

SEQ ID NO: 892394 - DNA, 22 bp, Homo sapiens
agtaaatgttatcttatactgt

SEQ ID NO: 892395 - DNA, 15 bp, Homo sapiens
agtaaattggaaaca

SEQ ID NO: 892396 - DNA, 15 bp, Homo sapiens
agtaacaaaaataaa

SEQ ID NO: 892397 - DNA, 15 bp, Homo sapiens
agtaacaaggtgtct

SEQ ID NO: 892398 - DNA, 15 bp, Homo sapiens
agtaacaatacatga

SEQ ID NO: 892399 - DNA, 13 bp, Homo sapiens
agtaacaatctat

SEQ ID NO: 892400 - DNA, 17 bp, Homo sapiens
agtaacaatctatggct

SEQ ID NO: 892401 - DNA, 16 bp, Homo sapiens
agtaacactaatatat

SEQ ID NO: 892402 - DNA, 13 bp, Homo sapiens
agtaacagacaca

SEQ ID NO: 892403 - DNA, 23 bp, Homo sapiens
agtaacaggaaaccacttatcac

SEQ ID NO: 892404 - DNA, 18 bp, Homo sapiens
agtaacatgcatacttta

SEQ ID NO: 892405 - DNA, 20 bp, Homo sapiens
agtaacatgcatactttatt

SEQ ID NO: 892406 - DNA, 16 bp, Homo sapiens
agtaacatttctgttc

SEQ ID NO: 892407 - DNA, 14 bp, Homo sapiens
agtaaccatttcag

SEQ ID NO: 892408 - DNA, 19 bp, Homo sapiens
agtaacgcgtcttcctgag

SEQ ID NO: 892409 - DNA, 17 bp, Homo sapiens
agtaacgtgctgctcaa

SEQ ID NO: 892410 - DNA, 20 bp, Homo sapiens
agtaactactttttatactc

SEQ ID NO: 892411 - DNA, 19 bp, Homo sapiens
agtaactgccatcaagatg

SEQ ID NO: 892412 - DNA, 17 bp, Homo sapiens
agtaactggttgctgtg

SEQ ID NO: 892413 - DNA, 14 bp, Homo sapiens
agtaactgtgactg

SEQ ID NO: 892414 - DNA, 17 bp, Homo sapiens
agtaactgttttttaag

SEQ ID NO: 892415 - DNA, 14 bp, Homo sapiens
agtaacttaatact

SEQ ID NO: 892416 - DNA, 20 bp, Homo sapiens
agtaactttactctgtgttt

SEQ ID NO: 892417 - DNA, 23 bp, Homo sapiens
agtaactttactctgtgtttaaa

SEQ ID NO: 892418 - DNA, 16 bp, Homo sapiens
agtaactttatgtgta

SEQ ID NO: 892419 - DNA, 19 bp, Homo sapiens
agtaacttttaaaatttgt

SEQ ID NO: 892420 - DNA, 14 bp, Homo sapiens
agtaacttttttgt

SEQ ID NO: 892421 - DNA, 22 bp, Homo sapiens
agtaacttttttgtgtatgtac

SEQ ID NO: 892422 - DNA, 14 bp, Homo sapiens
agtaagaagacatg

SEQ ID NO: 892423 - DNA, 15 bp, Homo sapiens
agtaagaagacatga

SEQ ID NO: 892424 - DNA, 19 bp, Homo sapiens
agtaagagctaagttctaa

SEQ ID NO: 892425 - DNA, 13 bp, Homo sapiens
aacgttttcttct

SEQ ID NO: 892426 - DNA, 14 bp, Homo sapiens
aacgttttcttctt

SEQ ID NO: 892427 - DNA, 19 bp, Homo sapiens
aactaaaaaaaaaaaggcc

SEQ ID NO: 892428 - DNA, 19 bp, Homo sapiens
aactaaaaaaatttttgac

SEQ ID NO: 892429 - DNA, 14 bp, Homo sapiens
aactaaaaataaat

SEQ ID NO: 892430 - DNA, 16 bp, Homo sapiens
aactaaaataaattaa

SEQ ID NO: 892431 - DNA, 17 bp, Homo sapiens
aactaaaataattttgt

SEQ ID NO: 892432 - DNA, 19 bp, Homo sapiens
aactaaaataattttgtaa

SEQ ID NO: 892433 - DNA, 13 bp, Homo sapiens
aactaaaatgtat

SEQ ID NO: 892434 - DNA, 21 bp, Homo sapiens
aactaaacagaaaactcccaa

SEQ ID NO: 892435 - DNA, 19 bp, Homo sapiens
aactaaataaacagatgta

SEQ ID NO: 892436 - DNA, 19 bp, Homo sapiens
aactaaataacacagatat

SEQ ID NO: 892437 - DNA, 13 bp, Homo sapiens
aactaaataatga

SEQ ID NO: 892438 - DNA, 23 bp, Homo sapiens
aactaaataatgaataaactgaa

SEQ ID NO: 892439 - DNA, 15 bp, Homo sapiens
aactaaatatatgtc

SEQ ID NO: 892440 - DNA, 15 bp, Homo sapiens
aactaactgactctg

SEQ ID NO: 892441 - DNA, 22 bp, Homo sapiens
aactaacttttttttttttaac

SEQ ID NO: 892442 - DNA, 15 bp, Homo sapiens
aactaagattctttt

SEQ ID NO: 892443 - DNA, 16 bp, Homo sapiens
aactaagattctttta

SEQ ID NO: 892444 - DNA, 22 bp, Homo sapiens
aactaagattcttttaaattag

SEQ ID NO: 892445 - DNA, 12 bp, Homo sapiens
aactaagccagg

SEQ ID NO: 892446 - DNA, 17 bp, Homo sapiens
aactaagcccccgctgt

SEQ ID NO: 892447 - DNA, 19 bp, Homo sapiens
aactaagcccccgctgtaa

SEQ ID NO: 892448 - DNA, 14 bp, Homo sapiens
aactaaggacaaat

SEQ ID NO: 892449 - DNA, 15 bp, Homo sapiens
aactaaggatttttc

SEQ ID NO: 892450 - DNA, 22 bp, Homo sapiens
aactaagggggtagaagtagtt

SEQ ID NO: 892451 - DNA, 18 bp, Homo sapiens
agtagatcatgcatagag

SEQ ID NO: 892452 - DNA, 18 bp, Homo sapiens
agtagattaaaaattata

SEQ ID NO: 892453 - DNA, 20 bp, Homo sapiens
agtagatttacagaacaaag

SEQ ID NO: 892454 - DNA, 15 bp, Homo sapiens
agtagcaatgtgcct

SEQ ID NO: 892455 - DNA, 18 bp, Homo sapiens
agtagcaccctggattga

SEQ ID NO: 892456 - DNA, 22 bp, Homo sapiens
agtagcagtgattgtcttaata

SEQ ID NO: 892457 - DNA, 23 bp, Homo sapiens
agtagcatgagagaattgtatca

SEQ ID NO: 892458 - DNA, 15 bp, Homo sapiens
agtagccaagttata

SEQ ID NO: 892459 - DNA, 22 bp, Homo sapiens
agtagccagggtgtggccctgc

SEQ ID NO: 892460 - DNA, 23 bp, Homo sapiens
agtagccagggtgtggccctgcc

SEQ ID NO: 892461 - DNA, 22 bp, Homo sapiens
agtagcccctaatcacatgtgc

SEQ ID NO: 892462 - DNA, 21 bp, Homo sapiens
agtagcccttcagtcttaata

SEQ ID NO: 892463 - DNA, 17 bp, Homo sapiens
agtagccctttctgtgt

SEQ ID NO: 892464 - DNA, 19 bp, Homo sapiens
agtagccgagagcctgctc

SEQ ID NO: 892465 - DNA, 13 bp, Homo sapiens
agtagctgggatt

SEQ ID NO: 892466 - DNA, 18 bp, Homo sapiens
agtagctgggcctgtgca

SEQ ID NO: 892467 - DNA, 19 bp, Homo sapiens
agtagctgggcctgtgcac

SEQ ID NO: 892468 - DNA, 14 bp, Homo sapiens
agtagctttccaca

SEQ ID NO: 892469 - DNA, 15 bp, Homo sapiens
agtagctttccacat

SEQ ID NO: 892470 - DNA, 20 bp, Homo sapiens
agtagctttccacatttgtc

SEQ ID NO: 892471 - DNA, 20 bp, Homo sapiens
agtagctttgctttgcagtc

SEQ ID NO: 892472 - DNA, 21 bp, Homo sapiens
agtagctttggaaaggtgccc

SEQ ID NO: 892473 - DNA, 14 bp, Homo sapiens
agtaggattgctgt

SEQ ID NO: 892474 - DNA, 23 bp, Homo sapiens
agtaggatttatgtattttgaaa

SEQ ID NO: 892475 - DNA, 18 bp, Homo sapiens
agtaggcatatatcacta

SEQ ID NO: 892476 - DNA, 13 bp, Homo sapiens
agtaggtccaagg

SEQ ID NO: 892477 - DNA, 17 bp, Homo sapiens
agtaggtccaagggcca

SEQ ID NO: 892478 - DNA, 17 bp, Homo sapiens
agtaggtctgggatgga

SEQ ID NO: 892479 - DNA, 16 bp, Homo sapiens
agtaggtggcttgagc

SEQ ID NO: 892480 - DNA, 20 bp, Homo sapiens
agtagtcaaaaacaaagctg

SEQ ID NO: 892481 - DNA, 12 bp, Homo sapiens
agtagtcctgtg

SEQ ID NO: 892482 - DNA, 23 bp, Homo sapiens
agtagtcttatgtaaagtatgtt

SEQ ID NO: 892483 - DNA, 23 bp, Homo sapiens
agtagtgtacattaccatataat

SEQ ID NO: 892484 - DNA, 20 bp, Homo sapiens
agtagtgtctggatcagtaa

SEQ ID NO: 892485 - DNA, 14 bp, Homo sapiens
agtagttagaacta

SEQ ID NO: 892486 - DNA, 18 bp, Homo sapiens
agtagttatataattgtt

SEQ ID NO: 892487 - DNA, 18 bp, Homo sapiens
agtagttcctattttcta

SEQ ID NO: 892488 - DNA, 14 bp, Homo sapiens
agtagttcctgcta

SEQ ID NO: 892489 - DNA, 13 bp, Homo sapiens
agtagttggtttg

SEQ ID NO: 892490 - DNA, 16 bp, Homo sapiens
agtagttggtttgtat

SEQ ID NO: 892491 - DNA, 19 bp, Homo sapiens
agtagttggtttgtatgag

SEQ ID NO: 892492 - DNA, 21 bp, Homo sapiens
agtagttgtattcttctgtat

SEQ ID NO: 892493 - DNA, 21 bp, Homo sapiens
agtagtttcatgtaaagaaaa

SEQ ID NO: 892494 - DNA, 17 bp, Homo sapiens
agtagtttgtataactt

SEQ ID NO: 892495 - DNA, 16 bp, Homo sapiens
agtagttttcaaaaca

SEQ ID NO: 892496 - DNA, 14 bp, Homo sapiens
agtagtttttacaa

SEQ ID NO: 892497 - DNA, 13 bp, Homo sapiens
agtataaaaacaa

SEQ ID NO: 892498 - DNA, 15 bp, Homo sapiens
agtataaaaacttga

SEQ ID NO: 892499 - DNA, 13 bp, Homo sapiens
agtataaacaaag

SEQ ID NO: 892500 - DNA, 19 bp, Homo sapiens
agtataaagtcacttccag

SEQ ID NO: 892501 - DNA, 18 bp, Homo sapiens
agtataaatggttgtctg

SEQ ID NO: 892502 - DNA, 19 bp, Homo sapiens
agtataagactactgaatc

SEQ ID NO: 892503 - DNA, 13 bp, Homo sapiens
agtataatatttc

SEQ ID NO: 892504 - DNA, 20 bp, Homo sapiens
agtataatctcctctgctca

SEQ ID NO: 892505 - DNA, 16 bp, Homo sapiens
agtatacaacaggaga

SEQ ID NO: 892506 - DNA, 14 bp, Homo sapiens
agtatacctggctt

SEQ ID NO: 892507 - DNA, 15 bp, Homo sapiens
agtatacctggcttt

SEQ ID NO: 892508 - DNA, 21 bp, Homo sapiens
agtatacctggctttttaaaa

SEQ ID NO: 892509 - DNA, 21 bp, Homo sapiens
agtatacgtataaatatcagt

SEQ ID NO: 892510 - DNA, 22 bp, Homo sapiens
agtatacgtataaatatcagta

SEQ ID NO: 892511 - DNA, 14 bp, Homo sapiens
agtatactgtgtgg

SEQ ID NO: 892512 - DNA, 22 bp, Homo sapiens
agtatactgtgtgggatactta

SEQ ID NO: 892513 - DNA, 12 bp, Homo sapiens
agtatagaatag

SEQ ID NO: 892514 - DNA, 17 bp, Homo sapiens
agtatatagtatattta

SEQ ID NO: 892515 - DNA, 16 bp, Homo sapiens
agtatatctggacaag

SEQ ID NO: 892516 - DNA, 18 bp, Homo sapiens
agtatatctggacaagcc

SEQ ID NO: 892517 - DNA, 13 bp, Homo sapiens
agtatatgtcttg

SEQ ID NO: 892518 - DNA, 15 bp, Homo sapiens
agtatattatgtatt

SEQ ID NO: 892519 - DNA, 18 bp, Homo sapiens
agtatattcttattggaa

SEQ ID NO: 892520 - DNA, 18 bp, Homo sapiens
agtatattgttgaagaga

SEQ ID NO: 892521 - DNA, 15 bp, Homo sapiens
agtatatttaaactc

SEQ ID NO: 892522 - DNA, 23 bp, Homo sapiens
agtatatttaattttgacataag

SEQ ID NO: 892523 - DNA, 18 bp, Homo sapiens
agtatatttatagtcaca

SEQ ID NO: 892524 - DNA, 19 bp, Homo sapiens
agtatattttcttttcctc

SEQ ID NO: 892525 - DNA, 23 bp, Homo sapiens
agtatatttttgtctgcagctgt

SEQ ID NO: 892526 - DNA, 15 bp, Homo sapiens
agtatcacttttctg

SEQ ID NO: 892527 - DNA, 13 bp, Homo sapiens
agtatcagaacaa

SEQ ID NO: 892528 - DNA, 11 bp, Homo sapiens
agtatcatgca

SEQ ID NO: 892529 - DNA, 15 bp, Homo sapiens
agtatccacaggata

SEQ ID NO: 892530 - DNA, 18 bp, Homo sapiens
agtatcccacatccaact

SEQ ID NO: 892531 - DNA, 23 bp, Homo sapiens
agtatcccttatccaaaatgctt

SEQ ID NO: 892532 - DNA, 15 bp, Homo sapiens
agtatccttccttca

SEQ ID NO: 892533 - DNA, 17 bp, Homo sapiens
agtatctaacaaaacca

SEQ ID NO: 892534 - DNA, 17 bp, Homo sapiens
agtatctatatatgtgt

SEQ ID NO: 892535 - DNA, 19 bp, Homo sapiens
agtatctgggattattctt

SEQ ID NO: 892536 - DNA, 21 bp, Homo sapiens
agtatctgggattattctttg

SEQ ID NO: 892537 - DNA, 12 bp, Homo sapiens
agtatctgtaac

SEQ ID NO: 892538 - DNA, 19 bp, Homo sapiens
agtatctgtaacccttgaa

SEQ ID NO: 892539 - DNA, 21 bp, Homo sapiens
agtatcttacctgtaaagtct

SEQ ID NO: 892540 - DNA, 15 bp, Homo sapiens
agtatcttagagttt

SEQ ID NO: 892541 - DNA, 22 bp, Homo sapiens
agtatcttagagtttacagttt

SEQ ID NO: 892542 - DNA, 15 bp, Homo sapiens
agtatcttgggtgta

SEQ ID NO: 892543 - DNA, 13 bp, Homo sapiens
agtatcttgtgct

SEQ ID NO: 892544 - DNA, 12 bp, Homo sapiens
agtatcttttga

SEQ ID NO: 892545 - DNA, 14 bp, Homo sapiens
agtatgaacttgag

SEQ ID NO: 892546 - DNA, 18 bp, Homo sapiens
agtatgaacttgagatct

SEQ ID NO: 892547 - DNA, 18 bp, Homo sapiens
agtatgaatctatgccaa

SEQ ID NO: 892548 - DNA, 15 bp, Homo sapiens
agtatgaggcatttg

SEQ ID NO: 892549 - DNA, 23 bp, Homo sapiens
agtatgaggcatttgtttgaact

SEQ ID NO: 892550 - DNA, 19 bp, Homo sapiens
agtatgcagttgataagag

SEQ ID NO: 892551 - DNA, 15 bp, Homo sapiens
agtatgccttaagca

SEQ ID NO: 892552 - DNA, 22 bp, Homo sapiens
agtatgccttaagcagaacaaa

SEQ ID NO: 892553 - DNA, 19 bp, Homo sapiens
agtatgctttccctgagga

SEQ ID NO: 892554 - DNA, 15 bp, Homo sapiens
agtatggaatattca

SEQ ID NO: 892555 - DNA, 19 bp, Homo sapiens
agtatgggggttgtaaatt

SEQ ID NO: 892556 - DNA, 19 bp, Homo sapiens
agtatggtaggggagggca

SEQ ID NO: 892557 - DNA, 15 bp, Homo sapiens
agtatgtaaagtatg

SEQ ID NO: 892558 - DNA, 23 bp, Homo sapiens
aactgatcatgtttatgagaaac

SEQ ID NO: 892559 - DNA, 21 bp, Homo sapiens
aactgatccagtataagacta

SEQ ID NO: 892560 - DNA, 23 bp, Homo sapiens
aactgatgagtaaactgaggccc

SEQ ID NO: 892561 - DNA, 18 bp, Homo sapiens
aactgatgttactagcct

SEQ ID NO: 892562 - DNA, 13 bp, Homo sapiens
aactgatttcttc

SEQ ID NO: 892563 - DNA, 16 bp, Homo sapiens
aactgatttcttcaga

SEQ ID NO: 892564 - DNA, 18 bp, Homo sapiens
aactgattttgtatgtaa

SEQ ID NO: 892565 - DNA, 17 bp, Homo sapiens
aactgcaaaaaaagcct

SEQ ID NO: 892566 - DNA, 18 bp, Homo sapiens
aactgcaaaaaaagcctc

SEQ ID NO: 892567 - DNA, 21 bp, Homo sapiens
aactgcaaaaaaagcctccaa

SEQ ID NO: 892568 - DNA, 14 bp, Homo sapiens
aactgcaaacagaa

SEQ ID NO: 892569 - DNA, 14 bp, Homo sapiens
aactgcaaagcttt

SEQ ID NO: 892570 - DNA, 15 bp, Homo sapiens
aactgcaacactgga

SEQ ID NO: 892571 - DNA, 17 bp, Homo sapiens
aactgcaaccttgttta

SEQ ID NO: 892572 - DNA, 19 bp, Homo sapiens
aactgcaataatatcaaaa

SEQ ID NO: 892573 - DNA, 18 bp, Homo sapiens
aactgttcccacctgctg

SEQ ID NO: 892574 - DNA, 21 bp, Homo sapiens
aactgttcttttgcaataata

SEQ ID NO: 892575 - DNA, 16 bp, Homo sapiens
aactgttcttttgcat

SEQ ID NO: 892576 - DNA, 15 bp, Homo sapiens
aactgttgtataaat

SEQ ID NO: 892577 - DNA, 22 bp, Homo sapiens
aactgtttggtcgagtctttgt

SEQ ID NO: 892578 - DNA, 23 bp, Homo sapiens
aactgtttggtcgagtctttgtg

SEQ ID NO: 892579 - DNA, 18 bp, Homo sapiens
aacttaaaaatgtaaata

SEQ ID NO: 892580 - DNA, 19 bp, Homo sapiens
aacttaaaaccttgaaggt

SEQ ID NO: 892581 - DNA, 16 bp, Homo sapiens
aacttaaaatatttta

SEQ ID NO: 892582 - DNA, 13 bp, Homo sapiens
aacttaaagcaaa

SEQ ID NO: 892583 - DNA, 16 bp, Homo sapiens
aacttaaagcaaaata

SEQ ID NO: 892584 - DNA, 19 bp, Homo sapiens
aacttaaagcaaaatagta

SEQ ID NO: 892585 - DNA, 22 bp, Homo sapiens
aacttaaagcaaaatagtattg

SEQ ID NO: 892586 - DNA, 14 bp, Homo sapiens
aacttaaataataa

SEQ ID NO: 892587 - DNA, 17 bp, Homo sapiens
aacttaaataatgtgaa

SEQ ID NO: 892588 - DNA, 18 bp, Homo sapiens
aacttaaatgcccccctc

SEQ ID NO: 892589 - DNA, 19 bp, Homo sapiens
aacttaaatgttattatct

SEQ ID NO: 892590 - DNA, 15 bp, Homo sapiens
aacttaacatgggct

SEQ ID NO: 892591 - DNA, 17 bp, Homo sapiens
aacttaacattctgtaa

SEQ ID NO: 892592 - DNA, 21 bp, Homo sapiens
aacttaacattctgtaaaatg

SEQ ID NO: 892593 - DNA, 16 bp, Homo sapiens
aacttaactgaagaaa

SEQ ID NO: 892594 - DNA, 20 bp, Homo sapiens
aacttaagggcaaggagttt

SEQ ID NO: 892595 - DNA, 13 bp, Homo sapiens
aacttacacacaa

SEQ ID NO: 892596 - DNA, 21 bp, Homo sapiens
aacttacattgttcaattaga

SEQ ID NO: 892597 - DNA, 20 bp, Homo sapiens
aacttacggatttattatat

SEQ ID NO: 892598 - DNA, 13 bp, Homo sapiens
aacttactgtata

SEQ ID NO: 892599 - DNA, 19 bp, Homo sapiens
aacttactgtatatgtatt

SEQ ID NO: 892600 - DNA, 14 bp, Homo sapiens
aacttactgtccac

SEQ ID NO: 892601 - DNA, 22 bp, Homo sapiens
aacttactgtccaccagtttat

SEQ ID NO: 892602 - DNA, 14 bp, Homo sapiens
aacttacttagtgt

SEQ ID NO: 892603 - DNA, 20 bp, Homo sapiens
aacttagactctagtattta

SEQ ID NO: 892604 - DNA, 14 bp, Homo sapiens
aacttagaggaaaa

SEQ ID NO: 892605 - DNA, 20 bp, Homo sapiens
aacttagatcatcagtcacc

SEQ ID NO: 892606 - DNA, 16 bp, Homo sapiens
aacttagcatgtgttg

SEQ ID NO: 892607 - DNA, 19 bp, Homo sapiens
aacttagccagagttaggt

SEQ ID NO: 892608 - DNA, 20 bp, Homo sapiens
aacttagtgacaaaatagac

SEQ ID NO: 892609 - DNA, 21 bp, Homo sapiens
aacttatagttaatattttgt

SEQ ID NO: 892610 - DNA, 23 bp, Homo sapiens
aacttatattaatagtaatttgt

SEQ ID NO: 892611 - DNA, 19 bp, Homo sapiens
aacttatattgtaagaaat

SEQ ID NO: 892612 - DNA, 19 bp, Homo sapiens
aacttatcctaaaacaaat

SEQ ID NO: 892613 - DNA, 12 bp, Homo sapiens
aacttatgtttt

SEQ ID NO: 892614 - DNA, 15 bp, Homo sapiens
aacttattagaaacc

SEQ ID NO: 892615 - DNA, 14 bp, Homo sapiens
aacttattctgtag

SEQ ID NO: 892616 - DNA, 13 bp, Homo sapiens
aacttcacatatt

SEQ ID NO: 892617 - DNA, 14 bp, Homo sapiens
aacttcacatattg

SEQ ID NO: 892618 - DNA, 16 bp, Homo sapiens
aacttcacatttatgt

SEQ ID NO: 892619 - DNA, 15 bp, Homo sapiens
aacttcaccaccccc

SEQ ID NO: 892620 - DNA, 23 bp, Homo sapiens
aacttcaccaccccctgtcccat

SEQ ID NO: 892621 - DNA, 15 bp, Homo sapiens
aacttcagacacaaa

SEQ ID NO: 892622 - DNA, 22 bp, Homo sapiens
aacttcagttttatttttgcca

SEQ ID NO: 892623 - DNA, 23 bp, Homo sapiens
aacttcagttttatttttgccaa

SEQ ID NO: 892624 - DNA, 20 bp, Homo sapiens
aacttcatatatgaggactt

SEQ ID NO: 892625 - DNA, 12 bp, Homo sapiens
aacttcatggat

SEQ ID NO: 892626 - DNA, 12 bp, Homo sapiens
aacttcattctc

SEQ ID NO: 892627 - DNA, 21 bp, Homo sapiens
aacttcatttgacacaaagct

SEQ ID NO: 892628 - DNA, 14 bp, Homo sapiens
aacttcatttgatg

SEQ ID NO: 892629 - DNA, 13 bp, Homo sapiens
aacttcattttta

SEQ ID NO: 892630 - DNA, 13 bp, Homo sapiens
aacttccaaagaa

SEQ ID NO: 892631 - DNA, 23 bp, Homo sapiens
aacttccaaataaataattttca

SEQ ID NO: 892632 - DNA, 24 bp, Homo sapiens
aacttccactaatccattatcctt

SEQ ID NO: 892633 - DNA, 22 bp, Homo sapiens
aacttccaggtgttactgtaat

SEQ ID NO: 892634 - DNA, 22 bp, Homo sapiens
aacttcccacacggcagccccc

SEQ ID NO: 892635 - DNA, 18 bp, Homo sapiens
aacttcccatctggctca

SEQ ID NO: 892636 - DNA, 17 bp, Homo sapiens
aacttccccatcttcta

SEQ ID NO: 892637 - DNA, 22 bp, Homo sapiens
aacttcccgtcccatatcctgc

SEQ ID NO: 892638 - DNA, 11 bp, Homo sapiens
aacttccctga

SEQ ID NO: 892639 - DNA, 17 bp, Homo sapiens
aacttcctgctgcaccc

SEQ ID NO: 892640 - DNA, 21 bp, Homo sapiens
aacttcctgctgcaccctgcg

SEQ ID NO: 892641 - DNA, 23 bp, Homo sapiens
aacttccttattgggacttttct

SEQ ID NO: 892642 - DNA, 12 bp, Homo sapiens
aacttcctttat

SEQ ID NO: 892643 - DNA, 20 bp, Homo sapiens
aacttcgaaagcatcattat

SEQ ID NO: 892644 - DNA, 14 bp, Homo sapiens
aacttctaatatat

SEQ ID NO: 892645 - DNA, 18 bp, Homo sapiens
aacttctatattttaata

SEQ ID NO: 892646 - DNA, 22 bp, Homo sapiens
aacttctatattttaatagaaa

SEQ ID NO: 892647 - DNA, 22 bp, Homo sapiens
aacttctatgttggtttcagtg

SEQ ID NO: 892648 - DNA, 13 bp, Homo sapiens
aacttctcccacc

SEQ ID NO: 892649 - DNA, 15 bp, Homo sapiens
aacttctcccacccc

SEQ ID NO: 892650 - DNA, 16 bp, Homo sapiens
aacttctcccacccct

SEQ ID NO: 892651 - DNA, 18 bp, Homo sapiens
aacttctcctgaatgcat

SEQ ID NO: 892652 - DNA, 19 bp, Homo sapiens
aacttcttacccgaaagca

SEQ ID NO: 892653 - DNA, 15 bp, Homo sapiens
aacttcttatggaat

SEQ ID NO: 892654 - DNA, 16 bp, Homo sapiens
aacttcttatggaatt

SEQ ID NO: 892655 - DNA, 21 bp, Homo sapiens
aacttcttctccatccctcta

SEQ ID NO: 892656 - DNA, 17 bp, Homo sapiens
aacttcttgaaaaagat

SEQ ID NO: 892657 - DNA, 12 bp, Homo sapiens
aacttcttgctt

SEQ ID NO: 892658 - DNA, 18 bp, Homo sapiens
aacttcttgcttctttct

SEQ ID NO: 892659 - DNA, 20 bp, Homo sapiens
aacttcttgcttctttctag

SEQ ID NO: 892660 - DNA, 12 bp, Homo sapiens
aacttgaaaatt

SEQ ID NO: 892661 - DNA, 24 bp, Homo sapiens
aacttgaaacagattcaggccagc

SEQ ID NO: 892662 - DNA, 22 bp, Homo sapiens
aacttgaaggattgcatcctgc

SEQ ID NO: 892663 - DNA, 15 bp, Homo sapiens
aacttgagatgtatg

SEQ ID NO: 892664 - DNA, 23 bp, Homo sapiens
aacttgagcctgtgaccttggga

SEQ ID NO: 892665 - DNA, 19 bp, Homo sapiens
aacttgagcgtgaatctgt

SEQ ID NO: 892666 - DNA, 12 bp, Homo sapiens
aacttgatatag

SEQ ID NO: 892667 - DNA, 19 bp, Homo sapiens
aacttgatgttccacctgc

SEQ ID NO: 892668 - DNA, 23 bp, Homo sapiens
aacttgatgttccacctgccaca

SEQ ID NO: 892669 - DNA, 20 bp, Homo sapiens
aacttgcaaaaagtagactt

SEQ ID NO: 892670 - DNA, 22 bp, Homo sapiens
aacttgcacttgttatattata

SEQ ID NO: 892671 - DNA, 15 bp, Homo sapiens
aacttgcatggagca

SEQ ID NO: 892672 - DNA, 22 bp, Homo sapiens
aacttgcattctggcataattt

SEQ ID NO: 892673 - DNA, 22 bp, Homo sapiens
aacttgcctggggtctgagcat

SEQ ID NO: 892674 - DNA, 16 bp, Homo sapiens
aacttgctgaatttca

SEQ ID NO: 892675 - DNA, 20 bp, Homo sapiens
aacttgcttaaatttcttat

SEQ ID NO: 892676 - DNA, 16 bp, Homo sapiens
aacttggatggacttg

SEQ ID NO: 892677 - DNA, 14 bp, Homo sapiens
aacttggcatttct

SEQ ID NO: 892678 - DNA, 15 bp, Homo sapiens
aacttggcatttcta

SEQ ID NO: 892679 - DNA, 23 bp, Homo sapiens
aacttggccctcttgcgggcctg

SEQ ID NO: 892680 - DNA, 23 bp, Homo sapiens
aacttggctcgaatctctgtgcc

SEQ ID NO: 892681 - DNA, 15 bp, Homo sapiens
aacttggctggaatt

SEQ ID NO: 892682 - DNA, 16 bp, Homo sapiens
aacttgggcacatgct

SEQ ID NO: 892683 - DNA, 15 bp, Homo sapiens
aacttgtaaatgctg

SEQ ID NO: 892684 - DNA, 18 bp, Homo sapiens
aacttgtaatcttcccca

SEQ ID NO: 892685 - DNA, 14 bp, Homo sapiens
aacttgtagcagct

SEQ ID NO: 892686 - DNA, 15 bp, Homo sapiens
aacttgtatattcca

SEQ ID NO: 892687 - DNA, 21 bp, Homo sapiens
aacttgtctgggaattgtgtg

SEQ ID NO: 892688 - DNA, 23 bp, Homo sapiens
agtcacctttctgggctttctcc

SEQ ID NO: 892689 - DNA, 13 bp, Homo sapiens
agtcaccttttct

SEQ ID NO: 892690 - DNA, 20 bp, Homo sapiens
agtcaccttttctgtggctg

SEQ ID NO: 892691 - DNA, 22 bp, Homo sapiens
agtcaccttttctgtggctggc

SEQ ID NO: 892692 - DNA, 18 bp, Homo sapiens
agtcacgcatgcagtgtt

SEQ ID NO: 892693 - DNA, 20 bp, Homo sapiens
agtcacggctgcgcactgtg

SEQ ID NO: 892694 - DNA, 21 bp, Homo sapiens
agtcgtggctttggcagtgtt

SEQ ID NO: 892695 - DNA, 12 bp, Homo sapiens
agtcgttatttc

SEQ ID NO: 892696 - DNA, 20 bp, Homo sapiens
aagaaagaatgttactgcct

SEQ ID NO: 892697 - DNA, 22 bp, Homo sapiens
aagaaagactatctaaatgttg

SEQ ID NO: 892698 - DNA, 9 bp, Homo sapiens
aagaaagag

SEQ ID NO: 892699 - DNA, 18 bp, Homo sapiens
aagaaagagggaaaaaga

SEQ ID NO: 892700 - DNA, 21 bp, Homo sapiens
aagaaagatttgttactgtat

SEQ ID NO: 892701 - DNA, 20 bp, Homo sapiens
aagaaagcacctgtttttac

SEQ ID NO: 892702 - DNA, 13 bp, Homo sapiens
aagaaagcagaat

SEQ ID NO: 892703 - DNA, 19 bp, Homo sapiens
aagaaagccaccttgttac

SEQ ID NO: 892704 - DNA, 19 bp, Homo sapiens
aagaaaggggacccaagaa

SEQ ID NO: 892705 - DNA, 16 bp, Homo sapiens
aagaaagggtgttttt

SEQ ID NO: 892706 - DNA, 17 bp, Homo sapiens
aagaaataaaccaaagg

SEQ ID NO: 892707 - DNA, 13 bp, Homo sapiens
aagaaataaatca

SEQ ID NO: 892708 - DNA, 14 bp, Homo sapiens
aagaaataaatcag

SEQ ID NO: 892709 - DNA, 15 bp, Homo sapiens
aagaaatagaacaag

SEQ ID NO: 892710 - DNA, 20 bp, Homo sapiens
aagaaatagaacaaggctga

SEQ ID NO: 892711 - DNA, 12 bp, Homo sapiens
aagaaatagaat

SEQ ID NO: 892712 - DNA, 13 bp, Homo sapiens
aagaaatagcaga

SEQ ID NO: 892713 - DNA, 15 bp, Homo sapiens
aagaaatatattatt

SEQ ID NO: 892714 - DNA, 21 bp, Homo sapiens
aagaaatatgaaattccagca

SEQ ID NO: 892715 - DNA, 17 bp, Homo sapiens
aagaaatatttacctaa

SEQ ID NO: 892716 - DNA, 18 bp, Homo sapiens
aagaaatcacagaatcat

SEQ ID NO: 892717 - DNA, 13 bp, Homo sapiens
aagaaatccctgt

SEQ ID NO: 892718 - DNA, 23 bp, Homo sapiens
aagaaatccctgtttaatattta

SEQ ID NO: 892719 - DNA, 12 bp, Homo sapiens
aagaaatctgtt

SEQ ID NO: 892720 - DNA, 19 bp, Homo sapiens
aagaaatcttgtcttacca

SEQ ID NO: 892721 - DNA, 11 bp, Homo sapiens
aagaaatgatt

SEQ ID NO: 892722 - DNA, 23 bp, Homo sapiens
aagaaatgattcaaattgctgct

SEQ ID NO: 892723 - DNA, 16 bp, Homo sapiens
aagaaatgcaaaaatc

SEQ ID NO: 892724 - DNA, 18 bp, Homo sapiens
aagaaatggcgtctgctc

SEQ ID NO: 892725 - DNA, 21 bp, Homo sapiens
aagaaatggcgtctgctctgg

SEQ ID NO: 892726 - DNA, 22 bp, Homo sapiens
aagaaatggcgtctgctctggt

SEQ ID NO: 892727 - DNA, 20 bp, Homo sapiens
aagaaatggctatgaacaga

SEQ ID NO: 892728 - DNA, 21 bp, Homo sapiens
aagaaattccatacttctctc

SEQ ID NO: 892729 - DNA, 22 bp, Homo sapiens
aagaaattccatacttctctca

SEQ ID NO: 892730 - DNA, 15 bp, Homo sapiens
aagaaatttcacata

SEQ ID NO: 892731 - DNA, 12 bp, Homo sapiens
aagaacaaagct

SEQ ID NO: 892732 - DNA, 14 bp, Homo sapiens
aagaacacgaaata

SEQ ID NO: 892733 - DNA, 12 bp, Homo sapiens
aagaacagatgg

SEQ ID NO: 892734 - DNA, 12 bp, Homo sapiens
aagaacatagaa

SEQ ID NO: 892735 - DNA, 16 bp, Homo sapiens
aagaacatagaactct

SEQ ID NO: 892736 - DNA, 19 bp, Homo sapiens
aagaacatggacttgtata

SEQ ID NO: 892737 - DNA, 11 bp, Homo sapiens
aagaaccaaaa

SEQ ID NO: 892738 - DNA, 12 bp, Homo sapiens
aagaaccaaaaa

SEQ ID NO: 892739 - DNA, 14 bp, Homo sapiens
aagaaccaaaactt

SEQ ID NO: 892740 - DNA, 19 bp, Homo sapiens
aagaaccttaatgacaaca

SEQ ID NO: 892741 - DNA, 20 bp, Homo sapiens
aagaactccttattttgtat

SEQ ID NO: 892742 - DNA, 14 bp, Homo sapiens
aagaactgcacttt

SEQ ID NO: 892743 - DNA, 23 bp, Homo sapiens
aagaactgcaggccctggcctcc

SEQ ID NO: 892744 - DNA, 23 bp, Homo sapiens
aagaactgcatggacctaacatt

SEQ ID NO: 892745 - DNA, 13 bp, Homo sapiens
aagaactgcatgt

SEQ ID NO: 892746 - DNA, 12 bp, Homo sapiens
aagaactgcttt

SEQ ID NO: 892747 - DNA, 12 bp, Homo sapiens
aagaactgtgtc

SEQ ID NO: 892748 - DNA, 20 bp, Homo sapiens
aagaactgtgtttcaagttc

SEQ ID NO: 892749 - DNA, 15 bp, Homo sapiens
aagaacttaagtctc

SEQ ID NO: 892750 - DNA, 13 bp, Homo sapiens
aagaacttcattt

SEQ ID NO: 892751 - DNA, 17 bp, Homo sapiens
aagaacttcatttttaa

SEQ ID NO: 892752 - DNA, 17 bp, Homo sapiens
aagaacttgatttgcat

SEQ ID NO: 892753 - DNA, 18 bp, Homo sapiens
aagaacttgatttgcatg

SEQ ID NO: 892754 - DNA, 12 bp, Homo sapiens
aagaagaaaaag

SEQ ID NO: 892755 - DNA, 14 bp, Homo sapiens
aagaagaaaaaggt

SEQ ID NO: 892756 - DNA, 23 bp, Homo sapiens
aagaagaaactccgaagaaaaga

SEQ ID NO: 892757 - DNA, 19 bp, Homo sapiens
aagaagaaatatgaaattc

SEQ ID NO: 892758 - DNA, 19 bp, Homo sapiens
aagaagacaaactttgcat

SEQ ID NO: 892759 - DNA, 12 bp, Homo sapiens
aagaagacatga

SEQ ID NO: 892760 - DNA, 17 bp, Homo sapiens
aagaagacatggagact

SEQ ID NO: 892761 - DNA, 11 bp, Homo sapiens
aagaagacatt

SEQ ID NO: 892762 - DNA, 12 bp, Homo sapiens
aagaagacattt

SEQ ID NO: 892763 - DNA, 14 bp, Homo sapiens
aagaagacattttg

SEQ ID NO: 892764 - DNA, 20 bp, Homo sapiens
aagaagacctgagaatgtat

SEQ ID NO: 892765 - DNA, 17 bp, Homo sapiens
aagaagagaagctgctg

SEQ ID NO: 892766 - DNA, 14 bp, Homo sapiens
aagaagagacagga

SEQ ID NO: 892767 - DNA, 12 bp, Homo sapiens
aagaagagatgc

SEQ ID NO: 892768 - DNA, 22 bp, Homo sapiens
aagaagagcgagagatcaaaga

SEQ ID NO: 892769 - DNA, 20 bp, Homo sapiens
aagaagagctatcaggagaa

SEQ ID NO: 892770 - DNA, 22 bp, Homo sapiens
aagaagcagtggccttattgca

SEQ ID NO: 892771 - DNA, 23 bp, Homo sapiens
aagaagccatatatgaccagaag

SEQ ID NO: 892772 - DNA, 19 bp, Homo sapiens
aagaagcccagtggtgagg

SEQ ID NO: 892773 - DNA, 23 bp, Homo sapiens
aagaagcccagtggtgaggaaag

SEQ ID NO: 892774 - DNA, 18 bp, Homo sapiens
aagaagccctgcagagca

SEQ ID NO: 892775 - DNA, 16 bp, Homo sapiens
aagaagccttaatttg

SEQ ID NO: 892776 - DNA, 19 bp, Homo sapiens
aagaagccttaatttgcac

SEQ ID NO: 892777 - DNA, 22 bp, Homo sapiens
aagaagccttaatttgcacagt

SEQ ID NO: 892778 - DNA, 19 bp, Homo sapiens
aagaagctctccaggcccc

SEQ ID NO: 892779 - DNA, 15 bp, Homo sapiens
aagaagctctctcct

SEQ ID NO: 892780 - DNA, 19 bp, Homo sapiens
aagaaggcaaaaatagttt

SEQ ID NO: 892781 - DNA, 15 bp, Homo sapiens
aagaaggcaatatta

SEQ ID NO: 892782 - DNA, 13 bp, Homo sapiens
aagaaggcaattt

SEQ ID NO: 892783 - DNA, 23 bp, Homo sapiens
aagaaggcaattttagtgtatta

SEQ ID NO: 892784 - DNA, 16 bp, Homo sapiens
aagaagggactgagag

SEQ ID NO: 892785 - DNA, 14 bp, Homo sapiens
aagaagggagaaga

SEQ ID NO: 892786 - DNA, 21 bp, Homo sapiens
aagaagggctgcatgatgttt

SEQ ID NO: 892787 - DNA, 17 bp, Homo sapiens
aagaaggtatttttcca

SEQ ID NO: 892788 - DNA, 18 bp, Homo sapiens
aagaaggtttgtgttttt

SEQ ID NO: 892789 - DNA, 15 bp, Homo sapiens
aagaagtattaaaaa

SEQ ID NO: 892790 - DNA, 20 bp, Homo sapiens
aagaagtatttttagaataa

SEQ ID NO: 892791 - DNA, 15 bp, Homo sapiens
aagaagtggagacag

SEQ ID NO: 892792 - DNA, 16 bp, Homo sapiens
aagaagtggagacagt

SEQ ID NO: 892793 - DNA, 19 bp, Homo sapiens
aagaagtggagacagtcct

SEQ ID NO: 892794 - DNA, 13 bp, Homo sapiens
aagaagtgggagc

SEQ ID NO: 892795 - DNA, 19 bp, Homo sapiens
aagaagtgtccgagaacta

SEQ ID NO: 892796 - DNA, 16 bp, Homo sapiens
aagaagttattttctt

SEQ ID NO: 892797 - DNA, 19 bp, Homo sapiens
aagaagtttattctcattt

SEQ ID NO: 892798 - DNA, 14 bp, Homo sapiens
aagaagttttatgc

SEQ ID NO: 892799 - DNA, 23 bp, Homo sapiens
aagaagttttttactttggttta

SEQ ID NO: 892800 - DNA, 21 bp, Homo sapiens
aagaataaaatgttgaaaagt

SEQ ID NO: 892801 - DNA, 12 bp, Homo sapiens
aagaataaagtc

SEQ ID NO: 892802 - DNA, 12 bp, Homo sapiens
aagaataataaa

SEQ ID NO: 892803 - DNA, 21 bp, Homo sapiens
aagaataatatgctgccaaat

SEQ ID NO: 892804 - DNA, 13 bp, Homo sapiens
aagaatacagaaa

SEQ ID NO: 892805 - DNA, 14 bp, Homo sapiens
aagaatacagaaag

SEQ ID NO: 892806 - DNA, 12 bp, Homo sapiens
aagaatacttct

SEQ ID NO: 892807 - DNA, 23 bp, Homo sapiens
aagaatagcattgtaaaagcatt

SEQ ID NO: 892808 - DNA, 15 bp, Homo sapiens
aagaatatcaaataa

SEQ ID NO: 892809 - DNA, 19 bp, Homo sapiens
aagaatatcgatataaatt

SEQ ID NO: 892810 - DNA, 13 bp, Homo sapiens
aagaatattcagg

SEQ ID NO: 892811 - DNA, 11 bp, Homo sapiens
aagaatattgt

SEQ ID NO: 892812 - DNA, 13 bp, Homo sapiens
aagaatattttga

SEQ ID NO: 892813 - DNA, 15 bp, Homo sapiens
aagaatattttgatg

SEQ ID NO: 892814 - DNA, 23 bp, Homo sapiens
aagaatcgatgggggatgcttca

SEQ ID NO: 892815 - DNA, 13 bp, Homo sapiens
aagaatctagaag

SEQ ID NO: 892816 - DNA, 16 bp, Homo sapiens
aagaatctattagatt

SEQ ID NO: 892817 - DNA, 15 bp, Homo sapiens
agtgacatagcctca

SEQ ID NO: 892818 - DNA, 16 bp, Homo sapiens
agtgacatagcctcat

SEQ ID NO: 892819 - DNA, 19 bp, Homo sapiens
agtgacatgattctgaact

SEQ ID NO: 892820 - DNA, 13 bp, Homo sapiens
agtgaccagggaa

SEQ ID NO: 892821 - DNA, 19 bp, Homo sapiens
agtgaccagggaagtgtgt

SEQ ID NO: 892822 - DNA, 20 bp, Homo sapiens
agtgaccattattcacaggt

SEQ ID NO: 892823 - DNA, 17 bp, Homo sapiens
agtgaccccagatgacc

SEQ ID NO: 892824 - DNA, 17 bp, Homo sapiens
agtgaccccagggcctg

SEQ ID NO: 892825 - DNA, 13 bp, Homo sapiens
agtgaccgggggc

SEQ ID NO: 892826 - DNA, 22 bp, Homo sapiens
agtgaccgggggctgctgggcg

SEQ ID NO: 892827 - DNA, 15 bp, Homo sapiens
agtgactctcctgcc

SEQ ID NO: 892828 - DNA, 17 bp, Homo sapiens
agtgactgaaaccattt

SEQ ID NO: 892829 - DNA, 22 bp, Homo sapiens
agtgactgaattctgccttggt

SEQ ID NO: 892830 - DNA, 23 bp, Homo sapiens
aagactgagtacgttgtgcattt

SEQ ID NO: 892831 - DNA, 20 bp, Homo sapiens
aagactgataattttacaat

SEQ ID NO: 892832 - DNA, 14 bp, Homo sapiens
aagactgcagctgc

SEQ ID NO: 892833 - DNA, 17 bp, Homo sapiens
aagactgcagctgctga

SEQ ID NO: 892834 - DNA, 14 bp, Homo sapiens
aagactgccaggtg

SEQ ID NO: 892835 - DNA, 17 bp, Homo sapiens
aagactgctaaatgcac

SEQ ID NO: 892836 - DNA, 11 bp, Homo sapiens
aagactggctt

SEQ ID NO: 892837 - DNA, 15 bp, Homo sapiens
aagactggttttctg

SEQ ID NO: 892838 - DNA, 20 bp, Homo sapiens
aagactggttttctgccaat

SEQ ID NO: 892839 - DNA, 18 bp, Homo sapiens
aagactgtcaaatgaact

SEQ ID NO: 892840 - DNA, 20 bp, Homo sapiens
aagactgtgaacagcttgct

SEQ ID NO: 892841 - DNA, 21 bp, Homo sapiens
aagactgtgaacagcttgctg

SEQ ID NO: 892842 - DNA, 19 bp, Homo sapiens
aagactgtggaaatgccaa

SEQ ID NO: 892843 - DNA, 16 bp, Homo sapiens
aagactgtttttaagt

SEQ ID NO: 892844 - DNA, 16 bp, Homo sapiens
aagacttaatgagact

SEQ ID NO: 892845 - DNA, 21 bp, Homo sapiens
aagacttcattgtccctcttc

SEQ ID NO: 892846 - DNA, 17 bp, Homo sapiens
aagacttggcaacagaa

SEQ ID NO: 892847 - DNA, 20 bp, Homo sapiens
aagactttagcttttccttc

SEQ ID NO: 892848 - DNA, 14 bp, Homo sapiens
aagactttgatcct

SEQ ID NO: 892849 - DNA, 18 bp, Homo sapiens
aagactttgatccttgga

SEQ ID NO: 892850 - DNA, 19 bp, Homo sapiens
aagactttgatccttggaa

SEQ ID NO: 892851 - DNA, 22 bp, Homo sapiens
aagagaaaaaaagtttgccaga

SEQ ID NO: 892852 - DNA, 18 bp, Homo sapiens
aagagaaaaagaaatgca

SEQ ID NO: 892853 - DNA, 15 bp, Homo sapiens
aagagaaaagagaga

SEQ ID NO: 892854 - DNA, 21 bp, Homo sapiens
aagagaaaccgggagaaggca

SEQ ID NO: 892855 - DNA, 14 bp, Homo sapiens
aagagaaaggactc

SEQ ID NO: 892856 - DNA, 14 bp, Homo sapiens
aagagaaatacagc

SEQ ID NO: 892857 - DNA, 18 bp, Homo sapiens
aagagaaatacagctggc

SEQ ID NO: 892858 - DNA, 12 bp, Homo sapiens
aagagaaatttt

SEQ ID NO: 892859 - DNA, 21 bp, Homo sapiens
aagagaaccgagcaaagatca

SEQ ID NO: 892860 - DNA, 20 bp, Homo sapiens
aagagaactcgcgctcagta

SEQ ID NO: 892861 - DNA, 21 bp, Homo sapiens
aagagaagagggcccagccca

SEQ ID NO: 892862 - DNA, 17 bp, Homo sapiens
aagagaagatgcctgtt

SEQ ID NO: 892863 - DNA, 14 bp, Homo sapiens
aagagaagctgctg

SEQ ID NO: 892864 - DNA, 16 bp, Homo sapiens
aagagaaggcacacag

SEQ ID NO: 892865 - DNA, 13 bp, Homo sapiens
aagagaagtagaa

SEQ ID NO: 892866 - DNA, 15 bp, Homo sapiens
aagagaatcaacaga

SEQ ID NO: 892867 - DNA, 19 bp, Homo sapiens
aagagaatgaactgtggaa

SEQ ID NO: 892868 - DNA, 22 bp, Homo sapiens
aagagaatgcccttctccttat

SEQ ID NO: 892869 - DNA, 21 bp, Homo sapiens
aagagacaaacacctcccagg

SEQ ID NO: 892870 - DNA, 18 bp, Homo sapiens
aagagacagagtgctgag

SEQ ID NO: 892871 - DNA, 15 bp, Homo sapiens
aagagacagcccagg

SEQ ID NO: 892872 - DNA, 20 bp, Homo sapiens
aagagacatgagaaagggag

SEQ ID NO: 892873 - DNA, 18 bp, Homo sapiens
aagagacatggaagagag

SEQ ID NO: 892874 - DNA, 13 bp, Homo sapiens
aagagaccagcac

SEQ ID NO: 892875 - DNA, 14 bp, Homo sapiens
aagagaccttggct

SEQ ID NO: 892876 - DNA, 18 bp, Homo sapiens
aagagactggagcatctg

SEQ ID NO: 892877 - DNA, 23 bp, Homo sapiens
aagagactggttagtgatgcagt

SEQ ID NO: 892878 - DNA, 14 bp, Homo sapiens
aagagacttctctg

SEQ ID NO: 892879 - DNA, 12 bp, Homo sapiens
aagagagaatgt

SEQ ID NO: 892880 - DNA, 19 bp, Homo sapiens
aagagagagagagaaaaaa

SEQ ID NO: 892881 - DNA, 19 bp, Homo sapiens
aagagagcagcgcccaggc

SEQ ID NO: 892882 - DNA, 12 bp, Homo sapiens
aagagaggaagg

SEQ ID NO: 892883 - DNA, 13 bp, Homo sapiens
aagagaggaagga

SEQ ID NO: 892884 - DNA, 17 bp, Homo sapiens
aagagaggaaggacccc

SEQ ID NO: 892885 - DNA, 22 bp, Homo sapiens
aagagaggaaggacccctcacc

SEQ ID NO: 892886 - DNA, 12 bp, Homo sapiens
aagagaggcacc

SEQ ID NO: 892887 - DNA, 15 bp, Homo sapiens
aagagaggggaagaa

SEQ ID NO: 892888 - DNA, 19 bp, Homo sapiens
aagagaggggaagaattta

SEQ ID NO: 892889 - DNA, 15 bp, Homo sapiens
aagagaggtgccggg

SEQ ID NO: 892890 - DNA, 13 bp, Homo sapiens
aagagataataag

SEQ ID NO: 892891 - DNA, 14 bp, Homo sapiens
aagagataataaga

SEQ ID NO: 892892 - DNA, 16 bp, Homo sapiens
aagagataataagatt

SEQ ID NO: 892893 - DNA, 17 bp, Homo sapiens
aagagatacttacattt

SEQ ID NO: 892894 - DNA, 19 bp, Homo sapiens
aagagatacttacatttcc

SEQ ID NO: 892895 - DNA, 22 bp, Homo sapiens
aagagatacttacatttccatt

SEQ ID NO: 892896 - DNA, 20 bp, Homo sapiens
aagagatattgatattgaag

SEQ ID NO: 892897 - DNA, 12 bp, Homo sapiens
aagagatatttt

SEQ ID NO: 892898 - DNA, 14 bp, Homo sapiens
aagagatctttctt

SEQ ID NO: 892899 - DNA, 15 bp, Homo sapiens
aagagatgggacaag

SEQ ID NO: 892900 - DNA, 18 bp, Homo sapiens
aagagatgggcttgtttt

SEQ ID NO: 892901 - DNA, 21 bp, Homo sapiens
aagagatgtggcaaagtgctg

SEQ ID NO: 892902 - DNA, 14 bp, Homo sapiens
aagagatgtttaca

SEQ ID NO: 892903 - DNA, 17 bp, Homo sapiens
aagagatgtttacagta

SEQ ID NO: 892904 - DNA, 14 bp, Homo sapiens
aagagattcttcta

SEQ ID NO: 892905 - DNA, 22 bp, Homo sapiens
aagagattgcacagtcaaaacg

SEQ ID NO: 892906 - DNA, 16 bp, Homo sapiens
aagagattgtggtttc

SEQ ID NO: 892907 - DNA, 19 bp, Homo sapiens
aagagattgtggtttcatt

SEQ ID NO: 892908 - DNA, 18 bp, Homo sapiens
aagagatttatctttata

SEQ ID NO: 892909 - DNA, 17 bp, Homo sapiens
aagagcaattgcagcag

SEQ ID NO: 892910 - DNA, 16 bp, Homo sapiens
aagagcacttaagaga

SEQ ID NO: 892911 - DNA, 17 bp, Homo sapiens
aagagcagagtctgggc

SEQ ID NO: 892912 - DNA, 22 bp, Homo sapiens
aagagcagagtctgggcctctg

SEQ ID NO: 892913 - DNA, 11 bp, Homo sapiens
aagagcagcct

SEQ ID NO: 892914 - DNA, 13 bp, Homo sapiens
aagagcagcctga

SEQ ID NO: 892915 - DNA, 19 bp, Homo sapiens
aagagcagcctgatggcca

SEQ ID NO: 892916 - DNA, 20 bp, Homo sapiens
aagagcagcctgatggccaa

SEQ ID NO: 892917 - DNA, 23 bp, Homo sapiens
aagagcagcctgatggccaaggg

SEQ ID NO: 892918 - DNA, 16 bp, Homo sapiens
aagagcagcctgtggc

SEQ ID NO: 892919 - DNA, 17 bp, Homo sapiens
aagagcaggactccagg

SEQ ID NO: 892920 - DNA, 14 bp, Homo sapiens
aagagcatctgatt

SEQ ID NO: 892921 - DNA, 13 bp, Homo sapiens
aagagccacctgc

SEQ ID NO: 892922 - DNA, 23 bp, Homo sapiens
aagagcccagtctgttgagttag

SEQ ID NO: 892923 - DNA, 23 bp, Homo sapiens
aagagcccgcagggccatgcaga

SEQ ID NO: 892924 - DNA, 20 bp, Homo sapiens
aagagccctggacacccctg

SEQ ID NO: 892925 - DNA, 23 bp, Homo sapiens
aagagccctggacacccctgctc

SEQ ID NO: 892926 - DNA, 16 bp, Homo sapiens
aagagccctggctctg

SEQ ID NO: 892927 - DNA, 19 bp, Homo sapiens
aagagccctggctctgccc

SEQ ID NO: 892928 - DNA, 21 bp, Homo sapiens
aagagccctggctctgcccct

SEQ ID NO: 892929 - DNA, 14 bp, Homo sapiens
aagagcccttgcct

SEQ ID NO: 892930 - DNA, 16 bp, Homo sapiens
aagagcccttgcctcc

SEQ ID NO: 892931 - DNA, 13 bp, Homo sapiens
aagagcctcccac

SEQ ID NO: 892932 - DNA, 14 bp, Homo sapiens
aagagcctggagaa

SEQ ID NO: 892933 - DNA, 21 bp, Homo sapiens
aagagccttggtgtccacctg

SEQ ID NO: 892934 - DNA, 20 bp, Homo sapiens
aagagcgctcctctgccttg

SEQ ID NO: 892935 - DNA, 16 bp, Homo sapiens
aagagctagaaaaata

SEQ ID NO: 892936 - DNA, 15 bp, Homo sapiens
aagagctagagaaat

SEQ ID NO: 892937 - DNA, 19 bp, Homo sapiens
aagagctagcgctgccgca

SEQ ID NO: 892938 - DNA, 20 bp, Homo sapiens
aagagctattgccaaccagt

SEQ ID NO: 892939 - DNA, 21 bp, Homo sapiens
aagatcctgtctttaaggaaa

SEQ ID NO: 892940 - DNA, 16 bp, Homo sapiens
aagatcgaatttttca

SEQ ID NO: 892941 - DNA, 14 bp, Homo sapiens
aagatcgttagtat

SEQ ID NO: 892942 - DNA, 17 bp, Homo sapiens
aagatcgttctctgcct

SEQ ID NO: 892943 - DNA, 12 bp, Homo sapiens
aagatctaaatc

SEQ ID NO: 892944 - DNA, 19 bp, Homo sapiens
aagatctaccccagggaga

SEQ ID NO: 892945 - DNA, 12 bp, Homo sapiens
aagatctctgtc

SEQ ID NO: 892946 - DNA, 21 bp, Homo sapiens
aagatctctgtcacatccaac

SEQ ID NO: 892947 - DNA, 14 bp, Homo sapiens
aagatctctttcta

SEQ ID NO: 892948 - DNA, 13 bp, Homo sapiens
aagatctgactgc

SEQ ID NO: 892949 - DNA, 23 bp, Homo sapiens
aagatctgttaaaaaagaaatct

SEQ ID NO: 892950 - DNA, 19 bp, Homo sapiens
aagatcttggcttaattta

SEQ ID NO: 892951 - DNA, 13 bp, Homo sapiens
aagatctttcagg

SEQ ID NO: 892952 - DNA, 20 bp, Homo sapiens
aagatcttttagaagtgaga

SEQ ID NO: 892953 - DNA, 17 bp, Homo sapiens
aagatgaaatgcactgt

SEQ ID NO: 892954 - DNA, 22 bp, Homo sapiens
aagatgaacccgaggctgagaa

SEQ ID NO: 892955 - DNA, 15 bp, Homo sapiens
aagatgaatcaatgg

SEQ ID NO: 892956 - DNA, 17 bp, Homo sapiens
aagatgagagaactgga

SEQ ID NO: 892957 - DNA, 21 bp, Homo sapiens
aagatgagattggcatggctt

SEQ ID NO: 892958 - DNA, 18 bp, Homo sapiens
aagatgagctgcagcccc

SEQ ID NO: 892959 - DNA, 13 bp, Homo sapiens
aagatgatcattt

SEQ ID NO: 892960 - DNA, 17 bp, Homo sapiens
agtgcaacatttctgta

SEQ ID NO: 892961 - DNA, 19 bp, Homo sapiens
agtgcaacatttctgtata

SEQ ID NO: 892962 - DNA, 23 bp, Homo sapiens
agtgcaacatttctgtatactgt

SEQ ID NO: 892963 - DNA, 22 bp, Homo sapiens
agtgcaagactgaattaatgag

SEQ ID NO: 892964 - DNA, 14 bp, Homo sapiens
agtgcaagattttt

SEQ ID NO: 892965 - DNA, 17 bp, Homo sapiens
agtgcaatgcttgtaga

SEQ ID NO: 892966 - DNA, 18 bp, Homo sapiens
agtgcaatgcttgtagaa

SEQ ID NO: 892967 - DNA, 22 bp, Homo sapiens
agtgcaatgcttgtagaagtag

SEQ ID NO: 892968 - DNA, 22 bp, Homo sapiens
agtgcaatggtataaatttcaa

SEQ ID NO: 892969 - DNA, 19 bp, Homo sapiens
agtgcaattccaagaaaat

SEQ ID NO: 892970 - DNA, 18 bp, Homo sapiens
agtgcacctccctcccca

SEQ ID NO: 892971 - DNA, 22 bp, Homo sapiens
agtgcacctgcctcagctacct

SEQ ID NO: 892972 - DNA, 18 bp, Homo sapiens
agtgcacggggcacagcg

SEQ ID NO: 892973 - DNA, 17 bp, Homo sapiens
agtgcactaaacaaata

SEQ ID NO: 892974 - DNA, 14 bp, Homo sapiens
agtgcactgacctg

SEQ ID NO: 892975 - DNA, 18 bp, Homo sapiens
agtgcactgacctgtagg

SEQ ID NO: 892976 - DNA, 21 bp, Homo sapiens
agtgcactgcattcctgtgcc

SEQ ID NO: 892977 - DNA, 21 bp, Homo sapiens
agtgcacttttttatgaagaa

SEQ ID NO: 892978 - DNA, 17 bp, Homo sapiens
agtgcagaacacctggc

SEQ ID NO: 892979 - DNA, 17 bp, Homo sapiens
agtgcagatgagtgtgt

SEQ ID NO: 892980 - DNA, 18 bp, Homo sapiens
agtgcagatgagtgtgtg

SEQ ID NO: 892981 - DNA, 21 bp, Homo sapiens
agtgcagcaggttaagaattt

SEQ ID NO: 892982 - DNA, 21 bp, Homo sapiens
agtgcagccaaaggggagcca

SEQ ID NO: 892983 - DNA, 22 bp, Homo sapiens
agtgcagccaaaggggagccag

SEQ ID NO: 892984 - DNA, 13 bp, Homo sapiens
agtgcagccaagt

SEQ ID NO: 892985 - DNA, 12 bp, Homo sapiens
agtgcagccact

SEQ ID NO: 892986 - DNA, 23 bp, Homo sapiens
agtgcagcccgtgtggccccttc

SEQ ID NO: 892987 - DNA, 24 bp, Homo sapiens
agtgcagcccgtgtggccccttca

SEQ ID NO: 892988 - DNA, 15 bp, Homo sapiens
agtgcagcttgcagt

SEQ ID NO: 892989 - DNA, 16 bp, Homo sapiens
agtgcagcttgcagtc

SEQ ID NO: 892990 - DNA, 11 bp, Homo sapiens
agtgcaggctg

SEQ ID NO: 892991 - DNA, 13 bp, Homo sapiens
agtgcaggctggc

SEQ ID NO: 892992 - DNA, 21 bp, Homo sapiens
agtgcagggaggaaaagtgca

SEQ ID NO: 892993 - DNA, 14 bp, Homo sapiens
agtgcagtatagaa

SEQ ID NO: 892994 - DNA, 15 bp, Homo sapiens
agtgcagtcatttgt

SEQ ID NO: 892995 - DNA, 22 bp, Homo sapiens
agtgcagtcctgatcagagccg

SEQ ID NO: 892996 - DNA, 23 bp, Homo sapiens
agtgcagtcctgatcagagccgt

SEQ ID NO: 892997 - DNA, 24 bp, Homo sapiens
agtgcagtggcacaatcatggctc

SEQ ID NO: 892998 - DNA, 18 bp, Homo sapiens
agtgcagtggtgcaatca

SEQ ID NO: 892999 - DNA, 20 bp, Homo sapiens
agtgcagtggtgcaatcaca

SEQ ID NO: 893000 - DNA, 20 bp, Homo sapiens
agtgcagttgaggtctgcgt

SEQ ID NO: 893001 - DNA, 22 bp, Homo sapiens
agtgcatagttgtagacaaagt

SEQ ID NO: 893002 - DNA, 15 bp, Homo sapiens
agtgcatccaaaggt

SEQ ID NO: 893003 - DNA, 22 bp, Homo sapiens
agtgcatccccacgacccctgc

SEQ ID NO: 893004 - DNA, 14 bp, Homo sapiens
agtgcatctacttg

SEQ ID NO: 893005 - DNA, 11 bp, Homo sapiens
agtgcatgcat

SEQ ID NO: 893006 - DNA, 15 bp, Homo sapiens
agtgcatgctctctg

SEQ ID NO: 893007 - DNA, 17 bp, Homo sapiens
agtgcatttcaaggaat

SEQ ID NO: 893008 - DNA, 21 bp, Homo sapiens
agtgcattttgtttctgtata

SEQ ID NO: 893009 - DNA, 15 bp, Homo sapiens
agtgcatttttaaac

SEQ ID NO: 893010 - DNA, 17 bp, Homo sapiens
agtgcatttttaaactt

SEQ ID NO: 893011 - DNA, 20 bp, Homo sapiens
agtgcatttttaaacttgaa

SEQ ID NO: 893012 - DNA, 18 bp, Homo sapiens
agtgcatttttcttattt

SEQ ID NO: 893013 - DNA, 17 bp, Homo sapiens
agtgccaatgatgtgac

SEQ ID NO: 893014 - DNA, 18 bp, Homo sapiens
agtgccacagcctgctgg

SEQ ID NO: 893015 - DNA, 20 bp, Homo sapiens
agtgccacagcctgctggca

SEQ ID NO: 893016 - DNA, 20 bp, Homo sapiens
agtgccacccgcagatgaca

SEQ ID NO: 893017 - DNA, 13 bp, Homo sapiens
agtgccacctatg

SEQ ID NO: 893018 - DNA, 18 bp, Homo sapiens
agtgccacctatgcctgt

SEQ ID NO: 893019 - DNA, 20 bp, Homo sapiens
agtgccacctatgcctgtgg

SEQ ID NO: 893020 - DNA, 22 bp, Homo sapiens
agtgccacctatgcctgtggtg

SEQ ID NO: 893021 - DNA, 18 bp, Homo sapiens
agtgccactgccccccga

SEQ ID NO: 893022 - DNA, 16 bp, Homo sapiens
agtgccacttaatgta

SEQ ID NO: 893023 - DNA, 17 bp, Homo sapiens
agtgccacttaatgtat

SEQ ID NO: 893024 - DNA, 21 bp, Homo sapiens
agtgccacttaatgtatgtta

SEQ ID NO: 893025 - DNA, 18 bp, Homo sapiens
agtgccacttgacattcc

SEQ ID NO: 893026 - DNA, 19 bp, Homo sapiens
agtgccagaggtgggcagg

SEQ ID NO: 893027 - DNA, 20 bp, Homo sapiens
agtgccagaggtgggcaggt

SEQ ID NO: 893028 - DNA, 22 bp, Homo sapiens
agtgccagaggtgggcaggtgg

SEQ ID NO: 893029 - DNA, 19 bp, Homo sapiens
agtgccagctactcaggag

SEQ ID NO: 893030 - DNA, 15 bp, Homo sapiens
agtgccagctccagt

SEQ ID NO: 893031 - DNA, 11 bp, Homo sapiens
agtgccaggac

SEQ ID NO: 893032 - DNA, 13 bp, Homo sapiens
agtgccaggacca

SEQ ID NO: 893033 - DNA, 17 bp, Homo sapiens
agtgccaggaccagcct

SEQ ID NO: 893034 - DNA, 24 bp, Homo sapiens
agtgccaggactccccaggccagg

SEQ ID NO: 893035 - DNA, 16 bp, Homo sapiens
agtgccaggagggcac

SEQ ID NO: 893036 - DNA, 16 bp, Homo sapiens
agtgccaggtggctca

SEQ ID NO: 893037 - DNA, 23 bp, Homo sapiens
agtgccagtattttaaaatagcg

SEQ ID NO: 893038 - DNA, 20 bp, Homo sapiens
agtgccagtcttgtgtctgc

SEQ ID NO: 893039 - DNA, 18 bp, Homo sapiens
agtgccattactactgta

SEQ ID NO: 893040 - DNA, 16 bp, Homo sapiens
agtgccattccactcc

SEQ ID NO: 893041 - DNA, 21 bp, Homo sapiens
agtgccattccactccactca

SEQ ID NO: 893042 - DNA, 16 bp, Homo sapiens
agtgcccaccaacatc

SEQ ID NO: 893043 - DNA, 20 bp, Homo sapiens
agtgcccaccgccctcctcc

SEQ ID NO: 893044 - DNA, 18 bp, Homo sapiens
agtgcccatgtgtacatt

SEQ ID NO: 893045 - DNA, 23 bp, Homo sapiens
agtgccccacctcccgccctcac

SEQ ID NO: 893046 - DNA, 12 bp, Homo sapiens
agtgccccagac

SEQ ID NO: 893047 - DNA, 14 bp, Homo sapiens
agtgccccagactg

SEQ ID NO: 893048 - DNA, 18 bp, Homo sapiens
agtgccccagactgagct

SEQ ID NO: 893049 - DNA, 22 bp, Homo sapiens
agtgccccagactgagctctcc

SEQ ID NO: 893050 - DNA, 19 bp, Homo sapiens
agtgccccattcttttgta

SEQ ID NO: 893051 - DNA, 14 bp, Homo sapiens
agtgcccctgctgc

SEQ ID NO: 893052 - DNA, 20 bp, Homo sapiens
agtgcccctgctgcctcccc

SEQ ID NO: 893053 - DNA, 22 bp, Homo sapiens
agtgcccctgctgcctccccaa

SEQ ID NO: 893054 - DNA, 20 bp, Homo sapiens
agtgcccgcctaggagttga

SEQ ID NO: 893055 - DNA, 17 bp, Homo sapiens
agtgccctccacagccg

SEQ ID NO: 893056 - DNA, 12 bp, Homo sapiens
agtgccctccag

SEQ ID NO: 893057 - DNA, 13 bp, Homo sapiens
agtgccctgcagg

SEQ ID NO: 893058 - DNA, 18 bp, Homo sapiens
agtgccgaatgactatgt

SEQ ID NO: 893059 - DNA, 19 bp, Homo sapiens
agtgccgctcctgcttccc

SEQ ID NO: 893060 - DNA, 21 bp, Homo sapiens
aagcagtatataataacttta

SEQ ID NO: 893061 - DNA, 18 bp, Homo sapiens
aagcagtatttttcttga

SEQ ID NO: 893062 - DNA, 14 bp, Homo sapiens
aagcagtcctgttc

SEQ ID NO: 893063 - DNA, 17 bp, Homo sapiens
aagcagtctaccctgtc

SEQ ID NO: 893064 - DNA, 14 bp, Homo sapiens
aagcagtcttgctc

SEQ ID NO: 893065 - DNA, 12 bp, Homo sapiens
aagcagtgcctc

SEQ ID NO: 893066 - DNA, 17 bp, Homo sapiens
aagcagtgcctcgaggc

SEQ ID NO: 893067 - DNA, 20 bp, Homo sapiens
aagcagtgccttccataatt

SEQ ID NO: 893068 - DNA, 17 bp, Homo sapiens
aagcagttaatttatat

SEQ ID NO: 893069 - DNA, 15 bp, Homo sapiens
aagcagttctcacaa

SEQ ID NO: 893070 - DNA, 19 bp, Homo sapiens
aagcagttggggccctctt

SEQ ID NO: 893071 - DNA, 20 bp, Homo sapiens
aagcagttggggccctcttg

SEQ ID NO: 893072 - DNA, 15 bp, Homo sapiens
aagcagttgtgtcag

SEQ ID NO: 893073 - DNA, 15 bp, Homo sapiens
aagcataaaagatca

SEQ ID NO: 893074 - DNA, 16 bp, Homo sapiens
aagcataaaagatcac

SEQ ID NO: 893075 - DNA, 13 bp, Homo sapiens
aagcataaggccg

SEQ ID NO: 893076 - DNA, 23 bp, Homo sapiens
aagcataatttgtttaaaattct

SEQ ID NO: 893077 - DNA, 14 bp, Homo sapiens
aagcatactttgta

SEQ ID NO: 893078 - DNA, 20 bp, Homo sapiens
aagcatagctacaatttgtt

SEQ ID NO: 893079 - DNA, 18 bp, Homo sapiens
aagcatatcccaccaacc

SEQ ID NO: 893080 - DNA, 17 bp, Homo sapiens
aagcatatgcagccaac

SEQ ID NO: 893081 - DNA, 19 bp, Homo sapiens
aagcatatgcagccaacca

SEQ ID NO: 893082 - DNA, 15 bp, Homo sapiens
aagcatatttgagaa

SEQ ID NO: 893083 - DNA, 18 bp, Homo sapiens
aagcatcacctcaggcca

SEQ ID NO: 893084 - DNA, 19 bp, Homo sapiens
aagcatcacctcaggccag

SEQ ID NO: 893085 - DNA, 23 bp, Homo sapiens
aagcatcacctcaggccaggtgc

SEQ ID NO: 893086 - DNA, 13 bp, Homo sapiens
aagcatcactgcc

SEQ ID NO: 893087 - DNA, 19 bp, Homo sapiens
aagcatcactgccttggcc

SEQ ID NO: 893088 - DNA, 22 bp, Homo sapiens
aagcatcatcacgacacatttg

SEQ ID NO: 893089 - DNA, 12 bp, Homo sapiens
aagcatccatgt

SEQ ID NO: 893090 - DNA, 20 bp, Homo sapiens
aagcatccatgtgtggactc

SEQ ID NO: 893091 - DNA, 14 bp, Homo sapiens
aagcatcctcagaa

SEQ ID NO: 893092 - DNA, 13 bp, Homo sapiens
aagcatctacttc

SEQ ID NO: 893093 - DNA, 19 bp, Homo sapiens
aagcatctggctctaattc

SEQ ID NO: 893094 - DNA, 14 bp, Homo sapiens
aagcatgaaacatt

SEQ ID NO: 893095 - DNA, 15 bp, Homo sapiens
aagcatgaagataaa

SEQ ID NO: 893096 - DNA, 15 bp, Homo sapiens
aagcatgatgggaaa

SEQ ID NO: 893097 - DNA, 20 bp, Homo sapiens
aagcatgatgggaaaatatt

SEQ ID NO: 893098 - DNA, 16 bp, Homo sapiens
aagcatgctttgctgc

SEQ ID NO: 893099 - DNA, 17 bp, Homo sapiens
aagcatgctttgctgct

SEQ ID NO: 893100 - DNA, 20 bp, Homo sapiens
aagcatgctttgctgctatg

SEQ ID NO: 893101 - DNA, 14 bp, Homo sapiens
aagcatggctgtct

SEQ ID NO: 893102 - DNA, 23 bp, Homo sapiens
aagcatggctgtctgcacagagg

SEQ ID NO: 893103 - DNA, 14 bp, Homo sapiens
aagcatgtctctct

SEQ ID NO: 893104 - DNA, 19 bp, Homo sapiens
aagcatgtctctctgccaa

SEQ ID NO: 893105 - DNA, 20 bp, Homo sapiens
aagcatgtttattctgttcc

SEQ ID NO: 893106 - DNA, 18 bp, Homo sapiens
aagcattaacttctctgg

SEQ ID NO: 893107 - DNA, 13 bp, Homo sapiens
aagcattactctt

SEQ ID NO: 893108 - DNA, 21 bp, Homo sapiens
aagcattcaatttattcaaga

SEQ ID NO: 893109 - DNA, 16 bp, Homo sapiens
aagcattctgagctgg

SEQ ID NO: 893110 - DNA, 16 bp, Homo sapiens
aagcattgaatggcta

SEQ ID NO: 893111 - DNA, 14 bp, Homo sapiens
aagcattgagatct

SEQ ID NO: 893112 - DNA, 18 bp, Homo sapiens
aagcattgtaaaataatt

SEQ ID NO: 893113 - DNA, 11 bp, Homo sapiens
aagcattgttt

SEQ ID NO: 893114 - DNA, 20 bp, Homo sapiens
aagcattgtttgcttattgt

SEQ ID NO: 893115 - DNA, 23 bp, Homo sapiens
aagcattgtttgcttattgttcc

SEQ ID NO: 893116 - DNA, 16 bp, Homo sapiens
aagcatttagaaaact

SEQ ID NO: 893117 - DNA, 21 bp, Homo sapiens
aagcatttcaaagccctgcct

SEQ ID NO: 893118 - DNA, 24 bp, Homo sapiens
aagcatttcaaagccctgcctctg

SEQ ID NO: 893119 - DNA, 11 bp, Homo sapiens
aagcatttcat

SEQ ID NO: 893120 - DNA, 16 bp, Homo sapiens
aagcatttcatgaaaa

SEQ ID NO: 893121 - DNA, 17 bp, Homo sapiens
aagcatttccagcctat

SEQ ID NO: 893122 - DNA, 16 bp, Homo sapiens
aagcatttgtatatta

SEQ ID NO: 893123 - DNA, 17 bp, Homo sapiens
aagcatttgtattttgt

SEQ ID NO: 893124 - DNA, 18 bp, Homo sapiens
aagcatttgtattttgtg

SEQ ID NO: 893125 - DNA, 19 bp, Homo sapiens
aagcatttgtattttgtgt

SEQ ID NO: 893126 - DNA, 21 bp, Homo sapiens
aagcatttgtattttgtgtga

SEQ ID NO: 893127 - DNA, 23 bp, Homo sapiens
aagcatttgtttctactttgata

SEQ ID NO: 893128 - DNA, 23 bp, Homo sapiens
aagcattttcagtcttgtagtgt

SEQ ID NO: 893129 - DNA, 17 bp, Homo sapiens
aagcattttgaaacaaa

SEQ ID NO: 893130 - DNA, 18 bp, Homo sapiens
aagcattttgggatcctt

SEQ ID NO: 893131 - DNA, 19 bp, Homo sapiens
aagcatttttcaatatatt

SEQ ID NO: 893132 - DNA, 12 bp, Homo sapiens
aagccaaaacaa

SEQ ID NO: 893133 - DNA, 14 bp, Homo sapiens
aagccaaaatggga

SEQ ID NO: 893134 - DNA, 16 bp, Homo sapiens
aagccaaacaaaactg

SEQ ID NO: 893135 - DNA, 14 bp, Homo sapiens
aagccaaactctgc

SEQ ID NO: 893136 - DNA, 15 bp, Homo sapiens
aagccaaagaaaaat

SEQ ID NO: 893137 - DNA, 21 bp, Homo sapiens
aagccaaagaaaaataaccct

SEQ ID NO: 893138 - DNA, 23 bp, Homo sapiens
aagccaaagaaacaagctgtgca

SEQ ID NO: 893139 - DNA, 19 bp, Homo sapiens
aagccaaagagcctcccac

SEQ ID NO: 893140 - DNA, 18 bp, Homo sapiens
aagccaacaactctgcct

SEQ ID NO: 893141 - DNA, 16 bp, Homo sapiens
aagccaaccagccttt

SEQ ID NO: 893142 - DNA, 14 bp, Homo sapiens
aagccaagaaagat

SEQ ID NO: 893143 - DNA, 17 bp, Homo sapiens
aagccaagctccctgga

SEQ ID NO: 893144 - DNA, 14 bp, Homo sapiens
aagccaagggaaag

SEQ ID NO: 893145 - DNA, 18 bp, Homo sapiens
aagccaagggaacctgtg

SEQ ID NO: 893146 - DNA, 19 bp, Homo sapiens
aagccaagggaacctgtgt

SEQ ID NO: 893147 - DNA, 20 bp, Homo sapiens
aagccaagggaacctgtgtc

SEQ ID NO: 893148 - DNA, 21 bp, Homo sapiens
aagccaatatttactcatcag

SEQ ID NO: 893149 - DNA, 14 bp, Homo sapiens
aagccaatcccctc

SEQ ID NO: 893150 - DNA, 15 bp, Homo sapiens
aagccaatcccctcc

SEQ ID NO: 893151 - DNA, 20 bp, Homo sapiens
aagccaatcccctccttggg

SEQ ID NO: 893152 - DNA, 18 bp, Homo sapiens
aagccacaagaaatttga

SEQ ID NO: 893153 - DNA, 21 bp, Homo sapiens
aagccacaaggctggccagca

SEQ ID NO: 893154 - DNA, 19 bp, Homo sapiens
aagccacatcgttgagaca

SEQ ID NO: 893155 - DNA, 22 bp, Homo sapiens
aagccacatcgttgagacatca

SEQ ID NO: 893156 - DNA, 20 bp, Homo sapiens
aagccacctctccctcaaca

SEQ ID NO: 893157 - DNA, 18 bp, Homo sapiens
aagccactgcctctccct

SEQ ID NO: 893158 - DNA, 14 bp, Homo sapiens
aagccagacaactt

SEQ ID NO: 893159 - DNA, 16 bp, Homo sapiens
aagccagacaacttct

SEQ ID NO: 893160 - DNA, 23 bp, Homo sapiens
aagccagattttttaaaatttat

SEQ ID NO: 893161 - DNA, 22 bp, Homo sapiens
aagccagccaagctttaaatta

SEQ ID NO: 893162 - DNA, 20 bp, Homo sapiens
aagccagcgtcctcctctgt

SEQ ID NO: 893163 - DNA, 15 bp, Homo sapiens
aagccagctgcccta

SEQ ID NO: 893164 - DNA, 22 bp, Homo sapiens
aagccagctgccctatgggcct

SEQ ID NO: 893165 - DNA, 15 bp, Homo sapiens
aagccagctttccct

SEQ ID NO: 893166 - DNA, 19 bp, Homo sapiens
aagccaggactattccctt

SEQ ID NO: 893167 - DNA, 17 bp, Homo sapiens
aagccaggcctggctgg

SEQ ID NO: 893168 - DNA, 12 bp, Homo sapiens
aagccagggccc

SEQ ID NO: 893169 - DNA, 13 bp, Homo sapiens
aagccagggccca

SEQ ID NO: 893170 - DNA, 14 bp, Homo sapiens
aagccagggcccag

SEQ ID NO: 893171 - DNA, 22 bp, Homo sapiens
aagccagggcccagagcccttg

SEQ ID NO: 893172 - DNA, 12 bp, Homo sapiens
aagccagggtct

SEQ ID NO: 893173 - DNA, 23 bp, Homo sapiens
aagccagggtctctccctcaggt

SEQ ID NO: 893174 - DNA, 20 bp, Homo sapiens
aagccagtgtccttcgagga

SEQ ID NO: 893175 - DNA, 23 bp, Homo sapiens
aagccagttggatctctggttgt

SEQ ID NO: 893176 - DNA, 16 bp, Homo sapiens
aagccataacgtgccc

SEQ ID NO: 893177 - DNA, 22 bp, Homo sapiens
aagccataacgtgcccccagag

SEQ ID NO: 893178 - DNA, 15 bp, Homo sapiens
aagccatagggggct

SEQ ID NO: 893179 - DNA, 13 bp, Homo sapiens
aagccatattcca

SEQ ID NO: 893180 - DNA, 14 bp, Homo sapiens
aagccatcatcctc

SEQ ID NO: 893181 - DNA, 16 bp, Homo sapiens
aagccatcatgccttg

SEQ ID NO: 893182 - DNA, 23 bp, Homo sapiens
agtgtgggtttggttagaggaag

SEQ ID NO: 893183 - DNA, 20 bp, Homo sapiens
agtgtgtatgtgcgtgtgtg

SEQ ID NO: 893184 - DNA, 20 bp, Homo sapiens
agtgtgtattaaaaaaaaca

SEQ ID NO: 893185 - DNA, 21 bp, Homo sapiens
agtgtgtattgttcccagtga

SEQ ID NO: 893186 - DNA, 17 bp, Homo sapiens
agtgtgtcagagcccag

SEQ ID NO: 893187 - DNA, 14 bp, Homo sapiens
agtgtgtctgctga

SEQ ID NO: 893188 - DNA, 15 bp, Homo sapiens
agtgtgtctgctgag

SEQ ID NO: 893189 - DNA, 13 bp, Homo sapiens
agtgtgtcttcct

SEQ ID NO: 893190 - DNA, 14 bp, Homo sapiens
agtgtgtgacattc

SEQ ID NO: 893191 - DNA, 21 bp, Homo sapiens
agtgtgtgattttttgcattc

SEQ ID NO: 893192 - DNA, 20 bp, Homo sapiens
agtgtgtgcacatgtgtgcg

SEQ ID NO: 893193 - DNA, 12 bp, Homo sapiens
agtgtgtgcagc

SEQ ID NO: 893194 - DNA, 17 bp, Homo sapiens
agtgtgtgcatgtgtgc

SEQ ID NO: 893195 - DNA, 13 bp, Homo sapiens
agtgtgtgtgcat

SEQ ID NO: 893196 - DNA, 15 bp, Homo sapiens
agtgtgtgtgcatgt

SEQ ID NO: 893197 - DNA, 16 bp, Homo sapiens
agtgtgtgtgcatgtg

SEQ ID NO: 893198 - DNA, 12 bp, Homo sapiens
agtgtgtgtgcg

SEQ ID NO: 893199 - DNA, 14 bp, Homo sapiens
agtgtgtgtgtgca

SEQ ID NO: 893200 - DNA, 20 bp, Homo sapiens
agtgtgtgtgtgcatgtgtg

SEQ ID NO: 893201 - DNA, 19 bp, Homo sapiens
agtgtgtgtttaacattca

SEQ ID NO: 893202 - DNA, 23 bp, Homo sapiens
agtgtgtgtttaacattcacagc

SEQ ID NO: 893203 - DNA, 15 bp, Homo sapiens
agtgtgttgttgctt

SEQ ID NO: 893204 - DNA, 21 bp, Homo sapiens
agtgttaaaaaatttttgaaa

SEQ ID NO: 893205 - DNA, 14 bp, Homo sapiens
agtgttaaattcat

SEQ ID NO: 893206 - DNA, 21 bp, Homo sapiens
agtgttactgcctataatctt

SEQ ID NO: 893207 - DNA, 22 bp, Homo sapiens
agtgttactgcctataatctta

SEQ ID NO: 893208 - DNA, 14 bp, Homo sapiens
agtgttacttgcag

SEQ ID NO: 893209 - DNA, 18 bp, Homo sapiens
agtgttagggaagggcct

SEQ ID NO: 893210 - DNA, 19 bp, Homo sapiens
agtgttagtgctggtcaga

SEQ ID NO: 893211 - DNA, 21 bp, Homo sapiens
agtgttagtgctggtcagaga

SEQ ID NO: 893212 - DNA, 19 bp, Homo sapiens
agtgttatgtagtattgtt

SEQ ID NO: 893213 - DNA, 15 bp, Homo sapiens
agtgttatgtatttc

SEQ ID NO: 893214 - DNA, 23 bp, Homo sapiens
agtgttcaaaacaaaatgaaaca

SEQ ID NO: 893215 - DNA, 15 bp, Homo sapiens
agtgttcacaaactg

SEQ ID NO: 893216 - DNA, 18 bp, Homo sapiens
agtgttcacaaactgtga

SEQ ID NO: 893217 - DNA, 17 bp, Homo sapiens
agtgttcatttgaaaga

SEQ ID NO: 893218 - DNA, 22 bp, Homo sapiens
agtgttcattttagtgactgta

SEQ ID NO: 893219 - DNA, 20 bp, Homo sapiens
agtgttcctatttggggctt

SEQ ID NO: 893220 - DNA, 20 bp, Homo sapiens
agtgttcctgaagctgctgt

SEQ ID NO: 893221 - DNA, 22 bp, Homo sapiens
agtgttcctttttaaatgtgaa

SEQ ID NO: 893222 - DNA, 14 bp, Homo sapiens
agtgttctgctcct

SEQ ID NO: 893223 - DNA, 19 bp, Homo sapiens
agtgttctgctcctgcttt

SEQ ID NO: 893224 - DNA, 22 bp, Homo sapiens
agtgttctgctcctgcttttct

SEQ ID NO: 893225 - DNA, 19 bp, Homo sapiens
agtgttctgtttgaaacta

SEQ ID NO: 893226 - DNA, 12 bp, Homo sapiens
agtgttgaaggg

SEQ ID NO: 893227 - DNA, 23 bp, Homo sapiens
agtgttgagccatgctacagtta

SEQ ID NO: 893228 - DNA, 17 bp, Homo sapiens
agtgttgagccttttcc

SEQ ID NO: 893229 - DNA, 19 bp, Homo sapiens
agtgttgcatatgagcctg

SEQ ID NO: 893230 - DNA, 14 bp, Homo sapiens
agtgttgctcttgg

SEQ ID NO: 893231 - DNA, 18 bp, Homo sapiens
agtgttgctcttggaaag

SEQ ID NO: 893232 - DNA, 17 bp, Homo sapiens
agtgttggctgtgtgac

SEQ ID NO: 893233 - DNA, 19 bp, Homo sapiens
agtgttggctgtgtgacag

SEQ ID NO: 893234 - DNA, 20 bp, Homo sapiens
agtgttgggattacaggcgt

SEQ ID NO: 893235 - DNA, 20 bp, Homo sapiens
agtgttgtggatttaacaga

SEQ ID NO: 893236 - DNA, 17 bp, Homo sapiens
agtgttgtgggcttcct

SEQ ID NO: 893237 - DNA, 16 bp, Homo sapiens
agtgttgtgttcctgg

SEQ ID NO: 893238 - DNA, 20 bp, Homo sapiens
agtgttgtgttcctggctga

SEQ ID NO: 893239 - DNA, 15 bp, Homo sapiens
agtgttgttccctcc

SEQ ID NO: 893240 - DNA, 17 bp, Homo sapiens
agtgttgttgctgacca

SEQ ID NO: 893241 - DNA, 20 bp, Homo sapiens
agtgttgttgctgaccagct

SEQ ID NO: 893242 - DNA, 13 bp, Homo sapiens
agtgtttaactgg

SEQ ID NO: 893243 - DNA, 14 bp, Homo sapiens
agtgtttaactggc

SEQ ID NO: 893244 - DNA, 15 bp, Homo sapiens
agtgtttaactggca

SEQ ID NO: 893245 - DNA, 16 bp, Homo sapiens
agtgtttatcctttca

SEQ ID NO: 893246 - DNA, 20 bp, Homo sapiens
agtgtttatcctttcatata

SEQ ID NO: 893247 - DNA, 16 bp, Homo sapiens
agtgtttatgtaatag

SEQ ID NO: 893248 - DNA, 19 bp, Homo sapiens
agtgtttatttttcatatt

SEQ ID NO: 893249 - DNA, 12 bp, Homo sapiens
agtgtttcaatt

SEQ ID NO: 893250 - DNA, 23 bp, Homo sapiens
agtgtttcaattctgtaattaca

SEQ ID NO: 893251 - DNA, 16 bp, Homo sapiens
agtgtttcagattttt

SEQ ID NO: 893252 - DNA, 15 bp, Homo sapiens
agtgtttcccataat

SEQ ID NO: 893253 - DNA, 13 bp, Homo sapiens
agtgtttcctttt

SEQ ID NO: 893254 - DNA, 21 bp, Homo sapiens
agtgtttcgcgggtaactggg

SEQ ID NO: 893255 - DNA, 17 bp, Homo sapiens
agtgtttctaataaact

SEQ ID NO: 893256 - DNA, 21 bp, Homo sapiens
agtgtttctaataaacttgga

SEQ ID NO: 893257 - DNA, 14 bp, Homo sapiens
agtgtttctagcta

SEQ ID NO: 893258 - DNA, 22 bp, Homo sapiens
agtgtttgggggacgtttctca

SEQ ID NO: 893259 - DNA, 23 bp, Homo sapiens
agtgtttgggggacgtttctcat

SEQ ID NO: 893260 - DNA, 13 bp, Homo sapiens
agtgtttgtggga

SEQ ID NO: 893261 - DNA, 20 bp, Homo sapiens
agtgttttaagataaattat

SEQ ID NO: 893262 - DNA, 13 bp, Homo sapiens
agtgttttactct

SEQ ID NO: 893263 - DNA, 18 bp, Homo sapiens
agtgttttagatgttact

SEQ ID NO: 893264 - DNA, 18 bp, Homo sapiens
agtgttttcaattttaaa

SEQ ID NO: 893265 - DNA, 18 bp, Homo sapiens
agtgttttcagaagaaat

SEQ ID NO: 893266 - DNA, 15 bp, Homo sapiens
agtgttttctctgaa

SEQ ID NO: 893267 - DNA, 15 bp, Homo sapiens
agtgttttctgggat

SEQ ID NO: 893268 - DNA, 13 bp, Homo sapiens
agtgttttgcaag

SEQ ID NO: 893269 - DNA, 14 bp, Homo sapiens
agttaaaacacata

SEQ ID NO: 893270 - DNA, 21 bp, Homo sapiens
agttaaaagactgcagctgct

SEQ ID NO: 893271 - DNA, 22 bp, Homo sapiens
agttaaaagtgttgattacata

SEQ ID NO: 893272 - DNA, 20 bp, Homo sapiens
agttaaaattgttatcaaaa

SEQ ID NO: 893273 - DNA, 14 bp, Homo sapiens
agttaaactgatta

SEQ ID NO: 893274 - DNA, 22 bp, Homo sapiens
agttaaagaggagaaggaaaac

SEQ ID NO: 893275 - DNA, 13 bp, Homo sapiens
agttaaaggcagt

SEQ ID NO: 893276 - DNA, 20 bp, Homo sapiens
agttaaaggcagtccagagc

SEQ ID NO: 893277 - DNA, 21 bp, Homo sapiens
agttaaaggcagtccagagct

SEQ ID NO: 893278 - DNA, 16 bp, Homo sapiens
agttaaagtgaataac

SEQ ID NO: 893279 - DNA, 12 bp, Homo sapiens
agttaaataaat

SEQ ID NO: 893280 - DNA, 16 bp, Homo sapiens
agttaaataactgtgt

SEQ ID NO: 893281 - DNA, 20 bp, Homo sapiens
agttaacaaggaatgcctgt

SEQ ID NO: 893282 - DNA, 13 bp, Homo sapiens
agttaacacacta

SEQ ID NO: 893283 - DNA, 16 bp, Homo sapiens
agttaacacactaccg

SEQ ID NO: 893284 - DNA, 12 bp, Homo sapiens
agttaacagaga

SEQ ID NO: 893285 - DNA, 16 bp, Homo sapiens
agttaacaggatatta

SEQ ID NO: 893286 - DNA, 15 bp, Homo sapiens
agttaacatcatgaa

SEQ ID NO: 893287 - DNA, 18 bp, Homo sapiens
agttaacccggagctaag

SEQ ID NO: 893288 - DNA, 24 bp, Homo sapiens
agttaactattgcatttatatgta

SEQ ID NO: 893289 - DNA, 14 bp, Homo sapiens
agttaactttcaga

SEQ ID NO: 893290 - DNA, 14 bp, Homo sapiens
agttaagagtagca

SEQ ID NO: 893291 - DNA, 21 bp, Homo sapiens
agttaagatatccctaatgtt

SEQ ID NO: 893292 - DNA, 22 bp, Homo sapiens
agttaagtctatctggtattaa

SEQ ID NO: 893293 - DNA, 19 bp, Homo sapiens
agttaatactccagagaca

SEQ ID NO: 893294 - DNA, 21 bp, Homo sapiens
agttaatatatcccagaaatt

SEQ ID NO: 893295 - DNA, 15 bp, Homo sapiens
agttaatgtatataa

SEQ ID NO: 893296 - DNA, 18 bp, Homo sapiens
agttaatgtatataaaaa

SEQ ID NO: 893297 - DNA, 20 bp, Homo sapiens
agttaatgtatataaaaatg

SEQ ID NO: 893298 - DNA, 19 bp, Homo sapiens
agttaattccctgctaaat

SEQ ID NO: 893299 - DNA, 15 bp, Homo sapiens
agttaatttttccaa

SEQ ID NO: 893300 - DNA, 19 bp, Homo sapiens
agttacaaagtaatttctt

SEQ ID NO: 893301 - DNA, 15 bp, Homo sapiens
agttacaaagttata

SEQ ID NO: 893302 - DNA, 22 bp, Homo sapiens
agttacagcctgttagtaacat

SEQ ID NO: 893303 - DNA, 16 bp, Homo sapiens
agttacagttctgtgg

SEQ ID NO: 893304 - DNA, 20 bp, Homo sapiens
aaggaatgaaagagagctct

SEQ ID NO: 893305 - DNA, 23 bp, Homo sapiens
aaggaattacattttatatgtga

SEQ ID NO: 893306 - DNA, 16 bp, Homo sapiens
aaggaatttccctgtg

SEQ ID NO: 893307 - DNA, 17 bp, Homo sapiens
aaggaatttgattgctt

SEQ ID NO: 893308 - DNA, 18 bp, Homo sapiens
aaggaatttgattgcttt

SEQ ID NO: 893309 - DNA, 13 bp, Homo sapiens
aaggaatttgtac

SEQ ID NO: 893310 - DNA, 16 bp, Homo sapiens
aaggaatttgtacttc

SEQ ID NO: 893311 - DNA, 23 bp, Homo sapiens
aaggacaaaaatgaactgaagtt

SEQ ID NO: 893312 - DNA, 15 bp, Homo sapiens
aaggacaaattagca

SEQ ID NO: 893313 - DNA, 22 bp, Homo sapiens
aaggacaaattagcatgcaagc

SEQ ID NO: 893314 - DNA, 13 bp, Homo sapiens
aaggacacagtga

SEQ ID NO: 893315 - DNA, 16 bp, Homo sapiens
aaggacacagtgatga

SEQ ID NO: 893316 - DNA, 13 bp, Homo sapiens
aaggacactagaa

SEQ ID NO: 893317 - DNA, 16 bp, Homo sapiens
aaggacagacagcagg

SEQ ID NO: 893318 - DNA, 16 bp, Homo sapiens
aaggacaggagcctgg

SEQ ID NO: 893319 - DNA, 16 bp, Homo sapiens
aaggacaggaggagga

SEQ ID NO: 893320 - DNA, 17 bp, Homo sapiens
aaggacatcagcaaaca

SEQ ID NO: 893321 - DNA, 17 bp, Homo sapiens
aaggacattcactgctg

SEQ ID NO: 893322 - DNA, 19 bp, Homo sapiens
aaggaccaactggcttctg

SEQ ID NO: 893323 - DNA, 20 bp, Homo sapiens
aaggaccaactggcttctgt

SEQ ID NO: 893324 - DNA, 21 bp, Homo sapiens
aaggaccaactggcttctgtg

SEQ ID NO: 893325 - DNA, 22 bp, Homo sapiens
aaggaccaactggcttctgtgc

SEQ ID NO: 893326 - DNA, 16 bp, Homo sapiens
aaggaccacattttat

SEQ ID NO: 893327 - DNA, 24 bp, Homo sapiens
aaggacccacccatcttcctgctg

SEQ ID NO: 893328 - DNA, 18 bp, Homo sapiens
aaggacccggaggggcct

SEQ ID NO: 893329 - DNA, 14 bp, Homo sapiens
aaggaccctgtgag

SEQ ID NO: 893330 - DNA, 15 bp, Homo sapiens
aaggacctaaattcg

SEQ ID NO: 893331 - DNA, 19 bp, Homo sapiens
aaggacgcctgcaggagag

SEQ ID NO: 893332 - DNA, 15 bp, Homo sapiens
aaggacgtaaaattt

SEQ ID NO: 893333 - DNA, 16 bp, Homo sapiens
aaggacgtaaaattta

SEQ ID NO: 893334 - DNA, 19 bp, Homo sapiens
aaggactaatagaaaagta

SEQ ID NO: 893335 - DNA, 22 bp, Homo sapiens
aaggactgagggcagtgccctt

SEQ ID NO: 893336 - DNA, 23 bp, Homo sapiens
aaggactgcgggacttgggtctc

SEQ ID NO: 893337 - DNA, 22 bp, Homo sapiens
aaggacttgaaagcatccatgt

SEQ ID NO: 893338 - DNA, 12 bp, Homo sapiens
aaggagaaaaaa

SEQ ID NO: 893339 - DNA, 18 bp, Homo sapiens
aaggagaaaaaaaacctt

SEQ ID NO: 893340 - DNA, 20 bp, Homo sapiens
aaggagaaaaaaaaccttgt

SEQ ID NO: 893341 - DNA, 15 bp, Homo sapiens
aaggagaaaagtggg

SEQ ID NO: 893342 - DNA, 18 bp, Homo sapiens
aaggagaaaagtgggctg

SEQ ID NO: 893343 - DNA, 21 bp, Homo sapiens
aaggagaaaagtgggctgcag

SEQ ID NO: 893344 - DNA, 21 bp, Homo sapiens
aaggagaaatgataagtgaca

SEQ ID NO: 893345 - DNA, 17 bp, Homo sapiens
aaggagacaaagcagga

SEQ ID NO: 893346 - DNA, 18 bp, Homo sapiens
aaggagacaaagcaggag

SEQ ID NO: 893347 - DNA, 20 bp, Homo sapiens
aaggagacattgctctatgt

SEQ ID NO: 893348 - DNA, 11 bp, Homo sapiens
aaggagagaag

SEQ ID NO: 893349 - DNA, 17 bp, Homo sapiens
aaggagatagggaaaag

SEQ ID NO: 893350 - DNA, 18 bp, Homo sapiens
aaggagatttacaactgg

SEQ ID NO: 893351 - DNA, 14 bp, Homo sapiens
aaggagatttctta

SEQ ID NO: 893352 - DNA, 20 bp, Homo sapiens
aaggagcaaaaatctgagaa

SEQ ID NO: 893353 - DNA, 13 bp, Homo sapiens
aaggagcacaagc

SEQ ID NO: 893354 - DNA, 14 bp, Homo sapiens
aaggagcagtgtga

SEQ ID NO: 893355 - DNA, 18 bp, Homo sapiens
agttctccttttgaactt

SEQ ID NO: 893356 - DNA, 17 bp, Homo sapiens
agttctctcgtaactgg

SEQ ID NO: 893357 - DNA, 14 bp, Homo sapiens
agttctctgatgca

SEQ ID NO: 893358 - DNA, 18 bp, Homo sapiens
agttctctgatgcagaaa

SEQ ID NO: 893359 - DNA, 19 bp, Homo sapiens
agttctctgatgcagaaat

SEQ ID NO: 893360 - DNA, 16 bp, Homo sapiens
agttctctgggaagtg

SEQ ID NO: 893361 - DNA, 11 bp, Homo sapiens
agttctcttcc

SEQ ID NO: 893362 - DNA, 12 bp, Homo sapiens
agttctcttccg

SEQ ID NO: 893363 - DNA, 15 bp, Homo sapiens
agttctcttgtcctg

SEQ ID NO: 893364 - DNA, 15 bp, Homo sapiens
agttctctttggaaa

SEQ ID NO: 893365 - DNA, 22 bp, Homo sapiens
agttctctttggaaatagcatg

SEQ ID NO: 893366 - DNA, 18 bp, Homo sapiens
agttctgaagaaaaatta

SEQ ID NO: 893367 - DNA, 14 bp, Homo sapiens
agttctgagctgta

SEQ ID NO: 893368 - DNA, 14 bp, Homo sapiens
agttctgagtgttt

SEQ ID NO: 893369 - DNA, 22 bp, Homo sapiens
agttctgagtgtttttactaca

SEQ ID NO: 893370 - DNA, 20 bp, Homo sapiens
agttctgattgtgttgaaga

SEQ ID NO: 893371 - DNA, 18 bp, Homo sapiens
agttctgcaggttgaagc

SEQ ID NO: 893372 - DNA, 20 bp, Homo sapiens
agttctgccacctctgacgc

SEQ ID NO: 893373 - DNA, 23 bp, Homo sapiens
agttctgccaggcaacttttaaa

SEQ ID NO: 893374 - DNA, 12 bp, Homo sapiens
agttctgctcct

SEQ ID NO: 893375 - DNA, 20 bp, Homo sapiens
agttctgctcctctccaggc

SEQ ID NO: 893376 - DNA, 13 bp, Homo sapiens
agttctgctgccc

SEQ ID NO: 893377 - DNA, 19 bp, Homo sapiens
agttctggcaagagcagat

SEQ ID NO: 893378 - DNA, 11 bp, Homo sapiens
agttctgggca

SEQ ID NO: 893379 - DNA, 14 bp, Homo sapiens
agttctgggtttct

SEQ ID NO: 893380 - DNA, 16 bp, Homo sapiens
agttctggtgttccta

SEQ ID NO: 893381 - DNA, 18 bp, Homo sapiens
agttctgtgcctcccccc

SEQ ID NO: 893382 - DNA, 19 bp, Homo sapiens
agttctgtggtttcatgtt

SEQ ID NO: 893383 - DNA, 23 bp, Homo sapiens
agttctgtggtttcatgttagtt

SEQ ID NO: 893384 - DNA, 14 bp, Homo sapiens
agttctgtgtactt

SEQ ID NO: 893385 - DNA, 22 bp, Homo sapiens
agttcttagctatccttggctt

SEQ ID NO: 893386 - DNA, 17 bp, Homo sapiens
agttcttatgaggaggg

SEQ ID NO: 893387 - DNA, 20 bp, Homo sapiens
agttcttatgaggaggggag

SEQ ID NO: 893388 - DNA, 15 bp, Homo sapiens
agttcttattttagt

SEQ ID NO: 893389 - DNA, 22 bp, Homo sapiens
agttcttattttagtatacgta

SEQ ID NO: 893390 - DNA, 16 bp, Homo sapiens
agttcttcacctctat

SEQ ID NO: 893391 - DNA, 20 bp, Homo sapiens
agttcttctttctttcttaa

SEQ ID NO: 893392 - DNA, 14 bp, Homo sapiens
agttcttgaattgt

SEQ ID NO: 893393 - DNA, 20 bp, Homo sapiens
agttcttgaattgttatgaa

SEQ ID NO: 893394 - DNA, 21 bp, Homo sapiens
agttcttggaccagtttgcag

SEQ ID NO: 893395 - DNA, 16 bp, Homo sapiens
agttcttgggggaggc

SEQ ID NO: 893396 - DNA, 17 bp, Homo sapiens
agttcttggtgctctgt

SEQ ID NO: 893397 - DNA, 19 bp, Homo sapiens
agttctttcctccccctgc

SEQ ID NO: 893398 - DNA, 19 bp, Homo sapiens
agttctttcctctttctgc

SEQ ID NO: 893399 - DNA, 22 bp, Homo sapiens
agttctttcctctttctgctct

SEQ ID NO: 893400 - DNA, 19 bp, Homo sapiens
agttctttgatttgtacca

SEQ ID NO: 893401 - DNA, 20 bp, Homo sapiens
agttctttgatttgtaccat

SEQ ID NO: 893402 - DNA, 23 bp, Homo sapiens
agttctttgatttgtaccattcc

SEQ ID NO: 893403 - DNA, 21 bp, Homo sapiens
agttctttgctgcccctgtct

SEQ ID NO: 893404 - DNA, 17 bp, Homo sapiens
agttgaaaaacagctga

SEQ ID NO: 893405 - DNA, 18 bp, Homo sapiens
agttgaacactagtctgt

SEQ ID NO: 893406 - DNA, 20 bp, Homo sapiens
agttgaaggctagaagtgtg

SEQ ID NO: 893407 - DNA, 18 bp, Homo sapiens
agttgaagggaggtgaag

SEQ ID NO: 893408 - DNA, 19 bp, Homo sapiens
agttgaatgacaacagaag

SEQ ID NO: 893409 - DNA, 16 bp, Homo sapiens
agttgacaacctagaa

SEQ ID NO: 893410 - DNA, 20 bp, Homo sapiens
agttgacaattctgcatgta

SEQ ID NO: 893411 - DNA, 19 bp, Homo sapiens
agttgaccgttttcatcct

SEQ ID NO: 893412 - DNA, 23 bp, Homo sapiens
agttgactcacaggccctggaga

SEQ ID NO: 893413 - DNA, 15 bp, Homo sapiens
agttgacttatagta

SEQ ID NO: 893414 - DNA, 20 bp, Homo sapiens
agttgagatttttaagaact

SEQ ID NO: 893415 - DNA, 11 bp, Homo sapiens
agttgagcccc

SEQ ID NO: 893416 - DNA, 12 bp, Homo sapiens
agttgagcccca

SEQ ID NO: 893417 - DNA, 16 bp, Homo sapiens
agttgaggccaggagt

SEQ ID NO: 893418 - DNA, 16 bp, Homo sapiens
agttgaggcttataag

SEQ ID NO: 893419 - DNA, 17 bp, Homo sapiens
agttgagtggaatgtgg

SEQ ID NO: 893420 - DNA, 17 bp, Homo sapiens
agttgataacccctctt

SEQ ID NO: 893421 - DNA, 22 bp, Homo sapiens
agttgatataaaactctgggtc

SEQ ID NO: 893422 - DNA, 23 bp, Homo sapiens
agttgatataaaactctgggtct

SEQ ID NO: 893423 - DNA, 13 bp, Homo sapiens
agttgatattcaa

SEQ ID NO: 893424 - DNA, 21 bp, Homo sapiens
agttgatcgcctttcccaggt

SEQ ID NO: 893425 - DNA, 12 bp, Homo sapiens
aaggcaactggg

SEQ ID NO: 893426 - DNA, 21 bp, Homo sapiens
aaggcaagattggaaagacag

SEQ ID NO: 893427 - DNA, 23 bp, Homo sapiens
aaggcaagattggaaagacagga

SEQ ID NO: 893428 - DNA, 16 bp, Homo sapiens
aaggcacagtgggagc

SEQ ID NO: 893429 - DNA, 22 bp, Homo sapiens
aaggcacagtgggagctgagct

SEQ ID NO: 893430 - DNA, 19 bp, Homo sapiens
aaggcacccacaaataaat

SEQ ID NO: 893431 - DNA, 19 bp, Homo sapiens
aaggcacccatctgtctgc

SEQ ID NO: 893432 - DNA, 22 bp, Homo sapiens
aaggcacccatctgtctgccaa

SEQ ID NO: 893433 - DNA, 21 bp, Homo sapiens
aaggcactctgttatttagac

SEQ ID NO: 893434 - DNA, 11 bp, Homo sapiens
aaggcactgtc

SEQ ID NO: 893435 - DNA, 20 bp, Homo sapiens
aaggcagagaagttctcaaa

SEQ ID NO: 893436 - DNA, 15 bp, Homo sapiens
aaggcagaggaattt

SEQ ID NO: 893437 - DNA, 22 bp, Homo sapiens
aaggcagatgtaaatgatgtgt

SEQ ID NO: 893438 - DNA, 16 bp, Homo sapiens
aaggcagcctccagag

SEQ ID NO: 893439 - DNA, 19 bp, Homo sapiens
aaggcagcctccagagcca

SEQ ID NO: 893440 - DNA, 21 bp, Homo sapiens
aaggcagcctccagagccagc

SEQ ID NO: 893441 - DNA, 22 bp, Homo sapiens
aaggcagcctccagagccagcc

SEQ ID NO: 893442 - DNA, 23 bp, Homo sapiens
aaggcagcctccagagccagcct

SEQ ID NO: 893443 - DNA, 17 bp, Homo sapiens
aaggcagcctgaacact

SEQ ID NO: 893444 - DNA, 16 bp, Homo sapiens
aaggcagctcacccct

SEQ ID NO: 893445 - DNA, 20 bp, Homo sapiens
aaggcagctcacccctgggc

SEQ ID NO: 893446 - DNA, 21 bp, Homo sapiens
aaggcagctcacccctgggca

SEQ ID NO: 893447 - DNA, 18 bp, Homo sapiens
aaggcagctcttctggag

SEQ ID NO: 893448 - DNA, 13 bp, Homo sapiens
aaggcagctgcct

SEQ ID NO: 893449 - DNA, 16 bp, Homo sapiens
aaggcagctgcctctg

SEQ ID NO: 893450 - DNA, 20 bp, Homo sapiens
aaggcagctgcctctgctcc

SEQ ID NO: 893451 - DNA, 22 bp, Homo sapiens
aaggcagctgcctctgctccct

SEQ ID NO: 893452 - DNA, 19 bp, Homo sapiens
aaggcaggaagggaagcgt

SEQ ID NO: 893453 - DNA, 18 bp, Homo sapiens
aaggcagggaaaggctct

SEQ ID NO: 893454 - DNA, 11 bp, Homo sapiens
aaggcagggcc

SEQ ID NO: 893455 - DNA, 17 bp, Homo sapiens
aaggcaggtgcctccag

SEQ ID NO: 893456 - DNA, 19 bp, Homo sapiens
aaggcaggtttcatttctt

SEQ ID NO: 893457 - DNA, 20 bp, Homo sapiens
aaggcagtagttttcaaaac

SEQ ID NO: 893458 - DNA, 18 bp, Homo sapiens
aaggcagtccagagcttt

SEQ ID NO: 893459 - DNA, 15 bp, Homo sapiens
aaggcagtcccggga

SEQ ID NO: 893460 - DNA, 15 bp, Homo sapiens
aaggcagtgcatgca

SEQ ID NO: 893461 - DNA, 18 bp, Homo sapiens
aaggcagtgcatgcatgt

SEQ ID NO: 893462 - DNA, 20 bp, Homo sapiens
aaggcagtgcctgctctgct

SEQ ID NO: 893463 - DNA, 15 bp, Homo sapiens
aaggcagtttgcaaa

SEQ ID NO: 893464 - DNA, 19 bp, Homo sapiens
aaggcagtttgcaaaaaat

SEQ ID NO: 893465 - DNA, 17 bp, Homo sapiens
aaggcatacgagagcag

SEQ ID NO: 893466 - DNA, 12 bp, Homo sapiens
aaggcatgaagg

SEQ ID NO: 893467 - DNA, 21 bp, Homo sapiens
aaggcatgtggcctttatctc

SEQ ID NO: 893468 - DNA, 17 bp, Homo sapiens
aaggcatttggctgctg

SEQ ID NO: 893469 - DNA, 18 bp, Homo sapiens
aaggccaaaatcaagagt

SEQ ID NO: 893470 - DNA, 14 bp, Homo sapiens
aaggccaaagataa

SEQ ID NO: 893471 - DNA, 15 bp, Homo sapiens
aaggccacaggcagt

SEQ ID NO: 893472 - DNA, 18 bp, Homo sapiens
aaggccacaggcagtcca

SEQ ID NO: 893473 - DNA, 18 bp, Homo sapiens
aaggccagaaggaggggg

SEQ ID NO: 893474 - DNA, 17 bp, Homo sapiens
aaggccagagtggcctg

SEQ ID NO: 893475 - DNA, 19 bp, Homo sapiens
aaggccagagtggcctggc

SEQ ID NO: 893476 - DNA, 16 bp, Homo sapiens
aaggccagtggaagaa

SEQ ID NO: 893477 - DNA, 14 bp, Homo sapiens
aaggccataaaaca

SEQ ID NO: 893478 - DNA, 17 bp, Homo sapiens
aaggccataaaacaggt

SEQ ID NO: 893479 - DNA, 18 bp, Homo sapiens
aaggccataaaacaggta

SEQ ID NO: 893480 - DNA, 24 bp, Homo sapiens
aaggccataaaacaggtaatataa

SEQ ID NO: 893481 - DNA, 17 bp, Homo sapiens
agttggtgtaatcattt

SEQ ID NO: 893482 - DNA, 16 bp, Homo sapiens
agttggtgttgacata

SEQ ID NO: 893483 - DNA, 13 bp, Homo sapiens
agttggtttgtat

SEQ ID NO: 893484 - DNA, 16 bp, Homo sapiens
agttggtttgtatgag

SEQ ID NO: 893485 - DNA, 12 bp, Homo sapiens
agttgtaaagta

SEQ ID NO: 893486 - DNA, 13 bp, Homo sapiens
agttgtaaagtat

SEQ ID NO: 893487 - DNA, 16 bp, Homo sapiens
agttgtaaataatttt

SEQ ID NO: 893488 - DNA, 18 bp, Homo sapiens
agttgtaaataattttct

SEQ ID NO: 893489 - DNA, 14 bp, Homo sapiens
agttgtaaatatat

SEQ ID NO: 893490 - DNA, 17 bp, Homo sapiens
agttgtaaatatataaa

SEQ ID NO: 893491 - DNA, 20 bp, Homo sapiens
agttgtaaatatataaatat

SEQ ID NO: 893492 - DNA, 14 bp, Homo sapiens
agttgtagacaaag

SEQ ID NO: 893493 - DNA, 16 bp, Homo sapiens
agttgtagacaaagta

SEQ ID NO: 893494 - DNA, 22 bp, Homo sapiens
agttgtagcaaagatttcaaaa

SEQ ID NO: 893495 - DNA, 18 bp, Homo sapiens
agttgtagcagattgttt

SEQ ID NO: 893496 - DNA, 16 bp, Homo sapiens
agttgtatctcttttg

SEQ ID NO: 893497 - DNA, 17 bp, Homo sapiens
agttgtatctcttttga

SEQ ID NO: 893498 - DNA, 21 bp, Homo sapiens
agttgtcctatggacaactta

SEQ ID NO: 893499 - DNA, 21 bp, Homo sapiens
agttgtcgtttttagctttgt

SEQ ID NO: 893500 - DNA, 20 bp, Homo sapiens
agttgtctattctgagcctt

SEQ ID NO: 893501 - DNA, 16 bp, Homo sapiens
agttgtctctgatgca

SEQ ID NO: 893502 - DNA, 13 bp, Homo sapiens
agttgtcttgtcc

SEQ ID NO: 893503 - DNA, 20 bp, Homo sapiens
agttgtgaaagaaagctgag

SEQ ID NO: 893504 - DNA, 22 bp, Homo sapiens
agttgtgagtttaccttgtata

SEQ ID NO: 893505 - DNA, 15 bp, Homo sapiens
agttgtgatataaag

SEQ ID NO: 893506 - DNA, 19 bp, Homo sapiens
agttgtggaaagcctctgc

SEQ ID NO: 893507 - DNA, 17 bp, Homo sapiens
agttgtgggtgggagag

SEQ ID NO: 893508 - DNA, 23 bp, Homo sapiens
agttgtgttgttttttgttcaat

SEQ ID NO: 893509 - DNA, 16 bp, Homo sapiens
agttgttaataaaagt

SEQ ID NO: 893510 - DNA, 23 bp, Homo sapiens
agttgttaataaaagtacatgtt

SEQ ID NO: 893511 - DNA, 15 bp, Homo sapiens
agttgttacattttt

SEQ ID NO: 893512 - DNA, 16 bp, Homo sapiens
agttgttacattttta

SEQ ID NO: 893513 - DNA, 22 bp, Homo sapiens
agttgttacatttttaagtgct

SEQ ID NO: 893514 - DNA, 20 bp, Homo sapiens
agttgttactaactaaactc

SEQ ID NO: 893515 - DNA, 22 bp, Homo sapiens
agttgttactaactaaactctc

SEQ ID NO: 893516 - DNA, 17 bp, Homo sapiens
agttgttctgaaatgtc

SEQ ID NO: 893517 - DNA, 13 bp, Homo sapiens
agttgttgactgt

SEQ ID NO: 893518 - DNA, 18 bp, Homo sapiens
agttgttgactgtgatta

SEQ ID NO: 893519 - DNA, 23 bp, Homo sapiens
agttgttgctatacatgttggaa

SEQ ID NO: 893520 - DNA, 14 bp, Homo sapiens
agttgttggcctcc

SEQ ID NO: 893521 - DNA, 22 bp, Homo sapiens
agttgttggtttattttaatgg

SEQ ID NO: 893522 - DNA, 12 bp, Homo sapiens
agttgttgtaac

SEQ ID NO: 893523 - DNA, 12 bp, Homo sapiens
agttgtttagat

SEQ ID NO: 893524 - DNA, 13 bp, Homo sapiens
agttgtttcattg

SEQ ID NO: 893525 - DNA, 16 bp, Homo sapiens
agttgtttcattgact

SEQ ID NO: 893526 - DNA, 19 bp, Homo sapiens
agttgtttcattgactatc

SEQ ID NO: 893527 - DNA, 16 bp, Homo sapiens
agttgtttctgaccca

SEQ ID NO: 893528 - DNA, 11 bp, Homo sapiens
agttgtttgat

SEQ ID NO: 893529 - DNA, 15 bp, Homo sapiens
agttgtttgtgcctt

SEQ ID NO: 893530 - DNA, 12 bp, Homo sapiens
agtttaaaaaaa

SEQ ID NO: 893531 - DNA, 14 bp, Homo sapiens
agtttaaaaaaatt

SEQ ID NO: 893532 - DNA, 14 bp, Homo sapiens
agtttaaaaaatca

SEQ ID NO: 893533 - DNA, 18 bp, Homo sapiens
agtttaaaacagaagcct

SEQ ID NO: 893534 - DNA, 14 bp, Homo sapiens
agtttaaaatgcag

SEQ ID NO: 893535 - DNA, 19 bp, Homo sapiens
agtttaacaaatgactgta

SEQ ID NO: 893536 - DNA, 17 bp, Homo sapiens
agtttaactttaaaact

SEQ ID NO: 893537 - DNA, 23 bp, Homo sapiens
agtttaagggtggaaaaatgccc

SEQ ID NO: 893538 - DNA, 14 bp, Homo sapiens
agtttaattgactt

SEQ ID NO: 893539 - DNA, 22 bp, Homo sapiens
agtttacaacttgattttttca

SEQ ID NO: 893540 - DNA, 17 bp, Homo sapiens
agtttacaagtgtatat

SEQ ID NO: 893541 - DNA, 19 bp, Homo sapiens
agtttacaagtgtatatca

SEQ ID NO: 893542 - DNA, 21 bp, Homo sapiens
agtttacaagtgtatatcaga

SEQ ID NO: 893543 - DNA, 19 bp, Homo sapiens
agtttacagaaaaatcttg

SEQ ID NO: 893544 - DNA, 13 bp, Homo sapiens
agtttaccatttg

SEQ ID NO: 893545 - DNA, 14 bp, Homo sapiens
agtttaccatttgt

SEQ ID NO: 893546 - DNA, 17 bp, Homo sapiens
agtttaccatttgtaat

SEQ ID NO: 893547 - DNA, 20 bp, Homo sapiens
aagggttggtgggctggccc

SEQ ID NO: 893548 - DNA, 21 bp, Homo sapiens
aagggtttcagagaaaggact

SEQ ID NO: 893549 - DNA, 20 bp, Homo sapiens
aagggtttcgactggtccag

SEQ ID NO: 893550 - DNA, 20 bp, Homo sapiens
aagggtttgtaatactttac

SEQ ID NO: 893551 - DNA, 20 bp, Homo sapiens
aagggtttgtggctgggggc

SEQ ID NO: 893552 - DNA, 19 bp, Homo sapiens
aagggttttccaccctgga

SEQ ID NO: 893553 - DNA, 15 bp, Homo sapiens
aagggttttgtgtgt

SEQ ID NO: 893554 - DNA, 21 bp, Homo sapiens
aagggttttttttttttcctt

SEQ ID NO: 893555 - DNA, 23 bp, Homo sapiens
aagggttttttttttttcctttt

SEQ ID NO: 893556 - DNA, 19 bp, Homo sapiens
aaggtaaaatcacttcaga

SEQ ID NO: 893557 - DNA, 22 bp, Homo sapiens
aaggtaaaatcacttcagatct

SEQ ID NO: 893558 - DNA, 12 bp, Homo sapiens
aaggtaaatggt

SEQ ID NO: 893559 - DNA, 12 bp, Homo sapiens
aaggtaactaac

SEQ ID NO: 893560 - DNA, 23 bp, Homo sapiens
aaggtaactactgctaatgttga

SEQ ID NO: 893561 - DNA, 22 bp, Homo sapiens
aaggtaagaggttggtgtggag

SEQ ID NO: 893562 - DNA, 21 bp, Homo sapiens
aaggtaagctcaggatatggc

SEQ ID NO: 893563 - DNA, 12 bp, Homo sapiens
aaggtaattgtt

SEQ ID NO: 893564 - DNA, 23 bp, Homo sapiens
aaggtaatttgatggtatttctt

SEQ ID NO: 893565 - DNA, 18 bp, Homo sapiens
aaggtacaagaagcattt

SEQ ID NO: 893566 - DNA, 18 bp, Homo sapiens
aaggtaccaaacaaggaa

SEQ ID NO: 893567 - DNA, 18 bp, Homo sapiens
aaggtactttcatatttt

SEQ ID NO: 893568 - DNA, 20 bp, Homo sapiens
aaggtagatcctgagatgat

SEQ ID NO: 893569 - DNA, 14 bp, Homo sapiens
aaggtagccatccc

SEQ ID NO: 893570 - DNA, 11 bp, Homo sapiens
aaggtataatt

SEQ ID NO: 893571 - DNA, 23 bp, Homo sapiens
aaggtatggtggggatattttta

SEQ ID NO: 893572 - DNA, 18 bp, Homo sapiens
aaggtattaaattgatgt

SEQ ID NO: 893573 - DNA, 19 bp, Homo sapiens
aaggtatttcgaaactgcc

SEQ ID NO: 893574 - DNA, 18 bp, Homo sapiens
aaggtcactgtttcctgg

SEQ ID NO: 893575 - DNA, 17 bp, Homo sapiens
aaggtcagcgagaagga

SEQ ID NO: 893576 - DNA, 16 bp, Homo sapiens
aaggtcagggacacat

SEQ ID NO: 893577 - DNA, 21 bp, Homo sapiens
aaggtcatccaaagaacatct

SEQ ID NO: 893578 - DNA, 12 bp, Homo sapiens
aaggtcattttt

SEQ ID NO: 893579 - DNA, 14 bp, Homo sapiens
aaggtcctctcagt

SEQ ID NO: 893580 - DNA, 20 bp, Homo sapiens
aaggtcctctgtcagtcaca

SEQ ID NO: 893581 - DNA, 13 bp, Homo sapiens
aaggtcctgccct

SEQ ID NO: 893582 - DNA, 24 bp, Homo sapiens
aaggtcctgctcaactctacccct

SEQ ID NO: 893583 - DNA, 23 bp, Homo sapiens
aaggtctcatgctgttgctgcta

SEQ ID NO: 893584 - DNA, 23 bp, Homo sapiens
aaggtctccttactctgagccca

SEQ ID NO: 893585 - DNA, 20 bp, Homo sapiens
aaggtcttcttgtgtcctga

SEQ ID NO: 893586 - DNA, 12 bp, Homo sapiens
aaggtctttgca

SEQ ID NO: 893587 - DNA, 20 bp, Homo sapiens
aaggtctttgtaaaatcttg

SEQ ID NO: 893588 - DNA, 13 bp, Homo sapiens
aaggtctttgtta

SEQ ID NO: 893589 - DNA, 22 bp, Homo sapiens
aaggtgaaacgactcaaaatga

SEQ ID NO: 893590 - DNA, 20 bp, Homo sapiens
aaggtgacatcggaaaaata

SEQ ID NO: 893591 - DNA, 21 bp, Homo sapiens
aaggtgacatcggaaaaataa

SEQ ID NO: 893592 - DNA, 14 bp, Homo sapiens
aaggtgactgtgtg

SEQ ID NO: 893593 - DNA, 15 bp, Homo sapiens
aaggtgactgtgtgt

SEQ ID NO: 893594 - DNA, 20 bp, Homo sapiens
aaggtgagtttgagctgcct

SEQ ID NO: 893595 - DNA, 19 bp, Homo sapiens
aaggtgataagggaaaaga

SEQ ID NO: 893596 - DNA, 19 bp, Homo sapiens
aaggtgcatatagaaaaca

SEQ ID NO: 893597 - DNA, 19 bp, Homo sapiens
aaggtgccagaaggaaggt

SEQ ID NO: 893598 - DNA, 11 bp, Homo sapiens
aaggtgcctgt

SEQ ID NO: 893599 - DNA, 20 bp, Homo sapiens
aaggtgctatataattgtga

SEQ ID NO: 893600 - DNA, 19 bp, Homo sapiens
aaggtgctctctttctgtc

SEQ ID NO: 893601 - DNA, 23 bp, Homo sapiens
aaggtgctggtgggtctgagctg

SEQ ID NO: 893602 - DNA, 17 bp, Homo sapiens
aaggtggaataaacatt

SEQ ID NO: 893603 - DNA, 21 bp, Homo sapiens
aaggtggaataaacattaatt

SEQ ID NO: 893604 - DNA, 15 bp, Homo sapiens
aaggtggagggaagg

SEQ ID NO: 893605 - DNA, 21 bp, Homo sapiens
aaggtggcagatgtcttccct

SEQ ID NO: 893606 - DNA, 15 bp, Homo sapiens
aaggtggccacagca

SEQ ID NO: 893607 - DNA, 16 bp, Homo sapiens
aaggtggcctctgcct

SEQ ID NO: 893608 - DNA, 18 bp, Homo sapiens
aaggtggcctctgcctgg

SEQ ID NO: 893609 - DNA, 19 bp, Homo sapiens
aaggtggcctctgcctggg

SEQ ID NO: 893610 - DNA, 22 bp, Homo sapiens
aaggtgggccttgctacctcaa

SEQ ID NO: 893611 - DNA, 21 bp, Homo sapiens
aaggtgggctgagccctggca

SEQ ID NO: 893612 - DNA, 15 bp, Homo sapiens
agttttgtaagccct

SEQ ID NO: 893613 - DNA, 11 bp, Homo sapiens
agttttgtata

SEQ ID NO: 893614 - DNA, 18 bp, Homo sapiens
agttttgtataaataata

SEQ ID NO: 893615 - DNA, 20 bp, Homo sapiens
agttttgtctaattatcaat

SEQ ID NO: 893616 - DNA, 12 bp, Homo sapiens
agttttgtctgt

SEQ ID NO: 893617 - DNA, 17 bp, Homo sapiens
agttttgtctgtctccc

SEQ ID NO: 893618 - DNA, 12 bp, Homo sapiens
agttttgtcttg

SEQ ID NO: 893619 - DNA, 16 bp, Homo sapiens
agttttgtgtgtatat

SEQ ID NO: 893620 - DNA, 23 bp, Homo sapiens
agttttgtgtgtatatatttaaa

SEQ ID NO: 893621 - DNA, 21 bp, Homo sapiens
agttttgtgtttgttgtagat

SEQ ID NO: 893622 - DNA, 17 bp, Homo sapiens
agtttttataatagatt

SEQ ID NO: 893623 - DNA, 13 bp, Homo sapiens
agtttttatacca

SEQ ID NO: 893624 - DNA, 14 bp, Homo sapiens
agtttttatagcta

SEQ ID NO: 893625 - DNA, 22 bp, Homo sapiens
agtttttatatagtctacagtt

SEQ ID NO: 893626 - DNA, 18 bp, Homo sapiens
agtttttatgagaaactt

SEQ ID NO: 893627 - DNA, 23 bp, Homo sapiens
agtttttatggcttttgtgcatt

SEQ ID NO: 893628 - DNA, 20 bp, Homo sapiens
agtttttcattaaataaatt

SEQ ID NO: 893629 - DNA, 22 bp, Homo sapiens
agtttttcattaaataaatttg

SEQ ID NO: 893630 - DNA, 23 bp, Homo sapiens
agtttttcatttgttttgctttt

SEQ ID NO: 893631 - DNA, 12 bp, Homo sapiens
agtttttcctcc

SEQ ID NO: 893632 - DNA, 21 bp, Homo sapiens
agtttttctttaatatgattc

SEQ ID NO: 893633 - DNA, 22 bp, Homo sapiens
agtttttggagtgttatgtatt

SEQ ID NO: 893634 - DNA, 16 bp, Homo sapiens
agtttttgtaatttat

SEQ ID NO: 893635 - DNA, 12 bp, Homo sapiens
agtttttgtatc

SEQ ID NO: 893636 - DNA, 13 bp, Homo sapiens
agtttttgtatct

SEQ ID NO: 893637 - DNA, 14 bp, Homo sapiens
agtttttgtatctt

SEQ ID NO: 893638 - DNA, 18 bp, Homo sapiens
agtttttgtttgtttctt

SEQ ID NO: 893639 - DNA, 19 bp, Homo sapiens
agtttttgtttttgcatga

SEQ ID NO: 893640 - DNA, 22 bp, Homo sapiens
agtttttgtttttgcatgaaat

SEQ ID NO: 893641 - DNA, 15 bp, Homo sapiens
agttttttactttgg

SEQ ID NO: 893642 - DNA, 21 bp, Homo sapiens
agttttttacttttgtttatt

SEQ ID NO: 893643 - DNA, 13 bp, Homo sapiens
agttttttcatct

SEQ ID NO: 893644 - DNA, 14 bp, Homo sapiens
agttttttcatctt

SEQ ID NO: 893645 - DNA, 18 bp, Homo sapiens
agttttttctcttgggct

SEQ ID NO: 893646 - DNA, 17 bp, Homo sapiens
agtttttttccttaaaa

SEQ ID NO: 893647 - DNA, 16 bp, Homo sapiens
agttttttttgtaaac

SEQ ID NO: 893648 - DNA, 22 bp, Homo sapiens
agttttttttttcttgtctata

SEQ ID NO: 893649 - DNA, 16 bp, Homo sapiens
agtttttttttttcca

SEQ ID NO: 893650 - DNA, 14 bp, Homo sapiens
ataaaaaaatgatg

SEQ ID NO: 893651 - DNA, 17 bp, Homo sapiens
ataaaaaaatgatgcag

SEQ ID NO: 893652 - DNA, 10 bp, Homo sapiens
ataaaaaaga

SEQ ID NO: 893653 - DNA, 14 bp, Homo sapiens
ataaaaaagaaaga

SEQ ID NO: 893654 - DNA, 15 bp, Homo sapiens
ataaaaaagattcta

SEQ ID NO: 893655 - DNA, 17 bp, Homo sapiens
ataaaaaatagacatgt

SEQ ID NO: 893656 - DNA, 17 bp, Homo sapiens
ataaaaaatatgtattt

SEQ ID NO: 893657 - DNA, 19 bp, Homo sapiens
ataaaaaatattcttgtca

SEQ ID NO: 893658 - DNA, 16 bp, Homo sapiens
ataaaaaatcatgcca

SEQ ID NO: 893659 - DNA, 12 bp, Homo sapiens
ataaaaaatgga

SEQ ID NO: 893660 - DNA, 18 bp, Homo sapiens
ataaaaactaatttcata

SEQ ID NO: 893661 - DNA, 22 bp, Homo sapiens
ataaaaagaaaagataaagatg

SEQ ID NO: 893662 - DNA, 22 bp, Homo sapiens
ataaaaagaggatgatttcaga

SEQ ID NO: 893663 - DNA, 13 bp, Homo sapiens
ataaaaagcaaaa

SEQ ID NO: 893664 - DNA, 16 bp, Homo sapiens
ataaaaagcaaaacaa

SEQ ID NO: 893665 - DNA, 13 bp, Homo sapiens
ataaaaagcagaa

SEQ ID NO: 893666 - DNA, 21 bp, Homo sapiens
ataaaaagcttccatgattct

SEQ ID NO: 893667 - DNA, 13 bp, Homo sapiens
ataaaaaggaaat

SEQ ID NO: 893668 - DNA, 16 bp, Homo sapiens
ataaactcagatctga

SEQ ID NO: 893669 - DNA, 18 bp, Homo sapiens
ataaactcagatctgatc

SEQ ID NO: 893670 - DNA, 12 bp, Homo sapiens
ataaactgaata

SEQ ID NO: 893671 - DNA, 23 bp, Homo sapiens
ataaactgaatattttggaaact

SEQ ID NO: 893672 - DNA, 12 bp, Homo sapiens
ataaactgactt

SEQ ID NO: 893673 - DNA, 13 bp, Homo sapiens
ataaactgacttt

SEQ ID NO: 893674 - DNA, 14 bp, Homo sapiens
ataaactgtattaa

SEQ ID NO: 893675 - DNA, 19 bp, Homo sapiens
ataaactgtattaaatctt

SEQ ID NO: 893676 - DNA, 17 bp, Homo sapiens
ataaacttagaggaaaa

SEQ ID NO: 893677 - DNA, 23 bp, Homo sapiens
ataaacttagtgcggacaagttt

SEQ ID NO: 893678 - DNA, 13 bp, Homo sapiens
ataaacttcttaa

SEQ ID NO: 893679 - DNA, 15 bp, Homo sapiens
ataaacttcttaaca

SEQ ID NO: 893680 - DNA, 21 bp, Homo sapiens
ataaactttaccttttttata

SEQ ID NO: 893681 - DNA, 23 bp, Homo sapiens
ataaacttttttttgagaatggt

SEQ ID NO: 893682 - DNA, 14 bp, Homo sapiens
ataaagaaaaagaa

SEQ ID NO: 893683 - DNA, 18 bp, Homo sapiens
ataaagaaaaagaagtac

SEQ ID NO: 893684 - DNA, 14 bp, Homo sapiens
ataaagaaatattt

SEQ ID NO: 893685 - DNA, 18 bp, Homo sapiens
ataaagaaatatttacct

SEQ ID NO: 893686 - DNA, 16 bp, Homo sapiens
ataaagacctataaat

SEQ ID NO: 893687 - DNA, 23 bp, Homo sapiens
ataaagacggattctaaggactc

SEQ ID NO: 893688 - DNA, 10 bp, Homo sapiens
ataaagactt

SEQ ID NO: 893689 - DNA, 13 bp, Homo sapiens
ataaagagttaga

SEQ ID NO: 893690 - DNA, 15 bp, Homo sapiens
ataaagataaaatat

SEQ ID NO: 893691 - DNA, 14 bp, Homo sapiens
ataaagatatatag

SEQ ID NO: 893692 - DNA, 13 bp, Homo sapiens
ataaagatgagtt

SEQ ID NO: 893693 - DNA, 16 bp, Homo sapiens
ataaagatgttaaatg

SEQ ID NO: 893694 - DNA, 17 bp, Homo sapiens
ataaagatgttaaatgg

SEQ ID NO: 893695 - DNA, 20 bp, Homo sapiens
ataaagattatataaagacc

SEQ ID NO: 893696 - DNA, 13 bp, Homo sapiens
ataaagattgtac

SEQ ID NO: 893697 - DNA, 16 bp, Homo sapiens
ataaagattttttaat

SEQ ID NO: 893698 - DNA, 17 bp, Homo sapiens
ataaagattttttaata

SEQ ID NO: 893699 - DNA, 16 bp, Homo sapiens
ataaagcaaattactc

SEQ ID NO: 893700 - DNA, 14 bp, Homo sapiens
ataaagcacagctg

SEQ ID NO: 893701 - DNA, 14 bp, Homo sapiens
ataaagcagagcca

SEQ ID NO: 893702 - DNA, 14 bp, Homo sapiens
ataaagcagtattt

SEQ ID NO: 893703 - DNA, 13 bp, Homo sapiens
ataaagcattctt

SEQ ID NO: 893704 - DNA, 18 bp, Homo sapiens
ataaagcatttataaatt

SEQ ID NO: 893705 - DNA, 15 bp, Homo sapiens
ataaagccaaatttc

SEQ ID NO: 893706 - DNA, 16 bp, Homo sapiens
ataaagccacttctgg

SEQ ID NO: 893707 - DNA, 18 bp, Homo sapiens
ataaagcctgtattctca

SEQ ID NO: 893708 - DNA, 20 bp, Homo sapiens
ataaagcctgttttgtcttt

SEQ ID NO: 893709 - DNA, 12 bp, Homo sapiens
ataaagccttta

SEQ ID NO: 893710 - DNA, 16 bp, Homo sapiens
ataaagcctttaaaac

SEQ ID NO: 893711 - DNA, 14 bp, Homo sapiens
ataaaggataaaga

SEQ ID NO: 893712 - DNA, 15 bp, Homo sapiens
ataaaggataactct

SEQ ID NO: 893713 - DNA, 23 bp, Homo sapiens
ataaaggataactctgtattaca

SEQ ID NO: 893714 - DNA, 17 bp, Homo sapiens
ataaaggatgtgattgt

SEQ ID NO: 893715 - DNA, 21 bp, Homo sapiens
ataaaggatgtgattgtggaa

SEQ ID NO: 893716 - DNA, 18 bp, Homo sapiens
ataaaggcagctgcctct

SEQ ID NO: 893717 - DNA, 22 bp, Homo sapiens
ataaaggcagctgcctctgctc

SEQ ID NO: 893718 - DNA, 23 bp, Homo sapiens
ataaaggcagctgcctctgctcc

SEQ ID NO: 893719 - DNA, 17 bp, Homo sapiens
ataaaggcagttttcta

SEQ ID NO: 893720 - DNA, 22 bp, Homo sapiens
ataaaggccacaggagacatta

SEQ ID NO: 893721 - DNA, 15 bp, Homo sapiens
ataaaggcgctaatt

SEQ ID NO: 893722 - DNA, 23 bp, Homo sapiens
ataaagggagaatggtgctgttt

SEQ ID NO: 893723 - DNA, 17 bp, Homo sapiens
ataaagggttgaaaatg

SEQ ID NO: 893724 - DNA, 19 bp, Homo sapiens
ataaaggtaaaatcacttc

SEQ ID NO: 893725 - DNA, 20 bp, Homo sapiens
ataaaggtaaaatcacttca

SEQ ID NO: 893726 - DNA, 15 bp, Homo sapiens
ataaaggtctttgca

SEQ ID NO: 893727 - DNA, 14 bp, Homo sapiens
ataaaggtgtagaa

SEQ ID NO: 893728 - DNA, 18 bp, Homo sapiens
ataaagtaaatacatgca

SEQ ID NO: 893729 - DNA, 15 bp, Homo sapiens
ataaagtaataatgt

SEQ ID NO: 893730 - DNA, 22 bp, Homo sapiens
ataaagtacaaatgaagaaagt

SEQ ID NO: 893731 - DNA, 14 bp, Homo sapiens
ataaagtagaaatg

SEQ ID NO: 893732 - DNA, 17 bp, Homo sapiens
ataaagtagcaaaacaa

SEQ ID NO: 893733 - DNA, 16 bp, Homo sapiens
ataaagtagtcctgtg

SEQ ID NO: 893734 - DNA, 13 bp, Homo sapiens
ataaagtatatat

SEQ ID NO: 893735 - DNA, 17 bp, Homo sapiens
ataaagtatcatgcatt

SEQ ID NO: 893736 - DNA, 18 bp, Homo sapiens
ataaagtatcatgcattc

SEQ ID NO: 893737 - DNA, 20 bp, Homo sapiens
ataaagtattccaccttaaa

SEQ ID NO: 893738 - DNA, 23 bp, Homo sapiens
ataaagtattccaccttaaatta

SEQ ID NO: 893739 - DNA, 15 bp, Homo sapiens
ataaagtattctttt

SEQ ID NO: 893740 - DNA, 17 bp, Homo sapiens
ataaagtcatttgtgaa

SEQ ID NO: 893741 - DNA, 18 bp, Homo sapiens
ataaagtcatttgtgaaa

SEQ ID NO: 893742 - DNA, 14 bp, Homo sapiens
aagtataaggtgct

SEQ ID NO: 893743 - DNA, 14 bp, Homo sapiens
aagtataatctttc

SEQ ID NO: 893744 - DNA, 18 bp, Homo sapiens
aagtataatctttctata

SEQ ID NO: 893745 - DNA, 18 bp, Homo sapiens
aagtatacaacaggagag

SEQ ID NO: 893746 - DNA, 15 bp, Homo sapiens
aagtatacataagtt

SEQ ID NO: 893747 - DNA, 12 bp, Homo sapiens
aagtatactttt

SEQ ID NO: 893748 - DNA, 16 bp, Homo sapiens
aagtatagaaaatctt

SEQ ID NO: 893749 - DNA, 18 bp, Homo sapiens
aagtatagaaaatcttca

SEQ ID NO: 893750 - DNA, 13 bp, Homo sapiens
aagtatagaaata

SEQ ID NO: 893751 - DNA, 16 bp, Homo sapiens
aagtatataatatgtc

SEQ ID NO: 893752 - DNA, 16 bp, Homo sapiens
aagtatatagtatatt

SEQ ID NO: 893753 - DNA, 21 bp, Homo sapiens
aagtatatagtatatttatac

SEQ ID NO: 893754 - DNA, 12 bp, Homo sapiens
aagtatatatta

SEQ ID NO: 893755 - DNA, 21 bp, Homo sapiens
aagtatatgtgaaaaaaatga

SEQ ID NO: 893756 - DNA, 15 bp, Homo sapiens
aagtatattcttatt

SEQ ID NO: 893757 - DNA, 19 bp, Homo sapiens
aagtatattgtgagttttc

SEQ ID NO: 893758 - DNA, 17 bp, Homo sapiens
aagtatcaagtatagaa

SEQ ID NO: 893759 - DNA, 19 bp, Homo sapiens
aagtatcatcagtgtagaa

SEQ ID NO: 893760 - DNA, 11 bp, Homo sapiens
aagtatcatgc

SEQ ID NO: 893761 - DNA, 20 bp, Homo sapiens
aagtatctgggattattctt

SEQ ID NO: 893762 - DNA, 19 bp, Homo sapiens
aagtatcttctatttttat

SEQ ID NO: 893763 - DNA, 20 bp, Homo sapiens
aagtatcttctatttttatc

SEQ ID NO: 893764 - DNA, 23 bp, Homo sapiens
aagtatcttctatttttatcatg

SEQ ID NO: 893765 - DNA, 21 bp, Homo sapiens
aagtatgagggaaaatgagta

SEQ ID NO: 893766 - DNA, 11 bp, Homo sapiens
aagtatgcaaa

SEQ ID NO: 893767 - DNA, 15 bp, Homo sapiens
aagtatgcaaaataa

SEQ ID NO: 893768 - DNA, 20 bp, Homo sapiens
aagtatgcaaaataaagaat

SEQ ID NO: 893769 - DNA, 22 bp, Homo sapiens
aagtatgcattattaaattgta

SEQ ID NO: 893770 - DNA, 20 bp, Homo sapiens
aagtatgccttaagcagaac

SEQ ID NO: 893771 - DNA, 12 bp, Homo sapiens
aagtatgtaaag

SEQ ID NO: 893772 - DNA, 19 bp, Homo sapiens
aagtatgtatattaaaaaa

SEQ ID NO: 893773 - DNA, 22 bp, Homo sapiens
aagtatgtatattaaaaaagag

SEQ ID NO: 893774 - DNA, 21 bp, Homo sapiens
aagtatgtgagtagtcttatg

SEQ ID NO: 893775 - DNA, 16 bp, Homo sapiens
aagtatgttttagcat

SEQ ID NO: 893776 - DNA, 16 bp, Homo sapiens
aagtatgtttttacat

SEQ ID NO: 893777 - DNA, 19 bp, Homo sapiens
aagtatgtttttacattat

SEQ ID NO: 893778 - DNA, 15 bp, Homo sapiens
aagtattaacttaca

SEQ ID NO: 893779 - DNA, 15 bp, Homo sapiens
aagtattaagcctac

SEQ ID NO: 893780 - DNA, 16 bp, Homo sapiens
aagtattactaaattg

SEQ ID NO: 893781 - DNA, 15 bp, Homo sapiens
aagtattataccttt

SEQ ID NO: 893782 - DNA, 15 bp, Homo sapiens
aagtattatgtctct

SEQ ID NO: 893783 - DNA, 23 bp, Homo sapiens
aagtattcagaaattaaaatatt

SEQ ID NO: 893784 - DNA, 18 bp, Homo sapiens
aagtattcgttacatctt

SEQ ID NO: 893785 - DNA, 18 bp, Homo sapiens
aagtattcttatttaatg

SEQ ID NO: 893786 - DNA, 23 bp, Homo sapiens
aagtattcttatttaatgaaaga

SEQ ID NO: 893787 - DNA, 14 bp, Homo sapiens
aagtattctttttc

SEQ ID NO: 893788 - DNA, 15 bp, Homo sapiens
aagtattgtaaatta

SEQ ID NO: 893789 - DNA, 16 bp, Homo sapiens
aagtatttaaatgttc

SEQ ID NO: 893790 - DNA, 21 bp, Homo sapiens
aagtatttaaatgttctaaca

SEQ ID NO: 893791 - DNA, 18 bp, Homo sapiens
ataagaaacatgatgtga

SEQ ID NO: 893792 - DNA, 20 bp, Homo sapiens
ataagaaacatgatgtgaga

SEQ ID NO: 893793 - DNA, 21 bp, Homo sapiens
ataagaaacttttttatttaa

SEQ ID NO: 893794 - DNA, 17 bp, Homo sapiens
ataagaaatgaacaaaa

SEQ ID NO: 893795 - DNA, 13 bp, Homo sapiens
ataagaacagatc

SEQ ID NO: 893796 - DNA, 17 bp, Homo sapiens
ataagaacccagggtgg

SEQ ID NO: 893797 - DNA, 20 bp, Homo sapiens
ataagaagcaatctttgaaa

SEQ ID NO: 893798 - DNA, 22 bp, Homo sapiens
ataagaagccttaatttgcaca

SEQ ID NO: 893799 - DNA, 19 bp, Homo sapiens
ataagaagggggagtgaaa

SEQ ID NO: 893800 - DNA, 22 bp, Homo sapiens
ataagaagggggagtgaaacag

SEQ ID NO: 893801 - DNA, 15 bp, Homo sapiens
ataagaataaaatgt

SEQ ID NO: 893802 - DNA, 21 bp, Homo sapiens
ataagaataaaatgttgaaaa

SEQ ID NO: 893803 - DNA, 21 bp, Homo sapiens
ataagaatgctggttttccta

SEQ ID NO: 893804 - DNA, 18 bp, Homo sapiens
ataagaatggttgcctta

SEQ ID NO: 893805 - DNA, 15 bp, Homo sapiens
ataagacatgcttac

SEQ ID NO: 893806 - DNA, 20 bp, Homo sapiens
ataagactaaatgattagaa

SEQ ID NO: 893807 - DNA, 17 bp, Homo sapiens
ataagactgtttttaag

SEQ ID NO: 893808 - DNA, 19 bp, Homo sapiens
ataagactgtttttaagta

SEQ ID NO: 893809 - DNA, 22 bp, Homo sapiens
ataagactgtttttaagtaact

SEQ ID NO: 893810 - DNA, 18 bp, Homo sapiens
ataagagaaagaaaatga

SEQ ID NO: 893811 - DNA, 20 bp, Homo sapiens
ataagagagaacaactactg

SEQ ID NO: 893812 - DNA, 17 bp, Homo sapiens
ataagagagatgagaaa

SEQ ID NO: 893813 - DNA, 20 bp, Homo sapiens
ataagagagatgagaaagct

SEQ ID NO: 893814 - DNA, 16 bp, Homo sapiens
ataagaggaatttctt

SEQ ID NO: 893815 - DNA, 17 bp, Homo sapiens
ataagagggctttttaa

SEQ ID NO: 893816 - DNA, 16 bp, Homo sapiens
ataagagtagaaactg

SEQ ID NO: 893817 - DNA, 13 bp, Homo sapiens
ataagataaatgt

SEQ ID NO: 893818 - DNA, 19 bp, Homo sapiens
ataagatgatttaatgttg

SEQ ID NO: 893819 - DNA, 14 bp, Homo sapiens
ataagattaaagga

SEQ ID NO: 893820 - DNA, 21 bp, Homo sapiens
ataagattcatatttacttct

SEQ ID NO: 893821 - DNA, 21 bp, Homo sapiens
ataagattccaaaaagcacat

SEQ ID NO: 893822 - DNA, 14 bp, Homo sapiens
ataagatttttgaa

SEQ ID NO: 893823 - DNA, 23 bp, Homo sapiens
ataagatttttgaaaatcctgaa

SEQ ID NO: 893824 - DNA, 20 bp, Homo sapiens
ataagcaaaaacaaaaagaa

SEQ ID NO: 893825 - DNA, 18 bp, Homo sapiens
ataagcaaattgcttttt

SEQ ID NO: 893826 - DNA, 16 bp, Homo sapiens
ataagcaagaaggcaa

SEQ ID NO: 893827 - DNA, 23 bp, Homo sapiens
ataagcaagaaggcaaaaatagt

SEQ ID NO: 893828 - DNA, 17 bp, Homo sapiens
ataagcacttgcctgga

SEQ ID NO: 893829 - DNA, 20 bp, Homo sapiens
ataagcacttgcctggaata

SEQ ID NO: 893830 - DNA, 18 bp, Homo sapiens
ataagcgtatttagactg

SEQ ID NO: 893831 - DNA, 21 bp, Homo sapiens
ataagctatcacctagcagcc

SEQ ID NO: 893832 - DNA, 20 bp, Homo sapiens
ataagctatccgtgttgcag

SEQ ID NO: 893833 - DNA, 17 bp, Homo sapiens
ataagctcgagtgaatt

SEQ ID NO: 893834 - DNA, 14 bp, Homo sapiens
ataagctctagttc

SEQ ID NO: 893835 - DNA, 22 bp, Homo sapiens
ataagctgggaaaaaagttttg

SEQ ID NO: 893836 - DNA, 17 bp, Homo sapiens
ataagcttggtgacaaa

SEQ ID NO: 893837 - DNA, 16 bp, Homo sapiens
ataagctttctctcag

SEQ ID NO: 893838 - DNA, 22 bp, Homo sapiens
ataagctttctctcagaaatgc

SEQ ID NO: 893839 - DNA, 12 bp, Homo sapiens
ataaggaaactt

SEQ ID NO: 893840 - DNA, 16 bp, Homo sapiens
ataaggaaactttatt

SEQ ID NO: 893841 - DNA, 22 bp, Homo sapiens
ataaggaaactttatttaaatg

SEQ ID NO: 893842 - DNA, 14 bp, Homo sapiens
ataaggaagagggc

SEQ ID NO: 893843 - DNA, 17 bp, Homo sapiens
ataaggaagagggctga

SEQ ID NO: 893844 - DNA, 10 bp, Homo sapiens
ataaggaatt

SEQ ID NO: 893845 - DNA, 22 bp, Homo sapiens
ataaggagggacatgatgggga

SEQ ID NO: 893846 - DNA, 14 bp, Homo sapiens
ataaggatcagaac

SEQ ID NO: 893847 - DNA, 21 bp, Homo sapiens
ataaggatgactttagaataa

SEQ ID NO: 893848 - DNA, 13 bp, Homo sapiens
ataaggcaggcat

SEQ ID NO: 893849 - DNA, 14 bp, Homo sapiens
ataaggccagaaac

SEQ ID NO: 893850 - DNA, 16 bp, Homo sapiens
ataaggccagaaactc

SEQ ID NO: 893851 - DNA, 16 bp, Homo sapiens
ataaggccttaatatg

SEQ ID NO: 893852 - DNA, 21 bp, Homo sapiens
ataaggcttaggtgccaggct

SEQ ID NO: 893853 - DNA, 18 bp, Homo sapiens
ataagggagagctgagcc

SEQ ID NO: 893854 - DNA, 14 bp, Homo sapiens
ataaggggccttgc

SEQ ID NO: 893855 - DNA, 18 bp, Homo sapiens
ataaggggccttgctctg

SEQ ID NO: 893856 - DNA, 15 bp, Homo sapiens
ataaggggtggggga

SEQ ID NO: 893857 - DNA, 14 bp, Homo sapiens
ataaggtaatgtag

SEQ ID NO: 893858 - DNA, 17 bp, Homo sapiens
ataaggtttaaaaagat

SEQ ID NO: 893859 - DNA, 17 bp, Homo sapiens
ataaggtttcctgctcc

SEQ ID NO: 893860 - DNA, 19 bp, Homo sapiens
ataaggtttcgtttctgta

SEQ ID NO: 893861 - DNA, 23 bp, Homo sapiens
ataagtaaagtgattaaagtgct

SEQ ID NO: 893862 - DNA, 23 bp, Homo sapiens
ataagtaaatatattatatatgg

SEQ ID NO: 893863 - DNA, 14 bp, Homo sapiens
ataagtaagaaaat

SEQ ID NO: 893864 - DNA, 15 bp, Homo sapiens
ataagtaagaaaata

SEQ ID NO: 893865 - DNA, 20 bp, Homo sapiens
ataagtaagaaatttctagt

SEQ ID NO: 893866 - DNA, 21 bp, Homo sapiens
ataagtagtaaatcagaaagt

SEQ ID NO: 893867 - DNA, 18 bp, Homo sapiens
ataagtagttggtttgta

SEQ ID NO: 893868 - DNA, 16 bp, Homo sapiens
ataagtatttcaaatt

SEQ ID NO: 893869 - DNA, 19 bp, Homo sapiens
ataagtatttcaaattgga

SEQ ID NO: 893870 - DNA, 13 bp, Homo sapiens
ataagtcaagcac

SEQ ID NO: 893871 - DNA, 14 bp, Homo sapiens
ataagtcaagcaca

SEQ ID NO: 893872 - DNA, 18 bp, Homo sapiens
ataagtcaagcacatgta

SEQ ID NO: 893873 - DNA, 19 bp, Homo sapiens
ataagtcaagcacatgtaa

SEQ ID NO: 893874 - DNA, 21 bp, Homo sapiens
ataagtcaagcacatgtaata

SEQ ID NO: 893875 - DNA, 17 bp, Homo sapiens
aagtggctggtagaaaa

SEQ ID NO: 893876 - DNA, 14 bp, Homo sapiens
aagtgggaaaaaat

SEQ ID NO: 893877 - DNA, 21 bp, Homo sapiens
aagtgggccaggacaggcccg

SEQ ID NO: 893878 - DNA, 12 bp, Homo sapiens
aagtgggctggt

SEQ ID NO: 893879 - DNA, 19 bp, Homo sapiens
aagtgggctggtattctct

SEQ ID NO: 893880 - DNA, 12 bp, Homo sapiens
aagtgggcttga

SEQ ID NO: 893881 - DNA, 15 bp, Homo sapiens
aagtggggacagatt

SEQ ID NO: 893882 - DNA, 19 bp, Homo sapiens
aagtgggggcagagggcag

SEQ ID NO: 893883 - DNA, 13 bp, Homo sapiens
aagtgggggcagc

SEQ ID NO: 893884 - DNA, 15 bp, Homo sapiens
aagtggggtgttctt

SEQ ID NO: 893885 - DNA, 20 bp, Homo sapiens
aagtggggttgcaaccactg

SEQ ID NO: 893886 - DNA, 15 bp, Homo sapiens
aagtggtaaatactg

SEQ ID NO: 893887 - DNA, 19 bp, Homo sapiens
aagtggtaaatactgtgaa

SEQ ID NO: 893888 - DNA, 23 bp, Homo sapiens
aagtggtaaatactgtgaaatac

SEQ ID NO: 893889 - DNA, 21 bp, Homo sapiens
aagtggtagtaatttccttta

SEQ ID NO: 893890 - DNA, 13 bp, Homo sapiens
aagtggtctctgc

SEQ ID NO: 893891 - DNA, 14 bp, Homo sapiens
aagtggtctctgct

SEQ ID NO: 893892 - DNA, 16 bp, Homo sapiens
aagtggtctctgctgg

SEQ ID NO: 893893 - DNA, 17 bp, Homo sapiens
aagtggtctctgctggg

SEQ ID NO: 893894 - DNA, 19 bp, Homo sapiens
aagtggttctccttcctca

SEQ ID NO: 893895 - DNA, 18 bp, Homo sapiens
aagtggtttgcaggtcag

SEQ ID NO: 893896 - DNA, 21 bp, Homo sapiens
aagtgtaaatgaagtacagta

SEQ ID NO: 893897 - DNA, 14 bp, Homo sapiens
aagtgtaacagctg

SEQ ID NO: 893898 - DNA, 21 bp, Homo sapiens
aagtgtaccaacataagtgtt

SEQ ID NO: 893899 - DNA, 17 bp, Homo sapiens
aagtgtagatgtagcat

SEQ ID NO: 893900 - DNA, 13 bp, Homo sapiens
aagtgtagctcaa

SEQ ID NO: 893901 - DNA, 13 bp, Homo sapiens
aagtgtaggcaga

SEQ ID NO: 893902 - DNA, 23 bp, Homo sapiens
aagtgtatatcagaaaagggaag

SEQ ID NO: 893903 - DNA, 13 bp, Homo sapiens
aagtgtatttgga

SEQ ID NO: 893904 - DNA, 15 bp, Homo sapiens
aagtgtatttggaaa

SEQ ID NO: 893905 - DNA, 17 bp, Homo sapiens
aagtgtattttgaaatt

SEQ ID NO: 893906 - DNA, 13 bp, Homo sapiens
aagtgtatttttc

SEQ ID NO: 893907 - DNA, 18 bp, Homo sapiens
aagtgtatttttttacta

SEQ ID NO: 893908 - DNA, 21 bp, Homo sapiens
aagtgtatttttttactaata

SEQ ID NO: 893909 - DNA, 23 bp, Homo sapiens
aagtgtatttttttactaataga

SEQ ID NO: 893910 - DNA, 17 bp, Homo sapiens
aagtgtcaactctttgt

SEQ ID NO: 893911 - DNA, 18 bp, Homo sapiens
aagtgtcaccctgtgggt

SEQ ID NO: 893912 - DNA, 15 bp, Homo sapiens
ataatgtgtctgtgt

SEQ ID NO: 893913 - DNA, 12 bp, Homo sapiens
ataatgtgttaa

SEQ ID NO: 893914 - DNA, 12 bp, Homo sapiens
ataatgttaaca

SEQ ID NO: 893915 - DNA, 11 bp, Homo sapiens
ataatgttctt

SEQ ID NO: 893916 - DNA, 13 bp, Homo sapiens
ataatgtttaaat

SEQ ID NO: 893917 - DNA, 20 bp, Homo sapiens
ataatgtttaaatcatgtat

SEQ ID NO: 893918 - DNA, 22 bp, Homo sapiens
ataatgtttaaatcatgtatgt

SEQ ID NO: 893919 - DNA, 19 bp, Homo sapiens
ataatgtttaatattgaga

SEQ ID NO: 893920 - DNA, 19 bp, Homo sapiens
ataattaaaaaaaaaactt

SEQ ID NO: 893921 - DNA, 12 bp, Homo sapiens
ataattaaagat

SEQ ID NO: 893922 - DNA, 18 bp, Homo sapiens
ataattaaagatgccata

SEQ ID NO: 893923 - DNA, 19 bp, Homo sapiens
ataattaaagatgccatag

SEQ ID NO: 893924 - DNA, 13 bp, Homo sapiens
ataattaaatctc

SEQ ID NO: 893925 - DNA, 16 bp, Homo sapiens
ataattaaatctcttt

SEQ ID NO: 893926 - DNA, 13 bp, Homo sapiens
ataattaatgctt

SEQ ID NO: 893927 - DNA, 16 bp, Homo sapiens
ataattacattcctaa

SEQ ID NO: 893928 - DNA, 18 bp, Homo sapiens
ataattacattcctaact

SEQ ID NO: 893929 - DNA, 19 bp, Homo sapiens
ataattagatccattaatt

SEQ ID NO: 893930 - DNA, 22 bp, Homo sapiens
ataattatcggaagcagtgcct

SEQ ID NO: 893931 - DNA, 18 bp, Homo sapiens
ataattatgacagttata

SEQ ID NO: 893932 - DNA, 21 bp, Homo sapiens
ataattatttatttaataaca

SEQ ID NO: 893933 - DNA, 18 bp, Homo sapiens
ataattattttattgtgt

SEQ ID NO: 893934 - DNA, 17 bp, Homo sapiens
ataattcagcgttattt

SEQ ID NO: 893935 - DNA, 14 bp, Homo sapiens
ataattcatttgta

SEQ ID NO: 893936 - DNA, 15 bp, Homo sapiens
ataattcatttgtat

SEQ ID NO: 893937 - DNA, 20 bp, Homo sapiens
ataattccctatcttttagt

SEQ ID NO: 893938 - DNA, 18 bp, Homo sapiens
ataattcctacagcacta

SEQ ID NO: 893939 - DNA, 19 bp, Homo sapiens
ataattcctacagcactac

SEQ ID NO: 893940 - DNA, 22 bp, Homo sapiens
ataattcctatatcctgtgact

SEQ ID NO: 893941 - DNA, 12 bp, Homo sapiens
ataattctaaat

SEQ ID NO: 893942 - DNA, 21 bp, Homo sapiens
ataattctaagttatttactt

SEQ ID NO: 893943 - DNA, 23 bp, Homo sapiens
ataattctcattaaaagaatatc

SEQ ID NO: 893944 - DNA, 15 bp, Homo sapiens
ataattctgaaacaa

SEQ ID NO: 893945 - DNA, 20 bp, Homo sapiens
ataattctgagttttgtgtt

SEQ ID NO: 893946 - DNA, 12 bp, Homo sapiens
ataattctgtaa

SEQ ID NO: 893947 - DNA, 19 bp, Homo sapiens
ataattcttgtatattatg

SEQ ID NO: 893948 - DNA, 13 bp, Homo sapiens
ataattcttttct

SEQ ID NO: 893949 - DNA, 19 bp, Homo sapiens
ataattgagttttcagtgg

SEQ ID NO: 893950 - DNA, 16 bp, Homo sapiens
ataattgctatttatt

SEQ ID NO: 893951 - DNA, 20 bp, Homo sapiens
ataattgctatttattttta

SEQ ID NO: 893952 - DNA, 19 bp, Homo sapiens
ataattgctcataagcaat

SEQ ID NO: 893953 - DNA, 16 bp, Homo sapiens
ataattggatttccta

SEQ ID NO: 893954 - DNA, 16 bp, Homo sapiens
ataattggtgctattt

SEQ ID NO: 893955 - DNA, 19 bp, Homo sapiens
ataattggtgctatttgaa

SEQ ID NO: 893956 - DNA, 20 bp, Homo sapiens
ataattgtaaatattttgat

SEQ ID NO: 893957 - DNA, 15 bp, Homo sapiens
ataattgttctcaga

SEQ ID NO: 893958 - DNA, 21 bp, Homo sapiens
ataattgttgttctgttaact

SEQ ID NO: 893959 - DNA, 13 bp, Homo sapiens
ataattgtttcca

SEQ ID NO: 893960 - DNA, 21 bp, Homo sapiens
ataatttaaaaatatatttat

SEQ ID NO: 893961 - DNA, 20 bp, Homo sapiens
ataatttaaatgatatttag

SEQ ID NO: 893962 - DNA, 16 bp, Homo sapiens
ataatttacctaagat

SEQ ID NO: 893963 - DNA, 15 bp, Homo sapiens
ataatttagttgttt

SEQ ID NO: 893964 - DNA, 20 bp, Homo sapiens
ataatttagttgtttctaga

SEQ ID NO: 893965 - DNA, 14 bp, Homo sapiens
ataatttattatta

SEQ ID NO: 893966 - DNA, 20 bp, Homo sapiens
ataatttatttccactaaaa

SEQ ID NO: 893967 - DNA, 18 bp, Homo sapiens
ataatttcccaattagga

SEQ ID NO: 893968 - DNA, 22 bp, Homo sapiens
ataatttcccaattaggaagtg

SEQ ID NO: 893969 - DNA, 17 bp, Homo sapiens
ataatttcctcactgcc

SEQ ID NO: 893970 - DNA, 23 bp, Homo sapiens
ataatttctactctgtcttaaat

SEQ ID NO: 893971 - DNA, 21 bp, Homo sapiens
ataatttcttttggaatgtaa

SEQ ID NO: 893972 - DNA, 13 bp, Homo sapiens
ataatttgaaaaa

SEQ ID NO: 893973 - DNA, 15 bp, Homo sapiens
ataatttgaaaaagt

SEQ ID NO: 893974 - DNA, 19 bp, Homo sapiens
ataatttgaatgtatttga

SEQ ID NO: 893975 - DNA, 20 bp, Homo sapiens
ataatttgaatgtatttgat

SEQ ID NO: 893976 - DNA, 21 bp, Homo sapiens
ataatttgaatgtatttgatt

SEQ ID NO: 893977 - DNA, 14 bp, Homo sapiens
ataatttgcactga

SEQ ID NO: 893978 - DNA, 14 bp, Homo sapiens
ataatttgtaaatg

SEQ ID NO: 893979 - DNA, 15 bp, Homo sapiens
ataatttgtaaatga

SEQ ID NO: 893980 - DNA, 14 bp, Homo sapiens
ataatttgtacaat

SEQ ID NO: 893981 - DNA, 12 bp, Homo sapiens
ataatttgttta

SEQ ID NO: 893982 - DNA, 14 bp, Homo sapiens
ataatttgtttaaa

SEQ ID NO: 893983 - DNA, 21 bp, Homo sapiens
ataattttaaaaaagccttcc

SEQ ID NO: 893984 - DNA, 14 bp, Homo sapiens
ataattttccaagt

SEQ ID NO: 893985 - DNA, 12 bp, Homo sapiens
ataattttgcct

SEQ ID NO: 893986 - DNA, 17 bp, Homo sapiens
ataattttggaataatt

SEQ ID NO: 893987 - DNA, 13 bp, Homo sapiens
ataattttgtaat

SEQ ID NO: 893988 - DNA, 19 bp, Homo sapiens
ataatttttaaagtatata

SEQ ID NO: 893989 - DNA, 13 bp, Homo sapiens
ataatttttctag

SEQ ID NO: 893990 - DNA, 21 bp, Homo sapiens
ataattttttaaaaaaaattt

SEQ ID NO: 893991 - DNA, 16 bp, Homo sapiens
ataattttttattcaa

SEQ ID NO: 893992 - DNA, 20 bp, Homo sapiens
ataatttttttcaatattta

SEQ ID NO: 893993 - DNA, 22 bp, Homo sapiens
ataattttttttaaaatagaaa

SEQ ID NO: 893994 - DNA, 22 bp, Homo sapiens
atacaaaaacatacttcaaaaa

SEQ ID NO: 893995 - DNA, 14 bp, Homo sapiens
atacaaaaagaaaa

SEQ ID NO: 893996 - DNA, 13 bp, Homo sapiens
atacaaaagcatg

SEQ ID NO: 893997 - DNA, 16 bp, Homo sapiens
atacaaaccactgtga

SEQ ID NO: 893998 - DNA, 18 bp, Homo sapiens
atacaaacctaccaaaat

SEQ ID NO: 893999 - DNA, 18 bp, Homo sapiens
atacaaactctcaccatg

SEQ ID NO: 894000 - DNA, 17 bp, Homo sapiens
atacaaatggattttgg

SEQ ID NO: 894001 - DNA, 14 bp, Homo sapiens
atacaaatgtttat

SEQ ID NO: 894002 - DNA, 18 bp, Homo sapiens
atacaaattaattttact

SEQ ID NO: 894003 - DNA, 14 bp, Homo sapiens
atacaaattagaaa

SEQ ID NO: 894004 - DNA, 18 bp, Homo sapiens
atacaaattagaaaatgt

SEQ ID NO: 894005 - DNA, 15 bp, Homo sapiens
atacaacacaaagag

SEQ ID NO: 894006 - DNA, 17 bp, Homo sapiens
atacaacaggagagaga

SEQ ID NO: 894007 - DNA, 18 bp, Homo sapiens
atacaaccttcatttaaa

SEQ ID NO: 894008 - DNA, 22 bp, Homo sapiens
atacaacgattgtatttgtgac

SEQ ID NO: 894009 - DNA, 17 bp, Homo sapiens
aataaaatgttgaaaag

SEQ ID NO: 894010 - DNA, 18 bp, Homo sapiens
aataaaatgtttcattat

SEQ ID NO: 894011 - DNA, 22 bp, Homo sapiens
aataaaattcaacaaacatttg

SEQ ID NO: 894012 - DNA, 16 bp, Homo sapiens
aataaaattcatttct

SEQ ID NO: 894013 - DNA, 13 bp, Homo sapiens
aataaaattccta

SEQ ID NO: 894014 - DNA, 18 bp, Homo sapiens
aataaaattcctatctca

SEQ ID NO: 894015 - DNA, 12 bp, Homo sapiens
aataaaatttgt

SEQ ID NO: 894016 - DNA, 14 bp, Homo sapiens
aataaaatttgttg

SEQ ID NO: 894017 - DNA, 16 bp, Homo sapiens
aataaaatttgttgca

SEQ ID NO: 894018 - DNA, 20 bp, Homo sapiens
aataaacagatgtattatgc

SEQ ID NO: 894019 - DNA, 16 bp, Homo sapiens
aataaacaggaatttt

SEQ ID NO: 894020 - DNA, 15 bp, Homo sapiens
aataaacagtatatt

SEQ ID NO: 894021 - DNA, 21 bp, Homo sapiens
aataaacagtgagcatatctg

SEQ ID NO: 894022 - DNA, 23 bp, Homo sapiens
aataaacatccttcaagaactct

SEQ ID NO: 894023 - DNA, 18 bp, Homo sapiens
aataaacattaattttgt

SEQ ID NO: 894024 - DNA, 15 bp, Homo sapiens
aataaaccattggac

SEQ ID NO: 894025 - DNA, 14 bp, Homo sapiens
aataaacctgtcat

SEQ ID NO: 894026 - DNA, 15 bp, Homo sapiens
aataaacgtggattt

SEQ ID NO: 894027 - DNA, 19 bp, Homo sapiens
aataaactactctttgatt

SEQ ID NO: 894028 - DNA, 15 bp, Homo sapiens
aataaactattggaa

SEQ ID NO: 894029 - DNA, 17 bp, Homo sapiens
aataaactcaaaactct

SEQ ID NO: 894030 - DNA, 18 bp, Homo sapiens
aataaactcataaaactc

SEQ ID NO: 894031 - DNA, 17 bp, Homo sapiens
aataaactgtattaaat

SEQ ID NO: 894032 - DNA, 18 bp, Homo sapiens
aataaactgttttcaagt

SEQ ID NO: 894033 - DNA, 17 bp, Homo sapiens
aataaacttcttaacat

SEQ ID NO: 894034 - DNA, 13 bp, Homo sapiens
aataagaaacttt

SEQ ID NO: 894035 - DNA, 11 bp, Homo sapiens
aataagaaagt

SEQ ID NO: 894036 - DNA, 14 bp, Homo sapiens
aataagaacagatc

SEQ ID NO: 894037 - DNA, 22 bp, Homo sapiens
aataagaagggggagtgaaaca

SEQ ID NO: 894038 - DNA, 13 bp, Homo sapiens
aataagaatagaa

SEQ ID NO: 894039 - DNA, 18 bp, Homo sapiens
aataagaatagaaataaa

SEQ ID NO: 894040 - DNA, 15 bp, Homo sapiens
aataagaatttgcat

SEQ ID NO: 894041 - DNA, 21 bp, Homo sapiens
aataagacatgcttacttttt

SEQ ID NO: 894042 - DNA, 13 bp, Homo sapiens
aataagcacttgc

SEQ ID NO: 894043 - DNA, 16 bp, Homo sapiens
aataagcacttgcctg

SEQ ID NO: 894044 - DNA, 20 bp, Homo sapiens
aataagcacttgcctggaat

SEQ ID NO: 894045 - DNA, 18 bp, Homo sapiens
aataagcaggtggatcta

SEQ ID NO: 894046 - DNA, 23 bp, Homo sapiens
aataagcaggtggatctatttca

SEQ ID NO: 894047 - DNA, 15 bp, Homo sapiens
aataagcattgtttt

SEQ ID NO: 894048 - DNA, 16 bp, Homo sapiens
aataagctcagtgata

SEQ ID NO: 894049 - DNA, 16 bp, Homo sapiens
aataaggaagagggct

SEQ ID NO: 894050 - DNA, 19 bp, Homo sapiens
aataaggatgactttagaa

SEQ ID NO: 894051 - DNA, 20 bp, Homo sapiens
aataaggcatgcgaaatgtt

SEQ ID NO: 894052 - DNA, 16 bp, Homo sapiens
aataaggcccagagcg

SEQ ID NO: 894053 - DNA, 17 bp, Homo sapiens
aataaggccttaatatg

SEQ ID NO: 894054 - DNA, 16 bp, Homo sapiens
aataagtcaacagtaa

SEQ ID NO: 894055 - DNA, 15 bp, Homo sapiens
aataagtcattgaaa

SEQ ID NO: 894056 - DNA, 17 bp, Homo sapiens
aataagtggcatacttt

SEQ ID NO: 894057 - DNA, 14 bp, Homo sapiens
aataagtgtatttt

SEQ ID NO: 894058 - DNA, 15 bp, Homo sapiens
aataagtgtctttct

SEQ ID NO: 894059 - DNA, 15 bp, Homo sapiens
aataagttaaaggca

SEQ ID NO: 894060 - DNA, 23 bp, Homo sapiens
aataagttaaaggcagtccagag

SEQ ID NO: 894061 - DNA, 11 bp, Homo sapiens
aataagttatt

SEQ ID NO: 894062 - DNA, 14 bp, Homo sapiens
aataagttattgca

SEQ ID NO: 894063 - DNA, 13 bp, Homo sapiens
aataagtttcata

SEQ ID NO: 894064 - DNA, 19 bp, Homo sapiens
aataagtttgtgttagaaa

SEQ ID NO: 894065 - DNA, 22 bp, Homo sapiens
aataagtttgtgttagaaaagt

SEQ ID NO: 894066 - DNA, 16 bp, Homo sapiens
aataagttttgatata

SEQ ID NO: 894067 - DNA, 17 bp, Homo sapiens
aataagttttgatataa

SEQ ID NO: 894068 - DNA, 13 bp, Homo sapiens
aataagtttttct

SEQ ID NO: 894069 - DNA, 17 bp, Homo sapiens
aataagtttttctttaa

SEQ ID NO: 894070 - DNA, 13 bp, Homo sapiens
aataataaaatca

SEQ ID NO: 894071 - DNA, 13 bp, Homo sapiens
aataataaaatgc

SEQ ID NO: 894072 - DNA, 13 bp, Homo sapiens
aataataaagaca

SEQ ID NO: 894073 - DNA, 12 bp, Homo sapiens
aataataaatag

SEQ ID NO: 894074 - DNA, 13 bp, Homo sapiens
aataataaatagt

SEQ ID NO: 894075 - DNA, 16 bp, Homo sapiens
aataataaatgccctc

SEQ ID NO: 894076 - DNA, 15 bp, Homo sapiens
aataataataaagtg

SEQ ID NO: 894077 - DNA, 11 bp, Homo sapiens
aataataatta

SEQ ID NO: 894078 - DNA, 21 bp, Homo sapiens
aataataattatccagagttt

SEQ ID NO: 894079 - DNA, 15 bp, Homo sapiens
aataatagggaaaat

SEQ ID NO: 894080 - DNA, 18 bp, Homo sapiens
aataatagggaaaatacc

SEQ ID NO: 894081 - DNA, 15 bp, Homo sapiens
aataatatattttct

SEQ ID NO: 894082 - DNA, 19 bp, Homo sapiens
aataatatattttctgttt

SEQ ID NO: 894083 - DNA, 16 bp, Homo sapiens
aataatatcaaaacaa

SEQ ID NO: 894084 - DNA, 17 bp, Homo sapiens
aataatcaagattttag

SEQ ID NO: 894085 - DNA, 20 bp, Homo sapiens
aataatcacgctttcctgaa

SEQ ID NO: 894086 - DNA, 21 bp, Homo sapiens
aataatccattccaaaataca

SEQ ID NO: 894087 - DNA, 21 bp, Homo sapiens
aataatcgactttttaaatgt

SEQ ID NO: 894088 - DNA, 16 bp, Homo sapiens
aataatcggcccacag

SEQ ID NO: 894089 - DNA, 13 bp, Homo sapiens
aataatctatatt

SEQ ID NO: 894090 - DNA, 19 bp, Homo sapiens
aataatctatattaaatga

SEQ ID NO: 894091 - DNA, 13 bp, Homo sapiens
aataatcttggct

SEQ ID NO: 894092 - DNA, 14 bp, Homo sapiens
aataatctttgggt

SEQ ID NO: 894093 - DNA, 12 bp, Homo sapiens
aataatgaaaat

SEQ ID NO: 894094 - DNA, 13 bp, Homo sapiens
aataatgaaaata

SEQ ID NO: 894095 - DNA, 18 bp, Homo sapiens
aataatgaataaactgaa

SEQ ID NO: 894096 - DNA, 19 bp, Homo sapiens
aataatgaataaactgaat

SEQ ID NO: 894097 - DNA, 19 bp, Homo sapiens
aataatgacagatggtgaa

SEQ ID NO: 894098 - DNA, 15 bp, Homo sapiens
aataatgcaaacttt

SEQ ID NO: 894099 - DNA, 16 bp, Homo sapiens
aataatgcctttgtaa

SEQ ID NO: 894100 - DNA, 22 bp, Homo sapiens
aataatgcctttgtaaccacaa

SEQ ID NO: 894101 - DNA, 13 bp, Homo sapiens
aataatggaaaaa

SEQ ID NO: 894102 - DNA, 18 bp, Homo sapiens
aataatggaaaaatagta

SEQ ID NO: 894103 - DNA, 19 bp, Homo sapiens
aataatgtacatctggcct

SEQ ID NO: 894104 - DNA, 19 bp, Homo sapiens
aataatgtattgtaatctt

SEQ ID NO: 894105 - DNA, 20 bp, Homo sapiens
aataatgtgcaaattttgca

SEQ ID NO: 894106 - DNA, 16 bp, Homo sapiens
aataatgtgggaagaa

SEQ ID NO: 894107 - DNA, 14 bp, Homo sapiens
aataatgttctgtc

SEQ ID NO: 894108 - DNA, 15 bp, Homo sapiens
aataatgttctgtca

SEQ ID NO: 894109 - DNA, 15 bp, Homo sapiens
aataattaaatctct

SEQ ID NO: 894110 - DNA, 20 bp, Homo sapiens
aataattatttttaatttaa

SEQ ID NO: 894111 - DNA, 21 bp, Homo sapiens
aataattctgagttttgtgtt

SEQ ID NO: 894112 - DNA, 17 bp, Homo sapiens
aataattgttgttctgt

SEQ ID NO: 894113 - DNA, 18 bp, Homo sapiens
aataattgttgttctgtt

SEQ ID NO: 894114 - DNA, 18 bp, Homo sapiens
aataattgtttccaactt

SEQ ID NO: 894115 - DNA, 21 bp, Homo sapiens
aataattgtttccaacttgtc

SEQ ID NO: 894116 - DNA, 22 bp, Homo sapiens
aataattgtttccaacttgtct

SEQ ID NO: 894117 - DNA, 21 bp, Homo sapiens
aataatttagacttcaagcat

SEQ ID NO: 894118 - DNA, 22 bp, Homo sapiens
aataatttcccaattaggaagt

SEQ ID NO: 894119 - DNA, 17 bp, Homo sapiens
aataatttgtgtctgtg

SEQ ID NO: 894120 - DNA, 23 bp, Homo sapiens
aataatttgtgtctgtgtttaat

SEQ ID NO: 894121 - DNA, 12 bp, Homo sapiens
aataattttaaa

SEQ ID NO: 894122 - DNA, 18 bp, Homo sapiens
aataattttcattttgca

SEQ ID NO: 894123 - DNA, 22 bp, Homo sapiens
aataattttccaagtaaagtga

SEQ ID NO: 894124 - DNA, 17 bp, Homo sapiens
aataattttggaataat

SEQ ID NO: 894125 - DNA, 13 bp, Homo sapiens
aataattttgtaa

SEQ ID NO: 894126 - DNA, 19 bp, Homo sapiens
aataatttttgctgaattc

SEQ ID NO: 894127 - DNA, 20 bp, Homo sapiens
aatacaaaaattagccgggc

SEQ ID NO: 894128 - DNA, 13 bp, Homo sapiens
aatacaaatggat

SEQ ID NO: 894129 - DNA, 13 bp, Homo sapiens
aatacaaattttg

SEQ ID NO: 894130 - DNA, 13 bp, Homo sapiens
aatacaaccagcc

SEQ ID NO: 894131 - DNA, 11 bp, Homo sapiens
aatacaataaa

SEQ ID NO: 894132 - DNA, 17 bp, Homo sapiens
aatacaatgttatcaac

SEQ ID NO: 894133 - DNA, 16 bp, Homo sapiens
aatacaattaaaggtc

SEQ ID NO: 894134 - DNA, 22 bp, Homo sapiens
aatacaatttttatttctttta

SEQ ID NO: 894135 - DNA, 19 bp, Homo sapiens
aatacacagtactttattg

SEQ ID NO: 894136 - DNA, 16 bp, Homo sapiens
aatacaccactacatt

SEQ ID NO: 894137 - DNA, 20 bp, Homo sapiens
aatacaccactacattctgt

SEQ ID NO: 894138 - DNA, 16 bp, Homo sapiens
aatacacgtttatctt

SEQ ID NO: 894139 - DNA, 20 bp, Homo sapiens
aatacactaattcctttcta

SEQ ID NO: 894140 - DNA, 18 bp, Homo sapiens
atacattccctctaattt

SEQ ID NO: 894141 - DNA, 13 bp, Homo sapiens
atacattctagat

SEQ ID NO: 894142 - DNA, 17 bp, Homo sapiens
atacattctatgacatt

SEQ ID NO: 894143 - DNA, 12 bp, Homo sapiens
atacattgaatt

SEQ ID NO: 894144 - DNA, 17 bp, Homo sapiens
atacattgatacaaagt

SEQ ID NO: 894145 - DNA, 21 bp, Homo sapiens
atacattgtataggccatctg

SEQ ID NO: 894146 - DNA, 14 bp, Homo sapiens
atacattgtgtgaa

SEQ ID NO: 894147 - DNA, 20 bp, Homo sapiens
atacattgtgtgaaaaaaga

SEQ ID NO: 894148 - DNA, 11 bp, Homo sapiens
atacatttaat

SEQ ID NO: 894149 - DNA, 16 bp, Homo sapiens
atacatttaataaaac

SEQ ID NO: 894150 - DNA, 23 bp, Homo sapiens
atacatttataatgtttgctatt

SEQ ID NO: 894151 - DNA, 16 bp, Homo sapiens
atacatttgataaagt

SEQ ID NO: 894152 - DNA, 19 bp, Homo sapiens
atacatttgatttgttcat

SEQ ID NO: 894153 - DNA, 12 bp, Homo sapiens
atacatttgtaa

SEQ ID NO: 894154 - DNA, 13 bp, Homo sapiens
atacattttctaa

SEQ ID NO: 894155 - DNA, 16 bp, Homo sapiens
atacattttctaaata

SEQ ID NO: 894156 - DNA, 18 bp, Homo sapiens
atacattttctaaataaa

SEQ ID NO: 894157 - DNA, 15 bp, Homo sapiens
aatagatcagtattt

SEQ ID NO: 894158 - DNA, 13 bp, Homo sapiens
aatagatggaatt

SEQ ID NO: 894159 - DNA, 20 bp, Homo sapiens
aatagatgtgcccttttata

SEQ ID NO: 894160 - DNA, 19 bp, Homo sapiens
aatagattactgatgtgat

SEQ ID NO: 894161 - DNA, 15 bp, Homo sapiens
aatagattatttcat

SEQ ID NO: 894162 - DNA, 19 bp, Homo sapiens
aatagattgttttgccact

SEQ ID NO: 894163 - DNA, 17 bp, Homo sapiens
aatagatttttgattca

SEQ ID NO: 894164 - DNA, 18 bp, Homo sapiens
aatagattttttttaaag

SEQ ID NO: 894165 - DNA, 11 bp, Homo sapiens
aatagcacagg

SEQ ID NO: 894166 - DNA, 16 bp, Homo sapiens
aatagcatactgtgta

SEQ ID NO: 894167 - DNA, 22 bp, Homo sapiens
aatagcatttgccacttagtat

SEQ ID NO: 894168 - DNA, 23 bp, Homo sapiens
aatagccacatttggaatacttt

SEQ ID NO: 894169 - DNA, 12 bp, Homo sapiens
aatagccagaga

SEQ ID NO: 894170 - DNA, 22 bp, Homo sapiens
aatagcccataaagtctgagaa

SEQ ID NO: 894171 - DNA, 14 bp, Homo sapiens
aatagccccagact

SEQ ID NO: 894172 - DNA, 15 bp, Homo sapiens
aatagccccagactg

SEQ ID NO: 894173 - DNA, 13 bp, Homo sapiens
aatagcctggcca

SEQ ID NO: 894174 - DNA, 14 bp, Homo sapiens
aatagcctggccac

SEQ ID NO: 894175 - DNA, 22 bp, Homo sapiens
aatagcgctgtttttgttgtgt

SEQ ID NO: 894176 - DNA, 14 bp, Homo sapiens
aatagcgttcttgt

SEQ ID NO: 894177 - DNA, 19 bp, Homo sapiens
aatagcgttcttgtaattt

SEQ ID NO: 894178 - DNA, 20 bp, Homo sapiens
aatagctatatccatgtact

SEQ ID NO: 894179 - DNA, 23 bp, Homo sapiens
aatagctatatccatgtactgta

SEQ ID NO: 894180 - DNA, 13 bp, Homo sapiens
aatagctctgtgt

SEQ ID NO: 894181 - DNA, 17 bp, Homo sapiens
aatagctgaaaactaat

SEQ ID NO: 894182 - DNA, 20 bp, Homo sapiens
aatagctgaaaactaatgta

SEQ ID NO: 894183 - DNA, 18 bp, Homo sapiens
aatagctgttttgtgtat

SEQ ID NO: 894184 - DNA, 20 bp, Homo sapiens
aatagctgttttgtgtatat

SEQ ID NO: 894185 - DNA, 19 bp, Homo sapiens
aatagctttaaaagggaaa

SEQ ID NO: 894186 - DNA, 12 bp, Homo sapiens
aataggaaagca

SEQ ID NO: 894187 - DNA, 12 bp, Homo sapiens
aataggaattca

SEQ ID NO: 894188 - DNA, 22 bp, Homo sapiens
aataggacaaaacgggttacta

SEQ ID NO: 894189 - DNA, 13 bp, Homo sapiens
aataggaggaaaa

SEQ ID NO: 894190 - DNA, 22 bp, Homo sapiens
aataggagtgggtattatgcaa

SEQ ID NO: 894191 - DNA, 22 bp, Homo sapiens
aataggagttgggtttggtttt

SEQ ID NO: 894192 - DNA, 16 bp, Homo sapiens
aataggatttttagaa

SEQ ID NO: 894193 - DNA, 15 bp, Homo sapiens
aataggcaaattaat

SEQ ID NO: 894194 - DNA, 16 bp, Homo sapiens
aataggcaaattaatc

SEQ ID NO: 894195 - DNA, 21 bp, Homo sapiens
aataggcagggggccctgccc

SEQ ID NO: 894196 - DNA, 23 bp, Homo sapiens
aataggcagggggccctgcccca

SEQ ID NO: 894197 - DNA, 16 bp, Homo sapiens
aataggcattaacaca

SEQ ID NO: 894198 - DNA, 15 bp, Homo sapiens
aatagggtagaatga

SEQ ID NO: 894199 - DNA, 16 bp, Homo sapiens
aatagggtagaatgat

SEQ ID NO: 894200 - DNA, 16 bp, Homo sapiens
aataggtagcctgctg

SEQ ID NO: 894201 - DNA, 18 bp, Homo sapiens
aataggtagtttggatat

SEQ ID NO: 894202 - DNA, 15 bp, Homo sapiens
aataggtatcaaaat

SEQ ID NO: 894203 - DNA, 19 bp, Homo sapiens
aataggtgcagtctttgag

SEQ ID NO: 894204 - DNA, 22 bp, Homo sapiens
aataggtgggggaaaatgaatt

SEQ ID NO: 894205 - DNA, 16 bp, Homo sapiens
aataggttcttcttgt

SEQ ID NO: 894206 - DNA, 15 bp, Homo sapiens
aatagtaattcccgt

SEQ ID NO: 894207 - DNA, 17 bp, Homo sapiens
aatagtatgaaaatgga

SEQ ID NO: 894208 - DNA, 18 bp, Homo sapiens
aatagtatgaaaatggaa

SEQ ID NO: 894209 - DNA, 15 bp, Homo sapiens
aatagtatgggaaaa

SEQ ID NO: 894210 - DNA, 19 bp, Homo sapiens
aatagtcaccttcatgatt

SEQ ID NO: 894211 - DNA, 20 bp, Homo sapiens
aatagtctagatggctcctc

SEQ ID NO: 894212 - DNA, 21 bp, Homo sapiens
aatagtctagatggctcctct

SEQ ID NO: 894213 - DNA, 14 bp, Homo sapiens
aatagtctgtgtga

SEQ ID NO: 894214 - DNA, 20 bp, Homo sapiens
aatagtgcaacatctctgaa

SEQ ID NO: 894215 - DNA, 19 bp, Homo sapiens
aatagtggacatggtcaca

SEQ ID NO: 894216 - DNA, 20 bp, Homo sapiens
aatagtggacatggtcacag

SEQ ID NO: 894217 - DNA, 16 bp, Homo sapiens
aatagtggtgtgattt

SEQ ID NO: 894218 - DNA, 16 bp, Homo sapiens
aatagtgtaagaactg

SEQ ID NO: 894219 - DNA, 19 bp, Homo sapiens
aatagtgtaagaactgtac

SEQ ID NO: 894220 - DNA, 18 bp, Homo sapiens
aatagtgtcatataaact

SEQ ID NO: 894221 - DNA, 16 bp, Homo sapiens
aatagtgtgaaatata

SEQ ID NO: 894222 - DNA, 20 bp, Homo sapiens
aatagtgtggaaattaagaa

SEQ ID NO: 894223 - DNA, 22 bp, Homo sapiens
aatagtgtggaaattaagaaga

SEQ ID NO: 894224 - DNA, 14 bp, Homo sapiens
aatagtgtgttctg

SEQ ID NO: 894225 - DNA, 22 bp, Homo sapiens
aatagttcaaagccaagtttat

SEQ ID NO: 894226 - DNA, 19 bp, Homo sapiens
aatagttcagtagaattac

SEQ ID NO: 894227 - DNA, 14 bp, Homo sapiens
aatagttctatcct

SEQ ID NO: 894228 - DNA, 16 bp, Homo sapiens
aatagtttaggagaaa

SEQ ID NO: 894229 - DNA, 14 bp, Homo sapiens
aatagtttatctta

SEQ ID NO: 894230 - DNA, 14 bp, Homo sapiens
aatagtttggatat

SEQ ID NO: 894231 - DNA, 14 bp, Homo sapiens
aatagtttgtctat

SEQ ID NO: 894232 - DNA, 16 bp, Homo sapiens
aatagtttgtctattt

SEQ ID NO: 894233 - DNA, 17 bp, Homo sapiens
aatagtttgtctatttt

SEQ ID NO: 894234 - DNA, 18 bp, Homo sapiens
aatagtttgtctatttta

SEQ ID NO: 894235 - DNA, 20 bp, Homo sapiens
aatagtttttcactttgtgt

SEQ ID NO: 894236 - DNA, 22 bp, Homo sapiens
aatagtttttcactttgtgtat

SEQ ID NO: 894237 - DNA, 14 bp, Homo sapiens
aatataaaacagtc

SEQ ID NO: 894238 - DNA, 14 bp, Homo sapiens
aatataaaactgaa

SEQ ID NO: 894239 - DNA, 17 bp, Homo sapiens
aatataaaactgaaata

SEQ ID NO: 894240 - DNA, 17 bp, Homo sapiens
aatataaaactgtactt

SEQ ID NO: 894241 - DNA, 22 bp, Homo sapiens
aatataaaaggcaaatgtgtac

SEQ ID NO: 894242 - DNA, 23 bp, Homo sapiens
aatataaactgaaaaatgtcagt

SEQ ID NO: 894243 - DNA, 12 bp, Homo sapiens
aatataaatgtg

SEQ ID NO: 894244 - DNA, 15 bp, Homo sapiens
aatataaatgtttaa

SEQ ID NO: 894245 - DNA, 16 bp, Homo sapiens
aatataaattgtacat

SEQ ID NO: 894246 - DNA, 16 bp, Homo sapiens
aatataaccattacat

SEQ ID NO: 894247 - DNA, 18 bp, Homo sapiens
aatataagaagcaatctt

SEQ ID NO: 894248 - DNA, 13 bp, Homo sapiens
aatataagaataa

SEQ ID NO: 894249 - DNA, 23 bp, Homo sapiens
aatataagacatttgtttgctgt

SEQ ID NO: 894250 - DNA, 14 bp, Homo sapiens
aatataagcataaa

SEQ ID NO: 894251 - DNA, 19 bp, Homo sapiens
aatataaggaaagcaataa

SEQ ID NO: 894252 - DNA, 15 bp, Homo sapiens
aatataattctgtaa

SEQ ID NO: 894253 - DNA, 16 bp, Homo sapiens
aatataattctgtaaa

SEQ ID NO: 894254 - DNA, 14 bp, Homo sapiens
aatatacaaaactt

SEQ ID NO: 894255 - DNA, 17 bp, Homo sapiens
aatatacagtttgactt

SEQ ID NO: 894256 - DNA, 18 bp, Homo sapiens
aatatacattttctaaat

SEQ ID NO: 894257 - DNA, 17 bp, Homo sapiens
aatataccccaaattgt

SEQ ID NO: 894258 - DNA, 17 bp, Homo sapiens
aatatactatatttatg

SEQ ID NO: 894259 - DNA, 11 bp, Homo sapiens
aatatactttt

SEQ ID NO: 894260 - DNA, 19 bp, Homo sapiens
aatatacttttacaagtaa

SEQ ID NO: 894261 - DNA, 15 bp, Homo sapiens
aatatagaagcattt

SEQ ID NO: 894262 - DNA, 18 bp, Homo sapiens
aatatagcaaatgcagaa

SEQ ID NO: 894263 - DNA, 19 bp, Homo sapiens
aatatagctgtacaaatat

SEQ ID NO: 894264 - DNA, 23 bp, Homo sapiens
aatatagggttttttttaatgtg

SEQ ID NO: 894265 - DNA, 22 bp, Homo sapiens
aatatagtaggggttgaagaaa

SEQ ID NO: 894266 - DNA, 20 bp, Homo sapiens
aatatagtgaaatggccact

SEQ ID NO: 894267 - DNA, 13 bp, Homo sapiens
aatatagttctgt

SEQ ID NO: 894268 - DNA, 18 bp, Homo sapiens
aatatataaaaagaaaag

SEQ ID NO: 894269 - DNA, 21 bp, Homo sapiens
aatatataaaaagaaaagata

SEQ ID NO: 894270 - DNA, 12 bp, Homo sapiens
aatatataaaca

SEQ ID NO: 894271 - DNA, 13 bp, Homo sapiens
aatatatataaac

SEQ ID NO: 894272 - DNA, 15 bp, Homo sapiens
aatatatataaacct

SEQ ID NO: 894273 - DNA, 17 bp, Homo sapiens
atagacaaatagaaaat

SEQ ID NO: 894274 - DNA, 19 bp, Homo sapiens
atagacaaatagaaaatgg

SEQ ID NO: 894275 - DNA, 14 bp, Homo sapiens
atagacaattgagg

SEQ ID NO: 894276 - DNA, 21 bp, Homo sapiens
atagacaattgaggtaagttt

SEQ ID NO: 894277 - DNA, 23 bp, Homo sapiens
atagacaatttattatggcacat

SEQ ID NO: 894278 - DNA, 18 bp, Homo sapiens
atagacacatcaaatgcc

SEQ ID NO: 894279 - DNA, 17 bp, Homo sapiens
atagctatatccatgta

SEQ ID NO: 894280 - DNA, 19 bp, Homo sapiens
atagctatatccatgtact

SEQ ID NO: 894281 - DNA, 18 bp, Homo sapiens
atagctattactgtctgg

SEQ ID NO: 894282 - DNA, 22 bp, Homo sapiens
atagctattactgtctggtttt

SEQ ID NO: 894283 - DNA, 15 bp, Homo sapiens
atagctattttcctt

SEQ ID NO: 894284 - DNA, 20 bp, Homo sapiens
atagctattttccttgcttt

SEQ ID NO: 894285 - DNA, 20 bp, Homo sapiens
atagctcactgcagcctcat

SEQ ID NO: 894286 - DNA, 20 bp, Homo sapiens
atagctccccgcttctgcct

SEQ ID NO: 894287 - DNA, 20 bp, Homo sapiens
atagctccttggagcaggca

SEQ ID NO: 894288 - DNA, 14 bp, Homo sapiens
atagctccttttga

SEQ ID NO: 894289 - DNA, 13 bp, Homo sapiens
atagctctggggt

SEQ ID NO: 894290 - DNA, 19 bp, Homo sapiens
atagctctggggtgggcag

SEQ ID NO: 894291 - DNA, 13 bp, Homo sapiens
atagctgaaaact

SEQ ID NO: 894292 - DNA, 16 bp, Homo sapiens
atagctgaaaactaat

SEQ ID NO: 894293 - DNA, 20 bp, Homo sapiens
atagctgaaaactaatgtac

SEQ ID NO: 894294 - DNA, 17 bp, Homo sapiens
atagctgagattcctgg

SEQ ID NO: 894295 - DNA, 20 bp, Homo sapiens
atagctgccttcaaggactg

SEQ ID NO: 894296 - DNA, 15 bp, Homo sapiens
atagctgtacaaata

SEQ ID NO: 894297 - DNA, 17 bp, Homo sapiens
atagctgtacaaatata

SEQ ID NO: 894298 - DNA, 21 bp, Homo sapiens
atagctgtagttttccctgca

SEQ ID NO: 894299 - DNA, 18 bp, Homo sapiens
atagctgttctaatggat

SEQ ID NO: 894300 - DNA, 19 bp, Homo sapiens
atagctgtttcaaatgtgc

SEQ ID NO: 894301 - DNA, 17 bp, Homo sapiens
atagctgttttgtgtat

SEQ ID NO: 894302 - DNA, 22 bp, Homo sapiens
atagctgttttgtgtatattgg

SEQ ID NO: 894303 - DNA, 17 bp, Homo sapiens
atagcttacactgagga

SEQ ID NO: 894304 - DNA, 21 bp, Homo sapiens
atagcttctcttctttctgaa

SEQ ID NO: 894305 - DNA, 14 bp, Homo sapiens
atagcttgtatagt

SEQ ID NO: 894306 - DNA, 17 bp, Homo sapiens
atagctttactgtttct

SEQ ID NO: 894307 - DNA, 21 bp, Homo sapiens
atagctttactgtttctcaag

SEQ ID NO: 894308 - DNA, 14 bp, Homo sapiens
atagcttttattgt

SEQ ID NO: 894309 - DNA, 15 bp, Homo sapiens
atagcttttattgta

SEQ ID NO: 894310 - DNA, 17 bp, Homo sapiens
atagcttttattgtata

SEQ ID NO: 894311 - DNA, 15 bp, Homo sapiens
ataggaacatatgaa

SEQ ID NO: 894312 - DNA, 18 bp, Homo sapiens
ataggaacatatgaaaat

SEQ ID NO: 894313 - DNA, 13 bp, Homo sapiens
ataggaagacaca

SEQ ID NO: 894314 - DNA, 14 bp, Homo sapiens
ataggaagtggctg

SEQ ID NO: 894315 - DNA, 15 bp, Homo sapiens
ataggaagtggctgg

SEQ ID NO: 894316 - DNA, 16 bp, Homo sapiens
ataggaagtggctggt

SEQ ID NO: 894317 - DNA, 16 bp, Homo sapiens
ataggaatagaggaag

SEQ ID NO: 894318 - DNA, 11 bp, Homo sapiens
ataggaattca

SEQ ID NO: 894319 - DNA, 13 bp, Homo sapiens
ataggaccagagc

SEQ ID NO: 894320 - DNA, 14 bp, Homo sapiens
ataggaccagagcg

SEQ ID NO: 894321 - DNA, 17 bp, Homo sapiens
ataggaccttgggccaa

SEQ ID NO: 894322 - DNA, 21 bp, Homo sapiens
ataggactccatttctttctt

SEQ ID NO: 894323 - DNA, 14 bp, Homo sapiens
ataggagactgcgt

SEQ ID NO: 894324 - DNA, 15 bp, Homo sapiens
ataggagaggagggt

SEQ ID NO: 894325 - DNA, 17 bp, Homo sapiens
ataggagggaaaccttt

SEQ ID NO: 894326 - DNA, 12 bp, Homo sapiens
ataggagggaga

SEQ ID NO: 894327 - DNA, 15 bp, Homo sapiens
ataggagttctctga

SEQ ID NO: 894328 - DNA, 22 bp, Homo sapiens
ataggagttctctgatgcagaa

SEQ ID NO: 894329 - DNA, 23 bp, Homo sapiens
ataggataaagttggccatgtat

SEQ ID NO: 894330 - DNA, 17 bp, Homo sapiens
ataggatagacactgga

SEQ ID NO: 894331 - DNA, 18 bp, Homo sapiens
ataggatagacactggac

SEQ ID NO: 894332 - DNA, 23 bp, Homo sapiens
ataggatcatttgttggaatgaa

SEQ ID NO: 894333 - DNA, 23 bp, Homo sapiens
ataggattgcttcaattaaaatt

SEQ ID NO: 894334 - DNA, 23 bp, Homo sapiens
ataggatttatttaaaatagcaa

SEQ ID NO: 894335 - DNA, 18 bp, Homo sapiens
ataggcaggaacatacag

SEQ ID NO: 894336 - DNA, 13 bp, Homo sapiens
ataggcaggaagc

SEQ ID NO: 894337 - DNA, 11 bp, Homo sapiens
ataggcagggg

SEQ ID NO: 894338 - DNA, 22 bp, Homo sapiens
ataggcagggggccctgcccca

SEQ ID NO: 894339 - DNA, 15 bp, Homo sapiens
ataggcatgagccac

SEQ ID NO: 894340 - DNA, 15 bp, Homo sapiens
ataggccaaggccca

SEQ ID NO: 894341 - DNA, 18 bp, Homo sapiens
ataggccatctgtaaata

SEQ ID NO: 894342 - DNA, 23 bp, Homo sapiens
ataggcccaaggtcccctccaca

SEQ ID NO: 894343 - DNA, 13 bp, Homo sapiens
ataggcccagcca

SEQ ID NO: 894344 - DNA, 19 bp, Homo sapiens
ataggcccagccagggtgt

SEQ ID NO: 894345 - DNA, 20 bp, Homo sapiens
ataggccctttcataaaaac

SEQ ID NO: 894346 - DNA, 20 bp, Homo sapiens
ataggcggtcatgtgtgcat

SEQ ID NO: 894347 - DNA, 18 bp, Homo sapiens
ataggctattaaaaaagt

SEQ ID NO: 894348 - DNA, 17 bp, Homo sapiens
ataggctattttctaaa

SEQ ID NO: 894349 - DNA, 22 bp, Homo sapiens
ataggctattttctaaagactt

SEQ ID NO: 894350 - DNA, 13 bp, Homo sapiens
ataggctctgcac

SEQ ID NO: 894351 - DNA, 15 bp, Homo sapiens
ataggctctgcacag

SEQ ID NO: 894352 - DNA, 22 bp, Homo sapiens
ataggctctgcacagatggatt

SEQ ID NO: 894353 - DNA, 21 bp, Homo sapiens
ataggctcttaagcagcatgg

SEQ ID NO: 894354 - DNA, 15 bp, Homo sapiens
atagggagaaaccaa

SEQ ID NO: 894355 - DNA, 17 bp, Homo sapiens
atagggctgagctctct

SEQ ID NO: 894356 - DNA, 11 bp, Homo sapiens
atagggctggg

SEQ ID NO: 894357 - DNA, 18 bp, Homo sapiens
ataggggatatttaaggt

SEQ ID NO: 894358 - DNA, 14 bp, Homo sapiens
ataggggggagggt

SEQ ID NO: 894359 - DNA, 22 bp, Homo sapiens
ataggggggagggtcttttacc

SEQ ID NO: 894360 - DNA, 20 bp, Homo sapiens
atagggtctgcagcctgctg

SEQ ID NO: 894361 - DNA, 23 bp, Homo sapiens
atagggtgctctgaggtcaataa

SEQ ID NO: 894362 - DNA, 16 bp, Homo sapiens
atagggttaaatggta

SEQ ID NO: 894363 - DNA, 17 bp, Homo sapiens
atagggttttttttaat

SEQ ID NO: 894364 - DNA, 18 bp, Homo sapiens
ataggtagaatgtaaagc

SEQ ID NO: 894365 - DNA, 20 bp, Homo sapiens
ataggtagagtcattcatat

SEQ ID NO: 894366 - DNA, 17 bp, Homo sapiens
ataggtagtttggatat

SEQ ID NO: 894367 - DNA, 19 bp, Homo sapiens
ataggtcactggctctcca

SEQ ID NO: 894368 - DNA, 20 bp, Homo sapiens
ataggtcactggctctccaa

SEQ ID NO: 894369 - DNA, 21 bp, Homo sapiens
ataggtcactggctctccaag

SEQ ID NO: 894370 - DNA, 15 bp, Homo sapiens
ataggtcatcatgaa

SEQ ID NO: 894371 - DNA, 18 bp, Homo sapiens
ataggtccagaagtcctt

SEQ ID NO: 894372 - DNA, 14 bp, Homo sapiens
ataggtctcatctc

SEQ ID NO: 894373 - DNA, 19 bp, Homo sapiens
ataggtctcatctcttcag

SEQ ID NO: 894374 - DNA, 20 bp, Homo sapiens
ataggtctcttctcccagaa

SEQ ID NO: 894375 - DNA, 13 bp, Homo sapiens
ataggtgatgggc

SEQ ID NO: 894376 - DNA, 15 bp, Homo sapiens
ataggtgatgggcag

SEQ ID NO: 894377 - DNA, 19 bp, Homo sapiens
ataggtgatgtttgctctt

SEQ ID NO: 894378 - DNA, 16 bp, Homo sapiens
ataggtgtaaatgaga

SEQ ID NO: 894379 - DNA, 21 bp, Homo sapiens
ataggttaaaaaaaaaagtca

SEQ ID NO: 894380 - DNA, 12 bp, Homo sapiens
ataggttatttt

SEQ ID NO: 894381 - DNA, 13 bp, Homo sapiens
ataggttgagcaa

SEQ ID NO: 894382 - DNA, 20 bp, Homo sapiens
ataggttgccaataatacac

SEQ ID NO: 894383 - DNA, 19 bp, Homo sapiens
atagtaaatcacgcttttt

SEQ ID NO: 894384 - DNA, 17 bp, Homo sapiens
atagtaaccattttcct

SEQ ID NO: 894385 - DNA, 21 bp, Homo sapiens
atagtaactactttttatact

SEQ ID NO: 894386 - DNA, 19 bp, Homo sapiens
atagtaagacccccatctc

SEQ ID NO: 894387 - DNA, 22 bp, Homo sapiens
atagtaataagatggctgtggc

SEQ ID NO: 894388 - DNA, 14 bp, Homo sapiens
atagtaatttgtaa

SEQ ID NO: 894389 - DNA, 17 bp, Homo sapiens
atagtaatttgtaaagt

SEQ ID NO: 894390 - DNA, 19 bp, Homo sapiens
atagtaatttgtaaagttg

SEQ ID NO: 894391 - DNA, 14 bp, Homo sapiens
atagtaccatttat

SEQ ID NO: 894392 - DNA, 22 bp, Homo sapiens
atagtactagagatattttgta

SEQ ID NO: 894393 - DNA, 23 bp, Homo sapiens
atagtactagagatattttgtaa

SEQ ID NO: 894394 - DNA, 17 bp, Homo sapiens
atagtagaaagacatct

SEQ ID NO: 894395 - DNA, 23 bp, Homo sapiens
atagtagaaagacatctgcctgt

SEQ ID NO: 894396 - DNA, 23 bp, Homo sapiens
atagtagaacgctatctgggaag

SEQ ID NO: 894397 - DNA, 15 bp, Homo sapiens
atagtagatttttaa

SEQ ID NO: 894398 - DNA, 21 bp, Homo sapiens
atagtagatttttaacaaaaa

SEQ ID NO: 894399 - DNA, 22 bp, Homo sapiens
atagtagatttttaacaaaaaa

SEQ ID NO: 894400 - DNA, 12 bp, Homo sapiens
atattatttctt

SEQ ID NO: 894401 - DNA, 13 bp, Homo sapiens
atattatttgtct

SEQ ID NO: 894402 - DNA, 17 bp, Homo sapiens
atattatttgtgtttcc

SEQ ID NO: 894403 - DNA, 23 bp, Homo sapiens
atattattttaattttttctctt

SEQ ID NO: 894404 - DNA, 18 bp, Homo sapiens
atattcaaagcagcagcc

SEQ ID NO: 894405 - DNA, 12 bp, Homo sapiens
atattcaagtaa

SEQ ID NO: 894406 - DNA, 17 bp, Homo sapiens
atattcaagtaacactt

SEQ ID NO: 894407 - DNA, 13 bp, Homo sapiens
atattcacatctt

SEQ ID NO: 894408 - DNA, 16 bp, Homo sapiens
atattcagatgtatgt

SEQ ID NO: 894409 - DNA, 18 bp, Homo sapiens
atattcagccagcttaaa

SEQ ID NO: 894410 - DNA, 18 bp, Homo sapiens
atattcaggctactcatt

SEQ ID NO: 894411 - DNA, 22 bp, Homo sapiens
atattcaggctactcattcagt

SEQ ID NO: 894412 - DNA, 23 bp, Homo sapiens
atattcagtgctgtggcctgggc

SEQ ID NO: 894413 - DNA, 20 bp, Homo sapiens
atattcatgcttcttcctta

SEQ ID NO: 894414 - DNA, 14 bp, Homo sapiens
atattccaaggaaa

SEQ ID NO: 894415 - DNA, 16 bp, Homo sapiens
atattccaaggaaaat

SEQ ID NO: 894416 - DNA, 19 bp, Homo sapiens
atattccaaggaaaattga

SEQ ID NO: 894417 - DNA, 21 bp, Homo sapiens
atattccaaggaaaattgaaa

SEQ ID NO: 894418 - DNA, 17 bp, Homo sapiens
atattccaccattcaca

SEQ ID NO: 894419 - DNA, 20 bp, Homo sapiens
atattccaggtttaagtaga

SEQ ID NO: 894420 - DNA, 19 bp, Homo sapiens
atattccatgaatgtatca

SEQ ID NO: 894421 - DNA, 23 bp, Homo sapiens
atattccctagaaacttccaaat

SEQ ID NO: 894422 - DNA, 23 bp, Homo sapiens
atattcctattgtgcaatgtaaa

SEQ ID NO: 894423 - DNA, 18 bp, Homo sapiens
atattcctgaatgaaata

SEQ ID NO: 894424 - DNA, 21 bp, Homo sapiens
atattcctgcatttgtgaaat

SEQ ID NO: 894425 - DNA, 16 bp, Homo sapiens
atattcctttgaagat

SEQ ID NO: 894426 - DNA, 23 bp, Homo sapiens
atattcctttgcatattataaag

SEQ ID NO: 894427 - DNA, 22 bp, Homo sapiens
atattctaagaaatatctgtga

SEQ ID NO: 894428 - DNA, 23 bp, Homo sapiens
atattctaagaaatatctgtgaa

SEQ ID NO: 894429 - DNA, 21 bp, Homo sapiens
aatcttgctttctttagaatt

SEQ ID NO: 894430 - DNA, 13 bp, Homo sapiens
aatcttggattaa

SEQ ID NO: 894431 - DNA, 14 bp, Homo sapiens
aatcttggcttctt

SEQ ID NO: 894432 - DNA, 17 bp, Homo sapiens
aatcttggcttcttaaa

SEQ ID NO: 894433 - DNA, 13 bp, Homo sapiens
aatcttgtatttg

SEQ ID NO: 894434 - DNA, 22 bp, Homo sapiens
aatcttgtgctagaatactttt

SEQ ID NO: 894435 - DNA, 14 bp, Homo sapiens
aatcttgttactgc

SEQ ID NO: 894436 - DNA, 21 bp, Homo sapiens
aatcttgttactgctgattct

SEQ ID NO: 894437 - DNA, 15 bp, Homo sapiens
aatcttgttcaaaat

SEQ ID NO: 894438 - DNA, 14 bp, Homo sapiens
aatcttgttttgaa

SEQ ID NO: 894439 - DNA, 23 bp, Homo sapiens
aatcttgttttgaaaataaccta

SEQ ID NO: 894440 - DNA, 16 bp, Homo sapiens
aatctttaagaatagt

SEQ ID NO: 894441 - DNA, 22 bp, Homo sapiens
aatctttacctgtatacagtgc

SEQ ID NO: 894442 - DNA, 18 bp, Homo sapiens
aatctttattgagaaaga

SEQ ID NO: 894443 - DNA, 16 bp, Homo sapiens
aatctttcacttgaaa

SEQ ID NO: 894444 - DNA, 14 bp, Homo sapiens
aatctttcatacat

SEQ ID NO: 894445 - DNA, 18 bp, Homo sapiens
aatctttcatccaaaata

SEQ ID NO: 894446 - DNA, 16 bp, Homo sapiens
aatctttctatataaa

SEQ ID NO: 894447 - DNA, 16 bp, Homo sapiens
aatctttctcctggtg

SEQ ID NO: 894448 - DNA, 18 bp, Homo sapiens
aatctttctcctggtgac

SEQ ID NO: 894449 - DNA, 18 bp, Homo sapiens
aatctttctgtaaacaga

SEQ ID NO: 894450 - DNA, 21 bp, Homo sapiens
aatctttctttacctgagacc

SEQ ID NO: 894451 - DNA, 13 bp, Homo sapiens
aatctttctttct

SEQ ID NO: 894452 - DNA, 16 bp, Homo sapiens
aatctttctttcttcc

SEQ ID NO: 894453 - DNA, 18 bp, Homo sapiens
aatctttgtaccaaaatt

SEQ ID NO: 894454 - DNA, 20 bp, Homo sapiens
aatctttgtaccaaaatttt

SEQ ID NO: 894455 - DNA, 16 bp, Homo sapiens
aatctttgtgacagga

SEQ ID NO: 894456 - DNA, 22 bp, Homo sapiens
aatctttgtgacaggaaagccc

SEQ ID NO: 894457 - DNA, 12 bp, Homo sapiens
aatcttttataa

SEQ ID NO: 894458 - DNA, 22 bp, Homo sapiens
aatcttttataatgattcataa

SEQ ID NO: 894459 - DNA, 17 bp, Homo sapiens
aatctttttctccaccc

SEQ ID NO: 894460 - DNA, 22 bp, Homo sapiens
aatctttttgcttctactttca

SEQ ID NO: 894461 - DNA, 21 bp, Homo sapiens
aatcttttttagcataaaatt

SEQ ID NO: 894462 - DNA, 18 bp, Homo sapiens
aatcttttttttatataa

SEQ ID NO: 894463 - DNA, 15 bp, Homo sapiens
aatgaaaaacaaaaa

SEQ ID NO: 894464 - DNA, 13 bp, Homo sapiens
aatgaaaaatata

SEQ ID NO: 894465 - DNA, 17 bp, Homo sapiens
aatgaaaaattctcagt

SEQ ID NO: 894466 - DNA, 22 bp, Homo sapiens
aatgaaaaatttaagcattgtt

SEQ ID NO: 894467 - DNA, 15 bp, Homo sapiens
aatgaaaacaaataa

SEQ ID NO: 894468 - DNA, 17 bp, Homo sapiens
aatgaaaacaatgcagt

SEQ ID NO: 894469 - DNA, 16 bp, Homo sapiens
aatgaaaacttttgta

SEQ ID NO: 894470 - DNA, 20 bp, Homo sapiens
aatgaaaacttttgtaaatt

SEQ ID NO: 894471 - DNA, 18 bp, Homo sapiens
aatgaaaatacatctttt

SEQ ID NO: 894472 - DNA, 23 bp, Homo sapiens
aatgaaaatgtcagaaaccagtt

SEQ ID NO: 894473 - DNA, 16 bp, Homo sapiens
aatgaaaatgtcttgt

SEQ ID NO: 894474 - DNA, 19 bp, Homo sapiens
aatgaaacaaataatcaca

SEQ ID NO: 894475 - DNA, 17 bp, Homo sapiens
aatgaaagactgtacaa

SEQ ID NO: 894476 - DNA, 20 bp, Homo sapiens
aatgaaagactgtacaaagt

SEQ ID NO: 894477 - DNA, 15 bp, Homo sapiens
aatgaaagcatgtgg

SEQ ID NO: 894478 - DNA, 19 bp, Homo sapiens
aatgaaagtataactgagt

SEQ ID NO: 894479 - DNA, 15 bp, Homo sapiens
aatgaaagtattggc

SEQ ID NO: 894480 - DNA, 15 bp, Homo sapiens
aatgaaataatcagt

SEQ ID NO: 894481 - DNA, 19 bp, Homo sapiens
aatgaaataggagggaaac

SEQ ID NO: 894482 - DNA, 14 bp, Homo sapiens
aatgaaatgcatat

SEQ ID NO: 894483 - DNA, 17 bp, Homo sapiens
aatgaaatgtatgtgct

SEQ ID NO: 894484 - DNA, 15 bp, Homo sapiens
aatgaaatgtttact

SEQ ID NO: 894485 - DNA, 20 bp, Homo sapiens
aatgaaattaaaaataaaat

SEQ ID NO: 894486 - DNA, 17 bp, Homo sapiens
aatgaaattactacaaa

SEQ ID NO: 894487 - DNA, 18 bp, Homo sapiens
aatgaaattcttttataa

SEQ ID NO: 894488 - DNA, 22 bp, Homo sapiens
aatgaaattcttttataaatat

SEQ ID NO: 894489 - DNA, 12 bp, Homo sapiens
aatgaacaaaag

SEQ ID NO: 894490 - DNA, 14 bp, Homo sapiens
aatgaacaaaagat

SEQ ID NO: 894491 - DNA, 17 bp, Homo sapiens
aatgaacaaaattattt

SEQ ID NO: 894492 - DNA, 12 bp, Homo sapiens
aatgaacaaatg

SEQ ID NO: 894493 - DNA, 15 bp, Homo sapiens
aatgaacactctttt

SEQ ID NO: 894494 - DNA, 15 bp, Homo sapiens
aatgaacagaacata

SEQ ID NO: 894495 - DNA, 17 bp, Homo sapiens
aatgaaccctcctcctt

SEQ ID NO: 894496 - DNA, 11 bp, Homo sapiens
aatgaactgaa

SEQ ID NO: 894497 - DNA, 17 bp, Homo sapiens
aatgaactgcttttcct

SEQ ID NO: 894498 - DNA, 14 bp, Homo sapiens
aatgaacttttaca

SEQ ID NO: 894499 - DNA, 17 bp, Homo sapiens
aatgaacttttacagaa

SEQ ID NO: 894500 - DNA, 12 bp, Homo sapiens
aatgaagaaagt

SEQ ID NO: 894501 - DNA, 15 bp, Homo sapiens
aatgaagaattatgt

SEQ ID NO: 894502 - DNA, 17 bp, Homo sapiens
aatgaaggttttcattt

SEQ ID NO: 894503 - DNA, 15 bp, Homo sapiens
aatgaataaactgaa

SEQ ID NO: 894504 - DNA, 21 bp, Homo sapiens
aatgaataataattatccaga

SEQ ID NO: 894505 - DNA, 17 bp, Homo sapiens
aatgaatagaggggcat

SEQ ID NO: 894506 - DNA, 22 bp, Homo sapiens
aatgaatatcaggctattattt

SEQ ID NO: 894507 - DNA, 14 bp, Homo sapiens
aatgaatatctatt

SEQ ID NO: 894508 - DNA, 19 bp, Homo sapiens
aatgaatatctattaatat

SEQ ID NO: 894509 - DNA, 16 bp, Homo sapiens
aatgaatgaatggctt

SEQ ID NO: 894510 - DNA, 20 bp, Homo sapiens
aatgaatgcaaaattgtttt

SEQ ID NO: 894511 - DNA, 22 bp, Homo sapiens
aatgaatgcaaaattgttttca

SEQ ID NO: 894512 - DNA, 21 bp, Homo sapiens
aatgaatggaggaactttcca

SEQ ID NO: 894513 - DNA, 13 bp, Homo sapiens
aatgaatgtcttt

SEQ ID NO: 894514 - DNA, 17 bp, Homo sapiens
aatgaattaaataaacc

SEQ ID NO: 894515 - DNA, 15 bp, Homo sapiens
aatgaattataacag

SEQ ID NO: 894516 - DNA, 16 bp, Homo sapiens
aatgaattataacagt

SEQ ID NO: 894517 - DNA, 15 bp, Homo sapiens
aatgaatttatcttt

SEQ ID NO: 894518 - DNA, 14 bp, Homo sapiens
aatgacaaagccat

SEQ ID NO: 894519 - DNA, 20 bp, Homo sapiens
aatgacaacacttaatagca

SEQ ID NO: 894520 - DNA, 17 bp, Homo sapiens
aatgacaacagaaaaac

SEQ ID NO: 894521 - DNA, 23 bp, Homo sapiens
aatgacaacagaaaaacaatctt

SEQ ID NO: 894522 - DNA, 21 bp, Homo sapiens
atatttttatatttcctttat

SEQ ID NO: 894523 - DNA, 15 bp, Homo sapiens
atatttttatctata

SEQ ID NO: 894524 - DNA, 22 bp, Homo sapiens
atatttttatctatataaaata

SEQ ID NO: 894525 - DNA, 14 bp, Homo sapiens
atatttttatcttt

SEQ ID NO: 894526 - DNA, 15 bp, Homo sapiens
atatttttatcttta

SEQ ID NO: 894527 - DNA, 14 bp, Homo sapiens
atatttttcaaata

SEQ ID NO: 894528 - DNA, 15 bp, Homo sapiens
atatttttcaaatag

SEQ ID NO: 894529 - DNA, 14 bp, Homo sapiens
atatttttctaaag

SEQ ID NO: 894530 - DNA, 15 bp, Homo sapiens
atatttttctaaaga

SEQ ID NO: 894531 - DNA, 19 bp, Homo sapiens
atatttttgataccttcaa

SEQ ID NO: 894532 - DNA, 15 bp, Homo sapiens
atatttttgtacata

SEQ ID NO: 894533 - DNA, 22 bp, Homo sapiens
atatttttgtacatattgttag

SEQ ID NO: 894534 - DNA, 13 bp, Homo sapiens
atatttttgtact

SEQ ID NO: 894535 - DNA, 16 bp, Homo sapiens
atatttttgtacttga

SEQ ID NO: 894536 - DNA, 16 bp, Homo sapiens
atatttttgtatgtca

SEQ ID NO: 894537 - DNA, 19 bp, Homo sapiens
atatttttgtatttctcta

SEQ ID NO: 894538 - DNA, 15 bp, Homo sapiens
atatttttgtctgca

SEQ ID NO: 894539 - DNA, 18 bp, Homo sapiens
atatttttgtctgcagct

SEQ ID NO: 894540 - DNA, 23 bp, Homo sapiens
atattttttaatgtattcccttc

SEQ ID NO: 894541 - DNA, 20 bp, Homo sapiens
atattttttatatatacagt

SEQ ID NO: 894542 - DNA, 19 bp, Homo sapiens
atattttttatttctaagt

SEQ ID NO: 894543 - DNA, 14 bp, Homo sapiens
atattttttctgta

SEQ ID NO: 894544 - DNA, 19 bp, Homo sapiens
atattttttgcaagttata

SEQ ID NO: 894545 - DNA, 14 bp, Homo sapiens
atattttttgtctg

SEQ ID NO: 894546 - DNA, 21 bp, Homo sapiens
atatttttttaaaatgttaaa

SEQ ID NO: 894547 - DNA, 16 bp, Homo sapiens
atcaaaaatattccat

SEQ ID NO: 894548 - DNA, 18 bp, Homo sapiens
atcaaaacaagtactggt

SEQ ID NO: 894549 - DNA, 12 bp, Homo sapiens
atcaaaacatgc

SEQ ID NO: 894550 - DNA, 24 bp, Homo sapiens
atcaaaaggttaataaagtaatta

SEQ ID NO: 894551 - DNA, 14 bp, Homo sapiens
atcaaaatagtcta

SEQ ID NO: 894552 - DNA, 16 bp, Homo sapiens
atcaaacattttgaaa

SEQ ID NO: 894553 - DNA, 16 bp, Homo sapiens
atcaaactcaatgctt

SEQ ID NO: 894554 - DNA, 24 bp, Homo sapiens
atcaaagaaaaacaatgaaattga

SEQ ID NO: 894555 - DNA, 16 bp, Homo sapiens
atcaaagaaattcaga

SEQ ID NO: 894556 - DNA, 13 bp, Homo sapiens
atcaaagaattac

SEQ ID NO: 894557 - DNA, 19 bp, Homo sapiens
atcaaagaattacagtaca

SEQ ID NO: 894558 - DNA, 20 bp, Homo sapiens
atcaaaggaatataagaaaa

SEQ ID NO: 894559 - DNA, 22 bp, Homo sapiens
atcaaagtcattaaagacagga

SEQ ID NO: 894560 - DNA, 15 bp, Homo sapiens
atcaaataaatttct

SEQ ID NO: 894561 - DNA, 18 bp, Homo sapiens
atcaaataagtatttata

SEQ ID NO: 894562 - DNA, 13 bp, Homo sapiens
atcaaatacttta

SEQ ID NO: 894563 - DNA, 17 bp, Homo sapiens
aatgccatcagcccctg

SEQ ID NO: 894564 - DNA, 20 bp, Homo sapiens
aatgccatcagcccctggga

SEQ ID NO: 894565 - DNA, 13 bp, Homo sapiens
aatgccatgaatt

SEQ ID NO: 894566 - DNA, 21 bp, Homo sapiens
aatgccatttcagtggcttcc

SEQ ID NO: 894567 - DNA, 18 bp, Homo sapiens
aatgcccagccagccacc

SEQ ID NO: 894568 - DNA, 19 bp, Homo sapiens
aatgcccagccagccaccc

SEQ ID NO: 894569 - DNA, 14 bp, Homo sapiens
aatgcccccattct

SEQ ID NO: 894570 - DNA, 16 bp, Homo sapiens
aatgcccccctcccaa

SEQ ID NO: 894571 - DNA, 22 bp, Homo sapiens
aatgccctcaggggacttgaat

SEQ ID NO: 894572 - DNA, 14 bp, Homo sapiens
aatgcctcagctat

SEQ ID NO: 894573 - DNA, 21 bp, Homo sapiens
aatgcctcagtgtatttgtat

SEQ ID NO: 894574 - DNA, 17 bp, Homo sapiens
aatgcctcctgtgggga

SEQ ID NO: 894575 - DNA, 13 bp, Homo sapiens
aatgcctgctttt

SEQ ID NO: 894576 - DNA, 12 bp, Homo sapiens
aatgcctggagg

SEQ ID NO: 894577 - DNA, 14 bp, Homo sapiens
aatgcctgtgccaa

SEQ ID NO: 894578 - DNA, 19 bp, Homo sapiens
aatgcctgtgccaataaaa

SEQ ID NO: 894579 - DNA, 15 bp, Homo sapiens
aatgccttgtataaa

SEQ ID NO: 894580 - DNA, 14 bp, Homo sapiens
aatgcgctttattg

SEQ ID NO: 894581 - DNA, 20 bp, Homo sapiens
aatgcggccgcattccctga

SEQ ID NO: 894582 - DNA, 13 bp, Homo sapiens
aatgctaagaaat

SEQ ID NO: 894583 - DNA, 13 bp, Homo sapiens
aatgctactttat

SEQ ID NO: 894584 - DNA, 19 bp, Homo sapiens
aatgctagaaaatcgagtt

SEQ ID NO: 894585 - DNA, 19 bp, Homo sapiens
aatgctattgttgtgggct

SEQ ID NO: 894586 - DNA, 21 bp, Homo sapiens
aatgctattgttgtgggcttt

SEQ ID NO: 894587 - DNA, 18 bp, Homo sapiens
aatgctcaatttcagcac

SEQ ID NO: 894588 - DNA, 15 bp, Homo sapiens
aatgctcataaagat

SEQ ID NO: 894589 - DNA, 16 bp, Homo sapiens
aatgctcatacacagt

SEQ ID NO: 894590 - DNA, 16 bp, Homo sapiens
aatgctcattttctgg

SEQ ID NO: 894591 - DNA, 18 bp, Homo sapiens
aatgctcattttctggtt

SEQ ID NO: 894592 - DNA, 23 bp, Homo sapiens
aatgctccagctgtcgtctgact

SEQ ID NO: 894593 - DNA, 15 bp, Homo sapiens
aatgctcccagctgt

SEQ ID NO: 894594 - DNA, 11 bp, Homo sapiens
aatgctctagt

SEQ ID NO: 894595 - DNA, 20 bp, Homo sapiens
aatgctctggggtcttttta

SEQ ID NO: 894596 - DNA, 15 bp, Homo sapiens
aatgctcttaaaata

SEQ ID NO: 894597 - DNA, 16 bp, Homo sapiens
aatgctcttaaaatat

SEQ ID NO: 894598 - DNA, 15 bp, Homo sapiens
aatgctgaggttatg

SEQ ID NO: 894599 - DNA, 17 bp, Homo sapiens
aatgctgcacttcctgt

SEQ ID NO: 894600 - DNA, 17 bp, Homo sapiens
aatgctgccagtgtgga

SEQ ID NO: 894601 - DNA, 21 bp, Homo sapiens
aatgctggcctgactggttgt

SEQ ID NO: 894602 - DNA, 16 bp, Homo sapiens
aatgctgggcccccag

SEQ ID NO: 894603 - DNA, 22 bp, Homo sapiens
aatgctgggcccccagcctggc

SEQ ID NO: 894604 - DNA, 21 bp, Homo sapiens
aatgctgggtatgctctgtga

SEQ ID NO: 894605 - DNA, 18 bp, Homo sapiens
aatgctggttttcctaaa

SEQ ID NO: 894606 - DNA, 23 bp, Homo sapiens
aatgctgtacatctattttggat

SEQ ID NO: 894607 - DNA, 20 bp, Homo sapiens
aatgctgtgccctaaagtgt

SEQ ID NO: 894608 - DNA, 15 bp, Homo sapiens
aatgctgttctgatt

SEQ ID NO: 894609 - DNA, 13 bp, Homo sapiens
aatgctgtttcta

SEQ ID NO: 894610 - DNA, 15 bp, Homo sapiens
aatgctgtttctaag

SEQ ID NO: 894611 - DNA, 24 bp, Homo sapiens
aatgctgtttctaagaaaatgtag

SEQ ID NO: 894612 - DNA, 14 bp, Homo sapiens
aatgcttaatcaga

SEQ ID NO: 894613 - DNA, 22 bp, Homo sapiens
aatgcttaatcagatagatatt

SEQ ID NO: 894614 - DNA, 19 bp, Homo sapiens
aatgcttatgcttgtgtat

SEQ ID NO: 894615 - DNA, 20 bp, Homo sapiens
aatgcttcaagtgttgctct

SEQ ID NO: 894616 - DNA, 21 bp, Homo sapiens
aatgcttcattcaatattgac

SEQ ID NO: 894617 - DNA, 17 bp, Homo sapiens
aatgcttccgagacacc

SEQ ID NO: 894618 - DNA, 20 bp, Homo sapiens
aatgcttctaagtaaataca

SEQ ID NO: 894619 - DNA, 21 bp, Homo sapiens
aatgcttctaagtaaatacaa

SEQ ID NO: 894620 - DNA, 22 bp, Homo sapiens
aatgcttctaagtaaatacaat

SEQ ID NO: 894621 - DNA, 23 bp, Homo sapiens
aatgcttctaagtaaatacaatt

SEQ ID NO: 894622 - DNA, 15 bp, Homo sapiens
aatgcttgtagaagt

SEQ ID NO: 894623 - DNA, 20 bp, Homo sapiens
aatgcttgtggattgagggt

SEQ ID NO: 894624 - DNA, 18 bp, Homo sapiens
aatgctttatttgtaaat

SEQ ID NO: 894625 - DNA, 22 bp, Homo sapiens
aatgctttatttgtaaatttag

SEQ ID NO: 894626 - DNA, 17 bp, Homo sapiens
aatgctttctgaagctt

SEQ ID NO: 894627 - DNA, 20 bp, Homo sapiens
aatgctttgggaggccaagg

SEQ ID NO: 894628 - DNA, 19 bp, Homo sapiens
aatgctttgtgtgattgaa

SEQ ID NO: 894629 - DNA, 21 bp, Homo sapiens
aatgcttttagtgtgtgcata

SEQ ID NO: 894630 - DNA, 23 bp, Homo sapiens
aatgcttttatatggcccagcct

SEQ ID NO: 894631 - DNA, 17 bp, Homo sapiens
aatgctttttagaaagc

SEQ ID NO: 894632 - DNA, 14 bp, Homo sapiens
aatgctttttgaat

SEQ ID NO: 894633 - DNA, 11 bp, Homo sapiens
aatggaaaaaa

SEQ ID NO: 894634 - DNA, 16 bp, Homo sapiens
aatggaaaaaaacata

SEQ ID NO: 894635 - DNA, 13 bp, Homo sapiens
aatggaaacatta

SEQ ID NO: 894636 - DNA, 18 bp, Homo sapiens
aatggaaacattacagtt

SEQ ID NO: 894637 - DNA, 16 bp, Homo sapiens
aatggaaattttgcta

SEQ ID NO: 894638 - DNA, 22 bp, Homo sapiens
aatggaagcctgaactgaggcc

SEQ ID NO: 894639 - DNA, 20 bp, Homo sapiens
aatggaaggtttgtatattg

SEQ ID NO: 894640 - DNA, 17 bp, Homo sapiens
aatggaattcgtgttat

SEQ ID NO: 894641 - DNA, 19 bp, Homo sapiens
aatggaattcgtgttatga

SEQ ID NO: 894642 - DNA, 23 bp, Homo sapiens
aatggaattcgtgttatgaatct

SEQ ID NO: 894643 - DNA, 15 bp, Homo sapiens
aatgtaaaattgaaa

SEQ ID NO: 894644 - DNA, 21 bp, Homo sapiens
aatgtaaaattgaaaatatgt

SEQ ID NO: 894645 - DNA, 14 bp, Homo sapiens
aatgtaaagaactt

SEQ ID NO: 894646 - DNA, 22 bp, Homo sapiens
aatgtaaagaacttaaattatg

SEQ ID NO: 894647 - DNA, 20 bp, Homo sapiens
aatgtaaaggagtcaaaact

SEQ ID NO: 894648 - DNA, 21 bp, Homo sapiens
aatgtaaaggagtcaaaacta

SEQ ID NO: 894649 - DNA, 17 bp, Homo sapiens
aatgtaaatattttaaa

SEQ ID NO: 894650 - DNA, 20 bp, Homo sapiens
aatgtaaatattttaaagaa

SEQ ID NO: 894651 - DNA, 22 bp, Homo sapiens
aatgtaaatattttaaagaatt

SEQ ID NO: 894652 - DNA, 15 bp, Homo sapiens
aatgtaaatgttatt

SEQ ID NO: 894653 - DNA, 17 bp, Homo sapiens
aatgtaacatcataatt

SEQ ID NO: 894654 - DNA, 13 bp, Homo sapiens
aatgtaacatgaa

SEQ ID NO: 894655 - DNA, 15 bp, Homo sapiens
aatgtaacttttgta

SEQ ID NO: 894656 - DNA, 19 bp, Homo sapiens
aatgtaagaaaacaaaatc

SEQ ID NO: 894657 - DNA, 15 bp, Homo sapiens
aatgtaagctctact

SEQ ID NO: 894658 - DNA, 13 bp, Homo sapiens
aatgtaaggctgt

SEQ ID NO: 894659 - DNA, 15 bp, Homo sapiens
aatgtaaggctgtgt

SEQ ID NO: 894660 - DNA, 14 bp, Homo sapiens
aatgtaatactgga

SEQ ID NO: 894661 - DNA, 21 bp, Homo sapiens
aatgtaatgatcataagtcta

SEQ ID NO: 894662 - DNA, 16 bp, Homo sapiens
aatgtaatgatgctga

SEQ ID NO: 894663 - DNA, 19 bp, Homo sapiens
aatgtaattaaactgttaa

SEQ ID NO: 894664 - DNA, 16 bp, Homo sapiens
aatgtaattgaataaa

SEQ ID NO: 894665 - DNA, 12 bp, Homo sapiens
aatgtaattgga

SEQ ID NO: 894666 - DNA, 13 bp, Homo sapiens
aatgtaattggaa

SEQ ID NO: 894667 - DNA, 16 bp, Homo sapiens
aatgtaattggaatct

SEQ ID NO: 894668 - DNA, 19 bp, Homo sapiens
aatgtaattggaatcttca

SEQ ID NO: 894669 - DNA, 16 bp, Homo sapiens
aatgtacaagttttgt

SEQ ID NO: 894670 - DNA, 18 bp, Homo sapiens
aatgtacaagttttgtat

SEQ ID NO: 894671 - DNA, 19 bp, Homo sapiens
aatgtacaagttttgtata

SEQ ID NO: 894672 - DNA, 15 bp, Homo sapiens
aatgtacaattatgt

SEQ ID NO: 894673 - DNA, 16 bp, Homo sapiens
aatgtacagagtaacc

SEQ ID NO: 894674 - DNA, 21 bp, Homo sapiens
aatgtacatttccaaatgaac

SEQ ID NO: 894675 - DNA, 21 bp, Homo sapiens
aatgtaccttctttcactctg

SEQ ID NO: 894676 - DNA, 14 bp, Homo sapiens
aatgtactgcatat

SEQ ID NO: 894677 - DNA, 15 bp, Homo sapiens
aatgtactgtacata

SEQ ID NO: 894678 - DNA, 15 bp, Homo sapiens
aatgtacttaaatga

SEQ ID NO: 894679 - DNA, 16 bp, Homo sapiens
aatgtacttaaatgag

SEQ ID NO: 894680 - DNA, 17 bp, Homo sapiens
aatgtacttaaatgagt

SEQ ID NO: 894681 - DNA, 22 bp, Homo sapiens
aatgtacttaaatgagttactt

SEQ ID NO: 894682 - DNA, 17 bp, Homo sapiens
aatgtacttgtttgaat

SEQ ID NO: 894683 - DNA, 14 bp, Homo sapiens
aatgtactttttaa

SEQ ID NO: 894684 - DNA, 19 bp, Homo sapiens
aatgtagaatattcagaca

SEQ ID NO: 894685 - DNA, 12 bp, Homo sapiens
aatgtagcactt

SEQ ID NO: 894686 - DNA, 22 bp, Homo sapiens
aatgtagctatttttcttgttg

SEQ ID NO: 894687 - DNA, 22 bp, Homo sapiens
aatgtagcttccacctcatgga

SEQ ID NO: 894688 - DNA, 15 bp, Homo sapiens
aatgtaggactgtat

SEQ ID NO: 894689 - DNA, 16 bp, Homo sapiens
aatgtaggcttagttt

SEQ ID NO: 894690 - DNA, 20 bp, Homo sapiens
aatgtataaaaattatcaaa

SEQ ID NO: 894691 - DNA, 14 bp, Homo sapiens
aatgtataaagatt

SEQ ID NO: 894692 - DNA, 17 bp, Homo sapiens
atcacgacgctgcagag

SEQ ID NO: 894693 - DNA, 14 bp, Homo sapiens
atcacgatttgcag

SEQ ID NO: 894694 - DNA, 20 bp, Homo sapiens
atcacgccactgcactccag

SEQ ID NO: 894695 - DNA, 23 bp, Homo sapiens
atcacgccactgcactccagcct

SEQ ID NO: 894696 - DNA, 14 bp, Homo sapiens
atcacgcctggcta

SEQ ID NO: 894697 - DNA, 18 bp, Homo sapiens
atcacgctttcctgaatc

SEQ ID NO: 894698 - DNA, 14 bp, Homo sapiens
atcacgtaaagcta

SEQ ID NO: 894699 - DNA, 17 bp, Homo sapiens
atcacgttagaggaaaa

SEQ ID NO: 894700 - DNA, 13 bp, Homo sapiens
atcacgttgctgg

SEQ ID NO: 894701 - DNA, 23 bp, Homo sapiens
atcacgttgctggtggtttttca

SEQ ID NO: 894702 - DNA, 20 bp, Homo sapiens
atcactaaactttatttgta

SEQ ID NO: 894703 - DNA, 17 bp, Homo sapiens
atcactaagctgtggct

SEQ ID NO: 894704 - DNA, 20 bp, Homo sapiens
atcactaatactaattcatt

SEQ ID NO: 894705 - DNA, 13 bp, Homo sapiens
atcactattctta

SEQ ID NO: 894706 - DNA, 22 bp, Homo sapiens
atcactattcttaagcactttg

SEQ ID NO: 894707 - DNA, 23 bp, Homo sapiens
atcactcaaccataacacttgat

SEQ ID NO: 894708 - DNA, 16 bp, Homo sapiens
atcactcaagatgcct

SEQ ID NO: 894709 - DNA, 12 bp, Homo sapiens
atcactcaccat

SEQ ID NO: 894710 - DNA, 19 bp, Homo sapiens
atcactcactcactcccca

SEQ ID NO: 894711 - DNA, 13 bp, Homo sapiens
atcactccctgga

SEQ ID NO: 894712 - DNA, 12 bp, Homo sapiens
atcactcctgga

SEQ ID NO: 894713 - DNA, 14 bp, Homo sapiens
atcactcgcaggac

SEQ ID NO: 894714 - DNA, 16 bp, Homo sapiens
atcactcgcaggacca

SEQ ID NO: 894715 - DNA, 17 bp, Homo sapiens
atcactgaacaaactaa

SEQ ID NO: 894716 - DNA, 16 bp, Homo sapiens
atcactgactctgact

SEQ ID NO: 894717 - DNA, 16 bp, Homo sapiens
atcactgagccatcat

SEQ ID NO: 894718 - DNA, 20 bp, Homo sapiens
atcactgatcattagagaaa

SEQ ID NO: 894719 - DNA, 12 bp, Homo sapiens
atcactgccaca

SEQ ID NO: 894720 - DNA, 21 bp, Homo sapiens
atcactgccacactctccatc

SEQ ID NO: 894721 - DNA, 15 bp, Homo sapiens
atcactgccttggcc

SEQ ID NO: 894722 - DNA, 19 bp, Homo sapiens
atcactgccttggcccctc

SEQ ID NO: 894723 - DNA, 20 bp, Homo sapiens
atcactgccttggcccctcc

SEQ ID NO: 894724 - DNA, 15 bp, Homo sapiens
atcactgctgaagat

SEQ ID NO: 894725 - DNA, 14 bp, Homo sapiens
atcactgcttgatg

SEQ ID NO: 894726 - DNA, 12 bp, Homo sapiens
atcactggactg

SEQ ID NO: 894727 - DNA, 18 bp, Homo sapiens
atcactggactgcatggg

SEQ ID NO: 894728 - DNA, 10 bp, Homo sapiens
atcactggag

SEQ ID NO: 894729 - DNA, 23 bp, Homo sapiens
atcactggagcaccaggcacgaa

SEQ ID NO: 894730 - DNA, 13 bp, Homo sapiens
atcactggagccc

SEQ ID NO: 894731 - DNA, 13 bp, Homo sapiens
atcactggatgaa

SEQ ID NO: 894732 - DNA, 18 bp, Homo sapiens
atcactggcaatgaaaaa

SEQ ID NO: 894733 - DNA, 21 bp, Homo sapiens
atcactggtatgatgtatatt

SEQ ID NO: 894734 - DNA, 14 bp, Homo sapiens
atcactgtaaagac

SEQ ID NO: 894735 - DNA, 14 bp, Homo sapiens
atcactgtgaaatt

SEQ ID NO: 894736 - DNA, 15 bp, Homo sapiens
atcactgtgaaattt

SEQ ID NO: 894737 - DNA, 16 bp, Homo sapiens
atcactgtgaaatttc

SEQ ID NO: 894738 - DNA, 19 bp, Homo sapiens
atcactgtgaaatttcatg

SEQ ID NO: 894739 - DNA, 18 bp, Homo sapiens
atcactgtttagaacaca

SEQ ID NO: 894740 - DNA, 12 bp, Homo sapiens
atcactgtttgt

SEQ ID NO: 894741 - DNA, 14 bp, Homo sapiens
atcacttaagcctg

SEQ ID NO: 894742 - DNA, 19 bp, Homo sapiens
atcacttggggtttgtaca

SEQ ID NO: 894743 - DNA, 16 bp, Homo sapiens
atcactttctcagttt

SEQ ID NO: 894744 - DNA, 18 bp, Homo sapiens
atcactttctcagttttc

SEQ ID NO: 894745 - DNA, 15 bp, Homo sapiens
atcacttttcagtga

SEQ ID NO: 894746 - DNA, 22 bp, Homo sapiens
atcagaaagtaacaatctatgg

SEQ ID NO: 894747 - DNA, 17 bp, Homo sapiens
atcagaacaaaagaaaa

SEQ ID NO: 894748 - DNA, 13 bp, Homo sapiens
atcagaacatgaa

SEQ ID NO: 894749 - DNA, 16 bp, Homo sapiens
atcagaacctgagcta

SEQ ID NO: 894750 - DNA, 18 bp, Homo sapiens
atcagaagtttctcagct

SEQ ID NO: 894751 - DNA, 22 bp, Homo sapiens
atcagaatagccacatttggaa

SEQ ID NO: 894752 - DNA, 18 bp, Homo sapiens
atcagaatggaagagaga

SEQ ID NO: 894753 - DNA, 14 bp, Homo sapiens
atcagacaagcact

SEQ ID NO: 894754 - DNA, 20 bp, Homo sapiens
atcagacaagcactatttta

SEQ ID NO: 894755 - DNA, 20 bp, Homo sapiens
atcagacagtggatgagaca

SEQ ID NO: 894756 - DNA, 13 bp, Homo sapiens
atcagacatacag

SEQ ID NO: 894757 - DNA, 17 bp, Homo sapiens
atcagacatacagctgc

SEQ ID NO: 894758 - DNA, 16 bp, Homo sapiens
atcagaccctacccca

SEQ ID NO: 894759 - DNA, 13 bp, Homo sapiens
atcagacctgtct

SEQ ID NO: 894760 - DNA, 16 bp, Homo sapiens
atcagacctgtcttcc

SEQ ID NO: 894761 - DNA, 21 bp, Homo sapiens
atcagacctgtcttccaagga

SEQ ID NO: 894762 - DNA, 22 bp, Homo sapiens
atcagaccttggatcagatgaa

SEQ ID NO: 894763 - DNA, 22 bp, Homo sapiens
atcagactagtgacaagctcct

SEQ ID NO: 894764 - DNA, 22 bp, Homo sapiens
atcagagacaaaatatttccca

SEQ ID NO: 894765 - DNA, 14 bp, Homo sapiens
atcagagagcctag

SEQ ID NO: 894766 - DNA, 21 bp, Homo sapiens
atcataggaagggaccaaggc

SEQ ID NO: 894767 - DNA, 22 bp, Homo sapiens
atcataggaagggaccaaggca

SEQ ID NO: 894768 - DNA, 15 bp, Homo sapiens
atcataggaagtggc

SEQ ID NO: 894769 - DNA, 22 bp, Homo sapiens
atcataggaagtggctggtctg

SEQ ID NO: 894770 - DNA, 18 bp, Homo sapiens
atcataggtatttcaaaa

SEQ ID NO: 894771 - DNA, 21 bp, Homo sapiens
atcatataaaaagcagcagag

SEQ ID NO: 894772 - DNA, 18 bp, Homo sapiens
atcatataaattttttgt

SEQ ID NO: 894773 - DNA, 16 bp, Homo sapiens
atcatataataaatgt

SEQ ID NO: 894774 - DNA, 16 bp, Homo sapiens
atcatatccttgccct

SEQ ID NO: 894775 - DNA, 16 bp, Homo sapiens
atcatattaacatatt

SEQ ID NO: 894776 - DNA, 15 bp, Homo sapiens
atcatattctattgt

SEQ ID NO: 894777 - DNA, 17 bp, Homo sapiens
atcatattctattgttt

SEQ ID NO: 894778 - DNA, 21 bp, Homo sapiens
atcatattggtattcactaat

SEQ ID NO: 894779 - DNA, 13 bp, Homo sapiens
atcatattgtatg

SEQ ID NO: 894780 - DNA, 12 bp, Homo sapiens
atcatcaagaag

SEQ ID NO: 894781 - DNA, 14 bp, Homo sapiens
atcatcaagaaggg

SEQ ID NO: 894782 - DNA, 12 bp, Homo sapiens
atcatcactgta

SEQ ID NO: 894783 - DNA, 14 bp, Homo sapiens
atcatcactgtaaa

SEQ ID NO: 894784 - DNA, 16 bp, Homo sapiens
atcatcactgtaaaga

SEQ ID NO: 894785 - DNA, 18 bp, Homo sapiens
atcatcactgtaaagaca

SEQ ID NO: 894786 - DNA, 18 bp, Homo sapiens
atcatcagtgcctctttg

SEQ ID NO: 894787 - DNA, 15 bp, Homo sapiens
atcatcagtgtagaa

SEQ ID NO: 894788 - DNA, 20 bp, Homo sapiens
atcatcataggtaacagtta

SEQ ID NO: 894789 - DNA, 18 bp, Homo sapiens
atcatcattcttgtggga

SEQ ID NO: 894790 - DNA, 13 bp, Homo sapiens
atcatccaggcct

SEQ ID NO: 894791 - DNA, 15 bp, Homo sapiens
atcatcccaacagcc

SEQ ID NO: 894792 - DNA, 18 bp, Homo sapiens
atcatcccaacagccaag

SEQ ID NO: 894793 - DNA, 15 bp, Homo sapiens
atcatcctaagctat

SEQ ID NO: 894794 - DNA, 12 bp, Homo sapiens
atcatcctactg

SEQ ID NO: 894795 - DNA, 21 bp, Homo sapiens
atcatcctttaggtaagaagt

SEQ ID NO: 894796 - DNA, 21 bp, Homo sapiens
atcatcctttgttctgagcat

SEQ ID NO: 894797 - DNA, 17 bp, Homo sapiens
atcatcgaagtcttccc

SEQ ID NO: 894798 - DNA, 15 bp, Homo sapiens
atcatcgccagaggt

SEQ ID NO: 894799 - DNA, 22 bp, Homo sapiens
atcatcgccagaggtgcttcac

SEQ ID NO: 894800 - DNA, 19 bp, Homo sapiens
atcatctaattctctgtgg

SEQ ID NO: 894801 - DNA, 18 bp, Homo sapiens
atcatctataaagaagaa

SEQ ID NO: 894802 - DNA, 19 bp, Homo sapiens
atcatctatagaaagctat

SEQ ID NO: 894803 - DNA, 23 bp, Homo sapiens
atcatctcctgccttcctcctgg

SEQ ID NO: 894804 - DNA, 20 bp, Homo sapiens
atcatctcttaaattttgtt

SEQ ID NO: 894805 - DNA, 18 bp, Homo sapiens
atcatctgtgtgaaaatg

SEQ ID NO: 894806 - DNA, 19 bp, Homo sapiens
atcatctgtgtgaaaatgg

SEQ ID NO: 894807 - DNA, 15 bp, Homo sapiens
atcatcttgaacatt

SEQ ID NO: 894808 - DNA, 17 bp, Homo sapiens
atcatgaaaagaggaac

SEQ ID NO: 894809 - DNA, 16 bp, Homo sapiens
atcatgaaacacttct

SEQ ID NO: 894810 - DNA, 19 bp, Homo sapiens
atcatgaaacacttctcat

SEQ ID NO: 894811 - DNA, 16 bp, Homo sapiens
atcatgaaaccaaaaa

SEQ ID NO: 894812 - DNA, 19 bp, Homo sapiens
atcatgaaaggttaaaaaa

SEQ ID NO: 894813 - DNA, 16 bp, Homo sapiens
atcatgaaatatgcat

SEQ ID NO: 894814 - DNA, 23 bp, Homo sapiens
atcatgaattcccttttaatcaa

SEQ ID NO: 894815 - DNA, 14 bp, Homo sapiens
atcatgaattttaa

SEQ ID NO: 894816 - DNA, 19 bp, Homo sapiens
atcatgaattttaaagtat

SEQ ID NO: 894817 - DNA, 16 bp, Homo sapiens
atcatgacatgttata

SEQ ID NO: 894818 - DNA, 18 bp, Homo sapiens
atcatgacatgttatata

SEQ ID NO: 894819 - DNA, 17 bp, Homo sapiens
atcatgaccagcaaata

SEQ ID NO: 894820 - DNA, 15 bp, Homo sapiens
atcatgagcctgctg

SEQ ID NO: 894821 - DNA, 17 bp, Homo sapiens
atcatgagcctgctgga

SEQ ID NO: 894822 - DNA, 21 bp, Homo sapiens
atcatgagcctgctggaagcc

SEQ ID NO: 894823 - DNA, 19 bp, Homo sapiens
aatgtgtctctgctttcct

SEQ ID NO: 894824 - DNA, 17 bp, Homo sapiens
aatgtgtctgtgttgct

SEQ ID NO: 894825 - DNA, 18 bp, Homo sapiens
aatgtgtctgtgttgctt

SEQ ID NO: 894826 - DNA, 14 bp, Homo sapiens
aatgtgtctttaga

SEQ ID NO: 894827 - DNA, 15 bp, Homo sapiens
aatgtgtctttagat

SEQ ID NO: 894828 - DNA, 18 bp, Homo sapiens
aatgtgtctttctaagaa

SEQ ID NO: 894829 - DNA, 19 bp, Homo sapiens
aatgtgtgaattcaataca

SEQ ID NO: 894830 - DNA, 12 bp, Homo sapiens
aatgtgtgcttt

SEQ ID NO: 894831 - DNA, 16 bp, Homo sapiens
aatgtgtggcctgcac

SEQ ID NO: 894832 - DNA, 16 bp, Homo sapiens
aatgtgtgtatgtgtg

SEQ ID NO: 894833 - DNA, 18 bp, Homo sapiens
aatgtgtgttgtgtgagc

SEQ ID NO: 894834 - DNA, 14 bp, Homo sapiens
aatgtgttcttttc

SEQ ID NO: 894835 - DNA, 13 bp, Homo sapiens
aatgtgtttctgt

SEQ ID NO: 894836 - DNA, 13 bp, Homo sapiens
aatgtgtttgctg

SEQ ID NO: 894837 - DNA, 15 bp, Homo sapiens
aatgtgtttgctgcc

SEQ ID NO: 894838 - DNA, 16 bp, Homo sapiens
aatgtgttttctgtag

SEQ ID NO: 894839 - DNA, 22 bp, Homo sapiens
aatgtgttttgtttattaaata

SEQ ID NO: 894840 - DNA, 16 bp, Homo sapiens
aatgtgtttttctata

SEQ ID NO: 894841 - DNA, 17 bp, Homo sapiens
aatgtgtttttctatat

SEQ ID NO: 894842 - DNA, 21 bp, Homo sapiens
aatgttaaggacttctgcagc

SEQ ID NO: 894843 - DNA, 22 bp, Homo sapiens
aatgttaaggacttctgcagct

SEQ ID NO: 894844 - DNA, 19 bp, Homo sapiens
aatgttaatttattttgct

SEQ ID NO: 894845 - DNA, 22 bp, Homo sapiens
aatgttaattttttggtacaaa

SEQ ID NO: 894846 - DNA, 15 bp, Homo sapiens
aatgttacattatta

SEQ ID NO: 894847 - DNA, 21 bp, Homo sapiens
aatgttactcagatataagag

SEQ ID NO: 894848 - DNA, 23 bp, Homo sapiens
aatgttactcagatataagagaa

SEQ ID NO: 894849 - DNA, 19 bp, Homo sapiens
aatgttactgatcatgcat

SEQ ID NO: 894850 - DNA, 15 bp, Homo sapiens
aatgttactgcctta

SEQ ID NO: 894851 - DNA, 17 bp, Homo sapiens
aatgttagcctcaattt

SEQ ID NO: 894852 - DNA, 17 bp, Homo sapiens
aatgttatatcatatgt

SEQ ID NO: 894853 - DNA, 21 bp, Homo sapiens
aatgttatcttatactgtaca

SEQ ID NO: 894854 - DNA, 22 bp, Homo sapiens
aatgttatgactatgtaaacta

SEQ ID NO: 894855 - DNA, 22 bp, Homo sapiens
aatgttatgggatgtaaacaat

SEQ ID NO: 894856 - DNA, 21 bp, Homo sapiens
aatgttatttgttattttcag

SEQ ID NO: 894857 - DNA, 21 bp, Homo sapiens
aatgttattttttaattatta

SEQ ID NO: 894858 - DNA, 18 bp, Homo sapiens
aatgttcacaatatattt

SEQ ID NO: 894859 - DNA, 13 bp, Homo sapiens
aatgttcatcctc

SEQ ID NO: 894860 - DNA, 17 bp, Homo sapiens
aatgttcattgtaatgt

SEQ ID NO: 894861 - DNA, 17 bp, Homo sapiens
aatgttctcagatttct

SEQ ID NO: 894862 - DNA, 21 bp, Homo sapiens
aatgttctctcttctccacct

SEQ ID NO: 894863 - DNA, 18 bp, Homo sapiens
aatgttctgaatttcctt

SEQ ID NO: 894864 - DNA, 15 bp, Homo sapiens
aatgttctgacatta

SEQ ID NO: 894865 - DNA, 10 bp, Homo sapiens
aatgttcttt

SEQ ID NO: 894866 - DNA, 14 bp, Homo sapiens
aatgttctttggaa

SEQ ID NO: 894867 - DNA, 20 bp, Homo sapiens
aatgttctttggaaagtaca

SEQ ID NO: 894868 - DNA, 21 bp, Homo sapiens
aatgttctttggaaagtacac

SEQ ID NO: 894869 - DNA, 12 bp, Homo sapiens
aatgttgaaaag

SEQ ID NO: 894870 - DNA, 15 bp, Homo sapiens
aatgttgaatgtatt

SEQ ID NO: 894871 - DNA, 21 bp, Homo sapiens
aatgttgacctttgaggtcta

SEQ ID NO: 894872 - DNA, 21 bp, Homo sapiens
aatgttgagaagcgtttttaa

SEQ ID NO: 894873 - DNA, 16 bp, Homo sapiens
aatgttgatcagcaaa

SEQ ID NO: 894874 - DNA, 23 bp, Homo sapiens
aatgttgctttaacctgaacctt

SEQ ID NO: 894875 - DNA, 18 bp, Homo sapiens
aatgttggataaggaatt

SEQ ID NO: 894876 - DNA, 18 bp, Homo sapiens
aatgttggcaaatcactt

SEQ ID NO: 894877 - DNA, 13 bp, Homo sapiens
aatgttgggactg

SEQ ID NO: 894878 - DNA, 17 bp, Homo sapiens
aatgttgtacttgaaaa

SEQ ID NO: 894879 - DNA, 16 bp, Homo sapiens
aatgttgtatttgtta

SEQ ID NO: 894880 - DNA, 19 bp, Homo sapiens
aatgttgtccaacaataaa

SEQ ID NO: 894881 - DNA, 12 bp, Homo sapiens
aatgttgtccag

SEQ ID NO: 894882 - DNA, 23 bp, Homo sapiens
aatgttgtcctgttaatttatag

SEQ ID NO: 894883 - DNA, 21 bp, Homo sapiens
aatgttgttcattattggagg

SEQ ID NO: 894884 - DNA, 22 bp, Homo sapiens
aatgttgtttcctaatatcaaa

SEQ ID NO: 894885 - DNA, 23 bp, Homo sapiens
aatgttgtttcctaatatcaaat

SEQ ID NO: 894886 - DNA, 15 bp, Homo sapiens
aatgtttaaaccttt

SEQ ID NO: 894887 - DNA, 14 bp, Homo sapiens
aatgtttaaatata

SEQ ID NO: 894888 - DNA, 20 bp, Homo sapiens
atccataggactaccgcagg

SEQ ID NO: 894889 - DNA, 20 bp, Homo sapiens
atccatattgagtcaaatgg

SEQ ID NO: 894890 - DNA, 18 bp, Homo sapiens
atccatattttattactg

SEQ ID NO: 894891 - DNA, 17 bp, Homo sapiens
atccatcaatacctgta

SEQ ID NO: 894892 - DNA, 18 bp, Homo sapiens
atccatcatcatgtgtgt

SEQ ID NO: 894893 - DNA, 19 bp, Homo sapiens
atccatccctagaagagca

SEQ ID NO: 894894 - DNA, 22 bp, Homo sapiens
atccatcctgcaaaggcccttg

SEQ ID NO: 894895 - DNA, 12 bp, Homo sapiens
atccatctccag

SEQ ID NO: 894896 - DNA, 20 bp, Homo sapiens
atccatctcctggtgttctg

SEQ ID NO: 894897 - DNA, 13 bp, Homo sapiens
atccatctgtccg

SEQ ID NO: 894898 - DNA, 18 bp, Homo sapiens
atccatgacctagttttc

SEQ ID NO: 894899 - DNA, 21 bp, Homo sapiens
atccatgacctagttttccat

SEQ ID NO: 894900 - DNA, 22 bp, Homo sapiens
atccatgacctagttttccatg

SEQ ID NO: 894901 - DNA, 22 bp, Homo sapiens
atccatgcactttaattgaaga

SEQ ID NO: 894902 - DNA, 14 bp, Homo sapiens
atccatgcttcact

SEQ ID NO: 894903 - DNA, 16 bp, Homo sapiens
atccatgtaataagca

SEQ ID NO: 894904 - DNA, 12 bp, Homo sapiens
atccatgtactg

SEQ ID NO: 894905 - DNA, 23 bp, Homo sapiens
atccatgtgaccattctgcctct

SEQ ID NO: 894906 - DNA, 20 bp, Homo sapiens
atccatgtgattaatgtttt

SEQ ID NO: 894907 - DNA, 20 bp, Homo sapiens
atccatgttagtttttactt

SEQ ID NO: 894908 - DNA, 13 bp, Homo sapiens
atccattaattta

SEQ ID NO: 894909 - DNA, 16 bp, Homo sapiens
atccattacgtgcatt

SEQ ID NO: 894910 - DNA, 19 bp, Homo sapiens
atccattacgtgcatttaa

SEQ ID NO: 894911 - DNA, 23 bp, Homo sapiens
atccattacgtgcatttaaactc

SEQ ID NO: 894912 - DNA, 16 bp, Homo sapiens
atccattaggccagca

SEQ ID NO: 894913 - DNA, 17 bp, Homo sapiens
atccattaggccagcaa

SEQ ID NO: 894914 - DNA, 18 bp, Homo sapiens
atccattaggccagcaac

SEQ ID NO: 894915 - DNA, 13 bp, Homo sapiens
atccattcacaag

SEQ ID NO: 894916 - DNA, 16 bp, Homo sapiens
atccattccaaaatac

SEQ ID NO: 894917 - DNA, 17 bp, Homo sapiens
atccattccaggtagct

SEQ ID NO: 894918 - DNA, 19 bp, Homo sapiens
atccattccaggtagctcg

SEQ ID NO: 894919 - DNA, 22 bp, Homo sapiens
atccattcctcagggacagaga

SEQ ID NO: 894920 - DNA, 19 bp, Homo sapiens
atccatttcccctccttcc

SEQ ID NO: 894921 - DNA, 11 bp, Homo sapiens
atccatttctt

SEQ ID NO: 894922 - DNA, 15 bp, Homo sapiens
atccatttcttttac

SEQ ID NO: 894923 - DNA, 21 bp, Homo sapiens
atccatttgaataaaatgaca

SEQ ID NO: 894924 - DNA, 15 bp, Homo sapiens
atcccaaacttcgga

SEQ ID NO: 894925 - DNA, 13 bp, Homo sapiens
atcccaaacttta

SEQ ID NO: 894926 - DNA, 14 bp, Homo sapiens
atcccaaactttaa

SEQ ID NO: 894927 - DNA, 15 bp, Homo sapiens
atcccaaactttaaa

SEQ ID NO: 894928 - DNA, 21 bp, Homo sapiens
atcccaaactttaaaatgcga

SEQ ID NO: 894929 - DNA, 17 bp, Homo sapiens
atcccaaaggatgagaa

SEQ ID NO: 894930 - DNA, 15 bp, Homo sapiens
atcccaacagccaag

SEQ ID NO: 894931 - DNA, 14 bp, Homo sapiens
atcccaacattctg

SEQ ID NO: 894932 - DNA, 16 bp, Homo sapiens
atcccaacattctgca

SEQ ID NO: 894933 - DNA, 18 bp, Homo sapiens
atcccaacattctgcaat

SEQ ID NO: 894934 - DNA, 22 bp, Homo sapiens
atcccaaccaggcacctcttcc

SEQ ID NO: 894935 - DNA, 15 bp, Homo sapiens
atcccaactgtcttt

SEQ ID NO: 894936 - DNA, 14 bp, Homo sapiens
atcccaagcctcct

SEQ ID NO: 894937 - DNA, 14 bp, Homo sapiens
atcccaatctttct

SEQ ID NO: 894938 - DNA, 15 bp, Homo sapiens
atcccaccagccccg

SEQ ID NO: 894939 - DNA, 20 bp, Homo sapiens
atcccaccagccccggcctt

SEQ ID NO: 894940 - DNA, 20 bp, Homo sapiens
atcccaccccctcctccccc

SEQ ID NO: 894941 - DNA, 21 bp, Homo sapiens
atcccaccccctcctccccca

SEQ ID NO: 894942 - DNA, 17 bp, Homo sapiens
atcccacgcactccatg

SEQ ID NO: 894943 - DNA, 16 bp, Homo sapiens
atcccactggatctgg

SEQ ID NO: 894944 - DNA, 23 bp, Homo sapiens
atcccacttagccgcaccctgca

SEQ ID NO: 894945 - DNA, 15 bp, Homo sapiens
atcccacttcctttc

SEQ ID NO: 894946 - DNA, 22 bp, Homo sapiens
atcccactttctatagcagatt

SEQ ID NO: 894947 - DNA, 18 bp, Homo sapiens
atcccagaccagccaagg

SEQ ID NO: 894948 - DNA, 14 bp, Homo sapiens
atcccagagaacaa

SEQ ID NO: 894949 - DNA, 16 bp, Homo sapiens
atcccagagaacaatc

SEQ ID NO: 894950 - DNA, 19 bp, Homo sapiens
atcccagataatggagaat

SEQ ID NO: 894951 - DNA, 16 bp, Homo sapiens
atcccagcacctgcct

SEQ ID NO: 894952 - DNA, 14 bp, Homo sapiens
atcccagcactttg

SEQ ID NO: 894953 - DNA, 14 bp, Homo sapiens
atcccagccggcca

SEQ ID NO: 894954 - DNA, 18 bp, Homo sapiens
atcccagctactcaggag

SEQ ID NO: 894955 - DNA, 22 bp, Homo sapiens
atcccagctacttgggaggctg

SEQ ID NO: 894956 - DNA, 19 bp, Homo sapiens
aattagttggtttgtgtga

SEQ ID NO: 894957 - DNA, 16 bp, Homo sapiens
aattagtttacctcat

SEQ ID NO: 894958 - DNA, 14 bp, Homo sapiens
aattagtttccttt

SEQ ID NO: 894959 - DNA, 15 bp, Homo sapiens
aattagtttcctttt

SEQ ID NO: 894960 - DNA, 23 bp, Homo sapiens
aattagtttcctttttaatatgc

SEQ ID NO: 894961 - DNA, 13 bp, Homo sapiens
aattataaatgac

SEQ ID NO: 894962 - DNA, 16 bp, Homo sapiens
aattataaatgtgttt

SEQ ID NO: 894963 - DNA, 14 bp, Homo sapiens
aattataaattgag

SEQ ID NO: 894964 - DNA, 21 bp, Homo sapiens
aattataagagacagacactt

SEQ ID NO: 894965 - DNA, 17 bp, Homo sapiens
aattataagggccctgc

SEQ ID NO: 894966 - DNA, 21 bp, Homo sapiens
aattataagggccctgccctg

SEQ ID NO: 894967 - DNA, 16 bp, Homo sapiens
aattataatatactat

SEQ ID NO: 894968 - DNA, 15 bp, Homo sapiens
aattataattgtaat

SEQ ID NO: 894969 - DNA, 20 bp, Homo sapiens
aattatactggagaagtctt

SEQ ID NO: 894970 - DNA, 20 bp, Homo sapiens
aattatagaaacaatactgt

SEQ ID NO: 894971 - DNA, 21 bp, Homo sapiens
aattataggagccttaatttt

SEQ ID NO: 894972 - DNA, 17 bp, Homo sapiens
aattatataactgtatt

SEQ ID NO: 894973 - DNA, 12 bp, Homo sapiens
aattatatttct

SEQ ID NO: 894974 - DNA, 19 bp, Homo sapiens
aattatatttctacagaga

SEQ ID NO: 894975 - DNA, 20 bp, Homo sapiens
aattatatttctacagagaa

SEQ ID NO: 894976 - DNA, 14 bp, Homo sapiens
aattatatttgaaa

SEQ ID NO: 894977 - DNA, 15 bp, Homo sapiens
aattatcaaaaagct

SEQ ID NO: 894978 - DNA, 16 bp, Homo sapiens
aattatcagcaaagaa

SEQ ID NO: 894979 - DNA, 19 bp, Homo sapiens
aattatcatcccaacagcc

SEQ ID NO: 894980 - DNA, 17 bp, Homo sapiens
aattatccattacgtgc

SEQ ID NO: 894981 - DNA, 15 bp, Homo sapiens
aattatcggaagcag

SEQ ID NO: 894982 - DNA, 17 bp, Homo sapiens
aattatcggaagcagtg

SEQ ID NO: 894983 - DNA, 14 bp, Homo sapiens
aattatctaattta

SEQ ID NO: 894984 - DNA, 18 bp, Homo sapiens
aattatctaatttataaa

SEQ ID NO: 894985 - DNA, 19 bp, Homo sapiens
aattatctaatttataaaa

SEQ ID NO: 894986 - DNA, 22 bp, Homo sapiens
aattatctatagctaagtacac

SEQ ID NO: 894987 - DNA, 17 bp, Homo sapiens
aattatcttatgaaaac

SEQ ID NO: 894988 - DNA, 17 bp, Homo sapiens
aattatcttgatacatt

SEQ ID NO: 894989 - DNA, 20 bp, Homo sapiens
aattatcttgatacattcaa

SEQ ID NO: 894990 - DNA, 13 bp, Homo sapiens
aattatgacagtt

SEQ ID NO: 894991 - DNA, 15 bp, Homo sapiens
aattatggcatttct

SEQ ID NO: 894992 - DNA, 17 bp, Homo sapiens
aattatggcatttctat

SEQ ID NO: 894993 - DNA, 18 bp, Homo sapiens
aattatggcatttctatt

SEQ ID NO: 894994 - DNA, 21 bp, Homo sapiens
aattatgggaataattgcttt

SEQ ID NO: 894995 - DNA, 15 bp, Homo sapiens
aattatgtctcttga

SEQ ID NO: 894996 - DNA, 22 bp, Homo sapiens
aattatgtctgctgaataataa

SEQ ID NO: 894997 - DNA, 15 bp, Homo sapiens
aattatgtgacattt

SEQ ID NO: 894998 - DNA, 17 bp, Homo sapiens
aattatgtgacatttta

SEQ ID NO: 894999 - DNA, 19 bp, Homo sapiens
aattattaataccaaatat

SEQ ID NO: 895000 - DNA, 22 bp, Homo sapiens
aattattaattgtcctgtgtct

SEQ ID NO: 895001 - DNA, 15 bp, Homo sapiens
aattattataaaaat

SEQ ID NO: 895002 - DNA, 17 bp, Homo sapiens
aattattataaaaatat

SEQ ID NO: 895003 - DNA, 22 bp, Homo sapiens
aattattataaaaatattaaga

SEQ ID NO: 895004 - DNA, 15 bp, Homo sapiens
aattattatattgaa

SEQ ID NO: 895005 - DNA, 11 bp, Homo sapiens
aattattattt

SEQ ID NO: 895006 - DNA, 12 bp, Homo sapiens
aattattatttg

SEQ ID NO: 895007 - DNA, 16 bp, Homo sapiens
aattattatttgtgtt

SEQ ID NO: 895008 - DNA, 18 bp, Homo sapiens
aattattatttgtgtttt

SEQ ID NO: 895009 - DNA, 15 bp, Homo sapiens
aattattcagtgaat

SEQ ID NO: 895010 - DNA, 16 bp, Homo sapiens
aattctactggaaaaa

SEQ ID NO: 895011 - DNA, 12 bp, Homo sapiens
aattctagtgct

SEQ ID NO: 895012 - DNA, 16 bp, Homo sapiens
aattctagtgctgctg

SEQ ID NO: 895013 - DNA, 21 bp, Homo sapiens
aattctagtgctgctgaagat

SEQ ID NO: 895014 - DNA, 16 bp, Homo sapiens
aattctataaggccat

SEQ ID NO: 895015 - DNA, 22 bp, Homo sapiens
aattctataaggccataaaaca

SEQ ID NO: 895016 - DNA, 13 bp, Homo sapiens
aattctatgttaa

SEQ ID NO: 895017 - DNA, 17 bp, Homo sapiens
aattctatgttaaatac

SEQ ID NO: 895018 - DNA, 22 bp, Homo sapiens
aattctatgttaaatactgtgc

SEQ ID NO: 895019 - DNA, 23 bp, Homo sapiens
aattctatgttaaatactgtgca

SEQ ID NO: 895020 - DNA, 16 bp, Homo sapiens
aattctcaagacctga

SEQ ID NO: 895021 - DNA, 19 bp, Homo sapiens
aattctcagaatctcaaat

SEQ ID NO: 895022 - DNA, 18 bp, Homo sapiens
aattctccaggattttaa

SEQ ID NO: 895023 - DNA, 17 bp, Homo sapiens
aattctctagtttgatt

SEQ ID NO: 895024 - DNA, 21 bp, Homo sapiens
aattctgactgtccaggagct

SEQ ID NO: 895025 - DNA, 20 bp, Homo sapiens
aattctgcaactagccaagg

SEQ ID NO: 895026 - DNA, 13 bp, Homo sapiens
aattctgcaagtt

SEQ ID NO: 895027 - DNA, 16 bp, Homo sapiens
aattctgctacctcac

SEQ ID NO: 895028 - DNA, 12 bp, Homo sapiens
aattctggaaac

SEQ ID NO: 895029 - DNA, 16 bp, Homo sapiens
aattctggacagacag

SEQ ID NO: 895030 - DNA, 15 bp, Homo sapiens
aattctgggaaggga

SEQ ID NO: 895031 - DNA, 12 bp, Homo sapiens
aattctgggtga

SEQ ID NO: 895032 - DNA, 15 bp, Homo sapiens
aattctggtatacat

SEQ ID NO: 895033 - DNA, 17 bp, Homo sapiens
aattctggtatacattg

SEQ ID NO: 895034 - DNA, 13 bp, Homo sapiens
aattctgtccctg

SEQ ID NO: 895035 - DNA, 15 bp, Homo sapiens
aattctgtccctgtc

SEQ ID NO: 895036 - DNA, 20 bp, Homo sapiens
aattctgtccctgtccctgc

SEQ ID NO: 895037 - DNA, 22 bp, Homo sapiens
aattctgtccctgtccctgccc

SEQ ID NO: 895038 - DNA, 22 bp, Homo sapiens
aattctgtcttgttcattttga

SEQ ID NO: 895039 - DNA, 17 bp, Homo sapiens
aattctgtgatattttc

SEQ ID NO: 895040 - DNA, 17 bp, Homo sapiens
aattctgttgttccatt

SEQ ID NO: 895041 - DNA, 15 bp, Homo sapiens
aattctgtttaattt

SEQ ID NO: 895042 - DNA, 16 bp, Homo sapiens
aattctgtttcttgag

SEQ ID NO: 895043 - DNA, 14 bp, Homo sapiens
aattcttaaaatat

SEQ ID NO: 895044 - DNA, 16 bp, Homo sapiens
aattcttaagtatgtt

SEQ ID NO: 895045 - DNA, 13 bp, Homo sapiens
aattcttacatgt

SEQ ID NO: 895046 - DNA, 18 bp, Homo sapiens
aattcttatgactaaatt

SEQ ID NO: 895047 - DNA, 15 bp, Homo sapiens
aattcttatgcttat

SEQ ID NO: 895048 - DNA, 18 bp, Homo sapiens
aattcttcaggtggaaaa

SEQ ID NO: 895049 - DNA, 19 bp, Homo sapiens
aattcttcctctccttccc

SEQ ID NO: 895050 - DNA, 15 bp, Homo sapiens
aattcttctgtcctg

SEQ ID NO: 895051 - DNA, 21 bp, Homo sapiens
aattcttctgttctctggttt

SEQ ID NO: 895052 - DNA, 23 bp, Homo sapiens
aattcttctgttctctggtttca

SEQ ID NO: 895053 - DNA, 13 bp, Homo sapiens
aattcttgataaa

SEQ ID NO: 895054 - DNA, 14 bp, Homo sapiens
aattcttgatctct

SEQ ID NO: 895055 - DNA, 15 bp, Homo sapiens
aattcttgatctcta

SEQ ID NO: 895056 - DNA, 17 bp, Homo sapiens
aattcttgatctctaat

SEQ ID NO: 895057 - DNA, 14 bp, Homo sapiens
aattcttgcaaagt

SEQ ID NO: 895058 - DNA, 20 bp, Homo sapiens
aattcttgtatattatggaa

SEQ ID NO: 895059 - DNA, 19 bp, Homo sapiens
aattctttcaattcttcat

SEQ ID NO: 895060 - DNA, 19 bp, Homo sapiens
aattctttcacttgatgtt

SEQ ID NO: 895061 - DNA, 21 bp, Homo sapiens
aattctttctgttgaaaagca

SEQ ID NO: 895062 - DNA, 13 bp, Homo sapiens
aattcttttctga

SEQ ID NO: 895063 - DNA, 14 bp, Homo sapiens
aattcttttgaatt

SEQ ID NO: 895064 - DNA, 15 bp, Homo sapiens
aattgaaaagaagta

SEQ ID NO: 895065 - DNA, 21 bp, Homo sapiens
aattgaaaatgcattagggaa

SEQ ID NO: 895066 - DNA, 15 bp, Homo sapiens
aattgaaacacagag

SEQ ID NO: 895067 - DNA, 14 bp, Homo sapiens
aattgaaagaactt

SEQ ID NO: 895068 - DNA, 16 bp, Homo sapiens
aattgaaagaacttaa

SEQ ID NO: 895069 - DNA, 21 bp, Homo sapiens
aattgaaagaacttaagtctc

SEQ ID NO: 895070 - DNA, 17 bp, Homo sapiens
aattgaaaggcattctc

SEQ ID NO: 895071 - DNA, 15 bp, Homo sapiens
aattgaaagtattca

SEQ ID NO: 895072 - DNA, 12 bp, Homo sapiens
aattgaaatgta

SEQ ID NO: 895073 - DNA, 16 bp, Homo sapiens
aattgaaatgtaaggc

SEQ ID NO: 895074 - DNA, 19 bp, Homo sapiens
aattgaagaactgcacttt

SEQ ID NO: 895075 - DNA, 20 bp, Homo sapiens
aattgacatgaccctctgtc

SEQ ID NO: 895076 - DNA, 15 bp, Homo sapiens
aattgactcaaatct

SEQ ID NO: 895077 - DNA, 14 bp, Homo sapiens
aattgactgcagtt

SEQ ID NO: 895078 - DNA, 19 bp, Homo sapiens
aattgagataatgatactt

SEQ ID NO: 895079 - DNA, 18 bp, Homo sapiens
aattgagctgcagaaacg

SEQ ID NO: 895080 - DNA, 22 bp, Homo sapiens
aattgaggagagggactgaata

SEQ ID NO: 895081 - DNA, 17 bp, Homo sapiens
aattgaggggattaata

SEQ ID NO: 895082 - DNA, 14 bp, Homo sapiens
aattgaggtctgct

SEQ ID NO: 895083 - DNA, 18 bp, Homo sapiens
aattgagtgtttaaagtt

SEQ ID NO: 895084 - DNA, 14 bp, Homo sapiens
aattgatacttcag

SEQ ID NO: 895085 - DNA, 21 bp, Homo sapiens
aattgatcataggtatttcaa

SEQ ID NO: 895086 - DNA, 22 bp, Homo sapiens
aattgatcattttccccccact

SEQ ID NO: 895087 - DNA, 22 bp, Homo sapiens
atccctttattaccccctcctt

SEQ ID NO: 895088 - DNA, 20 bp, Homo sapiens
atcccttttcctttctggcc

SEQ ID NO: 895089 - DNA, 15 bp, Homo sapiens
atccctttttcaatg

SEQ ID NO: 895090 - DNA, 22 bp, Homo sapiens
atccctttttcataaattattt

SEQ ID NO: 895091 - DNA, 19 bp, Homo sapiens
atccctttttttacatttc

SEQ ID NO: 895092 - DNA, 20 bp, Homo sapiens
atccctttttttacatttca

SEQ ID NO: 895093 - DNA, 18 bp, Homo sapiens
atccgcaatgtggagcag

SEQ ID NO: 895094 - DNA, 22 bp, Homo sapiens
atccgcagactgcttggccaga

SEQ ID NO: 895095 - DNA, 20 bp, Homo sapiens
atccgcccacctcagcctcc

SEQ ID NO: 895096 - DNA, 19 bp, Homo sapiens
atccgcctacctcagcctc

SEQ ID NO: 895097 - DNA, 13 bp, Homo sapiens
atccgcctgtggg

SEQ ID NO: 895098 - DNA, 14 bp, Homo sapiens
atccgcctgtgggc

SEQ ID NO: 895099 - DNA, 17 bp, Homo sapiens
atccgctctcttcctgc

SEQ ID NO: 895100 - DNA, 19 bp, Homo sapiens
atccgctctcttcctgccc

SEQ ID NO: 895101 - DNA, 23 bp, Homo sapiens
atccgctgccaccacgtctgcca

SEQ ID NO: 895102 - DNA, 22 bp, Homo sapiens
atccggctgctcctccagccct

SEQ ID NO: 895103 - DNA, 20 bp, Homo sapiens
atccggtcccctgcctggaa

SEQ ID NO: 895104 - DNA, 21 bp, Homo sapiens
atccggtcccctgcctggaac

SEQ ID NO: 895105 - DNA, 22 bp, Homo sapiens
atccggtttagtcatccaacaa

SEQ ID NO: 895106 - DNA, 12 bp, Homo sapiens
atccggtttctt

SEQ ID NO: 895107 - DNA, 16 bp, Homo sapiens
atccgtagttccctga

SEQ ID NO: 895108 - DNA, 14 bp, Homo sapiens
atccgtcctgggcg

SEQ ID NO: 895109 - DNA, 19 bp, Homo sapiens
atccgtctgtgtggggttc

SEQ ID NO: 895110 - DNA, 12 bp, Homo sapiens
atccgtgctgca

SEQ ID NO: 895111 - DNA, 13 bp, Homo sapiens
atccgtgttgcag

SEQ ID NO: 895112 - DNA, 14 bp, Homo sapiens
atcctaaaatatgt

SEQ ID NO: 895113 - DNA, 11 bp, Homo sapiens
atcctaaactc

SEQ ID NO: 895114 - DNA, 14 bp, Homo sapiens
atcctaagacacaa

SEQ ID NO: 895115 - DNA, 21 bp, Homo sapiens
atcctaagatgtgttcttatt

SEQ ID NO: 895116 - DNA, 15 bp, Homo sapiens
atcctaatttctcct

SEQ ID NO: 895117 - DNA, 18 bp, Homo sapiens
atcctaatttctcctccc

SEQ ID NO: 895118 - DNA, 20 bp, Homo sapiens
atcctaatttctcctccctt

SEQ ID NO: 895119 - DNA, 11 bp, Homo sapiens
atcctacagta

SEQ ID NO: 895120 - DNA, 14 bp, Homo sapiens
atcctacagtacaa

SEQ ID NO: 895121 - DNA, 15 bp, Homo sapiens
atcctacagtacaat

SEQ ID NO: 895122 - DNA, 14 bp, Homo sapiens
atcctaccaatgca

SEQ ID NO: 895123 - DNA, 17 bp, Homo sapiens
atcctaccaatgcatgc

SEQ ID NO: 895124 - DNA, 18 bp, Homo sapiens
atcctaccaatgcatgca

SEQ ID NO: 895125 - DNA, 23 bp, Homo sapiens
atcctacccagcgtggcccaggc

SEQ ID NO: 895126 - DNA, 23 bp, Homo sapiens
atcctaccccctcttcaaagcag

SEQ ID NO: 895127 - DNA, 22 bp, Homo sapiens
atcctaccctcgggcccacctg

SEQ ID NO: 895128 - DNA, 15 bp, Homo sapiens
atcctaccttgcttt

SEQ ID NO: 895129 - DNA, 22 bp, Homo sapiens
atcctaccttgcttttgcttct

SEQ ID NO: 895130 - DNA, 15 bp, Homo sapiens
atcctagacttgaaa

SEQ ID NO: 895131 - DNA, 21 bp, Homo sapiens
atcctagccttatcctctgat

SEQ ID NO: 895132 - DNA, 16 bp, Homo sapiens
aattggcagtgacttt

SEQ ID NO: 895133 - DNA, 20 bp, Homo sapiens
aattggcagtgactttgtat

SEQ ID NO: 895134 - DNA, 14 bp, Homo sapiens
aattggcataattt

SEQ ID NO: 895135 - DNA, 23 bp, Homo sapiens
aattggcatggaaatttaaagca

SEQ ID NO: 895136 - DNA, 15 bp, Homo sapiens
aattggccatcttaa

SEQ ID NO: 895137 - DNA, 11 bp, Homo sapiens
aattggccatg

SEQ ID NO: 895138 - DNA, 14 bp, Homo sapiens
aattggccatgtcg

SEQ ID NO: 895139 - DNA, 16 bp, Homo sapiens
aattgggaagctgggg

SEQ ID NO: 895140 - DNA, 18 bp, Homo sapiens
aattgggagtccaggcac

SEQ ID NO: 895141 - DNA, 21 bp, Homo sapiens
aattgggagtccaggcacagg

SEQ ID NO: 895142 - DNA, 15 bp, Homo sapiens
aattgggatctgtct

SEQ ID NO: 895143 - DNA, 15 bp, Homo sapiens
aattggtaaaaacag

SEQ ID NO: 895144 - DNA, 20 bp, Homo sapiens
aattggtaaaactcactgtg

SEQ ID NO: 895145 - DNA, 17 bp, Homo sapiens
aattggtctgaaaggct

SEQ ID NO: 895146 - DNA, 13 bp, Homo sapiens
aattggtgcttca

SEQ ID NO: 895147 - DNA, 15 bp, Homo sapiens
aattggtgcttcagc

SEQ ID NO: 895148 - DNA, 12 bp, Homo sapiens
aattggtgtata

SEQ ID NO: 895149 - DNA, 16 bp, Homo sapiens
aattggtgtatatcat

SEQ ID NO: 895150 - DNA, 15 bp, Homo sapiens
aattggttctttatt

SEQ ID NO: 895151 - DNA, 14 bp, Homo sapiens
aattggttgtttaa

SEQ ID NO: 895152 - DNA, 17 bp, Homo sapiens
aattgtaaatattttga

SEQ ID NO: 895153 - DNA, 17 bp, Homo sapiens
aattgtaaattgaatca

SEQ ID NO: 895154 - DNA, 16 bp, Homo sapiens
aattgtaactgttctt

SEQ ID NO: 895155 - DNA, 13 bp, Homo sapiens
aattgtaatctga

SEQ ID NO: 895156 - DNA, 15 bp, Homo sapiens
aattgtacatatttg

SEQ ID NO: 895157 - DNA, 18 bp, Homo sapiens
aattgtagttctgtgtac

SEQ ID NO: 895158 - DNA, 21 bp, Homo sapiens
aattgtagttctgtgtacttt

SEQ ID NO: 895159 - DNA, 10 bp, Homo sapiens
aattgtataa

SEQ ID NO: 895160 - DNA, 20 bp, Homo sapiens
aattgtatacattttgttat

SEQ ID NO: 895161 - DNA, 22 bp, Homo sapiens
aattgtatacattttgttatag

SEQ ID NO: 895162 - DNA, 19 bp, Homo sapiens
aattgtataccaatgtgtt

SEQ ID NO: 895163 - DNA, 21 bp, Homo sapiens
aattgtataccaatgtgtttt

SEQ ID NO: 895164 - DNA, 24 bp, Homo sapiens
aattgtatcatttgaacaactagg

SEQ ID NO: 895165 - DNA, 20 bp, Homo sapiens
aattgtatctagtgcagctg

SEQ ID NO: 895166 - DNA, 18 bp, Homo sapiens
aattgtatgaaaatcctt

SEQ ID NO: 895167 - DNA, 18 bp, Homo sapiens
aattgtattttatatgag

SEQ ID NO: 895168 - DNA, 17 bp, Homo sapiens
aattgtccctgtttcaa

SEQ ID NO: 895169 - DNA, 18 bp, Homo sapiens
aattgtcccttaaacaaa

SEQ ID NO: 895170 - DNA, 13 bp, Homo sapiens
aattgtcctgtgt

SEQ ID NO: 895171 - DNA, 18 bp, Homo sapiens
aattgtctaaaatgtcag

SEQ ID NO: 895172 - DNA, 22 bp, Homo sapiens
aattgtctaaagttactactga

SEQ ID NO: 895173 - DNA, 13 bp, Homo sapiens
aattgtctattta

SEQ ID NO: 895174 - DNA, 17 bp, Homo sapiens
aattgtctatttatctt

SEQ ID NO: 895175 - DNA, 21 bp, Homo sapiens
aattgtctatttatcttttat

SEQ ID NO: 895176 - DNA, 19 bp, Homo sapiens
aattgtcttttagacaact

SEQ ID NO: 895177 - DNA, 15 bp, Homo sapiens
aattgtgatgttttg

SEQ ID NO: 895178 - DNA, 15 bp, Homo sapiens
aattgtgctgccatt

SEQ ID NO: 895179 - DNA, 16 bp, Homo sapiens
aattgtgctgccattt

SEQ ID NO: 895180 - DNA, 19 bp, Homo sapiens
aattgtgctgccatttgat

SEQ ID NO: 895181 - DNA, 16 bp, Homo sapiens
aattgtgctttcacca

SEQ ID NO: 895182 - DNA, 15 bp, Homo sapiens
aattgtgtaaaaaat

SEQ ID NO: 895183 - DNA, 21 bp, Homo sapiens
aattgtgtaaaaaatggaaaa

SEQ ID NO: 895184 - DNA, 23 bp, Homo sapiens
aattgtgtaaaaaatggaaaaaa

SEQ ID NO: 895185 - DNA, 17 bp, Homo sapiens
aattgtgtagccttttt

SEQ ID NO: 895186 - DNA, 21 bp, Homo sapiens
aattgtgtagcctttttgtat

SEQ ID NO: 895187 - DNA, 17 bp, Homo sapiens
aattgtgtatatatctt

SEQ ID NO: 895188 - DNA, 22 bp, Homo sapiens
aattgtgtattgatgcaatata

SEQ ID NO: 895189 - DNA, 23 bp, Homo sapiens
aattgtgtattgatgcaatataa

SEQ ID NO: 895190 - DNA, 13 bp, Homo sapiens
aattgtgtatttt

SEQ ID NO: 895191 - DNA, 19 bp, Homo sapiens
aattgtgtggattctttaa

SEQ ID NO: 895192 - DNA, 19 bp, Homo sapiens
aattgtgttgtcttcagca

SEQ ID NO: 895193 - DNA, 20 bp, Homo sapiens
aattgtgttttaattgtaaa

SEQ ID NO: 895194 - DNA, 18 bp, Homo sapiens
aattgttgacagttctga

SEQ ID NO: 895195 - DNA, 17 bp, Homo sapiens
aattgttgagatacttt

SEQ ID NO: 895196 - DNA, 13 bp, Homo sapiens
aattgttgatatt

SEQ ID NO: 895197 - DNA, 17 bp, Homo sapiens
aattgttgatattttcc

SEQ ID NO: 895198 - DNA, 19 bp, Homo sapiens
aattgttgattaatttgag

SEQ ID NO: 895199 - DNA, 13 bp, Homo sapiens
aattgttgttctg

SEQ ID NO: 895200 - DNA, 16 bp, Homo sapiens
aattgttgttctgtta

SEQ ID NO: 895201 - DNA, 22 bp, Homo sapiens
aattgttgttctgttaactgaa

SEQ ID NO: 895202 - DNA, 13 bp, Homo sapiens
aattgtttaaaaa

SEQ ID NO: 895203 - DNA, 19 bp, Homo sapiens
aattgtttatacacaactt

SEQ ID NO: 895204 - DNA, 23 bp, Homo sapiens
aattgtttatgtgttatgaacat

SEQ ID NO: 895205 - DNA, 16 bp, Homo sapiens
aattgtttcatatctg

SEQ ID NO: 895206 - DNA, 12 bp, Homo sapiens
aattgtttccaa

SEQ ID NO: 895207 - DNA, 21 bp, Homo sapiens
aattgtttccaacttgtctgg

SEQ ID NO: 895208 - DNA, 19 bp, Homo sapiens
aattgttttacctgttctg

SEQ ID NO: 895209 - DNA, 19 bp, Homo sapiens
aattgttttatctgaattt

SEQ ID NO: 895210 - DNA, 14 bp, Homo sapiens
aattgttttcttta

SEQ ID NO: 895211 - DNA, 19 bp, Homo sapiens
aattgttttctttaaagat

SEQ ID NO: 895212 - DNA, 20 bp, Homo sapiens
aattgttttgcactttttta

SEQ ID NO: 895213 - DNA, 22 bp, Homo sapiens
aattgtttttgaatttaaataa

SEQ ID NO: 895214 - DNA, 18 bp, Homo sapiens
atcctgaggccagtggcc

SEQ ID NO: 895215 - DNA, 19 bp, Homo sapiens
atcctgataaacattaaac

SEQ ID NO: 895216 - DNA, 14 bp, Homo sapiens
atcctgattccaaa

SEQ ID NO: 895217 - DNA, 18 bp, Homo sapiens
atcctgcaaaggcccttg

SEQ ID NO: 895218 - DNA, 14 bp, Homo sapiens
atcctgcaccccag

SEQ ID NO: 895219 - DNA, 15 bp, Homo sapiens
atcctgcaccccagc

SEQ ID NO: 895220 - DNA, 11 bp, Homo sapiens
atcctgcactc

SEQ ID NO: 895221 - DNA, 20 bp, Homo sapiens
atcctgcagcctcctcctga

SEQ ID NO: 895222 - DNA, 20 bp, Homo sapiens
atcctgcaggaacgagcact

SEQ ID NO: 895223 - DNA, 21 bp, Homo sapiens
atcctgcaggaacgagcactg

SEQ ID NO: 895224 - DNA, 15 bp, Homo sapiens
atcctgcagggcttc

SEQ ID NO: 895225 - DNA, 22 bp, Homo sapiens
atcctgcccagtgttgtttgta

SEQ ID NO: 895226 - DNA, 14 bp, Homo sapiens
atcctgccctgcag

SEQ ID NO: 895227 - DNA, 18 bp, Homo sapiens
atcctgctagcaggcccc

SEQ ID NO: 895228 - DNA, 15 bp, Homo sapiens
atcctgctagctgta

SEQ ID NO: 895229 - DNA, 12 bp, Homo sapiens
atcctgctcttt

SEQ ID NO: 895230 - DNA, 15 bp, Homo sapiens
atcctgctcttttgt

SEQ ID NO: 895231 - DNA, 17 bp, Homo sapiens
atcctgctcttttgtga

SEQ ID NO: 895232 - DNA, 20 bp, Homo sapiens
atcctgctcttttgtgatga

SEQ ID NO: 895233 - DNA, 15 bp, Homo sapiens
atcctgctggggctg

SEQ ID NO: 895234 - DNA, 22 bp, Homo sapiens
atcctgcttctcttttcctcgc

SEQ ID NO: 895235 - DNA, 21 bp, Homo sapiens
atcctgcttcttcttccaaat

SEQ ID NO: 895236 - DNA, 20 bp, Homo sapiens
atcctggaacaatattttat

SEQ ID NO: 895237 - DNA, 17 bp, Homo sapiens
atcctggaaggacacag

SEQ ID NO: 895238 - DNA, 19 bp, Homo sapiens
atcctggaaggacacagtg

SEQ ID NO: 895239 - DNA, 21 bp, Homo sapiens
atcctggaaggacacagtgat

SEQ ID NO: 895240 - DNA, 21 bp, Homo sapiens
atcctggaggtcttttctagt

SEQ ID NO: 895241 - DNA, 23 bp, Homo sapiens
atcctggatgatttcatcttctg

SEQ ID NO: 895242 - DNA, 12 bp, Homo sapiens
atcctggcagcc

SEQ ID NO: 895243 - DNA, 19 bp, Homo sapiens
atcctggcagcccagagac

SEQ ID NO: 895244 - DNA, 11 bp, Homo sapiens
atcctggcccc

SEQ ID NO: 895245 - DNA, 15 bp, Homo sapiens
atcctggcccctcca

SEQ ID NO: 895246 - DNA, 22 bp, Homo sapiens
atcctggcccctccagaccctg

SEQ ID NO: 895247 - DNA, 19 bp, Homo sapiens
atcctggggcagcactccc

SEQ ID NO: 895248 - DNA, 21 bp, Homo sapiens
atcctgggggatacgggggtt

SEQ ID NO: 895249 - DNA, 18 bp, Homo sapiens
atcctgggggcctgggtt

SEQ ID NO: 895250 - DNA, 19 bp, Homo sapiens
atcctggttaccactcttt

SEQ ID NO: 895251 - DNA, 12 bp, Homo sapiens
atcctgtaataa

SEQ ID NO: 895252 - DNA, 14 bp, Homo sapiens
atcctgtataagca

SEQ ID NO: 895253 - DNA, 23 bp, Homo sapiens
atcctgtataagcactgaaaaac

SEQ ID NO: 895254 - DNA, 13 bp, Homo sapiens
atctcacttccag

SEQ ID NO: 895255 - DNA, 16 bp, Homo sapiens
atctcacttccagata

SEQ ID NO: 895256 - DNA, 18 bp, Homo sapiens
atctcagaaagtaaatct

SEQ ID NO: 895257 - DNA, 16 bp, Homo sapiens
atctcagaaagtgcct

SEQ ID NO: 895258 - DNA, 19 bp, Homo sapiens
atctcagaaagtgcctgac

SEQ ID NO: 895259 - DNA, 12 bp, Homo sapiens
atctcagaacct

SEQ ID NO: 895260 - DNA, 17 bp, Homo sapiens
atctcagacctttactg

SEQ ID NO: 895261 - DNA, 23 bp, Homo sapiens
atctcagacctttactgatacta

SEQ ID NO: 895262 - DNA, 15 bp, Homo sapiens
atctcagagtccact

SEQ ID NO: 895263 - DNA, 19 bp, Homo sapiens
atctcagagtccactgtgg

SEQ ID NO: 895264 - DNA, 19 bp, Homo sapiens
atctcagatgttaaaataa

SEQ ID NO: 895265 - DNA, 20 bp, Homo sapiens
atctcagatgttaaaataaa

SEQ ID NO: 895266 - DNA, 21 bp, Homo sapiens
atctcagatgttaaaataaat

SEQ ID NO: 895267 - DNA, 23 bp, Homo sapiens
atctcagatgttaaaataaatgg

SEQ ID NO: 895268 - DNA, 18 bp, Homo sapiens
atctcagattctgtctaa

SEQ ID NO: 895269 - DNA, 17 bp, Homo sapiens
atctcagccatccgcag

SEQ ID NO: 895270 - DNA, 11 bp, Homo sapiens
atctcagccca

SEQ ID NO: 895271 - DNA, 12 bp, Homo sapiens
atctcagcctcc

SEQ ID NO: 895272 - DNA, 22 bp, Homo sapiens
atctcagctttgagaagccttc

SEQ ID NO: 895273 - DNA, 19 bp, Homo sapiens
atctcaggaaaatctgtga

SEQ ID NO: 895274 - DNA, 13 bp, Homo sapiens
atctcagggaggg

SEQ ID NO: 895275 - DNA, 16 bp, Homo sapiens
atctcaggggccagag

SEQ ID NO: 895276 - DNA, 17 bp, Homo sapiens
atctcaggggctgtttg

SEQ ID NO: 895277 - DNA, 24 bp, Homo sapiens
atctcaggtgccactccctgagct

SEQ ID NO: 895278 - DNA, 15 bp, Homo sapiens
atctcagtgctttcc

SEQ ID NO: 895279 - DNA, 17 bp, Homo sapiens
atctcagttgtttgctt

SEQ ID NO: 895280 - DNA, 13 bp, Homo sapiens
atctcatcatgtc

SEQ ID NO: 895281 - DNA, 16 bp, Homo sapiens
atctcattcagtatta

SEQ ID NO: 895282 - DNA, 17 bp, Homo sapiens
atctcattgcttacaag

SEQ ID NO: 895283 - DNA, 19 bp, Homo sapiens
atctcatttaagggaaaaa

SEQ ID NO: 895284 - DNA, 23 bp, Homo sapiens
atctcatttttccgtaaaaatga

SEQ ID NO: 895285 - DNA, 15 bp, Homo sapiens
atctccaagacctgg

SEQ ID NO: 895286 - DNA, 19 bp, Homo sapiens
atctccacagtcaaagaag

SEQ ID NO: 895287 - DNA, 20 bp, Homo sapiens
atctccaggattgaagagca

SEQ ID NO: 895288 - DNA, 14 bp, Homo sapiens
atctccagggaagc

SEQ ID NO: 895289 - DNA, 23 bp, Homo sapiens
atctccagggagcaagacagaga

SEQ ID NO: 895290 - DNA, 15 bp, Homo sapiens
atctccagtattctt

SEQ ID NO: 895291 - DNA, 17 bp, Homo sapiens
atctccagtgtgccaga

SEQ ID NO: 895292 - DNA, 19 bp, Homo sapiens
atctccatcatatgcctga

SEQ ID NO: 895293 - DNA, 19 bp, Homo sapiens
atctccatccctgaaattt

SEQ ID NO: 895294 - DNA, 15 bp, Homo sapiens
atctccatggccctg

SEQ ID NO: 895295 - DNA, 21 bp, Homo sapiens
atctccatggccctgtcccag

SEQ ID NO: 895296 - DNA, 17 bp, Homo sapiens
atctccatggcttcctc

SEQ ID NO: 895297 - DNA, 22 bp, Homo sapiens
atctccatggcttcctcctccc

SEQ ID NO: 895298 - DNA, 14 bp, Homo sapiens
atctccatttcaaa

SEQ ID NO: 895299 - DNA, 20 bp, Homo sapiens
atctcccaagctatctaaag

SEQ ID NO: 895300 - DNA, 18 bp, Homo sapiens
atctcccacctagcagca

SEQ ID NO: 895301 - DNA, 18 bp, Homo sapiens
atctcccagcccacctca

SEQ ID NO: 895302 - DNA, 17 bp, Homo sapiens
atctcccattttggaat

SEQ ID NO: 895303 - DNA, 13 bp, Homo sapiens
atctccccactct

SEQ ID NO: 895304 - DNA, 14 bp, Homo sapiens
atctccccaggcct

SEQ ID NO: 895305 - DNA, 15 bp, Homo sapiens
atctccccaggcctc

SEQ ID NO: 895306 - DNA, 21 bp, Homo sapiens
atctccccaggcctccagcct

SEQ ID NO: 895307 - DNA, 16 bp, Homo sapiens
atctccctgccatccc

SEQ ID NO: 895308 - DNA, 19 bp, Homo sapiens
atctccctgccgcctcaat

SEQ ID NO: 895309 - DNA, 15 bp, Homo sapiens
atctccctgcctggc

SEQ ID NO: 895310 - DNA, 18 bp, Homo sapiens
atctccctgcctggcccc

SEQ ID NO: 895311 - DNA, 18 bp, Homo sapiens
atctcccttagaagagag

SEQ ID NO: 895312 - DNA, 19 bp, Homo sapiens
atctcctaactttggacct

SEQ ID NO: 895313 - DNA, 18 bp, Homo sapiens
atctcctataatctgtca

SEQ ID NO: 895314 - DNA, 19 bp, Homo sapiens
atctcctataatctgtcaa

SEQ ID NO: 895315 - DNA, 19 bp, Homo sapiens
atctcctcaagtccccaag

SEQ ID NO: 895316 - DNA, 14 bp, Homo sapiens
atctcctcttttgt

SEQ ID NO: 895317 - DNA, 17 bp, Homo sapiens
atctcctgaatctaaca

SEQ ID NO: 895318 - DNA, 21 bp, Homo sapiens
atctcctgaccctcccactcc

SEQ ID NO: 895319 - DNA, 14 bp, Homo sapiens
atctcctgtgcatg

SEQ ID NO: 895320 - DNA, 15 bp, Homo sapiens
atctcctgtgcatgg

SEQ ID NO: 895321 - DNA, 19 bp, Homo sapiens
atctccttacctctggaac

SEQ ID NO: 895322 - DNA, 15 bp, Homo sapiens
atctccttgggctgg

SEQ ID NO: 895323 - DNA, 16 bp, Homo sapiens
atctcgagccccctgg

SEQ ID NO: 895324 - DNA, 18 bp, Homo sapiens
atctcggatgaccaaacc

SEQ ID NO: 895325 - DNA, 20 bp, Homo sapiens
atctcggcccgctgcagcct

SEQ ID NO: 895326 - DNA, 18 bp, Homo sapiens
atctcgggagtcctctag

SEQ ID NO: 895327 - DNA, 15 bp, Homo sapiens
atctctaaagagcat

SEQ ID NO: 895328 - DNA, 15 bp, Homo sapiens
atctctaatgagcta

SEQ ID NO: 895329 - DNA, 17 bp, Homo sapiens
atctctaatgagctagt

SEQ ID NO: 895330 - DNA, 21 bp, Homo sapiens
atctctaattagtctatcaaa

SEQ ID NO: 895331 - DNA, 15 bp, Homo sapiens
atctctaccatcatc

SEQ ID NO: 895332 - DNA, 14 bp, Homo sapiens
atctctaccccttt

SEQ ID NO: 895333 - DNA, 17 bp, Homo sapiens
atctctacccctttctt

SEQ ID NO: 895334 - DNA, 20 bp, Homo sapiens
atctctacccctttcttctc

SEQ ID NO: 895335 - DNA, 20 bp, Homo sapiens
atctctactaccacaaggaa

SEQ ID NO: 895336 - DNA, 15 bp, Homo sapiens
atctctagaatttta

SEQ ID NO: 895337 - DNA, 16 bp, Homo sapiens
atctctagaattttaa

SEQ ID NO: 895338 - DNA, 18 bp, Homo sapiens
atctctagaattttaagt

SEQ ID NO: 895339 - DNA, 19 bp, Homo sapiens
atctctatcgattgtgtag

SEQ ID NO: 895340 - DNA, 14 bp, Homo sapiens
atctctatttaata

SEQ ID NO: 895341 - DNA, 19 bp, Homo sapiens
atctctatttaatatttat

SEQ ID NO: 895342 - DNA, 21 bp, Homo sapiens
atctctcaggagcacaggcag

SEQ ID NO: 895343 - DNA, 12 bp, Homo sapiens
atctctcctcca

SEQ ID NO: 895344 - DNA, 20 bp, Homo sapiens
atctctcctccaagacactg

SEQ ID NO: 895345 - DNA, 12 bp, Homo sapiens
atctctcctggc

SEQ ID NO: 895346 - DNA, 20 bp, Homo sapiens
atctctcggttccacgtccc

SEQ ID NO: 895347 - DNA, 15 bp, Homo sapiens
atctctctacctcca

SEQ ID NO: 895348 - DNA, 17 bp, Homo sapiens
atctctctacctccacc

SEQ ID NO: 895349 - DNA, 21 bp, Homo sapiens
atctctctactcctacctcag

SEQ ID NO: 895350 - DNA, 22 bp, Homo sapiens
atctctctactcctacctcagc

SEQ ID NO: 895351 - DNA, 14 bp, Homo sapiens
aattttctttgttt

SEQ ID NO: 895352 - DNA, 20 bp, Homo sapiens
aattttgaagtgctgtttat

SEQ ID NO: 895353 - DNA, 21 bp, Homo sapiens
aattttgaataaataaatgta

SEQ ID NO: 895354 - DNA, 16 bp, Homo sapiens
aattttgagattaaga

SEQ ID NO: 895355 - DNA, 20 bp, Homo sapiens
aattttgatataatctttca

SEQ ID NO: 895356 - DNA, 16 bp, Homo sapiens
aattttgatatacatt

SEQ ID NO: 895357 - DNA, 21 bp, Homo sapiens
aattttgatatacattgtgtg

SEQ ID NO: 895358 - DNA, 14 bp, Homo sapiens
aattttgatgtttt

SEQ ID NO: 895359 - DNA, 12 bp, Homo sapiens
aattttgcattt

SEQ ID NO: 895360 - DNA, 15 bp, Homo sapiens
aattttgcatttagt

SEQ ID NO: 895361 - DNA, 22 bp, Homo sapiens
aattttgctggaattcctaact

SEQ ID NO: 895362 - DNA, 17 bp, Homo sapiens
aattttggccaaagtgt

SEQ ID NO: 895363 - DNA, 22 bp, Homo sapiens
aattttggccaaagtgttaatc

SEQ ID NO: 895364 - DNA, 18 bp, Homo sapiens
aattttggggattttcaa

SEQ ID NO: 895365 - DNA, 16 bp, Homo sapiens
aattttggtttttcaa

SEQ ID NO: 895366 - DNA, 13 bp, Homo sapiens
aattttgtaagaa

SEQ ID NO: 895367 - DNA, 18 bp, Homo sapiens
aattttgtaatgtatcaa

SEQ ID NO: 895368 - DNA, 13 bp, Homo sapiens
aattttgtacaaa

SEQ ID NO: 895369 - DNA, 16 bp, Homo sapiens
aattttgtacatactg

SEQ ID NO: 895370 - DNA, 13 bp, Homo sapiens
aattttgtacgta

SEQ ID NO: 895371 - DNA, 16 bp, Homo sapiens
aattttgtatgaaaaa

SEQ ID NO: 895372 - DNA, 12 bp, Homo sapiens
aattttgtctca

SEQ ID NO: 895373 - DNA, 16 bp, Homo sapiens
aattttgtctcacttt

SEQ ID NO: 895374 - DNA, 16 bp, Homo sapiens
aattttgtgcattctt

SEQ ID NO: 895375 - DNA, 17 bp, Homo sapiens
aattttgtgcattcttt

SEQ ID NO: 895376 - DNA, 19 bp, Homo sapiens
atctctgtcccattccctg

SEQ ID NO: 895377 - DNA, 14 bp, Homo sapiens
atctctgtctgggg

SEQ ID NO: 895378 - DNA, 14 bp, Homo sapiens
atctctgtgccttc

SEQ ID NO: 895379 - DNA, 19 bp, Homo sapiens
atctctgtgtgcacaaata

SEQ ID NO: 895380 - DNA, 18 bp, Homo sapiens
atctctgttctgctccca

SEQ ID NO: 895381 - DNA, 21 bp, Homo sapiens
atctctgttctgtttggcact

SEQ ID NO: 895382 - DNA, 20 bp, Homo sapiens
atctcttaagacagcatgtg

SEQ ID NO: 895383 - DNA, 23 bp, Homo sapiens
atctcttaagacagcatgtgtta

SEQ ID NO: 895384 - DNA, 23 bp, Homo sapiens
atctcttagaagccatgggacct

SEQ ID NO: 895385 - DNA, 14 bp, Homo sapiens
atctcttattctaa

SEQ ID NO: 895386 - DNA, 16 bp, Homo sapiens
atctcttattttacaa

SEQ ID NO: 895387 - DNA, 18 bp, Homo sapiens
atctcttcactaccctga

SEQ ID NO: 895388 - DNA, 19 bp, Homo sapiens
atctcttcactaccctgat

SEQ ID NO: 895389 - DNA, 14 bp, Homo sapiens
atctcttccccaga

SEQ ID NO: 895390 - DNA, 17 bp, Homo sapiens
atctcttccccagagag

SEQ ID NO: 895391 - DNA, 22 bp, Homo sapiens
atctcttcctacccaaccactc

SEQ ID NO: 895392 - DNA, 12 bp, Homo sapiens
atctcttcctgt

SEQ ID NO: 895393 - DNA, 12 bp, Homo sapiens
atctcttccttg

SEQ ID NO: 895394 - DNA, 21 bp, Homo sapiens
atctcttctgggttccttcct

SEQ ID NO: 895395 - DNA, 15 bp, Homo sapiens
atctcttgaggccag

SEQ ID NO: 895396 - DNA, 18 bp, Homo sapiens
atctcttgggagtcttgg

SEQ ID NO: 895397 - DNA, 17 bp, Homo sapiens
atctctttaaaggcaaa

SEQ ID NO: 895398 - DNA, 13 bp, Homo sapiens
atctctttcacat

SEQ ID NO: 895399 - DNA, 15 bp, Homo sapiens
atctctttgaatttt

SEQ ID NO: 895400 - DNA, 15 bp, Homo sapiens
atctctttgatctac

SEQ ID NO: 895401 - DNA, 21 bp, Homo sapiens
atctctttggaaaatagtttg

SEQ ID NO: 895402 - DNA, 22 bp, Homo sapiens
atctctttgttctaaagatgga

SEQ ID NO: 895403 - DNA, 11 bp, Homo sapiens
atctcttttat

SEQ ID NO: 895404 - DNA, 14 bp, Homo sapiens
atctgaaaatgtat

SEQ ID NO: 895405 - DNA, 20 bp, Homo sapiens
atctgaaaatgtatgtgtaa

SEQ ID NO: 895406 - DNA, 21 bp, Homo sapiens
atctgaaacccacagatgtct

SEQ ID NO: 895407 - DNA, 13 bp, Homo sapiens
atctgaacccagc

SEQ ID NO: 895408 - DNA, 23 bp, Homo sapiens
atctgaactgaccttgaatcttt

SEQ ID NO: 895409 - DNA, 14 bp, Homo sapiens
atctgaactgctct

SEQ ID NO: 895410 - DNA, 19 bp, Homo sapiens
atctgaactgctctacttt

SEQ ID NO: 895411 - DNA, 11 bp, Homo sapiens
atctgaagaaa

SEQ ID NO: 895412 - DNA, 21 bp, Homo sapiens
atctgaagaaagttattcttg

SEQ ID NO: 895413 - DNA, 21 bp, Homo sapiens
atctgaagagctattatataa

SEQ ID NO: 895414 - DNA, 22 bp, Homo sapiens
atctgaagagtatccttccttc

SEQ ID NO: 895415 - DNA, 18 bp, Homo sapiens
atctgaaggaccccaggt

SEQ ID NO: 895416 - DNA, 18 bp, Homo sapiens
atctgaaggggcaaattc

SEQ ID NO: 895417 - DNA, 21 bp, Homo sapiens
atctgaaggggcaaattcttt

SEQ ID NO: 895418 - DNA, 17 bp, Homo sapiens
atctgaattaaataaat

SEQ ID NO: 895419 - DNA, 12 bp, Homo sapiens
atctgaattttt

SEQ ID NO: 895420 - DNA, 20 bp, Homo sapiens
atctgaatttttaaacaagt

SEQ ID NO: 895421 - DNA, 13 bp, Homo sapiens
atctgacaaaatg

SEQ ID NO: 895422 - DNA, 23 bp, Homo sapiens
atctgacagcaggccactagtga

SEQ ID NO: 895423 - DNA, 20 bp, Homo sapiens
atctgaccagcagcgccttt

SEQ ID NO: 895424 - DNA, 21 bp, Homo sapiens
atctgaccccggggggctggg

SEQ ID NO: 895425 - DNA, 15 bp, Homo sapiens
atctgaccctcccag

SEQ ID NO: 895426 - DNA, 18 bp, Homo sapiens
atctgactcacaagaaga

SEQ ID NO: 895427 - DNA, 16 bp, Homo sapiens
atctgactgccaaata

SEQ ID NO: 895428 - DNA, 17 bp, Homo sapiens
atctgagcaagagctgg

SEQ ID NO: 895429 - DNA, 12 bp, Homo sapiens
atctgagctggg

SEQ ID NO: 895430 - DNA, 17 bp, Homo sapiens
atctgagggaaatgttt

SEQ ID NO: 895431 - DNA, 14 bp, Homo sapiens
atctgagggaggag

SEQ ID NO: 895432 - DNA, 15 bp, Homo sapiens
atctgataaaattgt

SEQ ID NO: 895433 - DNA, 16 bp, Homo sapiens
atctgataaaattgtg

SEQ ID NO: 895434 - DNA, 17 bp, Homo sapiens
atctgatcacttcatgt

SEQ ID NO: 895435 - DNA, 15 bp, Homo sapiens
atctgatctgtacca

SEQ ID NO: 895436 - DNA, 20 bp, Homo sapiens
atctgatctttttatacaca

SEQ ID NO: 895437 - DNA, 22 bp, Homo sapiens
atctgatctttttatacacaat

SEQ ID NO: 895438 - DNA, 13 bp, Homo sapiens
atctgatgtttca

SEQ ID NO: 895439 - DNA, 14 bp, Homo sapiens
atctgattccttta

SEQ ID NO: 895440 - DNA, 15 bp, Homo sapiens
atctgattcctttaa

SEQ ID NO: 895441 - DNA, 11 bp, Homo sapiens
atctgatttaa

SEQ ID NO: 895442 - DNA, 16 bp, Homo sapiens
atctgatttaatgttt

SEQ ID NO: 895443 - DNA, 17 bp, Homo sapiens
atctgatttaatgtttt

SEQ ID NO: 895444 - DNA, 21 bp, Homo sapiens
atctgatttaatgttttctgc

SEQ ID NO: 895445 - DNA, 14 bp, Homo sapiens
atctgatttcatta

SEQ ID NO: 895446 - DNA, 13 bp, Homo sapiens
atctgatttttaa

SEQ ID NO: 895447 - DNA, 17 bp, Homo sapiens
atctgattttttttgta

SEQ ID NO: 895448 - DNA, 21 bp, Homo sapiens
atctgcaaaaggcctcttgta

SEQ ID NO: 895449 - DNA, 17 bp, Homo sapiens
atctgcaccccttctct

SEQ ID NO: 895450 - DNA, 20 bp, Homo sapiens
atctgcaccccttctctcct

SEQ ID NO: 895451 - DNA, 23 bp, Homo sapiens
atctgcaccccttctctcctccc

SEQ ID NO: 895452 - DNA, 20 bp, Homo sapiens
atctgcacccttcttttctc

SEQ ID NO: 895453 - DNA, 19 bp, Homo sapiens
atctgcactctaaactgca

SEQ ID NO: 895454 - DNA, 13 bp, Homo sapiens
atctgcagaagga

SEQ ID NO: 895455 - DNA, 20 bp, Homo sapiens
atctgcagaaggaaaaatgt

SEQ ID NO: 895456 - DNA, 17 bp, Homo sapiens
atctgcagaatgggcca

SEQ ID NO: 895457 - DNA, 21 bp, Homo sapiens
atctgcagccattcttcaggt

SEQ ID NO: 895458 - DNA, 19 bp, Homo sapiens
atctgcaggcaccgggctg

SEQ ID NO: 895459 - DNA, 16 bp, Homo sapiens
atctgcaggcagacac

SEQ ID NO: 895460 - DNA, 16 bp, Homo sapiens
atctgcaggcttctta

SEQ ID NO: 895461 - DNA, 12 bp, Homo sapiens
atctgcagggag

SEQ ID NO: 895462 - DNA, 20 bp, Homo sapiens
atctgcagggggtgtgtctg

SEQ ID NO: 895463 - DNA, 17 bp, Homo sapiens
atctgcagtgatgcaat

SEQ ID NO: 895464 - DNA, 16 bp, Homo sapiens
atctgccaagggccga

SEQ ID NO: 895465 - DNA, 15 bp, Homo sapiens
atctgccagaaaact

SEQ ID NO: 895466 - DNA, 13 bp, Homo sapiens
atctgccagacct

SEQ ID NO: 895467 - DNA, 22 bp, Homo sapiens
atctgccatctaatggcttcag

SEQ ID NO: 895468 - DNA, 19 bp, Homo sapiens
atctgcccaggggtgcccc

SEQ ID NO: 895469 - DNA, 22 bp, Homo sapiens
atctgcccaggggtgccccctc

SEQ ID NO: 895470 - DNA, 15 bp, Homo sapiens
atctgcccctgttga

SEQ ID NO: 895471 - DNA, 18 bp, Homo sapiens
atctgcccgcctcggtct

SEQ ID NO: 895472 - DNA, 14 bp, Homo sapiens
atctgccctccctg

SEQ ID NO: 895473 - DNA, 23 bp, Homo sapiens
atctgcctggcctggctccccac

SEQ ID NO: 895474 - DNA, 19 bp, Homo sapiens
atctgcctgggcctgtgca

SEQ ID NO: 895475 - DNA, 13 bp, Homo sapiens
atctgccttccag

SEQ ID NO: 895476 - DNA, 18 bp, Homo sapiens
atctgccttccagcccag

SEQ ID NO: 895477 - DNA, 23 bp, Homo sapiens
atctgcgagtagatgaacctgca

SEQ ID NO: 895478 - DNA, 21 bp, Homo sapiens
atctgcgtgacaataaaacat

SEQ ID NO: 895479 - DNA, 12 bp, Homo sapiens
acaaaagtgaac

SEQ ID NO: 895480 - DNA, 14 bp, Homo sapiens
acaaaataaacaaa

SEQ ID NO: 895481 - DNA, 18 bp, Homo sapiens
acaaaatagaagctgtag

SEQ ID NO: 895482 - DNA, 12 bp, Homo sapiens
acaaaatataca

SEQ ID NO: 895483 - DNA, 12 bp, Homo sapiens
acaaaatattta

SEQ ID NO: 895484 - DNA, 14 bp, Homo sapiens
acaaaatatttaag

SEQ ID NO: 895485 - DNA, 22 bp, Homo sapiens
acaaaatccattccaggtagct

SEQ ID NO: 895486 - DNA, 16 bp, Homo sapiens
acaaaatctaaaacaa

SEQ ID NO: 895487 - DNA, 19 bp, Homo sapiens
acaaaatctgaactctcaa

SEQ ID NO: 895488 - DNA, 23 bp, Homo sapiens
acaaaatcttgtaggtcattgca

SEQ ID NO: 895489 - DNA, 18 bp, Homo sapiens
acaaaatgaaaatatctt

SEQ ID NO: 895490 - DNA, 12 bp, Homo sapiens
acaaaatgccaa

SEQ ID NO: 895491 - DNA, 16 bp, Homo sapiens
acaaaatggcttcagt

SEQ ID NO: 895492 - DNA, 20 bp, Homo sapiens
acaaaatggggcagaagaga

SEQ ID NO: 895493 - DNA, 19 bp, Homo sapiens
acaaaatgtagaatattca

SEQ ID NO: 895494 - DNA, 18 bp, Homo sapiens
acaaaattaatacattct

SEQ ID NO: 895495 - DNA, 16 bp, Homo sapiens
acaaaattttctcatt

SEQ ID NO: 895496 - DNA, 15 bp, Homo sapiens
acaaaattttgttta

SEQ ID NO: 895497 - DNA, 15 bp, Homo sapiens
acaaacaaaacttaa

SEQ ID NO: 895498 - DNA, 17 bp, Homo sapiens
acaaattagcatgcaag

SEQ ID NO: 895499 - DNA, 14 bp, Homo sapiens
acaaattcaaataa

SEQ ID NO: 895500 - DNA, 17 bp, Homo sapiens
acaaattcatattctgt

SEQ ID NO: 895501 - DNA, 12 bp, Homo sapiens
acaaattctgtt

SEQ ID NO: 895502 - DNA, 13 bp, Homo sapiens
acaaatttataaa

SEQ ID NO: 895503 - DNA, 11 bp, Homo sapiens
acaaatttatg

SEQ ID NO: 895504 - DNA, 13 bp, Homo sapiens
acaaatttatgca

SEQ ID NO: 895505 - DNA, 15 bp, Homo sapiens
acaaatttatgcatt

SEQ ID NO: 895506 - DNA, 19 bp, Homo sapiens
acaaatttatgcatttcat

SEQ ID NO: 895507 - DNA, 19 bp, Homo sapiens
acaaatttggccttaagaa

SEQ ID NO: 895508 - DNA, 12 bp, Homo sapiens
acaaattttcaa

SEQ ID NO: 895509 - DNA, 21 bp, Homo sapiens
acaaattttcactgctgctcc

SEQ ID NO: 895510 - DNA, 23 bp, Homo sapiens
acaaatttttcaaatcattcctt

SEQ ID NO: 895511 - DNA, 23 bp, Homo sapiens
acaaattttttaatttccaaaat

SEQ ID NO: 895512 - DNA, 11 bp, Homo sapiens
acaacaaaaac

SEQ ID NO: 895513 - DNA, 15 bp, Homo sapiens
acaacaaactgaatt

SEQ ID NO: 895514 - DNA, 12 bp, Homo sapiens
acaacaacagtt

SEQ ID NO: 895515 - DNA, 18 bp, Homo sapiens
acaacaattggtaaaact

SEQ ID NO: 895516 - DNA, 14 bp, Homo sapiens
acaacacacacact

SEQ ID NO: 895517 - DNA, 21 bp, Homo sapiens
acaacaccagccccacttctg

SEQ ID NO: 895518 - DNA, 15 bp, Homo sapiens
acaacaccttcctcc

SEQ ID NO: 895519 - DNA, 18 bp, Homo sapiens
acaacaccttcctcctgc

SEQ ID NO: 895520 - DNA, 16 bp, Homo sapiens
acaacactgattcctg

SEQ ID NO: 895521 - DNA, 16 bp, Homo sapiens
acaacacttaatagca

SEQ ID NO: 895522 - DNA, 13 bp, Homo sapiens
acaacagaaaaac

SEQ ID NO: 895523 - DNA, 11 bp, Homo sapiens
acaacagaagt

SEQ ID NO: 895524 - DNA, 13 bp, Homo sapiens
acaacagaagtca

SEQ ID NO: 895525 - DNA, 15 bp, Homo sapiens
acaacagctgaagca

SEQ ID NO: 895526 - DNA, 12 bp, Homo sapiens
acaacaggagag

SEQ ID NO: 895527 - DNA, 15 bp, Homo sapiens
acaacaggagagaga

SEQ ID NO: 895528 - DNA, 18 bp, Homo sapiens
acaacagtcttcattttt

SEQ ID NO: 895529 - DNA, 19 bp, Homo sapiens
acaacagttctgagctgta

SEQ ID NO: 895530 - DNA, 19 bp, Homo sapiens
acaacatcccacagtggca

SEQ ID NO: 895531 - DNA, 17 bp, Homo sapiens
acaacatttatatgtag

SEQ ID NO: 895532 - DNA, 13 bp, Homo sapiens
acaaccaaaacat

SEQ ID NO: 895533 - DNA, 22 bp, Homo sapiens
acaaccaacagaaaacatccca

SEQ ID NO: 895534 - DNA, 19 bp, Homo sapiens
acaaccaccgctccccagc

SEQ ID NO: 895535 - DNA, 17 bp, Homo sapiens
acaaccactcattcaaa

SEQ ID NO: 895536 - DNA, 21 bp, Homo sapiens
acaacccacaccgtcttcctt

SEQ ID NO: 895537 - DNA, 22 bp, Homo sapiens
acaacccaggcagtaccattca

SEQ ID NO: 895538 - DNA, 12 bp, Homo sapiens
acaaccctgacc

SEQ ID NO: 895539 - DNA, 14 bp, Homo sapiens
acaaccctgcaaag

SEQ ID NO: 895540 - DNA, 13 bp, Homo sapiens
acaaccctggcct

SEQ ID NO: 895541 - DNA, 19 bp, Homo sapiens
acaaccgatgctccagcca

SEQ ID NO: 895542 - DNA, 20 bp, Homo sapiens
acaaccgatgctccagccaa

SEQ ID NO: 895543 - DNA, 20 bp, Homo sapiens
acaaccgtcctgctgtccct

SEQ ID NO: 895544 - DNA, 16 bp, Homo sapiens
acaacctcaactgcct

SEQ ID NO: 895545 - DNA, 20 bp, Homo sapiens
acaacctctctgatcttgtg

SEQ ID NO: 895546 - DNA, 13 bp, Homo sapiens
acaacctgaacct

SEQ ID NO: 895547 - DNA, 13 bp, Homo sapiens
acaacctgaatct

SEQ ID NO: 895548 - DNA, 19 bp, Homo sapiens
acaacctgtgtgagagaat

SEQ ID NO: 895549 - DNA, 23 bp, Homo sapiens
acaacctgtgtgagagaatttat

SEQ ID NO: 895550 - DNA, 18 bp, Homo sapiens
acaaccttcggctccggg

SEQ ID NO: 895551 - DNA, 18 bp, Homo sapiens
acaaccttctgtggctca

SEQ ID NO: 895552 - DNA, 22 bp, Homo sapiens
acaacgatgaatttcttctaat

SEQ ID NO: 895553 - DNA, 14 bp, Homo sapiens
acaacgtctcttca

SEQ ID NO: 895554 - DNA, 18 bp, Homo sapiens
acaactagatttgtcctt

SEQ ID NO: 895555 - DNA, 23 bp, Homo sapiens
acaactagatttgtccttttatt

SEQ ID NO: 895556 - DNA, 16 bp, Homo sapiens
acaactaggcttcagc

SEQ ID NO: 895557 - DNA, 19 bp, Homo sapiens
acaactaggcttcagcata

SEQ ID NO: 895558 - DNA, 18 bp, Homo sapiens
acaactatcaattcttga

SEQ ID NO: 895559 - DNA, 19 bp, Homo sapiens
acaactcagaatgggggct

SEQ ID NO: 895560 - DNA, 14 bp, Homo sapiens
acaactcattctga

SEQ ID NO: 895561 - DNA, 22 bp, Homo sapiens
acaactcccttaaggtctccaa

SEQ ID NO: 895562 - DNA, 16 bp, Homo sapiens
acaactctagaaatgc

SEQ ID NO: 895563 - DNA, 18 bp, Homo sapiens
acaactctgcctttatga

SEQ ID NO: 895564 - DNA, 15 bp, Homo sapiens
acaactgcaaagaaa

SEQ ID NO: 895565 - DNA, 16 bp, Homo sapiens
acaactggacaagatt

SEQ ID NO: 895566 - DNA, 17 bp, Homo sapiens
acaactgtaaagcaaat

SEQ ID NO: 895567 - DNA, 14 bp, Homo sapiens
acaacttaaataat

SEQ ID NO: 895568 - DNA, 15 bp, Homo sapiens
acaacttagctcagg

SEQ ID NO: 895569 - DNA, 16 bp, Homo sapiens
acaacttagctcaggt

SEQ ID NO: 895570 - DNA, 22 bp, Homo sapiens
acaacttataggtgaatgagta

SEQ ID NO: 895571 - DNA, 16 bp, Homo sapiens
acaacttatttaaaaa

SEQ ID NO: 895572 - DNA, 15 bp, Homo sapiens
acaacttctgtttct

SEQ ID NO: 895573 - DNA, 22 bp, Homo sapiens
acaacttgaagattgtagcaat

SEQ ID NO: 895574 - DNA, 15 bp, Homo sapiens
acaacttgatttttt

SEQ ID NO: 895575 - DNA, 20 bp, Homo sapiens
acaacttgctacttatcatt

SEQ ID NO: 895576 - DNA, 21 bp, Homo sapiens
acaacttgctacttatcattt

SEQ ID NO: 895577 - DNA, 18 bp, Homo sapiens
acaacttgtagcagctat

SEQ ID NO: 895578 - DNA, 17 bp, Homo sapiens
acaactttaagaggaca

SEQ ID NO: 895579 - DNA, 22 bp, Homo sapiens
acaactttaccataaagccttt

SEQ ID NO: 895580 - DNA, 12 bp, Homo sapiens
acaactttcact

SEQ ID NO: 895581 - DNA, 22 bp, Homo sapiens
acaactttcactataatgtgaa

SEQ ID NO: 895582 - DNA, 15 bp, Homo sapiens
acaactttcacttct

SEQ ID NO: 895583 - DNA, 13 bp, Homo sapiens
acaacttttgttt

SEQ ID NO: 895584 - DNA, 12 bp, Homo sapiens
acaagaaaatgt

SEQ ID NO: 895585 - DNA, 19 bp, Homo sapiens
acaagaaagggccaggaga

SEQ ID NO: 895586 - DNA, 15 bp, Homo sapiens
acaagaaatccctgt

SEQ ID NO: 895587 - DNA, 23 bp, Homo sapiens
acaagaaatccctgtttaatatt

SEQ ID NO: 895588 - DNA, 11 bp, Homo sapiens
acaagaaatgg

SEQ ID NO: 895589 - DNA, 20 bp, Homo sapiens
acaagaagaaatatgaaatt

SEQ ID NO: 895590 - DNA, 15 bp, Homo sapiens
acaagaagcattttg

SEQ ID NO: 895591 - DNA, 14 bp, Homo sapiens
acaagaagcccagt

SEQ ID NO: 895592 - DNA, 20 bp, Homo sapiens
acaagaagcccagtggtgag

SEQ ID NO: 895593 - DNA, 17 bp, Homo sapiens
acaagaatcacctcaaa

SEQ ID NO: 895594 - DNA, 19 bp, Homo sapiens
acaagaatgcattccctga

SEQ ID NO: 895595 - DNA, 11 bp, Homo sapiens
acaagaatgtc

SEQ ID NO: 895596 - DNA, 13 bp, Homo sapiens
acaagaatgtccc

SEQ ID NO: 895597 - DNA, 21 bp, Homo sapiens
acaagaattgagtatcacttt

SEQ ID NO: 895598 - DNA, 14 bp, Homo sapiens
acaagacacagtga

SEQ ID NO: 895599 - DNA, 15 bp, Homo sapiens
acaagacagaagctg

SEQ ID NO: 895600 - DNA, 19 bp, Homo sapiens
acaagaccacgtttctaaa

SEQ ID NO: 895601 - DNA, 19 bp, Homo sapiens
acaagaccgccccagggct

SEQ ID NO: 895602 - DNA, 16 bp, Homo sapiens
acaagacttcagtatg

SEQ ID NO: 895603 - DNA, 16 bp, Homo sapiens
acaagagcagcctgtg

SEQ ID NO: 895604 - DNA, 20 bp, Homo sapiens
acaagagcagcctgtggcat

SEQ ID NO: 895605 - DNA, 13 bp, Homo sapiens
acaagagcccagc

SEQ ID NO: 895606 - DNA, 22 bp, Homo sapiens
acaagagcctgatctcttcctg

SEQ ID NO: 895607 - DNA, 17 bp, Homo sapiens
acaagagcgaaactccg

SEQ ID NO: 895608 - DNA, 13 bp, Homo sapiens
acaagagctgctg

SEQ ID NO: 895609 - DNA, 15 bp, Homo sapiens
acaagagctgctgtc

SEQ ID NO: 895610 - DNA, 16 bp, Homo sapiens
acaagagtccctttga

SEQ ID NO: 895611 - DNA, 16 bp, Homo sapiens
atctgtgtttttgaaa

SEQ ID NO: 895612 - DNA, 21 bp, Homo sapiens
atctgtgtttttgaaatatta

SEQ ID NO: 895613 - DNA, 14 bp, Homo sapiens
atctgttagcagag

SEQ ID NO: 895614 - DNA, 14 bp, Homo sapiens
atctgttagggcct

SEQ ID NO: 895615 - DNA, 16 bp, Homo sapiens
atctgttagggccttg

SEQ ID NO: 895616 - DNA, 17 bp, Homo sapiens
atctgttagggccttgg

SEQ ID NO: 895617 - DNA, 18 bp, Homo sapiens
atctgttatagctttaaa

SEQ ID NO: 895618 - DNA, 19 bp, Homo sapiens
atctgttcaacctcagtat

SEQ ID NO: 895619 - DNA, 16 bp, Homo sapiens
atctgttccttggcag

SEQ ID NO: 895620 - DNA, 13 bp, Homo sapiens
atctgttgaaaag

SEQ ID NO: 895621 - DNA, 20 bp, Homo sapiens
acaatttgcactaaatcaga

SEQ ID NO: 895622 - DNA, 21 bp, Homo sapiens
atgaaactatggctttaaact

SEQ ID NO: 895623 - DNA, 17 bp, Homo sapiens
atgaaactcctgatttt

SEQ ID NO: 895624 - DNA, 18 bp, Homo sapiens
atgaaactctttcattct

SEQ ID NO: 895625 - DNA, 12 bp, Homo sapiens
atgaaactgtac

SEQ ID NO: 895626 - DNA, 14 bp, Homo sapiens
atgaaagaaaggcc

SEQ ID NO: 895627 - DNA, 16 bp, Homo sapiens
atgaaagactgtacaa

SEQ ID NO: 895628 - DNA, 19 bp, Homo sapiens
atgaaagactgtacaaagt

SEQ ID NO: 895629 - DNA, 19 bp, Homo sapiens
atgaaagatggctgtgcct

SEQ ID NO: 895630 - DNA, 23 bp, Homo sapiens
atgaaagatggctgtgcctctgc

SEQ ID NO: 895631 - DNA, 13 bp, Homo sapiens
atgaaagcaacaa

SEQ ID NO: 895632 - DNA, 18 bp, Homo sapiens
atgaaagcatgtggcatg

SEQ ID NO: 895633 - DNA, 21 bp, Homo sapiens
atgaaagctgattactgtcaa

SEQ ID NO: 895634 - DNA, 23 bp, Homo sapiens
atgaaagctgattactgtcaata

SEQ ID NO: 895635 - DNA, 22 bp, Homo sapiens
atgaaagggtttgtaatacttt

SEQ ID NO: 895636 - DNA, 21 bp, Homo sapiens
atgaaaggttaaaaaagcgag

SEQ ID NO: 895637 - DNA, 16 bp, Homo sapiens
atgaaaggtttacatt

SEQ ID NO: 895638 - DNA, 13 bp, Homo sapiens
atgaaagttttgc

SEQ ID NO: 895639 - DNA, 16 bp, Homo sapiens
atgaaataaaatatat

SEQ ID NO: 895640 - DNA, 24 bp, Homo sapiens
atgaaataaattctgacttatgaa

SEQ ID NO: 895641 - DNA, 20 bp, Homo sapiens
atgaaatacacaagtaaaca

SEQ ID NO: 895642 - DNA, 18 bp, Homo sapiens
atgaaatactccagcacc

SEQ ID NO: 895643 - DNA, 15 bp, Homo sapiens
atgaaatatatgtga

SEQ ID NO: 895644 - DNA, 17 bp, Homo sapiens
atgaaatatatgtgaaa

SEQ ID NO: 895645 - DNA, 19 bp, Homo sapiens
atgaaatatcagactagtg

SEQ ID NO: 895646 - DNA, 17 bp, Homo sapiens
atgaaatattgctgtat

SEQ ID NO: 895647 - DNA, 22 bp, Homo sapiens
atgaaatgccctcctaaatgtc

SEQ ID NO: 895648 - DNA, 16 bp, Homo sapiens
atgaaatggttaagaa

SEQ ID NO: 895649 - DNA, 17 bp, Homo sapiens
atgaaattcaagtgctt

SEQ ID NO: 895650 - DNA, 18 bp, Homo sapiens
atgaaattcttgaagttc

SEQ ID NO: 895651 - DNA, 21 bp, Homo sapiens
atgaaattcttttataaatat

SEQ ID NO: 895652 - DNA, 12 bp, Homo sapiens
atgaaattgcca

SEQ ID NO: 895653 - DNA, 21 bp, Homo sapiens
atgaaattttctagactttct

SEQ ID NO: 895654 - DNA, 15 bp, Homo sapiens
atgaaattttttagt

SEQ ID NO: 895655 - DNA, 16 bp, Homo sapiens
atgaacaaaattattt

SEQ ID NO: 895656 - DNA, 17 bp, Homo sapiens
atgaacaaaattatttg

SEQ ID NO: 895657 - DNA, 19 bp, Homo sapiens
atgaacaaaattatttgta

SEQ ID NO: 895658 - DNA, 13 bp, Homo sapiens
atgaacaaatatg

SEQ ID NO: 895659 - DNA, 17 bp, Homo sapiens
atgaacaaatatgcttt

SEQ ID NO: 895660 - DNA, 21 bp, Homo sapiens
atgaacaacagtagtttctca

SEQ ID NO: 895661 - DNA, 14 bp, Homo sapiens
atgaacaagtttta

SEQ ID NO: 895662 - DNA, 15 bp, Homo sapiens
atgaacaagttttaa

SEQ ID NO: 895663 - DNA, 22 bp, Homo sapiens
atgaacacactgtgtcctggtg

SEQ ID NO: 895664 - DNA, 17 bp, Homo sapiens
atgaacatcatggactg

SEQ ID NO: 895665 - DNA, 16 bp, Homo sapiens
atgaacatctcttgaa

SEQ ID NO: 895666 - DNA, 19 bp, Homo sapiens
atgaacatctcttgaaacc

SEQ ID NO: 895667 - DNA, 20 bp, Homo sapiens
atgaaccagccggggcctta

SEQ ID NO: 895668 - DNA, 21 bp, Homo sapiens
atgaacccaaaaagagaccca

SEQ ID NO: 895669 - DNA, 14 bp, Homo sapiens
atgaacccataggg

SEQ ID NO: 895670 - DNA, 21 bp, Homo sapiens
atgaaccctcctcctttttaa

SEQ ID NO: 895671 - DNA, 14 bp, Homo sapiens
atgaacctattttc

SEQ ID NO: 895672 - DNA, 16 bp, Homo sapiens
atgaacctattttcat

SEQ ID NO: 895673 - DNA, 19 bp, Homo sapiens
atgaacctattttcatttg

SEQ ID NO: 895674 - DNA, 22 bp, Homo sapiens
atgaacctattttcatttgtac

SEQ ID NO: 895675 - DNA, 23 bp, Homo sapiens
atgaacctattttcatttgtaca

SEQ ID NO: 895676 - DNA, 24 bp, Homo sapiens
atgaaccttctggcctcccacaga

SEQ ID NO: 895677 - DNA, 15 bp, Homo sapiens
atgaactgaagtttc

SEQ ID NO: 895678 - DNA, 16 bp, Homo sapiens
atgaactgaagtttca

SEQ ID NO: 895679 - DNA, 19 bp, Homo sapiens
atgaactgaagtttcacat

SEQ ID NO: 895680 - DNA, 16 bp, Homo sapiens
atgaactgtggaattt

SEQ ID NO: 895681 - DNA, 19 bp, Homo sapiens
atgaactgtggaatttatt

SEQ ID NO: 895682 - DNA, 17 bp, Homo sapiens
atgaacttattctgtag

SEQ ID NO: 895683 - DNA, 19 bp, Homo sapiens
atgaacttgagatctgtat

SEQ ID NO: 895684 - DNA, 22 bp, Homo sapiens
atgaacttgagctctgtaactt

SEQ ID NO: 895685 - DNA, 12 bp, Homo sapiens
atgaactttaaa

SEQ ID NO: 895686 - DNA, 21 bp, Homo sapiens
atgaactttgtcattatgatt

SEQ ID NO: 895687 - DNA, 18 bp, Homo sapiens
atgaacttttacagaatg

SEQ ID NO: 895688 - DNA, 19 bp, Homo sapiens
atgaacttttacagaatgc

SEQ ID NO: 895689 - DNA, 20 bp, Homo sapiens
atgaacttttacagaatgca

SEQ ID NO: 895690 - DNA, 14 bp, Homo sapiens
atgaagaaagtgga

SEQ ID NO: 895691 - DNA, 19 bp, Homo sapiens
atgaagaacacagcatgtg

SEQ ID NO: 895692 - DNA, 15 bp, Homo sapiens
atgaagaacataaaa

SEQ ID NO: 895693 - DNA, 15 bp, Homo sapiens
atgaagaagtttcta

SEQ ID NO: 895694 - DNA, 14 bp, Homo sapiens
atgaagaatagaaa

SEQ ID NO: 895695 - DNA, 17 bp, Homo sapiens
atgaagaatagaaacaa

SEQ ID NO: 895696 - DNA, 13 bp, Homo sapiens
atgaagaccaaag

SEQ ID NO: 895697 - DNA, 21 bp, Homo sapiens
atgaagactgttaaatgaaac

SEQ ID NO: 895698 - DNA, 22 bp, Homo sapiens
atgaagactgttaaatgaaacc

SEQ ID NO: 895699 - DNA, 17 bp, Homo sapiens
atgaagagctagagaaa

SEQ ID NO: 895700 - DNA, 22 bp, Homo sapiens
atgaagagctgtcttcccctga

SEQ ID NO: 895701 - DNA, 22 bp, Homo sapiens
atgaagattctcctgtgctaga

SEQ ID NO: 895702 - DNA, 22 bp, Homo sapiens
atgaagcagctttaaacaaatt

SEQ ID NO: 895703 - DNA, 14 bp, Homo sapiens
atgaagcaggaggc

SEQ ID NO: 895704 - DNA, 13 bp, Homo sapiens
atgaagcagtatt

SEQ ID NO: 895705 - DNA, 12 bp, Homo sapiens
atgaagcccaag

SEQ ID NO: 895706 - DNA, 17 bp, Homo sapiens
atgaagcccaagtgaaa

SEQ ID NO: 895707 - DNA, 19 bp, Homo sapiens
atgaagcctttggtgaatt

SEQ ID NO: 895708 - DNA, 23 bp, Homo sapiens
atgaagcctttggtgaattcctt

SEQ ID NO: 895709 - DNA, 19 bp, Homo sapiens
atgaagcgaaacacagaga

SEQ ID NO: 895710 - DNA, 22 bp, Homo sapiens
atgaagctaataaaattcgctt

SEQ ID NO: 895711 - DNA, 15 bp, Homo sapiens
atgaagctacctcaa

SEQ ID NO: 895712 - DNA, 14 bp, Homo sapiens
atgaagctgccatc

SEQ ID NO: 895713 - DNA, 14 bp, Homo sapiens
atgaagctgtataa

SEQ ID NO: 895714 - DNA, 13 bp, Homo sapiens
atgaagctgttgt

SEQ ID NO: 895715 - DNA, 17 bp, Homo sapiens
atgaaggaatcattcca

SEQ ID NO: 895716 - DNA, 12 bp, Homo sapiens
atgaaggaattt

SEQ ID NO: 895717 - DNA, 15 bp, Homo sapiens
atgaagggaaattgt

SEQ ID NO: 895718 - DNA, 17 bp, Homo sapiens
atgaaggtaaataaaaa

SEQ ID NO: 895719 - DNA, 14 bp, Homo sapiens
atgaagtagaagtt

SEQ ID NO: 895720 - DNA, 14 bp, Homo sapiens
atgaagtatacttt

SEQ ID NO: 895721 - DNA, 15 bp, Homo sapiens
atgaagtatactttt

SEQ ID NO: 895722 - DNA, 16 bp, Homo sapiens
atgaagtatacttttc

SEQ ID NO: 895723 - DNA, 15 bp, Homo sapiens
atgaagtgttagata

SEQ ID NO: 895724 - DNA, 19 bp, Homo sapiens
atgaagttggcacatttca

SEQ ID NO: 895725 - DNA, 21 bp, Homo sapiens
atgaagttggcacatttcatg

SEQ ID NO: 895726 - DNA, 18 bp, Homo sapiens
atgaagtttgaacttcat

SEQ ID NO: 895727 - DNA, 15 bp, Homo sapiens
atgaataaaacactc

SEQ ID NO: 895728 - DNA, 16 bp, Homo sapiens
atgaataaaacactca

SEQ ID NO: 895729 - DNA, 17 bp, Homo sapiens
atgaataacatttaaat

SEQ ID NO: 895730 - DNA, 21 bp, Homo sapiens
atgaataagctttctctcaga

SEQ ID NO: 895731 - DNA, 15 bp, Homo sapiens
atgaatacagcattt

SEQ ID NO: 895732 - DNA, 21 bp, Homo sapiens
atgaatacagggcatgcattt

SEQ ID NO: 895733 - DNA, 21 bp, Homo sapiens
atgaatacatttccaaaatgg

SEQ ID NO: 895734 - DNA, 22 bp, Homo sapiens
atgaatactatccatgtaataa

SEQ ID NO: 895735 - DNA, 21 bp, Homo sapiens
atgaatactgtattttgtatt

SEQ ID NO: 895736 - DNA, 21 bp, Homo sapiens
atgaatagatggaatttggaa

SEQ ID NO: 895737 - DNA, 20 bp, Homo sapiens
atgaatagatgtgatcactg

SEQ ID NO: 895738 - DNA, 12 bp, Homo sapiens
atgaatagcttg

SEQ ID NO: 895739 - DNA, 16 bp, Homo sapiens
atgaatataatgaatg

SEQ ID NO: 895740 - DNA, 23 bp, Homo sapiens
atgaatatatttaagcaacatct

SEQ ID NO: 895741 - DNA, 12 bp, Homo sapiens
atgaatatcagg

SEQ ID NO: 895742 - DNA, 13 bp, Homo sapiens
atgaggtctgttt

SEQ ID NO: 895743 - DNA, 14 bp, Homo sapiens
atgaggtgggaggt

SEQ ID NO: 895744 - DNA, 18 bp, Homo sapiens
atgaggttgcttactaag

SEQ ID NO: 895745 - DNA, 15 bp, Homo sapiens
atgagtaaaggagta

SEQ ID NO: 895746 - DNA, 17 bp, Homo sapiens
atgagtaacatttgctg

SEQ ID NO: 895747 - DNA, 22 bp, Homo sapiens
atgagtagataatttcagggtg

SEQ ID NO: 895748 - DNA, 16 bp, Homo sapiens
atgagtatctgtggga

SEQ ID NO: 895749 - DNA, 15 bp, Homo sapiens
atgagtatgaacttg

SEQ ID NO: 895750 - DNA, 19 bp, Homo sapiens
atgagtcaatcagccttta

SEQ ID NO: 895751 - DNA, 13 bp, Homo sapiens
atgagtcagacac

SEQ ID NO: 895752 - DNA, 17 bp, Homo sapiens
atgagtctacctgagca

SEQ ID NO: 895753 - DNA, 21 bp, Homo sapiens
atgagtctacctgagcattca

SEQ ID NO: 895754 - DNA, 22 bp, Homo sapiens
atgagtctacctgagcattcag

SEQ ID NO: 895755 - DNA, 15 bp, Homo sapiens
atgagtgaataaatg

SEQ ID NO: 895756 - DNA, 21 bp, Homo sapiens
atgagtggaaattaagacttt

SEQ ID NO: 895757 - DNA, 12 bp, Homo sapiens
atgagtggccag

SEQ ID NO: 895758 - DNA, 11 bp, Homo sapiens
acaccccagcc

SEQ ID NO: 895759 - DNA, 12 bp, Homo sapiens
acaccccagccc

SEQ ID NO: 895760 - DNA, 14 bp, Homo sapiens
acaccccagcccac

SEQ ID NO: 895761 - DNA, 12 bp, Homo sapiens
acacccccagag

SEQ ID NO: 895762 - DNA, 12 bp, Homo sapiens
acacccccagct

SEQ ID NO: 895763 - DNA, 19 bp, Homo sapiens
acacccccagctgactgtt

SEQ ID NO: 895764 - DNA, 19 bp, Homo sapiens
acacccccgacggcctcca

SEQ ID NO: 895765 - DNA, 13 bp, Homo sapiens
acacccctctgtc

SEQ ID NO: 895766 - DNA, 13 bp, Homo sapiens
acacccctgctct

SEQ ID NO: 895767 - DNA, 18 bp, Homo sapiens
acaccccttatccaggac

SEQ ID NO: 895768 - DNA, 19 bp, Homo sapiens
acaccccttatccaggact

SEQ ID NO: 895769 - DNA, 20 bp, Homo sapiens
acaccccttatccaggactc

SEQ ID NO: 895770 - DNA, 16 bp, Homo sapiens
acaccctcccccgcca

SEQ ID NO: 895771 - DNA, 17 bp, Homo sapiens
acaccctgcttctcccg

SEQ ID NO: 895772 - DNA, 18 bp, Homo sapiens
acaccctgcttctcccgg

SEQ ID NO: 895773 - DNA, 13 bp, Homo sapiens
acaccctggcctg

SEQ ID NO: 895774 - DNA, 13 bp, Homo sapiens
acacccttagaaa

SEQ ID NO: 895775 - DNA, 21 bp, Homo sapiens
acaccctttagtgtacattta

SEQ ID NO: 895776 - DNA, 13 bp, Homo sapiens
acaccgactagcc

SEQ ID NO: 895777 - DNA, 16 bp, Homo sapiens
acaccgctcagtatta

SEQ ID NO: 895778 - DNA, 14 bp, Homo sapiens
acaccgggcctgga

SEQ ID NO: 895779 - DNA, 14 bp, Homo sapiens
acaccgtcttcctt

SEQ ID NO: 895780 - DNA, 14 bp, Homo sapiens
acaccgtggcctgg

SEQ ID NO: 895781 - DNA, 16 bp, Homo sapiens
acaccgtggcctgggc

SEQ ID NO: 895782 - DNA, 17 bp, Homo sapiens
acaccgtggcctgggct

SEQ ID NO: 895783 - DNA, 18 bp, Homo sapiens
acacctaccaaaaaataa

SEQ ID NO: 895784 - DNA, 15 bp, Homo sapiens
acacctaccatgctg

SEQ ID NO: 895785 - DNA, 16 bp, Homo sapiens
acacctaccatgctgc

SEQ ID NO: 895786 - DNA, 18 bp, Homo sapiens
acacctaccatgctgctt

SEQ ID NO: 895787 - DNA, 16 bp, Homo sapiens
acacctagattatagt

SEQ ID NO: 895788 - DNA, 22 bp, Homo sapiens
acacctagccagctgtcaaggg

SEQ ID NO: 895789 - DNA, 18 bp, Homo sapiens
acacctagctttattctt

SEQ ID NO: 895790 - DNA, 21 bp, Homo sapiens
acacctagctttattcttcag

SEQ ID NO: 895791 - DNA, 15 bp, Homo sapiens
acacctcagtgggaa

SEQ ID NO: 895792 - DNA, 16 bp, Homo sapiens
acacctcagtgggaag

SEQ ID NO: 895793 - DNA, 13 bp, Homo sapiens
acacctcccagga

SEQ ID NO: 895794 - DNA, 19 bp, Homo sapiens
acacctcccaggagacagt

SEQ ID NO: 895795 - DNA, 14 bp, Homo sapiens
acacctcccagggg

SEQ ID NO: 895796 - DNA, 19 bp, Homo sapiens
acacctccccctacccata

SEQ ID NO: 895797 - DNA, 22 bp, Homo sapiens
acacctccccctttcacactgg

SEQ ID NO: 895798 - DNA, 16 bp, Homo sapiens
acacctccctgaacca

SEQ ID NO: 895799 - DNA, 21 bp, Homo sapiens
acacctcgtcaagagcatgca

SEQ ID NO: 895800 - DNA, 18 bp, Homo sapiens
acacctctgcacaagctg

SEQ ID NO: 895801 - DNA, 13 bp, Homo sapiens
acacctctgggct

SEQ ID NO: 895802 - DNA, 16 bp, Homo sapiens
acacctgactctgaaa

SEQ ID NO: 895803 - DNA, 19 bp, Homo sapiens
acacctgagcgctgtggac

SEQ ID NO: 895804 - DNA, 20 bp, Homo sapiens
acacctgagcgctgtggact

SEQ ID NO: 895805 - DNA, 23 bp, Homo sapiens
acacctgagcgctgtggactgtc

SEQ ID NO: 895806 - DNA, 14 bp, Homo sapiens
acacctgcacctcc

SEQ ID NO: 895807 - DNA, 15 bp, Homo sapiens
acacctgcacctccc

SEQ ID NO: 895808 - DNA, 16 bp, Homo sapiens
acacctgcacctcccc

SEQ ID NO: 895809 - DNA, 18 bp, Homo sapiens
acacctgcacctcccccc

SEQ ID NO: 895810 - DNA, 19 bp, Homo sapiens
acacctgcacctcccccca

SEQ ID NO: 895811 - DNA, 13 bp, Homo sapiens
acacctgccctgc

SEQ ID NO: 895812 - DNA, 22 bp, Homo sapiens
acacctgcctctgaccccagca

SEQ ID NO: 895813 - DNA, 20 bp, Homo sapiens
acacctgccttctaccctct

SEQ ID NO: 895814 - DNA, 22 bp, Homo sapiens
acacctgggcccgggcaggcca

SEQ ID NO: 895815 - DNA, 19 bp, Homo sapiens
acacctgggggacagaggc

SEQ ID NO: 895816 - DNA, 13 bp, Homo sapiens
acacctgtacatt

SEQ ID NO: 895817 - DNA, 14 bp, Homo sapiens
acaccttccagctc

SEQ ID NO: 895818 - DNA, 14 bp, Homo sapiens
acaccttctctgga

SEQ ID NO: 895819 - DNA, 21 bp, Homo sapiens
acaccttctgagtattctcat

SEQ ID NO: 895820 - DNA, 22 bp, Homo sapiens
acaccttggacatcctcctccc

SEQ ID NO: 895821 - DNA, 16 bp, Homo sapiens
acacgagatttctttt

SEQ ID NO: 895822 - DNA, 18 bp, Homo sapiens
acacgagcaaacccagag

SEQ ID NO: 895823 - DNA, 19 bp, Homo sapiens
acacgagccacaagctgca

SEQ ID NO: 895824 - DNA, 23 bp, Homo sapiens
acacgatgttgtcaaggatggtt

SEQ ID NO: 895825 - DNA, 20 bp, Homo sapiens
acacgattttcaagattcta

SEQ ID NO: 895826 - DNA, 23 bp, Homo sapiens
acacgattttcaagattctaaag

SEQ ID NO: 895827 - DNA, 24 bp, Homo sapiens
acacgcaagggcatcaggcactgg

SEQ ID NO: 895828 - DNA, 17 bp, Homo sapiens
acacgcacctgcctcag

SEQ ID NO: 895829 - DNA, 15 bp, Homo sapiens
acacgcacgcacaca

SEQ ID NO: 895830 - DNA, 17 bp, Homo sapiens
acacgcacgcacacaca

SEQ ID NO: 895831 - DNA, 21 bp, Homo sapiens
acacgcacggcagccacagct

SEQ ID NO: 895832 - DNA, 18 bp, Homo sapiens
acacgcagcctgctctgg

SEQ ID NO: 895833 - DNA, 12 bp, Homo sapiens
acacgcaggcgg

SEQ ID NO: 895834 - DNA, 21 bp, Homo sapiens
acacgcgggcgcgatcccaca

SEQ ID NO: 895835 - DNA, 14 bp, Homo sapiens
acacgctgcctggt

SEQ ID NO: 895836 - DNA, 12 bp, Homo sapiens
acacgcttttgt

SEQ ID NO: 895837 - DNA, 14 bp, Homo sapiens
acacgcttttgtga

SEQ ID NO: 895838 - DNA, 15 bp, Homo sapiens
acacggacactcaaa

SEQ ID NO: 895839 - DNA, 19 bp, Homo sapiens
acacggactgaggtgcctg

SEQ ID NO: 895840 - DNA, 17 bp, Homo sapiens
acacggaggcatctgca

SEQ ID NO: 895841 - DNA, 15 bp, Homo sapiens
acacggatctgagaa

SEQ ID NO: 895842 - DNA, 16 bp, Homo sapiens
acacggatctgagaat

SEQ ID NO: 895843 - DNA, 19 bp, Homo sapiens
acacggatctgagaatctt

SEQ ID NO: 895844 - DNA, 13 bp, Homo sapiens
acacggcagcccc

SEQ ID NO: 895845 - DNA, 17 bp, Homo sapiens
acacggcagctgtagct

SEQ ID NO: 895846 - DNA, 12 bp, Homo sapiens
acacggccacat

SEQ ID NO: 895847 - DNA, 14 bp, Homo sapiens
acacggccacatca

SEQ ID NO: 895848 - DNA, 21 bp, Homo sapiens
acacggctggtcactctgccc

SEQ ID NO: 895849 - DNA, 20 bp, Homo sapiens
acacgggagccgctggcaga

SEQ ID NO: 895850 - DNA, 17 bp, Homo sapiens
acacggggctcgggcct

SEQ ID NO: 895851 - DNA, 23 bp, Homo sapiens
acacgtacttaaatgaaagcatg

SEQ ID NO: 895852 - DNA, 21 bp, Homo sapiens
acacgtatttatatttggaaa

SEQ ID NO: 895853 - DNA, 22 bp, Homo sapiens
acacgtggaggaatgctccccc

SEQ ID NO: 895854 - DNA, 16 bp, Homo sapiens
acacgtgggctcccct

SEQ ID NO: 895855 - DNA, 20 bp, Homo sapiens
acacgtgggctcccctcttc

SEQ ID NO: 895856 - DNA, 13 bp, Homo sapiens
acacgtgtgtatg

SEQ ID NO: 895857 - DNA, 14 bp, Homo sapiens
acactaaaaataaa

SEQ ID NO: 895858 - DNA, 14 bp, Homo sapiens
acactaaaatttta

SEQ ID NO: 895859 - DNA, 16 bp, Homo sapiens
acactaaactctgggg

SEQ ID NO: 895860 - DNA, 16 bp, Homo sapiens
acactaaccaagctga

SEQ ID NO: 895861 - DNA, 15 bp, Homo sapiens
acactaacctgggtt

SEQ ID NO: 895862 - DNA, 17 bp, Homo sapiens
acactaacgaaatatca

SEQ ID NO: 895863 - DNA, 17 bp, Homo sapiens
acactaactcaccagcc

SEQ ID NO: 895864 - DNA, 19 bp, Homo sapiens
acactaactcaccagcccc

SEQ ID NO: 895865 - DNA, 17 bp, Homo sapiens
atgcacacattttttaa

SEQ ID NO: 895866 - DNA, 19 bp, Homo sapiens
atgcacacggctggtcact

SEQ ID NO: 895867 - DNA, 24 bp, Homo sapiens
atgcacacggctggtcactctgcc

SEQ ID NO: 895868 - DNA, 20 bp, Homo sapiens
atgcacactagcctctccag

SEQ ID NO: 895869 - DNA, 17 bp, Homo sapiens
atgcacagagaagctgg

SEQ ID NO: 895870 - DNA, 21 bp, Homo sapiens
atgcacagagttgttacattt

SEQ ID NO: 895871 - DNA, 11 bp, Homo sapiens
atgcacagcct

SEQ ID NO: 895872 - DNA, 12 bp, Homo sapiens
atgcacagccta

SEQ ID NO: 895873 - DNA, 15 bp, Homo sapiens
atgcacagtatttgt

SEQ ID NO: 895874 - DNA, 18 bp, Homo sapiens
atgcacagtatttgtaat

SEQ ID NO: 895875 - DNA, 19 bp, Homo sapiens
atgcacatgctgtctggcc

SEQ ID NO: 895876 - DNA, 22 bp, Homo sapiens
atgcacatgctgtctggccctg

SEQ ID NO: 895877 - DNA, 17 bp, Homo sapiens
atgcacatttatatata

SEQ ID NO: 895878 - DNA, 21 bp, Homo sapiens
atgcacatttatatatatatg

SEQ ID NO: 895879 - DNA, 13 bp, Homo sapiens
atgcacatttctg

SEQ ID NO: 895880 - DNA, 16 bp, Homo sapiens
atgcacatttctggat

SEQ ID NO: 895881 - DNA, 15 bp, Homo sapiens
atgcacctaaagaaa

SEQ ID NO: 895882 - DNA, 16 bp, Homo sapiens
atgcacctaaagaaaa

SEQ ID NO: 895883 - DNA, 18 bp, Homo sapiens
atgcacctaaagaaaaac

SEQ ID NO: 895884 - DNA, 23 bp, Homo sapiens
atgcacctaaagaaaaacaaact

SEQ ID NO: 895885 - DNA, 16 bp, Homo sapiens
atgcacctggaatata

SEQ ID NO: 895886 - DNA, 24 bp, Homo sapiens
atgcaccttatatttctgtgtaca

SEQ ID NO: 895887 - DNA, 19 bp, Homo sapiens
atgcacgtggggcccactg

SEQ ID NO: 895888 - DNA, 18 bp, Homo sapiens
atgcactatatgtttaca

SEQ ID NO: 895889 - DNA, 20 bp, Homo sapiens
atgcactatatttgtatata

SEQ ID NO: 895890 - DNA, 23 bp, Homo sapiens
atgcactgaaaacttagccagag

SEQ ID NO: 895891 - DNA, 14 bp, Homo sapiens
acacttctcatcat

SEQ ID NO: 895892 - DNA, 20 bp, Homo sapiens
acacttctcatcatattgta

SEQ ID NO: 895893 - DNA, 17 bp, Homo sapiens
acacttcttaccccagc

SEQ ID NO: 895894 - DNA, 21 bp, Homo sapiens
acacttcttgaaacagcctgg

SEQ ID NO: 895895 - DNA, 13 bp, Homo sapiens
acacttcttttga

SEQ ID NO: 895896 - DNA, 14 bp, Homo sapiens
acacttgagaggat

SEQ ID NO: 895897 - DNA, 18 bp, Homo sapiens
acacttgccttcttcacc

SEQ ID NO: 895898 - DNA, 20 bp, Homo sapiens
acacttgccttcttcaccca

SEQ ID NO: 895899 - DNA, 16 bp, Homo sapiens
acacttgctcccaacc

SEQ ID NO: 895900 - DNA, 17 bp, Homo sapiens
acacttggagcccgtgc

SEQ ID NO: 895901 - DNA, 18 bp, Homo sapiens
acacttggagcccgtgca

SEQ ID NO: 895902 - DNA, 16 bp, Homo sapiens
acacttggcatacaaa

SEQ ID NO: 895903 - DNA, 20 bp, Homo sapiens
acacttggttagacgccttc

SEQ ID NO: 895904 - DNA, 18 bp, Homo sapiens
acacttgtgtgtgggctg

SEQ ID NO: 895905 - DNA, 22 bp, Homo sapiens
acacttgtgtgtgggctgtgag

SEQ ID NO: 895906 - DNA, 12 bp, Homo sapiens
acactttacaat

SEQ ID NO: 895907 - DNA, 22 bp, Homo sapiens
acactttatgccggatgtgctt

SEQ ID NO: 895908 - DNA, 23 bp, Homo sapiens
acactttatgccggatgtgcttt

SEQ ID NO: 895909 - DNA, 14 bp, Homo sapiens
acactttctgctgg

SEQ ID NO: 895910 - DNA, 17 bp, Homo sapiens
acactttgaaatgtgtt

SEQ ID NO: 895911 - DNA, 18 bp, Homo sapiens
acactttgaaatgtgttt

SEQ ID NO: 895912 - DNA, 23 bp, Homo sapiens
acactttgaaatgtgtttctgta

SEQ ID NO: 895913 - DNA, 19 bp, Homo sapiens
acactttgcactgatatat

SEQ ID NO: 895914 - DNA, 18 bp, Homo sapiens
acactttgccaaggctct

SEQ ID NO: 895915 - DNA, 20 bp, Homo sapiens
acactttgccaaggctctcc

SEQ ID NO: 895916 - DNA, 19 bp, Homo sapiens
acactttgccatattttca

SEQ ID NO: 895917 - DNA, 12 bp, Homo sapiens
acactttgtatt

SEQ ID NO: 895918 - DNA, 13 bp, Homo sapiens
acactttgtatta

SEQ ID NO: 895919 - DNA, 17 bp, Homo sapiens
acacttttaaaaaacaa

SEQ ID NO: 895920 - DNA, 17 bp, Homo sapiens
acacttttcatatcatt

SEQ ID NO: 895921 - DNA, 18 bp, Homo sapiens
acacttttcatatcattt

SEQ ID NO: 895922 - DNA, 22 bp, Homo sapiens
acactttttccatttcttcaga

SEQ ID NO: 895923 - DNA, 21 bp, Homo sapiens
acactttttgtattttttcct

SEQ ID NO: 895924 - DNA, 15 bp, Homo sapiens
acactttttgtgaat

SEQ ID NO: 895925 - DNA, 17 bp, Homo sapiens
acagaaaaagcatgatg

SEQ ID NO: 895926 - DNA, 15 bp, Homo sapiens
acagaaaaatcttgt

SEQ ID NO: 895927 - DNA, 19 bp, Homo sapiens
acagaaaacaaaagagaga

SEQ ID NO: 895928 - DNA, 21 bp, Homo sapiens
acagaaaacaaaagagagaat

SEQ ID NO: 895929 - DNA, 13 bp, Homo sapiens
acagaaaacatgt

SEQ ID NO: 895930 - DNA, 13 bp, Homo sapiens
acagaaaaccgag

SEQ ID NO: 895931 - DNA, 13 bp, Homo sapiens
acagaaaatttaa

SEQ ID NO: 895932 - DNA, 17 bp, Homo sapiens
acagaaaatttaactta

SEQ ID NO: 895933 - DNA, 16 bp, Homo sapiens
acagaaaccaagccat

SEQ ID NO: 895934 - DNA, 17 bp, Homo sapiens
acagaaacctatcctca

SEQ ID NO: 895935 - DNA, 18 bp, Homo sapiens
acagaaacctctactaaa

SEQ ID NO: 895936 - DNA, 16 bp, Homo sapiens
acagaaacgtgttaaa

SEQ ID NO: 895937 - DNA, 23 bp, Homo sapiens
acagaaactaaactcttaccata

SEQ ID NO: 895938 - DNA, 23 bp, Homo sapiens
acagaaactggattaaaacaatt

SEQ ID NO: 895939 - DNA, 16 bp, Homo sapiens
acagaaaggttttctt

SEQ ID NO: 895940 - DNA, 17 bp, Homo sapiens
acagaaatactgctctg

SEQ ID NO: 895941 - DNA, 19 bp, Homo sapiens
acagaaatcaggtgtttta

SEQ ID NO: 895942 - DNA, 24 bp, Homo sapiens
acagaaatgattactaaggaagat

SEQ ID NO: 895943 - DNA, 15 bp, Homo sapiens
acagaaatggactgg

SEQ ID NO: 895944 - DNA, 13 bp, Homo sapiens
acagaaatgtaca

SEQ ID NO: 895945 - DNA, 16 bp, Homo sapiens
acagaaatgtttttaa

SEQ ID NO: 895946 - DNA, 17 bp, Homo sapiens
acagaaattagccgggc

SEQ ID NO: 895947 - DNA, 21 bp, Homo sapiens
acagaaattctgcaagtttct

SEQ ID NO: 895948 - DNA, 14 bp, Homo sapiens
acagaaattgtata

SEQ ID NO: 895949 - DNA, 23 bp, Homo sapiens
acagaaattgtatattgtaattt

SEQ ID NO: 895950 - DNA, 15 bp, Homo sapiens
acagaacacaaatgt

SEQ ID NO: 895951 - DNA, 19 bp, Homo sapiens
acagaacattgccttcctc

SEQ ID NO: 895952 - DNA, 16 bp, Homo sapiens
acagaaccaaatcgtg

SEQ ID NO: 895953 - DNA, 17 bp, Homo sapiens
acagaacccctacatga

SEQ ID NO: 895954 - DNA, 20 bp, Homo sapiens
acagaacctactgttccttt

SEQ ID NO: 895955 - DNA, 17 bp, Homo sapiens
acagaaccttcaaccca

SEQ ID NO: 895956 - DNA, 21 bp, Homo sapiens
acagaaccttcaacccagtgg

SEQ ID NO: 895957 - DNA, 15 bp, Homo sapiens
acagaactcccttca

SEQ ID NO: 895958 - DNA, 14 bp, Homo sapiens
acagaacttcagaa

SEQ ID NO: 895959 - DNA, 18 bp, Homo sapiens
acagaacttcagaaagac

SEQ ID NO: 895960 - DNA, 20 bp, Homo sapiens
acagaacttcagaaagactt

SEQ ID NO: 895961 - DNA, 18 bp, Homo sapiens
acagaagaaaatagaatt

SEQ ID NO: 895962 - DNA, 14 bp, Homo sapiens
acagaagaaacaag

SEQ ID NO: 895963 - DNA, 15 bp, Homo sapiens
acagaagaaactggg

SEQ ID NO: 895964 - DNA, 20 bp, Homo sapiens
acagaagcaaaatggctttt

SEQ ID NO: 895965 - DNA, 22 bp, Homo sapiens
acagaagcagttgagtcgtcat

SEQ ID NO: 895966 - DNA, 21 bp, Homo sapiens
acagaagcatttgtattttgt

SEQ ID NO: 895967 - DNA, 22 bp, Homo sapiens
acagaagccaagctccctggag

SEQ ID NO: 895968 - DNA, 23 bp, Homo sapiens
acagaagccaagctccctggagc

SEQ ID NO: 895969 - DNA, 15 bp, Homo sapiens
acagaagccaggagc

SEQ ID NO: 895970 - DNA, 21 bp, Homo sapiens
acagaagccaggagcaaatgt

SEQ ID NO: 895971 - DNA, 18 bp, Homo sapiens
acagaagtatcaagccat

SEQ ID NO: 895972 - DNA, 16 bp, Homo sapiens
acagaagtcatgaagc

SEQ ID NO: 895973 - DNA, 18 bp, Homo sapiens
acagaagtcatgaagccc

SEQ ID NO: 895974 - DNA, 23 bp, Homo sapiens
acagaataatccagtattgctga

SEQ ID NO: 895975 - DNA, 15 bp, Homo sapiens
acagaataatgaatg

SEQ ID NO: 895976 - DNA, 17 bp, Homo sapiens
acagaatagaatacatt

SEQ ID NO: 895977 - DNA, 16 bp, Homo sapiens
acagaatatttttata

SEQ ID NO: 895978 - DNA, 22 bp, Homo sapiens
acagaatatttttatatttcct

SEQ ID NO: 895979 - DNA, 23 bp, Homo sapiens
acagaatcatatgattctgcttt

SEQ ID NO: 895980 - DNA, 16 bp, Homo sapiens
acagaatcattgctta

SEQ ID NO: 895981 - DNA, 15 bp, Homo sapiens
acagaatcttctggg

SEQ ID NO: 895982 - DNA, 18 bp, Homo sapiens
acagaatgcattaaaaaa

SEQ ID NO: 895983 - DNA, 16 bp, Homo sapiens
acagaatgctatttca

SEQ ID NO: 895984 - DNA, 13 bp, Homo sapiens
acagaatgctcag

SEQ ID NO: 895985 - DNA, 22 bp, Homo sapiens
acagaatgctcagggtcactga

SEQ ID NO: 895986 - DNA, 17 bp, Homo sapiens
acagccgtcagccaaat

SEQ ID NO: 895987 - DNA, 19 bp, Homo sapiens
acagccgtcagccaaatgt

SEQ ID NO: 895988 - DNA, 20 bp, Homo sapiens
acagccgtcagccaaatgta

SEQ ID NO: 895989 - DNA, 21 bp, Homo sapiens
acagcctaaagctaaaaatat

SEQ ID NO: 895990 - DNA, 21 bp, Homo sapiens
acagcctaatcccgtgcccct

SEQ ID NO: 895991 - DNA, 15 bp, Homo sapiens
acagcctccagggcc

SEQ ID NO: 895992 - DNA, 17 bp, Homo sapiens
acagcctcccctgccag

SEQ ID NO: 895993 - DNA, 13 bp, Homo sapiens
acagcctccctga

SEQ ID NO: 895994 - DNA, 14 bp, Homo sapiens
acagcctccctgag

SEQ ID NO: 895995 - DNA, 19 bp, Homo sapiens
acagcctccctgagcctgc

SEQ ID NO: 895996 - DNA, 14 bp, Homo sapiens
acagcctctacagc

SEQ ID NO: 895997 - DNA, 18 bp, Homo sapiens
acagcctctacagccgtc

SEQ ID NO: 895998 - DNA, 13 bp, Homo sapiens
acagcctctgact

SEQ ID NO: 895999 - DNA, 13 bp, Homo sapiens
acagcctcttttt

SEQ ID NO: 896000 - DNA, 13 bp, Homo sapiens
acagcctgctggc

SEQ ID NO: 896001 - DNA, 15 bp, Homo sapiens
acagcctgctggcag

SEQ ID NO: 896002 - DNA, 20 bp, Homo sapiens
acagcctgctggcagggcca

SEQ ID NO: 896003 - DNA, 11 bp, Homo sapiens
acagcctggca

SEQ ID NO: 896004 - DNA, 20 bp, Homo sapiens
acagcctggggttgtccccg

SEQ ID NO: 896005 - DNA, 18 bp, Homo sapiens
acagccttatttttgtat

SEQ ID NO: 896006 - DNA, 15 bp, Homo sapiens
acagccttccccagc

SEQ ID NO: 896007 - DNA, 18 bp, Homo sapiens
acagccttccccagctcc

SEQ ID NO: 896008 - DNA, 13 bp, Homo sapiens
acagccttccttc

SEQ ID NO: 896009 - DNA, 21 bp, Homo sapiens
acagccttccttctgctccca

SEQ ID NO: 896010 - DNA, 12 bp, Homo sapiens
acagccttgggc

SEQ ID NO: 896011 - DNA, 19 bp, Homo sapiens
acagccttgggcctttcag

SEQ ID NO: 896012 - DNA, 19 bp, Homo sapiens
acagcgaagtagcttgctc

SEQ ID NO: 896013 - DNA, 22 bp, Homo sapiens
acagcgagaggcagagaaagaa

SEQ ID NO: 896014 - DNA, 14 bp, Homo sapiens
acagcgagggcagc

SEQ ID NO: 896015 - DNA, 17 bp, Homo sapiens
acagcgagggcagctgc

SEQ ID NO: 896016 - DNA, 18 bp, Homo sapiens
acagcgagggcagctgct

SEQ ID NO: 896017 - DNA, 21 bp, Homo sapiens
acagcgatggcaggcctgacc

SEQ ID NO: 896018 - DNA, 15 bp, Homo sapiens
acagcgccagcctca

SEQ ID NO: 896019 - DNA, 15 bp, Homo sapiens
acagcgcggaggagg

SEQ ID NO: 896020 - DNA, 13 bp, Homo sapiens
acagcggcccctg

SEQ ID NO: 896021 - DNA, 19 bp, Homo sapiens
acagcggcccctgcatccc

SEQ ID NO: 896022 - DNA, 20 bp, Homo sapiens
acagcgggagacctgtgcta

SEQ ID NO: 896023 - DNA, 14 bp, Homo sapiens
acagcgggctgtgc

SEQ ID NO: 896024 - DNA, 17 bp, Homo sapiens
acagcgtccctggcgca

SEQ ID NO: 896025 - DNA, 19 bp, Homo sapiens
acagcgtgctggcgacact

SEQ ID NO: 896026 - DNA, 18 bp, Homo sapiens
atgcctttaatgttgccc

SEQ ID NO: 896027 - DNA, 13 bp, Homo sapiens
atgcctttgctgt

SEQ ID NO: 896028 - DNA, 13 bp, Homo sapiens
atgcctttgtaag

SEQ ID NO: 896029 - DNA, 16 bp, Homo sapiens
atgcctttgtaagtta

SEQ ID NO: 896030 - DNA, 23 bp, Homo sapiens
atgccttttcccaaaatgttgaa

SEQ ID NO: 896031 - DNA, 16 bp, Homo sapiens
atgccttttttgtagt

SEQ ID NO: 896032 - DNA, 19 bp, Homo sapiens
atgcctttttttctctgca

SEQ ID NO: 896033 - DNA, 21 bp, Homo sapiens
atgcgaaccacccaaaacacg

SEQ ID NO: 896034 - DNA, 16 bp, Homo sapiens
atgcgagactctgatg

SEQ ID NO: 896035 - DNA, 18 bp, Homo sapiens
atgcgagactctgatgga

SEQ ID NO: 896036 - DNA, 12 bp, Homo sapiens
atgcgaggggcc

SEQ ID NO: 896037 - DNA, 21 bp, Homo sapiens
atgcgaggggccagcagaggg

SEQ ID NO: 896038 - DNA, 15 bp, Homo sapiens
atgcgcaatgtggca

SEQ ID NO: 896039 - DNA, 13 bp, Homo sapiens
atgcgccccctcc

SEQ ID NO: 896040 - DNA, 18 bp, Homo sapiens
atgcgccccctccgccct

SEQ ID NO: 896041 - DNA, 22 bp, Homo sapiens
atgcgccccctccgccctgcca

SEQ ID NO: 896042 - DNA, 13 bp, Homo sapiens
atgcgccttgctg

SEQ ID NO: 896043 - DNA, 21 bp, Homo sapiens
atgcgccttgctgatggcttg

SEQ ID NO: 896044 - DNA, 17 bp, Homo sapiens
atgcggaggaaagcaag

SEQ ID NO: 896045 - DNA, 18 bp, Homo sapiens
atgcggcaagaaggaatt

SEQ ID NO: 896046 - DNA, 12 bp, Homo sapiens
atgcggccaaga

SEQ ID NO: 896047 - DNA, 14 bp, Homo sapiens
atgcggctttctct

SEQ ID NO: 896048 - DNA, 19 bp, Homo sapiens
atgcggctttctctgcctc

SEQ ID NO: 896049 - DNA, 15 bp, Homo sapiens
atgcggggacaggct

SEQ ID NO: 896050 - DNA, 15 bp, Homo sapiens
atgcggtagccagca

SEQ ID NO: 896051 - DNA, 18 bp, Homo sapiens
atgcggtagccagcacac

SEQ ID NO: 896052 - DNA, 21 bp, Homo sapiens
atgcggtagccagcacacagg

SEQ ID NO: 896053 - DNA, 19 bp, Homo sapiens
atgcggtttccaaggtgca

SEQ ID NO: 896054 - DNA, 16 bp, Homo sapiens
atgcgtaatttaatgg

SEQ ID NO: 896055 - DNA, 14 bp, Homo sapiens
atgcgtatatgtgc

SEQ ID NO: 896056 - DNA, 13 bp, Homo sapiens
atgcgtattctgt

SEQ ID NO: 896057 - DNA, 14 bp, Homo sapiens
atgcgtattctgtg

SEQ ID NO: 896058 - DNA, 16 bp, Homo sapiens
atgcgtattctgtggc

SEQ ID NO: 896059 - DNA, 17 bp, Homo sapiens
atgcgtcccaagcagcc

SEQ ID NO: 896060 - DNA, 22 bp, Homo sapiens
atgcgtgcataccacttttgtt

SEQ ID NO: 896061 - DNA, 19 bp, Homo sapiens
atgcgtgcccttttcatat

SEQ ID NO: 896062 - DNA, 18 bp, Homo sapiens
atgcgtgccgcctgctcc

SEQ ID NO: 896063 - DNA, 19 bp, Homo sapiens
atgcgtgccgcctgctcct

SEQ ID NO: 896064 - DNA, 15 bp, Homo sapiens
atgcgtgggaggcag

SEQ ID NO: 896065 - DNA, 15 bp, Homo sapiens
atgcgtttgcctcct

SEQ ID NO: 896066 - DNA, 16 bp, Homo sapiens
atgcgtttgcctcctg

SEQ ID NO: 896067 - DNA, 15 bp, Homo sapiens
atgctaacaaagaca

SEQ ID NO: 896068 - DNA, 23 bp, Homo sapiens
atgctaacaaagacaaaagtctg

SEQ ID NO: 896069 - DNA, 16 bp, Homo sapiens
atgctaacatctaaaa

SEQ ID NO: 896070 - DNA, 13 bp, Homo sapiens
atgctaagaaatg

SEQ ID NO: 896071 - DNA, 19 bp, Homo sapiens
atgctaagaaatgctgaaa

SEQ ID NO: 896072 - DNA, 21 bp, Homo sapiens
atgctaagaatgcattattga

SEQ ID NO: 896073 - DNA, 15 bp, Homo sapiens
atgctaagagaagta

SEQ ID NO: 896074 - DNA, 16 bp, Homo sapiens
atgctaagagaagtag

SEQ ID NO: 896075 - DNA, 23 bp, Homo sapiens
atgctaagctgatattatttctt

SEQ ID NO: 896076 - DNA, 17 bp, Homo sapiens
atgctaatcttgtccct

SEQ ID NO: 896077 - DNA, 16 bp, Homo sapiens
atgctaatttaaagag

SEQ ID NO: 896078 - DNA, 12 bp, Homo sapiens
atgctaatttat

SEQ ID NO: 896079 - DNA, 15 bp, Homo sapiens
atgctacagtaataa

SEQ ID NO: 896080 - DNA, 17 bp, Homo sapiens
atgctacagtaataaat

SEQ ID NO: 896081 - DNA, 13 bp, Homo sapiens
atgctatctctgt

SEQ ID NO: 896082 - DNA, 20 bp, Homo sapiens
atgctatgagttttctcctt

SEQ ID NO: 896083 - DNA, 18 bp, Homo sapiens
atgctatgctgaagacat

SEQ ID NO: 896084 - DNA, 17 bp, Homo sapiens
atgctatggtcaggtta

SEQ ID NO: 896085 - DNA, 14 bp, Homo sapiens
atgctatttatgca

SEQ ID NO: 896086 - DNA, 22 bp, Homo sapiens
atgctatttatgcaagttaggg

SEQ ID NO: 896087 - DNA, 13 bp, Homo sapiens
atgctatttgaac

SEQ ID NO: 896088 - DNA, 15 bp, Homo sapiens
atgctatttgaacaa

SEQ ID NO: 896089 - DNA, 14 bp, Homo sapiens
atgctatttggaca

SEQ ID NO: 896090 - DNA, 15 bp, Homo sapiens
atgctcaaagaaatc

SEQ ID NO: 896091 - DNA, 22 bp, Homo sapiens
atgctcaacccccctcccagac

SEQ ID NO: 896092 - DNA, 15 bp, Homo sapiens
atgctcaatttcagc

SEQ ID NO: 896093 - DNA, 14 bp, Homo sapiens
atgctcacctctag

SEQ ID NO: 896094 - DNA, 15 bp, Homo sapiens
atgctcactttatta

SEQ ID NO: 896095 - DNA, 12 bp, Homo sapiens
atgctcagacca

SEQ ID NO: 896096 - DNA, 13 bp, Homo sapiens
atgctcagccctg

SEQ ID NO: 896097 - DNA, 23 bp, Homo sapiens
atgctcagtgccttttggtttca

SEQ ID NO: 896098 - DNA, 20 bp, Homo sapiens
atgctcataaagatgttaaa

SEQ ID NO: 896099 - DNA, 13 bp, Homo sapiens
atgctcatctgct

SEQ ID NO: 896100 - DNA, 14 bp, Homo sapiens
atgctcatctgctg

SEQ ID NO: 896101 - DNA, 22 bp, Homo sapiens
atgctcatgtccctgtccccag

SEQ ID NO: 896102 - DNA, 15 bp, Homo sapiens
atgctcattttctgg

SEQ ID NO: 896103 - DNA, 17 bp, Homo sapiens
atgctcattttctttag

SEQ ID NO: 896104 - DNA, 15 bp, Homo sapiens
atgctccaaatataa

SEQ ID NO: 896105 - DNA, 19 bp, Homo sapiens
atgctccagccaacccctg

SEQ ID NO: 896106 - DNA, 18 bp, Homo sapiens
atgctcccccatcctccc

SEQ ID NO: 896107 - DNA, 16 bp, Homo sapiens
atgctccctcccctgc

SEQ ID NO: 896108 - DNA, 17 bp, Homo sapiens
atgctccctcctctcct

SEQ ID NO: 896109 - DNA, 13 bp, Homo sapiens
atgcttctcactg

SEQ ID NO: 896110 - DNA, 16 bp, Homo sapiens
atgcttctcactgcca

SEQ ID NO: 896111 - DNA, 13 bp, Homo sapiens
atgcttcttctca

SEQ ID NO: 896112 - DNA, 11 bp, Homo sapiens
atgcttgccta

SEQ ID NO: 896113 - DNA, 22 bp, Homo sapiens
atgcttgggaccagaagtgttt

SEQ ID NO: 896114 - DNA, 13 bp, Homo sapiens
atgcttgggctga

SEQ ID NO: 896115 - DNA, 12 bp, Homo sapiens
atgcttgtacat

SEQ ID NO: 896116 - DNA, 13 bp, Homo sapiens
atgcttgtacata

SEQ ID NO: 896117 - DNA, 14 bp, Homo sapiens
atgcttgtacataa

SEQ ID NO: 896118 - DNA, 16 bp, Homo sapiens
atgcttgtacataatg

SEQ ID NO: 896119 - DNA, 21 bp, Homo sapiens
atgcttgtgtatatgtataaa

SEQ ID NO: 896120 - DNA, 13 bp, Homo sapiens
atgcttgtgttat

SEQ ID NO: 896121 - DNA, 18 bp, Homo sapiens
atgctttatttgtaaatt

SEQ ID NO: 896122 - DNA, 20 bp, Homo sapiens
atgctttccctgaggaatga

SEQ ID NO: 896123 - DNA, 22 bp, Homo sapiens
atgctttctttggcctacattc

SEQ ID NO: 896124 - DNA, 17 bp, Homo sapiens
atgctttgaactttagt

SEQ ID NO: 896125 - DNA, 18 bp, Homo sapiens
atgctttgggaggccaag

SEQ ID NO: 896126 - DNA, 20 bp, Homo sapiens
atgctttgggaggccaaggc

SEQ ID NO: 896127 - DNA, 21 bp, Homo sapiens
atgctttgggaggccaaggca

SEQ ID NO: 896128 - DNA, 15 bp, Homo sapiens
atgctttgtgaacaa

SEQ ID NO: 896129 - DNA, 22 bp, Homo sapiens
atgcttttatatttttttaaaa

SEQ ID NO: 896130 - DNA, 19 bp, Homo sapiens
atgcttttctgtctctgcc

SEQ ID NO: 896131 - DNA, 13 bp, Homo sapiens
atgcttttgctgc

SEQ ID NO: 896132 - DNA, 20 bp, Homo sapiens
atgcttttgctgctgcttaa

SEQ ID NO: 896133 - DNA, 17 bp, Homo sapiens
atgcttttggaagttaa

SEQ ID NO: 896134 - DNA, 19 bp, Homo sapiens
atgctttttagaaagcatt

SEQ ID NO: 896135 - DNA, 20 bp, Homo sapiens
atggaaaaaaacataaaaag

SEQ ID NO: 896136 - DNA, 21 bp, Homo sapiens
atggaaaaaaacataaaaagc

SEQ ID NO: 896137 - DNA, 21 bp, Homo sapiens
atggaaaaaccatttgaagtg

SEQ ID NO: 896138 - DNA, 17 bp, Homo sapiens
atggaaaaataaaactg

SEQ ID NO: 896139 - DNA, 16 bp, Homo sapiens
atggaaaaatactgcc

SEQ ID NO: 896140 - DNA, 22 bp, Homo sapiens
atggaaaaatgccatcaaatga

SEQ ID NO: 896141 - DNA, 17 bp, Homo sapiens
atggaaaaattgacaaa

SEQ ID NO: 896142 - DNA, 15 bp, Homo sapiens
atggaaaacagagta

SEQ ID NO: 896143 - DNA, 14 bp, Homo sapiens
atggaaaacctggg

SEQ ID NO: 896144 - DNA, 13 bp, Homo sapiens
atggaaaagagag

SEQ ID NO: 896145 - DNA, 20 bp, Homo sapiens
atggaaaaggaagactagag

SEQ ID NO: 896146 - DNA, 20 bp, Homo sapiens
atggaaaatacctaattgtg

SEQ ID NO: 896147 - DNA, 17 bp, Homo sapiens
atggaaaatcagctgct

SEQ ID NO: 896148 - DNA, 15 bp, Homo sapiens
atggaaaattttctc

SEQ ID NO: 896149 - DNA, 14 bp, Homo sapiens
atggaaacatttta

SEQ ID NO: 896150 - DNA, 20 bp, Homo sapiens
atggaaacattttatactgt

SEQ ID NO: 896151 - DNA, 16 bp, Homo sapiens
atggaaacgcacttac

SEQ ID NO: 896152 - DNA, 20 bp, Homo sapiens
atggaaacgcacttacaagt

SEQ ID NO: 896153 - DNA, 21 bp, Homo sapiens
atggaaagactgggacagccc

SEQ ID NO: 896154 - DNA, 16 bp, Homo sapiens
atggaaagtaactcat

SEQ ID NO: 896155 - DNA, 14 bp, Homo sapiens
atggaacacttcga

SEQ ID NO: 896156 - DNA, 14 bp, Homo sapiens
atggaaccttccct

SEQ ID NO: 896157 - DNA, 17 bp, Homo sapiens
atggaaccttccctcca

SEQ ID NO: 896158 - DNA, 18 bp, Homo sapiens
atggaaccttccctccaa

SEQ ID NO: 896159 - DNA, 18 bp, Homo sapiens
atggaactactgtacttt

SEQ ID NO: 896160 - DNA, 16 bp, Homo sapiens
atggaactgtgtattt

SEQ ID NO: 896161 - DNA, 12 bp, Homo sapiens
atggaagaaagt

SEQ ID NO: 896162 - DNA, 17 bp, Homo sapiens
atggaagattttaaatt

SEQ ID NO: 896163 - DNA, 17 bp, Homo sapiens
atggaagcaaagacaaa

SEQ ID NO: 896164 - DNA, 15 bp, Homo sapiens
atggaaggaagaaaa

SEQ ID NO: 896165 - DNA, 18 bp, Homo sapiens
atggaaggggcttctgga

SEQ ID NO: 896166 - DNA, 15 bp, Homo sapiens
atggaaggtgccaga

SEQ ID NO: 896167 - DNA, 22 bp, Homo sapiens
atggaaggtgccagaaggaagg

SEQ ID NO: 896168 - DNA, 21 bp, Homo sapiens
atggaagtcacctttctgggc

SEQ ID NO: 896169 - DNA, 18 bp, Homo sapiens
atggaagtggcagtgaaa

SEQ ID NO: 896170 - DNA, 15 bp, Homo sapiens
atggaagttttccta

SEQ ID NO: 896171 - DNA, 15 bp, Homo sapiens
atggaataaaccatt

SEQ ID NO: 896172 - DNA, 14 bp, Homo sapiens
atggaataaattat

SEQ ID NO: 896173 - DNA, 15 bp, Homo sapiens
atggaataaattatg

SEQ ID NO: 896174 - DNA, 20 bp, Homo sapiens
atggaataacaactttcagt

SEQ ID NO: 896175 - DNA, 14 bp, Homo sapiens
atggaataacatgt

SEQ ID NO: 896176 - DNA, 15 bp, Homo sapiens
atggaataacatgta

SEQ ID NO: 896177 - DNA, 13 bp, Homo sapiens
atggaataactat

SEQ ID NO: 896178 - DNA, 17 bp, Homo sapiens
atggaatacagtgttat

SEQ ID NO: 896179 - DNA, 22 bp, Homo sapiens
atggaatacagtgttattttct

SEQ ID NO: 896180 - DNA, 14 bp, Homo sapiens
atggaatatcagaa

SEQ ID NO: 896181 - DNA, 15 bp, Homo sapiens
atggaatatcagaag

SEQ ID NO: 896182 - DNA, 17 bp, Homo sapiens
atggaatattcatttta

SEQ ID NO: 896183 - DNA, 16 bp, Homo sapiens
atggaatcgaagtgtt

SEQ ID NO: 896184 - DNA, 17 bp, Homo sapiens
atggaatcgatttcctc

SEQ ID NO: 896185 - DNA, 20 bp, Homo sapiens
atggaatcgatttcctccca

SEQ ID NO: 896186 - DNA, 13 bp, Homo sapiens
atggaatcttctc

SEQ ID NO: 896187 - DNA, 16 bp, Homo sapiens
atggaatcttgctgca

SEQ ID NO: 896188 - DNA, 23 bp, Homo sapiens
atggaatcttgctgcaggccctc

SEQ ID NO: 896189 - DNA, 21 bp, Homo sapiens
atggaatgattggttaaaatg

SEQ ID NO: 896190 - DNA, 18 bp, Homo sapiens
atggaatggacatcctgt

SEQ ID NO: 896191 - DNA, 19 bp, Homo sapiens
atggaatgtgcccctggcc

SEQ ID NO: 896192 - DNA, 21 bp, Homo sapiens
atggaatgtgcccctggccca

SEQ ID NO: 896193 - DNA, 15 bp, Homo sapiens
atggaattaaatgtg

SEQ ID NO: 896194 - DNA, 16 bp, Homo sapiens
atggaattcacaaagt

SEQ ID NO: 896195 - DNA, 16 bp, Homo sapiens
atggaattcgtgttat

SEQ ID NO: 896196 - DNA, 22 bp, Homo sapiens
atggaattcgtgttatgaatct

SEQ ID NO: 896197 - DNA, 19 bp, Homo sapiens
atggaattcttcctcctct

SEQ ID NO: 896198 - DNA, 14 bp, Homo sapiens
atggaattgatttg

SEQ ID NO: 896199 - DNA, 13 bp, Homo sapiens
atggaatttggaa

SEQ ID NO: 896200 - DNA, 16 bp, Homo sapiens
atggacaaagaaaacg

SEQ ID NO: 896201 - DNA, 13 bp, Homo sapiens
atggacacaaatt

SEQ ID NO: 896202 - DNA, 20 bp, Homo sapiens
atggacacccccagctgact

SEQ ID NO: 896203 - DNA, 17 bp, Homo sapiens
atggacacgagccacaa

SEQ ID NO: 896204 - DNA, 20 bp, Homo sapiens
atggacacgagccacaagct

SEQ ID NO: 896205 - DNA, 11 bp, Homo sapiens
atggacactcc

SEQ ID NO: 896206 - DNA, 13 bp, Homo sapiens
atggacactccag

SEQ ID NO: 896207 - DNA, 19 bp, Homo sapiens
atggacactccagtgccag

SEQ ID NO: 896208 - DNA, 23 bp, Homo sapiens
atggacactgccaagagccgaca

SEQ ID NO: 896209 - DNA, 15 bp, Homo sapiens
atggacactgcctta

SEQ ID NO: 896210 - DNA, 15 bp, Homo sapiens
atggacagacacctc

SEQ ID NO: 896211 - DNA, 21 bp, Homo sapiens
atggacagacacctcccccta

SEQ ID NO: 896212 - DNA, 14 bp, Homo sapiens
atggacagattaat

SEQ ID NO: 896213 - DNA, 16 bp, Homo sapiens
atggacagattaatat

SEQ ID NO: 896214 - DNA, 15 bp, Homo sapiens
atggacatcctgtat

SEQ ID NO: 896215 - DNA, 20 bp, Homo sapiens
atggacatcctgtataagca

SEQ ID NO: 896216 - DNA, 19 bp, Homo sapiens
atggacatgatcttcttta

SEQ ID NO: 896217 - DNA, 14 bp, Homo sapiens
atggacatggaaat

SEQ ID NO: 896218 - DNA, 20 bp, Homo sapiens
atggacatgtgtcccagcca

SEQ ID NO: 896219 - DNA, 17 bp, Homo sapiens
atggacatttagaagaa

SEQ ID NO: 896220 - DNA, 12 bp, Homo sapiens
atggacattttc

SEQ ID NO: 896221 - DNA, 22 bp, Homo sapiens
atggacccacgaacgctcttag

SEQ ID NO: 896222 - DNA, 19 bp, Homo sapiens
atggacccctcccttgctc

SEQ ID NO: 896223 - DNA, 21 bp, Homo sapiens
atggaccgggtgggcctggcc

SEQ ID NO: 896224 - DNA, 23 bp, Homo sapiens
atggaccgggtgggcctggcctg

SEQ ID NO: 896225 - DNA, 12 bp, Homo sapiens
atggacctaaca

SEQ ID NO: 896226 - DNA, 13 bp, Homo sapiens
atggacctaacat

SEQ ID NO: 896227 - DNA, 23 bp, Homo sapiens
atggacctgccccggacctacct

SEQ ID NO: 896228 - DNA, 18 bp, Homo sapiens
atggacgcaggccctgtc

SEQ ID NO: 896229 - DNA, 21 bp, Homo sapiens
atggacgcaggccctgtccag

SEQ ID NO: 896230 - DNA, 13 bp, Homo sapiens
atggactatctgt

SEQ ID NO: 896231 - DNA, 20 bp, Homo sapiens
atgggagtgggcacctcaga

SEQ ID NO: 896232 - DNA, 23 bp, Homo sapiens
atgggatcatttttccaggactc

SEQ ID NO: 896233 - DNA, 19 bp, Homo sapiens
atgggatccaattttaata

SEQ ID NO: 896234 - DNA, 20 bp, Homo sapiens
atgggatccaattttaatat

SEQ ID NO: 896235 - DNA, 21 bp, Homo sapiens
atgggatggtcggatctcaca

SEQ ID NO: 896236 - DNA, 22 bp, Homo sapiens
atgggatggtcggatctcacag

SEQ ID NO: 896237 - DNA, 18 bp, Homo sapiens
atgggatggtggagggcc

SEQ ID NO: 896238 - DNA, 17 bp, Homo sapiens
atgggatgtatttttct

SEQ ID NO: 896239 - DNA, 20 bp, Homo sapiens
atgggcaaagcttgtcaaag

SEQ ID NO: 896240 - DNA, 19 bp, Homo sapiens
atgggcagctccatcctct

SEQ ID NO: 896241 - DNA, 21 bp, Homo sapiens
atgggcagctccatcctcttg

SEQ ID NO: 896242 - DNA, 15 bp, Homo sapiens
atgggcagttctccc

SEQ ID NO: 896243 - DNA, 20 bp, Homo sapiens
atgggcagttctcccaggga

SEQ ID NO: 896244 - DNA, 21 bp, Homo sapiens
atgggcagttctcccagggag

SEQ ID NO: 896245 - DNA, 14 bp, Homo sapiens
atgggcattgcagc

SEQ ID NO: 896246 - DNA, 16 bp, Homo sapiens
atgggcattgcagcct

SEQ ID NO: 896247 - DNA, 17 bp, Homo sapiens
atgggcattgcagcctt

SEQ ID NO: 896248 - DNA, 18 bp, Homo sapiens
atgggcattgcagccttg

SEQ ID NO: 896249 - DNA, 15 bp, Homo sapiens
atgggcattgggctg

SEQ ID NO: 896250 - DNA, 21 bp, Homo sapiens
atgggcattgggctgacacct

SEQ ID NO: 896251 - DNA, 22 bp, Homo sapiens
atgggcatttgtttagagccaa

SEQ ID NO: 896252 - DNA, 20 bp, Homo sapiens
atgggccccgccttcctggg

SEQ ID NO: 896253 - DNA, 15 bp, Homo sapiens
atgggccgtcccctc

SEQ ID NO: 896254 - DNA, 21 bp, Homo sapiens
atgggccgtcccctctcccct

SEQ ID NO: 896255 - DNA, 16 bp, Homo sapiens
atgggcctctctgggg

SEQ ID NO: 896256 - DNA, 21 bp, Homo sapiens
atgggcctctctgggggaggc

SEQ ID NO: 896257 - DNA, 12 bp, Homo sapiens
atgggcctgcct

SEQ ID NO: 896258 - DNA, 13 bp, Homo sapiens
atgggcctgcctg

SEQ ID NO: 896259 - DNA, 16 bp, Homo sapiens
atgggcctgcctgcct

SEQ ID NO: 896260 - DNA, 23 bp, Homo sapiens
atgggcctgcctgcctccacccg

SEQ ID NO: 896261 - DNA, 12 bp, Homo sapiens
atgggcctgggc

SEQ ID NO: 896262 - DNA, 13 bp, Homo sapiens
atgggcctgggcc

SEQ ID NO: 896263 - DNA, 15 bp, Homo sapiens
atgggcctgggcctg

SEQ ID NO: 896264 - DNA, 18 bp, Homo sapiens
atgggcctgggcctgctt

SEQ ID NO: 896265 - DNA, 22 bp, Homo sapiens
atgggccttgctttgggctttg

SEQ ID NO: 896266 - DNA, 20 bp, Homo sapiens
atgggcctttaagaacctta

SEQ ID NO: 896267 - DNA, 14 bp, Homo sapiens
atgggccttttctt

SEQ ID NO: 896268 - DNA, 21 bp, Homo sapiens
atgggctcgccgtgtctcagc

SEQ ID NO: 896269 - DNA, 22 bp, Homo sapiens
atgggctctacctctctttctc

SEQ ID NO: 896270 - DNA, 15 bp, Homo sapiens
atgggctcttccaac

SEQ ID NO: 896271 - DNA, 18 bp, Homo sapiens
atgggctggggcaggggc

SEQ ID NO: 896272 - DNA, 21 bp, Homo sapiens
atgggctggggcaggggcctg

SEQ ID NO: 896273 - DNA, 13 bp, Homo sapiens
atgggcttggact

SEQ ID NO: 896274 - DNA, 23 bp, Homo sapiens
atgggcttgttttcttgccaatg

SEQ ID NO: 896275 - DNA, 22 bp, Homo sapiens
atgggctttgtacgttccttct

SEQ ID NO: 896276 - DNA, 19 bp, Homo sapiens
atgggcttttgttctgagg

SEQ ID NO: 896277 - DNA, 21 bp, Homo sapiens
atgggcttttgttctgagggg

SEQ ID NO: 896278 - DNA, 23 bp, Homo sapiens
atggggaaaccctggagccatcc

SEQ ID NO: 896279 - DNA, 18 bp, Homo sapiens
atggggaaagcagaactg

SEQ ID NO: 896280 - DNA, 23 bp, Homo sapiens
atggggaaggagtacaaaacaat

SEQ ID NO: 896281 - DNA, 17 bp, Homo sapiens
atggggaaggcagaggc

SEQ ID NO: 896282 - DNA, 17 bp, Homo sapiens
atggggaatacaagttc

SEQ ID NO: 896283 - DNA, 17 bp, Homo sapiens
atggggaggcaagtgtg

SEQ ID NO: 896284 - DNA, 16 bp, Homo sapiens
atggggaggcagcaga

SEQ ID NO: 896285 - DNA, 18 bp, Homo sapiens
atggggaggcagcagagc

SEQ ID NO: 896286 - DNA, 13 bp, Homo sapiens
atggggaggccct

SEQ ID NO: 896287 - DNA, 16 bp, Homo sapiens
atggggaggccctgcc

SEQ ID NO: 896288 - DNA, 24 bp, Homo sapiens
atggggagtcggttagtcattgat

SEQ ID NO: 896289 - DNA, 12 bp, Homo sapiens
atggggagtgag

SEQ ID NO: 896290 - DNA, 23 bp, Homo sapiens
atggggatctggggggtggggag

SEQ ID NO: 896291 - DNA, 18 bp, Homo sapiens
acaggcccagcattgctg

SEQ ID NO: 896292 - DNA, 22 bp, Homo sapiens
acaggcccagcattgctggttc

SEQ ID NO: 896293 - DNA, 23 bp, Homo sapiens
acaggcccagcattgctggttct

SEQ ID NO: 896294 - DNA, 23 bp, Homo sapiens
acaggcccggcccagcctaggcc

SEQ ID NO: 896295 - DNA, 19 bp, Homo sapiens
acaggcccgtgcccagccc

SEQ ID NO: 896296 - DNA, 15 bp, Homo sapiens
acaggccctgctcct

SEQ ID NO: 896297 - DNA, 20 bp, Homo sapiens
acaggccctgctcctgcagc

SEQ ID NO: 896298 - DNA, 16 bp, Homo sapiens
acaggccgccctgcgg

SEQ ID NO: 896299 - DNA, 13 bp, Homo sapiens
acaggcctcacct

SEQ ID NO: 896300 - DNA, 17 bp, Homo sapiens
acaggcctcttcctgtt

SEQ ID NO: 896301 - DNA, 20 bp, Homo sapiens
acaggccttctgtggggctg

SEQ ID NO: 896302 - DNA, 14 bp, Homo sapiens
acaggctcaatatt

SEQ ID NO: 896303 - DNA, 18 bp, Homo sapiens
acaggctccaagaggctg

SEQ ID NO: 896304 - DNA, 20 bp, Homo sapiens
acaggctccaagaggctgag

SEQ ID NO: 896305 - DNA, 20 bp, Homo sapiens
acaggctcgtcagccacctg

SEQ ID NO: 896306 - DNA, 20 bp, Homo sapiens
acaggctctagagagaggga

SEQ ID NO: 896307 - DNA, 15 bp, Homo sapiens
acaggctcttagcag

SEQ ID NO: 896308 - DNA, 19 bp, Homo sapiens
acaggctcttagcagcttc

SEQ ID NO: 896309 - DNA, 19 bp, Homo sapiens
acaggctgaagagagggac

SEQ ID NO: 896310 - DNA, 20 bp, Homo sapiens
acaggctgacgttccgggca

SEQ ID NO: 896311 - DNA, 15 bp, Homo sapiens
acaggctgagaactc

SEQ ID NO: 896312 - DNA, 16 bp, Homo sapiens
acaggctggggccttt

SEQ ID NO: 896313 - DNA, 23 bp, Homo sapiens
acagggaaccctgcttgcacttt

SEQ ID NO: 896314 - DNA, 15 bp, Homo sapiens
acagggaagagcaga

SEQ ID NO: 896315 - DNA, 13 bp, Homo sapiens
acagggacatgcc

SEQ ID NO: 896316 - DNA, 19 bp, Homo sapiens
acagggactacgtattttt

SEQ ID NO: 896317 - DNA, 10 bp, Homo sapiens
acagggaggg

SEQ ID NO: 896318 - DNA, 22 bp, Homo sapiens
acagggagggccggcggctctg

SEQ ID NO: 896319 - DNA, 22 bp, Homo sapiens
acagggagggggacctgtcccc

SEQ ID NO: 896320 - DNA, 18 bp, Homo sapiens
acagggataaggcctgtg

SEQ ID NO: 896321 - DNA, 17 bp, Homo sapiens
acagggatggcgaggcc

SEQ ID NO: 896322 - DNA, 18 bp, Homo sapiens
acagggcactgactgata

SEQ ID NO: 896323 - DNA, 12 bp, Homo sapiens
acagggcagcag

SEQ ID NO: 896324 - DNA, 19 bp, Homo sapiens
acagggcagcagtggggtg

SEQ ID NO: 896325 - DNA, 11 bp, Homo sapiens
acagggcaggc

SEQ ID NO: 896326 - DNA, 21 bp, Homo sapiens
acagggcagtccttactcccc

SEQ ID NO: 896327 - DNA, 15 bp, Homo sapiens
acagggccacataga

SEQ ID NO: 896328 - DNA, 13 bp, Homo sapiens
acagggccagggt

SEQ ID NO: 896329 - DNA, 14 bp, Homo sapiens
acagggccagggtt

SEQ ID NO: 896330 - DNA, 20 bp, Homo sapiens
acagggccctgttgaatttt

SEQ ID NO: 896331 - DNA, 22 bp, Homo sapiens
acagggctaagagctagcgctg

SEQ ID NO: 896332 - DNA, 18 bp, Homo sapiens
acagggctcacagggcag

SEQ ID NO: 896333 - DNA, 21 bp, Homo sapiens
acagggctgataagctaacac

SEQ ID NO: 896334 - DNA, 24 bp, Homo sapiens
acagggctgctccccaacacctgc

SEQ ID NO: 896335 - DNA, 15 bp, Homo sapiens
acagggctgggagaa

SEQ ID NO: 896336 - DNA, 23 bp, Homo sapiens
acaggggaaggaaataacattgc

SEQ ID NO: 896337 - DNA, 20 bp, Homo sapiens
acaggggaaggtggcctctg

SEQ ID NO: 896338 - DNA, 23 bp, Homo sapiens
acaggggaggtgatagcattgct

SEQ ID NO: 896339 - DNA, 17 bp, Homo sapiens
acaggggcaggcctggg

SEQ ID NO: 896340 - DNA, 12 bp, Homo sapiens
acaggggccctg

SEQ ID NO: 896341 - DNA, 13 bp, Homo sapiens
acaggggccctgt

SEQ ID NO: 896342 - DNA, 17 bp, Homo sapiens
acaggggccctgtacag

SEQ ID NO: 896343 - DNA, 22 bp, Homo sapiens
acaggggccctgtacagtgaat

SEQ ID NO: 896344 - DNA, 16 bp, Homo sapiens
acaggggggtcggaag

SEQ ID NO: 896345 - DNA, 15 bp, Homo sapiens
acagggtacctcaag

SEQ ID NO: 896346 - DNA, 15 bp, Homo sapiens
acagggtaggaaagg

SEQ ID NO: 896347 - DNA, 16 bp, Homo sapiens
acagggtattaagaat

SEQ ID NO: 896348 - DNA, 17 bp, Homo sapiens
acagggtcttgctctgt

SEQ ID NO: 896349 - DNA, 20 bp, Homo sapiens
acagggtgctccttgtcaat

SEQ ID NO: 896350 - DNA, 22 bp, Homo sapiens
acagggtggaccccctgagtca

SEQ ID NO: 896351 - DNA, 23 bp, Homo sapiens
atgtaaatattttaaagaattgt

SEQ ID NO: 896352 - DNA, 12 bp, Homo sapiens
atgtaaatgtgc

SEQ ID NO: 896353 - DNA, 14 bp, Homo sapiens
atgtaaatgtgcat

SEQ ID NO: 896354 - DNA, 13 bp, Homo sapiens
atgtaaatgtgtt

SEQ ID NO: 896355 - DNA, 20 bp, Homo sapiens
atgtaaatgttattattctt

SEQ ID NO: 896356 - DNA, 19 bp, Homo sapiens
atgtaaattattgtaaact

SEQ ID NO: 896357 - DNA, 16 bp, Homo sapiens
atgtaacatcataatt

SEQ ID NO: 896358 - DNA, 21 bp, Homo sapiens
atgtaacatcataattacatt

SEQ ID NO: 896359 - DNA, 14 bp, Homo sapiens
atgtaacattggtg

SEQ ID NO: 896360 - DNA, 16 bp, Homo sapiens
atgtaacattggtgaa

SEQ ID NO: 896361 - DNA, 13 bp, Homo sapiens
atgtaaccaagct

SEQ ID NO: 896362 - DNA, 15 bp, Homo sapiens
atgtaaccaagctgt

SEQ ID NO: 896363 - DNA, 16 bp, Homo sapiens
atgtaaccaagctgta

SEQ ID NO: 896364 - DNA, 17 bp, Homo sapiens
atgtaactccagataga

SEQ ID NO: 896365 - DNA, 14 bp, Homo sapiens
atgtaactctccag

SEQ ID NO: 896366 - DNA, 17 bp, Homo sapiens
atgtaactctccagcca

SEQ ID NO: 896367 - DNA, 20 bp, Homo sapiens
atgtaactgcattgagaact

SEQ ID NO: 896368 - DNA, 22 bp, Homo sapiens
atgtaactgtccgtagtatcag

SEQ ID NO: 896369 - DNA, 15 bp, Homo sapiens
atgtaacttattatt

SEQ ID NO: 896370 - DNA, 14 bp, Homo sapiens
atgtaacttattcc

SEQ ID NO: 896371 - DNA, 18 bp, Homo sapiens
atgtaacttttgtaagac

SEQ ID NO: 896372 - DNA, 17 bp, Homo sapiens
atgtaagaaaagctgat

SEQ ID NO: 896373 - DNA, 20 bp, Homo sapiens
atgtaagagcaccttcctca

SEQ ID NO: 896374 - DNA, 15 bp, Homo sapiens
atgtaagcatacttt

SEQ ID NO: 896375 - DNA, 17 bp, Homo sapiens
atgtaagccaagtcatg

SEQ ID NO: 896376 - DNA, 17 bp, Homo sapiens
atgtaagctctactgag

SEQ ID NO: 896377 - DNA, 12 bp, Homo sapiens
atgtaaggactg

SEQ ID NO: 896378 - DNA, 15 bp, Homo sapiens
atgtaaggcactgtc

SEQ ID NO: 896379 - DNA, 23 bp, Homo sapiens
atgtaaggctgtgtaagatttgt

SEQ ID NO: 896380 - DNA, 17 bp, Homo sapiens
atgtaagggtctttggt

SEQ ID NO: 896381 - DNA, 21 bp, Homo sapiens
atgtaagggtctttggtgttt

SEQ ID NO: 896382 - DNA, 16 bp, Homo sapiens
atgtaagtgtggtttt

SEQ ID NO: 896383 - DNA, 17 bp, Homo sapiens
atgtaagtgtggttttg

SEQ ID NO: 896384 - DNA, 14 bp, Homo sapiens
atgtaataaacttt

SEQ ID NO: 896385 - DNA, 16 bp, Homo sapiens
atgtaataaactttaa

SEQ ID NO: 896386 - DNA, 14 bp, Homo sapiens
atgtaataaattca

SEQ ID NO: 896387 - DNA, 22 bp, Homo sapiens
atgtaataagcacttgcctgga

SEQ ID NO: 896388 - DNA, 14 bp, Homo sapiens
atgtaatactggaa

SEQ ID NO: 896389 - DNA, 14 bp, Homo sapiens
atgtaatatattgt

SEQ ID NO: 896390 - DNA, 18 bp, Homo sapiens
atgtaatcaaacttctag

SEQ ID NO: 896391 - DNA, 18 bp, Homo sapiens
atgtaatccttttgttta

SEQ ID NO: 896392 - DNA, 20 bp, Homo sapiens
atgtaatctctctgcagctg

SEQ ID NO: 896393 - DNA, 22 bp, Homo sapiens
atgtaatctctctgcagctgcc

SEQ ID NO: 896394 - DNA, 19 bp, Homo sapiens
atgtaatcttgaattgtaa

SEQ ID NO: 896395 - DNA, 16 bp, Homo sapiens
atgtaatgcactttgg

SEQ ID NO: 896396 - DNA, 23 bp, Homo sapiens
atgtaatgcattaataaaaatca

SEQ ID NO: 896397 - DNA, 14 bp, Homo sapiens
atgtaatgtcagac

SEQ ID NO: 896398 - DNA, 18 bp, Homo sapiens
atgtaatgttaatgttat

SEQ ID NO: 896399 - DNA, 18 bp, Homo sapiens
atgtaattaaactgttaa

SEQ ID NO: 896400 - DNA, 13 bp, Homo sapiens
atgtaattggaat

SEQ ID NO: 896401 - DNA, 14 bp, Homo sapiens
atgtaattggaatc

SEQ ID NO: 896402 - DNA, 16 bp, Homo sapiens
atgtaatttagaaact

SEQ ID NO: 896403 - DNA, 17 bp, Homo sapiens
atgtaatttcaaaatac

SEQ ID NO: 896404 - DNA, 19 bp, Homo sapiens
atgtaatttcaaaatacat

SEQ ID NO: 896405 - DNA, 21 bp, Homo sapiens
atgtaatttcaaaatacattt

SEQ ID NO: 896406 - DNA, 16 bp, Homo sapiens
atgtaatttgtacagg

SEQ ID NO: 896407 - DNA, 21 bp, Homo sapiens
atgtaatttgtacaggggcca

SEQ ID NO: 896408 - DNA, 11 bp, Homo sapiens
atgtacaaact

SEQ ID NO: 896409 - DNA, 12 bp, Homo sapiens
atgtacaaacta

SEQ ID NO: 896410 - DNA, 15 bp, Homo sapiens
atgtacaaccctgac

SEQ ID NO: 896411 - DNA, 16 bp, Homo sapiens
atgtacaaccctgacc

SEQ ID NO: 896412 - DNA, 14 bp, Homo sapiens
atgtacaagttgag

SEQ ID NO: 896413 - DNA, 16 bp, Homo sapiens
atgtacaagttttgta

SEQ ID NO: 896414 - DNA, 13 bp, Homo sapiens
atgtacaatacaa

SEQ ID NO: 896415 - DNA, 14 bp, Homo sapiens
atgtacaatacaat

SEQ ID NO: 896416 - DNA, 16 bp, Homo sapiens
atgtacaatacaatgt

SEQ ID NO: 896417 - DNA, 17 bp, Homo sapiens
atgtacaatacaatgta

SEQ ID NO: 896418 - DNA, 22 bp, Homo sapiens
atgtacaatacaatgtacaatt

SEQ ID NO: 896419 - DNA, 22 bp, Homo sapiens
atgtacaattatgtctcttgag

SEQ ID NO: 896420 - DNA, 19 bp, Homo sapiens
atgtacagaacacaaatgt

SEQ ID NO: 896421 - DNA, 16 bp, Homo sapiens
atgtacagagctttct

SEQ ID NO: 896422 - DNA, 13 bp, Homo sapiens
atgtacagagtgg

SEQ ID NO: 896423 - DNA, 9 bp, Homo sapiens
acagtgttt

SEQ ID NO: 896424 - DNA, 18 bp, Homo sapiens
acagtgtttatcctttca

SEQ ID NO: 896425 - DNA, 20 bp, Homo sapiens
acagtgtttatcctttcata

SEQ ID NO: 896426 - DNA, 21 bp, Homo sapiens
acagtgtttatcctttcatat

SEQ ID NO: 896427 - DNA, 16 bp, Homo sapiens
acagtgtttcccataa

SEQ ID NO: 896428 - DNA, 13 bp, Homo sapiens
acagttaaataaa

SEQ ID NO: 896429 - DNA, 16 bp, Homo sapiens
acagttaactctccca

SEQ ID NO: 896430 - DNA, 13 bp, Homo sapiens
acagttaactttc

SEQ ID NO: 896431 - DNA, 21 bp, Homo sapiens
acagttaagaagccctgcaga

SEQ ID NO: 896432 - DNA, 20 bp, Homo sapiens
acagttactcagaattctct

SEQ ID NO: 896433 - DNA, 23 bp, Homo sapiens
acagttagggttttgcaataact

SEQ ID NO: 896434 - DNA, 16 bp, Homo sapiens
acagttatcaaaaagt

SEQ ID NO: 896435 - DNA, 15 bp, Homo sapiens
acagttatctaagtt

SEQ ID NO: 896436 - DNA, 16 bp, Homo sapiens
acagttatctaagtta

SEQ ID NO: 896437 - DNA, 14 bp, Homo sapiens
acagttatgtgggt

SEQ ID NO: 896438 - DNA, 21 bp, Homo sapiens
acagttatgtgggtggcttct

SEQ ID NO: 896439 - DNA, 21 bp, Homo sapiens
acagttcaaaattctaaatgt

SEQ ID NO: 896440 - DNA, 21 bp, Homo sapiens
acagttcacagaggtctttca

SEQ ID NO: 896441 - DNA, 15 bp, Homo sapiens
acagttcatatgtac

SEQ ID NO: 896442 - DNA, 15 bp, Homo sapiens
acagttctgaagaat

SEQ ID NO: 896443 - DNA, 13 bp, Homo sapiens
acagttctgagct

SEQ ID NO: 896444 - DNA, 21 bp, Homo sapiens
acagttctgagctgtaatttc

SEQ ID NO: 896445 - DNA, 21 bp, Homo sapiens
acagttctgctctggttgttt

SEQ ID NO: 896446 - DNA, 15 bp, Homo sapiens
acagttctgtaatgt

SEQ ID NO: 896447 - DNA, 13 bp, Homo sapiens
acagttctgtcat

SEQ ID NO: 896448 - DNA, 22 bp, Homo sapiens
acagttctgtggtttcatgtta

SEQ ID NO: 896449 - DNA, 22 bp, Homo sapiens
acagttcttggtgactgtccca

SEQ ID NO: 896450 - DNA, 17 bp, Homo sapiens
acagttctttcctcttt

SEQ ID NO: 896451 - DNA, 20 bp, Homo sapiens
acagttctttcctctttctg

SEQ ID NO: 896452 - DNA, 21 bp, Homo sapiens
acagttctttcctctttctgc

SEQ ID NO: 896453 - DNA, 22 bp, Homo sapiens
acagttctttcctctttctgct

SEQ ID NO: 896454 - DNA, 15 bp, Homo sapiens
acagttgaaaaacag

SEQ ID NO: 896455 - DNA, 15 bp, Homo sapiens
acagttgaattttaa

SEQ ID NO: 896456 - DNA, 18 bp, Homo sapiens
acagttgagagagaatct

SEQ ID NO: 896457 - DNA, 23 bp, Homo sapiens
acagttgcatgtagtaacactaa

SEQ ID NO: 896458 - DNA, 19 bp, Homo sapiens
acagttgccaccacctctg

SEQ ID NO: 896459 - DNA, 21 bp, Homo sapiens
acagttgccaccacctctgtg

SEQ ID NO: 896460 - DNA, 22 bp, Homo sapiens
acagttgccaccacctctgtgg

SEQ ID NO: 896461 - DNA, 13 bp, Homo sapiens
acagttgctgtga

SEQ ID NO: 896462 - DNA, 14 bp, Homo sapiens
acagttggcagaga

SEQ ID NO: 896463 - DNA, 22 bp, Homo sapiens
acagttggcagagaaggcctct

SEQ ID NO: 896464 - DNA, 14 bp, Homo sapiens
acagttggtaactt

SEQ ID NO: 896465 - DNA, 24 bp, Homo sapiens
acagttggtaacttttgtgaatta

SEQ ID NO: 896466 - DNA, 22 bp, Homo sapiens
acagttgtatttaacagaaatt

SEQ ID NO: 896467 - DNA, 14 bp, Homo sapiens
acagttgtcctgat

SEQ ID NO: 896468 - DNA, 21 bp, Homo sapiens
acagttgtcctgatttcttat

SEQ ID NO: 896469 - DNA, 15 bp, Homo sapiens
acagttgttggcctc

SEQ ID NO: 896470 - DNA, 22 bp, Homo sapiens
acagttgtttgatgcattaaaa

SEQ ID NO: 896471 - DNA, 16 bp, Homo sapiens
acagtttaaagctttt

SEQ ID NO: 896472 - DNA, 18 bp, Homo sapiens
acagtttactttgccaac

SEQ ID NO: 896473 - DNA, 15 bp, Homo sapiens
atgtcacctggctgc

SEQ ID NO: 896474 - DNA, 21 bp, Homo sapiens
atgtcacctggctgctaggcc

SEQ ID NO: 896475 - DNA, 23 bp, Homo sapiens
atgtcactaaacaagaaatctga

SEQ ID NO: 896476 - DNA, 17 bp, Homo sapiens
atgtcactattttcact

SEQ ID NO: 896477 - DNA, 11 bp, Homo sapiens
atgtcactgcc

SEQ ID NO: 896478 - DNA, 18 bp, Homo sapiens
atgtcacttctggatata

SEQ ID NO: 896479 - DNA, 17 bp, Homo sapiens
atgtcagaaaaaatatg

SEQ ID NO: 896480 - DNA, 20 bp, Homo sapiens
atgtcagaaaataacagatg

SEQ ID NO: 896481 - DNA, 13 bp, Homo sapiens
atgtcagacacag

SEQ ID NO: 896482 - DNA, 22 bp, Homo sapiens
atgtcagactttgctgcatttt

SEQ ID NO: 896483 - DNA, 23 bp, Homo sapiens
atgtcagactttgctgcatttta

SEQ ID NO: 896484 - DNA, 17 bp, Homo sapiens
atgtcagaggaccccag

SEQ ID NO: 896485 - DNA, 17 bp, Homo sapiens
atgtcagataagtgtaa

SEQ ID NO: 896486 - DNA, 19 bp, Homo sapiens
atgtcagataagtgtaaat

SEQ ID NO: 896487 - DNA, 21 bp, Homo sapiens
atgtcagatgcgtgcccagct

SEQ ID NO: 896488 - DNA, 15 bp, Homo sapiens
atgtcagatttctgg

SEQ ID NO: 896489 - DNA, 16 bp, Homo sapiens
atgtcagcaaaaagca

SEQ ID NO: 896490 - DNA, 19 bp, Homo sapiens
atgtcagccgagccgggcc

SEQ ID NO: 896491 - DNA, 12 bp, Homo sapiens
atgtcagccttg

SEQ ID NO: 896492 - DNA, 13 bp, Homo sapiens
atgtcagccttgc

SEQ ID NO: 896493 - DNA, 12 bp, Homo sapiens
atgtcagccttt

SEQ ID NO: 896494 - DNA, 17 bp, Homo sapiens
atgtcagtaccttcaaa

SEQ ID NO: 896495 - DNA, 22 bp, Homo sapiens
atgtcagtctgcttagaaataa

SEQ ID NO: 896496 - DNA, 16 bp, Homo sapiens
atgtcagtctggttta

SEQ ID NO: 896497 - DNA, 15 bp, Homo sapiens
atgtcagtggtttct

SEQ ID NO: 896498 - DNA, 21 bp, Homo sapiens
atgtcagttctgatatggaag

SEQ ID NO: 896499 - DNA, 12 bp, Homo sapiens
atgtcatagcca

SEQ ID NO: 896500 - DNA, 23 bp, Homo sapiens
atgtcatgcctcactttcttcta

SEQ ID NO: 896501 - DNA, 19 bp, Homo sapiens
atgtcatggccttgaaaca

SEQ ID NO: 896502 - DNA, 18 bp, Homo sapiens
atgtcatgtacttcctgt

SEQ ID NO: 896503 - DNA, 13 bp, Homo sapiens
atgtcattattta

SEQ ID NO: 896504 - DNA, 18 bp, Homo sapiens
atgtcattatttattgtt

SEQ ID NO: 896505 - DNA, 20 bp, Homo sapiens
atgtcattatttattgttaa

SEQ ID NO: 896506 - DNA, 21 bp, Homo sapiens
atgtcattatttattgttaaa

SEQ ID NO: 896507 - DNA, 22 bp, Homo sapiens
atgtcattatttattgttaaat

SEQ ID NO: 896508 - DNA, 14 bp, Homo sapiens
atgtcattgctaaa

SEQ ID NO: 896509 - DNA, 17 bp, Homo sapiens
atgtcatttttaatgta

SEQ ID NO: 896510 - DNA, 19 bp, Homo sapiens
atgtcatttttaatgtatc

SEQ ID NO: 896511 - DNA, 15 bp, Homo sapiens
atgtccaaagaggct

SEQ ID NO: 896512 - DNA, 16 bp, Homo sapiens
atgtccaaagaggctg

SEQ ID NO: 896513 - DNA, 19 bp, Homo sapiens
atgtccaaagaggctgccc

SEQ ID NO: 896514 - DNA, 22 bp, Homo sapiens
atgtccaaagaggctgcccctc

SEQ ID NO: 896515 - DNA, 16 bp, Homo sapiens
atgtccaacccgtctg

SEQ ID NO: 896516 - DNA, 21 bp, Homo sapiens
atgtccaccatgaacttgata

SEQ ID NO: 896517 - DNA, 17 bp, Homo sapiens
atgtccactgtgtatag

SEQ ID NO: 896518 - DNA, 14 bp, Homo sapiens
atgtccagccaccc

SEQ ID NO: 896519 - DNA, 20 bp, Homo sapiens
atgtccagccacccccaggc

SEQ ID NO: 896520 - DNA, 12 bp, Homo sapiens
atgtccaggaaa

SEQ ID NO: 896521 - DNA, 18 bp, Homo sapiens
atgtccataaaagagacc

SEQ ID NO: 896522 - DNA, 19 bp, Homo sapiens
atgtccatttatatcattt

SEQ ID NO: 896523 - DNA, 12 bp, Homo sapiens
atgtccccactc

SEQ ID NO: 896524 - DNA, 15 bp, Homo sapiens
atgtcccctgtccca

SEQ ID NO: 896525 - DNA, 22 bp, Homo sapiens
atgtccccttcctgttcttcct

SEQ ID NO: 896526 - DNA, 21 bp, Homo sapiens
atgtccctacacccctcccct

SEQ ID NO: 896527 - DNA, 12 bp, Homo sapiens
atgtccctccag

SEQ ID NO: 896528 - DNA, 19 bp, Homo sapiens
atgtccctgtccccaggcc

SEQ ID NO: 896529 - DNA, 20 bp, Homo sapiens
atgtccctgtccccaggccc

SEQ ID NO: 896530 - DNA, 18 bp, Homo sapiens
atgtcccttgatgcacag

SEQ ID NO: 896531 - DNA, 14 bp, Homo sapiens
atgtcccttgctgt

SEQ ID NO: 896532 - DNA, 16 bp, Homo sapiens
atgtcctaaggacaca

SEQ ID NO: 896533 - DNA, 17 bp, Homo sapiens
atgtcctaaggacacac

SEQ ID NO: 896534 - DNA, 18 bp, Homo sapiens
atgtcctaaggacacact

SEQ ID NO: 896535 - DNA, 21 bp, Homo sapiens
atgtcctaaggacacactaat

SEQ ID NO: 896536 - DNA, 19 bp, Homo sapiens
atgtcctccagaagcctct

SEQ ID NO: 896537 - DNA, 21 bp, Homo sapiens
atgtcctgactttgccccctt

SEQ ID NO: 896538 - DNA, 11 bp, Homo sapiens
atgtcctgcat

SEQ ID NO: 896539 - DNA, 16 bp, Homo sapiens
atgtcctgcctattat

SEQ ID NO: 896540 - DNA, 22 bp, Homo sapiens
atgtcctgcctattatctgtca

SEQ ID NO: 896541 - DNA, 13 bp, Homo sapiens
atgtcctgtaaag

SEQ ID NO: 896542 - DNA, 14 bp, Homo sapiens
atgtcctgtaaagg

SEQ ID NO: 896543 - DNA, 19 bp, Homo sapiens
atgtcctgtgagatgtgta

SEQ ID NO: 896544 - DNA, 20 bp, Homo sapiens
atgtcctgtgagatgtgtat

SEQ ID NO: 896545 - DNA, 14 bp, Homo sapiens
atgtcgatcaagag

SEQ ID NO: 896546 - DNA, 19 bp, Homo sapiens
atgtcgatcaagagaatca

SEQ ID NO: 896547 - DNA, 20 bp, Homo sapiens
atgtcgatcaagagaatcaa

SEQ ID NO: 896548 - DNA, 14 bp, Homo sapiens
atgtcgattaaaat

SEQ ID NO: 896549 - DNA, 16 bp, Homo sapiens
atgtcgcacaatgttt

SEQ ID NO: 896550 - DNA, 13 bp, Homo sapiens
atgtcgcctctgc

SEQ ID NO: 896551 - DNA, 14 bp, Homo sapiens
atgtcgcctctgca

SEQ ID NO: 896552 - DNA, 19 bp, Homo sapiens
atgtctaaatgctgaaaaa

SEQ ID NO: 896553 - DNA, 13 bp, Homo sapiens
atgtctaattgag

SEQ ID NO: 896554 - DNA, 15 bp, Homo sapiens
atgtctactttttaa

SEQ ID NO: 896555 - DNA, 14 bp, Homo sapiens
atgtctattcagct

SEQ ID NO: 896556 - DNA, 12 bp, Homo sapiens
atgtctatttaa

SEQ ID NO: 896557 - DNA, 23 bp, Homo sapiens
acatccagctgcccctccctcag

SEQ ID NO: 896558 - DNA, 13 bp, Homo sapiens
acatcccaaactt

SEQ ID NO: 896559 - DNA, 20 bp, Homo sapiens
acatcccaaaggatgagaat

SEQ ID NO: 896560 - DNA, 16 bp, Homo sapiens
acatcccactggatct

SEQ ID NO: 896561 - DNA, 22 bp, Homo sapiens
acatcccactggatctggctta

SEQ ID NO: 896562 - DNA, 17 bp, Homo sapiens
acatcccagcagcccaa

SEQ ID NO: 896563 - DNA, 13 bp, Homo sapiens
acatcccagcctg

SEQ ID NO: 896564 - DNA, 17 bp, Homo sapiens
acatcccattgccctgg

SEQ ID NO: 896565 - DNA, 14 bp, Homo sapiens
acatccccagagcc

SEQ ID NO: 896566 - DNA, 18 bp, Homo sapiens
acatccccagagcccagc

SEQ ID NO: 896567 - DNA, 19 bp, Homo sapiens
acatccccagagcccagct

SEQ ID NO: 896568 - DNA, 14 bp, Homo sapiens
acatccctgtaaat

SEQ ID NO: 896569 - DNA, 13 bp, Homo sapiens
acatcccttcctg

SEQ ID NO: 896570 - DNA, 14 bp, Homo sapiens
acatcccttcctgg

SEQ ID NO: 896571 - DNA, 19 bp, Homo sapiens
acatcccttcctggaaaca

SEQ ID NO: 896572 - DNA, 21 bp, Homo sapiens
acatcccttcctggaaacagc

SEQ ID NO: 896573 - DNA, 21 bp, Homo sapiens
acatccgtcattgctgctgct

SEQ ID NO: 896574 - DNA, 14 bp, Homo sapiens
acatcctccgtcca

SEQ ID NO: 896575 - DNA, 17 bp, Homo sapiens
acatcctccgtccagcc

SEQ ID NO: 896576 - DNA, 13 bp, Homo sapiens
acatcctcctccc

SEQ ID NO: 896577 - DNA, 22 bp, Homo sapiens
acatcctcctgcccagctcctc

SEQ ID NO: 896578 - DNA, 22 bp, Homo sapiens
acatcctctgatagctgtttca

SEQ ID NO: 896579 - DNA, 13 bp, Homo sapiens
acatcctcttctg

SEQ ID NO: 896580 - DNA, 23 bp, Homo sapiens
acatcctgggatccagtgtataa

SEQ ID NO: 896581 - DNA, 16 bp, Homo sapiens
acatcctgtgtttcta

SEQ ID NO: 896582 - DNA, 12 bp, Homo sapiens
acatccttctca

SEQ ID NO: 896583 - DNA, 17 bp, Homo sapiens
acatccttctcactgcc

SEQ ID NO: 896584 - DNA, 14 bp, Homo sapiens
acatcgatatgtat

SEQ ID NO: 896585 - DNA, 14 bp, Homo sapiens
acatcgtgggtcac

SEQ ID NO: 896586 - DNA, 18 bp, Homo sapiens
acatcgtgggtcactaca

SEQ ID NO: 896587 - DNA, 18 bp, Homo sapiens
acatcgttgttttgctgg

SEQ ID NO: 896588 - DNA, 14 bp, Homo sapiens
acatctaaagcttt

SEQ ID NO: 896589 - DNA, 16 bp, Homo sapiens
acatctaaagctttat

SEQ ID NO: 896590 - DNA, 20 bp, Homo sapiens
acatctaaagctttatcttt

SEQ ID NO: 896591 - DNA, 19 bp, Homo sapiens
acatctaatgtctcttcct

SEQ ID NO: 896592 - DNA, 18 bp, Homo sapiens
acatctacctatacttaa

SEQ ID NO: 896593 - DNA, 16 bp, Homo sapiens
acatctagtagttgtt

SEQ ID NO: 896594 - DNA, 12 bp, Homo sapiens
acatctcatttt

SEQ ID NO: 896595 - DNA, 21 bp, Homo sapiens
atgtgccttatgttgaaaaaa

SEQ ID NO: 896596 - DNA, 19 bp, Homo sapiens
atgtgccttgtccaggaac

SEQ ID NO: 896597 - DNA, 20 bp, Homo sapiens
atgtgcgtgtgtgcaagtgt

SEQ ID NO: 896598 - DNA, 14 bp, Homo sapiens
atgtgctactgatt

SEQ ID NO: 896599 - DNA, 20 bp, Homo sapiens
atgtgctactgattgtttca

SEQ ID NO: 896600 - DNA, 19 bp, Homo sapiens
atgtgctagaacaatggga

SEQ ID NO: 896601 - DNA, 18 bp, Homo sapiens
atgtgctatacacacaca

SEQ ID NO: 896602 - DNA, 18 bp, Homo sapiens
atgtgctatataaatatg

SEQ ID NO: 896603 - DNA, 16 bp, Homo sapiens
atgtgctatcacatgt

SEQ ID NO: 896604 - DNA, 15 bp, Homo sapiens
atgtgctgaacattg

SEQ ID NO: 896605 - DNA, 13 bp, Homo sapiens
atgtgcttttctc

SEQ ID NO: 896606 - DNA, 16 bp, Homo sapiens
atgtgcttttctccaa

SEQ ID NO: 896607 - DNA, 13 bp, Homo sapiens
atgtggaaaacag

SEQ ID NO: 896608 - DNA, 16 bp, Homo sapiens
atgtggaactgtagga

SEQ ID NO: 896609 - DNA, 21 bp, Homo sapiens
atgtggaagtatacctggctt

SEQ ID NO: 896610 - DNA, 22 bp, Homo sapiens
atgtggacgtcacgctccctga

SEQ ID NO: 896611 - DNA, 19 bp, Homo sapiens
atgtggacgtgcactgaca

SEQ ID NO: 896612 - DNA, 16 bp, Homo sapiens
atgtggaggaagagcc

SEQ ID NO: 896613 - DNA, 17 bp, Homo sapiens
atgtggaggaagagcca

SEQ ID NO: 896614 - DNA, 20 bp, Homo sapiens
atgtggaggaagagccacct

SEQ ID NO: 896615 - DNA, 16 bp, Homo sapiens
atgtggataaaactgt

SEQ ID NO: 896616 - DNA, 20 bp, Homo sapiens
atgtggataaaactgtgtaa

SEQ ID NO: 896617 - DNA, 19 bp, Homo sapiens
atgtggcaaagctcaccat

SEQ ID NO: 896618 - DNA, 20 bp, Homo sapiens
atgtggcaaagtgctgtacc

SEQ ID NO: 896619 - DNA, 19 bp, Homo sapiens
atgtggccacaactgctgt

SEQ ID NO: 896620 - DNA, 19 bp, Homo sapiens
atgtggcctaaaaatgcaa

SEQ ID NO: 896621 - DNA, 16 bp, Homo sapiens
atgtggcctccatgtg

SEQ ID NO: 896622 - DNA, 15 bp, Homo sapiens
atgtggcctgcccag

SEQ ID NO: 896623 - DNA, 24 bp, Homo sapiens
atgtggcttctctgtctctgtgga

SEQ ID NO: 896624 - DNA, 21 bp, Homo sapiens
atgtggcttgagaaatatgga

SEQ ID NO: 896625 - DNA, 22 bp, Homo sapiens
atgtggcttttttaaaaaagca

SEQ ID NO: 896626 - DNA, 23 bp, Homo sapiens
atgtgggagctgaaccacagaaa

SEQ ID NO: 896627 - DNA, 10 bp, Homo sapiens
atgtgggagg

SEQ ID NO: 896628 - DNA, 17 bp, Homo sapiens
atgtggggctgagctgg

SEQ ID NO: 896629 - DNA, 21 bp, Homo sapiens
atgtggggtccccatcatccc

SEQ ID NO: 896630 - DNA, 13 bp, Homo sapiens
atgtggtctcagg

SEQ ID NO: 896631 - DNA, 14 bp, Homo sapiens
atgtggtctcagga

SEQ ID NO: 896632 - DNA, 18 bp, Homo sapiens
atgtggtcttatgatttt

SEQ ID NO: 896633 - DNA, 23 bp, Homo sapiens
atgtggtcttatgattttattac

SEQ ID NO: 896634 - DNA, 19 bp, Homo sapiens
atgtggtgacacctccccc

SEQ ID NO: 896635 - DNA, 13 bp, Homo sapiens
atgtggtgcctga

SEQ ID NO: 896636 - DNA, 21 bp, Homo sapiens
atgtggttaccgagtatctgt

SEQ ID NO: 896637 - DNA, 20 bp, Homo sapiens
atgtggttgcaaggccgctg

SEQ ID NO: 896638 - DNA, 16 bp, Homo sapiens
atgtgtaaacaggtat

SEQ ID NO: 896639 - DNA, 15 bp, Homo sapiens
atgtgtaaagattta

SEQ ID NO: 896640 - DNA, 14 bp, Homo sapiens
atgtgtaagtattc

SEQ ID NO: 896641 - DNA, 21 bp, Homo sapiens
atgtgtacagtgaattgtctt

SEQ ID NO: 896642 - DNA, 16 bp, Homo sapiens
atgtgtacatggcaga

SEQ ID NO: 896643 - DNA, 15 bp, Homo sapiens
atgtgtagccttctc

SEQ ID NO: 896644 - DNA, 21 bp, Homo sapiens
atgtgtagctgcaaaaataat

SEQ ID NO: 896645 - DNA, 19 bp, Homo sapiens
atgtgtataaactgctgtc

SEQ ID NO: 896646 - DNA, 22 bp, Homo sapiens
atgtgtataaactgctgtcaat

SEQ ID NO: 896647 - DNA, 13 bp, Homo sapiens
atgtgtataaatt

SEQ ID NO: 896648 - DNA, 20 bp, Homo sapiens
atgtgtatgcacagtaaaaa

SEQ ID NO: 896649 - DNA, 14 bp, Homo sapiens
atgtgtatttctta

SEQ ID NO: 896650 - DNA, 17 bp, Homo sapiens
atgtgtattttattaca

SEQ ID NO: 896651 - DNA, 15 bp, Homo sapiens
atgtgtcaaaataaa

SEQ ID NO: 896652 - DNA, 22 bp, Homo sapiens
atgtgtcaaattataagagaca

SEQ ID NO: 896653 - DNA, 15 bp, Homo sapiens
atgtgtcacttgtgc

SEQ ID NO: 896654 - DNA, 18 bp, Homo sapiens
atgtgtcagaataggaaa

SEQ ID NO: 896655 - DNA, 22 bp, Homo sapiens
atgtgtcagaataggaaaacat

SEQ ID NO: 896656 - DNA, 15 bp, Homo sapiens
atgtgtcatgaagaa

SEQ ID NO: 896657 - DNA, 23 bp, Homo sapiens
atgtgtcatgaagaatgtttctg

SEQ ID NO: 896658 - DNA, 23 bp, Homo sapiens
atgtgtcccccccaggccttgtc

SEQ ID NO: 896659 - DNA, 18 bp, Homo sapiens
atgtgtcccctcactctg

SEQ ID NO: 896660 - DNA, 19 bp, Homo sapiens
atgtgtcccctcactctgt

SEQ ID NO: 896661 - DNA, 24 bp, Homo sapiens
atgtgtcccctcactctgtcagcc

SEQ ID NO: 896662 - DNA, 13 bp, Homo sapiens
atgtgtcccttcc

SEQ ID NO: 896663 - DNA, 14 bp, Homo sapiens
atgtgtcccttcca

SEQ ID NO: 896664 - DNA, 22 bp, Homo sapiens
atgtgtcccttccaagctgtgt

SEQ ID NO: 896665 - DNA, 18 bp, Homo sapiens
atgtgtcctcagggagca

SEQ ID NO: 896666 - DNA, 18 bp, Homo sapiens
atgtgtctgctaatgtaa

SEQ ID NO: 896667 - DNA, 16 bp, Homo sapiens
atgtgtctgtatttca

SEQ ID NO: 896668 - DNA, 21 bp, Homo sapiens
atgtgtctgtatttcatgtgg

SEQ ID NO: 896669 - DNA, 13 bp, Homo sapiens
atgtgtctttaga

SEQ ID NO: 896670 - DNA, 22 bp, Homo sapiens
atgtgtgcaacagggtatggac

SEQ ID NO: 896671 - DNA, 13 bp, Homo sapiens
atgtgtgcatgtg

SEQ ID NO: 896672 - DNA, 15 bp, Homo sapiens
atgtgtgcatgtgtg

SEQ ID NO: 896673 - DNA, 18 bp, Homo sapiens
atgtgtgcctggccgcag

SEQ ID NO: 896674 - DNA, 18 bp, Homo sapiens
atgtgtgcctgtggcaga

SEQ ID NO: 896675 - DNA, 23 bp, Homo sapiens
atgtgtgcctgtggcagaaaaga

SEQ ID NO: 896676 - DNA, 15 bp, Homo sapiens
atgtgtgcgagtgtg

SEQ ID NO: 896677 - DNA, 13 bp, Homo sapiens
atgtgtgctttcc

SEQ ID NO: 896678 - DNA, 15 bp, Homo sapiens
atgtgtggggcatgg

SEQ ID NO: 896679 - DNA, 23 bp, Homo sapiens
atgtgtgggtgaatgtgtgttca

SEQ ID NO: 896680 - DNA, 17 bp, Homo sapiens
atgtgtgtaagtgtgtg

SEQ ID NO: 896681 - DNA, 18 bp, Homo sapiens
atgtgtgtagactgtaac

SEQ ID NO: 896682 - DNA, 14 bp, Homo sapiens
atgtgtgtaggtta

SEQ ID NO: 896683 - DNA, 18 bp, Homo sapiens
atgtgtgtaggttatctt

SEQ ID NO: 896684 - DNA, 13 bp, Homo sapiens
atgtgtgtatgtg

SEQ ID NO: 896685 - DNA, 22 bp, Homo sapiens
atgtgtgtccacgactgtctcc

SEQ ID NO: 896686 - DNA, 23 bp, Homo sapiens
atgtgtgtccacgactgtctcca

SEQ ID NO: 896687 - DNA, 10 bp, Homo sapiens
atgtgtgtga

SEQ ID NO: 896688 - DNA, 11 bp, Homo sapiens
atgtgtgtgca

SEQ ID NO: 896689 - DNA, 12 bp, Homo sapiens
acatgtttcaga

SEQ ID NO: 896690 - DNA, 11 bp, Homo sapiens
acatgtttcct

SEQ ID NO: 896691 - DNA, 22 bp, Homo sapiens
acatgtttctgttttgttgttt

SEQ ID NO: 896692 - DNA, 18 bp, Homo sapiens
acatgtttttatatgtct

SEQ ID NO: 896693 - DNA, 13 bp, Homo sapiens
acatgtttttcta

SEQ ID NO: 896694 - DNA, 17 bp, Homo sapiens
acatgttttttcatttg

SEQ ID NO: 896695 - DNA, 22 bp, Homo sapiens
acattaaaacaatattgtttct

SEQ ID NO: 896696 - DNA, 22 bp, Homo sapiens
acattaaaactcataattattt

SEQ ID NO: 896697 - DNA, 20 bp, Homo sapiens
acattaaaatatagagacag

SEQ ID NO: 896698 - DNA, 19 bp, Homo sapiens
acattaaagccctgtgtta

SEQ ID NO: 896699 - DNA, 15 bp, Homo sapiens
acattaaagttaata

SEQ ID NO: 896700 - DNA, 12 bp, Homo sapiens
acattaaataat

SEQ ID NO: 896701 - DNA, 20 bp, Homo sapiens
acattaaatgcaataatttt

SEQ ID NO: 896702 - DNA, 21 bp, Homo sapiens
acattaaatgtggaaggaaaa

SEQ ID NO: 896703 - DNA, 12 bp, Homo sapiens
acattaacagtt

SEQ ID NO: 896704 - DNA, 20 bp, Homo sapiens
acattaacagttttccatga

SEQ ID NO: 896705 - DNA, 18 bp, Homo sapiens
acattaacggtgctaaaa

SEQ ID NO: 896706 - DNA, 15 bp, Homo sapiens
acattaactcattag

SEQ ID NO: 896707 - DNA, 16 bp, Homo sapiens
acattaactccctcca

SEQ ID NO: 896708 - DNA, 20 bp, Homo sapiens
acattaactccctccaccag

SEQ ID NO: 896709 - DNA, 13 bp, Homo sapiens
acattaagaaaat

SEQ ID NO: 896710 - DNA, 17 bp, Homo sapiens
acattaagaaaatcata

SEQ ID NO: 896711 - DNA, 20 bp, Homo sapiens
acattaagattgaggcctgc

SEQ ID NO: 896712 - DNA, 16 bp, Homo sapiens
acattaagtaaatgct

SEQ ID NO: 896713 - DNA, 17 bp, Homo sapiens
acattaatcaccaaagt

SEQ ID NO: 896714 - DNA, 15 bp, Homo sapiens
acattaatgcccagc

SEQ ID NO: 896715 - DNA, 18 bp, Homo sapiens
acattaatgcccagccag

SEQ ID NO: 896716 - DNA, 14 bp, Homo sapiens
accaaagtctgccg

SEQ ID NO: 896717 - DNA, 22 bp, Homo sapiens
accaaagtctgccgcccacctc

SEQ ID NO: 896718 - DNA, 18 bp, Homo sapiens
accaaatagtgtgaaata

SEQ ID NO: 896719 - DNA, 15 bp, Homo sapiens
accaaatattaaaga

SEQ ID NO: 896720 - DNA, 17 bp, Homo sapiens
accaaatattaaagatt

SEQ ID NO: 896721 - DNA, 19 bp, Homo sapiens
accaaatcagctgctacta

SEQ ID NO: 896722 - DNA, 17 bp, Homo sapiens
accaaatcatcctgaat

SEQ ID NO: 896723 - DNA, 15 bp, Homo sapiens
accaaatctggaagc

SEQ ID NO: 896724 - DNA, 19 bp, Homo sapiens
accaaatggccagttttct

SEQ ID NO: 896725 - DNA, 15 bp, Homo sapiens
accaaattgcttcta

SEQ ID NO: 896726 - DNA, 14 bp, Homo sapiens
accaaattttaaaa

SEQ ID NO: 896727 - DNA, 16 bp, Homo sapiens
accaacaaaatccatg

SEQ ID NO: 896728 - DNA, 15 bp, Homo sapiens
accaacagcttttcc

SEQ ID NO: 896729 - DNA, 21 bp, Homo sapiens
accaacataaaacaaaaccaa

SEQ ID NO: 896730 - DNA, 13 bp, Homo sapiens
accaacatctttg

SEQ ID NO: 896731 - DNA, 14 bp, Homo sapiens
accaacatctttgc

SEQ ID NO: 896732 - DNA, 16 bp, Homo sapiens
accaacatggagaaac

SEQ ID NO: 896733 - DNA, 23 bp, Homo sapiens
accaacatggagaaaccctgtct

SEQ ID NO: 896734 - DNA, 13 bp, Homo sapiens
accaaccacagca

SEQ ID NO: 896735 - DNA, 13 bp, Homo sapiens
accaaccagcagg

SEQ ID NO: 896736 - DNA, 22 bp, Homo sapiens
accaacccatcagaaggagaag

SEQ ID NO: 896737 - DNA, 20 bp, Homo sapiens
accaaccccgcggcccagac

SEQ ID NO: 896738 - DNA, 13 bp, Homo sapiens
accaaccctggga

SEQ ID NO: 896739 - DNA, 15 bp, Homo sapiens
accaacctgctctgt

SEQ ID NO: 896740 - DNA, 15 bp, Homo sapiens
accaactctgcactc

SEQ ID NO: 896741 - DNA, 22 bp, Homo sapiens
accaactctgcactccatggcc

SEQ ID NO: 896742 - DNA, 15 bp, Homo sapiens
accaactgcacaatc

SEQ ID NO: 896743 - DNA, 16 bp, Homo sapiens
accaactgcacaatca

SEQ ID NO: 896744 - DNA, 19 bp, Homo sapiens
accaactgcacaatcagtt

SEQ ID NO: 896745 - DNA, 14 bp, Homo sapiens
accaactggcttct

SEQ ID NO: 896746 - DNA, 16 bp, Homo sapiens
accaactgtgttgtat

SEQ ID NO: 896747 - DNA, 22 bp, Homo sapiens
accaactgtgttgtattaacaa

SEQ ID NO: 896748 - DNA, 23 bp, Homo sapiens
accaactgtgttgtattaacaaa

SEQ ID NO: 896749 - DNA, 18 bp, Homo sapiens
accaactttctgtaaact

SEQ ID NO: 896750 - DNA, 14 bp, Homo sapiens
accaagaaagcagg

SEQ ID NO: 896751 - DNA, 15 bp, Homo sapiens
accaagacagtgctg

SEQ ID NO: 896752 - DNA, 15 bp, Homo sapiens
accaagagagaaaga

SEQ ID NO: 896753 - DNA, 18 bp, Homo sapiens
accaagaggatttcttca

SEQ ID NO: 896754 - DNA, 14 bp, Homo sapiens
accaagaggctggt

SEQ ID NO: 896755 - DNA, 18 bp, Homo sapiens
accaagattttgaaggaa

SEQ ID NO: 896756 - DNA, 17 bp, Homo sapiens
accaagcacagcagcct

SEQ ID NO: 896757 - DNA, 9 bp, Homo sapiens
accaagcag

SEQ ID NO: 896758 - DNA, 13 bp, Homo sapiens
accaagcaggaaa

SEQ ID NO: 896759 - DNA, 20 bp, Homo sapiens
accaagccaagggaacctgt

SEQ ID NO: 896760 - DNA, 14 bp, Homo sapiens
accaagccgtggct

SEQ ID NO: 896761 - DNA, 21 bp, Homo sapiens
accaagcggctcaagaataaa

SEQ ID NO: 896762 - DNA, 19 bp, Homo sapiens
accaagctattcctttccc

SEQ ID NO: 896763 - DNA, 17 bp, Homo sapiens
accaagctcacagttcc

SEQ ID NO: 896764 - DNA, 19 bp, Homo sapiens
accaagctcacagttcctc

SEQ ID NO: 896765 - DNA, 18 bp, Homo sapiens
accaagctgagtttccta

SEQ ID NO: 896766 - DNA, 20 bp, Homo sapiens
accaagctgtacccttgaga

SEQ ID NO: 896767 - DNA, 20 bp, Homo sapiens
accaaggaaacgctacctct

SEQ ID NO: 896768 - DNA, 13 bp, Homo sapiens
accaaggaaggag

SEQ ID NO: 896769 - DNA, 16 bp, Homo sapiens
accaaggaaggagccc

SEQ ID NO: 896770 - DNA, 17 bp, Homo sapiens
accaaggaaggagcccc

SEQ ID NO: 896771 - DNA, 13 bp, Homo sapiens
accaaggacccct

SEQ ID NO: 896772 - DNA, 14 bp, Homo sapiens
accaaggaggggcc

SEQ ID NO: 896773 - DNA, 21 bp, Homo sapiens
accaaggatcggactctgccc

SEQ ID NO: 896774 - DNA, 22 bp, Homo sapiens
accaaggatgaattctttcaat

SEQ ID NO: 896775 - DNA, 20 bp, Homo sapiens
accaaggcaaggcaggtgcc

SEQ ID NO: 896776 - DNA, 15 bp, Homo sapiens
accaaggcagcctcc

SEQ ID NO: 896777 - DNA, 17 bp, Homo sapiens
accaaggcagcctccag

SEQ ID NO: 896778 - DNA, 20 bp, Homo sapiens
accaaggcagcctccagagc

SEQ ID NO: 896779 - DNA, 22 bp, Homo sapiens
accaaggcagcctccagagcca

SEQ ID NO: 896780 - DNA, 23 bp, Homo sapiens
accaaggcagcctccagagccag

SEQ ID NO: 896781 - DNA, 18 bp, Homo sapiens
accaaggcagtgcatgca

SEQ ID NO: 896782 - DNA, 21 bp, Homo sapiens
accaaggctgagacagtgaat

SEQ ID NO: 896783 - DNA, 15 bp, Homo sapiens
accaagggacaggag

SEQ ID NO: 896784 - DNA, 13 bp, Homo sapiens
accaagggggcgg

SEQ ID NO: 896785 - DNA, 19 bp, Homo sapiens
accaaggtcttcagccatc

SEQ ID NO: 896786 - DNA, 14 bp, Homo sapiens
accaagtcaggcca

SEQ ID NO: 896787 - DNA, 13 bp, Homo sapiens
accaagtgcaata

SEQ ID NO: 896788 - DNA, 15 bp, Homo sapiens
accaagtgggctggt

SEQ ID NO: 896789 - DNA, 23 bp, Homo sapiens
accaagtgggctggtattctctc

SEQ ID NO: 896790 - DNA, 23 bp, Homo sapiens
accaagtgtgctctttttttaaa

SEQ ID NO: 896791 - DNA, 20 bp, Homo sapiens
accaagttgtgcttttctgt

SEQ ID NO: 896792 - DNA, 21 bp, Homo sapiens
accaagttgtgcttttctgtt

SEQ ID NO: 896793 - DNA, 14 bp, Homo sapiens
accaataaactgag

SEQ ID NO: 896794 - DNA, 15 bp, Homo sapiens
accaataaatgtttg

SEQ ID NO: 896795 - DNA, 19 bp, Homo sapiens
accaataaatgtttgttat

SEQ ID NO: 896796 - DNA, 24 bp, Homo sapiens
accaataacaaggagctcaccctg

SEQ ID NO: 896797 - DNA, 23 bp, Homo sapiens
accaatagggctgagctctctgt

SEQ ID NO: 896798 - DNA, 14 bp, Homo sapiens
accaatattgtaca

SEQ ID NO: 896799 - DNA, 14 bp, Homo sapiens
accaatccccagcc

SEQ ID NO: 896800 - DNA, 18 bp, Homo sapiens
accaatcccgtgaaagaa

SEQ ID NO: 896801 - DNA, 23 bp, Homo sapiens
accaatcccgtgaaagaattatt

SEQ ID NO: 896802 - DNA, 13 bp, Homo sapiens
accaatgagcctt

SEQ ID NO: 896803 - DNA, 14 bp, Homo sapiens
accaatgagcctta

SEQ ID NO: 896804 - DNA, 18 bp, Homo sapiens
accaatgcatctctttaa

SEQ ID NO: 896805 - DNA, 18 bp, Homo sapiens
accaatgcatgcagccac

SEQ ID NO: 896806 - DNA, 22 bp, Homo sapiens
accaatgcatgcagccactgtg

SEQ ID NO: 896807 - DNA, 13 bp, Homo sapiens
accaatgcctttt

SEQ ID NO: 896808 - DNA, 15 bp, Homo sapiens
accaatgccttttta

SEQ ID NO: 896809 - DNA, 13 bp, Homo sapiens
accaatgtcttga

SEQ ID NO: 896810 - DNA, 19 bp, Homo sapiens
accaatgtgttttctgtag

SEQ ID NO: 896811 - DNA, 15 bp, Homo sapiens
accaatgttctctct

SEQ ID NO: 896812 - DNA, 17 bp, Homo sapiens
accaattccaccaagac

SEQ ID NO: 896813 - DNA, 15 bp, Homo sapiens
accaattgatgtttt

SEQ ID NO: 896814 - DNA, 16 bp, Homo sapiens
accaattggttaatct

SEQ ID NO: 896815 - DNA, 17 bp, Homo sapiens
accaattgtgctgccat

SEQ ID NO: 896816 - DNA, 15 bp, Homo sapiens
accaatttcttcctt

SEQ ID NO: 896817 - DNA, 21 bp, Homo sapiens
accaatttggtaaaaatgctg

SEQ ID NO: 896818 - DNA, 14 bp, Homo sapiens
accacaaaaattga

SEQ ID NO: 896819 - DNA, 20 bp, Homo sapiens
accacaaacggagcccctga

SEQ ID NO: 896820 - DNA, 21 bp, Homo sapiens
accacaagctgagcaggacag

SEQ ID NO: 896821 - DNA, 18 bp, Homo sapiens
accacaatgtttcttcat

SEQ ID NO: 896822 - DNA, 17 bp, Homo sapiens
accacacccaggtctct

SEQ ID NO: 896823 - DNA, 18 bp, Homo sapiens
accacacccgaagtcctg

SEQ ID NO: 896824 - DNA, 16 bp, Homo sapiens
accacaccgcagaagc

SEQ ID NO: 896825 - DNA, 22 bp, Homo sapiens
atgttttgtgcatttgtaaatg

SEQ ID NO: 896826 - DNA, 13 bp, Homo sapiens
atgttttgttcaa

SEQ ID NO: 896827 - DNA, 18 bp, Homo sapiens
atgtttttaaaagtttca

SEQ ID NO: 896828 - DNA, 21 bp, Homo sapiens
atgtttttacattatgcaaat

SEQ ID NO: 896829 - DNA, 15 bp, Homo sapiens
atgtttttactttat

SEQ ID NO: 896830 - DNA, 16 bp, Homo sapiens
atgtttttatatgtct

SEQ ID NO: 896831 - DNA, 15 bp, Homo sapiens
atgtttttcatgaaa

SEQ ID NO: 896832 - DNA, 15 bp, Homo sapiens
atgtttttccctccc

SEQ ID NO: 896833 - DNA, 17 bp, Homo sapiens
atgtttttccctcccca

SEQ ID NO: 896834 - DNA, 21 bp, Homo sapiens
atgtttttctgccagggagct

SEQ ID NO: 896835 - DNA, 22 bp, Homo sapiens
atgtttttgatcaaaaactatt

SEQ ID NO: 896836 - DNA, 13 bp, Homo sapiens
atgtttttgccaa

SEQ ID NO: 896837 - DNA, 14 bp, Homo sapiens
atgtttttgccaaa

SEQ ID NO: 896838 - DNA, 21 bp, Homo sapiens
accacttatttattgttgcct

SEQ ID NO: 896839 - DNA, 16 bp, Homo sapiens
accacttccagagcca

SEQ ID NO: 896840 - DNA, 13 bp, Homo sapiens
accacttctctgc

SEQ ID NO: 896841 - DNA, 15 bp, Homo sapiens
accacttctctgctg

SEQ ID NO: 896842 - DNA, 20 bp, Homo sapiens
accacttctctgctgcctct

SEQ ID NO: 896843 - DNA, 16 bp, Homo sapiens
accacttctgtgggca

SEQ ID NO: 896844 - DNA, 16 bp, Homo sapiens
accacttgaatttatt

SEQ ID NO: 896845 - DNA, 16 bp, Homo sapiens
accacttgcctggggc

SEQ ID NO: 896846 - DNA, 15 bp, Homo sapiens
accacttttgttctt

SEQ ID NO: 896847 - DNA, 13 bp, Homo sapiens
accagaaaagcaa

SEQ ID NO: 896848 - DNA, 15 bp, Homo sapiens
accagaaacacccct

SEQ ID NO: 896849 - DNA, 13 bp, Homo sapiens
accagaacaaggt

SEQ ID NO: 896850 - DNA, 19 bp, Homo sapiens
accagaacgcaccccactg

SEQ ID NO: 896851 - DNA, 21 bp, Homo sapiens
accagaacgtggtttgcctga

SEQ ID NO: 896852 - DNA, 14 bp, Homo sapiens
accagaagccaaag

SEQ ID NO: 896853 - DNA, 15 bp, Homo sapiens
accagaagccttgga

SEQ ID NO: 896854 - DNA, 15 bp, Homo sapiens
accagaagggcttca

SEQ ID NO: 896855 - DNA, 21 bp, Homo sapiens
accagacaaaaaaatttaaaa

SEQ ID NO: 896856 - DNA, 15 bp, Homo sapiens
accagacggggctgg

SEQ ID NO: 896857 - DNA, 15 bp, Homo sapiens
accagactcttgcct

SEQ ID NO: 896858 - DNA, 16 bp, Homo sapiens
accagactcttgcctg

SEQ ID NO: 896859 - DNA, 13 bp, Homo sapiens
accagactgtgga

SEQ ID NO: 896860 - DNA, 20 bp, Homo sapiens
accagactgtggagaaataa

SEQ ID NO: 896861 - DNA, 21 bp, Homo sapiens
accagacttggcctccagctg

SEQ ID NO: 896862 - DNA, 16 bp, Homo sapiens
accagactttgagcct

SEQ ID NO: 896863 - DNA, 12 bp, Homo sapiens
accagagaatct

SEQ ID NO: 896864 - DNA, 15 bp, Homo sapiens
accagagagagttgt

SEQ ID NO: 896865 - DNA, 20 bp, Homo sapiens
accagagcatttccaacacc

SEQ ID NO: 896866 - DNA, 20 bp, Homo sapiens
accagagccccacacggagg

SEQ ID NO: 896867 - DNA, 15 bp, Homo sapiens
accagagctgtctga

SEQ ID NO: 896868 - DNA, 14 bp, Homo sapiens
accagagggcatgc

SEQ ID NO: 896869 - DNA, 16 bp, Homo sapiens
accagagggtgtggct

SEQ ID NO: 896870 - DNA, 15 bp, Homo sapiens
accagagtcacccag

SEQ ID NO: 896871 - DNA, 17 bp, Homo sapiens
accagagttaaagcata

SEQ ID NO: 896872 - DNA, 19 bp, Homo sapiens
accagataaatagaactat

SEQ ID NO: 896873 - DNA, 23 bp, Homo sapiens
accagataaatagaactatctgc

SEQ ID NO: 896874 - DNA, 14 bp, Homo sapiens
accagatattttgt

SEQ ID NO: 896875 - DNA, 22 bp, Homo sapiens
accagatctttctcttccctga

SEQ ID NO: 896876 - DNA, 17 bp, Homo sapiens
accagatgaacatttca

SEQ ID NO: 896877 - DNA, 13 bp, Homo sapiens
accagatgagaat

SEQ ID NO: 896878 - DNA, 20 bp, Homo sapiens
accagattctatcctcatct

SEQ ID NO: 896879 - DNA, 14 bp, Homo sapiens
accagcaacatctc

SEQ ID NO: 896880 - DNA, 23 bp, Homo sapiens
accagcaacatctcgagccccct

SEQ ID NO: 896881 - DNA, 16 bp, Homo sapiens
accagcaagtcccaga

SEQ ID NO: 896882 - DNA, 20 bp, Homo sapiens
accagcaagtcccagacaag

SEQ ID NO: 896883 - DNA, 17 bp, Homo sapiens
accagcaatatgtaaat

SEQ ID NO: 896884 - DNA, 13 bp, Homo sapiens
accagcactcagc

SEQ ID NO: 896885 - DNA, 17 bp, Homo sapiens
accagcactcagcctca

SEQ ID NO: 896886 - DNA, 19 bp, Homo sapiens
accagcagaaatgccccca

SEQ ID NO: 896887 - DNA, 12 bp, Homo sapiens
accagcagcaca

SEQ ID NO: 896888 - DNA, 14 bp, Homo sapiens
accagcagcacaat

SEQ ID NO: 896889 - DNA, 22 bp, Homo sapiens
accagcagcacaattctgtccc

SEQ ID NO: 896890 - DNA, 22 bp, Homo sapiens
accagcaggaggttctgggcct

SEQ ID NO: 896891 - DNA, 12 bp, Homo sapiens
accagcaggtgt

SEQ ID NO: 896892 - DNA, 21 bp, Homo sapiens
accagcaggtgtggtggctca

SEQ ID NO: 896893 - DNA, 22 bp, Homo sapiens
accagcaggtgtggtggctcat

SEQ ID NO: 896894 - DNA, 16 bp, Homo sapiens
accagcattccctaca

SEQ ID NO: 896895 - DNA, 14 bp, Homo sapiens
accagcatttgtcc

SEQ ID NO: 896896 - DNA, 17 bp, Homo sapiens
accagccagccctggcc

SEQ ID NO: 896897 - DNA, 20 bp, Homo sapiens
accagcccagcctgccccct

SEQ ID NO: 896898 - DNA, 21 bp, Homo sapiens
accagccccactgccagcagc

SEQ ID NO: 896899 - DNA, 20 bp, Homo sapiens
accagccccacttctgggtc

SEQ ID NO: 896900 - DNA, 14 bp, Homo sapiens
accagccccagcaa

SEQ ID NO: 896901 - DNA, 17 bp, Homo sapiens
accagccccagcaagag

SEQ ID NO: 896902 - DNA, 18 bp, Homo sapiens
accagccccagcaagagc

SEQ ID NO: 896903 - DNA, 21 bp, Homo sapiens
accagcccccgccccagagtg

SEQ ID NO: 896904 - DNA, 21 bp, Homo sapiens
accagccccctggatgggcat

SEQ ID NO: 896905 - DNA, 21 bp, Homo sapiens
accagcccgacagtgccatcc

SEQ ID NO: 896906 - DNA, 15 bp, Homo sapiens
accagcccggcctgc

SEQ ID NO: 896907 - DNA, 17 bp, Homo sapiens
accagccctactcctgc

SEQ ID NO: 896908 - DNA, 18 bp, Homo sapiens
accagccctactcctgcg

SEQ ID NO: 896909 - DNA, 17 bp, Homo sapiens
accagccgccccagccc

SEQ ID NO: 896910 - DNA, 21 bp, Homo sapiens
accagcctagcctggctctgc

SEQ ID NO: 896911 - DNA, 19 bp, Homo sapiens
accagcctccatgctgcct

SEQ ID NO: 896912 - DNA, 20 bp, Homo sapiens
accagcctccatgctgcctc

SEQ ID NO: 896913 - DNA, 15 bp, Homo sapiens
accagcctgctgaca

SEQ ID NO: 896914 - DNA, 20 bp, Homo sapiens
accagcctggtcaacatggt

SEQ ID NO: 896915 - DNA, 14 bp, Homo sapiens
accagcctgttgga

SEQ ID NO: 896916 - DNA, 22 bp, Homo sapiens
accagccttcctgtgggcccct

SEQ ID NO: 896917 - DNA, 13 bp, Homo sapiens
accagcctttggg

SEQ ID NO: 896918 - DNA, 19 bp, Homo sapiens
accagcgccaaatgttcat

SEQ ID NO: 896919 - DNA, 15 bp, Homo sapiens
accagcgcccgctgg

SEQ ID NO: 896920 - DNA, 22 bp, Homo sapiens
accagcgtgtgactactccccc

SEQ ID NO: 896921 - DNA, 22 bp, Homo sapiens
accagcgttcccttctccccct

SEQ ID NO: 896922 - DNA, 23 bp, Homo sapiens
accagcgttcccttctccccctt

SEQ ID NO: 896923 - DNA, 23 bp, Homo sapiens
accagctaagaaaagattttaat

SEQ ID NO: 896924 - DNA, 15 bp, Homo sapiens
accagctatctgtca

SEQ ID NO: 896925 - DNA, 12 bp, Homo sapiens
accagctcaggg

SEQ ID NO: 896926 - DNA, 14 bp, Homo sapiens
accagctcatctcc

SEQ ID NO: 896927 - DNA, 12 bp, Homo sapiens
accagctcccag

SEQ ID NO: 896928 - DNA, 13 bp, Homo sapiens
accagctcccagg

SEQ ID NO: 896929 - DNA, 12 bp, Homo sapiens
accagctcctcc

SEQ ID NO: 896930 - DNA, 14 bp, Homo sapiens
accagctcctccag

SEQ ID NO: 896931 - DNA, 16 bp, Homo sapiens
accagctcctccagcc

SEQ ID NO: 896932 - DNA, 14 bp, Homo sapiens
accagctcctccct

SEQ ID NO: 896933 - DNA, 16 bp, Homo sapiens
accagctctgtggcct

SEQ ID NO: 896934 - DNA, 23 bp, Homo sapiens
accagctctgtggcctgtgtcca

SEQ ID NO: 896935 - DNA, 20 bp, Homo sapiens
accagctgaaagttgggact

SEQ ID NO: 896936 - DNA, 17 bp, Homo sapiens
accagctgctctgcccc

SEQ ID NO: 896937 - DNA, 18 bp, Homo sapiens
accagctgctctgcccct

SEQ ID NO: 896938 - DNA, 20 bp, Homo sapiens
accagctggggcgtggggag

SEQ ID NO: 896939 - DNA, 23 bp, Homo sapiens
accagctggggcgtggggagggc

SEQ ID NO: 896940 - DNA, 17 bp, Homo sapiens
accagctgtaacacagc

SEQ ID NO: 896941 - DNA, 20 bp, Homo sapiens
accagcttctccaggctctt

SEQ ID NO: 896942 - DNA, 20 bp, Homo sapiens
accaggaaagccacacggag

SEQ ID NO: 896943 - DNA, 13 bp, Homo sapiens
accaggaacagca

SEQ ID NO: 896944 - DNA, 14 bp, Homo sapiens
accaggacccaggg

SEQ ID NO: 896945 - DNA, 16 bp, Homo sapiens
accaggacccagggtc

SEQ ID NO: 896946 - DNA, 12 bp, Homo sapiens
accaggaccctg

SEQ ID NO: 896947 - DNA, 21 bp, Homo sapiens
accaggactatagcccaggtc

SEQ ID NO: 896948 - DNA, 17 bp, Homo sapiens
accaggactccctcctc

SEQ ID NO: 896949 - DNA, 14 bp, Homo sapiens
accaggagaaccac

SEQ ID NO: 896950 - DNA, 20 bp, Homo sapiens
accaggagaaccactacatg

SEQ ID NO: 896951 - DNA, 15 bp, Homo sapiens
accaggagcacctgg

SEQ ID NO: 896952 - DNA, 17 bp, Homo sapiens
accaggagcagcagcca

SEQ ID NO: 896953 - DNA, 19 bp, Homo sapiens
accaggagcagcagccagc

SEQ ID NO: 896954 - DNA, 20 bp, Homo sapiens
accaggagctgatggcagct

SEQ ID NO: 896955 - DNA, 17 bp, Homo sapiens
accaggagtccctggta

SEQ ID NO: 896956 - DNA, 22 bp, Homo sapiens
accaggagtccctggtaataag

SEQ ID NO: 896957 - DNA, 20 bp, Homo sapiens
accaggcaccaaaagaagta

SEQ ID NO: 896958 - DNA, 13 bp, Homo sapiens
attacatagatca

SEQ ID NO: 896959 - DNA, 19 bp, Homo sapiens
attacatagatcagccatt

SEQ ID NO: 896960 - DNA, 19 bp, Homo sapiens
attatctatagctaagtac

SEQ ID NO: 896961 - DNA, 21 bp, Homo sapiens
attatctatggaaatgtgaga

SEQ ID NO: 896962 - DNA, 20 bp, Homo sapiens
attatctctttgatctactt

SEQ ID NO: 896963 - DNA, 17 bp, Homo sapiens
attatctgattccttta

SEQ ID NO: 896964 - DNA, 14 bp, Homo sapiens
attatcttatgaaa

SEQ ID NO: 896965 - DNA, 15 bp, Homo sapiens
attatcttatgaaaa

SEQ ID NO: 896966 - DNA, 23 bp, Homo sapiens
accatctgtttgaagattatatg

SEQ ID NO: 896967 - DNA, 20 bp, Homo sapiens
accatctttgccaacatggt

SEQ ID NO: 896968 - DNA, 20 bp, Homo sapiens
accatcttttattctttttt

SEQ ID NO: 896969 - DNA, 21 bp, Homo sapiens
accatcttttcctcattttca

SEQ ID NO: 896970 - DNA, 19 bp, Homo sapiens
accatgaaagacttctcta

SEQ ID NO: 896971 - DNA, 18 bp, Homo sapiens
accatgaacagaaaacat

SEQ ID NO: 896972 - DNA, 18 bp, Homo sapiens
accatgaagtaaattatg

SEQ ID NO: 896973 - DNA, 18 bp, Homo sapiens
accatgaccccttctctc

SEQ ID NO: 896974 - DNA, 16 bp, Homo sapiens
accatgactgtgacca

SEQ ID NO: 896975 - DNA, 23 bp, Homo sapiens
accatgagaataagagaaagaaa

SEQ ID NO: 896976 - DNA, 20 bp, Homo sapiens
accatgagcacctccagctg

SEQ ID NO: 896977 - DNA, 22 bp, Homo sapiens
accatgattaaccacttcagct

SEQ ID NO: 896978 - DNA, 16 bp, Homo sapiens
accatgcaaatgctat

SEQ ID NO: 896979 - DNA, 21 bp, Homo sapiens
accatgcaaatgtcttccagg

SEQ ID NO: 896980 - DNA, 19 bp, Homo sapiens
accatgcactatatttgta

SEQ ID NO: 896981 - DNA, 20 bp, Homo sapiens
accatgcccagctagttttt

SEQ ID NO: 896982 - DNA, 17 bp, Homo sapiens
accatgcctcactaatt

SEQ ID NO: 896983 - DNA, 19 bp, Homo sapiens
accatgcctcactaatttt

SEQ ID NO: 896984 - DNA, 20 bp, Homo sapiens
accatgcctcactaattttt

SEQ ID NO: 896985 - DNA, 17 bp, Homo sapiens
accatgcctcccagagc

SEQ ID NO: 896986 - DNA, 19 bp, Homo sapiens
accatgcctggtattttca

SEQ ID NO: 896987 - DNA, 20 bp, Homo sapiens
accatgcgtcaggggcctag

SEQ ID NO: 896988 - DNA, 22 bp, Homo sapiens
accatgctcaatgaaaaggtga

SEQ ID NO: 896989 - DNA, 21 bp, Homo sapiens
accatgctgctttttggcaca

SEQ ID NO: 896990 - DNA, 17 bp, Homo sapiens
accatgctggtatatgg

SEQ ID NO: 896991 - DNA, 16 bp, Homo sapiens
accatggagacaagaa

SEQ ID NO: 896992 - DNA, 23 bp, Homo sapiens
accatggctgaaggaaaccagtg

SEQ ID NO: 896993 - DNA, 20 bp, Homo sapiens
accatgggaccaggtcttgg

SEQ ID NO: 896994 - DNA, 20 bp, Homo sapiens
accatggggaagaaatctgg

SEQ ID NO: 896995 - DNA, 21 bp, Homo sapiens
accatgtaagcactctggatg

SEQ ID NO: 896996 - DNA, 13 bp, Homo sapiens
accatgtcactgt

SEQ ID NO: 896997 - DNA, 15 bp, Homo sapiens
accatgtcagcaaaa

SEQ ID NO: 896998 - DNA, 21 bp, Homo sapiens
accatgtcagcaaaaagcaaa

SEQ ID NO: 896999 - DNA, 22 bp, Homo sapiens
accatgtcagcaaaaagcaaaa

SEQ ID NO: 897000 - DNA, 19 bp, Homo sapiens
accatgtctctaagccaac

SEQ ID NO: 897001 - DNA, 19 bp, Homo sapiens
accatgtgtcacttgtgct

SEQ ID NO: 897002 - DNA, 19 bp, Homo sapiens
accatgttggccaggctgg

SEQ ID NO: 897003 - DNA, 13 bp, Homo sapiens
accattaaaactg

SEQ ID NO: 897004 - DNA, 13 bp, Homo sapiens
accattaattaca

SEQ ID NO: 897005 - DNA, 16 bp, Homo sapiens
accattaattacatac

SEQ ID NO: 897006 - DNA, 21 bp, Homo sapiens
accattataaccttaatttat

SEQ ID NO: 897007 - DNA, 18 bp, Homo sapiens
accattatttaatttgta

SEQ ID NO: 897008 - DNA, 14 bp, Homo sapiens
accattcaattagt

SEQ ID NO: 897009 - DNA, 19 bp, Homo sapiens
accattcacatttgatgta

SEQ ID NO: 897010 - DNA, 22 bp, Homo sapiens
accattcacatttgatgtacat

SEQ ID NO: 897011 - DNA, 15 bp, Homo sapiens
accattccccatggg

SEQ ID NO: 897012 - DNA, 21 bp, Homo sapiens
accattcctgcctttaagcca

SEQ ID NO: 897013 - DNA, 22 bp, Homo sapiens
accattccttcaaataaagaaa

SEQ ID NO: 897014 - DNA, 15 bp, Homo sapiens
accattctcctgcct

SEQ ID NO: 897015 - DNA, 24 bp, Homo sapiens
accattctgactcggtttctccaa

SEQ ID NO: 897016 - DNA, 17 bp, Homo sapiens
accattgacctcagctg

SEQ ID NO: 897017 - DNA, 19 bp, Homo sapiens
accattgacctcagctgca

SEQ ID NO: 897018 - DNA, 22 bp, Homo sapiens
accattgacctcagctgcacat

SEQ ID NO: 897019 - DNA, 21 bp, Homo sapiens
accattgctcttagtcccaag

SEQ ID NO: 897020 - DNA, 21 bp, Homo sapiens
accattgcttcactacccatc

SEQ ID NO: 897021 - DNA, 15 bp, Homo sapiens
accattggacagatt

SEQ ID NO: 897022 - DNA, 20 bp, Homo sapiens
accattggacagatttcagt

SEQ ID NO: 897023 - DNA, 21 bp, Homo sapiens
accattggacagatttcagta

SEQ ID NO: 897024 - DNA, 23 bp, Homo sapiens
accattgtaatattaactaaata

SEQ ID NO: 897025 - DNA, 20 bp, Homo sapiens
accattgtattttgtttgtg

SEQ ID NO: 897026 - DNA, 18 bp, Homo sapiens
accattgtgaagcaccta

SEQ ID NO: 897027 - DNA, 20 bp, Homo sapiens
accattgttctgaatgctgc

SEQ ID NO: 897028 - DNA, 21 bp, Homo sapiens
accattgttctgaatgctgct

SEQ ID NO: 897029 - DNA, 13 bp, Homo sapiens
accatttaaaaat

SEQ ID NO: 897030 - DNA, 20 bp, Homo sapiens
accatttaaagaaagaatgc

SEQ ID NO: 897031 - DNA, 15 bp, Homo sapiens
accatttaataaaga

SEQ ID NO: 897032 - DNA, 18 bp, Homo sapiens
accatttaataaagaaat

SEQ ID NO: 897033 - DNA, 13 bp, Homo sapiens
accatttatacaa

SEQ ID NO: 897034 - DNA, 16 bp, Homo sapiens
accatttatacaaatt

SEQ ID NO: 897035 - DNA, 19 bp, Homo sapiens
accatttatacaaattaga

SEQ ID NO: 897036 - DNA, 22 bp, Homo sapiens
accatttcctcagcttatctct

SEQ ID NO: 897037 - DNA, 17 bp, Homo sapiens
accatttgggatggaga

SEQ ID NO: 897038 - DNA, 15 bp, Homo sapiens
accatttgtaataaa

SEQ ID NO: 897039 - DNA, 19 bp, Homo sapiens
accatttgtaataaagtat

SEQ ID NO: 897040 - DNA, 15 bp, Homo sapiens
accattttaaagtta

SEQ ID NO: 897041 - DNA, 11 bp, Homo sapiens
accattttaca

SEQ ID NO: 897042 - DNA, 22 bp, Homo sapiens
accattttattttttgggccat

SEQ ID NO: 897043 - DNA, 17 bp, Homo sapiens
accattttcccatcatc

SEQ ID NO: 897044 - DNA, 23 bp, Homo sapiens
accattttcccatcatcctttgt

SEQ ID NO: 897045 - DNA, 18 bp, Homo sapiens
acccaaaaactgtcttta

SEQ ID NO: 897046 - DNA, 18 bp, Homo sapiens
acccaaaaatatctcctc

SEQ ID NO: 897047 - DNA, 19 bp, Homo sapiens
acccaaaaatatctcctcc

SEQ ID NO: 897048 - DNA, 22 bp, Homo sapiens
acccaaaaatatctcctccaat

SEQ ID NO: 897049 - DNA, 23 bp, Homo sapiens
acccaaaaatatctcctccaatg

SEQ ID NO: 897050 - DNA, 12 bp, Homo sapiens
acccaaaacacg

SEQ ID NO: 897051 - DNA, 23 bp, Homo sapiens
acccaaaacacgcacaccctgcc

SEQ ID NO: 897052 - DNA, 23 bp, Homo sapiens
acccaaaagtcaaaaggtgcctg

SEQ ID NO: 897053 - DNA, 14 bp, Homo sapiens
acccaaacacttct

SEQ ID NO: 897054 - DNA, 17 bp, Homo sapiens
acccaaacacttctgct

SEQ ID NO: 897055 - DNA, 20 bp, Homo sapiens
acccaaacacttctgctttc

SEQ ID NO: 897056 - DNA, 13 bp, Homo sapiens
acccaaaccccca

SEQ ID NO: 897057 - DNA, 16 bp, Homo sapiens
acccaaaccccttccc

SEQ ID NO: 897058 - DNA, 17 bp, Homo sapiens
acccaaaccccttccca

SEQ ID NO: 897059 - DNA, 18 bp, Homo sapiens
acccaaagaggtatttat

SEQ ID NO: 897060 - DNA, 13 bp, Homo sapiens
acccaaagcagga

SEQ ID NO: 897061 - DNA, 20 bp, Homo sapiens
acccaaagcctgtcccagga

SEQ ID NO: 897062 - DNA, 22 bp, Homo sapiens
acccaaagcggtccctgtccct

SEQ ID NO: 897063 - DNA, 19 bp, Homo sapiens
acccaaatgtgtacacctg

SEQ ID NO: 897064 - DNA, 20 bp, Homo sapiens
acccaaattataagggccct

SEQ ID NO: 897065 - DNA, 21 bp, Homo sapiens
acccaaattataagggccctg

SEQ ID NO: 897066 - DNA, 22 bp, Homo sapiens
acccaacaggtgctgaactgtg

SEQ ID NO: 897067 - DNA, 13 bp, Homo sapiens
acccaacagttta

SEQ ID NO: 897068 - DNA, 20 bp, Homo sapiens
acccaaccctatctcctgac

SEQ ID NO: 897069 - DNA, 22 bp, Homo sapiens
acccaaccctatctcctgacag

SEQ ID NO: 897070 - DNA, 15 bp, Homo sapiens
acccaacggccctgc

SEQ ID NO: 897071 - DNA, 18 bp, Homo sapiens
acccaactgggggcaaag

SEQ ID NO: 897072 - DNA, 18 bp, Homo sapiens
acccaagaaaccaaagtc

SEQ ID NO: 897073 - DNA, 15 bp, Homo sapiens
acccaagccctcctt

SEQ ID NO: 897074 - DNA, 15 bp, Homo sapiens
acccaagcctgctgg

SEQ ID NO: 897075 - DNA, 18 bp, Homo sapiens
acccaagcttggcagccg

SEQ ID NO: 897076 - DNA, 22 bp, Homo sapiens
acccaagcttggcagccgagct

SEQ ID NO: 897077 - DNA, 15 bp, Homo sapiens
acccaaggagcacag

SEQ ID NO: 897078 - DNA, 14 bp, Homo sapiens
acccaagtgcctca

SEQ ID NO: 897079 - DNA, 15 bp, Homo sapiens
acccaatacttttgt

SEQ ID NO: 897080 - DNA, 12 bp, Homo sapiens
attcagatgtat

SEQ ID NO: 897081 - DNA, 19 bp, Homo sapiens
attcagattttaaaaagtc

SEQ ID NO: 897082 - DNA, 12 bp, Homo sapiens
attcagcacaca

SEQ ID NO: 897083 - DNA, 21 bp, Homo sapiens
attcagcaccctgggtgccat

SEQ ID NO: 897084 - DNA, 19 bp, Homo sapiens
attcagcactgatttcaca

SEQ ID NO: 897085 - DNA, 19 bp, Homo sapiens
attcagcagcaaattttca

SEQ ID NO: 897086 - DNA, 13 bp, Homo sapiens
attcagcagtttt

SEQ ID NO: 897087 - DNA, 14 bp, Homo sapiens
attcagcctgtttg

SEQ ID NO: 897088 - DNA, 12 bp, Homo sapiens
attcagccttct

SEQ ID NO: 897089 - DNA, 15 bp, Homo sapiens
attcagccttctttt

SEQ ID NO: 897090 - DNA, 21 bp, Homo sapiens
attcagccttctttttctgga

SEQ ID NO: 897091 - DNA, 19 bp, Homo sapiens
attcagctagaatttctgg

SEQ ID NO: 897092 - DNA, 15 bp, Homo sapiens
attcagctcagcttc

SEQ ID NO: 897093 - DNA, 23 bp, Homo sapiens
attcagctcattatgaaaaacat

SEQ ID NO: 897094 - DNA, 18 bp, Homo sapiens
attcagctctgcaagaat

SEQ ID NO: 897095 - DNA, 12 bp, Homo sapiens
attcagcttcat

SEQ ID NO: 897096 - DNA, 13 bp, Homo sapiens
acccagtcccaca

SEQ ID NO: 897097 - DNA, 15 bp, Homo sapiens
acccagtcccacact

SEQ ID NO: 897098 - DNA, 16 bp, Homo sapiens
acccagtcccacactg

SEQ ID NO: 897099 - DNA, 21 bp, Homo sapiens
acccagtccccgtgccccgcc

SEQ ID NO: 897100 - DNA, 13 bp, Homo sapiens
acccagtctcctc

SEQ ID NO: 897101 - DNA, 15 bp, Homo sapiens
acccagtctcctctc

SEQ ID NO: 897102 - DNA, 15 bp, Homo sapiens
acccagtcttgtgga

SEQ ID NO: 897103 - DNA, 13 bp, Homo sapiens
acccagtgctgcc

SEQ ID NO: 897104 - DNA, 21 bp, Homo sapiens
acccagtgctgccatgccact

SEQ ID NO: 897105 - DNA, 17 bp, Homo sapiens
acccagttgccatctgc

SEQ ID NO: 897106 - DNA, 19 bp, Homo sapiens
acccagttggtgactggga

SEQ ID NO: 897107 - DNA, 20 bp, Homo sapiens
acccagttggtgactgggaa

SEQ ID NO: 897108 - DNA, 13 bp, Homo sapiens
acccatacaatgt

SEQ ID NO: 897109 - DNA, 18 bp, Homo sapiens
acccatagatcttctgaa

SEQ ID NO: 897110 - DNA, 21 bp, Homo sapiens
acccatagatcttctgaaatg

SEQ ID NO: 897111 - DNA, 15 bp, Homo sapiens
acccatagcttccat

SEQ ID NO: 897112 - DNA, 14 bp, Homo sapiens
acccatcccttttc

SEQ ID NO: 897113 - DNA, 20 bp, Homo sapiens
acccatcctaccaatgcatg

SEQ ID NO: 897114 - DNA, 16 bp, Homo sapiens
acccatcgtccacccc

SEQ ID NO: 897115 - DNA, 19 bp, Homo sapiens
acccatctagtacttgaaa

SEQ ID NO: 897116 - DNA, 22 bp, Homo sapiens
acccatcttccacctcacctct

SEQ ID NO: 897117 - DNA, 16 bp, Homo sapiens
acccatcttccccgga

SEQ ID NO: 897118 - DNA, 16 bp, Homo sapiens
acccatcttcctgctg

SEQ ID NO: 897119 - DNA, 20 bp, Homo sapiens
acccatcttcctgctgctgt

SEQ ID NO: 897120 - DNA, 12 bp, Homo sapiens
acccatgaagat

SEQ ID NO: 897121 - DNA, 14 bp, Homo sapiens
acccatgaatcaaa

SEQ ID NO: 897122 - DNA, 17 bp, Homo sapiens
acccatgaatcaaagac

SEQ ID NO: 897123 - DNA, 13 bp, Homo sapiens
acccatgagcctg

SEQ ID NO: 897124 - DNA, 14 bp, Homo sapiens
acccatgagcctgc

SEQ ID NO: 897125 - DNA, 15 bp, Homo sapiens
acccatgagcctgcc

SEQ ID NO: 897126 - DNA, 18 bp, Homo sapiens
acccatgagcctgcccgc

SEQ ID NO: 897127 - DNA, 19 bp, Homo sapiens
acccatgagcctgcccgct

SEQ ID NO: 897128 - DNA, 22 bp, Homo sapiens
acccatggggaggagacctttg

SEQ ID NO: 897129 - DNA, 23 bp, Homo sapiens
acccatgtcaccggtcagtgcct

SEQ ID NO: 897130 - DNA, 22 bp, Homo sapiens
acccatgtgctgggaaatgcag

SEQ ID NO: 897131 - DNA, 13 bp, Homo sapiens
acccattcagaga

SEQ ID NO: 897132 - DNA, 17 bp, Homo sapiens
acccattccagtacagt

SEQ ID NO: 897133 - DNA, 19 bp, Homo sapiens
acccattcccccatgtggc

SEQ ID NO: 897134 - DNA, 22 bp, Homo sapiens
acccattcccccatgtggctga

SEQ ID NO: 897135 - DNA, 19 bp, Homo sapiens
acccattctacacagagca

SEQ ID NO: 897136 - DNA, 19 bp, Homo sapiens
acccattgttcccttcctc

SEQ ID NO: 897137 - DNA, 23 bp, Homo sapiens
acccatttaaatttttttcctta

SEQ ID NO: 897138 - DNA, 14 bp, Homo sapiens
acccattttcacat

SEQ ID NO: 897139 - DNA, 16 bp, Homo sapiens
accccaaaccccagcc

SEQ ID NO: 897140 - DNA, 22 bp, Homo sapiens
accccaaagagcctggagaagc

SEQ ID NO: 897141 - DNA, 16 bp, Homo sapiens
accccaaagccccttg

SEQ ID NO: 897142 - DNA, 15 bp, Homo sapiens
accccaaagctttcc

SEQ ID NO: 897143 - DNA, 15 bp, Homo sapiens
accccaacaaaccat

SEQ ID NO: 897144 - DNA, 15 bp, Homo sapiens
accccaactctcccc

SEQ ID NO: 897145 - DNA, 13 bp, Homo sapiens
accccaaggactg

SEQ ID NO: 897146 - DNA, 13 bp, Homo sapiens
accccaaggccag

SEQ ID NO: 897147 - DNA, 14 bp, Homo sapiens
accccaatccctgc

SEQ ID NO: 897148 - DNA, 18 bp, Homo sapiens
accccaatccctgccact

SEQ ID NO: 897149 - DNA, 20 bp, Homo sapiens
accccaatccctgccactgg

SEQ ID NO: 897150 - DNA, 22 bp, Homo sapiens
accccaatccctgccactgggc

SEQ ID NO: 897151 - DNA, 21 bp, Homo sapiens
accccaatttcggattttttc

SEQ ID NO: 897152 - DNA, 16 bp, Homo sapiens
accccacaccaggccg

SEQ ID NO: 897153 - DNA, 20 bp, Homo sapiens
accccacaccaggccgtcct

SEQ ID NO: 897154 - DNA, 22 bp, Homo sapiens
accccacaccaggccgtcctcc

SEQ ID NO: 897155 - DNA, 17 bp, Homo sapiens
accccacaccccagccc

SEQ ID NO: 897156 - DNA, 19 bp, Homo sapiens
accccacaccccagcccac

SEQ ID NO: 897157 - DNA, 21 bp, Homo sapiens
accccacacttgttccagctc

SEQ ID NO: 897158 - DNA, 23 bp, Homo sapiens
accccacatccttctcactgcca

SEQ ID NO: 897159 - DNA, 13 bp, Homo sapiens
accccacccagct

SEQ ID NO: 897160 - DNA, 20 bp, Homo sapiens
accccacccagctccaggcc

SEQ ID NO: 897161 - DNA, 18 bp, Homo sapiens
accccacccccgccatgc

SEQ ID NO: 897162 - DNA, 12 bp, Homo sapiens
accccaccctca

SEQ ID NO: 897163 - DNA, 13 bp, Homo sapiens
accccaccctcag

SEQ ID NO: 897164 - DNA, 22 bp, Homo sapiens
accccacgatttgtcttatccc

SEQ ID NO: 897165 - DNA, 12 bp, Homo sapiens
accccactccca

SEQ ID NO: 897166 - DNA, 13 bp, Homo sapiens
accccactcccac

SEQ ID NO: 897167 - DNA, 16 bp, Homo sapiens
accccactggctgaga

SEQ ID NO: 897168 - DNA, 22 bp, Homo sapiens
accccacttatgctgctgtgaa

SEQ ID NO: 897169 - DNA, 13 bp, Homo sapiens
accccagaaatca

SEQ ID NO: 897170 - DNA, 17 bp, Homo sapiens
accccagaaatcactgt

SEQ ID NO: 897171 - DNA, 18 bp, Homo sapiens
accccagaaatcactgtg

SEQ ID NO: 897172 - DNA, 19 bp, Homo sapiens
accccagactagatgtagt

SEQ ID NO: 897173 - DNA, 15 bp, Homo sapiens
accccagactgtaga

SEQ ID NO: 897174 - DNA, 13 bp, Homo sapiens
accccagagtgtg

SEQ ID NO: 897175 - DNA, 17 bp, Homo sapiens
accccagattcttcagc

SEQ ID NO: 897176 - DNA, 24 bp, Homo sapiens
accccagattcttcagcttgatcc

SEQ ID NO: 897177 - DNA, 20 bp, Homo sapiens
accccagcaattatgaaaat

SEQ ID NO: 897178 - DNA, 19 bp, Homo sapiens
accccagcacagccacctc

SEQ ID NO: 897179 - DNA, 12 bp, Homo sapiens
accccagcccac

SEQ ID NO: 897180 - DNA, 20 bp, Homo sapiens
accccagcccaccctgctcc

SEQ ID NO: 897181 - DNA, 19 bp, Homo sapiens
accccagcctacccttcct

SEQ ID NO: 897182 - DNA, 23 bp, Homo sapiens
accccagcctcattgtgccaagc

SEQ ID NO: 897183 - DNA, 14 bp, Homo sapiens
accccagcctgacc

SEQ ID NO: 897184 - DNA, 17 bp, Homo sapiens
accccagcctgacctga

SEQ ID NO: 897185 - DNA, 13 bp, Homo sapiens
accccagcggctg

SEQ ID NO: 897186 - DNA, 17 bp, Homo sapiens
accccagcgtcaggcct

SEQ ID NO: 897187 - DNA, 17 bp, Homo sapiens
accccagctccctagga

SEQ ID NO: 897188 - DNA, 11 bp, Homo sapiens
accccagctgg

SEQ ID NO: 897189 - DNA, 12 bp, Homo sapiens
accccagctggg

SEQ ID NO: 897190 - DNA, 22 bp, Homo sapiens
accccaggacagtttatcctgt

SEQ ID NO: 897191 - DNA, 13 bp, Homo sapiens
accccagggcctg

SEQ ID NO: 897192 - DNA, 14 bp, Homo sapiens
accccagggcctgt

SEQ ID NO: 897193 - DNA, 12 bp, Homo sapiens
accccagggtgg

SEQ ID NO: 897194 - DNA, 16 bp, Homo sapiens
accccaggtcagccct

SEQ ID NO: 897195 - DNA, 17 bp, Homo sapiens
accccaggtcagccctg

SEQ ID NO: 897196 - DNA, 22 bp, Homo sapiens
accccaggtcagccctgtgtct

SEQ ID NO: 897197 - DNA, 18 bp, Homo sapiens
accccaggtcaggggctc

SEQ ID NO: 897198 - DNA, 22 bp, Homo sapiens
accccaggtcaggggctcccta

SEQ ID NO: 897199 - DNA, 23 bp, Homo sapiens
accccagttctgctcctctccag

SEQ ID NO: 897200 - DNA, 19 bp, Homo sapiens
accccataataaccctgcc

SEQ ID NO: 897201 - DNA, 22 bp, Homo sapiens
accccataataaccctgccagt

SEQ ID NO: 897202 - DNA, 19 bp, Homo sapiens
attcctgtgttcaatattt

SEQ ID NO: 897203 - DNA, 21 bp, Homo sapiens
attcctgttgatgggaaaagc

SEQ ID NO: 897204 - DNA, 15 bp, Homo sapiens
attccttacttgcac

SEQ ID NO: 897205 - DNA, 21 bp, Homo sapiens
attccttagcttagacctcag

SEQ ID NO: 897206 - DNA, 23 bp, Homo sapiens
attccttagcttagacctcagcc

SEQ ID NO: 897207 - DNA, 18 bp, Homo sapiens
attccttatgggatcatt

SEQ ID NO: 897208 - DNA, 13 bp, Homo sapiens
attccttcaaata

SEQ ID NO: 897209 - DNA, 15 bp, Homo sapiens
attccttcaaataaa

SEQ ID NO: 897210 - DNA, 23 bp, Homo sapiens
attccttccatctagcagctggc

SEQ ID NO: 897211 - DNA, 17 bp, Homo sapiens
attccttcgaaaggcct

SEQ ID NO: 897212 - DNA, 19 bp, Homo sapiens
attccttcgaaaggccttc

SEQ ID NO: 897213 - DNA, 17 bp, Homo sapiens
attccttgaggacagac

SEQ ID NO: 897214 - DNA, 20 bp, Homo sapiens
attccttgagtcaggagctt

SEQ ID NO: 897215 - DNA, 18 bp, Homo sapiens
attccttgcgcctcagcc

SEQ ID NO: 897216 - DNA, 17 bp, Homo sapiens
attccttgtcaccagca

SEQ ID NO: 897217 - DNA, 21 bp, Homo sapiens
attccttgtcaccagcaacat

SEQ ID NO: 897218 - DNA, 16 bp, Homo sapiens
attcctttacaactaa

SEQ ID NO: 897219 - DNA, 20 bp, Homo sapiens
attcctttacaactaaataa

SEQ ID NO: 897220 - DNA, 23 bp, Homo sapiens
attcctttacaactaaataacac

SEQ ID NO: 897221 - DNA, 17 bp, Homo sapiens
attcctttcccttcctc

SEQ ID NO: 897222 - DNA, 19 bp, Homo sapiens
attcctttcccttcctctt

SEQ ID NO: 897223 - DNA, 15 bp, Homo sapiens
attcctttttctatg

SEQ ID NO: 897224 - DNA, 18 bp, Homo sapiens
attcctttttcttcactt

SEQ ID NO: 897225 - DNA, 16 bp, Homo sapiens
attcgacctataagaa

SEQ ID NO: 897226 - DNA, 19 bp, Homo sapiens
attcgatgcgtattctgtg

SEQ ID NO: 897227 - DNA, 19 bp, Homo sapiens
attcgcccaaagccagaca

SEQ ID NO: 897228 - DNA, 20 bp, Homo sapiens
attcgcccaaagccagacag

SEQ ID NO: 897229 - DNA, 13 bp, Homo sapiens
attcgcccacccg

SEQ ID NO: 897230 - DNA, 22 bp, Homo sapiens
attcgcctttgtcttgtacttc

SEQ ID NO: 897231 - DNA, 14 bp, Homo sapiens
attcgctagtgttt

SEQ ID NO: 897232 - DNA, 17 bp, Homo sapiens
attcgctcccacattct

SEQ ID NO: 897233 - DNA, 22 bp, Homo sapiens
attcgctgtaccctttaagata

SEQ ID NO: 897234 - DNA, 14 bp, Homo sapiens
attcggacggccaa

SEQ ID NO: 897235 - DNA, 15 bp, Homo sapiens
attcggcatttaact

SEQ ID NO: 897236 - DNA, 21 bp, Homo sapiens
attcggtgtgcaccagggttg

SEQ ID NO: 897237 - DNA, 14 bp, Homo sapiens
attcggtgtgctgc

SEQ ID NO: 897238 - DNA, 17 bp, Homo sapiens
attcggtgtgctgccaa

SEQ ID NO: 897239 - DNA, 18 bp, Homo sapiens
attcggtgtgctgccaac

SEQ ID NO: 897240 - DNA, 19 bp, Homo sapiens
attcggtgtgctgccaact

SEQ ID NO: 897241 - DNA, 17 bp, Homo sapiens
attcgtcctttgacaaa

SEQ ID NO: 897242 - DNA, 17 bp, Homo sapiens
attcgtgaatagtcttt

SEQ ID NO: 897243 - DNA, 17 bp, Homo sapiens
attcgtgttatgaatct

SEQ ID NO: 897244 - DNA, 20 bp, Homo sapiens
attcgtgttatgaatctgtg

SEQ ID NO: 897245 - DNA, 17 bp, Homo sapiens
attctaaagttttgcaa

SEQ ID NO: 897246 - DNA, 17 bp, Homo sapiens
attctaaatgaatgttt

SEQ ID NO: 897247 - DNA, 21 bp, Homo sapiens
attctaagccagttttcattt

SEQ ID NO: 897248 - DNA, 21 bp, Homo sapiens
attctaagttagactcttccc

SEQ ID NO: 897249 - DNA, 13 bp, Homo sapiens
attctaagttatt

SEQ ID NO: 897250 - DNA, 12 bp, Homo sapiens
attctaatgtct

SEQ ID NO: 897251 - DNA, 18 bp, Homo sapiens
attctaatgtcttcattt

SEQ ID NO: 897252 - DNA, 13 bp, Homo sapiens
attctacacagag

SEQ ID NO: 897253 - DNA, 16 bp, Homo sapiens
attctacacatgtaaa

SEQ ID NO: 897254 - DNA, 23 bp, Homo sapiens
attctacacatgtaaaatatgta

SEQ ID NO: 897255 - DNA, 13 bp, Homo sapiens
attctacacctgg

SEQ ID NO: 897256 - DNA, 17 bp, Homo sapiens
attctacacctggacca

SEQ ID NO: 897257 - DNA, 12 bp, Homo sapiens
attctacagaat

SEQ ID NO: 897258 - DNA, 11 bp, Homo sapiens
attctactaac

SEQ ID NO: 897259 - DNA, 16 bp, Homo sapiens
attctactttgagtgc

SEQ ID NO: 897260 - DNA, 17 bp, Homo sapiens
attctagatcctgcacc

SEQ ID NO: 897261 - DNA, 22 bp, Homo sapiens
attctagatcctgcaccccagc

SEQ ID NO: 897262 - DNA, 16 bp, Homo sapiens
attctaggtgtttcaa

SEQ ID NO: 897263 - DNA, 13 bp, Homo sapiens
attctagtggctg

SEQ ID NO: 897264 - DNA, 17 bp, Homo sapiens
attctagtggctgttca

SEQ ID NO: 897265 - DNA, 15 bp, Homo sapiens
attctagtgtccata

SEQ ID NO: 897266 - DNA, 23 bp, Homo sapiens
attctagtgtccataaataaagt

SEQ ID NO: 897267 - DNA, 17 bp, Homo sapiens
attctagttttgtcaaa

SEQ ID NO: 897268 - DNA, 14 bp, Homo sapiens
attctatatgaatt

SEQ ID NO: 897269 - DNA, 23 bp, Homo sapiens
attctatatgaatttaaatataa

SEQ ID NO: 897270 - DNA, 17 bp, Homo sapiens
attctatccatctcctg

SEQ ID NO: 897271 - DNA, 13 bp, Homo sapiens
attctatgttaaa

SEQ ID NO: 897272 - DNA, 19 bp, Homo sapiens
attctatgttaaatactgt

SEQ ID NO: 897273 - DNA, 20 bp, Homo sapiens
attctatgttaaatactgtg

SEQ ID NO: 897274 - DNA, 18 bp, Homo sapiens
attctattctaataactg

SEQ ID NO: 897275 - DNA, 19 bp, Homo sapiens
attctattgactttcttaa

SEQ ID NO: 897276 - DNA, 17 bp, Homo sapiens
attctattgtattattt

SEQ ID NO: 897277 - DNA, 13 bp, Homo sapiens
attctatttaatt

SEQ ID NO: 897278 - DNA, 18 bp, Homo sapiens
attctatttaattgaaac

SEQ ID NO: 897279 - DNA, 20 bp, Homo sapiens
attctatttatatgtacatg

SEQ ID NO: 897280 - DNA, 22 bp, Homo sapiens
attctatttatatgtacatgag

SEQ ID NO: 897281 - DNA, 12 bp, Homo sapiens
attctatttctc

SEQ ID NO: 897282 - DNA, 18 bp, Homo sapiens
attctatttgctgggctt

SEQ ID NO: 897283 - DNA, 15 bp, Homo sapiens
attctcaaagatgca

SEQ ID NO: 897284 - DNA, 23 bp, Homo sapiens
attctcacataagcccagttcat

SEQ ID NO: 897285 - DNA, 13 bp, Homo sapiens
attctcagaattc

SEQ ID NO: 897286 - DNA, 22 bp, Homo sapiens
attctcagaattcggtgtgctg

SEQ ID NO: 897287 - DNA, 17 bp, Homo sapiens
attctcataattcctac

SEQ ID NO: 897288 - DNA, 18 bp, Homo sapiens
attctcataattcctaca

SEQ ID NO: 897289 - DNA, 19 bp, Homo sapiens
attctcataattcctacag

SEQ ID NO: 897290 - DNA, 16 bp, Homo sapiens
attctcataggagact

SEQ ID NO: 897291 - DNA, 18 bp, Homo sapiens
attctcataggagactgc

SEQ ID NO: 897292 - DNA, 19 bp, Homo sapiens
attctcatgggaaggggag

SEQ ID NO: 897293 - DNA, 14 bp, Homo sapiens
attctccacagcaa

SEQ ID NO: 897294 - DNA, 16 bp, Homo sapiens
attctccactttttct

SEQ ID NO: 897295 - DNA, 18 bp, Homo sapiens
attctccactttttctta

SEQ ID NO: 897296 - DNA, 15 bp, Homo sapiens
attctccagttgatt

SEQ ID NO: 897297 - DNA, 19 bp, Homo sapiens
attctccagttgattattt

SEQ ID NO: 897298 - DNA, 21 bp, Homo sapiens
attctcccaggtaccagctgc

SEQ ID NO: 897299 - DNA, 16 bp, Homo sapiens
attctcccagtctctg

SEQ ID NO: 897300 - DNA, 21 bp, Homo sapiens
attctcccagtctctgtcgtg

SEQ ID NO: 897301 - DNA, 20 bp, Homo sapiens
attctccctaaggaatctga

SEQ ID NO: 897302 - DNA, 15 bp, Homo sapiens
attctccctgacctt

SEQ ID NO: 897303 - DNA, 15 bp, Homo sapiens
attctcctgcctcag

SEQ ID NO: 897304 - DNA, 17 bp, Homo sapiens
attctccttgtgttact

SEQ ID NO: 897305 - DNA, 17 bp, Homo sapiens
attctcgcttccctgaa

SEQ ID NO: 897306 - DNA, 19 bp, Homo sapiens
attctctaccaacaataaa

SEQ ID NO: 897307 - DNA, 21 bp, Homo sapiens
attctctaccaacaataaacc

SEQ ID NO: 897308 - DNA, 19 bp, Homo sapiens
attctctagtttgattaaa

SEQ ID NO: 897309 - DNA, 20 bp, Homo sapiens
attctctagtttgattaaat

SEQ ID NO: 897310 - DNA, 21 bp, Homo sapiens
attctctcctgtacctcttga

SEQ ID NO: 897311 - DNA, 15 bp, Homo sapiens
attctctctatgcaa

SEQ ID NO: 897312 - DNA, 11 bp, Homo sapiens
attctctgagc

SEQ ID NO: 897313 - DNA, 18 bp, Homo sapiens
attctctgagctgtgcag

SEQ ID NO: 897314 - DNA, 13 bp, Homo sapiens
attctctgcaatt

SEQ ID NO: 897315 - DNA, 14 bp, Homo sapiens
attctctgtaagtg

SEQ ID NO: 897316 - DNA, 20 bp, Homo sapiens
attctctgtaagtgtagctc

SEQ ID NO: 897317 - DNA, 22 bp, Homo sapiens
attctctgtaagtgtagctcaa

SEQ ID NO: 897318 - DNA, 19 bp, Homo sapiens
attctctgtctcatccatc

SEQ ID NO: 897319 - DNA, 18 bp, Homo sapiens
attctcttaaaatgacaa

SEQ ID NO: 897320 - DNA, 21 bp, Homo sapiens
attctcttaaataaaaataat

SEQ ID NO: 897321 - DNA, 20 bp, Homo sapiens
attctcttaatcactactgt

SEQ ID NO: 897322 - DNA, 12 bp, Homo sapiens
attctcttatcc

SEQ ID NO: 897323 - DNA, 14 bp, Homo sapiens
attctcttcactcc

SEQ ID NO: 897324 - DNA, 20 bp, Homo sapiens
attgagcagaattcattcat

SEQ ID NO: 897325 - DNA, 22 bp, Homo sapiens
attgagcagttagctcatttga

SEQ ID NO: 897326 - DNA, 14 bp, Homo sapiens
attgagcatttgaa

SEQ ID NO: 897327 - DNA, 12 bp, Homo sapiens
attgagccttgc

SEQ ID NO: 897328 - DNA, 17 bp, Homo sapiens
attgagctgcagaaacg

SEQ ID NO: 897329 - DNA, 19 bp, Homo sapiens
attgagctgcagaaacgaa

SEQ ID NO: 897330 - DNA, 18 bp, Homo sapiens
attgaggagctgcactga

SEQ ID NO: 897331 - DNA, 16 bp, Homo sapiens
attgagggccagtgat

SEQ ID NO: 897332 - DNA, 17 bp, Homo sapiens
attgaggggattaatat

SEQ ID NO: 897333 - DNA, 16 bp, Homo sapiens
attgagggtcattctt

SEQ ID NO: 897334 - DNA, 14 bp, Homo sapiens
attgaggtaagttt

SEQ ID NO: 897335 - DNA, 20 bp, Homo sapiens
attgagtaatggtgtagaac

SEQ ID NO: 897336 - DNA, 23 bp, Homo sapiens
attgagtgcactaaacaaataag

SEQ ID NO: 897337 - DNA, 19 bp, Homo sapiens
attgagttcttcctgtaat

SEQ ID NO: 897338 - DNA, 16 bp, Homo sapiens
attgagttttcagtgg

SEQ ID NO: 897339 - DNA, 18 bp, Homo sapiens
attgataatgctttcaca

SEQ ID NO: 897340 - DNA, 16 bp, Homo sapiens
attgatacaaagtaca

SEQ ID NO: 897341 - DNA, 19 bp, Homo sapiens
attgatacaaagtacagaa

SEQ ID NO: 897342 - DNA, 16 bp, Homo sapiens
attgatacttcaggtg

SEQ ID NO: 897343 - DNA, 14 bp, Homo sapiens
attgatagaactac

SEQ ID NO: 897344 - DNA, 21 bp, Homo sapiens
attgatatacacggatgactt

SEQ ID NO: 897345 - DNA, 17 bp, Homo sapiens
attgatatgcttataca

SEQ ID NO: 897346 - DNA, 15 bp, Homo sapiens
attgatcaaattcat

SEQ ID NO: 897347 - DNA, 17 bp, Homo sapiens
attgatcaaattcattt

SEQ ID NO: 897348 - DNA, 19 bp, Homo sapiens
attgatcattttcccccca

SEQ ID NO: 897349 - DNA, 20 bp, Homo sapiens
attgatcccacatttccatg

SEQ ID NO: 897350 - DNA, 16 bp, Homo sapiens
attgatcccttctcct

SEQ ID NO: 897351 - DNA, 22 bp, Homo sapiens
attgatcctgcaaaatctgttg

SEQ ID NO: 897352 - DNA, 21 bp, Homo sapiens
attgatccttaaccaataatg

SEQ ID NO: 897353 - DNA, 22 bp, Homo sapiens
attgatcctttgatcccagaaa

SEQ ID NO: 897354 - DNA, 19 bp, Homo sapiens
attgatcggagcctcctct

SEQ ID NO: 897355 - DNA, 21 bp, Homo sapiens
attgatgataacacttaaaat

SEQ ID NO: 897356 - DNA, 17 bp, Homo sapiens
attgatgattttgtaat

SEQ ID NO: 897357 - DNA, 14 bp, Homo sapiens
attgatgcaaataa

SEQ ID NO: 897358 - DNA, 16 bp, Homo sapiens
attgatgcaatataag

SEQ ID NO: 897359 - DNA, 20 bp, Homo sapiens
attgatgcatgctattcaca

SEQ ID NO: 897360 - DNA, 22 bp, Homo sapiens
attgatgtaaggactgtaaaca

SEQ ID NO: 897361 - DNA, 21 bp, Homo sapiens
attgatgtacagaacacaaat

SEQ ID NO: 897362 - DNA, 12 bp, Homo sapiens
attgatgtatat

SEQ ID NO: 897363 - DNA, 20 bp, Homo sapiens
attgatgttttacgtgcaaa

SEQ ID NO: 897364 - DNA, 20 bp, Homo sapiens
attgattacaaataaacagt

SEQ ID NO: 897365 - DNA, 22 bp, Homo sapiens
attgattattctgattccactt

SEQ ID NO: 897366 - DNA, 13 bp, Homo sapiens
attgattcagtat

SEQ ID NO: 897367 - DNA, 20 bp, Homo sapiens
attgattgatgtacagaaca

SEQ ID NO: 897368 - DNA, 13 bp, Homo sapiens
attgattgtattg

SEQ ID NO: 897369 - DNA, 20 bp, Homo sapiens
attgattgtgaattccttaa

SEQ ID NO: 897370 - DNA, 15 bp, Homo sapiens
attgatttaaaagtg

SEQ ID NO: 897371 - DNA, 17 bp, Homo sapiens
attgatttaaaagtgta

SEQ ID NO: 897372 - DNA, 14 bp, Homo sapiens
attgatttataaat

SEQ ID NO: 897373 - DNA, 13 bp, Homo sapiens
attgatttcaaga

SEQ ID NO: 897374 - DNA, 12 bp, Homo sapiens
attgatttcttc

SEQ ID NO: 897375 - DNA, 16 bp, Homo sapiens
attgatttgaagaaca

SEQ ID NO: 897376 - DNA, 15 bp, Homo sapiens
attgattttataatt

SEQ ID NO: 897377 - DNA, 15 bp, Homo sapiens
attgcaataaagtat

SEQ ID NO: 897378 - DNA, 12 bp, Homo sapiens
attgcacacaga

SEQ ID NO: 897379 - DNA, 13 bp, Homo sapiens
attgcacagaatt

SEQ ID NO: 897380 - DNA, 22 bp, Homo sapiens
attgcacagagcacacttattt

SEQ ID NO: 897381 - DNA, 19 bp, Homo sapiens
attgcacatttttttctat

SEQ ID NO: 897382 - DNA, 12 bp, Homo sapiens
attgcaccactg

SEQ ID NO: 897383 - DNA, 21 bp, Homo sapiens
attgcacctatctcagccata

SEQ ID NO: 897384 - DNA, 15 bp, Homo sapiens
attgcacgtggcctc

SEQ ID NO: 897385 - DNA, 17 bp, Homo sapiens
attgcactcccgcctgg

SEQ ID NO: 897386 - DNA, 18 bp, Homo sapiens
attgcactctagcctggc

SEQ ID NO: 897387 - DNA, 20 bp, Homo sapiens
attgcactgctgttcctgct

SEQ ID NO: 897388 - DNA, 21 bp, Homo sapiens
attgcacttggcctcatgctg

SEQ ID NO: 897389 - DNA, 20 bp, Homo sapiens
attgcactttataaacactg

SEQ ID NO: 897390 - DNA, 13 bp, Homo sapiens
attgcacttttaa

SEQ ID NO: 897391 - DNA, 16 bp, Homo sapiens
attgcagctttatgtt

SEQ ID NO: 897392 - DNA, 19 bp, Homo sapiens
attgcagttcaaatcctca

SEQ ID NO: 897393 - DNA, 20 bp, Homo sapiens
attgcagttcaaatcctcac

SEQ ID NO: 897394 - DNA, 19 bp, Homo sapiens
attgcagtttatcattcaa

SEQ ID NO: 897395 - DNA, 23 bp, Homo sapiens
attgcagtttatcattcaagtgt

SEQ ID NO: 897396 - DNA, 18 bp, Homo sapiens
attgcatataacttatat

SEQ ID NO: 897397 - DNA, 14 bp, Homo sapiens
attgcatcctgctg

SEQ ID NO: 897398 - DNA, 14 bp, Homo sapiens
attgcatttccaga

SEQ ID NO: 897399 - DNA, 14 bp, Homo sapiens
attgcatttctgct

SEQ ID NO: 897400 - DNA, 12 bp, Homo sapiens
attgccacagct

SEQ ID NO: 897401 - DNA, 21 bp, Homo sapiens
attgccacagctcaactcggg

SEQ ID NO: 897402 - DNA, 14 bp, Homo sapiens
attgccacctctgg

SEQ ID NO: 897403 - DNA, 20 bp, Homo sapiens
attgccacctctggccaaat

SEQ ID NO: 897404 - DNA, 15 bp, Homo sapiens
attgccacggaaaca

SEQ ID NO: 897405 - DNA, 16 bp, Homo sapiens
attgccagcaaataaa

SEQ ID NO: 897406 - DNA, 20 bp, Homo sapiens
attgccaggagatggcccca

SEQ ID NO: 897407 - DNA, 21 bp, Homo sapiens
attgccaggagatggccccaa

SEQ ID NO: 897408 - DNA, 16 bp, Homo sapiens
attgcccatgatataa

SEQ ID NO: 897409 - DNA, 19 bp, Homo sapiens
attgcccatgatataactt

SEQ ID NO: 897410 - DNA, 23 bp, Homo sapiens
attgcccccatggggtccttgga

SEQ ID NO: 897411 - DNA, 16 bp, Homo sapiens
attgcctacaataaaa

SEQ ID NO: 897412 - DNA, 19 bp, Homo sapiens
attgcctacaataaaaaga

SEQ ID NO: 897413 - DNA, 20 bp, Homo sapiens
attgcctacaataaaaagaa

SEQ ID NO: 897414 - DNA, 21 bp, Homo sapiens
attgcctacaataaaaagaaa

SEQ ID NO: 897415 - DNA, 22 bp, Homo sapiens
attgcctagaaatatctttctc

SEQ ID NO: 897416 - DNA, 19 bp, Homo sapiens
attgcctataatacttgca

SEQ ID NO: 897417 - DNA, 15 bp, Homo sapiens
attgcctgttctgct

SEQ ID NO: 897418 - DNA, 16 bp, Homo sapiens
attgcctgttctgctt

SEQ ID NO: 897419 - DNA, 17 bp, Homo sapiens
attgcctgttctgcttc

SEQ ID NO: 897420 - DNA, 16 bp, Homo sapiens
attgccttcctcgtgc

SEQ ID NO: 897421 - DNA, 18 bp, Homo sapiens
attgccttctctgcccac

SEQ ID NO: 897422 - DNA, 12 bp, Homo sapiens
attgcctttaat

SEQ ID NO: 897423 - DNA, 18 bp, Homo sapiens
attgcctttaatattttg

SEQ ID NO: 897424 - DNA, 15 bp, Homo sapiens
attgcgaatgtgcag

SEQ ID NO: 897425 - DNA, 14 bp, Homo sapiens
attgcgcctttgta

SEQ ID NO: 897426 - DNA, 23 bp, Homo sapiens
attgcgcctttgtattataaaag

SEQ ID NO: 897427 - DNA, 16 bp, Homo sapiens
attgcgctctcaagac

SEQ ID NO: 897428 - DNA, 20 bp, Homo sapiens
attgcgtagaggctacaggg

SEQ ID NO: 897429 - DNA, 21 bp, Homo sapiens
attgctaaaaaataaataaaa

SEQ ID NO: 897430 - DNA, 19 bp, Homo sapiens
attgctaaaagtgcattta

SEQ ID NO: 897431 - DNA, 15 bp, Homo sapiens
attgctaatgttgct

SEQ ID NO: 897432 - DNA, 18 bp, Homo sapiens
attgctccagatctggaa

SEQ ID NO: 897433 - DNA, 12 bp, Homo sapiens
attgctcctccc

SEQ ID NO: 897434 - DNA, 12 bp, Homo sapiens
attgctccttga

SEQ ID NO: 897435 - DNA, 16 bp, Homo sapiens
attgctctatgtctgc

SEQ ID NO: 897436 - DNA, 14 bp, Homo sapiens
attgctctggagca

SEQ ID NO: 897437 - DNA, 17 bp, Homo sapiens
attgctctggagcagcc

SEQ ID NO: 897438 - DNA, 13 bp, Homo sapiens
attgctcttctcc

SEQ ID NO: 897439 - DNA, 16 bp, Homo sapiens
attgctgaaaatggta

SEQ ID NO: 897440 - DNA, 13 bp, Homo sapiens
attgctgaaattt

SEQ ID NO: 897441 - DNA, 19 bp, Homo sapiens
attgctgaatcccatcagg

SEQ ID NO: 897442 - DNA, 20 bp, Homo sapiens
attgctgaatcccatcaggc

SEQ ID NO: 897443 - DNA, 21 bp, Homo sapiens
attgctgagagaaatatggaa

SEQ ID NO: 897444 - DNA, 12 bp, Homo sapiens
attgctgccaaa

SEQ ID NO: 897445 - DNA, 13 bp, Homo sapiens
attgctgccaaaa

SEQ ID NO: 897446 - DNA, 15 bp, Homo sapiens
attgtaaattatatt

SEQ ID NO: 897447 - DNA, 16 bp, Homo sapiens
attgtaaattgaatca

SEQ ID NO: 897448 - DNA, 18 bp, Homo sapiens
attgtaaccctgtctgga

SEQ ID NO: 897449 - DNA, 13 bp, Homo sapiens
attgtaactatta

SEQ ID NO: 897450 - DNA, 13 bp, Homo sapiens
attgtaactgttc

SEQ ID NO: 897451 - DNA, 19 bp, Homo sapiens
attgtaactgttcttgaat

SEQ ID NO: 897452 - DNA, 12 bp, Homo sapiens
attgtaagaaat

SEQ ID NO: 897453 - DNA, 16 bp, Homo sapiens
attgtaagtggaaaat

SEQ ID NO: 897454 - DNA, 12 bp, Homo sapiens
attgtaattttg

SEQ ID NO: 897455 - DNA, 14 bp, Homo sapiens
attgtacaaatgta

SEQ ID NO: 897456 - DNA, 14 bp, Homo sapiens
attgtacagctgtt

SEQ ID NO: 897457 - DNA, 15 bp, Homo sapiens
attgtacagttttta

SEQ ID NO: 897458 - DNA, 21 bp, Homo sapiens
attgtacagtttttattgctt

SEQ ID NO: 897459 - DNA, 12 bp, Homo sapiens
attgtacataaa

SEQ ID NO: 897460 - DNA, 15 bp, Homo sapiens
attgtacataaaaga

SEQ ID NO: 897461 - DNA, 20 bp, Homo sapiens
attgtacatatttgtggaat

SEQ ID NO: 897462 - DNA, 12 bp, Homo sapiens
attgtacctctc

SEQ ID NO: 897463 - DNA, 19 bp, Homo sapiens
attgtacctctcttataga

SEQ ID NO: 897464 - DNA, 18 bp, Homo sapiens
attgtactaatctgagat

SEQ ID NO: 897465 - DNA, 20 bp, Homo sapiens
attgtactgttgctttaata

SEQ ID NO: 897466 - DNA, 21 bp, Homo sapiens
attgtactgttgctttaatat

SEQ ID NO: 897467 - DNA, 16 bp, Homo sapiens
attgtacttggagtaa

SEQ ID NO: 897468 - DNA, 13 bp, Homo sapiens
attgtagacatgc

SEQ ID NO: 897469 - DNA, 18 bp, Homo sapiens
attgtagggctttagctt

SEQ ID NO: 897470 - DNA, 13 bp, Homo sapiens
attgtagtaatct

SEQ ID NO: 897471 - DNA, 19 bp, Homo sapiens
attgtagtggcctgtgctt

SEQ ID NO: 897472 - DNA, 21 bp, Homo sapiens
attgtataaactatcagtttg

SEQ ID NO: 897473 - DNA, 14 bp, Homo sapiens
attgtataagtcaa

SEQ ID NO: 897474 - DNA, 18 bp, Homo sapiens
attgtataagtcaagcac

SEQ ID NO: 897475 - DNA, 20 bp, Homo sapiens
attgtataagtcaagcacat

SEQ ID NO: 897476 - DNA, 16 bp, Homo sapiens
attgtataggccatct

SEQ ID NO: 897477 - DNA, 19 bp, Homo sapiens
attgtataggccatctgta

SEQ ID NO: 897478 - DNA, 20 bp, Homo sapiens
attgtataggccatctgtaa

SEQ ID NO: 897479 - DNA, 11 bp, Homo sapiens
attgtatatat

SEQ ID NO: 897480 - DNA, 13 bp, Homo sapiens
attgtatatatgt

SEQ ID NO: 897481 - DNA, 17 bp, Homo sapiens
attgtatattgtaattt

SEQ ID NO: 897482 - DNA, 15 bp, Homo sapiens
attgtatctagtgca

SEQ ID NO: 897483 - DNA, 18 bp, Homo sapiens
attgtatctagtgcagct

SEQ ID NO: 897484 - DNA, 14 bp, Homo sapiens
attgtatgatgtgt

SEQ ID NO: 897485 - DNA, 14 bp, Homo sapiens
attgtatgtaagta

SEQ ID NO: 897486 - DNA, 15 bp, Homo sapiens
attgtatgtggtcat

SEQ ID NO: 897487 - DNA, 17 bp, Homo sapiens
attgtattaggaaaata

SEQ ID NO: 897488 - DNA, 14 bp, Homo sapiens
attgtcagccacct

SEQ ID NO: 897489 - DNA, 15 bp, Homo sapiens
attgtcagccacctc

SEQ ID NO: 897490 - DNA, 21 bp, Homo sapiens
attgtcagccacctccctctg

SEQ ID NO: 897491 - DNA, 12 bp, Homo sapiens
attgtcagccat

SEQ ID NO: 897492 - DNA, 14 bp, Homo sapiens
attgtcagttttgt

SEQ ID NO: 897493 - DNA, 19 bp, Homo sapiens
cagcttatctcttttatat

SEQ ID NO: 897494 - DNA, 16 bp, Homo sapiens
cagcttcaccagagca

SEQ ID NO: 897495 - DNA, 17 bp, Homo sapiens
cagcttcaccctgtcaa

SEQ ID NO: 897496 - DNA, 23 bp, Homo sapiens
cagcttcagaaagagctcaaaat

SEQ ID NO: 897497 - DNA, 23 bp, Homo sapiens
cagcttcattatctgagttgcat

SEQ ID NO: 897498 - DNA, 12 bp, Homo sapiens
cagcttccaaag

SEQ ID NO: 897499 - DNA, 13 bp, Homo sapiens
cagcttcctcaca

SEQ ID NO: 897500 - DNA, 16 bp, Homo sapiens
cagcttcctcacaccc

SEQ ID NO: 897501 - DNA, 20 bp, Homo sapiens
cagcttcctcacacccctgt

SEQ ID NO: 897502 - DNA, 21 bp, Homo sapiens
cagcttcctcacacccctgtc

SEQ ID NO: 897503 - DNA, 15 bp, Homo sapiens
cagcttcctggtgta

SEQ ID NO: 897504 - DNA, 21 bp, Homo sapiens
cagcttcggagggcccctgcg

SEQ ID NO: 897505 - DNA, 17 bp, Homo sapiens
cagcttcggggccggtg

SEQ ID NO: 897506 - DNA, 18 bp, Homo sapiens
cagcttcgtgctggagga

SEQ ID NO: 897507 - DNA, 12 bp, Homo sapiens
cagcttctaaga

SEQ ID NO: 897508 - DNA, 15 bp, Homo sapiens
cagcttctccaagca

SEQ ID NO: 897509 - DNA, 12 bp, Homo sapiens
cagcttctccag

SEQ ID NO: 897510 - DNA, 13 bp, Homo sapiens
cagcttctccagg

SEQ ID NO: 897511 - DNA, 14 bp, Homo sapiens
cagcttctccaggc

SEQ ID NO: 897512 - DNA, 15 bp, Homo sapiens
cagcttctcctgtgt

SEQ ID NO: 897513 - DNA, 19 bp, Homo sapiens
cagcttctctctccagggt

SEQ ID NO: 897514 - DNA, 18 bp, Homo sapiens
cagcttctctctccctgt

SEQ ID NO: 897515 - DNA, 20 bp, Homo sapiens
cagcttctctctccctgtca

SEQ ID NO: 897516 - DNA, 14 bp, Homo sapiens
cagcttctggtact

SEQ ID NO: 897517 - DNA, 23 bp, Homo sapiens
cagcttctggtactctcctagag

SEQ ID NO: 897518 - DNA, 20 bp, Homo sapiens
cagcttcttcctaggtccaa

SEQ ID NO: 897519 - DNA, 23 bp, Homo sapiens
cagcttcttctgcccctctactg

SEQ ID NO: 897520 - DNA, 13 bp, Homo sapiens
cagcttcttgggc

SEQ ID NO: 897521 - DNA, 20 bp, Homo sapiens
cagcttcttgggctgagtgc

SEQ ID NO: 897522 - DNA, 12 bp, Homo sapiens
cagcttcttttg

SEQ ID NO: 897523 - DNA, 17 bp, Homo sapiens
cagcttcttttgtctcc

SEQ ID NO: 897524 - DNA, 16 bp, Homo sapiens
cagcttgacctgaggc

SEQ ID NO: 897525 - DNA, 19 bp, Homo sapiens
cagcttgacctgaggctgt

SEQ ID NO: 897526 - DNA, 14 bp, Homo sapiens
cagcttgagccggg

SEQ ID NO: 897527 - DNA, 22 bp, Homo sapiens
cagcttgcagtccgttgctgaa

SEQ ID NO: 897528 - DNA, 15 bp, Homo sapiens
cagcttgcccccgct

SEQ ID NO: 897529 - DNA, 23 bp, Homo sapiens
cagcttgctcttcagtgggagaa

SEQ ID NO: 897530 - DNA, 15 bp, Homo sapiens
cagcttgctgtcact

SEQ ID NO: 897531 - DNA, 20 bp, Homo sapiens
cagcttgctgtcacttcttc

SEQ ID NO: 897532 - DNA, 17 bp, Homo sapiens
cagcttggccctttcct

SEQ ID NO: 897533 - DNA, 16 bp, Homo sapiens
cagcttgggcccagct

SEQ ID NO: 897534 - DNA, 18 bp, Homo sapiens
cagcttgggcccagctgg

SEQ ID NO: 897535 - DNA, 22 bp, Homo sapiens
cagcttgggcccagctgggctc

SEQ ID NO: 897536 - DNA, 15 bp, Homo sapiens
cagcttgggcttctt

SEQ ID NO: 897537 - DNA, 14 bp, Homo sapiens
cagcttgggtcagg

SEQ ID NO: 897538 - DNA, 20 bp, Homo sapiens
cagcttgtgattcctacccc

SEQ ID NO: 897539 - DNA, 18 bp, Homo sapiens
cagcttgtggcaagtgaa

SEQ ID NO: 897540 - DNA, 17 bp, Homo sapiens
cagcttgttatttataa

SEQ ID NO: 897541 - DNA, 17 bp, Homo sapiens
cagctttaaactcaggg

SEQ ID NO: 897542 - DNA, 19 bp, Homo sapiens
cagctttacatgcaattta

SEQ ID NO: 897543 - DNA, 14 bp, Homo sapiens
cagctttcaagtgc

SEQ ID NO: 897544 - DNA, 13 bp, Homo sapiens
cagctttcagagc

SEQ ID NO: 897545 - DNA, 13 bp, Homo sapiens
cagctttccctgc

SEQ ID NO: 897546 - DNA, 19 bp, Homo sapiens
cagctttccctgcctctca

SEQ ID NO: 897547 - DNA, 16 bp, Homo sapiens
cagctttctgggatgt

SEQ ID NO: 897548 - DNA, 12 bp, Homo sapiens
cagctttgagct

SEQ ID NO: 897549 - DNA, 23 bp, Homo sapiens
cagctttgaggttgacctgtttc

SEQ ID NO: 897550 - DNA, 16 bp, Homo sapiens
cagctttgatccctga

SEQ ID NO: 897551 - DNA, 17 bp, Homo sapiens
cagctttgctattccca

SEQ ID NO: 897552 - DNA, 19 bp, Homo sapiens
cagctttgctccgctccca

SEQ ID NO: 897553 - DNA, 18 bp, Homo sapiens
cagcttttgttctagact

SEQ ID NO: 897554 - DNA, 21 bp, Homo sapiens
cagcttttgttctagacttcc

SEQ ID NO: 897555 - DNA, 18 bp, Homo sapiens
cagcttttgttgtttata

SEQ ID NO: 897556 - DNA, 21 bp, Homo sapiens
cagctttttattccctgccca

SEQ ID NO: 897557 - DNA, 13 bp, Homo sapiens
cagctttttctgt

SEQ ID NO: 897558 - DNA, 18 bp, Homo sapiens
caggaaaaaaaattctgt

SEQ ID NO: 897559 - DNA, 19 bp, Homo sapiens
caggaaaaaaaattctgtt

SEQ ID NO: 897560 - DNA, 22 bp, Homo sapiens
caggaaaaaaaattctgttgtt

SEQ ID NO: 897561 - DNA, 13 bp, Homo sapiens
caggaaaaaataa

SEQ ID NO: 897562 - DNA, 21 bp, Homo sapiens
caggaaaaacaaaacaaagaa

SEQ ID NO: 897563 - DNA, 17 bp, Homo sapiens
caggaaaaatgaggaat

SEQ ID NO: 897564 - DNA, 19 bp, Homo sapiens
caggaaaactgacagagga

SEQ ID NO: 897565 - DNA, 23 bp, Homo sapiens
caggaaaactgacagaggagggc

SEQ ID NO: 897566 - DNA, 22 bp, Homo sapiens
caggaaaatacgaaaatcccat

SEQ ID NO: 897567 - DNA, 16 bp, Homo sapiens
caggaaaatcctctgg

SEQ ID NO: 897568 - DNA, 13 bp, Homo sapiens
caggaaaatgtat

SEQ ID NO: 897569 - DNA, 21 bp, Homo sapiens
caggaaaatgtatccagagga

SEQ ID NO: 897570 - DNA, 22 bp, Homo sapiens
caggaaacaagggaaggggcct

SEQ ID NO: 897571 - DNA, 22 bp, Homo sapiens
caggaaacaaggggtctgagga

SEQ ID NO: 897572 - DNA, 13 bp, Homo sapiens
caggaaaccgagt

SEQ ID NO: 897573 - DNA, 16 bp, Homo sapiens
caggaaagaagcattt

SEQ ID NO: 897574 - DNA, 11 bp, Homo sapiens
caggaaagagc

SEQ ID NO: 897575 - DNA, 21 bp, Homo sapiens
caggaaagagcagtcagagtc

SEQ ID NO: 897576 - DNA, 13 bp, Homo sapiens
caggaaagccaca

SEQ ID NO: 897577 - DNA, 15 bp, Homo sapiens
caggaaagccacatc

SEQ ID NO: 897578 - DNA, 17 bp, Homo sapiens
caggaaagccacatctt

SEQ ID NO: 897579 - DNA, 22 bp, Homo sapiens
caggaaagccacatcttgctct

SEQ ID NO: 897580 - DNA, 23 bp, Homo sapiens
caggaaagccacatcttgctctg

SEQ ID NO: 897581 - DNA, 13 bp, Homo sapiens
caggaaagggcaa

SEQ ID NO: 897582 - DNA, 14 bp, Homo sapiens
caggaacaaacagg

SEQ ID NO: 897583 - DNA, 21 bp, Homo sapiens
caggaacaagtaatgtattag

SEQ ID NO: 897584 - DNA, 21 bp, Homo sapiens
caggaacaatcgatggccttg

SEQ ID NO: 897585 - DNA, 14 bp, Homo sapiens
caggaacagaagga

SEQ ID NO: 897586 - DNA, 16 bp, Homo sapiens
caggaacagtggctgg

SEQ ID NO: 897587 - DNA, 13 bp, Homo sapiens
caggaacatacag

SEQ ID NO: 897588 - DNA, 18 bp, Homo sapiens
caggaacatacagacaca

SEQ ID NO: 897589 - DNA, 14 bp, Homo sapiens
caggaaccagggcc

SEQ ID NO: 897590 - DNA, 19 bp, Homo sapiens
caggaacccttgcatccat

SEQ ID NO: 897591 - DNA, 21 bp, Homo sapiens
caggaaccgaacatatcattt

SEQ ID NO: 897592 - DNA, 17 bp, Homo sapiens
caggaacgagcactggc

SEQ ID NO: 897593 - DNA, 19 bp, Homo sapiens
caggaacgagcactggcca

SEQ ID NO: 897594 - DNA, 15 bp, Homo sapiens
caggaacggccctgc

SEQ ID NO: 897595 - DNA, 21 bp, Homo sapiens
caggaactatggcaaggaact

SEQ ID NO: 897596 - DNA, 16 bp, Homo sapiens
caggaactcccagcaa

SEQ ID NO: 897597 - DNA, 17 bp, Homo sapiens
caggaactcccagcaac

SEQ ID NO: 897598 - DNA, 13 bp, Homo sapiens
caggaactgcctg

SEQ ID NO: 897599 - DNA, 18 bp, Homo sapiens
caggaactgcctgggcca

SEQ ID NO: 897600 - DNA, 14 bp, Homo sapiens
caggaactgggctg

SEQ ID NO: 897601 - DNA, 15 bp, Homo sapiens
caggaactgggctgg

SEQ ID NO: 897602 - DNA, 18 bp, Homo sapiens
caggaactgggctgggcc

SEQ ID NO: 897603 - DNA, 19 bp, Homo sapiens
caggaactgggctgggcct

SEQ ID NO: 897604 - DNA, 14 bp, Homo sapiens
caggaacttgaata

SEQ ID NO: 897605 - DNA, 17 bp, Homo sapiens
caggaagaaagaatgtt

SEQ ID NO: 897606 - DNA, 22 bp, Homo sapiens
caggaagaaaggagtctgcaca

SEQ ID NO: 897607 - DNA, 20 bp, Homo sapiens
caggaagaccaaggcctcgg

SEQ ID NO: 897608 - DNA, 17 bp, Homo sapiens
caggaagatcccccaga

SEQ ID NO: 897609 - DNA, 14 bp, Homo sapiens
caggaagcagggag

SEQ ID NO: 897610 - DNA, 18 bp, Homo sapiens
caggaagcattcagagag

SEQ ID NO: 897611 - DNA, 20 bp, Homo sapiens
caggaagcattcagagagca

SEQ ID NO: 897612 - DNA, 13 bp, Homo sapiens
caggaagcctgca

SEQ ID NO: 897613 - DNA, 20 bp, Homo sapiens
caggaagctggcagaacgga

SEQ ID NO: 897614 - DNA, 18 bp, Homo sapiens
caggaaggacaggaagct

SEQ ID NO: 897615 - DNA, 14 bp, Homo sapiens
cattatgattcttt

SEQ ID NO: 897616 - DNA, 18 bp, Homo sapiens
cattatgccacttccttt

SEQ ID NO: 897617 - DNA, 20 bp, Homo sapiens
cattatgttagagaggtagc

SEQ ID NO: 897618 - DNA, 13 bp, Homo sapiens
cattatgttcatg

SEQ ID NO: 897619 - DNA, 15 bp, Homo sapiens
cattatgttcatgta

SEQ ID NO: 897620 - DNA, 19 bp, Homo sapiens
cattattagtactgctctt

SEQ ID NO: 897621 - DNA, 16 bp, Homo sapiens
cattattatgtaaata

SEQ ID NO: 897622 - DNA, 16 bp, Homo sapiens
cattattatttctgtt

SEQ ID NO: 897623 - DNA, 19 bp, Homo sapiens
cattattatttctgttctt

SEQ ID NO: 897624 - DNA, 18 bp, Homo sapiens
cattattcaagaatgaaa

SEQ ID NO: 897625 - DNA, 21 bp, Homo sapiens
cattattcaagaatgaaaaat

SEQ ID NO: 897626 - DNA, 20 bp, Homo sapiens
cattattcatctctcctccc

SEQ ID NO: 897627 - DNA, 14 bp, Homo sapiens
cattattcctcaga

SEQ ID NO: 897628 - DNA, 22 bp, Homo sapiens
cattattctctgctatatataa

SEQ ID NO: 897629 - DNA, 18 bp, Homo sapiens
cattattggaattaacct

SEQ ID NO: 897630 - DNA, 15 bp, Homo sapiens
cattatttaatgttt

SEQ ID NO: 897631 - DNA, 19 bp, Homo sapiens
cattatttaatgtttgatt

SEQ ID NO: 897632 - DNA, 15 bp, Homo sapiens
cattatttaatttgt

SEQ ID NO: 897633 - DNA, 21 bp, Homo sapiens
cattatttattaaaaatgttc

SEQ ID NO: 897634 - DNA, 22 bp, Homo sapiens
cattatttattcagcttcattt

SEQ ID NO: 897635 - DNA, 21 bp, Homo sapiens
cattatttattgttaaattac

SEQ ID NO: 897636 - DNA, 14 bp, Homo sapiens
cattattttctgtc

SEQ ID NO: 897637 - DNA, 13 bp, Homo sapiens
cattattttgtgg

SEQ ID NO: 897638 - DNA, 23 bp, Homo sapiens
cattattttgtggttctatttta

SEQ ID NO: 897639 - DNA, 17 bp, Homo sapiens
cattattttttatttct

SEQ ID NO: 897640 - DNA, 22 bp, Homo sapiens
cattattttttatttctgattt

SEQ ID NO: 897641 - DNA, 22 bp, Homo sapiens
cattcaaaaagacagcagacaa

SEQ ID NO: 897642 - DNA, 23 bp, Homo sapiens
cattcaaaaagacagcagacaaa

SEQ ID NO: 897643 - DNA, 24 bp, Homo sapiens
cattcaaaaagacagcagacaaaa

SEQ ID NO: 897644 - DNA, 17 bp, Homo sapiens
cattcaaaagttgaaat

SEQ ID NO: 897645 - DNA, 14 bp, Homo sapiens
cattcaaatttgtc

SEQ ID NO: 897646 - DNA, 13 bp, Homo sapiens
ctgtggggctggg

SEQ ID NO: 897647 - DNA, 14 bp, Homo sapiens
ctgtggggctgggc

SEQ ID NO: 897648 - DNA, 21 bp, Homo sapiens
ctgtggggcttacagaaatga

SEQ ID NO: 897649 - DNA, 23 bp, Homo sapiens
ctgtgggggtgagggtcccatgt

SEQ ID NO: 897650 - DNA, 16 bp, Homo sapiens
ctgtgggggtggccat

SEQ ID NO: 897651 - DNA, 13 bp, Homo sapiens
ctgtggggtctgg

SEQ ID NO: 897652 - DNA, 18 bp, Homo sapiens
ctgtggggtggagcactg

SEQ ID NO: 897653 - DNA, 21 bp, Homo sapiens
ctgtggggtggagcactggac

SEQ ID NO: 897654 - DNA, 18 bp, Homo sapiens
ctgtggggtgggctggag

SEQ ID NO: 897655 - DNA, 14 bp, Homo sapiens
ctgtgggtctctga

SEQ ID NO: 897656 - DNA, 16 bp, Homo sapiens
ctgtgggtctctgaag

SEQ ID NO: 897657 - DNA, 20 bp, Homo sapiens
ctgtgggtctctgaagggac

SEQ ID NO: 897658 - DNA, 16 bp, Homo sapiens
ctgtgggtgaagcgcc

SEQ ID NO: 897659 - DNA, 19 bp, Homo sapiens
ctgtgggtggggaggccct

SEQ ID NO: 897660 - DNA, 22 bp, Homo sapiens
ctgtgggtggggaggccctgcc

SEQ ID NO: 897661 - DNA, 18 bp, Homo sapiens
ctgtgggtgtctccctcg

SEQ ID NO: 897662 - DNA, 23 bp, Homo sapiens
ctgtgggtgtctccctcgggggc

SEQ ID NO: 897663 - DNA, 18 bp, Homo sapiens
ctgtgggtgttctttcct

SEQ ID NO: 897664 - DNA, 23 bp, Homo sapiens
ctgtgggtttgggtgcctcctgc

SEQ ID NO: 897665 - DNA, 23 bp, Homo sapiens
ctgtggtaactttgcaggcggcc

SEQ ID NO: 897666 - DNA, 20 bp, Homo sapiens
ctgtggtaggggcagggagg

SEQ ID NO: 897667 - DNA, 16 bp, Homo sapiens
ctgtggtcacagcgga

SEQ ID NO: 897668 - DNA, 21 bp, Homo sapiens
ctgtggtctataaaataaact

SEQ ID NO: 897669 - DNA, 13 bp, Homo sapiens
ctgtggtgacagg

SEQ ID NO: 897670 - DNA, 14 bp, Homo sapiens
ctgtggtgatctgt

SEQ ID NO: 897671 - DNA, 14 bp, Homo sapiens
ctgtggtggctccc

SEQ ID NO: 897672 - DNA, 19 bp, Homo sapiens
ctgtggtggctccccctct

SEQ ID NO: 897673 - DNA, 14 bp, Homo sapiens
ctgtggtgtgtccc

SEQ ID NO: 897674 - DNA, 22 bp, Homo sapiens
ctgtggtgtgtccccctctgtc

SEQ ID NO: 897675 - DNA, 17 bp, Homo sapiens
ctgtggttacagtgcag

SEQ ID NO: 897676 - DNA, 23 bp, Homo sapiens
ctgtggttacagtgcagacaggc

SEQ ID NO: 897677 - DNA, 20 bp, Homo sapiens
ctgtggttcctaagcctgtt

SEQ ID NO: 897678 - DNA, 18 bp, Homo sapiens
ctgtggttctataataag

SEQ ID NO: 897679 - DNA, 23 bp, Homo sapiens
ctgtggtttcagatgtgcaataa

SEQ ID NO: 897680 - DNA, 16 bp, Homo sapiens
ctgtggtttcatgtta

SEQ ID NO: 897681 - DNA, 23 bp, Homo sapiens
ctgtggtttggttggggcttcac

SEQ ID NO: 897682 - DNA, 21 bp, Homo sapiens
ctgtggttttcccctccctgg

SEQ ID NO: 897683 - DNA, 18 bp, Homo sapiens
ctgtgtaaatatttttcc

SEQ ID NO: 897684 - DNA, 18 bp, Homo sapiens
ctgtgtaactttctctta

SEQ ID NO: 897685 - DNA, 13 bp, Homo sapiens
ctgtgtaagattt

SEQ ID NO: 897686 - DNA, 17 bp, Homo sapiens
ctgtgtaagctcacatc

SEQ ID NO: 897687 - DNA, 18 bp, Homo sapiens
ctgtgtaattagtgccac

SEQ ID NO: 897688 - DNA, 16 bp, Homo sapiens
ctgtgtacaaagaaat

SEQ ID NO: 897689 - DNA, 23 bp, Homo sapiens
ctgtgtacacatctattctcaaa

SEQ ID NO: 897690 - DNA, 17 bp, Homo sapiens
ctgtgtacacctctgga

SEQ ID NO: 897691 - DNA, 21 bp, Homo sapiens
ctgtgtacagaattctgctac

SEQ ID NO: 897692 - DNA, 17 bp, Homo sapiens
ctgtgtacataactgaa

SEQ ID NO: 897693 - DNA, 19 bp, Homo sapiens
ctgtgtaccacttctgtgg

SEQ ID NO: 897694 - DNA, 21 bp, Homo sapiens
ctgtgtaccacttctgtgggc

SEQ ID NO: 897695 - DNA, 22 bp, Homo sapiens
ctgtgtaccacttctgtgggca

SEQ ID NO: 897696 - DNA, 13 bp, Homo sapiens
ctgtgtactgttc

SEQ ID NO: 897697 - DNA, 15 bp, Homo sapiens
ctgtgtatcattaaa

SEQ ID NO: 897698 - DNA, 16 bp, Homo sapiens
ctgtgtatcattaaaa

SEQ ID NO: 897699 - DNA, 18 bp, Homo sapiens
ctgtgtatgtacatatat

SEQ ID NO: 897700 - DNA, 19 bp, Homo sapiens
ctgtgtattccaagacatg

SEQ ID NO: 897701 - DNA, 11 bp, Homo sapiens
ctgtgtattta

SEQ ID NO: 897702 - DNA, 15 bp, Homo sapiens
ctgtgtatttgcttt

SEQ ID NO: 897703 - DNA, 12 bp, Homo sapiens
ctgtgtcagagc

SEQ ID NO: 897704 - DNA, 13 bp, Homo sapiens
ctgtgtcagagcc

SEQ ID NO: 897705 - DNA, 19 bp, Homo sapiens
ctgtgtcagagcctacctt

SEQ ID NO: 897706 - DNA, 17 bp, Homo sapiens
ctgtgtccatctgaccg

SEQ ID NO: 897707 - DNA, 19 bp, Homo sapiens
ctgtgtcccatgacccacc

SEQ ID NO: 897708 - DNA, 20 bp, Homo sapiens
ctgtgtcccatgacccaccc

SEQ ID NO: 897709 - DNA, 19 bp, Homo sapiens
ctgtgtcccctgacctgtc

SEQ ID NO: 897710 - DNA, 20 bp, Homo sapiens
ctgtgtcccctgacctgtcc

SEQ ID NO: 897711 - DNA, 16 bp, Homo sapiens
ctgtgtcctaaggccc

SEQ ID NO: 897712 - DNA, 15 bp, Homo sapiens
ctgtgtcctccctcc

SEQ ID NO: 897713 - DNA, 16 bp, Homo sapiens
ctgtgtcctccctccc

SEQ ID NO: 897714 - DNA, 14 bp, Homo sapiens
ctgtgtcctctgcc

SEQ ID NO: 897715 - DNA, 15 bp, Homo sapiens
ctgtgtcctctgcct

SEQ ID NO: 897716 - DNA, 15 bp, Homo sapiens
ctgtgtcctggtgct

SEQ ID NO: 897717 - DNA, 19 bp, Homo sapiens
ctgtgtcctggtgctctct

SEQ ID NO: 897718 - DNA, 16 bp, Homo sapiens
ctgtgtccttgcacct

SEQ ID NO: 897719 - DNA, 17 bp, Homo sapiens
ctgtgtcggtcagaaca

SEQ ID NO: 897720 - DNA, 16 bp, Homo sapiens
ctgtgtcgtagccaag

SEQ ID NO: 897721 - DNA, 12 bp, Homo sapiens
ctgtgtctaaac

SEQ ID NO: 897722 - DNA, 14 bp, Homo sapiens
ctgtgtctaaactg

SEQ ID NO: 897723 - DNA, 13 bp, Homo sapiens
ctgtgtctctccc

SEQ ID NO: 897724 - DNA, 14 bp, Homo sapiens
ctgtgtctctgcca

SEQ ID NO: 897725 - DNA, 21 bp, Homo sapiens
ctgtgtctgccaaacacattt

SEQ ID NO: 897726 - DNA, 21 bp, Homo sapiens
ctgtgtctggcgttctcaaga

SEQ ID NO: 897727 - DNA, 20 bp, Homo sapiens
ctgtgtctgtcacaggctgg

SEQ ID NO: 897728 - DNA, 19 bp, Homo sapiens
ctgtgtgaaataccagtgt

SEQ ID NO: 897729 - DNA, 19 bp, Homo sapiens
ctgtgtgacatcagtggca

SEQ ID NO: 897730 - DNA, 14 bp, Homo sapiens
ctgtgtgagagggg

SEQ ID NO: 897731 - DNA, 19 bp, Homo sapiens
ctgtgtgaggctgtgtctc

SEQ ID NO: 897732 - DNA, 18 bp, Homo sapiens
ctgtgtgatgaactttct

SEQ ID NO: 897733 - DNA, 21 bp, Homo sapiens
ctgtgtgattgacagctttgc

SEQ ID NO: 897734 - DNA, 23 bp, Homo sapiens
ctgtgtgattgacagctttgctg

SEQ ID NO: 897735 - DNA, 21 bp, Homo sapiens
ctgtgtgcaccttaccaactt

SEQ ID NO: 897736 - DNA, 14 bp, Homo sapiens
ctgtgtgcagcaac

SEQ ID NO: 897737 - DNA, 17 bp, Homo sapiens
ctgtgtgcagtgaaggt

SEQ ID NO: 897738 - DNA, 15 bp, Homo sapiens
ctgtgtgcccaagtg

SEQ ID NO: 897739 - DNA, 16 bp, Homo sapiens
ctgtgtgcccaagtgg

SEQ ID NO: 897740 - DNA, 20 bp, Homo sapiens
ctgtgtgcccaagtgggcag

SEQ ID NO: 897741 - DNA, 19 bp, Homo sapiens
cattcgtgagctggggact

SEQ ID NO: 897742 - DNA, 23 bp, Homo sapiens
cattcgtgagctggggactcagg

SEQ ID NO: 897743 - DNA, 19 bp, Homo sapiens
cattcgtggcatgttttga

SEQ ID NO: 897744 - DNA, 14 bp, Homo sapiens
cattcgttctgtgg

SEQ ID NO: 897745 - DNA, 13 bp, Homo sapiens
cattctaatttgc

SEQ ID NO: 897746 - DNA, 14 bp, Homo sapiens
cattctaatttgca

SEQ ID NO: 897747 - DNA, 15 bp, Homo sapiens
cattctacacctgga

SEQ ID NO: 897748 - DNA, 16 bp, Homo sapiens
cattctacacctggac

SEQ ID NO: 897749 - DNA, 21 bp, Homo sapiens
cattctacagaataatccagt

SEQ ID NO: 897750 - DNA, 10 bp, Homo sapiens
cattctagat

SEQ ID NO: 897751 - DNA, 13 bp, Homo sapiens
cattctagatcct

SEQ ID NO: 897752 - DNA, 18 bp, Homo sapiens
cattctagatcctgcacc

SEQ ID NO: 897753 - DNA, 14 bp, Homo sapiens
cattctaggatgtg

SEQ ID NO: 897754 - DNA, 20 bp, Homo sapiens
cattctaggatgtggagcta

SEQ ID NO: 897755 - DNA, 17 bp, Homo sapiens
cattctaggctcactgc

SEQ ID NO: 897756 - DNA, 18 bp, Homo sapiens
cattctatctactgattt

SEQ ID NO: 897757 - DNA, 16 bp, Homo sapiens
cattctattttagaat

SEQ ID NO: 897758 - DNA, 14 bp, Homo sapiens
cattctcactccta

SEQ ID NO: 897759 - DNA, 17 bp, Homo sapiens
cattctcataattccta

SEQ ID NO: 897760 - DNA, 18 bp, Homo sapiens
cattctcataattcctac

SEQ ID NO: 897761 - DNA, 19 bp, Homo sapiens
cattctcataattcctaca

SEQ ID NO: 897762 - DNA, 23 bp, Homo sapiens
cattctcataattcctacagcac

SEQ ID NO: 897763 - DNA, 13 bp, Homo sapiens
cattctcatctgc

SEQ ID NO: 897764 - DNA, 17 bp, Homo sapiens
cattctcatctgcaccc

SEQ ID NO: 897765 - DNA, 14 bp, Homo sapiens
cattctccacagca

SEQ ID NO: 897766 - DNA, 22 bp, Homo sapiens
cattctccaggggtttacagtg

SEQ ID NO: 897767 - DNA, 20 bp, Homo sapiens
cattctccagttgattattt

SEQ ID NO: 897768 - DNA, 21 bp, Homo sapiens
cattgccttctctgcccacag

SEQ ID NO: 897769 - DNA, 17 bp, Homo sapiens
cattgccttctggagct

SEQ ID NO: 897770 - DNA, 23 bp, Homo sapiens
cattgccttctggagctgggaga

SEQ ID NO: 897771 - DNA, 23 bp, Homo sapiens
cattgcctttccagggttattta

SEQ ID NO: 897772 - DNA, 21 bp, Homo sapiens
cattgcgctctagcctgggca

SEQ ID NO: 897773 - DNA, 17 bp, Homo sapiens
cattgctaaaaaataaa

SEQ ID NO: 897774 - DNA, 17 bp, Homo sapiens
cattgctccaagatgtt

SEQ ID NO: 897775 - DNA, 21 bp, Homo sapiens
cattgctctatgtctgccttc

SEQ ID NO: 897776 - DNA, 16 bp, Homo sapiens
cattgctgaaaatggt

SEQ ID NO: 897777 - DNA, 22 bp, Homo sapiens
cattgctgccaaggtggaggga

SEQ ID NO: 897778 - DNA, 23 bp, Homo sapiens
cattgctgccaaggtggagggaa

SEQ ID NO: 897779 - DNA, 15 bp, Homo sapiens
cattgctgctgctac

SEQ ID NO: 897780 - DNA, 18 bp, Homo sapiens
cattgctgggcttgtctg

SEQ ID NO: 897781 - DNA, 17 bp, Homo sapiens
cattgctggtagagacc

SEQ ID NO: 897782 - DNA, 20 bp, Homo sapiens
cattgctgtaccacatctgc

SEQ ID NO: 897783 - DNA, 19 bp, Homo sapiens
cattgctgtcttgccccag

SEQ ID NO: 897784 - DNA, 16 bp, Homo sapiens
cattgctttgaagcag

SEQ ID NO: 897785 - DNA, 18 bp, Homo sapiens
cattgctttgaagcagtt

SEQ ID NO: 897786 - DNA, 11 bp, Homo sapiens
cattgcttttg

SEQ ID NO: 897787 - DNA, 13 bp, Homo sapiens
cattgcttttgaa

SEQ ID NO: 897788 - DNA, 17 bp, Homo sapiens
cattggaagaccccacc

SEQ ID NO: 897789 - DNA, 14 bp, Homo sapiens
cattggaagcctga

SEQ ID NO: 897790 - DNA, 22 bp, Homo sapiens
cattggaataaggcatggctca

SEQ ID NO: 897791 - DNA, 18 bp, Homo sapiens
cattggaatgttctcaga

SEQ ID NO: 897792 - DNA, 19 bp, Homo sapiens
cattggaatgttctcagat

SEQ ID NO: 897793 - DNA, 20 bp, Homo sapiens
cattggaattctactggaaa

SEQ ID NO: 897794 - DNA, 17 bp, Homo sapiens
cattggacagtctccct

SEQ ID NO: 897795 - DNA, 16 bp, Homo sapiens
cattggacccttccat

SEQ ID NO: 897796 - DNA, 16 bp, Homo sapiens
cattggagcacctggg

SEQ ID NO: 897797 - DNA, 11 bp, Homo sapiens
cattggatatt

SEQ ID NO: 897798 - DNA, 14 bp, Homo sapiens
cattggatctgcaa

SEQ ID NO: 897799 - DNA, 21 bp, Homo sapiens
cattggcccctgagcccagag

SEQ ID NO: 897800 - DNA, 21 bp, Homo sapiens
cattggccgagctcctgggga

SEQ ID NO: 897801 - DNA, 20 bp, Homo sapiens
cattggcctctgtgtacaaa

SEQ ID NO: 897802 - DNA, 16 bp, Homo sapiens
cattggcctcttgtcc

SEQ ID NO: 897803 - DNA, 14 bp, Homo sapiens
cattggctatttaa

SEQ ID NO: 897804 - DNA, 17 bp, Homo sapiens
cattgggcacagtccag

SEQ ID NO: 897805 - DNA, 18 bp, Homo sapiens
cattgggcacagtccaga

SEQ ID NO: 897806 - DNA, 15 bp, Homo sapiens
cattgggctgacacc

SEQ ID NO: 897807 - DNA, 14 bp, Homo sapiens
cattggtggactac

SEQ ID NO: 897808 - DNA, 14 bp, Homo sapiens
cattggttaatttt

SEQ ID NO: 897809 - DNA, 15 bp, Homo sapiens
cattggttaattttt

SEQ ID NO: 897810 - DNA, 21 bp, Homo sapiens
cattggttcttcctttccctg

SEQ ID NO: 897811 - DNA, 20 bp, Homo sapiens
cattgtaaaagcattttgta

SEQ ID NO: 897812 - DNA, 21 bp, Homo sapiens
cattgtaaaagcattttgtaa

SEQ ID NO: 897813 - DNA, 15 bp, Homo sapiens
cattgtaaaataatt

SEQ ID NO: 897814 - DNA, 16 bp, Homo sapiens
cattgtaaaataattc

SEQ ID NO: 897815 - DNA, 18 bp, Homo sapiens
cattgtaaacaaactctt

SEQ ID NO: 897816 - DNA, 23 bp, Homo sapiens
cattgtaaacaaactcttgaaga

SEQ ID NO: 897817 - DNA, 19 bp, Homo sapiens
cattgtaaagtatgtgagt

SEQ ID NO: 897818 - DNA, 21 bp, Homo sapiens
cattgtaaatatttactcttt

SEQ ID NO: 897819 - DNA, 18 bp, Homo sapiens
cattgtaaatctgaagaa

SEQ ID NO: 897820 - DNA, 16 bp, Homo sapiens
cattgtaatgttactg

SEQ ID NO: 897821 - DNA, 21 bp, Homo sapiens
cattgtaatgttactgatcat

SEQ ID NO: 897822 - DNA, 14 bp, Homo sapiens
cattgtacaagtat

SEQ ID NO: 897823 - DNA, 20 bp, Homo sapiens
cattgtactccagcctgggt

SEQ ID NO: 897824 - DNA, 22 bp, Homo sapiens
cattgtactccagcctgggtga

SEQ ID NO: 897825 - DNA, 14 bp, Homo sapiens
cattgtagaaacac

SEQ ID NO: 897826 - DNA, 15 bp, Homo sapiens
cattgtagagcttct

SEQ ID NO: 897827 - DNA, 24 bp, Homo sapiens
cattgtatagatataatgaacaaa

SEQ ID NO: 897828 - DNA, 15 bp, Homo sapiens
cattgtataggccat

SEQ ID NO: 897829 - DNA, 19 bp, Homo sapiens
cattgtataggccatctgt

SEQ ID NO: 897830 - DNA, 22 bp, Homo sapiens
cattgtataggccatctgtaaa

SEQ ID NO: 897831 - DNA, 14 bp, Homo sapiens
cattgtatatatgt

SEQ ID NO: 897832 - DNA, 15 bp, Homo sapiens
cattgtatctgtctt

SEQ ID NO: 897833 - DNA, 18 bp, Homo sapiens
cattgtatctgtctttcc

SEQ ID NO: 897834 - DNA, 15 bp, Homo sapiens
cattgtatgtggtca

SEQ ID NO: 897835 - DNA, 19 bp, Homo sapiens
cattgtccaatcctatgtt

SEQ ID NO: 897836 - DNA, 21 bp, Homo sapiens
cattgtccaatcctatgtttt

SEQ ID NO: 897837 - DNA, 13 bp, Homo sapiens
cattgtccctctg

SEQ ID NO: 897838 - DNA, 14 bp, Homo sapiens
cattgtccctctgc

SEQ ID NO: 897839 - DNA, 21 bp, Homo sapiens
cattgtccctctgccccatcc

SEQ ID NO: 897840 - DNA, 17 bp, Homo sapiens
cattgtccctcttcact

SEQ ID NO: 897841 - DNA, 20 bp, Homo sapiens
cattgtccctcttcactccc

SEQ ID NO: 897842 - DNA, 19 bp, Homo sapiens
cattgtcctaagaacaatg

SEQ ID NO: 897843 - DNA, 16 bp, Homo sapiens
cattgtcctgtagctt

SEQ ID NO: 897844 - DNA, 13 bp, Homo sapiens
cattgtcctgtga

SEQ ID NO: 897845 - DNA, 21 bp, Homo sapiens
cattgtctcctatatatttct

SEQ ID NO: 897846 - DNA, 20 bp, Homo sapiens
cattgtctcgtgtacagctc

SEQ ID NO: 897847 - DNA, 15 bp, Homo sapiens
cattgtctgtctgca

SEQ ID NO: 897848 - DNA, 14 bp, Homo sapiens
cattgtcttgttat

SEQ ID NO: 897849 - DNA, 20 bp, Homo sapiens
cattgtcttgttatgtacaa

SEQ ID NO: 897850 - DNA, 23 bp, Homo sapiens
cattgtcttgttatgtacaaact

SEQ ID NO: 897851 - DNA, 13 bp, Homo sapiens
cattgtctttgct

SEQ ID NO: 897852 - DNA, 20 bp, Homo sapiens
cattgtctttgctgtactct

SEQ ID NO: 897853 - DNA, 22 bp, Homo sapiens
cattgtgatgtatattcctttg

SEQ ID NO: 897854 - DNA, 15 bp, Homo sapiens
cattgtgccaagcct

SEQ ID NO: 897855 - DNA, 22 bp, Homo sapiens
cattgtgccatgtcaaacaaat

SEQ ID NO: 897856 - DNA, 19 bp, Homo sapiens
cattgtgcttggcccctgg

SEQ ID NO: 897857 - DNA, 21 bp, Homo sapiens
cattgtgggatgttcagcact

SEQ ID NO: 897858 - DNA, 17 bp, Homo sapiens
cattgtgtcagaaacat

SEQ ID NO: 897859 - DNA, 22 bp, Homo sapiens
cattgtgtcagaaacatgaaat

SEQ ID NO: 897860 - DNA, 19 bp, Homo sapiens
cattgtgtgatccagccct

SEQ ID NO: 897861 - DNA, 20 bp, Homo sapiens
cattgtgtgatccagccctg

SEQ ID NO: 897862 - DNA, 14 bp, Homo sapiens
cattgtgtggcctg

SEQ ID NO: 897863 - DNA, 18 bp, Homo sapiens
cattgtgtggcctggtgg

SEQ ID NO: 897864 - DNA, 19 bp, Homo sapiens
cattgtgtggcctggtggg

SEQ ID NO: 897865 - DNA, 14 bp, Homo sapiens
cattgtgttacctg

SEQ ID NO: 897866 - DNA, 16 bp, Homo sapiens
cattgttataaagaca

SEQ ID NO: 897867 - DNA, 19 bp, Homo sapiens
cattgttattgtggaagat

SEQ ID NO: 897868 - DNA, 15 bp, Homo sapiens
cattgttatttatac

SEQ ID NO: 897869 - DNA, 17 bp, Homo sapiens
cattgttcaaaaggaac

SEQ ID NO: 897870 - DNA, 16 bp, Homo sapiens
cattgttcaattagaa

SEQ ID NO: 897871 - DNA, 19 bp, Homo sapiens
ctgttctagttttttactt

SEQ ID NO: 897872 - DNA, 14 bp, Homo sapiens
ctgttctctcccct

SEQ ID NO: 897873 - DNA, 15 bp, Homo sapiens
ctgttctctcccctc

SEQ ID NO: 897874 - DNA, 22 bp, Homo sapiens
ctgttctctcccctcacatcct

SEQ ID NO: 897875 - DNA, 17 bp, Homo sapiens
ctgttctctgctgaggg

SEQ ID NO: 897876 - DNA, 17 bp, Homo sapiens
ctgttctcttcacacca

SEQ ID NO: 897877 - DNA, 19 bp, Homo sapiens
ctgttctgaaaggagacat

SEQ ID NO: 897878 - DNA, 13 bp, Homo sapiens
ctgttctgcaaag

SEQ ID NO: 897879 - DNA, 16 bp, Homo sapiens
ctgttctgcacacagc

SEQ ID NO: 897880 - DNA, 14 bp, Homo sapiens
ctgttctgcagtgg

SEQ ID NO: 897881 - DNA, 14 bp, Homo sapiens
ctgttctggaggaa

SEQ ID NO: 897882 - DNA, 12 bp, Homo sapiens
ctgttctggggg

SEQ ID NO: 897883 - DNA, 14 bp, Homo sapiens
ctgttctgggggac

SEQ ID NO: 897884 - DNA, 20 bp, Homo sapiens
ctgttctggtatttcccctg

SEQ ID NO: 897885 - DNA, 20 bp, Homo sapiens
ctgttctgtggttcctctgc

SEQ ID NO: 897886 - DNA, 21 bp, Homo sapiens
ctgttcttagagtgtagctgt

SEQ ID NO: 897887 - DNA, 20 bp, Homo sapiens
ctgttcttcctccagctgca

SEQ ID NO: 897888 - DNA, 15 bp, Homo sapiens
ctgttcttccttcct

SEQ ID NO: 897889 - DNA, 14 bp, Homo sapiens
gccctcctttccct

SEQ ID NO: 897890 - DNA, 11 bp, Homo sapiens
gccctcctttg

SEQ ID NO: 897891 - DNA, 16 bp, Homo sapiens
gccctcgcccccgccc

SEQ ID NO: 897892 - DNA, 14 bp, Homo sapiens
gccctcgctgccag

SEQ ID NO: 897893 - DNA, 15 bp, Homo sapiens
gccctcgctgccagc

SEQ ID NO: 897894 - DNA, 14 bp, Homo sapiens
gccctcggtggctg

SEQ ID NO: 897895 - DNA, 19 bp, Homo sapiens
gccctcggtggctgcacag

SEQ ID NO: 897896 - DNA, 14 bp, Homo sapiens
gccctcgtggccag

SEQ ID NO: 897897 - DNA, 15 bp, Homo sapiens
gccctcgtggccagc

SEQ ID NO: 897898 - DNA, 14 bp, Homo sapiens
gccctctagggcag

SEQ ID NO: 897899 - DNA, 14 bp, Homo sapiens
gccctctatgctgg

SEQ ID NO: 897900 - DNA, 15 bp, Homo sapiens
gccctctatgctggc

SEQ ID NO: 897901 - DNA, 19 bp, Homo sapiens
gccctctatgctggctttt

SEQ ID NO: 897902 - DNA, 15 bp, Homo sapiens
gccctctcactccag

SEQ ID NO: 897903 - DNA, 15 bp, Homo sapiens
gccctctccccaccc

SEQ ID NO: 897904 - DNA, 22 bp, Homo sapiens
gccctctccccacccctacccc

SEQ ID NO: 897905 - DNA, 13 bp, Homo sapiens
gccctctccctgt

SEQ ID NO: 897906 - DNA, 15 bp, Homo sapiens
gccctctccctgtgt

SEQ ID NO: 897907 - DNA, 22 bp, Homo sapiens
gccctctccctgtgttctgggc

SEQ ID NO: 897908 - DNA, 20 bp, Homo sapiens
gccctctcctccccctccta

SEQ ID NO: 897909 - DNA, 13 bp, Homo sapiens
gccctctctctgg

SEQ ID NO: 897910 - DNA, 19 bp, Homo sapiens
gccctctgcctcctcagcc

SEQ ID NO: 897911 - DNA, 12 bp, Homo sapiens
gccctctgcctg

SEQ ID NO: 897912 - DNA, 15 bp, Homo sapiens
gccctctgcctgcac

SEQ ID NO: 897913 - DNA, 17 bp, Homo sapiens
gccctctgcctgcactc

SEQ ID NO: 897914 - DNA, 18 bp, Homo sapiens
gccctctgcctgcactcc

SEQ ID NO: 897915 - DNA, 18 bp, Homo sapiens
gccctctgctctgcctgg

SEQ ID NO: 897916 - DNA, 19 bp, Homo sapiens
gccctctgctctgcctgga

SEQ ID NO: 897917 - DNA, 17 bp, Homo sapiens
gccctctgctgctgccc

SEQ ID NO: 897918 - DNA, 18 bp, Homo sapiens
gccctctggagtggccac

SEQ ID NO: 897919 - DNA, 22 bp, Homo sapiens
gccctctggagtggccactaag

SEQ ID NO: 897920 - DNA, 21 bp, Homo sapiens
gccctctgtctgtcttctcct

SEQ ID NO: 897921 - DNA, 16 bp, Homo sapiens
gccctcttaagatctg

SEQ ID NO: 897922 - DNA, 19 bp, Homo sapiens
gccctcttaagatctgact

SEQ ID NO: 897923 - DNA, 13 bp, Homo sapiens
gccctcttcctga

SEQ ID NO: 897924 - DNA, 18 bp, Homo sapiens
gccctcttgccagcctcc

SEQ ID NO: 897925 - DNA, 17 bp, Homo sapiens
gccctcttgcgggcctg

SEQ ID NO: 897926 - DNA, 18 bp, Homo sapiens
gccctcttgcgggcctgg

SEQ ID NO: 897927 - DNA, 21 bp, Homo sapiens
gccctcttgcgggcctggaca

SEQ ID NO: 897928 - DNA, 16 bp, Homo sapiens
gccctctttcatctgt

SEQ ID NO: 897929 - DNA, 13 bp, Homo sapiens
gccctctttccct

SEQ ID NO: 897930 - DNA, 17 bp, Homo sapiens
gccctctttccctgcga

SEQ ID NO: 897931 - DNA, 19 bp, Homo sapiens
gccctctttccctgcgaga

SEQ ID NO: 897932 - DNA, 20 bp, Homo sapiens
gccctctttccctgcgagac

SEQ ID NO: 897933 - DNA, 16 bp, Homo sapiens
gccctgaaagggccct

SEQ ID NO: 897934 - DNA, 21 bp, Homo sapiens
gccctgacatgctaacctctc

SEQ ID NO: 897935 - DNA, 17 bp, Homo sapiens
gccctgaccctgtggaa

SEQ ID NO: 897936 - DNA, 12 bp, Homo sapiens
gccctgacctcc

SEQ ID NO: 897937 - DNA, 15 bp, Homo sapiens
gccctgacctcccag

SEQ ID NO: 897938 - DNA, 19 bp, Homo sapiens
gccctgacctcccagccct

SEQ ID NO: 897939 - DNA, 15 bp, Homo sapiens
gccctgaccttggct

SEQ ID NO: 897940 - DNA, 19 bp, Homo sapiens
gccctgactcctctggctt

SEQ ID NO: 897941 - DNA, 21 bp, Homo sapiens
gccctgactcctctggctttc

SEQ ID NO: 897942 - DNA, 15 bp, Homo sapiens
gccctgactcctgga

SEQ ID NO: 897943 - DNA, 16 bp, Homo sapiens
gccctgactcctggac

SEQ ID NO: 897944 - DNA, 22 bp, Homo sapiens
gccctgactgtcagggagggcc

SEQ ID NO: 897945 - DNA, 19 bp, Homo sapiens
gccctgacttctggagatg

SEQ ID NO: 897946 - DNA, 12 bp, Homo sapiens
gccctgagaaga

SEQ ID NO: 897947 - DNA, 20 bp, Homo sapiens
gccctgagaagctgctccag

SEQ ID NO: 897948 - DNA, 23 bp, Homo sapiens
gccctgagagagaatagagctgc

SEQ ID NO: 897949 - DNA, 17 bp, Homo sapiens
gccctgaggacctctca

SEQ ID NO: 897950 - DNA, 23 bp, Homo sapiens
gccctgaggacctctcagcatag

SEQ ID NO: 897951 - DNA, 20 bp, Homo sapiens
gccctgaggcctagactctg

SEQ ID NO: 897952 - DNA, 15 bp, Homo sapiens
gccctgaggggctgg

SEQ ID NO: 897953 - DNA, 20 bp, Homo sapiens
gccctgaggggctggggagg

SEQ ID NO: 897954 - DNA, 21 bp, Homo sapiens
gccctgaggtgaaagggagct

SEQ ID NO: 897955 - DNA, 21 bp, Homo sapiens
gccctgagtggatctccaagg

SEQ ID NO: 897956 - DNA, 22 bp, Homo sapiens
gccctgagtggatctccaagga

SEQ ID NO: 897957 - DNA, 22 bp, Homo sapiens
gccctgagttttacccagactc

SEQ ID NO: 897958 - DNA, 22 bp, Homo sapiens
gccctgatgtgtcctcagggag

SEQ ID NO: 897959 - DNA, 21 bp, Homo sapiens
gccctgcaaaaggactctcag

SEQ ID NO: 897960 - DNA, 12 bp, Homo sapiens
gccctgcagagc

SEQ ID NO: 897961 - DNA, 15 bp, Homo sapiens
gccctgcagagcaat

SEQ ID NO: 897962 - DNA, 13 bp, Homo sapiens
gccctgcagaggg

SEQ ID NO: 897963 - DNA, 16 bp, Homo sapiens
gccctgcaggagcagg

SEQ ID NO: 897964 - DNA, 18 bp, Homo sapiens
gccctgcaggagcagggc

SEQ ID NO: 897965 - DNA, 11 bp, Homo sapiens
gccctgcaggc

SEQ ID NO: 897966 - DNA, 22 bp, Homo sapiens
gccctgcaggcacagaggaggt

SEQ ID NO: 897967 - DNA, 17 bp, Homo sapiens
gccctgcaggctgcagg

SEQ ID NO: 897968 - DNA, 21 bp, Homo sapiens
gccctgcaggctgcaggaggg

SEQ ID NO: 897969 - DNA, 22 bp, Homo sapiens
gccctgccacgtcccgctgcct

SEQ ID NO: 897970 - DNA, 11 bp, Homo sapiens
gccctgccact

SEQ ID NO: 897971 - DNA, 12 bp, Homo sapiens
gccctgccactc

SEQ ID NO: 897972 - DNA, 20 bp, Homo sapiens
gccctgccactcactaggcc

SEQ ID NO: 897973 - DNA, 21 bp, Homo sapiens
gccctgccactcactaggccc

SEQ ID NO: 897974 - DNA, 18 bp, Homo sapiens
gccctgccatcttcccag

SEQ ID NO: 897975 - DNA, 22 bp, Homo sapiens
gccctgccattggcctcttgtc

SEQ ID NO: 897976 - DNA, 11 bp, Homo sapiens
gccctgcccaa

SEQ ID NO: 897977 - DNA, 14 bp, Homo sapiens
gccctgcccaagtg

SEQ ID NO: 897978 - DNA, 16 bp, Homo sapiens
gccctgcccaagtgac

SEQ ID NO: 897979 - DNA, 20 bp, Homo sapiens
gccctgcccaagtgaccagg

SEQ ID NO: 897980 - DNA, 21 bp, Homo sapiens
gccctgcccaggtggcctcct

SEQ ID NO: 897981 - DNA, 14 bp, Homo sapiens
gccctgccccacac

SEQ ID NO: 897982 - DNA, 15 bp, Homo sapiens
gccctgccccacacc

SEQ ID NO: 897983 - DNA, 14 bp, Homo sapiens
gccctgccccaccc

SEQ ID NO: 897984 - DNA, 23 bp, Homo sapiens
gccctgccccaccccatccagcc

SEQ ID NO: 897985 - DNA, 13 bp, Homo sapiens
gccctgccccagg

SEQ ID NO: 897986 - DNA, 21 bp, Homo sapiens
gccctgccccaggcctggacg

SEQ ID NO: 897987 - DNA, 20 bp, Homo sapiens
gccctgcccccatctcccca

SEQ ID NO: 897988 - DNA, 13 bp, Homo sapiens
gccctgccctgta

SEQ ID NO: 897989 - DNA, 17 bp, Homo sapiens
gccctgcccttggcacc

SEQ ID NO: 897990 - DNA, 21 bp, Homo sapiens
gccctgcccttggcaccacca

SEQ ID NO: 897991 - DNA, 23 bp, Homo sapiens
gccctgcccttggcaccaccagg

SEQ ID NO: 897992 - DNA, 16 bp, Homo sapiens
gccctgcctcagccag

SEQ ID NO: 897993 - DNA, 16 bp, Homo sapiens
gccctgcctccctttc

SEQ ID NO: 897994 - DNA, 20 bp, Homo sapiens
gccctgcctccctttctggg

SEQ ID NO: 897995 - DNA, 16 bp, Homo sapiens
gccctgcctcctggag

SEQ ID NO: 897996 - DNA, 14 bp, Homo sapiens
gccctgcctgaccc

SEQ ID NO: 897997 - DNA, 15 bp, Homo sapiens
gccctgcctgaggag

SEQ ID NO: 897998 - DNA, 18 bp, Homo sapiens
gccctgcctgaggaggag

SEQ ID NO: 897999 - DNA, 16 bp, Homo sapiens
cggtgtgctgccaact

SEQ ID NO: 898000 - DNA, 18 bp, Homo sapiens
cggtgtggagaagcggct

SEQ ID NO: 898001 - DNA, 16 bp, Homo sapiens
cggtgtgggctgtgtc

SEQ ID NO: 898002 - DNA, 19 bp, Homo sapiens
cggtgtttggcaatgctaa

SEQ ID NO: 898003 - DNA, 20 bp, Homo sapiens
cggttatgaaattcaccccc

SEQ ID NO: 898004 - DNA, 20 bp, Homo sapiens
cggttcaaggtcactgtttc

SEQ ID NO: 898005 - DNA, 20 bp, Homo sapiens
cggttcaggaaaattgaatg

SEQ ID NO: 898006 - DNA, 20 bp, Homo sapiens
cggttccacgtccccctggg

SEQ ID NO: 898007 - DNA, 18 bp, Homo sapiens
cggttcctcatctgagag

SEQ ID NO: 898008 - DNA, 22 bp, Homo sapiens
cggttgccatggagatctgaag

SEQ ID NO: 898009 - DNA, 17 bp, Homo sapiens
cggttgctggtcaggtc

SEQ ID NO: 898010 - DNA, 18 bp, Homo sapiens
cggttgtttagaaacaga

SEQ ID NO: 898011 - DNA, 14 bp, Homo sapiens
cgtcctgccctgcc

SEQ ID NO: 898012 - DNA, 13 bp, Homo sapiens
cgtcctgcctgtg

SEQ ID NO: 898013 - DNA, 12 bp, Homo sapiens
cgtcctgctgga

SEQ ID NO: 898014 - DNA, 19 bp, Homo sapiens
cgtcctgctgtccctgtca

SEQ ID NO: 898015 - DNA, 18 bp, Homo sapiens
cgtcctgtcactgatgga

SEQ ID NO: 898016 - DNA, 22 bp, Homo sapiens
cgtccttccatatccctgccca

SEQ ID NO: 898017 - DNA, 19 bp, Homo sapiens
cgtcggactgcccccagaa

SEQ ID NO: 898018 - DNA, 22 bp, Homo sapiens
cgtcggactgcccccagaaagc

SEQ ID NO: 898019 - DNA, 17 bp, Homo sapiens
cgtcggagctgcctgca

SEQ ID NO: 898020 - DNA, 19 bp, Homo sapiens
cgtcggagctgcctgcagc

SEQ ID NO: 898021 - DNA, 13 bp, Homo sapiens
cgtcggccctgcg

SEQ ID NO: 898022 - DNA, 23 bp, Homo sapiens
cgtcgggcgtgggtctctgggga

SEQ ID NO: 898023 - DNA, 20 bp, Homo sapiens
cgtcgtgtgctgaagacatg

SEQ ID NO: 898024 - DNA, 15 bp, Homo sapiens
cgtctcactgtgtgt

SEQ ID NO: 898025 - DNA, 14 bp, Homo sapiens
cgtctcccatcctg

SEQ ID NO: 898026 - DNA, 16 bp, Homo sapiens
cgtctcccatcctgat

SEQ ID NO: 898027 - DNA, 19 bp, Homo sapiens
cgtctcccatcctgatccc

SEQ ID NO: 898028 - DNA, 12 bp, Homo sapiens
cgtctcctccct

SEQ ID NO: 898029 - DNA, 13 bp, Homo sapiens
cgtctcggccctg

SEQ ID NO: 898030 - DNA, 16 bp, Homo sapiens
cgtctctcctgctctc

SEQ ID NO: 898031 - DNA, 23 bp, Homo sapiens
cgtctctggagcggaatttacct

SEQ ID NO: 898032 - DNA, 18 bp, Homo sapiens
cgtctcttcaagcatcct

SEQ ID NO: 898033 - DNA, 22 bp, Homo sapiens
cgtctcttgtgactcagcagag

SEQ ID NO: 898034 - DNA, 16 bp, Homo sapiens
cgtctgaccctctgcg

SEQ ID NO: 898035 - DNA, 17 bp, Homo sapiens
cgtctgactccagagtc

SEQ ID NO: 898036 - DNA, 18 bp, Homo sapiens
cgtctgactccagagtct

SEQ ID NO: 898037 - DNA, 19 bp, Homo sapiens
cgtctgactccagagtctg

SEQ ID NO: 898038 - DNA, 18 bp, Homo sapiens
cgtctgactccctcccca

SEQ ID NO: 898039 - DNA, 13 bp, Homo sapiens
cgtctgactctgg

SEQ ID NO: 898040 - DNA, 17 bp, Homo sapiens
cgtctgactctgggttc

SEQ ID NO: 898041 - DNA, 22 bp, Homo sapiens
cgtctgaggcctgccccctggg

SEQ ID NO: 898042 - DNA, 17 bp, Homo sapiens
cgtctgcaggggcctgg

SEQ ID NO: 898043 - DNA, 13 bp, Homo sapiens
cgtctgcagggtg

SEQ ID NO: 898044 - DNA, 22 bp, Homo sapiens
cgtctgcagggtgacgcctgag

SEQ ID NO: 898045 - DNA, 12 bp, Homo sapiens
cgtctgccaggc

SEQ ID NO: 898046 - DNA, 14 bp, Homo sapiens
cgtctgccaggccc

SEQ ID NO: 898047 - DNA, 13 bp, Homo sapiens
cgtctgcctgggc

SEQ ID NO: 898048 - DNA, 14 bp, Homo sapiens
cgtctgcctgggcc

SEQ ID NO: 898049 - DNA, 22 bp, Homo sapiens
cgtctgctcttctgtgcccagg

SEQ ID NO: 898050 - DNA, 17 bp, Homo sapiens
cgtctggcccaccaggg

SEQ ID NO: 898051 - DNA, 14 bp, Homo sapiens
cgtctggctccctg

SEQ ID NO: 898052 - DNA, 22 bp, Homo sapiens
cgtctgggagaaattgacagat

SEQ ID NO: 898053 - DNA, 19 bp, Homo sapiens
cgtctgtctcgatgcctga

SEQ ID NO: 898054 - DNA, 19 bp, Homo sapiens
cgtctgtctgtcgcccttc

SEQ ID NO: 898055 - DNA, 20 bp, Homo sapiens
cgtctgtgtggtggagccag

SEQ ID NO: 898056 - DNA, 17 bp, Homo sapiens
cgtcttcaatctctgtt

SEQ ID NO: 898057 - DNA, 19 bp, Homo sapiens
cgtcttcaatctctgttct

SEQ ID NO: 898058 - DNA, 13 bp, Homo sapiens
cgtcttcagccta

SEQ ID NO: 898059 - DNA, 14 bp, Homo sapiens
cgtcttcagcctag

SEQ ID NO: 898060 - DNA, 22 bp, Homo sapiens
cgtcttcccagcggttcctgtg

SEQ ID NO: 898061 - DNA, 21 bp, Homo sapiens
cgtcttccgcccctgcctgcc

SEQ ID NO: 898062 - DNA, 21 bp, Homo sapiens
cgtcttcgccctctgaaatta

SEQ ID NO: 898063 - DNA, 22 bp, Homo sapiens
cgtcttggtgtaatttgaagat

SEQ ID NO: 898064 - DNA, 14 bp, Homo sapiens
cgtcttgtgtttgc

SEQ ID NO: 898065 - DNA, 18 bp, Homo sapiens
cgtcttgtgtttgctgca

SEQ ID NO: 898066 - DNA, 14 bp, Homo sapiens
cgtctttgtgtatg

SEQ ID NO: 898067 - DNA, 15 bp, Homo sapiens
cgtgaaaacggagct

SEQ ID NO: 898068 - DNA, 16 bp, Homo sapiens
cgtgaaaacggagctg

SEQ ID NO: 898069 - DNA, 18 bp, Homo sapiens
cgtgaaaacggagctgaa

SEQ ID NO: 898070 - DNA, 13 bp, Homo sapiens
cgtgaaaccctgt

SEQ ID NO: 898071 - DNA, 12 bp, Homo sapiens
cgtgaactgtgc

SEQ ID NO: 898072 - DNA, 21 bp, Homo sapiens
cgtgaagcagtgcctcgaggc

SEQ ID NO: 898073 - DNA, 22 bp, Homo sapiens
cgtgaagcagtgcctcgaggca

SEQ ID NO: 898074 - DNA, 12 bp, Homo sapiens
cgtgacaacaca

SEQ ID NO: 898075 - DNA, 17 bp, Homo sapiens
cgtgacaataaaacatt

SEQ ID NO: 898076 - DNA, 19 bp, Homo sapiens
cgtgacaataaaacattaa

SEQ ID NO: 898077 - DNA, 15 bp, Homo sapiens
cgtgacagactcctg

SEQ ID NO: 898078 - DNA, 16 bp, Homo sapiens
cgtgacagactcctga

SEQ ID NO: 898079 - DNA, 18 bp, Homo sapiens
cgtgacagactcctgagg

SEQ ID NO: 898080 - DNA, 21 bp, Homo sapiens
cgtgacaggctcgtcagccac

SEQ ID NO: 898081 - DNA, 17 bp, Homo sapiens
cgtgacagtgcctggga

SEQ ID NO: 898082 - DNA, 14 bp, Homo sapiens
cgtgacccttcagg

SEQ ID NO: 898083 - DNA, 23 bp, Homo sapiens
cgtgacctattcaccctccactt

SEQ ID NO: 898084 - DNA, 14 bp, Homo sapiens
cgtgactcacccaa

SEQ ID NO: 898085 - DNA, 20 bp, Homo sapiens
cgtgactgccccaactcctg

SEQ ID NO: 898086 - DNA, 21 bp, Homo sapiens
cgtgagccaggtaatgaggga

SEQ ID NO: 898087 - DNA, 15 bp, Homo sapiens
cgtgagctgcccggc

SEQ ID NO: 898088 - DNA, 23 bp, Homo sapiens
cgtgagctgcccggcgcctgccc

SEQ ID NO: 898089 - DNA, 18 bp, Homo sapiens
cgtgagctggggactcag

SEQ ID NO: 898090 - DNA, 22 bp, Homo sapiens
cgtgagcttaaaatacaagact

SEQ ID NO: 898091 - DNA, 13 bp, Homo sapiens
cgtgagtgtgtga

SEQ ID NO: 898092 - DNA, 15 bp, Homo sapiens
cgtgagtgtgtgagc

SEQ ID NO: 898093 - DNA, 20 bp, Homo sapiens
cgtgagtgtgtgagcgcttc

SEQ ID NO: 898094 - DNA, 17 bp, Homo sapiens
cgtgataaaactgggtt

SEQ ID NO: 898095 - DNA, 14 bp, Homo sapiens
cgtgataatttttg

SEQ ID NO: 898096 - DNA, 18 bp, Homo sapiens
cgtgatcaaagccacact

SEQ ID NO: 898097 - DNA, 22 bp, Homo sapiens
cgtgatcaaagccacactctgg

SEQ ID NO: 898098 - DNA, 20 bp, Homo sapiens
cgtgatccatccatctccag

SEQ ID NO: 898099 - DNA, 22 bp, Homo sapiens
cgtgatccatccatctccaggg

SEQ ID NO: 898100 - DNA, 13 bp, Homo sapiens
cgtgatcttggct

SEQ ID NO: 898101 - DNA, 14 bp, Homo sapiens
cgtgatgtgccact

SEQ ID NO: 898102 - DNA, 20 bp, Homo sapiens
cgtgatgtggaggaagagcc

SEQ ID NO: 898103 - DNA, 12 bp, Homo sapiens
cgtgatgttttg

SEQ ID NO: 898104 - DNA, 21 bp, Homo sapiens
cgtgatgttttgaatgtggat

SEQ ID NO: 898105 - DNA, 18 bp, Homo sapiens
cgtgattttgctgtagaa

SEQ ID NO: 898106 - DNA, 13 bp, Homo sapiens
cgtgcaaacaacc

SEQ ID NO: 898107 - DNA, 21 bp, Homo sapiens
cgtgcacgtggagagctggtg

SEQ ID NO: 898108 - DNA, 14 bp, Homo sapiens
cgtgcactctgcta

SEQ ID NO: 898109 - DNA, 12 bp, Homo sapiens
cgtgcactgtga

SEQ ID NO: 898110 - DNA, 20 bp, Homo sapiens
cgtgcactgtgaatcctggc

SEQ ID NO: 898111 - DNA, 16 bp, Homo sapiens
cgtgcagtacaggcaa

SEQ ID NO: 898112 - DNA, 22 bp, Homo sapiens
cgtgcagtcaggtgggcggtgt

SEQ ID NO: 898113 - DNA, 18 bp, Homo sapiens
cgtgcatccttgtaatac

SEQ ID NO: 898114 - DNA, 14 bp, Homo sapiens
cgtgcatggctcct

SEQ ID NO: 898115 - DNA, 17 bp, Homo sapiens
cgtgcatttaaactctg

SEQ ID NO: 898116 - DNA, 20 bp, Homo sapiens
cgtgccaaccccacccagct

SEQ ID NO: 898117 - DNA, 22 bp, Homo sapiens
cgtgccaccccgagggctgagc

SEQ ID NO: 898118 - DNA, 23 bp, Homo sapiens
cgtgccacccgtaggcagcctct

SEQ ID NO: 898119 - DNA, 16 bp, Homo sapiens
cgtgccagctctagtt

SEQ ID NO: 898120 - DNA, 18 bp, Homo sapiens
cgtgccattgtactccag

SEQ ID NO: 898121 - DNA, 23 bp, Homo sapiens
cgtgcccaggcccttggctgcag

SEQ ID NO: 898122 - DNA, 19 bp, Homo sapiens
cgtgcccaggggcccacag

SEQ ID NO: 898123 - DNA, 14 bp, Homo sapiens
cgtgccccacctcc

SEQ ID NO: 898124 - DNA, 18 bp, Homo sapiens
cgtgccccacctccccac

SEQ ID NO: 898125 - DNA, 23 bp, Homo sapiens
cgtgcccccagagtgtagggggc

SEQ ID NO: 898126 - DNA, 15 bp, Homo sapiens
cgtgcccccctcctc

SEQ ID NO: 898127 - DNA, 18 bp, Homo sapiens
cgtgcccccctcctccag

SEQ ID NO: 898128 - DNA, 20 bp, Homo sapiens
cgtgcccccctcctccagta

SEQ ID NO: 898129 - DNA, 20 bp, Homo sapiens
cgtgcccccgcctgccaccg

SEQ ID NO: 898130 - DNA, 15 bp, Homo sapiens
cgtgcccctttcctt

SEQ ID NO: 898131 - DNA, 15 bp, Homo sapiens
cgtgccctggaggct

SEQ ID NO: 898132 - DNA, 23 bp, Homo sapiens
cgtgcctccaccaccactggcca

SEQ ID NO: 898133 - DNA, 13 bp, Homo sapiens
cgtgttcccctct

SEQ ID NO: 898134 - DNA, 18 bp, Homo sapiens
cgtgttcccctcttgtct

SEQ ID NO: 898135 - DNA, 19 bp, Homo sapiens
cgtgttcccctcttgtctc

SEQ ID NO: 898136 - DNA, 18 bp, Homo sapiens
cgtgttccgcttctctct

SEQ ID NO: 898137 - DNA, 19 bp, Homo sapiens
cgtgttcgaaagtctgaaa

SEQ ID NO: 898138 - DNA, 22 bp, Homo sapiens
cgtgttgccttgaaccacttcc

SEQ ID NO: 898139 - DNA, 15 bp, Homo sapiens
cgtgtttctgactct

SEQ ID NO: 898140 - DNA, 21 bp, Homo sapiens
cgtgtttgggtttttttcctt

SEQ ID NO: 898141 - DNA, 13 bp, Homo sapiens
cgtgttttcaagg

SEQ ID NO: 898142 - DNA, 11 bp, Homo sapiens
cgttaacattg

SEQ ID NO: 898143 - DNA, 20 bp, Homo sapiens
cgttaagggaaggaactctg

SEQ ID NO: 898144 - DNA, 14 bp, Homo sapiens
cgttagaggaaaaa

SEQ ID NO: 898145 - DNA, 17 bp, Homo sapiens
cgttagaggaaaaatat

SEQ ID NO: 898146 - DNA, 14 bp, Homo sapiens
cgttagctcctgtg

SEQ ID NO: 898147 - DNA, 15 bp, Homo sapiens
cgttagctcctgtgg

SEQ ID NO: 898148 - DNA, 17 bp, Homo sapiens
cgttagctcctgtggcc

SEQ ID NO: 898149 - DNA, 15 bp, Homo sapiens
cgttcaataagcatt

SEQ ID NO: 898150 - DNA, 12 bp, Homo sapiens
cgttccacagtt

SEQ ID NO: 898151 - DNA, 14 bp, Homo sapiens
cgttccacagttgc

SEQ ID NO: 898152 - DNA, 17 bp, Homo sapiens
cgttccacagttgccac

SEQ ID NO: 898153 - DNA, 19 bp, Homo sapiens
cgttccacagttgccacca

SEQ ID NO: 898154 - DNA, 20 bp, Homo sapiens
cgttccacagttgccaccac

SEQ ID NO: 898155 - DNA, 12 bp, Homo sapiens
cgttccccaccc

SEQ ID NO: 898156 - DNA, 11 bp, Homo sapiens
cgttccctgcg

SEQ ID NO: 898157 - DNA, 16 bp, Homo sapiens
cgttcctggccttctg

SEQ ID NO: 898158 - DNA, 21 bp, Homo sapiens
cgttcgcagagcttttcagat

SEQ ID NO: 898159 - DNA, 20 bp, Homo sapiens
cgttcgcctctggccctggg

SEQ ID NO: 898160 - DNA, 20 bp, Homo sapiens
cgttctaggtaggaagagcc

SEQ ID NO: 898161 - DNA, 22 bp, Homo sapiens
cgttctcaagaatctagaagat

SEQ ID NO: 898162 - DNA, 15 bp, Homo sapiens
cgttctcacacccac

SEQ ID NO: 898163 - DNA, 15 bp, Homo sapiens
cgttctcccaaagat

SEQ ID NO: 898164 - DNA, 14 bp, Homo sapiens
cgttctcccagcac

SEQ ID NO: 898165 - DNA, 18 bp, Homo sapiens
cgttctccttccccattt

SEQ ID NO: 898166 - DNA, 13 bp, Homo sapiens
cgttctctctttg

SEQ ID NO: 898167 - DNA, 19 bp, Homo sapiens
cgttctctgggtggccggc

SEQ ID NO: 898168 - DNA, 20 bp, Homo sapiens
cgttctctgtcctacttctg

SEQ ID NO: 898169 - DNA, 18 bp, Homo sapiens
cgttctcttctctcttca

SEQ ID NO: 898170 - DNA, 14 bp, Homo sapiens
cgttctgctcatca

SEQ ID NO: 898171 - DNA, 18 bp, Homo sapiens
cgttctggactctgcccc

SEQ ID NO: 898172 - DNA, 19 bp, Homo sapiens
cgttctggactctgcccca

SEQ ID NO: 898173 - DNA, 12 bp, Homo sapiens
cgttctgtgcac

SEQ ID NO: 898174 - DNA, 20 bp, Homo sapiens
cgttcttacaagcttaaagc

SEQ ID NO: 898175 - DNA, 13 bp, Homo sapiens
cgttcttgtaatt

SEQ ID NO: 898176 - DNA, 14 bp, Homo sapiens
cgttcttgtaattt

SEQ ID NO: 898177 - DNA, 20 bp, Homo sapiens
cgttgaattggaaactgctt

SEQ ID NO: 898178 - DNA, 19 bp, Homo sapiens
cgttgagtgtacagatttt

SEQ ID NO: 898179 - DNA, 21 bp, Homo sapiens
cgttggagagcagcaggtgct

SEQ ID NO: 898180 - DNA, 14 bp, Homo sapiens
cgttggatttaaaa

SEQ ID NO: 898181 - DNA, 13 bp, Homo sapiens
cgttgggagccta

SEQ ID NO: 898182 - DNA, 17 bp, Homo sapiens
cgttgggagcctagctc

SEQ ID NO: 898183 - DNA, 21 bp, Homo sapiens
cgttggtagagccctcagaac

SEQ ID NO: 898184 - DNA, 14 bp, Homo sapiens
cgttgtaaaatata

SEQ ID NO: 898185 - DNA, 14 bp, Homo sapiens
cgttgtgagctgga

SEQ ID NO: 898186 - DNA, 16 bp, Homo sapiens
cgtttaagttgtatta

SEQ ID NO: 898187 - DNA, 23 bp, Homo sapiens
cgtttacaagcccccccttccac

SEQ ID NO: 898188 - DNA, 22 bp, Homo sapiens
cgtttcagcgactccgttggcc

SEQ ID NO: 898189 - DNA, 15 bp, Homo sapiens
cgtttccctgaactt

SEQ ID NO: 898190 - DNA, 19 bp, Homo sapiens
cgtttctaaaggctacctt

SEQ ID NO: 898191 - DNA, 21 bp, Homo sapiens
cgtttctaaaggctacctttg

SEQ ID NO: 898192 - DNA, 20 bp, Homo sapiens
cgtttctatgacacatgcaa

SEQ ID NO: 898193 - DNA, 12 bp, Homo sapiens
cgtttcttcccc

SEQ ID NO: 898194 - DNA, 13 bp, Homo sapiens
cgtttcttcctgc

SEQ ID NO: 898195 - DNA, 17 bp, Homo sapiens
cgtttgaccttttatgt

SEQ ID NO: 898196 - DNA, 15 bp, Homo sapiens
cgtttgcaccgcctg

SEQ ID NO: 898197 - DNA, 13 bp, Homo sapiens
cgtttgcctcctg

SEQ ID NO: 898198 - DNA, 14 bp, Homo sapiens
cgtttgcctcctgg

SEQ ID NO: 898199 - DNA, 18 bp, Homo sapiens
cgtttggtgcttctcaga

SEQ ID NO: 898200 - DNA, 15 bp, Homo sapiens
cgtttgtatgtgtgt

SEQ ID NO: 898201 - DNA, 15 bp, Homo sapiens
cgttttaccaataaa

SEQ ID NO: 898202 - DNA, 18 bp, Homo sapiens
cgttttaccaataaactg

SEQ ID NO: 898203 - DNA, 20 bp, Homo sapiens
cgttttcatcctggcctcct

SEQ ID NO: 898204 - DNA, 18 bp, Homo sapiens
cgttttcttctttccctg

SEQ ID NO: 898205 - DNA, 13 bp, Homo sapiens
cgttttgggccag

SEQ ID NO: 898206 - DNA, 20 bp, Homo sapiens
cgttttggtgttgcttttca

SEQ ID NO: 898207 - DNA, 16 bp, Homo sapiens
cgtttttagctttgtg

SEQ ID NO: 898208 - DNA, 20 bp, Homo sapiens
cgtttttattcctcttattg

SEQ ID NO: 898209 - DNA, 22 bp, Homo sapiens
cgtttttctcgtccccctccct

SEQ ID NO: 898210 - DNA, 13 bp, Homo sapiens
cgtttttgtgctg

SEQ ID NO: 898211 - DNA, 15 bp, Homo sapiens
cgtttttgtgctgtg

SEQ ID NO: 898212 - DNA, 15 bp, Homo sapiens
ctaaaaaaaagatga

SEQ ID NO: 898213 - DNA, 17 bp, Homo sapiens
ctaaaaaaatttttgac

SEQ ID NO: 898214 - DNA, 21 bp, Homo sapiens
ctaaaaaaatttttgacactt

SEQ ID NO: 898215 - DNA, 11 bp, Homo sapiens
ctaaaaaacag

SEQ ID NO: 898216 - DNA, 17 bp, Homo sapiens
ctaaaaaacagaggcca

SEQ ID NO: 898217 - DNA, 15 bp, Homo sapiens
ctaaaaaagatatat

SEQ ID NO: 898218 - DNA, 22 bp, Homo sapiens
ctaaaaacccaagtttatttct

SEQ ID NO: 898219 - DNA, 18 bp, Homo sapiens
ctaaaaagacctggcctt

SEQ ID NO: 898220 - DNA, 24 bp, Homo sapiens
ctaaaaagctatgtatcgctccta

SEQ ID NO: 898221 - DNA, 13 bp, Homo sapiens
ctaaaaagtataa

SEQ ID NO: 898222 - DNA, 16 bp, Homo sapiens
ctaaaaagtataaaat

SEQ ID NO: 898223 - DNA, 17 bp, Homo sapiens
ctaaaaagtataaaata

SEQ ID NO: 898224 - DNA, 13 bp, Homo sapiens
ctaaaaataagaa

SEQ ID NO: 898225 - DNA, 23 bp, Homo sapiens
ctaaaaataagaaattagccggg

SEQ ID NO: 898226 - DNA, 21 bp, Homo sapiens
ctaaaaatagacttaaatctc

SEQ ID NO: 898227 - DNA, 21 bp, Homo sapiens
ctaaaaatctgagaaactcta

SEQ ID NO: 898228 - DNA, 15 bp, Homo sapiens
ctaaaaatgaaaatt

SEQ ID NO: 898229 - DNA, 17 bp, Homo sapiens
ctaaaacaacagatgta

SEQ ID NO: 898230 - DNA, 17 bp, Homo sapiens
ctaaaaccattccattt

SEQ ID NO: 898231 - DNA, 24 bp, Homo sapiens
ctaaaactcagagaatcaaagatg

SEQ ID NO: 898232 - DNA, 18 bp, Homo sapiens
ctaaaactggcctgactt

SEQ ID NO: 898233 - DNA, 13 bp, Homo sapiens
ctaaaagaagaga

SEQ ID NO: 898234 - DNA, 14 bp, Homo sapiens
ctaaaagaagagag

SEQ ID NO: 898235 - DNA, 19 bp, Homo sapiens
ctaaaagacagcagggaca

SEQ ID NO: 898236 - DNA, 15 bp, Homo sapiens
ctaaaagatcctttt

SEQ ID NO: 898237 - DNA, 15 bp, Homo sapiens
ctaaaagccacccca

SEQ ID NO: 898238 - DNA, 14 bp, Homo sapiens
ctaaaaggaaaagg

SEQ ID NO: 898239 - DNA, 13 bp, Homo sapiens
ctaaaagtaaaca

SEQ ID NO: 898240 - DNA, 21 bp, Homo sapiens
ctaaaagtgcatttaaggaga

SEQ ID NO: 898241 - DNA, 23 bp, Homo sapiens
ctaaaagtgcatttaaggagatt

SEQ ID NO: 898242 - DNA, 19 bp, Homo sapiens
ctaaaagtgggcttgattc

SEQ ID NO: 898243 - DNA, 20 bp, Homo sapiens
ctaaaagtgggcttgattct

SEQ ID NO: 898244 - DNA, 14 bp, Homo sapiens
ctaaaataaagaaa

SEQ ID NO: 898245 - DNA, 22 bp, Homo sapiens
ctaaaataaagaaatagaacaa

SEQ ID NO: 898246 - DNA, 18 bp, Homo sapiens
ctaaaataagctcagtga

SEQ ID NO: 898247 - DNA, 16 bp, Homo sapiens
ctaaaatattttagat

SEQ ID NO: 898248 - DNA, 16 bp, Homo sapiens
ctaaaatgaattttct

SEQ ID NO: 898249 - DNA, 14 bp, Homo sapiens
ctaaaatgatttta

SEQ ID NO: 898250 - DNA, 19 bp, Homo sapiens
ctaaaatggcgaacatgtg

SEQ ID NO: 898251 - DNA, 20 bp, Homo sapiens
ctaaaatggcgaacatgtgt

SEQ ID NO: 898252 - DNA, 20 bp, Homo sapiens
cttcgtcctgatccctccac

SEQ ID NO: 898253 - DNA, 14 bp, Homo sapiens
cttcgtctttccca

SEQ ID NO: 898254 - DNA, 22 bp, Homo sapiens
cttcgtctttcccatggggagg

SEQ ID NO: 898255 - DNA, 23 bp, Homo sapiens
cttcgtgaacatcccctcccatc

SEQ ID NO: 898256 - DNA, 12 bp, Homo sapiens
cttcgtgctgga

SEQ ID NO: 898257 - DNA, 17 bp, Homo sapiens
cttcgtgtctctcccac

SEQ ID NO: 898258 - DNA, 16 bp, Homo sapiens
cttcgtgtgctgctgc

SEQ ID NO: 898259 - DNA, 16 bp, Homo sapiens
cttcgtgtggctcctg

SEQ ID NO: 898260 - DNA, 18 bp, Homo sapiens
cttcgtgtggctcctggt

SEQ ID NO: 898261 - DNA, 19 bp, Homo sapiens
cttcgttaatagattattt

SEQ ID NO: 898262 - DNA, 21 bp, Homo sapiens
cttcgttagtaatctgtataa

SEQ ID NO: 898263 - DNA, 19 bp, Homo sapiens
cttcgttctttttaagtta

SEQ ID NO: 898264 - DNA, 14 bp, Homo sapiens
cttctaaaagccat

SEQ ID NO: 898265 - DNA, 21 bp, Homo sapiens
cttctaaaggtgttgtccctt

SEQ ID NO: 898266 - DNA, 22 bp, Homo sapiens
cttctaaaggtgttgtcccttc

SEQ ID NO: 898267 - DNA, 23 bp, Homo sapiens
cttctaaaggtgttgtcccttct

SEQ ID NO: 898268 - DNA, 15 bp, Homo sapiens
cttctaaatgcatat

SEQ ID NO: 898269 - DNA, 18 bp, Homo sapiens
cttctaagaagacatttt

SEQ ID NO: 898270 - DNA, 23 bp, Homo sapiens
cttctaagagcgaacttcacata

SEQ ID NO: 898271 - DNA, 19 bp, Homo sapiens
cttctaagaggatacaaat

SEQ ID NO: 898272 - DNA, 14 bp, Homo sapiens
cttctaagtaaata

SEQ ID NO: 898273 - DNA, 17 bp, Homo sapiens
cttctaccatgaacaga

SEQ ID NO: 898274 - DNA, 12 bp, Homo sapiens
cttctacctgcc

SEQ ID NO: 898275 - DNA, 18 bp, Homo sapiens
cttctacctgccctcaag

SEQ ID NO: 898276 - DNA, 19 bp, Homo sapiens
cttctacggccatgagact

SEQ ID NO: 898277 - DNA, 13 bp, Homo sapiens
cttctactttcat

SEQ ID NO: 898278 - DNA, 13 bp, Homo sapiens
cttctagagctta

SEQ ID NO: 898279 - DNA, 16 bp, Homo sapiens
cttctagattcactgt

SEQ ID NO: 898280 - DNA, 16 bp, Homo sapiens
cttctagctgtctgtg

SEQ ID NO: 898281 - DNA, 19 bp, Homo sapiens
cttctaggagtcaactggc

SEQ ID NO: 898282 - DNA, 15 bp, Homo sapiens
gtggcaggaccagga

SEQ ID NO: 898283 - DNA, 21 bp, Homo sapiens
gtggcaggcacacagcagccc

SEQ ID NO: 898284 - DNA, 22 bp, Homo sapiens
gtggcaggcacacagcagcccc

SEQ ID NO: 898285 - DNA, 16 bp, Homo sapiens
gtggcaggggacagga

SEQ ID NO: 898286 - DNA, 22 bp, Homo sapiens
gtggcagggggccccgccaggg

SEQ ID NO: 898287 - DNA, 19 bp, Homo sapiens
gtggcaggtcactgtcact

SEQ ID NO: 898288 - DNA, 22 bp, Homo sapiens
gtggcaggtcactgtcactgcc

SEQ ID NO: 898289 - DNA, 21 bp, Homo sapiens
gtggcaggtgaccttctggga

SEQ ID NO: 898290 - DNA, 19 bp, Homo sapiens
gtggcaggtgggctgcctg

SEQ ID NO: 898291 - DNA, 21 bp, Homo sapiens
gtggcatctttgccttgggct

SEQ ID NO: 898292 - DNA, 17 bp, Homo sapiens
gtggcatgtggcctgtg

SEQ ID NO: 898293 - DNA, 19 bp, Homo sapiens
gtggcatgtggcctgtggc

SEQ ID NO: 898294 - DNA, 14 bp, Homo sapiens
gtggcatgttttga

SEQ ID NO: 898295 - DNA, 14 bp, Homo sapiens
gtggcattgaaatg

SEQ ID NO: 898296 - DNA, 16 bp, Homo sapiens
gtggcatttccaaaca

SEQ ID NO: 898297 - DNA, 19 bp, Homo sapiens
gtggccaaccaggacccag

SEQ ID NO: 898298 - DNA, 20 bp, Homo sapiens
gtggccaaccaggacccagg

SEQ ID NO: 898299 - DNA, 23 bp, Homo sapiens
gtggccaagaagcagtggcctta

SEQ ID NO: 898300 - DNA, 16 bp, Homo sapiens
gtggccaaggagctgc

SEQ ID NO: 898301 - DNA, 18 bp, Homo sapiens
gtggccaaggagctgcta

SEQ ID NO: 898302 - DNA, 14 bp, Homo sapiens
gtggccacagcccc

SEQ ID NO: 898303 - DNA, 20 bp, Homo sapiens
gtggccacagcccccttgcc

SEQ ID NO: 898304 - DNA, 21 bp, Homo sapiens
gtggccacagcccccttgccc

SEQ ID NO: 898305 - DNA, 17 bp, Homo sapiens
gtggccacagcgccagc

SEQ ID NO: 898306 - DNA, 18 bp, Homo sapiens
gtggccacagcgtgctgg

SEQ ID NO: 898307 - DNA, 20 bp, Homo sapiens
gtggccaccgggggtggctc

SEQ ID NO: 898308 - DNA, 22 bp, Homo sapiens
gtggccaccgggggtggctctg

SEQ ID NO: 898309 - DNA, 19 bp, Homo sapiens
gtggccacgttcagggagg

SEQ ID NO: 898310 - DNA, 11 bp, Homo sapiens
gtggccagagc

SEQ ID NO: 898311 - DNA, 14 bp, Homo sapiens
gtggccagagctgg

SEQ ID NO: 898312 - DNA, 18 bp, Homo sapiens
gtggccagagctggaagg

SEQ ID NO: 898313 - DNA, 19 bp, Homo sapiens
gtggccagagctggaaggc

SEQ ID NO: 898314 - DNA, 11 bp, Homo sapiens
gtggccagccc

SEQ ID NO: 898315 - DNA, 15 bp, Homo sapiens
gtggccagcctggat

SEQ ID NO: 898316 - DNA, 13 bp, Homo sapiens
gtggccagcgcca

SEQ ID NO: 898317 - DNA, 16 bp, Homo sapiens
gtggccagcgccaggg

SEQ ID NO: 898318 - DNA, 21 bp, Homo sapiens
gtggccaggctgcctggcctt

SEQ ID NO: 898319 - DNA, 12 bp, Homo sapiens
gtggccagggct

SEQ ID NO: 898320 - DNA, 15 bp, Homo sapiens
gtggccagggcttcc

SEQ ID NO: 898321 - DNA, 13 bp, Homo sapiens
gtggccagggtga

SEQ ID NO: 898322 - DNA, 17 bp, Homo sapiens
gtggccaggtgcttttc

SEQ ID NO: 898323 - DNA, 19 bp, Homo sapiens
gtggccatcactcagcccc

SEQ ID NO: 898324 - DNA, 18 bp, Homo sapiens
gtggccatcagggtgggc

SEQ ID NO: 898325 - DNA, 22 bp, Homo sapiens
gtggccatccctgggcccctcc

SEQ ID NO: 898326 - DNA, 18 bp, Homo sapiens
gtggccatcctacccagc

SEQ ID NO: 898327 - DNA, 21 bp, Homo sapiens
gtggccccaccctgggccctg

SEQ ID NO: 898328 - DNA, 16 bp, Homo sapiens
gtggcccccgggcctg

SEQ ID NO: 898329 - DNA, 19 bp, Homo sapiens
gtggcccccgggcctgcac

SEQ ID NO: 898330 - DNA, 13 bp, Homo sapiens
gtggccccctctc

SEQ ID NO: 898331 - DNA, 17 bp, Homo sapiens
gtggccccgtttctggt

SEQ ID NO: 898332 - DNA, 18 bp, Homo sapiens
gtggcccctcacctgggc

SEQ ID NO: 898333 - DNA, 21 bp, Homo sapiens
gtggcccctcacctgggcctt

SEQ ID NO: 898334 - DNA, 20 bp, Homo sapiens
gtggcccctgctgtctctct

SEQ ID NO: 898335 - DNA, 22 bp, Homo sapiens
gtggcccctgctgtctctctgg

SEQ ID NO: 898336 - DNA, 23 bp, Homo sapiens
gtggcccctgctgtctctctggg

SEQ ID NO: 898337 - DNA, 17 bp, Homo sapiens
gtggcccgaggaagctg

SEQ ID NO: 898338 - DNA, 17 bp, Homo sapiens
gtggccctgccatcttc

SEQ ID NO: 898339 - DNA, 13 bp, Homo sapiens
gtggccctgccct

SEQ ID NO: 898340 - DNA, 16 bp, Homo sapiens
gtggccctggcctgct

SEQ ID NO: 898341 - DNA, 19 bp, Homo sapiens
gtggccctggcctgctggg

SEQ ID NO: 898342 - DNA, 14 bp, Homo sapiens
gtggccctgtgcct

SEQ ID NO: 898343 - DNA, 11 bp, Homo sapiens
gtggcccttgc

SEQ ID NO: 898344 - DNA, 18 bp, Homo sapiens
gtggccgcacgcctctcc

SEQ ID NO: 898345 - DNA, 13 bp, Homo sapiens
gtggccgccatct

SEQ ID NO: 898346 - DNA, 14 bp, Homo sapiens
gtggccgccatctg

SEQ ID NO: 898347 - DNA, 16 bp, Homo sapiens
gtggccgcccctgagg

SEQ ID NO: 898348 - DNA, 15 bp, Homo sapiens
gtggccgctcctccc

SEQ ID NO: 898349 - DNA, 17 bp, Homo sapiens
gtggccgctcctccctg

SEQ ID NO: 898350 - DNA, 19 bp, Homo sapiens
gtggcctcaaccctccctc

SEQ ID NO: 898351 - DNA, 13 bp, Homo sapiens
gtggcctcagaat

SEQ ID NO: 898352 - DNA, 16 bp, Homo sapiens
gtggcctcagccctca

SEQ ID NO: 898353 - DNA, 18 bp, Homo sapiens
gtggcctcagctgaatgc

SEQ ID NO: 898354 - DNA, 23 bp, Homo sapiens
gtggcctcagctgaatgcctcct

SEQ ID NO: 898355 - DNA, 14 bp, Homo sapiens
gtggcctccctgct

SEQ ID NO: 898356 - DNA, 13 bp, Homo sapiens
gtggcctcctggc

SEQ ID NO: 898357 - DNA, 14 bp, Homo sapiens
gtggcctcctggcc

SEQ ID NO: 898358 - DNA, 22 bp, Homo sapiens
gtggcctcgggacacctgccct

SEQ ID NO: 898359 - DNA, 20 bp, Homo sapiens
gtggcctctctctctctcct

SEQ ID NO: 898360 - DNA, 16 bp, Homo sapiens
gtggcctctgcctggg

SEQ ID NO: 898361 - DNA, 21 bp, Homo sapiens
gtggcctcttgagcagtggct

SEQ ID NO: 898362 - DNA, 22 bp, Homo sapiens
gtggcctcttggataccagctc

SEQ ID NO: 898363 - DNA, 13 bp, Homo sapiens
gtggcctgcccag

SEQ ID NO: 898364 - DNA, 20 bp, Homo sapiens
gtggcctggcatctgtgtgc

SEQ ID NO: 898365 - DNA, 14 bp, Homo sapiens
gtggcctgggcaag

SEQ ID NO: 898366 - DNA, 13 bp, Homo sapiens
gtggcctgtgctt

SEQ ID NO: 898367 - DNA, 15 bp, Homo sapiens
gtggcctgtggcctg

SEQ ID NO: 898368 - DNA, 19 bp, Homo sapiens
gtggcctgtgtccagcagc

SEQ ID NO: 898369 - DNA, 20 bp, Homo sapiens
gtggcctgtgtccagcagct

SEQ ID NO: 898370 - DNA, 21 bp, Homo sapiens
gtggcctgtgtccagcagctg

SEQ ID NO: 898371 - DNA, 19 bp, Homo sapiens
gtggcctgtgtcccatgac

SEQ ID NO: 898372 - DNA, 13 bp, Homo sapiens
gtggcctgtttct

SEQ ID NO: 898373 - DNA, 23 bp, Homo sapiens
gtggcctgtttgaaagtaaaaac

SEQ ID NO: 898374 - DNA, 20 bp, Homo sapiens
cttctgtccatcagtgcatg

SEQ ID NO: 898375 - DNA, 22 bp, Homo sapiens
cttctgtccccagccctgtcct

SEQ ID NO: 898376 - DNA, 21 bp, Homo sapiens
cttctgtgagacccccacacc

SEQ ID NO: 898377 - DNA, 22 bp, Homo sapiens
cttctgtgagacccccacacct

SEQ ID NO: 898378 - DNA, 15 bp, Homo sapiens
cttctgtgatgagct

SEQ ID NO: 898379 - DNA, 19 bp, Homo sapiens
cttctgtgatgagctgatc

SEQ ID NO: 898380 - DNA, 22 bp, Homo sapiens
cttctgtgcactagcctgtgat

SEQ ID NO: 898381 - DNA, 17 bp, Homo sapiens
cttctgtgcccagggtg

SEQ ID NO: 898382 - DNA, 13 bp, Homo sapiens
cttctgtggctca

SEQ ID NO: 898383 - DNA, 22 bp, Homo sapiens
cttctgtggctcacagaaccct

SEQ ID NO: 898384 - DNA, 14 bp, Homo sapiens
cttctgtggggctg

SEQ ID NO: 898385 - DNA, 15 bp, Homo sapiens
cttctgtggggctgg

SEQ ID NO: 898386 - DNA, 16 bp, Homo sapiens
cttctgtgtaccactt

SEQ ID NO: 898387 - DNA, 22 bp, Homo sapiens
cttctgtgtaccacttctgtgg

SEQ ID NO: 898388 - DNA, 16 bp, Homo sapiens
cttctgtgttcatttt

SEQ ID NO: 898389 - DNA, 16 bp, Homo sapiens
cttctgttaagaaagg

SEQ ID NO: 898390 - DNA, 14 bp, Homo sapiens
cttctgttctctgc

SEQ ID NO: 898391 - DNA, 15 bp, Homo sapiens
cttctgttctctgct

SEQ ID NO: 898392 - DNA, 17 bp, Homo sapiens
cttctgttctctgctga

SEQ ID NO: 898393 - DNA, 16 bp, Homo sapiens
cttctgttctctggtt

SEQ ID NO: 898394 - DNA, 21 bp, Homo sapiens
cttcttaaaagaaatcttgct

SEQ ID NO: 898395 - DNA, 13 bp, Homo sapiens
cttcttaaagagt

SEQ ID NO: 898396 - DNA, 14 bp, Homo sapiens
cttcttaaaggcct

SEQ ID NO: 898397 - DNA, 14 bp, Homo sapiens
cttcttacacttct

SEQ ID NO: 898398 - DNA, 13 bp, Homo sapiens
cttcttacatgca

SEQ ID NO: 898399 - DNA, 14 bp, Homo sapiens
cttcttacatgcat

SEQ ID NO: 898400 - DNA, 15 bp, Homo sapiens
cttcttacatgcatt

SEQ ID NO: 898401 - DNA, 22 bp, Homo sapiens
cttcttacccgaaagcatcact

SEQ ID NO: 898402 - DNA, 23 bp, Homo sapiens
cttcttatggaattgatttgcat

SEQ ID NO: 898403 - DNA, 13 bp, Homo sapiens
cttcttcaccatt

SEQ ID NO: 898404 - DNA, 14 bp, Homo sapiens
cttcttcacccagc

SEQ ID NO: 898405 - DNA, 22 bp, Homo sapiens
cttcttcagagtgaagaatctt

SEQ ID NO: 898406 - DNA, 21 bp, Homo sapiens
cttcttcagcaggaagggtgg

SEQ ID NO: 898407 - DNA, 23 bp, Homo sapiens
cttcttccaaggagcagagaggt

SEQ ID NO: 898408 - DNA, 21 bp, Homo sapiens
cttcttccaggatcaggggtt

SEQ ID NO: 898409 - DNA, 20 bp, Homo sapiens
cttcttccccaggtccttcc

SEQ ID NO: 898410 - DNA, 20 bp, Homo sapiens
cttcttcccctttgtcctgc

SEQ ID NO: 898411 - DNA, 20 bp, Homo sapiens
cttcttccctgtcagcctga

SEQ ID NO: 898412 - DNA, 17 bp, Homo sapiens
cttcttcctaggtccaa

SEQ ID NO: 898413 - DNA, 10 bp, Homo sapiens
cttcttcctc

SEQ ID NO: 898414 - DNA, 15 bp, Homo sapiens
cttcttcctcacact

SEQ ID NO: 898415 - DNA, 15 bp, Homo sapiens
cttcttcctcctcca

SEQ ID NO: 898416 - DNA, 15 bp, Homo sapiens
cttcttcctgaagct

SEQ ID NO: 898417 - DNA, 19 bp, Homo sapiens
cttcttcctttctctttct

SEQ ID NO: 898418 - DNA, 19 bp, Homo sapiens
cttcttcgctgctagagaa

SEQ ID NO: 898419 - DNA, 22 bp, Homo sapiens
cttcttcgttaatagattattt

SEQ ID NO: 898420 - DNA, 15 bp, Homo sapiens
cttcttctaagaaga

SEQ ID NO: 898421 - DNA, 18 bp, Homo sapiens
cttcttctaagaagacat

SEQ ID NO: 898422 - DNA, 14 bp, Homo sapiens
cttcttctctccac

SEQ ID NO: 898423 - DNA, 19 bp, Homo sapiens
cttcttctgccacttctgc

SEQ ID NO: 898424 - DNA, 17 bp, Homo sapiens
cttcttctgtaatattt

SEQ ID NO: 898425 - DNA, 13 bp, Homo sapiens
cttcttcttcaga

SEQ ID NO: 898426 - DNA, 17 bp, Homo sapiens
cttcttgaaacagcctg

SEQ ID NO: 898427 - DNA, 16 bp, Homo sapiens
cttcttgaatataaaa

SEQ ID NO: 898428 - DNA, 19 bp, Homo sapiens
cttcttgaatataaaaaat

SEQ ID NO: 898429 - DNA, 20 bp, Homo sapiens
cttcttgccatcactggtcc

SEQ ID NO: 898430 - DNA, 15 bp, Homo sapiens
cttcttgcctctgtg

SEQ ID NO: 898431 - DNA, 16 bp, Homo sapiens
cttcttgcctctgtgc

SEQ ID NO: 898432 - DNA, 18 bp, Homo sapiens
cttcttgcctctgtgctg

SEQ ID NO: 898433 - DNA, 17 bp, Homo sapiens
cttcttggagctttgga

SEQ ID NO: 898434 - DNA, 18 bp, Homo sapiens
cttcttggagctttggaa

SEQ ID NO: 898435 - DNA, 19 bp, Homo sapiens
cttcttggagctttggaat

SEQ ID NO: 898436 - DNA, 23 bp, Homo sapiens
cttcttggcgctggagagtcaaa

SEQ ID NO: 898437 - DNA, 16 bp, Homo sapiens
cttcttggcttctggg

SEQ ID NO: 898438 - DNA, 18 bp, Homo sapiens
cttcttgggagtatgttg

SEQ ID NO: 898439 - DNA, 21 bp, Homo sapiens
cttcttgggagtatgttgtca

SEQ ID NO: 898440 - DNA, 17 bp, Homo sapiens
cttcttgggctgagtgc

SEQ ID NO: 898441 - DNA, 22 bp, Homo sapiens
cttcttgggctgagtgcagcca

SEQ ID NO: 898442 - DNA, 18 bp, Homo sapiens
cttcttgggtctgccctg

SEQ ID NO: 898443 - DNA, 14 bp, Homo sapiens
cttcttggttcctg

SEQ ID NO: 898444 - DNA, 21 bp, Homo sapiens
cttcttggtttggggagaaat

SEQ ID NO: 898445 - DNA, 20 bp, Homo sapiens
cttcttggttttctctctgg

SEQ ID NO: 898446 - DNA, 17 bp, Homo sapiens
cttcttgtgattgctgc

SEQ ID NO: 898447 - DNA, 21 bp, Homo sapiens
cttcttgtgattgctgccata

SEQ ID NO: 898448 - DNA, 22 bp, Homo sapiens
cttcttgtgattgctgccataa

SEQ ID NO: 898449 - DNA, 18 bp, Homo sapiens
cttcttgtgtcctgatga

SEQ ID NO: 898450 - DNA, 22 bp, Homo sapiens
cttcttgttctgagattcaata

SEQ ID NO: 898451 - DNA, 16 bp, Homo sapiens
cttcttgtttccttgt

SEQ ID NO: 898452 - DNA, 19 bp, Homo sapiens
cttctttagaccctcgggc

SEQ ID NO: 898453 - DNA, 18 bp, Homo sapiens
cttctttagatgccaaac

SEQ ID NO: 898454 - DNA, 15 bp, Homo sapiens
cttctttagcatttt

SEQ ID NO: 898455 - DNA, 16 bp, Homo sapiens
cttctttattattcct

SEQ ID NO: 898456 - DNA, 14 bp, Homo sapiens
cttctttattgcac

SEQ ID NO: 898457 - DNA, 13 bp, Homo sapiens
cttctttccctgg

SEQ ID NO: 898458 - DNA, 14 bp, Homo sapiens
cttctttccctgga

SEQ ID NO: 898459 - DNA, 16 bp, Homo sapiens
cttctttccctggaca

SEQ ID NO: 898460 - DNA, 17 bp, Homo sapiens
cttctttccctggacag

SEQ ID NO: 898461 - DNA, 23 bp, Homo sapiens
cttctttccctggacaggcagcc

SEQ ID NO: 898462 - DNA, 12 bp, Homo sapiens
cttctttccttt

SEQ ID NO: 898463 - DNA, 15 bp, Homo sapiens
cttctttctggactg

SEQ ID NO: 898464 - DNA, 17 bp, Homo sapiens
cttctttctggactggc

SEQ ID NO: 898465 - DNA, 16 bp, Homo sapiens
cttctttctggttgtt

SEQ ID NO: 898466 - DNA, 15 bp, Homo sapiens
cttctttgcagggct

SEQ ID NO: 898467 - DNA, 15 bp, Homo sapiens
cttctttgcctccct

SEQ ID NO: 898468 - DNA, 23 bp, Homo sapiens
cttcttttaagatgtgtcttcaa

SEQ ID NO: 898469 - DNA, 12 bp, Homo sapiens
cttcttttcctt

SEQ ID NO: 898470 - DNA, 13 bp, Homo sapiens
cttcttttccttt

SEQ ID NO: 898471 - DNA, 14 bp, Homo sapiens
cttcttttctcatg

SEQ ID NO: 898472 - DNA, 13 bp, Homo sapiens
cttcttttgatta

SEQ ID NO: 898473 - DNA, 14 bp, Homo sapiens
cttcttttgattat

SEQ ID NO: 898474 - DNA, 14 bp, Homo sapiens
cttcttttgtctcc

SEQ ID NO: 898475 - DNA, 21 bp, Homo sapiens
cttcttttgtggtgtcttcca

SEQ ID NO: 898476 - DNA, 13 bp, Homo sapiens
cttctttttcatc

SEQ ID NO: 898477 - DNA, 13 bp, Homo sapiens
cttctttttctgg

SEQ ID NO: 898478 - DNA, 14 bp, Homo sapiens
cttctttttctgga

SEQ ID NO: 898479 - DNA, 19 bp, Homo sapiens
cttctttttctggactctg

SEQ ID NO: 898480 - DNA, 16 bp, Homo sapiens
cttcttttttttcatt

SEQ ID NO: 898481 - DNA, 13 bp, Homo sapiens
cttgaaaaacaaa

SEQ ID NO: 898482 - DNA, 23 bp, Homo sapiens
cttgaaaaacaaagtttctattt

SEQ ID NO: 898483 - DNA, 11 bp, Homo sapiens
cttgaaaagtt

SEQ ID NO: 898484 - DNA, 20 bp, Homo sapiens
cttgaaacagattcaggcca

SEQ ID NO: 898485 - DNA, 21 bp, Homo sapiens
cttgaaacagattcaggccag

SEQ ID NO: 898486 - DNA, 22 bp, Homo sapiens
cttgaaacagattcaggccagc

SEQ ID NO: 898487 - DNA, 14 bp, Homo sapiens
cttgaaacagcctg

SEQ ID NO: 898488 - DNA, 15 bp, Homo sapiens
cttgaaacagcctgg

SEQ ID NO: 898489 - DNA, 17 bp, Homo sapiens
cttgaaacagcctgggt

SEQ ID NO: 898490 - DNA, 21 bp, Homo sapiens
cttgaaacctgttaaaacaac

SEQ ID NO: 898491 - DNA, 19 bp, Homo sapiens
cttgaaagaagtattaaaa

SEQ ID NO: 898492 - DNA, 20 bp, Homo sapiens
cttgaaagaagtattaaaaa

SEQ ID NO: 898493 - DNA, 20 bp, Homo sapiens
cttgaaagattttattgtat

SEQ ID NO: 898494 - DNA, 16 bp, Homo sapiens
cttgaaagcatccatg

SEQ ID NO: 898495 - DNA, 17 bp, Homo sapiens
cttgaaagcatccatgt

SEQ ID NO: 898496 - DNA, 16 bp, Homo sapiens
gtggtcattaagcatt

SEQ ID NO: 898497 - DNA, 12 bp, Homo sapiens
gtggtcctgact

SEQ ID NO: 898498 - DNA, 20 bp, Homo sapiens
gtggtctcacctggaggcaa

SEQ ID NO: 898499 - DNA, 13 bp, Homo sapiens
gtggtctcaggat

SEQ ID NO: 898500 - DNA, 15 bp, Homo sapiens
gtggtctctgctggg

SEQ ID NO: 898501 - DNA, 14 bp, Homo sapiens
gtggtctgaatgtt

SEQ ID NO: 898502 - DNA, 18 bp, Homo sapiens
gtggtctgaatgttctga

SEQ ID NO: 898503 - DNA, 16 bp, Homo sapiens
gtggtctgtggatcag

SEQ ID NO: 898504 - DNA, 19 bp, Homo sapiens
gtggtctgttggcaggctg

SEQ ID NO: 898505 - DNA, 17 bp, Homo sapiens
gtggtctttctggagag

SEQ ID NO: 898506 - DNA, 20 bp, Homo sapiens
gtggtgaagtgtggctggtg

SEQ ID NO: 898507 - DNA, 23 bp, Homo sapiens
gtggtgaagtgtggctggtgtcc

SEQ ID NO: 898508 - DNA, 14 bp, Homo sapiens
gtggtgacaggccc

SEQ ID NO: 898509 - DNA, 16 bp, Homo sapiens
gtggtgaccccaggag

SEQ ID NO: 898510 - DNA, 13 bp, Homo sapiens
gtggtgagatcat

SEQ ID NO: 898511 - DNA, 18 bp, Homo sapiens
gtggtgatgtccaaaaga

SEQ ID NO: 898512 - DNA, 20 bp, Homo sapiens
gtggtgcagccttcccctcc

SEQ ID NO: 898513 - DNA, 21 bp, Homo sapiens
gtggtggaggggcgcccaggg

SEQ ID NO: 898514 - DNA, 22 bp, Homo sapiens
gtggtggaggggcgcccagggt

SEQ ID NO: 898515 - DNA, 16 bp, Homo sapiens
gtggtggcacaggccc

SEQ ID NO: 898516 - DNA, 14 bp, Homo sapiens
gtggtggcaggcac

SEQ ID NO: 898517 - DNA, 17 bp, Homo sapiens
gtggtggcagtggaggt

SEQ ID NO: 898518 - DNA, 13 bp, Homo sapiens
gtggtggcctcag

SEQ ID NO: 898519 - DNA, 18 bp, Homo sapiens
gtggtggcctggtccctg

SEQ ID NO: 898520 - DNA, 18 bp, Homo sapiens
gtggtggcgggcgcctgt

SEQ ID NO: 898521 - DNA, 18 bp, Homo sapiens
gtggtggctcacgcctgt

SEQ ID NO: 898522 - DNA, 14 bp, Homo sapiens
gtggtgggcttctg

SEQ ID NO: 898523 - DNA, 19 bp, Homo sapiens
gtggtgggcttctgcgtcc

SEQ ID NO: 898524 - DNA, 15 bp, Homo sapiens
gtggtggggctgccg

SEQ ID NO: 898525 - DNA, 22 bp, Homo sapiens
gtggtgggttctttggaaggag

SEQ ID NO: 898526 - DNA, 14 bp, Homo sapiens
gtggtgtatttgag

SEQ ID NO: 898527 - DNA, 22 bp, Homo sapiens
gtggtgtcccctatcctcccct

SEQ ID NO: 898528 - DNA, 13 bp, Homo sapiens
gtggtgtggcccg

SEQ ID NO: 898529 - DNA, 23 bp, Homo sapiens
gtggtgtgtccccctctgtccag

SEQ ID NO: 898530 - DNA, 20 bp, Homo sapiens
gtggtgtttcctgcaggcca

SEQ ID NO: 898531 - DNA, 20 bp, Homo sapiens
gtggttaaaagggaacacaa

SEQ ID NO: 898532 - DNA, 18 bp, Homo sapiens
gtggttaaggccagggcc

SEQ ID NO: 898533 - DNA, 17 bp, Homo sapiens
gtggttataacttaatg

SEQ ID NO: 898534 - DNA, 22 bp, Homo sapiens
gtggttatttctcaacaaagca

SEQ ID NO: 898535 - DNA, 17 bp, Homo sapiens
gtggttcaagcacactg

SEQ ID NO: 898536 - DNA, 12 bp, Homo sapiens
gtggttcctaag

SEQ ID NO: 898537 - DNA, 17 bp, Homo sapiens
gtggttctataataagt

SEQ ID NO: 898538 - DNA, 14 bp, Homo sapiens
gtggttctatttta

SEQ ID NO: 898539 - DNA, 19 bp, Homo sapiens
gtggttctattttactttg

SEQ ID NO: 898540 - DNA, 15 bp, Homo sapiens
gtggttctcatttgg

SEQ ID NO: 898541 - DNA, 12 bp, Homo sapiens
gtggttcttaaa

SEQ ID NO: 898542 - DNA, 19 bp, Homo sapiens
gtggttcttaaatgtttat

SEQ ID NO: 898543 - DNA, 18 bp, Homo sapiens
cttgaaggactgcagaca

SEQ ID NO: 898544 - DNA, 21 bp, Homo sapiens
cttgaaggccctgctgagtca

SEQ ID NO: 898545 - DNA, 19 bp, Homo sapiens
cttgaagtcagccacactg

SEQ ID NO: 898546 - DNA, 20 bp, Homo sapiens
cttgaagtctaaaagcagaa

SEQ ID NO: 898547 - DNA, 16 bp, Homo sapiens
cttgaagttgggtgtt

SEQ ID NO: 898548 - DNA, 20 bp, Homo sapiens
cttgaagttgggtgtttcca

SEQ ID NO: 898549 - DNA, 19 bp, Homo sapiens
cttgaatactctgccctct

SEQ ID NO: 898550 - DNA, 20 bp, Homo sapiens
cttgaatagattttctctgg

SEQ ID NO: 898551 - DNA, 18 bp, Homo sapiens
cttgaatagtattgtgtt

SEQ ID NO: 898552 - DNA, 13 bp, Homo sapiens
cttgaatataaaa

SEQ ID NO: 898553 - DNA, 16 bp, Homo sapiens
cttgaatataaaaaat

SEQ ID NO: 898554 - DNA, 19 bp, Homo sapiens
cttgaatattcctggactt

SEQ ID NO: 898555 - DNA, 22 bp, Homo sapiens
cttgaatattcctggacttaca

SEQ ID NO: 898556 - DNA, 21 bp, Homo sapiens
cttgaatcagcatctcttctt

SEQ ID NO: 898557 - DNA, 16 bp, Homo sapiens
cttgaatgctgccagt

SEQ ID NO: 898558 - DNA, 13 bp, Homo sapiens
cttgaatgtcttt

SEQ ID NO: 898559 - DNA, 20 bp, Homo sapiens
cttgaatgtggcttgagaaa

SEQ ID NO: 898560 - DNA, 22 bp, Homo sapiens
cttgaatgtggcttgagaaata

SEQ ID NO: 898561 - DNA, 20 bp, Homo sapiens
cttgaatgtggtctcaggat

SEQ ID NO: 898562 - DNA, 15 bp, Homo sapiens
cttgaatgtgtcagg

SEQ ID NO: 898563 - DNA, 22 bp, Homo sapiens
cttgaattgtaactgttcttga

SEQ ID NO: 898564 - DNA, 18 bp, Homo sapiens
cttgaattgttatgaaaa

SEQ ID NO: 898565 - DNA, 13 bp, Homo sapiens
cttgaatttctgc

SEQ ID NO: 898566 - DNA, 20 bp, Homo sapiens
cttgacaaaacctaacttgc

SEQ ID NO: 898567 - DNA, 16 bp, Homo sapiens
cttgacaacagactga

SEQ ID NO: 898568 - DNA, 15 bp, Homo sapiens
cttgacaacatccca

SEQ ID NO: 898569 - DNA, 24 bp, Homo sapiens
cttgacaacatcccacagtggcac

SEQ ID NO: 898570 - DNA, 11 bp, Homo sapiens
cttgacaagct

SEQ ID NO: 898571 - DNA, 13 bp, Homo sapiens
cttgacacctgct

SEQ ID NO: 898572 - DNA, 22 bp, Homo sapiens
cttgacagtatatttgaaactg

SEQ ID NO: 898573 - DNA, 15 bp, Homo sapiens
cttgacatacctacc

SEQ ID NO: 898574 - DNA, 20 bp, Homo sapiens
cttgacatacctaccagtat

SEQ ID NO: 898575 - DNA, 22 bp, Homo sapiens
cttgacatacctaccagtatta

SEQ ID NO: 898576 - DNA, 14 bp, Homo sapiens
cttgacattcaagg

SEQ ID NO: 898577 - DNA, 23 bp, Homo sapiens
cttgacattccttgtcaccagca

SEQ ID NO: 898578 - DNA, 17 bp, Homo sapiens
cttgaccattggctgcg

SEQ ID NO: 898579 - DNA, 15 bp, Homo sapiens
cttgaccctgcaccc

SEQ ID NO: 898580 - DNA, 18 bp, Homo sapiens
cttgaccctgcaccctcc

SEQ ID NO: 898581 - DNA, 22 bp, Homo sapiens
cttgaccctgcaccctcctagg

SEQ ID NO: 898582 - DNA, 17 bp, Homo sapiens
cttgaccgtactctcac

SEQ ID NO: 898583 - DNA, 12 bp, Homo sapiens
cttgacctccta

SEQ ID NO: 898584 - DNA, 22 bp, Homo sapiens
cttgacgggagcattggcccct

SEQ ID NO: 898585 - DNA, 20 bp, Homo sapiens
cttgacgtttcttctttcta

SEQ ID NO: 898586 - DNA, 16 bp, Homo sapiens
cttgactcaggattta

SEQ ID NO: 898587 - DNA, 17 bp, Homo sapiens
cttgactcatggcagct

SEQ ID NO: 898588 - DNA, 19 bp, Homo sapiens
cttgactcatggcagctgt

SEQ ID NO: 898589 - DNA, 13 bp, Homo sapiens
cttgactcttcta

SEQ ID NO: 898590 - DNA, 12 bp, Homo sapiens
cttgactgtcta

SEQ ID NO: 898591 - DNA, 17 bp, Homo sapiens
cttgacttgattagtgc

SEQ ID NO: 898592 - DNA, 20 bp, Homo sapiens
cttgactttagtctgcaaaa

SEQ ID NO: 898593 - DNA, 19 bp, Homo sapiens
cttgagaaccagtctcctc

SEQ ID NO: 898594 - DNA, 21 bp, Homo sapiens
cttgagaagtctaattcacag

SEQ ID NO: 898595 - DNA, 18 bp, Homo sapiens
cttgagacaaatcctttc

SEQ ID NO: 898596 - DNA, 21 bp, Homo sapiens
cttgagacaaatcctttctgc

SEQ ID NO: 898597 - DNA, 22 bp, Homo sapiens
cttgagacacggagcccagccc

SEQ ID NO: 898598 - DNA, 21 bp, Homo sapiens
cttgagagaaaaagtgcccct

SEQ ID NO: 898599 - DNA, 18 bp, Homo sapiens
cttgagaggagaaatgca

SEQ ID NO: 898600 - DNA, 22 bp, Homo sapiens
cttgagagtatcaggtctccca

SEQ ID NO: 898601 - DNA, 15 bp, Homo sapiens
cttgagatctgattt

SEQ ID NO: 898602 - DNA, 19 bp, Homo sapiens
cttgagatctgtataaata

SEQ ID NO: 898603 - DNA, 20 bp, Homo sapiens
cttgagatctgtataaataa

SEQ ID NO: 898604 - DNA, 19 bp, Homo sapiens
cttgagatgagtttctggg

SEQ ID NO: 898605 - DNA, 16 bp, Homo sapiens
cttgagatggtgaggc

SEQ ID NO: 898606 - DNA, 19 bp, Homo sapiens
cttgagcaagttccttctg

SEQ ID NO: 898607 - DNA, 18 bp, Homo sapiens
cttgagcaataaagtgga

SEQ ID NO: 898608 - DNA, 16 bp, Homo sapiens
cttgagcatcaatctt

SEQ ID NO: 898609 - DNA, 13 bp, Homo sapiens
cttgagccagtaa

SEQ ID NO: 898610 - DNA, 18 bp, Homo sapiens
cttgagccagtaatcttt

SEQ ID NO: 898611 - DNA, 14 bp, Homo sapiens
cttgagcccactcc

SEQ ID NO: 898612 - DNA, 12 bp, Homo sapiens
cttgagcccagg

SEQ ID NO: 898613 - DNA, 14 bp, Homo sapiens
cttgagcccaggag

SEQ ID NO: 898614 - DNA, 15 bp, Homo sapiens
cttgagcccaggagt

SEQ ID NO: 898615 - DNA, 14 bp, Homo sapiens
cttgagccctggct

SEQ ID NO: 898616 - DNA, 17 bp, Homo sapiens
cttgagccgggcccctg

SEQ ID NO: 898617 - DNA, 19 bp, Homo sapiens
cttgagccgggcccctggg

SEQ ID NO: 898618 - DNA, 14 bp, Homo sapiens
tcctgctcctccct

SEQ ID NO: 898619 - DNA, 15 bp, Homo sapiens
tcctgctcctccctg

SEQ ID NO: 898620 - DNA, 13 bp, Homo sapiens
tcctgctctctgc

SEQ ID NO: 898621 - DNA, 16 bp, Homo sapiens
tcctgctctctgctca

SEQ ID NO: 898622 - DNA, 18 bp, Homo sapiens
tcctgctctctgctcatg

SEQ ID NO: 898623 - DNA, 13 bp, Homo sapiens
tcctgctctgttt

SEQ ID NO: 898624 - DNA, 14 bp, Homo sapiens
tcctgctcttttgt

SEQ ID NO: 898625 - DNA, 22 bp, Homo sapiens
tcctgctgaaagtcctgctttc

SEQ ID NO: 898626 - DNA, 17 bp, Homo sapiens
tcctgctgaccttctgc

SEQ ID NO: 898627 - DNA, 18 bp, Homo sapiens
tcctgctgccttttctgg

SEQ ID NO: 898628 - DNA, 16 bp, Homo sapiens
tcctgctgctcctgtt

SEQ ID NO: 898629 - DNA, 12 bp, Homo sapiens
tcctgctgctgt

SEQ ID NO: 898630 - DNA, 21 bp, Homo sapiens
tcctgctgctgtaactgctga

SEQ ID NO: 898631 - DNA, 13 bp, Homo sapiens
tcctgctgtccct

SEQ ID NO: 898632 - DNA, 18 bp, Homo sapiens
tcctgctgtccctgtcag

SEQ ID NO: 898633 - DNA, 16 bp, Homo sapiens
tcctgcttcccctccc

SEQ ID NO: 898634 - DNA, 18 bp, Homo sapiens
tcctgcttccgagatccc

SEQ ID NO: 898635 - DNA, 21 bp, Homo sapiens
tcctgcttctctcagccagct

SEQ ID NO: 898636 - DNA, 20 bp, Homo sapiens
tcctgcttcttcttccaaat

SEQ ID NO: 898637 - DNA, 19 bp, Homo sapiens
tcctgcttgccaaggcaga

SEQ ID NO: 898638 - DNA, 23 bp, Homo sapiens
tcctgcttgtactaagccaggag

SEQ ID NO: 898639 - DNA, 19 bp, Homo sapiens
tcctgctttgcgtgcccgg

SEQ ID NO: 898640 - DNA, 15 bp, Homo sapiens
tcctgctttggcagt

SEQ ID NO: 898641 - DNA, 18 bp, Homo sapiens
tcctgctttgggaagccg

SEQ ID NO: 898642 - DNA, 13 bp, Homo sapiens
tcctgcttttagg

SEQ ID NO: 898643 - DNA, 21 bp, Homo sapiens
tcctgcttttctgtcctgggc

SEQ ID NO: 898644 - DNA, 20 bp, Homo sapiens
tcctggaaaagaagaaactt

SEQ ID NO: 898645 - DNA, 17 bp, Homo sapiens
tcctggaaacagcatga

SEQ ID NO: 898646 - DNA, 20 bp, Homo sapiens
tcctggaaacagcatgaata

SEQ ID NO: 898647 - DNA, 19 bp, Homo sapiens
tcctggaaaggctcagtct

SEQ ID NO: 898648 - DNA, 22 bp, Homo sapiens
tcctggaaattgacgaggggtg

SEQ ID NO: 898649 - DNA, 19 bp, Homo sapiens
tcctggaacaatattttat

SEQ ID NO: 898650 - DNA, 14 bp, Homo sapiens
tcctggaaccaatc

SEQ ID NO: 898651 - DNA, 18 bp, Homo sapiens
gcctggggtgacctctag

SEQ ID NO: 898652 - DNA, 21 bp, Homo sapiens
gcctggggtgcatcctcctca

SEQ ID NO: 898653 - DNA, 22 bp, Homo sapiens
gcctggggtgcatcctcctcag

SEQ ID NO: 898654 - DNA, 21 bp, Homo sapiens
gcctggggtggcctggccctc

SEQ ID NO: 898655 - DNA, 16 bp, Homo sapiens
gcctggggtggggtca

SEQ ID NO: 898656 - DNA, 19 bp, Homo sapiens
gcctggggttcccgaggga

SEQ ID NO: 898657 - DNA, 20 bp, Homo sapiens
gcctggggttgtccccgctg

SEQ ID NO: 898658 - DNA, 14 bp, Homo sapiens
gcctgggtctgtgt

SEQ ID NO: 898659 - DNA, 23 bp, Homo sapiens
gcctgggtgacaaagtgagactc

SEQ ID NO: 898660 - DNA, 19 bp, Homo sapiens
gcctgggtgacagagcgag

SEQ ID NO: 898661 - DNA, 15 bp, Homo sapiens
gcctgggtgacagtg

SEQ ID NO: 898662 - DNA, 12 bp, Homo sapiens
gcctgggtgctg

SEQ ID NO: 898663 - DNA, 15 bp, Homo sapiens
gcctgggtgctggct

SEQ ID NO: 898664 - DNA, 20 bp, Homo sapiens
gcctgggtgctggctgccca

SEQ ID NO: 898665 - DNA, 16 bp, Homo sapiens
gcctgggtggccatcc

SEQ ID NO: 898666 - DNA, 17 bp, Homo sapiens
gcctgggtggccatcct

SEQ ID NO: 898667 - DNA, 20 bp, Homo sapiens
gcctgggtggggctgctcct

SEQ ID NO: 898668 - DNA, 22 bp, Homo sapiens
gcctgggttttgtggtcatcta

SEQ ID NO: 898669 - DNA, 19 bp, Homo sapiens
gcctggtactctggcaaat

SEQ ID NO: 898670 - DNA, 20 bp, Homo sapiens
gcctggtatatccaaaagct

SEQ ID NO: 898671 - DNA, 15 bp, Homo sapiens
gcctggtattttcaa

SEQ ID NO: 898672 - DNA, 22 bp, Homo sapiens
gcctggtccatgatggagtcag

SEQ ID NO: 898673 - DNA, 20 bp, Homo sapiens
gcctggtccatgcagggggc

SEQ ID NO: 898674 - DNA, 15 bp, Homo sapiens
gcctggtccctggga

SEQ ID NO: 898675 - DNA, 21 bp, Homo sapiens
gcctggtccttccctgatggc

SEQ ID NO: 898676 - DNA, 13 bp, Homo sapiens
gcctggtgggcct

SEQ ID NO: 898677 - DNA, 16 bp, Homo sapiens
gcctggtgttctgaag

SEQ ID NO: 898678 - DNA, 17 bp, Homo sapiens
gcctggtgttctgaagt

SEQ ID NO: 898679 - DNA, 14 bp, Homo sapiens
gcctggtttagcct

SEQ ID NO: 898680 - DNA, 20 bp, Homo sapiens
gcctggtttgcaaagaccac

SEQ ID NO: 898681 - DNA, 13 bp, Homo sapiens
gcctgtaaacttt

SEQ ID NO: 898682 - DNA, 22 bp, Homo sapiens
gcctgtaagaaaaaaaatgtac

SEQ ID NO: 898683 - DNA, 18 bp, Homo sapiens
gcctgtaatcccagctac

SEQ ID NO: 898684 - DNA, 20 bp, Homo sapiens
gcctgtaatcctagcacttt

SEQ ID NO: 898685 - DNA, 12 bp, Homo sapiens
gcctgtaatctt

SEQ ID NO: 898686 - DNA, 17 bp, Homo sapiens
gcctgtaatctttttct

SEQ ID NO: 898687 - DNA, 18 bp, Homo sapiens
gcctgtaccttgctgtgg

SEQ ID NO: 898688 - DNA, 22 bp, Homo sapiens
gcctgtagagacaatacagtaa

SEQ ID NO: 898689 - DNA, 15 bp, Homo sapiens
gcctgtagagttgct

SEQ ID NO: 898690 - DNA, 17 bp, Homo sapiens
gcctgtagagttgctga

SEQ ID NO: 898691 - DNA, 19 bp, Homo sapiens
gcctgtagagttgctgaga

SEQ ID NO: 898692 - DNA, 19 bp, Homo sapiens
gcctgtagcaatggccaga

SEQ ID NO: 898693 - DNA, 14 bp, Homo sapiens
gcctgtagcagtga

SEQ ID NO: 898694 - DNA, 18 bp, Homo sapiens
gcctgtagttaggaaata

SEQ ID NO: 898695 - DNA, 21 bp, Homo sapiens
gcctgtatcctccctggcaga

SEQ ID NO: 898696 - DNA, 19 bp, Homo sapiens
gcctgtatgagacaggaaa

SEQ ID NO: 898697 - DNA, 13 bp, Homo sapiens
gcctgtcacccag

SEQ ID NO: 898698 - DNA, 14 bp, Homo sapiens
gcctgtcacctggg

SEQ ID NO: 898699 - DNA, 15 bp, Homo sapiens
gcctgtcacctggga

SEQ ID NO: 898700 - DNA, 21 bp, Homo sapiens
gcctgtccaccctgccaagac

SEQ ID NO: 898701 - DNA, 12 bp, Homo sapiens
gcctgtccagcc

SEQ ID NO: 898702 - DNA, 13 bp, Homo sapiens
gcctgtccagcct

SEQ ID NO: 898703 - DNA, 17 bp, Homo sapiens
gcctgtccagcctgggc

SEQ ID NO: 898704 - DNA, 20 bp, Homo sapiens
gcctgtcccacccccacccc

SEQ ID NO: 898705 - DNA, 15 bp, Homo sapiens
gcctgtcccaggact

SEQ ID NO: 898706 - DNA, 21 bp, Homo sapiens
gcctgtcccaggactcaccct

SEQ ID NO: 898707 - DNA, 24 bp, Homo sapiens
gcctgtcccaggactcaccctcca

SEQ ID NO: 898708 - DNA, 16 bp, Homo sapiens
gcctgtccccagacca

SEQ ID NO: 898709 - DNA, 19 bp, Homo sapiens
gcctgtccccagaccaacc

SEQ ID NO: 898710 - DNA, 17 bp, Homo sapiens
gcctgtccccgccttcc

SEQ ID NO: 898711 - DNA, 16 bp, Homo sapiens
gcctgtcctcctggaa

SEQ ID NO: 898712 - DNA, 21 bp, Homo sapiens
gcctgtcctggtacagcaggg

SEQ ID NO: 898713 - DNA, 20 bp, Homo sapiens
gcctgtccttgaaaaacaaa

SEQ ID NO: 898714 - DNA, 14 bp, Homo sapiens
gcctgtcgtgccag

SEQ ID NO: 898715 - DNA, 18 bp, Homo sapiens
gcctgtcgtgccagtcct

SEQ ID NO: 898716 - DNA, 15 bp, Homo sapiens
gcctgtctccatgag

SEQ ID NO: 898717 - DNA, 15 bp, Homo sapiens
gcctgtctcgggctg

SEQ ID NO: 898718 - DNA, 16 bp, Homo sapiens
gcctgtctcgggctga

SEQ ID NO: 898719 - DNA, 19 bp, Homo sapiens
gcctgtctctattagctgg

SEQ ID NO: 898720 - DNA, 21 bp, Homo sapiens
gcctgtctctattagctgggt

SEQ ID NO: 898721 - DNA, 14 bp, Homo sapiens
gcctgtctctttcc

SEQ ID NO: 898722 - DNA, 13 bp, Homo sapiens
gcctgtctgcccc

SEQ ID NO: 898723 - DNA, 15 bp, Homo sapiens
gcctgtctgccccag

SEQ ID NO: 898724 - DNA, 20 bp, Homo sapiens
gcctgtctgtctctccatct

SEQ ID NO: 898725 - DNA, 14 bp, Homo sapiens
gcctgtgagccatt

SEQ ID NO: 898726 - DNA, 18 bp, Homo sapiens
gcctgtgattaacttgct

SEQ ID NO: 898727 - DNA, 19 bp, Homo sapiens
gcctgtgattaacttgctt

SEQ ID NO: 898728 - DNA, 13 bp, Homo sapiens
gcctgtgcactgg

SEQ ID NO: 898729 - DNA, 15 bp, Homo sapiens
gcctgtgcactgggc

SEQ ID NO: 898730 - DNA, 24 bp, Homo sapiens
gcctgtgcactgggcaggttcctg

SEQ ID NO: 898731 - DNA, 13 bp, Homo sapiens
gcctgtgcagcag

SEQ ID NO: 898732 - DNA, 14 bp, Homo sapiens
gcctgtgcagcagc

SEQ ID NO: 898733 - DNA, 15 bp, Homo sapiens
gcctgtgcagcagcc

SEQ ID NO: 898734 - DNA, 19 bp, Homo sapiens
gcctgtgccacccaccagg

SEQ ID NO: 898735 - DNA, 15 bp, Homo sapiens
gcctgtgccatgccc

SEQ ID NO: 898736 - DNA, 18 bp, Homo sapiens
gcctgtgccatgcccaag

SEQ ID NO: 898737 - DNA, 16 bp, Homo sapiens
gcctgtgcctctggga

SEQ ID NO: 898738 - DNA, 19 bp, Homo sapiens
gcctgtgcctctgggactg

SEQ ID NO: 898739 - DNA, 12 bp, Homo sapiens
gcctgtgccttc

SEQ ID NO: 898740 - DNA, 14 bp, Homo sapiens
gccttcgtgccccc

SEQ ID NO: 898741 - DNA, 15 bp, Homo sapiens
gccttcgtgtgctgc

SEQ ID NO: 898742 - DNA, 16 bp, Homo sapiens
gccttctcagaagcac

SEQ ID NO: 898743 - DNA, 14 bp, Homo sapiens
gccttctcccctct

SEQ ID NO: 898744 - DNA, 14 bp, Homo sapiens
gccttctcctcccc

SEQ ID NO: 898745 - DNA, 14 bp, Homo sapiens
gccttctcctctct

SEQ ID NO: 898746 - DNA, 22 bp, Homo sapiens
gccttctcttgaggcctgtgct

SEQ ID NO: 898747 - DNA, 15 bp, Homo sapiens
gccttctgaactcca

SEQ ID NO: 898748 - DNA, 18 bp, Homo sapiens
gccttctgaactccatac

SEQ ID NO: 898749 - DNA, 19 bp, Homo sapiens
gccttctgggaactctcct

SEQ ID NO: 898750 - DNA, 21 bp, Homo sapiens
gccttctgggaactctccttt

SEQ ID NO: 898751 - DNA, 12 bp, Homo sapiens
gccttctgggct

SEQ ID NO: 898752 - DNA, 17 bp, Homo sapiens
gccttctggttttagga

SEQ ID NO: 898753 - DNA, 13 bp, Homo sapiens
gccttctgtggcc

SEQ ID NO: 898754 - DNA, 20 bp, Homo sapiens
gccttctgtggggctgggca

SEQ ID NO: 898755 - DNA, 18 bp, Homo sapiens
gccttcttattctcactc

SEQ ID NO: 898756 - DNA, 19 bp, Homo sapiens
gccttcttattctcactcc

SEQ ID NO: 898757 - DNA, 14 bp, Homo sapiens
gccttcttggtttc

SEQ ID NO: 898758 - DNA, 19 bp, Homo sapiens
gccttgaaccacttccctc

SEQ ID NO: 898759 - DNA, 14 bp, Homo sapiens
gccttgaactttga

SEQ ID NO: 898760 - DNA, 14 bp, Homo sapiens
gccttgaagaaaat

SEQ ID NO: 898761 - DNA, 14 bp, Homo sapiens
gccttgaataataa

SEQ ID NO: 898762 - DNA, 18 bp, Homo sapiens
gccttgacatcagttcct

SEQ ID NO: 898763 - DNA, 21 bp, Homo sapiens
gccttgagagaaaaagtgccc

SEQ ID NO: 898764 - DNA, 23 bp, Homo sapiens
gccttgagagaaaaagtgcccct

SEQ ID NO: 898765 - DNA, 17 bp, Homo sapiens
gccttgagtccccaggg

SEQ ID NO: 898766 - DNA, 20 bp, Homo sapiens
gccttgagtgacatgcggct

SEQ ID NO: 898767 - DNA, 15 bp, Homo sapiens
gccttgagttccagt

SEQ ID NO: 898768 - DNA, 17 bp, Homo sapiens
gccttgcacggctgctc

SEQ ID NO: 898769 - DNA, 19 bp, Homo sapiens
gccttgcacggctgctcgg

SEQ ID NO: 898770 - DNA, 20 bp, Homo sapiens
gccttgcacggctgctcggc

SEQ ID NO: 898771 - DNA, 19 bp, Homo sapiens
gccttgcagatatctgcat

SEQ ID NO: 898772 - DNA, 21 bp, Homo sapiens
gccttgcagcactcacacagg

SEQ ID NO: 898773 - DNA, 23 bp, Homo sapiens
gccttgcagcactcacacaggac

SEQ ID NO: 898774 - DNA, 21 bp, Homo sapiens
gccttgcccacccccaccatg

SEQ ID NO: 898775 - DNA, 20 bp, Homo sapiens
gccttgcccagagatgcctc

SEQ ID NO: 898776 - DNA, 22 bp, Homo sapiens
gccttgcccagagatgcctcca

SEQ ID NO: 898777 - DNA, 18 bp, Homo sapiens
gccttgcccgccagcctc

SEQ ID NO: 898778 - DNA, 13 bp, Homo sapiens
gccttgccgctcc

SEQ ID NO: 898779 - DNA, 15 bp, Homo sapiens
gccttgccgctcccc

SEQ ID NO: 898780 - DNA, 19 bp, Homo sapiens
tcctggtgaggcccagcct

SEQ ID NO: 898781 - DNA, 16 bp, Homo sapiens
tcctggtgcccacagc

SEQ ID NO: 898782 - DNA, 18 bp, Homo sapiens
tcctggtgcccacagcag

SEQ ID NO: 898783 - DNA, 14 bp, Homo sapiens
tcctggtgctctct

SEQ ID NO: 898784 - DNA, 15 bp, Homo sapiens
tcctggtgctctctg

SEQ ID NO: 898785 - DNA, 20 bp, Homo sapiens
tcctggtgctctctgccact

SEQ ID NO: 898786 - DNA, 18 bp, Homo sapiens
tcctggtggtattttcaa

SEQ ID NO: 898787 - DNA, 14 bp, Homo sapiens
tcctggtgtgaagg

SEQ ID NO: 898788 - DNA, 18 bp, Homo sapiens
tcctggtttcctttctca

SEQ ID NO: 898789 - DNA, 19 bp, Homo sapiens
tcctggtttcctttctcat

SEQ ID NO: 898790 - DNA, 21 bp, Homo sapiens
tcctgtaaagaaacatttcct

SEQ ID NO: 898791 - DNA, 20 bp, Homo sapiens
tcctgtaaatggtgtacata

SEQ ID NO: 898792 - DNA, 20 bp, Homo sapiens
tcctgtaacacaagccacag

SEQ ID NO: 898793 - DNA, 17 bp, Homo sapiens
tcctgtaacaggtgtgg

SEQ ID NO: 898794 - DNA, 19 bp, Homo sapiens
tcctgtaactacaatgatg

SEQ ID NO: 898795 - DNA, 16 bp, Homo sapiens
tcctgtacactgaata

SEQ ID NO: 898796 - DNA, 20 bp, Homo sapiens
tcctgtacattgtgggatgt

SEQ ID NO: 898797 - DNA, 14 bp, Homo sapiens
tcctgtacctcagt

SEQ ID NO: 898798 - DNA, 20 bp, Homo sapiens
tcctgtacttgtcctcagct

SEQ ID NO: 898799 - DNA, 22 bp, Homo sapiens
tcctgtacttgtcctcagcttg

SEQ ID NO: 898800 - DNA, 21 bp, Homo sapiens
tcctgtagaggttttgttgtt

SEQ ID NO: 898801 - DNA, 18 bp, Homo sapiens
tcctgtagcacgctgcct

SEQ ID NO: 898802 - DNA, 15 bp, Homo sapiens
tcctgtagcatcttc

SEQ ID NO: 898803 - DNA, 21 bp, Homo sapiens
tcctgtagcatcttctggagt

SEQ ID NO: 898804 - DNA, 22 bp, Homo sapiens
tcctgtagcatcttctggagtc

SEQ ID NO: 898805 - DNA, 16 bp, Homo sapiens
tcctgtagctctccct

SEQ ID NO: 898806 - DNA, 13 bp, Homo sapiens
tcctgtatgttgt

SEQ ID NO: 898807 - DNA, 17 bp, Homo sapiens
tcctgtattcttgtttg

SEQ ID NO: 898808 - DNA, 18 bp, Homo sapiens
tcctgtattcttgtttga

SEQ ID NO: 898809 - DNA, 19 bp, Homo sapiens
tcctgtattcttgtttgaa

SEQ ID NO: 898810 - DNA, 17 bp, Homo sapiens
tcctgtattgctttagt

SEQ ID NO: 898811 - DNA, 22 bp, Homo sapiens
tcctgtcacctagaacgtgcat

SEQ ID NO: 898812 - DNA, 15 bp, Homo sapiens
tcctgtcactcactg

SEQ ID NO: 898813 - DNA, 18 bp, Homo sapiens
tcctgtccaacctaaccc

SEQ ID NO: 898814 - DNA, 20 bp, Homo sapiens
tcctgtccaacctaacccct

SEQ ID NO: 898815 - DNA, 13 bp, Homo sapiens
tcctgtcccagag

SEQ ID NO: 898816 - DNA, 14 bp, Homo sapiens
tcctgtccctttgt

SEQ ID NO: 898817 - DNA, 21 bp, Homo sapiens
tcctgtcctcccatcccctgg

SEQ ID NO: 898818 - DNA, 14 bp, Homo sapiens
tcctgtcctgcctc

SEQ ID NO: 898819 - DNA, 17 bp, Homo sapiens
tcctgtcctgcctcctc

SEQ ID NO: 898820 - DNA, 18 bp, Homo sapiens
tcctgtcctgcctcctca

SEQ ID NO: 898821 - DNA, 24 bp, Homo sapiens
tcctgtcctgctcattatgccact

SEQ ID NO: 898822 - DNA, 12 bp, Homo sapiens
tcctgtccttgt

SEQ ID NO: 898823 - DNA, 17 bp, Homo sapiens
tcctgtcgattagactg

SEQ ID NO: 898824 - DNA, 21 bp, Homo sapiens
tcctgtcgattagactggaca

SEQ ID NO: 898825 - DNA, 15 bp, Homo sapiens
tcctgtctcccactt

SEQ ID NO: 898826 - DNA, 12 bp, Homo sapiens
tcctgtctctgc

SEQ ID NO: 898827 - DNA, 13 bp, Homo sapiens
tcctgtctctgcc

SEQ ID NO: 898828 - DNA, 14 bp, Homo sapiens
tcctgtctctgcct

SEQ ID NO: 898829 - DNA, 12 bp, Homo sapiens
tcctgtctgcca

SEQ ID NO: 898830 - DNA, 21 bp, Homo sapiens
tcctgtctgccagccagcagc

SEQ ID NO: 898831 - DNA, 17 bp, Homo sapiens
tcctgtctgtccttctg

SEQ ID NO: 898832 - DNA, 12 bp, Homo sapiens
tcctgtctgttt

SEQ ID NO: 898833 - DNA, 21 bp, Homo sapiens
tcctgtcttatcctccaccgt

SEQ ID NO: 898834 - DNA, 20 bp, Homo sapiens
tcctgtcttatggtccagaa

SEQ ID NO: 898835 - DNA, 18 bp, Homo sapiens
tcctgtgacagtgaaata

SEQ ID NO: 898836 - DNA, 15 bp, Homo sapiens
tcctgtgaccccacc

SEQ ID NO: 898837 - DNA, 19 bp, Homo sapiens
tcctgtgaccccaccttga

SEQ ID NO: 898838 - DNA, 19 bp, Homo sapiens
tcctgtgacccgtgaatgt

SEQ ID NO: 898839 - DNA, 15 bp, Homo sapiens
tcctgtgagatgtgt

SEQ ID NO: 898840 - DNA, 17 bp, Homo sapiens
tcctgtgagatgtgtat

SEQ ID NO: 898841 - DNA, 15 bp, Homo sapiens
tcctgtgcatgggtg

SEQ ID NO: 898842 - DNA, 22 bp, Homo sapiens
tcctgtgccaacctgatgcccc

SEQ ID NO: 898843 - DNA, 19 bp, Homo sapiens
tcctgtgccccagctgcca

SEQ ID NO: 898844 - DNA, 16 bp, Homo sapiens
tcctgtgccctcaccc

SEQ ID NO: 898845 - DNA, 18 bp, Homo sapiens
tcctgtgccctcacccca

SEQ ID NO: 898846 - DNA, 15 bp, Homo sapiens
tcctgtgcctggccc

SEQ ID NO: 898847 - DNA, 20 bp, Homo sapiens
tcctgtgcctggccccagcc

SEQ ID NO: 898848 - DNA, 14 bp, Homo sapiens
tcctgtgctggggg

SEQ ID NO: 898849 - DNA, 24 bp, Homo sapiens
tcctgtgcttgcttagagtgccca

SEQ ID NO: 898850 - DNA, 16 bp, Homo sapiens
tcctgtggagacactg

SEQ ID NO: 898851 - DNA, 14 bp, Homo sapiens
tcctgtggcaggag

SEQ ID NO: 898852 - DNA, 16 bp, Homo sapiens
tcctgtggcaggaggc

SEQ ID NO: 898853 - DNA, 15 bp, Homo sapiens
tcctgtggggaaagg

SEQ ID NO: 898854 - DNA, 20 bp, Homo sapiens
tcctgtgggtgttctttcct

SEQ ID NO: 898855 - DNA, 23 bp, Homo sapiens
tcctgtgggtgttctttcctgcc

SEQ ID NO: 898856 - DNA, 22 bp, Homo sapiens
tcctgtgtaacacttggctctt

SEQ ID NO: 898857 - DNA, 15 bp, Homo sapiens
tcctgtgtcccctga

SEQ ID NO: 898858 - DNA, 19 bp, Homo sapiens
tcctgtgtgattgacagct

SEQ ID NO: 898859 - DNA, 23 bp, Homo sapiens
tcctgtgttcaatatttagaaaa

SEQ ID NO: 898860 - DNA, 12 bp, Homo sapiens
tcctgtgtttct

SEQ ID NO: 898861 - DNA, 14 bp, Homo sapiens
tcctgtgtttgtga

SEQ ID NO: 898862 - DNA, 19 bp, Homo sapiens
catgttgttgtgtgtatat

SEQ ID NO: 898863 - DNA, 13 bp, Homo sapiens
catgtttacttta

SEQ ID NO: 898864 - DNA, 19 bp, Homo sapiens
catgtttacttttcagggc

SEQ ID NO: 898865 - DNA, 13 bp, Homo sapiens
catgtttataaat

SEQ ID NO: 898866 - DNA, 15 bp, Homo sapiens
catgtttatctgctt

SEQ ID NO: 898867 - DNA, 16 bp, Homo sapiens
catgtttattgagctg

SEQ ID NO: 898868 - DNA, 13 bp, Homo sapiens
catgtttcatgtt

SEQ ID NO: 898869 - DNA, 21 bp, Homo sapiens
catgtttcctctagttctttg

SEQ ID NO: 898870 - DNA, 19 bp, Homo sapiens
catgtttgagctcagaccc

SEQ ID NO: 898871 - DNA, 23 bp, Homo sapiens
catgtttgagctcagacccccac

SEQ ID NO: 898872 - DNA, 20 bp, Homo sapiens
catgtttgcacctttctagt

SEQ ID NO: 898873 - DNA, 21 bp, Homo sapiens
catgtttgcacctttctagtt

SEQ ID NO: 898874 - DNA, 23 bp, Homo sapiens
catgtttggtgtttgtctgtgtt

SEQ ID NO: 898875 - DNA, 13 bp, Homo sapiens
catgtttgtaaaa

SEQ ID NO: 898876 - DNA, 14 bp, Homo sapiens
catgtttgtgattg

SEQ ID NO: 898877 - DNA, 18 bp, Homo sapiens
catgttttataatttgaa

SEQ ID NO: 898878 - DNA, 21 bp, Homo sapiens
catgttttccattgtttgaaa

SEQ ID NO: 898879 - DNA, 20 bp, Homo sapiens
catgttttgatgagaaaaaa

SEQ ID NO: 898880 - DNA, 15 bp, Homo sapiens
catgttttgtttacg

SEQ ID NO: 898881 - DNA, 13 bp, Homo sapiens
catgtttttgcca

SEQ ID NO: 898882 - DNA, 14 bp, Homo sapiens
catgttttttcatt

SEQ ID NO: 898883 - DNA, 16 bp, Homo sapiens
catgttttttcatttg

SEQ ID NO: 898884 - DNA, 19 bp, Homo sapiens
catgttttttcatttgtaa

SEQ ID NO: 898885 - DNA, 22 bp, Homo sapiens
cattaaaaaaaaaaaaaaactc

SEQ ID NO: 898886 - DNA, 12 bp, Homo sapiens
cattaaaacaat

SEQ ID NO: 898887 - DNA, 22 bp, Homo sapiens
cattaaaacaatattgtttcta

SEQ ID NO: 898888 - DNA, 15 bp, Homo sapiens
cattaaaactgcttt

SEQ ID NO: 898889 - DNA, 14 bp, Homo sapiens
cattaaaataaaac

SEQ ID NO: 898890 - DNA, 11 bp, Homo sapiens
cattaaaatat

SEQ ID NO: 898891 - DNA, 20 bp, Homo sapiens
cattaaaatatagagacagg

SEQ ID NO: 898892 - DNA, 19 bp, Homo sapiens
cattaaaatatatgttctg

SEQ ID NO: 898893 - DNA, 20 bp, Homo sapiens
cattaaaattttacctctct

SEQ ID NO: 898894 - DNA, 12 bp, Homo sapiens
cattaaacctgt

SEQ ID NO: 898895 - DNA, 13 bp, Homo sapiens
cattaaacctgtc

SEQ ID NO: 898896 - DNA, 17 bp, Homo sapiens
cattaaacttgaagcag

SEQ ID NO: 898897 - DNA, 11 bp, Homo sapiens
cattaaataaa

SEQ ID NO: 898898 - DNA, 17 bp, Homo sapiens
cattaaatcaatcagga

SEQ ID NO: 898899 - DNA, 18 bp, Homo sapiens
tctctgctttccttttct

SEQ ID NO: 898900 - DNA, 13 bp, Homo sapiens
tctctggaacctg

SEQ ID NO: 898901 - DNA, 14 bp, Homo sapiens
tctctggaacctga

SEQ ID NO: 898902 - DNA, 23 bp, Homo sapiens
tctctggaagaggaaccaggaga

SEQ ID NO: 898903 - DNA, 19 bp, Homo sapiens
tctctggaagcccctgggc

SEQ ID NO: 898904 - DNA, 21 bp, Homo sapiens
tctctggaaggggcagccctg

SEQ ID NO: 898905 - DNA, 12 bp, Homo sapiens
tctctggagccc

SEQ ID NO: 898906 - DNA, 20 bp, Homo sapiens
tctctggagcccctcctccc

SEQ ID NO: 898907 - DNA, 21 bp, Homo sapiens
tctctggaggtactgagacag

SEQ ID NO: 898908 - DNA, 17 bp, Homo sapiens
tctctggcctcccaccc

SEQ ID NO: 898909 - DNA, 18 bp, Homo sapiens
tctctggcctcccacccg

SEQ ID NO: 898910 - DNA, 17 bp, Homo sapiens
tctctggccttttccta

SEQ ID NO: 898911 - DNA, 21 bp, Homo sapiens
tctctggcttctgaagagcct

SEQ ID NO: 898912 - DNA, 23 bp, Homo sapiens
tctctgggactctcctcctcccc

SEQ ID NO: 898913 - DNA, 18 bp, Homo sapiens
tctctgggagaaaatcat

SEQ ID NO: 898914 - DNA, 12 bp, Homo sapiens
tctctgggcctg

SEQ ID NO: 898915 - DNA, 22 bp, Homo sapiens
tctctgggcctgtgtgtgggtg

SEQ ID NO: 898916 - DNA, 12 bp, Homo sapiens
tctctgggctga

SEQ ID NO: 898917 - DNA, 13 bp, Homo sapiens
tctctgggctgag

SEQ ID NO: 898918 - DNA, 15 bp, Homo sapiens
tctctgggctgagga

SEQ ID NO: 898919 - DNA, 16 bp, Homo sapiens
tctctggggcagatcc

SEQ ID NO: 898920 - DNA, 22 bp, Homo sapiens
tctctggggcagatccccactg

SEQ ID NO: 898921 - DNA, 18 bp, Homo sapiens
tctctggggccacacaga

SEQ ID NO: 898922 - DNA, 18 bp, Homo sapiens
tctctggggccctgggcc

SEQ ID NO: 898923 - DNA, 14 bp, Homo sapiens
tctctgggggaggc

SEQ ID NO: 898924 - DNA, 21 bp, Homo sapiens
tctctgggggaggcagggctg

SEQ ID NO: 898925 - DNA, 15 bp, Homo sapiens
tctctggtttcacca

SEQ ID NO: 898926 - DNA, 22 bp, Homo sapiens
tctctggtttcaccagcgttgg

SEQ ID NO: 898927 - DNA, 21 bp, Homo sapiens
tctctgtacttttcattctct

SEQ ID NO: 898928 - DNA, 18 bp, Homo sapiens
tctctgtagggaactctg

SEQ ID NO: 898929 - DNA, 18 bp, Homo sapiens
tctctgtatgaatgtgat

SEQ ID NO: 898930 - DNA, 12 bp, Homo sapiens
tctctgtcacat

SEQ ID NO: 898931 - DNA, 15 bp, Homo sapiens
tctctgtcccattcc

SEQ ID NO: 898932 - DNA, 20 bp, Homo sapiens
tctctgtcccattccctggg

SEQ ID NO: 898933 - DNA, 19 bp, Homo sapiens
tctctgtcccttgctgtat

SEQ ID NO: 898934 - DNA, 20 bp, Homo sapiens
tctctgtcccttgctgtatg

SEQ ID NO: 898935 - DNA, 15 bp, Homo sapiens
tctctgtcgtggagc

SEQ ID NO: 898936 - DNA, 14 bp, Homo sapiens
tctctgtctcatcc

SEQ ID NO: 898937 - DNA, 23 bp, Homo sapiens
tctctgtctcatccatcatcatg

SEQ ID NO: 898938 - DNA, 14 bp, Homo sapiens
tctctgtctctcct

SEQ ID NO: 898939 - DNA, 15 bp, Homo sapiens
tctctgtctggggct

SEQ ID NO: 898940 - DNA, 13 bp, Homo sapiens
tctctgtctgtct

SEQ ID NO: 898941 - DNA, 14 bp, Homo sapiens
tctctgtctgtctc

SEQ ID NO: 898942 - DNA, 23 bp, Homo sapiens
tctctgtgaacgatttagaaaga

SEQ ID NO: 898943 - DNA, 21 bp, Homo sapiens
tctctgtgaagcctctctcct

SEQ ID NO: 898944 - DNA, 14 bp, Homo sapiens
tctctgtgaataca

SEQ ID NO: 898945 - DNA, 15 bp, Homo sapiens
tctctgtgaatacaa

SEQ ID NO: 898946 - DNA, 18 bp, Homo sapiens
tctctgtgacctgccccg

SEQ ID NO: 898947 - DNA, 12 bp, Homo sapiens
tctctgtgcctt

SEQ ID NO: 898948 - DNA, 13 bp, Homo sapiens
tctctgtgctctg

SEQ ID NO: 898949 - DNA, 19 bp, Homo sapiens
tctctgtgcttcaattaat

SEQ ID NO: 898950 - DNA, 16 bp, Homo sapiens
tctctgtgctttgact

SEQ ID NO: 898951 - DNA, 21 bp, Homo sapiens
tctctgtgtatttatataaaa

SEQ ID NO: 898952 - DNA, 10 bp, Homo sapiens
tctctgtgtt

SEQ ID NO: 898953 - DNA, 15 bp, Homo sapiens
tctctgttaacatct

SEQ ID NO: 898954 - DNA, 18 bp, Homo sapiens
tctctgttaacatctagc

SEQ ID NO: 898955 - DNA, 19 bp, Homo sapiens
tctctgttcagatgtgcat

SEQ ID NO: 898956 - DNA, 18 bp, Homo sapiens
tctctgttcccttcctca

SEQ ID NO: 898957 - DNA, 19 bp, Homo sapiens
tctctgttcccttcctcac

SEQ ID NO: 898958 - DNA, 20 bp, Homo sapiens
tctctgttccttttgcaaac

SEQ ID NO: 898959 - DNA, 19 bp, Homo sapiens
tctctgttggtccactgtg

SEQ ID NO: 898960 - DNA, 19 bp, Homo sapiens
tctcttaaatattctgaat

SEQ ID NO: 898961 - DNA, 15 bp, Homo sapiens
tctcttaagtggtct

SEQ ID NO: 898962 - DNA, 19 bp, Homo sapiens
tctcttaatcactactgta

SEQ ID NO: 898963 - DNA, 22 bp, Homo sapiens
tctcttacgcccaacccttccc

SEQ ID NO: 898964 - DNA, 16 bp, Homo sapiens
tctcttagaaatactt

SEQ ID NO: 898965 - DNA, 20 bp, Homo sapiens
tctcttagctactgtatgca

SEQ ID NO: 898966 - DNA, 18 bp, Homo sapiens
tctcttatcctctctctc

SEQ ID NO: 898967 - DNA, 22 bp, Homo sapiens
tctcttatcctctctctcttct

SEQ ID NO: 898968 - DNA, 21 bp, Homo sapiens
tctcttatcttacgaaaaaat

SEQ ID NO: 898969 - DNA, 14 bp, Homo sapiens
tctcttcaatctct

SEQ ID NO: 898970 - DNA, 13 bp, Homo sapiens
tctcttcagcccc

SEQ ID NO: 898971 - DNA, 23 bp, Homo sapiens
tctcttcagcccctagtgctatt

SEQ ID NO: 898972 - DNA, 16 bp, Homo sapiens
tctcttccacatgtta

SEQ ID NO: 898973 - DNA, 21 bp, Homo sapiens
tctcttccagaagatgccctc

SEQ ID NO: 898974 - DNA, 19 bp, Homo sapiens
tctcttcccaggcctttgg

SEQ ID NO: 898975 - DNA, 13 bp, Homo sapiens
tctcttccccaga

SEQ ID NO: 898976 - DNA, 16 bp, Homo sapiens
tctcttccccttcctg

SEQ ID NO: 898977 - DNA, 11 bp, Homo sapiens
tctcttcctac

SEQ ID NO: 898978 - DNA, 12 bp, Homo sapiens
tctcttcctctg

SEQ ID NO: 898979 - DNA, 16 bp, Homo sapiens
tctcttcctctgttct

SEQ ID NO: 898980 - DNA, 11 bp, Homo sapiens
tctcttcctgc

SEQ ID NO: 898981 - DNA, 14 bp, Homo sapiens
tctcttcctgcccc

SEQ ID NO: 898982 - DNA, 22 bp, Homo sapiens
tctcttcctgcccctctttctc

SEQ ID NO: 898983 - DNA, 21 bp, Homo sapiens
tctcttccttgacctgcattg

SEQ ID NO: 898984 - DNA, 17 bp, Homo sapiens
tctcttctcagagtggt

SEQ ID NO: 898985 - DNA, 13 bp, Homo sapiens
tctcttctccact

SEQ ID NO: 898986 - DNA, 14 bp, Homo sapiens
tctcttctccactg

SEQ ID NO: 898987 - DNA, 13 bp, Homo sapiens
tctcttctcccag

SEQ ID NO: 898988 - DNA, 21 bp, Homo sapiens
tctcttctcccagaatcccag

SEQ ID NO: 898989 - DNA, 13 bp, Homo sapiens
tctcttctgctcc

SEQ ID NO: 898990 - DNA, 14 bp, Homo sapiens
tctcttctgctcca

SEQ ID NO: 898991 - DNA, 16 bp, Homo sapiens
tctcttctgctccacc

SEQ ID NO: 898992 - DNA, 22 bp, Homo sapiens
ttaagagcttgatctgtgattt

SEQ ID NO: 898993 - DNA, 13 bp, Homo sapiens
ttaagataactta

SEQ ID NO: 898994 - DNA, 19 bp, Homo sapiens
ttaagataacttactgtat

SEQ ID NO: 898995 - DNA, 19 bp, Homo sapiens
ttaagatacttagattaga

SEQ ID NO: 898996 - DNA, 14 bp, Homo sapiens
ttaagatagaacac

SEQ ID NO: 898997 - DNA, 11 bp, Homo sapiens
ttaagatatcc

SEQ ID NO: 898998 - DNA, 18 bp, Homo sapiens
ttaagatcctaaactctc

SEQ ID NO: 898999 - DNA, 23 bp, Homo sapiens
ttaagatcctaaactctctagct

SEQ ID NO: 899000 - DNA, 15 bp, Homo sapiens
ttaagatctgactgc

SEQ ID NO: 899001 - DNA, 15 bp, Homo sapiens
ttaagatgtacattt

SEQ ID NO: 899002 - DNA, 17 bp, Homo sapiens
ttaagatgtgtcttcaa

SEQ ID NO: 899003 - DNA, 17 bp, Homo sapiens
ttaagattttactttaa

SEQ ID NO: 899004 - DNA, 19 bp, Homo sapiens
ttaagcaaaagaaaaagat

SEQ ID NO: 899005 - DNA, 14 bp, Homo sapiens
ttaagcactacata

SEQ ID NO: 899006 - DNA, 13 bp, Homo sapiens
ttaagcactttga

SEQ ID NO: 899007 - DNA, 20 bp, Homo sapiens
ttaagcactttgaaaatatt

SEQ ID NO: 899008 - DNA, 19 bp, Homo sapiens
ttaagcagaacaaatgtgt

SEQ ID NO: 899009 - DNA, 21 bp, Homo sapiens
ttaagcagactggaaaagtga

SEQ ID NO: 899010 - DNA, 22 bp, Homo sapiens
ttaagcattttgaaacaaagta

SEQ ID NO: 899011 - DNA, 17 bp, Homo sapiens
ttaagccaaagaaacaa

SEQ ID NO: 899012 - DNA, 20 bp, Homo sapiens
ttaagccaaagaaacaagct

SEQ ID NO: 899013 - DNA, 23 bp, Homo sapiens
ttaagccaaagaaacaagctgtg

SEQ ID NO: 899014 - DNA, 22 bp, Homo sapiens
ttaagccaatatttactcatca

SEQ ID NO: 899015 - DNA, 15 bp, Homo sapiens
ttaagccaggaaaca

SEQ ID NO: 899016 - DNA, 19 bp, Homo sapiens
ttaagcccacagtatattt

SEQ ID NO: 899017 - DNA, 20 bp, Homo sapiens
ttaagcctaccgtatttcag

SEQ ID NO: 899018 - DNA, 19 bp, Homo sapiens
ttaagcctcatatttaaag

SEQ ID NO: 899019 - DNA, 16 bp, Homo sapiens
ttaagctatcagcaat

SEQ ID NO: 899020 - DNA, 13 bp, Homo sapiens
ttaagctccagct

SEQ ID NO: 899021 - DNA, 14 bp, Homo sapiens
ttaagctccagctt

SEQ ID NO: 899022 - DNA, 18 bp, Homo sapiens
ttaagctccatgtgcata

SEQ ID NO: 899023 - DNA, 15 bp, Homo sapiens
ttaagcttttatttc

SEQ ID NO: 899024 - DNA, 19 bp, Homo sapiens
ttaagctttttttttttga

SEQ ID NO: 899025 - DNA, 14 bp, Homo sapiens
ttaaggaaacaata

SEQ ID NO: 899026 - DNA, 16 bp, Homo sapiens
ttaaggagatggcctc

SEQ ID NO: 899027 - DNA, 20 bp, Homo sapiens
ttaaggcacagtgggagctg

SEQ ID NO: 899028 - DNA, 21 bp, Homo sapiens
ttaaggcacagtgggagctga

SEQ ID NO: 899029 - DNA, 16 bp, Homo sapiens
ttaaggctaaaaagta

SEQ ID NO: 899030 - DNA, 15 bp, Homo sapiens
ttaagggaaagaaaa

SEQ ID NO: 899031 - DNA, 18 bp, Homo sapiens
ttaagggaagaattccag

SEQ ID NO: 899032 - DNA, 19 bp, Homo sapiens
ttaagggacgggggtggga

SEQ ID NO: 899033 - DNA, 18 bp, Homo sapiens
ttaagggtaggatgttgc

SEQ ID NO: 899034 - DNA, 20 bp, Homo sapiens
ttaaggtaactactgctaat

SEQ ID NO: 899035 - DNA, 21 bp, Homo sapiens
ttaaggtatttcgaaactgcc

SEQ ID NO: 899036 - DNA, 24 bp, Homo sapiens
ttaaggtatttcgaaactgccaag

SEQ ID NO: 899037 - DNA, 21 bp, Homo sapiens
ttaaggtctaactgtggaata

SEQ ID NO: 899038 - DNA, 19 bp, Homo sapiens
ttaaggtgagcataaatca

SEQ ID NO: 899039 - DNA, 18 bp, Homo sapiens
ttaaggtgatatatttaa

SEQ ID NO: 899040 - DNA, 13 bp, Homo sapiens
ttaagtaaatgct

SEQ ID NO: 899041 - DNA, 11 bp, Homo sapiens
ttaagtaactt

SEQ ID NO: 899042 - DNA, 22 bp, Homo sapiens
ttaagtaattgcctacaataaa

SEQ ID NO: 899043 - DNA, 21 bp, Homo sapiens
ttaagtaccaatgggaagcag

SEQ ID NO: 899044 - DNA, 22 bp, Homo sapiens
ttaagtaccaatgggaagcagg

SEQ ID NO: 899045 - DNA, 17 bp, Homo sapiens
ttaagtactatgtatca

SEQ ID NO: 899046 - DNA, 19 bp, Homo sapiens
ttaagtagaacaaaaaacc

SEQ ID NO: 899047 - DNA, 15 bp, Homo sapiens
ttaagtatatagtat

SEQ ID NO: 899048 - DNA, 19 bp, Homo sapiens
ttaagtatcttttttcaaa

SEQ ID NO: 899049 - DNA, 20 bp, Homo sapiens
ttaagtatggaatattcatt

SEQ ID NO: 899050 - DNA, 19 bp, Homo sapiens
ttaagtatttatatattta

SEQ ID NO: 899051 - DNA, 23 bp, Homo sapiens
ttaagtcatcattacttgggaaa

SEQ ID NO: 899052 - DNA, 21 bp, Homo sapiens
ttaagtcattttcatgtgtgt

SEQ ID NO: 899053 - DNA, 17 bp, Homo sapiens
ttaagtcattttgtaat

SEQ ID NO: 899054 - DNA, 14 bp, Homo sapiens
ttaagtccagcttg

SEQ ID NO: 899055 - DNA, 19 bp, Homo sapiens
ttaagtctaaatatttcct

SEQ ID NO: 899056 - DNA, 17 bp, Homo sapiens
ttaagtctatctggtat

SEQ ID NO: 899057 - DNA, 19 bp, Homo sapiens
ttaagtctgggatgtagaa

SEQ ID NO: 899058 - DNA, 22 bp, Homo sapiens
ttaagtctgggatgtagaactt

SEQ ID NO: 899059 - DNA, 15 bp, Homo sapiens
ttaagtcttccttaa

SEQ ID NO: 899060 - DNA, 19 bp, Homo sapiens
ttaagtgaaggagaagtct

SEQ ID NO: 899061 - DNA, 11 bp, Homo sapiens
ttaagtgactg

SEQ ID NO: 899062 - DNA, 16 bp, Homo sapiens
ttaagtgatgaacatt

SEQ ID NO: 899063 - DNA, 16 bp, Homo sapiens
ttaagtgatgtcattt

SEQ ID NO: 899064 - DNA, 18 bp, Homo sapiens
ttaagtgatttaaaaaaa

SEQ ID NO: 899065 - DNA, 20 bp, Homo sapiens
ttaagtgcaacatttctgta

SEQ ID NO: 899066 - DNA, 21 bp, Homo sapiens
ttaagtgcaacatttctgtat

SEQ ID NO: 899067 - DNA, 23 bp, Homo sapiens
ttaagtgcaacatttctgtatac

SEQ ID NO: 899068 - DNA, 21 bp, Homo sapiens
ttaagtgcacttttttatgaa

SEQ ID NO: 899069 - DNA, 23 bp, Homo sapiens
ttaagtgcacttttttatgaaga

SEQ ID NO: 899070 - DNA, 21 bp, Homo sapiens
ttaagtgccattactactgta

SEQ ID NO: 899071 - DNA, 22 bp, Homo sapiens
ttaagtgccattactactgtac

SEQ ID NO: 899072 - DNA, 22 bp, Homo sapiens
ttaagtgctgcatttaaaagat

SEQ ID NO: 899073 - DNA, 16 bp, Homo sapiens
ttaagtgctttgtaat

SEQ ID NO: 899074 - DNA, 19 bp, Homo sapiens
ttaagtggttactttgtgt

SEQ ID NO: 899075 - DNA, 24 bp, Homo sapiens
ttaaagatttcttttcattattct

SEQ ID NO: 899076 - DNA, 22 bp, Homo sapiens
ttaaagcaaactatgatttatt

SEQ ID NO: 899077 - DNA, 14 bp, Homo sapiens
ttaaagcagacagt

SEQ ID NO: 899078 - DNA, 13 bp, Homo sapiens
ttaaagcctcctc

SEQ ID NO: 899079 - DNA, 13 bp, Homo sapiens
ttaaagctaaact

SEQ ID NO: 899080 - DNA, 17 bp, Homo sapiens
ttaaagctaaattttgt

SEQ ID NO: 899081 - DNA, 22 bp, Homo sapiens
ttaaagctgagagaccctggcc

SEQ ID NO: 899082 - DNA, 13 bp, Homo sapiens
ttaaagcttattt

SEQ ID NO: 899083 - DNA, 19 bp, Homo sapiens
ttaaagcttgatttgatct

SEQ ID NO: 899084 - DNA, 13 bp, Homo sapiens
ttaaagctttcaa

SEQ ID NO: 899085 - DNA, 17 bp, Homo sapiens
ttaaaggaaaaaatgtt

SEQ ID NO: 899086 - DNA, 20 bp, Homo sapiens
ttaaaggaaacactaaggct

SEQ ID NO: 899087 - DNA, 12 bp, Homo sapiens
ttaaaggaagga

SEQ ID NO: 899088 - DNA, 19 bp, Homo sapiens
ttaaaggcagtccagagct

SEQ ID NO: 899089 - DNA, 16 bp, Homo sapiens
ttaaaggcccagcccc

SEQ ID NO: 899090 - DNA, 20 bp, Homo sapiens
ttaaagtaaacttgtgtatt

SEQ ID NO: 899091 - DNA, 16 bp, Homo sapiens
ttaaagtaaaggcctc

SEQ ID NO: 899092 - DNA, 15 bp, Homo sapiens
ttaaagtacctgtag

SEQ ID NO: 899093 - DNA, 22 bp, Homo sapiens
ttaaagtacctgtagtgagaaa

SEQ ID NO: 899094 - DNA, 12 bp, Homo sapiens
ttaaagtagttc

SEQ ID NO: 899095 - DNA, 13 bp, Homo sapiens
ttaaagtatatat

SEQ ID NO: 899096 - DNA, 16 bp, Homo sapiens
ttaaagtatatattta

SEQ ID NO: 899097 - DNA, 16 bp, Homo sapiens
ttaaagtatctacctg

SEQ ID NO: 899098 - DNA, 18 bp, Homo sapiens
ttaaagtatgaatctatg

SEQ ID NO: 899099 - DNA, 23 bp, Homo sapiens
ttaaagtatgttattgcataatt

SEQ ID NO: 899100 - DNA, 14 bp, Homo sapiens
ttaaagtgactttc

SEQ ID NO: 899101 - DNA, 17 bp, Homo sapiens
ttaaagtgatactgaaa

SEQ ID NO: 899102 - DNA, 14 bp, Homo sapiens
ttaaagtgcagtca

SEQ ID NO: 899103 - DNA, 17 bp, Homo sapiens
ttaaagtgcagtcattt

SEQ ID NO: 899104 - DNA, 22 bp, Homo sapiens
ttaaagtgcagtcatttgtggt

SEQ ID NO: 899105 - DNA, 17 bp, Homo sapiens
ttaaagtggcaatctca

SEQ ID NO: 899106 - DNA, 19 bp, Homo sapiens
ttaaagtgtacttataaac

SEQ ID NO: 899107 - DNA, 12 bp, Homo sapiens
ttaaagttaata

SEQ ID NO: 899108 - DNA, 23 bp, Homo sapiens
ttaaagttagtatcttttgatat

SEQ ID NO: 899109 - DNA, 15 bp, Homo sapiens
ttaaagttcttattt

SEQ ID NO: 899110 - DNA, 18 bp, Homo sapiens
ttaaagttgattttgaac

SEQ ID NO: 899111 - DNA, 14 bp, Homo sapiens
ttaaagttggaatt

SEQ ID NO: 899112 - DNA, 19 bp, Homo sapiens
ttaaagttggaatttacca

SEQ ID NO: 899113 - DNA, 17 bp, Homo sapiens
ttaaataaaactttcca

SEQ ID NO: 899114 - DNA, 21 bp, Homo sapiens
ttaaataaaactttccaaata

SEQ ID NO: 899115 - DNA, 16 bp, Homo sapiens
ttaaataaaagcacaa

SEQ ID NO: 899116 - DNA, 13 bp, Homo sapiens
ttaaataaaagct

SEQ ID NO: 899117 - DNA, 14 bp, Homo sapiens
ttaaataaaagtga

SEQ ID NO: 899118 - DNA, 14 bp, Homo sapiens
ttaaataaaattta

SEQ ID NO: 899119 - DNA, 12 bp, Homo sapiens
ttaaataaactg

SEQ ID NO: 899120 - DNA, 15 bp, Homo sapiens
ttaaataaactgttt

SEQ ID NO: 899121 - DNA, 16 bp, Homo sapiens
ttaaataaactgtttt

SEQ ID NO: 899122 - DNA, 19 bp, Homo sapiens
ttaaataaaggtacacatg

SEQ ID NO: 899123 - DNA, 21 bp, Homo sapiens
ttaaataaagtatcatgcatt

SEQ ID NO: 899124 - DNA, 20 bp, Homo sapiens
ttaaataaattaagatccta

SEQ ID NO: 899125 - DNA, 16 bp, Homo sapiens
ttaaataaatttgact

SEQ ID NO: 899126 - DNA, 16 bp, Homo sapiens
ttaaataacctctggc

SEQ ID NO: 899127 - DNA, 15 bp, Homo sapiens
ttaaataagaaactt

SEQ ID NO: 899128 - DNA, 22 bp, Homo sapiens
ttaaataaggttggagatgtca

SEQ ID NO: 899129 - DNA, 16 bp, Homo sapiens
ttaaataatacaactc

SEQ ID NO: 899130 - DNA, 15 bp, Homo sapiens
ttaaataatagacat

SEQ ID NO: 899131 - DNA, 20 bp, Homo sapiens
ttaaataatgcttcagatat

SEQ ID NO: 899132 - DNA, 21 bp, Homo sapiens
ttaaataatgtgaaactggat

SEQ ID NO: 899133 - DNA, 15 bp, Homo sapiens
ttaaatacaaaactt

SEQ ID NO: 899134 - DNA, 16 bp, Homo sapiens
ttaaatacaaaacttc

SEQ ID NO: 899135 - DNA, 10 bp, Homo sapiens
ttaaatacag

SEQ ID NO: 899136 - DNA, 16 bp, Homo sapiens
ttaaatacagacacta

SEQ ID NO: 899137 - DNA, 17 bp, Homo sapiens
ttaaatacagacactaa

SEQ ID NO: 899138 - DNA, 18 bp, Homo sapiens
ttaaatacagacactaag

SEQ ID NO: 899139 - DNA, 20 bp, Homo sapiens
ttaaatacagacactaagtt

SEQ ID NO: 899140 - DNA, 17 bp, Homo sapiens
ttaaatacaggaaacag

SEQ ID NO: 899141 - DNA, 16 bp, Homo sapiens
ttaaatacatatggat

SEQ ID NO: 899142 - DNA, 18 bp, Homo sapiens
ttaaataggatattaaca

SEQ ID NO: 899143 - DNA, 12 bp, Homo sapiens
ttaaatataaat

SEQ ID NO: 899144 - DNA, 12 bp, Homo sapiens
ttaaatataatt

SEQ ID NO: 899145 - DNA, 14 bp, Homo sapiens
ttaaatataattct

SEQ ID NO: 899146 - DNA, 16 bp, Homo sapiens
ttaaatataattctgt

SEQ ID NO: 899147 - DNA, 13 bp, Homo sapiens
ttaaatatacact

SEQ ID NO: 899148 - DNA, 16 bp, Homo sapiens
ttaaatatatgtatgt

SEQ ID NO: 899149 - DNA, 20 bp, Homo sapiens
ttaaatatatgtatgtaaaa

SEQ ID NO: 899150 - DNA, 22 bp, Homo sapiens
ttaaatatatgtatgtaaaaat

SEQ ID NO: 899151 - DNA, 22 bp, Homo sapiens
ttaaatattttctattttaaga

SEQ ID NO: 899152 - DNA, 14 bp, Homo sapiens
ttaaatcaaggaaa

SEQ ID NO: 899153 - DNA, 17 bp, Homo sapiens
ttaaatcattagagctt

SEQ ID NO: 899154 - DNA, 20 bp, Homo sapiens
ttaaatctaaatctatttat

SEQ ID NO: 899155 - DNA, 16 bp, Homo sapiens
ttaaatctcattgctt

SEQ ID NO: 899156 - DNA, 15 bp, Homo sapiens
ttaaatctgtgatga

SEQ ID NO: 899157 - DNA, 16 bp, Homo sapiens
ttaaatctgtgatgat

SEQ ID NO: 899158 - DNA, 16 bp, Homo sapiens
ttaaatcttaaacaat

SEQ ID NO: 899159 - DNA, 11 bp, Homo sapiens
ttaaatgaaag

SEQ ID NO: 899160 - DNA, 20 bp, Homo sapiens
ttaaatgacttgattgtact

SEQ ID NO: 899161 - DNA, 20 bp, Homo sapiens
ttaaatgatcatgaaaccaa

SEQ ID NO: 899162 - DNA, 12 bp, Homo sapiens
ttaaatgattcc

SEQ ID NO: 899163 - DNA, 11 bp, Homo sapiens
ttaaatgattg

SEQ ID NO: 899164 - DNA, 20 bp, Homo sapiens
ttaaatgcaagtgcctagat

SEQ ID NO: 899165 - DNA, 16 bp, Homo sapiens
ttaaatgcaataattt

SEQ ID NO: 899166 - DNA, 22 bp, Homo sapiens
ttaaatgcatgtcttaaatgct

SEQ ID NO: 899167 - DNA, 18 bp, Homo sapiens
ttaaatgccaaaatgtac

SEQ ID NO: 899168 - DNA, 18 bp, Homo sapiens
ttaaatgccttgtataaa

SEQ ID NO: 899169 - DNA, 18 bp, Homo sapiens
ttaaatgctcataaagat

SEQ ID NO: 899170 - DNA, 16 bp, Homo sapiens
ttaaatgcttcatttg

SEQ ID NO: 899171 - DNA, 23 bp, Homo sapiens
ttaaatgggctactttgtccttt

SEQ ID NO: 899172 - DNA, 21 bp, Homo sapiens
ttaaatgtacagacatattta

SEQ ID NO: 899173 - DNA, 22 bp, Homo sapiens
ttaaatgtagcttcagtcatta

SEQ ID NO: 899174 - DNA, 19 bp, Homo sapiens
ttaaatgtatactatagta

SEQ ID NO: 899175 - DNA, 13 bp, Homo sapiens
ttaaatgtattta

SEQ ID NO: 899176 - DNA, 23 bp, Homo sapiens
ttaaatgttctaacagatcagaa

SEQ ID NO: 899177 - DNA, 19 bp, Homo sapiens
gttctgacactttctgctg

SEQ ID NO: 899178 - DNA, 15 bp, Homo sapiens
gttctgacattaaca

SEQ ID NO: 899179 - DNA, 13 bp, Homo sapiens
gttctgacttgac

SEQ ID NO: 899180 - DNA, 16 bp, Homo sapiens
gttctgattagaaatg

SEQ ID NO: 899181 - DNA, 20 bp, Homo sapiens
gttctgattagaaatgacca

SEQ ID NO: 899182 - DNA, 21 bp, Homo sapiens
gttctgcaaatagaaaacagg

SEQ ID NO: 899183 - DNA, 17 bp, Homo sapiens
gttctgcaagaattaaa

SEQ ID NO: 899184 - DNA, 19 bp, Homo sapiens
gttctgcaagaattaaaac

SEQ ID NO: 899185 - DNA, 20 bp, Homo sapiens
gttctgcaagaattaaaact

SEQ ID NO: 899186 - DNA, 16 bp, Homo sapiens
gttctgcacacagcac

SEQ ID NO: 899187 - DNA, 15 bp, Homo sapiens
gttctgcaggttgaa

SEQ ID NO: 899188 - DNA, 23 bp, Homo sapiens
gttctgcaggttgaagccatgtc

SEQ ID NO: 899189 - DNA, 13 bp, Homo sapiens
gttctgcagtcat

SEQ ID NO: 899190 - DNA, 14 bp, Homo sapiens
gttctgccaggcaa

SEQ ID NO: 899191 - DNA, 23 bp, Homo sapiens
gttctgcccacgatcccctcccc

SEQ ID NO: 899192 - DNA, 15 bp, Homo sapiens
gttctgcccccagcc

SEQ ID NO: 899193 - DNA, 19 bp, Homo sapiens
gttctgcccccagcccaaa

SEQ ID NO: 899194 - DNA, 20 bp, Homo sapiens
gttctgcccccagcccaaag

SEQ ID NO: 899195 - DNA, 15 bp, Homo sapiens
gttctgccctgcctg

SEQ ID NO: 899196 - DNA, 16 bp, Homo sapiens
gttctgccctgcctga

SEQ ID NO: 899197 - DNA, 23 bp, Homo sapiens
gttctgccctgcctgaggaggag

SEQ ID NO: 899198 - DNA, 19 bp, Homo sapiens
gttctgcctctccctgggt

SEQ ID NO: 899199 - DNA, 19 bp, Homo sapiens
gttctgctagagcagacag

SEQ ID NO: 899200 - DNA, 18 bp, Homo sapiens
gttctgctcctgcttttc

SEQ ID NO: 899201 - DNA, 22 bp, Homo sapiens
gttctgctcctgcttttctgtc

SEQ ID NO: 899202 - DNA, 18 bp, Homo sapiens
gttctgctgaccaaatgg

SEQ ID NO: 899203 - DNA, 17 bp, Homo sapiens
tgtggtaggtgataaag

SEQ ID NO: 899204 - DNA, 17 bp, Homo sapiens
tgtggtataaaaaggaa

SEQ ID NO: 899205 - DNA, 21 bp, Homo sapiens
tgtggtctaaagtgtttagct

SEQ ID NO: 899206 - DNA, 20 bp, Homo sapiens
tgtggtctataaaataaact

SEQ ID NO: 899207 - DNA, 23 bp, Homo sapiens
tgtggtctataaaataaacttct

SEQ ID NO: 899208 - DNA, 14 bp, Homo sapiens
tgtggtctcaggat

SEQ ID NO: 899209 - DNA, 19 bp, Homo sapiens
tgtggtcttatgattttat

SEQ ID NO: 899210 - DNA, 23 bp, Homo sapiens
tgtggtgaagtgtggctggtgtc

SEQ ID NO: 899211 - DNA, 14 bp, Homo sapiens
tgtggtgaggggct

SEQ ID NO: 899212 - DNA, 19 bp, Homo sapiens
tgtggtgaggggctttctc

SEQ ID NO: 899213 - DNA, 20 bp, Homo sapiens
tgtggtgaggggctttctct

SEQ ID NO: 899214 - DNA, 16 bp, Homo sapiens
tgtggtgcagtgtgaa

SEQ ID NO: 899215 - DNA, 15 bp, Homo sapiens
tgtggtggagccagg

SEQ ID NO: 899216 - DNA, 18 bp, Homo sapiens
tgtggtggattctccctg

SEQ ID NO: 899217 - DNA, 14 bp, Homo sapiens
tgtggtggcctcag

SEQ ID NO: 899218 - DNA, 15 bp, Homo sapiens
tgtggtggcctcagc

SEQ ID NO: 899219 - DNA, 22 bp, Homo sapiens
tgtggtggctccccctctgctt

SEQ ID NO: 899220 - DNA, 16 bp, Homo sapiens
tgtggtgggcgctggg

SEQ ID NO: 899221 - DNA, 23 bp, Homo sapiens
tgtggtgggttctttggaaggag

SEQ ID NO: 899222 - DNA, 14 bp, Homo sapiens
tgtggtgtctgtgt

SEQ ID NO: 899223 - DNA, 12 bp, Homo sapiens
tgtggtgtgacc

SEQ ID NO: 899224 - DNA, 20 bp, Homo sapiens
tgtggtgtgaccatgttcat

SEQ ID NO: 899225 - DNA, 19 bp, Homo sapiens
tgtggttatcactttaagt

SEQ ID NO: 899226 - DNA, 18 bp, Homo sapiens
tgtggttcctaagcctgt

SEQ ID NO: 899227 - DNA, 21 bp, Homo sapiens
tgtggttcctaagcctgttgc

SEQ ID NO: 899228 - DNA, 18 bp, Homo sapiens
tgtggttctattttactt

SEQ ID NO: 899229 - DNA, 19 bp, Homo sapiens
tgtggttgaggggcctgga

SEQ ID NO: 899230 - DNA, 18 bp, Homo sapiens
tgtggtttactagcagga

SEQ ID NO: 899231 - DNA, 15 bp, Homo sapiens
tgtggtttcagatgt

SEQ ID NO: 899232 - DNA, 22 bp, Homo sapiens
tgtggtttcagatgtgcaataa

SEQ ID NO: 899233 - DNA, 12 bp, Homo sapiens
tgtggtttcatt

SEQ ID NO: 899234 - DNA, 13 bp, Homo sapiens
tgtggtttggaat

SEQ ID NO: 899235 - DNA, 18 bp, Homo sapiens
tgtggttttcccctccct

SEQ ID NO: 899236 - DNA, 22 bp, Homo sapiens
tgtggttttcccctccctgggt

SEQ ID NO: 899237 - DNA, 23 bp, Homo sapiens
tgtggttttcccctccctgggtt

SEQ ID NO: 899238 - DNA, 16 bp, Homo sapiens
tgtggttttgtaattt

SEQ ID NO: 899239 - DNA, 21 bp, Homo sapiens
tgtgtaaacacagtcaaaata

SEQ ID NO: 899240 - DNA, 15 bp, Homo sapiens
tgtgtaaagatttat

SEQ ID NO: 899241 - DNA, 17 bp, Homo sapiens
tgtgtaaataatttgca

SEQ ID NO: 899242 - DNA, 15 bp, Homo sapiens
tgtgtaaatatatgt

SEQ ID NO: 899243 - DNA, 21 bp, Homo sapiens
tgtgtaaatatttttccctcc

SEQ ID NO: 899244 - DNA, 19 bp, Homo sapiens
tgtgtaactttaaacatct

SEQ ID NO: 899245 - DNA, 17 bp, Homo sapiens
tgtgtaagaaatacaga

SEQ ID NO: 899246 - DNA, 12 bp, Homo sapiens
tgtgtaagattt

SEQ ID NO: 899247 - DNA, 14 bp, Homo sapiens
tgtgtaataagaaa

SEQ ID NO: 899248 - DNA, 15 bp, Homo sapiens
tgtgtaataagaaag

SEQ ID NO: 899249 - DNA, 16 bp, Homo sapiens
tgtgtaattttgttct

SEQ ID NO: 899250 - DNA, 17 bp, Homo sapiens
tgtgtacaatgtacaca

SEQ ID NO: 899251 - DNA, 16 bp, Homo sapiens
tgtgtacaattttagt

SEQ ID NO: 899252 - DNA, 13 bp, Homo sapiens
tgtgtacacatgg

SEQ ID NO: 899253 - DNA, 21 bp, Homo sapiens
tgtgtacacctgcggggccac

SEQ ID NO: 899254 - DNA, 22 bp, Homo sapiens
tgtgtacacgggactgacgcaa

SEQ ID NO: 899255 - DNA, 18 bp, Homo sapiens
tgtgtacagatgaatgat

SEQ ID NO: 899256 - DNA, 20 bp, Homo sapiens
tgtgtacagtgaattgtctt

SEQ ID NO: 899257 - DNA, 20 bp, Homo sapiens
tgtgtacataactctgtaaa

SEQ ID NO: 899258 - DNA, 15 bp, Homo sapiens
tgtgtacataactga

SEQ ID NO: 899259 - DNA, 17 bp, Homo sapiens
tgtgtacataactgaaa

SEQ ID NO: 899260 - DNA, 20 bp, Homo sapiens
tgtgtaccacttctgtgggc

SEQ ID NO: 899261 - DNA, 16 bp, Homo sapiens
tgtgtactgataaaat

SEQ ID NO: 899262 - DNA, 17 bp, Homo sapiens
tgtgtactgtaaagaat

SEQ ID NO: 899263 - DNA, 21 bp, Homo sapiens
tgtgtagacaaatatttggag

SEQ ID NO: 899264 - DNA, 23 bp, Homo sapiens
tgtgtagcaattgacagagaata

SEQ ID NO: 899265 - DNA, 14 bp, Homo sapiens
tgtgtagctttgct

SEQ ID NO: 899266 - DNA, 18 bp, Homo sapiens
tgtgtaggtgtctgcctt

SEQ ID NO: 899267 - DNA, 15 bp, Homo sapiens
tgtgtatatagtttt

SEQ ID NO: 899268 - DNA, 21 bp, Homo sapiens
tgtgtatatatatatatatgt

SEQ ID NO: 899269 - DNA, 17 bp, Homo sapiens
tgtgtatatatttaaaa

SEQ ID NO: 899270 - DNA, 19 bp, Homo sapiens
tgtgtatatatttaaaaaa

SEQ ID NO: 899271 - DNA, 15 bp, Homo sapiens
tgtgtatatgtataa

SEQ ID NO: 899272 - DNA, 14 bp, Homo sapiens
tgtgtatattggtg

SEQ ID NO: 899273 - DNA, 14 bp, Homo sapiens
tgtgtatatttgct

SEQ ID NO: 899274 - DNA, 15 bp, Homo sapiens
tgtgtatatttgctt

SEQ ID NO: 899275 - DNA, 18 bp, Homo sapiens
tgtgtatattttaatgaa

SEQ ID NO: 899276 - DNA, 21 bp, Homo sapiens
tgtgtatctaaaggatggaaa

SEQ ID NO: 899277 - DNA, 18 bp, Homo sapiens
tgtgtatctgtgcttcta

SEQ ID NO: 899278 - DNA, 19 bp, Homo sapiens
tgtgtatgctgatgatcaa

SEQ ID NO: 899279 - DNA, 15 bp, Homo sapiens
tgtgtatgctgcttt

SEQ ID NO: 899280 - DNA, 23 bp, Homo sapiens
tgtgtatgggggaaggcgctggg

SEQ ID NO: 899281 - DNA, 15 bp, Homo sapiens
tgtgtatgtacatat

SEQ ID NO: 899282 - DNA, 20 bp, Homo sapiens
tgtgtatgtacttagctgta

SEQ ID NO: 899283 - DNA, 12 bp, Homo sapiens
tgtgtatgtata

SEQ ID NO: 899284 - DNA, 15 bp, Homo sapiens
tgtgtatgtcagtgg

SEQ ID NO: 899285 - DNA, 19 bp, Homo sapiens
tgtgtatgtcagtggtttc

SEQ ID NO: 899286 - DNA, 21 bp, Homo sapiens
tgtgtattaaaaaaaacaaaa

SEQ ID NO: 899287 - DNA, 17 bp, Homo sapiens
tgtgtattcagaggcag

SEQ ID NO: 899288 - DNA, 20 bp, Homo sapiens
tgtgtattgagtcttaactg

SEQ ID NO: 899289 - DNA, 13 bp, Homo sapiens
tgtgtatttaaca

SEQ ID NO: 899290 - DNA, 18 bp, Homo sapiens
tgtgtatttaacagggag

SEQ ID NO: 899291 - DNA, 20 bp, Homo sapiens
tgtgtatttaacagggaggg

SEQ ID NO: 899292 - DNA, 15 bp, Homo sapiens
tgtgtatttacgctt

SEQ ID NO: 899293 - DNA, 20 bp, Homo sapiens
tgtgtatttatttaaaactc

SEQ ID NO: 899294 - DNA, 21 bp, Homo sapiens
tgtgtatttatttaaaactct

SEQ ID NO: 899295 - DNA, 14 bp, Homo sapiens
tgtgtatttgtatt

SEQ ID NO: 899296 - DNA, 16 bp, Homo sapiens
tgtgtatttgtattaa

SEQ ID NO: 899297 - DNA, 15 bp, Homo sapiens
tgtgtattttcagtc

SEQ ID NO: 899298 - DNA, 14 bp, Homo sapiens
tgtgtcaaaataaa

SEQ ID NO: 899299 - DNA, 23 bp, Homo sapiens
tgtgtcacaatgagattgaattt

SEQ ID NO: 899300 - DNA, 17 bp, Homo sapiens
tgtgtcagaaacatgaa

SEQ ID NO: 899301 - DNA, 21 bp, Homo sapiens
tgtgtcagaaacatgaaatgc

SEQ ID NO: 899302 - DNA, 12 bp, Homo sapiens
tgtgtcagagcc

SEQ ID NO: 899303 - DNA, 15 bp, Homo sapiens
tgtgtcagagcccag

SEQ ID NO: 899304 - DNA, 12 bp, Homo sapiens
tgtgtcagagtg

SEQ ID NO: 899305 - DNA, 15 bp, Homo sapiens
tgtgtcagctgaggc

SEQ ID NO: 899306 - DNA, 13 bp, Homo sapiens
tgtgtcagggatg

SEQ ID NO: 899307 - DNA, 15 bp, Homo sapiens
tgtgtcagggatgag

SEQ ID NO: 899308 - DNA, 20 bp, Homo sapiens
tgtgtcagggatgagttgag

SEQ ID NO: 899309 - DNA, 14 bp, Homo sapiens
tgtgtcagttttca

SEQ ID NO: 899310 - DNA, 18 bp, Homo sapiens
tgtgtcataaattacaca

SEQ ID NO: 899311 - DNA, 13 bp, Homo sapiens
tgtgtccagcagc

SEQ ID NO: 899312 - DNA, 19 bp, Homo sapiens
tgtgtcccaaaatcccctc

SEQ ID NO: 899313 - DNA, 22 bp, Homo sapiens
tgtgtcccaaaatcccctcagc

SEQ ID NO: 899314 - DNA, 16 bp, Homo sapiens
tgtgtcccagatgctg

SEQ ID NO: 899315 - DNA, 14 bp, Homo sapiens
tgtgtcccatgacc

SEQ ID NO: 899316 - DNA, 22 bp, Homo sapiens
tgtgtcccatgacccacccctg

SEQ ID NO: 899317 - DNA, 16 bp, Homo sapiens
tgtgtccccctctgtc

SEQ ID NO: 899318 - DNA, 18 bp, Homo sapiens
tgtgtcccctcactctgt

SEQ ID NO: 899319 - DNA, 16 bp, Homo sapiens
tgtgtcccctgacctg

SEQ ID NO: 899320 - DNA, 17 bp, Homo sapiens
tgtgtccctggaacctt

SEQ ID NO: 899321 - DNA, 20 bp, Homo sapiens
tgtgtccctggaaccttcta

SEQ ID NO: 899322 - DNA, 17 bp, Homo sapiens
tgtgtcctaaggcccat

SEQ ID NO: 899323 - DNA, 15 bp, Homo sapiens
tgtgtcctctgtgcc

SEQ ID NO: 899324 - DNA, 17 bp, Homo sapiens
tgtgtcctgatggccca

SEQ ID NO: 899325 - DNA, 15 bp, Homo sapiens
tgtgtcctgctctgt

SEQ ID NO: 899326 - DNA, 22 bp, Homo sapiens
tgtgtcctggtgctctctgcca

SEQ ID NO: 899327 - DNA, 14 bp, Homo sapiens
tgtgtcctggttcc

SEQ ID NO: 899328 - DNA, 14 bp, Homo sapiens
gttctgctggcctg

SEQ ID NO: 899329 - DNA, 19 bp, Homo sapiens
gttctgctggcctggatct

SEQ ID NO: 899330 - DNA, 16 bp, Homo sapiens
gttctggactctgccc

SEQ ID NO: 899331 - DNA, 17 bp, Homo sapiens
gttctggactctgcccc

SEQ ID NO: 899332 - DNA, 14 bp, Homo sapiens
gttctggcaagagc

SEQ ID NO: 899333 - DNA, 16 bp, Homo sapiens
gttctggcaagagcag

SEQ ID NO: 899334 - DNA, 11 bp, Homo sapiens
gttctggcagg

SEQ ID NO: 899335 - DNA, 13 bp, Homo sapiens
gttctggcaggac

SEQ ID NO: 899336 - DNA, 12 bp, Homo sapiens
gttctggccaga

SEQ ID NO: 899337 - DNA, 22 bp, Homo sapiens
gttctggctgccccaacctgct

SEQ ID NO: 899338 - DNA, 11 bp, Homo sapiens
gttctgggcaa

SEQ ID NO: 899339 - DNA, 13 bp, Homo sapiens
gttctgggctggg

SEQ ID NO: 899340 - DNA, 14 bp, Homo sapiens
gttctgggctgggg

SEQ ID NO: 899341 - DNA, 21 bp, Homo sapiens
gttctgggctggggccacctt

SEQ ID NO: 899342 - DNA, 20 bp, Homo sapiens
gttctggtatttcccctgtc

SEQ ID NO: 899343 - DNA, 18 bp, Homo sapiens
gttctgtattctggcgga

SEQ ID NO: 899344 - DNA, 20 bp, Homo sapiens
gttctgtgggcttggccttg

SEQ ID NO: 899345 - DNA, 16 bp, Homo sapiens
gttctgtggtcacagt

SEQ ID NO: 899346 - DNA, 16 bp, Homo sapiens
gttctgtggtttcatg

SEQ ID NO: 899347 - DNA, 21 bp, Homo sapiens
gttctgtggttttcccctccc

SEQ ID NO: 899348 - DNA, 22 bp, Homo sapiens
gttctgtgtctttcacagctcc

SEQ ID NO: 899349 - DNA, 23 bp, Homo sapiens
gttctgtgtctttcacagctcct

SEQ ID NO: 899350 - DNA, 17 bp, Homo sapiens
gttctgttgaaggtgcc

SEQ ID NO: 899351 - DNA, 21 bp, Homo sapiens
gttctgttgaaggtgccattt

SEQ ID NO: 899352 - DNA, 20 bp, Homo sapiens
gttctgttgatcccacttca

SEQ ID NO: 899353 - DNA, 16 bp, Homo sapiens
gttctgtttggcactt

SEQ ID NO: 899354 - DNA, 15 bp, Homo sapiens
gttctgtttgttaaa

SEQ ID NO: 899355 - DNA, 14 bp, Homo sapiens
gttctgtttgttat

SEQ ID NO: 899356 - DNA, 18 bp, Homo sapiens
gttctgtttgttattgtt

SEQ ID NO: 899357 - DNA, 23 bp, Homo sapiens
gttctgtttgttattgttttgtt

SEQ ID NO: 899358 - DNA, 14 bp, Homo sapiens
gttctgttttcgta

SEQ ID NO: 899359 - DNA, 20 bp, Homo sapiens
gttctgttttcgtaccttcc

SEQ ID NO: 899360 - DNA, 16 bp, Homo sapiens
gttctgttttgcctga

SEQ ID NO: 899361 - DNA, 17 bp, Homo sapiens
gttcttaattcttagct

SEQ ID NO: 899362 - DNA, 23 bp, Homo sapiens
gttcttagattcaggggaagggc

SEQ ID NO: 899363 - DNA, 20 bp, Homo sapiens
gttcttatgaggaggggagg

SEQ ID NO: 899364 - DNA, 14 bp, Homo sapiens
gttcttatttgcca

SEQ ID NO: 899365 - DNA, 13 bp, Homo sapiens
gttcttattttag

SEQ ID NO: 899366 - DNA, 21 bp, Homo sapiens
gttcttattttgcattccaga

SEQ ID NO: 899367 - DNA, 23 bp, Homo sapiens
gttcttattttgcattccagaat

SEQ ID NO: 899368 - DNA, 16 bp, Homo sapiens
gttcttcaagaggaaa

SEQ ID NO: 899369 - DNA, 14 bp, Homo sapiens
gttcttcagggcca

SEQ ID NO: 899370 - DNA, 11 bp, Homo sapiens
gttcttcatga

SEQ ID NO: 899371 - DNA, 21 bp, Homo sapiens
gttcttcctccagctgcacca

SEQ ID NO: 899372 - DNA, 18 bp, Homo sapiens
gttcttcctgtctccttt

SEQ ID NO: 899373 - DNA, 21 bp, Homo sapiens
gttcttcctttccctggagct

SEQ ID NO: 899374 - DNA, 20 bp, Homo sapiens
gttcttcttcctgaagctga

SEQ ID NO: 899375 - DNA, 24 bp, Homo sapiens
gttcttcttgggagtatgttgtca

SEQ ID NO: 899376 - DNA, 19 bp, Homo sapiens
gttcttctttctctgtatt

SEQ ID NO: 899377 - DNA, 13 bp, Homo sapiens
gttcttctttctt

SEQ ID NO: 899378 - DNA, 13 bp, Homo sapiens
gttcttgaagctg

SEQ ID NO: 899379 - DNA, 15 bp, Homo sapiens
gttcttgaattgtta

SEQ ID NO: 899380 - DNA, 21 bp, Homo sapiens
gttcttgctgagcaccctctc

SEQ ID NO: 899381 - DNA, 16 bp, Homo sapiens
gttcttggaccagttt

SEQ ID NO: 899382 - DNA, 21 bp, Homo sapiens
gttcttggaccagtttgcaga

SEQ ID NO: 899383 - DNA, 16 bp, Homo sapiens
gttcttggtagagatt

SEQ ID NO: 899384 - DNA, 14 bp, Homo sapiens
gttcttggtttgta

SEQ ID NO: 899385 - DNA, 13 bp, Homo sapiens
gttcttgtaattt

SEQ ID NO: 899386 - DNA, 18 bp, Homo sapiens
gttcttgtgcatgtttac

SEQ ID NO: 899387 - DNA, 15 bp, Homo sapiens
gttcttgttggtgca

SEQ ID NO: 899388 - DNA, 19 bp, Homo sapiens
gttctttactcgtcccctt

SEQ ID NO: 899389 - DNA, 20 bp, Homo sapiens
gttctttcatttgctttgga

SEQ ID NO: 899390 - DNA, 14 bp, Homo sapiens
gttctttccaaagt

SEQ ID NO: 899391 - DNA, 18 bp, Homo sapiens
gttctttcctctttctgc

SEQ ID NO: 899392 - DNA, 14 bp, Homo sapiens
gttctttcctgccc

SEQ ID NO: 899393 - DNA, 16 bp, Homo sapiens
gttctttcctgccctg

SEQ ID NO: 899394 - DNA, 19 bp, Homo sapiens
gttctttcctgccctgtcc

SEQ ID NO: 899395 - DNA, 16 bp, Homo sapiens
gttctttcttcctctg

SEQ ID NO: 899396 - DNA, 18 bp, Homo sapiens
gttctttcttcctctgct

SEQ ID NO: 899397 - DNA, 20 bp, Homo sapiens
gttctttgatttgtaccatt

SEQ ID NO: 899398 - DNA, 18 bp, Homo sapiens
gttctttggaaggagtga

SEQ ID NO: 899399 - DNA, 13 bp, Homo sapiens
gttctttgttcat

SEQ ID NO: 899400 - DNA, 20 bp, Homo sapiens
gttctttgttcatagcccag

SEQ ID NO: 899401 - DNA, 14 bp, Homo sapiens
gttcttttaccact

SEQ ID NO: 899402 - DNA, 17 bp, Homo sapiens
gttctttttaagttaat

SEQ ID NO: 899403 - DNA, 19 bp, Homo sapiens
gttgaaaaagtttgttttt

SEQ ID NO: 899404 - DNA, 21 bp, Homo sapiens
gttgaaaaagtttgtttttgc

SEQ ID NO: 899405 - DNA, 16 bp, Homo sapiens
gttgaaaagcacacac

SEQ ID NO: 899406 - DNA, 20 bp, Homo sapiens
gttgaaaatgtatttcctga

SEQ ID NO: 899407 - DNA, 12 bp, Homo sapiens
gttgaacagagg

SEQ ID NO: 899408 - DNA, 13 bp, Homo sapiens
gttgaacagctat

SEQ ID NO: 899409 - DNA, 20 bp, Homo sapiens
gttgaagacttcctctctac

SEQ ID NO: 899410 - DNA, 15 bp, Homo sapiens
gttgaagaggaaggg

SEQ ID NO: 899411 - DNA, 18 bp, Homo sapiens
gttgaagcaaatcgaatg

SEQ ID NO: 899412 - DNA, 15 bp, Homo sapiens
gttgaagccatgtct

SEQ ID NO: 899413 - DNA, 13 bp, Homo sapiens
gttgaaggcagtc

SEQ ID NO: 899414 - DNA, 12 bp, Homo sapiens
gttgaagggagg

SEQ ID NO: 899415 - DNA, 22 bp, Homo sapiens
gttgaatattggtaattaaaag

SEQ ID NO: 899416 - DNA, 18 bp, Homo sapiens
gttgaatctgggagggaa

SEQ ID NO: 899417 - DNA, 19 bp, Homo sapiens
gttgaatgttgcaatgtga

SEQ ID NO: 899418 - DNA, 21 bp, Homo sapiens
gttgaattttgttctctggga

SEQ ID NO: 899419 - DNA, 18 bp, Homo sapiens
gttgacaacctagaatgt

SEQ ID NO: 899420 - DNA, 21 bp, Homo sapiens
gttgacaattctgcatgtact

SEQ ID NO: 899421 - DNA, 14 bp, Homo sapiens
gttgacactgtttt

SEQ ID NO: 899422 - DNA, 17 bp, Homo sapiens
gttgacactgttttcct

SEQ ID NO: 899423 - DNA, 12 bp, Homo sapiens
gttgacagcagg

SEQ ID NO: 899424 - DNA, 18 bp, Homo sapiens
gttgacagttcatatgta

SEQ ID NO: 899425 - DNA, 16 bp, Homo sapiens
gttgacagttctgaag

SEQ ID NO: 899426 - DNA, 17 bp, Homo sapiens
gttgacagttctgaaga

SEQ ID NO: 899427 - DNA, 18 bp, Homo sapiens
gttgacatatttaatgtt

SEQ ID NO: 899428 - DNA, 19 bp, Homo sapiens
gttgacatatttaatgttt

SEQ ID NO: 899429 - DNA, 13 bp, Homo sapiens
gttgacattctga

SEQ ID NO: 899430 - DNA, 14 bp, Homo sapiens
gttgacattctgaa

SEQ ID NO: 899431 - DNA, 16 bp, Homo sapiens
gttgacattttctttt

SEQ ID NO: 899432 - DNA, 17 bp, Homo sapiens
gttgaccactccagaga

SEQ ID NO: 899433 - DNA, 23 bp, Homo sapiens
gttgacgggccgcaggagggagg

SEQ ID NO: 899434 - DNA, 15 bp, Homo sapiens
gttgactgctgctcc

SEQ ID NO: 899435 - DNA, 19 bp, Homo sapiens
gttgacttatagtacatga

SEQ ID NO: 899436 - DNA, 16 bp, Homo sapiens
gttgagaatcccaaat

SEQ ID NO: 899437 - DNA, 12 bp, Homo sapiens
gttgagagccag

SEQ ID NO: 899438 - DNA, 18 bp, Homo sapiens
gttgagatagttttcatc

SEQ ID NO: 899439 - DNA, 19 bp, Homo sapiens
gttgagatttttaagaact

SEQ ID NO: 899440 - DNA, 14 bp, Homo sapiens
gttgagcaagcagt

SEQ ID NO: 899441 - DNA, 19 bp, Homo sapiens
gttgagcatgacagcctgc

SEQ ID NO: 899442 - DNA, 21 bp, Homo sapiens
gttgagcatgacagcctgcag

SEQ ID NO: 899443 - DNA, 23 bp, Homo sapiens
gttgagccaggcctgggtctgtg

SEQ ID NO: 899444 - DNA, 16 bp, Homo sapiens
gttgagccccaagtcc

SEQ ID NO: 899445 - DNA, 16 bp, Homo sapiens
gttgagccccagtgct

SEQ ID NO: 899446 - DNA, 21 bp, Homo sapiens
gttgagcttcatataccagca

SEQ ID NO: 899447 - DNA, 20 bp, Homo sapiens
gttgaggccgaggataaaga

SEQ ID NO: 899448 - DNA, 22 bp, Homo sapiens
gttgagggaacagacaggagaa

SEQ ID NO: 899449 - DNA, 23 bp, Homo sapiens
gttgagggaacagacaggagaaa

SEQ ID NO: 899450 - DNA, 20 bp, Homo sapiens
gttgaggtctttctcctcag

SEQ ID NO: 899451 - DNA, 16 bp, Homo sapiens
gttgaggtggtctgaa

SEQ ID NO: 899452 - DNA, 13 bp, Homo sapiens
gttgataatttca

SEQ ID NO: 899453 - DNA, 22 bp, Homo sapiens
tgtgtcctgtcctttcttgcag

SEQ ID NO: 899454 - DNA, 22 bp, Homo sapiens
tgtgtccttgaactgaggccct

SEQ ID NO: 899455 - DNA, 14 bp, Homo sapiens
tgtgtccttgcacc

SEQ ID NO: 899456 - DNA, 18 bp, Homo sapiens
tgtgtccttgcacctgca

SEQ ID NO: 899457 - DNA, 17 bp, Homo sapiens
tgtgtctaaactgcatt

SEQ ID NO: 899458 - DNA, 21 bp, Homo sapiens
tgtgtctaaactgcattaccg

SEQ ID NO: 899459 - DNA, 19 bp, Homo sapiens
tgtgtctaggcaggacctg

SEQ ID NO: 899460 - DNA, 16 bp, Homo sapiens
tgtgtctatgtacctc

SEQ ID NO: 899461 - DNA, 14 bp, Homo sapiens
tgtgtctcccagaa

SEQ ID NO: 899462 - DNA, 15 bp, Homo sapiens
tgtgtctcccagaac

SEQ ID NO: 899463 - DNA, 15 bp, Homo sapiens
tgtgtctctgctttc

SEQ ID NO: 899464 - DNA, 18 bp, Homo sapiens
tgtgtctctgtttcctga

SEQ ID NO: 899465 - DNA, 20 bp, Homo sapiens
tgtgtctctgtttcctgaaa

SEQ ID NO: 899466 - DNA, 14 bp, Homo sapiens
tgtgtctcttttct

SEQ ID NO: 899467 - DNA, 20 bp, Homo sapiens
tgtgtctgcattgttattgt

SEQ ID NO: 899468 - DNA, 19 bp, Homo sapiens
tgtgtctgcgtctgtgttg

SEQ ID NO: 899469 - DNA, 16 bp, Homo sapiens
tgtgtctgctaatgta

SEQ ID NO: 899470 - DNA, 20 bp, Homo sapiens
tgtgtctgctaatgtaaact

SEQ ID NO: 899471 - DNA, 14 bp, Homo sapiens
tgtgtctgctcagt

SEQ ID NO: 899472 - DNA, 22 bp, Homo sapiens
tgtgtctggcgttctcaagaat

SEQ ID NO: 899473 - DNA, 20 bp, Homo sapiens
tgtgtctgggagagcctggc

SEQ ID NO: 899474 - DNA, 22 bp, Homo sapiens
tgtgtctgtaggtgtctctggg

SEQ ID NO: 899475 - DNA, 22 bp, Homo sapiens
tgtgtctgtgccctccaaagag

SEQ ID NO: 899476 - DNA, 23 bp, Homo sapiens
tgtgtctgtgtttaatattacca

SEQ ID NO: 899477 - DNA, 21 bp, Homo sapiens
tgtgtcttatgaggaattgga

SEQ ID NO: 899478 - DNA, 20 bp, Homo sapiens
tgtgtctttatagatgtaca

SEQ ID NO: 899479 - DNA, 15 bp, Homo sapiens
tgtgtctttgtctgg

SEQ ID NO: 899480 - DNA, 16 bp, Homo sapiens
tgtgtgaactgggcac

SEQ ID NO: 899481 - DNA, 17 bp, Homo sapiens
tgtgtgaagttacacaa

SEQ ID NO: 899482 - DNA, 12 bp, Homo sapiens
tgtgtgaatgaa

SEQ ID NO: 899483 - DNA, 14 bp, Homo sapiens
tgtgtgacaattct

SEQ ID NO: 899484 - DNA, 16 bp, Homo sapiens
tgtgtgacactgatga

SEQ ID NO: 899485 - DNA, 15 bp, Homo sapiens
tgtgtgactgagcaa

SEQ ID NO: 899486 - DNA, 21 bp, Homo sapiens
tgtgtgagcgtggccttggga

SEQ ID NO: 899487 - DNA, 17 bp, Homo sapiens
tgtgtgaggctgtgtct

SEQ ID NO: 899488 - DNA, 21 bp, Homo sapiens
tgtgtgagtggagttgaggtg

SEQ ID NO: 899489 - DNA, 17 bp, Homo sapiens
tgtgtgagtgtgaatat

SEQ ID NO: 899490 - DNA, 14 bp, Homo sapiens
tgtgtgagtgtgag

SEQ ID NO: 899491 - DNA, 13 bp, Homo sapiens
tgtgtgatttcct

SEQ ID NO: 899492 - DNA, 15 bp, Homo sapiens
tgtgtgatttcctaa

SEQ ID NO: 899493 - DNA, 22 bp, Homo sapiens
tgtgtgatttcctaaacataat

SEQ ID NO: 899494 - DNA, 22 bp, Homo sapiens
tgtgtgcaacagggtatggact

SEQ ID NO: 899495 - DNA, 22 bp, Homo sapiens
tgtgtgcacacgtgtgtatgag

SEQ ID NO: 899496 - DNA, 21 bp, Homo sapiens
tgtgtgcaggagcctccctgc

SEQ ID NO: 899497 - DNA, 13 bp, Homo sapiens
tgtgtgcatgtga

SEQ ID NO: 899498 - DNA, 16 bp, Homo sapiens
tgtgtgcatgtgagca

SEQ ID NO: 899499 - DNA, 15 bp, Homo sapiens
tgtgtgcatgtgtgt

SEQ ID NO: 899500 - DNA, 24 bp, Homo sapiens
tgtgtgcatgtgtgtgtctgtctt

SEQ ID NO: 899501 - DNA, 22 bp, Homo sapiens
tgtgtgcattggggtggggctt

SEQ ID NO: 899502 - DNA, 24 bp, Homo sapiens
tgtgtgccatagagtttaacacaa

SEQ ID NO: 899503 - DNA, 13 bp, Homo sapiens
tgtgtgccctggg

SEQ ID NO: 899504 - DNA, 13 bp, Homo sapiens
tgtgtgcctgtgg

SEQ ID NO: 899505 - DNA, 16 bp, Homo sapiens
tgtgtgcctgtggcag

SEQ ID NO: 899506 - DNA, 17 bp, Homo sapiens
tgtgtgcctgtggcaga

SEQ ID NO: 899507 - DNA, 18 bp, Homo sapiens
tgtgtgcttgaatgtgag

SEQ ID NO: 899508 - DNA, 19 bp, Homo sapiens
tgtgtgcttgaatgtgagt

SEQ ID NO: 899509 - DNA, 21 bp, Homo sapiens
tgtgtggacggcgctgcctca

SEQ ID NO: 899510 - DNA, 17 bp, Homo sapiens
tgtgtggactcaagtcc

SEQ ID NO: 899511 - DNA, 22 bp, Homo sapiens
tgtgtggagctcgctaaagtca

SEQ ID NO: 899512 - DNA, 15 bp, Homo sapiens
tgtgtggcagggggc

SEQ ID NO: 899513 - DNA, 17 bp, Homo sapiens
tgtgtggccaaccagga

SEQ ID NO: 899514 - DNA, 12 bp, Homo sapiens
tgtgtggctcct

SEQ ID NO: 899515 - DNA, 15 bp, Homo sapiens
tgtgtgggatactta

SEQ ID NO: 899516 - DNA, 13 bp, Homo sapiens
tgtgtgggcaggg

SEQ ID NO: 899517 - DNA, 14 bp, Homo sapiens
tgtgtgggggagat

SEQ ID NO: 899518 - DNA, 19 bp, Homo sapiens
tgtgtgggtgctgataatt

SEQ ID NO: 899519 - DNA, 20 bp, Homo sapiens
tgtgtggtgggttctttgga

SEQ ID NO: 899520 - DNA, 16 bp, Homo sapiens
tgtgtggttggaaaac

SEQ ID NO: 899521 - DNA, 21 bp, Homo sapiens
tgtgtggttggaaaacttttg

SEQ ID NO: 899522 - DNA, 14 bp, Homo sapiens
tgtgtgtatgctga

SEQ ID NO: 899523 - DNA, 17 bp, Homo sapiens
tgtgtgtatgctgcttt

SEQ ID NO: 899524 - DNA, 12 bp, Homo sapiens
tgtgtgtatgta

SEQ ID NO: 899525 - DNA, 20 bp, Homo sapiens
tgtgtgtatttgctaatttt

SEQ ID NO: 899526 - DNA, 15 bp, Homo sapiens
tgtgtgtatttgtgt

SEQ ID NO: 899527 - DNA, 16 bp, Homo sapiens
tgtgtgtccaaaactg

SEQ ID NO: 899528 - DNA, 22 bp, Homo sapiens
tgtgtgtctaggcaggacctgt

SEQ ID NO: 899529 - DNA, 12 bp, Homo sapiens
tgtgtgtctcac

SEQ ID NO: 899530 - DNA, 15 bp, Homo sapiens
tgtgtgtctgtcttt

SEQ ID NO: 899531 - DNA, 20 bp, Homo sapiens
tgtgtgtgaatgaacactct

SEQ ID NO: 899532 - DNA, 14 bp, Homo sapiens
tgtgtgtgccctgg

SEQ ID NO: 899533 - DNA, 15 bp, Homo sapiens
tgtgtgtgccctggg

SEQ ID NO: 899534 - DNA, 14 bp, Homo sapiens
tgtgtgtggcaggg

SEQ ID NO: 899535 - DNA, 13 bp, Homo sapiens
tgtgtgtgtgaat

SEQ ID NO: 899536 - DNA, 12 bp, Homo sapiens
tgtgtgtgtgca

SEQ ID NO: 899537 - DNA, 14 bp, Homo sapiens
tgtgtgtgtgcatg

SEQ ID NO: 899538 - DNA, 12 bp, Homo sapiens
tgtgtgtgtgta

SEQ ID NO: 899539 - DNA, 13 bp, Homo sapiens
tgtgtgtgtgtgt

SEQ ID NO: 899540 - DNA, 14 bp, Homo sapiens
tgtgtgtgtgtttg

SEQ ID NO: 899541 - DNA, 15 bp, Homo sapiens
tgtgtgtgtgtttta

SEQ ID NO: 899542 - DNA, 24 bp, Homo sapiens
tgttaatttattttgctccctctg

SEQ ID NO: 899543 - DNA, 20 bp, Homo sapiens
tgttaatttgtgtgttttta

SEQ ID NO: 899544 - DNA, 20 bp, Homo sapiens
tgttaattttattgcaaagt

SEQ ID NO: 899545 - DNA, 17 bp, Homo sapiens
tgttacaagtttgctaa

SEQ ID NO: 899546 - DNA, 23 bp, Homo sapiens
tgttacaagtttgctaaaagaag

SEQ ID NO: 899547 - DNA, 16 bp, Homo sapiens
tgttacacaatggttt

SEQ ID NO: 899548 - DNA, 21 bp, Homo sapiens
tgttacaggcaccgagaatgt

SEQ ID NO: 899549 - DNA, 21 bp, Homo sapiens
tgttacagtaatgtcataaag

SEQ ID NO: 899550 - DNA, 19 bp, Homo sapiens
tgttacatgaagatgttaa

SEQ ID NO: 899551 - DNA, 19 bp, Homo sapiens
tgttaccaaaaataaatat

SEQ ID NO: 899552 - DNA, 21 bp, Homo sapiens
tgttaccatactgtctctgga

SEQ ID NO: 899553 - DNA, 23 bp, Homo sapiens
tgttaccatactgtctctggagt

SEQ ID NO: 899554 - DNA, 24 bp, Homo sapiens
tgttaccatactgtctctggagtg

SEQ ID NO: 899555 - DNA, 19 bp, Homo sapiens
tgttaccatgtcactgtgg

SEQ ID NO: 899556 - DNA, 19 bp, Homo sapiens
tgttacccaggctggtctc

SEQ ID NO: 899557 - DNA, 18 bp, Homo sapiens
tgttaccctcctgtaaat

SEQ ID NO: 899558 - DNA, 15 bp, Homo sapiens
tgttacctgaaaaca

SEQ ID NO: 899559 - DNA, 23 bp, Homo sapiens
tgttacctgaaaacactgtgcac

SEQ ID NO: 899560 - DNA, 17 bp, Homo sapiens
tgttactaactaaactc

SEQ ID NO: 899561 - DNA, 18 bp, Homo sapiens
tgttactaactaaactct

SEQ ID NO: 899562 - DNA, 21 bp, Homo sapiens
tgttactaccttattttcccc

SEQ ID NO: 899563 - DNA, 15 bp, Homo sapiens
tgttactagcctctc

SEQ ID NO: 899564 - DNA, 14 bp, Homo sapiens
tgttactattttct

SEQ ID NO: 899565 - DNA, 15 bp, Homo sapiens
tgttactattttcta

SEQ ID NO: 899566 - DNA, 20 bp, Homo sapiens
tgttactcagtgttagagaa

SEQ ID NO: 899567 - DNA, 13 bp, Homo sapiens
tgttactctggtt

SEQ ID NO: 899568 - DNA, 15 bp, Homo sapiens
tgttactgaccagca

SEQ ID NO: 899569 - DNA, 20 bp, Homo sapiens
tgttactgatcatgcattgt

SEQ ID NO: 899570 - DNA, 19 bp, Homo sapiens
tgttactgcctataatctt

SEQ ID NO: 899571 - DNA, 18 bp, Homo sapiens
tgttactgctgattcttg

SEQ ID NO: 899572 - DNA, 22 bp, Homo sapiens
tgttactgctgattcttgtaaa

SEQ ID NO: 899573 - DNA, 17 bp, Homo sapiens
tgttactggtgtccagc

SEQ ID NO: 899574 - DNA, 12 bp, Homo sapiens
tgttactgtaat

SEQ ID NO: 899575 - DNA, 13 bp, Homo sapiens
tgttactgtattt

SEQ ID NO: 899576 - DNA, 15 bp, Homo sapiens
tgttactgtcttcag

SEQ ID NO: 899577 - DNA, 10 bp, Homo sapiens
tgttactgtt

SEQ ID NO: 899578 - DNA, 12 bp, Homo sapiens
tgttacttacct

SEQ ID NO: 899579 - DNA, 17 bp, Homo sapiens
tgttagaaaacaaaatt

SEQ ID NO: 899580 - DNA, 12 bp, Homo sapiens
tgttagaaaagt

SEQ ID NO: 899581 - DNA, 17 bp, Homo sapiens
tgttagaaaatgactta

SEQ ID NO: 899582 - DNA, 20 bp, Homo sapiens
tgttagaaaatgacttattt

SEQ ID NO: 899583 - DNA, 14 bp, Homo sapiens
gttggggccctctt

SEQ ID NO: 899584 - DNA, 16 bp, Homo sapiens
gttggggccctcttgc

SEQ ID NO: 899585 - DNA, 18 bp, Homo sapiens
gttggggccctcttgcca

SEQ ID NO: 899586 - DNA, 22 bp, Homo sapiens
gttgggggagggaagaccagaa

SEQ ID NO: 899587 - DNA, 14 bp, Homo sapiens
gttgggggtcagtg

SEQ ID NO: 899588 - DNA, 19 bp, Homo sapiens
gttggggtgacagtcatca

SEQ ID NO: 899589 - DNA, 14 bp, Homo sapiens
gttgggtcaccaga

SEQ ID NO: 899590 - DNA, 15 bp, Homo sapiens
gttgggttcatctga

SEQ ID NO: 899591 - DNA, 14 bp, Homo sapiens
gttgggtttgctca

SEQ ID NO: 899592 - DNA, 18 bp, Homo sapiens
gttggtattaataaaaag

SEQ ID NO: 899593 - DNA, 12 bp, Homo sapiens
gttggtcagagg

SEQ ID NO: 899594 - DNA, 15 bp, Homo sapiens
gttggtccactgtgt

SEQ ID NO: 899595 - DNA, 16 bp, Homo sapiens
gttggtccactgtgtt

SEQ ID NO: 899596 - DNA, 23 bp, Homo sapiens
gttggtccagagcggaggctgtg

SEQ ID NO: 899597 - DNA, 16 bp, Homo sapiens
gttggtcggtgggttg

SEQ ID NO: 899598 - DNA, 22 bp, Homo sapiens
gttggtgaattttcaaggcctt

SEQ ID NO: 899599 - DNA, 11 bp, Homo sapiens
gttggtgactg

SEQ ID NO: 899600 - DNA, 12 bp, Homo sapiens
gttggtgactga

SEQ ID NO: 899601 - DNA, 17 bp, Homo sapiens
gttggtgcacagcacaa

SEQ ID NO: 899602 - DNA, 12 bp, Homo sapiens
gttggtggcagt

SEQ ID NO: 899603 - DNA, 18 bp, Homo sapiens
gttggtgttccacgtgtt

SEQ ID NO: 899604 - DNA, 17 bp, Homo sapiens
gttggttcacttcaaag

SEQ ID NO: 899605 - DNA, 21 bp, Homo sapiens
gttggttccttggggggccaa

SEQ ID NO: 899606 - DNA, 13 bp, Homo sapiens
gttggtttcagtg

SEQ ID NO: 899607 - DNA, 14 bp, Homo sapiens
gttgtaaaatatag

SEQ ID NO: 899608 - DNA, 23 bp, Homo sapiens
gttgtaaacaacgtgtatagtgc

SEQ ID NO: 899609 - DNA, 16 bp, Homo sapiens
gttgtaaaccaagtga

SEQ ID NO: 899610 - DNA, 18 bp, Homo sapiens
gttgtaaataatttattt

SEQ ID NO: 899611 - DNA, 19 bp, Homo sapiens
gttgtaaatgctcgtgtga

SEQ ID NO: 899612 - DNA, 15 bp, Homo sapiens
gttgtaacttatatt

SEQ ID NO: 899613 - DNA, 16 bp, Homo sapiens
gttgtaatagtccatg

SEQ ID NO: 899614 - DNA, 15 bp, Homo sapiens
gttgtaccaaaacat

SEQ ID NO: 899615 - DNA, 16 bp, Homo sapiens
gttgtaccaaaacatc

SEQ ID NO: 899616 - DNA, 18 bp, Homo sapiens
gttgtactttggaattct

SEQ ID NO: 899617 - DNA, 19 bp, Homo sapiens
gttgtagcaggtttcacta

SEQ ID NO: 899618 - DNA, 22 bp, Homo sapiens
gttgtagcattttcctgtttac

SEQ ID NO: 899619 - DNA, 23 bp, Homo sapiens
gttgtatgcctttaaatctgtga

SEQ ID NO: 899620 - DNA, 13 bp, Homo sapiens
gttgtattaacaa

SEQ ID NO: 899621 - DNA, 21 bp, Homo sapiens
gttgtattcttctgtatttct

SEQ ID NO: 899622 - DNA, 23 bp, Homo sapiens
gttgtattttaactcataccttt

SEQ ID NO: 899623 - DNA, 16 bp, Homo sapiens
gttgtcaaagagaggg

SEQ ID NO: 899624 - DNA, 16 bp, Homo sapiens
gttgtcaaggaagaag

SEQ ID NO: 899625 - DNA, 16 bp, Homo sapiens
gttgtcaatattaaat

SEQ ID NO: 899626 - DNA, 12 bp, Homo sapiens
gttgtcagaatg

SEQ ID NO: 899627 - DNA, 22 bp, Homo sapiens
gttgtcataacatttaaagaga

SEQ ID NO: 899628 - DNA, 20 bp, Homo sapiens
gttgtcattgtaaacaaact

SEQ ID NO: 899629 - DNA, 13 bp, Homo sapiens
gttgtccaggctg

SEQ ID NO: 899630 - DNA, 18 bp, Homo sapiens
gttgtcccatctgccctc

SEQ ID NO: 899631 - DNA, 13 bp, Homo sapiens
gttgtccctctgc

SEQ ID NO: 899632 - DNA, 17 bp, Homo sapiens
gttgtccctctgctacg

SEQ ID NO: 899633 - DNA, 19 bp, Homo sapiens
gttgtcctatggacaactt

SEQ ID NO: 899634 - DNA, 15 bp, Homo sapiens
gttgtccttgcccca

SEQ ID NO: 899635 - DNA, 21 bp, Homo sapiens
gttgtctccacttgtatatat

SEQ ID NO: 899636 - DNA, 11 bp, Homo sapiens
gttgtctctga

SEQ ID NO: 899637 - DNA, 14 bp, Homo sapiens
gttgtctctgatgc

SEQ ID NO: 899638 - DNA, 19 bp, Homo sapiens
gttgtctgaagtcactgca

SEQ ID NO: 899639 - DNA, 21 bp, Homo sapiens
gttgtctgtccaggcccttag

SEQ ID NO: 899640 - DNA, 18 bp, Homo sapiens
gttgtgaaatgtaacatg

SEQ ID NO: 899641 - DNA, 18 bp, Homo sapiens
gttgtgagccctctaggg

SEQ ID NO: 899642 - DNA, 18 bp, Homo sapiens
gttgtgattgacagaacc

SEQ ID NO: 899643 - DNA, 17 bp, Homo sapiens
gttgtgcaaattaacag

SEQ ID NO: 899644 - DNA, 16 bp, Homo sapiens
gttgtgcatgtatgta

SEQ ID NO: 899645 - DNA, 12 bp, Homo sapiens
gttgtgccaaat

SEQ ID NO: 899646 - DNA, 19 bp, Homo sapiens
gttgtggaaagcctctgct

SEQ ID NO: 899647 - DNA, 14 bp, Homo sapiens
gttgtggatatcag

SEQ ID NO: 899648 - DNA, 17 bp, Homo sapiens
gttgtggatgctccagg

SEQ ID NO: 899649 - DNA, 12 bp, Homo sapiens
gttgtggggagg

SEQ ID NO: 899650 - DNA, 20 bp, Homo sapiens
gttgtggggaggctgcactg

SEQ ID NO: 899651 - DNA, 15 bp, Homo sapiens
gttgtgggtgggaga

SEQ ID NO: 899652 - DNA, 16 bp, Homo sapiens
gttgtgggtgggagag

SEQ ID NO: 899653 - DNA, 14 bp, Homo sapiens
gttgtggttaatct

SEQ ID NO: 899654 - DNA, 12 bp, Homo sapiens
gttgtgtattgt

SEQ ID NO: 899655 - DNA, 22 bp, Homo sapiens
gttgtgtctgtgccctccaaag

SEQ ID NO: 899656 - DNA, 12 bp, Homo sapiens
gttgtgttcctg

SEQ ID NO: 899657 - DNA, 16 bp, Homo sapiens
gttgtgttcctggctg

SEQ ID NO: 899658 - DNA, 16 bp, Homo sapiens
gttgtgttctgttgaa

SEQ ID NO: 899659 - DNA, 23 bp, Homo sapiens
gttgtgttgttttttgttcaatg

SEQ ID NO: 899660 - DNA, 21 bp, Homo sapiens
gttgttaaacacgtgtctata

SEQ ID NO: 899661 - DNA, 18 bp, Homo sapiens
gttgttaatgaaaatgtc

SEQ ID NO: 899662 - DNA, 19 bp, Homo sapiens
gttgttaatgaaaatgtca

SEQ ID NO: 899663 - DNA, 13 bp, Homo sapiens
gttgttaatttag

SEQ ID NO: 899664 - DNA, 16 bp, Homo sapiens
tgttcaatgtttaatg

SEQ ID NO: 899665 - DNA, 15 bp, Homo sapiens
tgttcacaaactgtg

SEQ ID NO: 899666 - DNA, 16 bp, Homo sapiens
tgttcacaaactgtga

SEQ ID NO: 899667 - DNA, 17 bp, Homo sapiens
tgttcacactgcagaga

SEQ ID NO: 899668 - DNA, 20 bp, Homo sapiens
tgttcaccttcaaaatgttc

SEQ ID NO: 899669 - DNA, 23 bp, Homo sapiens
tgttcacggtgacacaggtcagg

SEQ ID NO: 899670 - DNA, 20 bp, Homo sapiens
tgttcactgctccttgctgc

SEQ ID NO: 899671 - DNA, 22 bp, Homo sapiens
tgttcagaaagcaataactttg

SEQ ID NO: 899672 - DNA, 22 bp, Homo sapiens
tgttcagaagaaattctgtcat

SEQ ID NO: 899673 - DNA, 19 bp, Homo sapiens
tgttcagaattaagcagaa

SEQ ID NO: 899674 - DNA, 15 bp, Homo sapiens
tgttcagatgtgcat

SEQ ID NO: 899675 - DNA, 14 bp, Homo sapiens
tgttcagcagaacc

SEQ ID NO: 899676 - DNA, 18 bp, Homo sapiens
tgttcagcagaacctgca

SEQ ID NO: 899677 - DNA, 22 bp, Homo sapiens
tgttcagcagaacctgcacaca

SEQ ID NO: 899678 - DNA, 21 bp, Homo sapiens
tgttcagctctttccaaatta

SEQ ID NO: 899679 - DNA, 17 bp, Homo sapiens
tgttcagcttataatga

SEQ ID NO: 899680 - DNA, 23 bp, Homo sapiens
tgttcaggaaaaggttgaataat

SEQ ID NO: 899681 - DNA, 18 bp, Homo sapiens
tgttcagtgagatatcat

SEQ ID NO: 899682 - DNA, 17 bp, Homo sapiens
tgttcagtgtcccgggc

SEQ ID NO: 899683 - DNA, 12 bp, Homo sapiens
tgttcatacatt

SEQ ID NO: 899684 - DNA, 14 bp, Homo sapiens
tgttcatagcccag

SEQ ID NO: 899685 - DNA, 20 bp, Homo sapiens
tgttcatagcccagtagacc

SEQ ID NO: 899686 - DNA, 23 bp, Homo sapiens
tgttcatagcccagtagaccttg

SEQ ID NO: 899687 - DNA, 11 bp, Homo sapiens
tgttcatattg

SEQ ID NO: 899688 - DNA, 16 bp, Homo sapiens
tgttcatcatccagat

SEQ ID NO: 899689 - DNA, 19 bp, Homo sapiens
tgttcatcatcctaagcta

SEQ ID NO: 899690 - DNA, 11 bp, Homo sapiens
tgttcatccca

SEQ ID NO: 899691 - DNA, 22 bp, Homo sapiens
tgttcatcctcattgcctcctg

SEQ ID NO: 899692 - DNA, 23 bp, Homo sapiens
tgttcatcctcattgcctcctgt

SEQ ID NO: 899693 - DNA, 21 bp, Homo sapiens
tgttcatctgtaactctaaaa

SEQ ID NO: 899694 - DNA, 16 bp, Homo sapiens
tgttcatggagagctg

SEQ ID NO: 899695 - DNA, 20 bp, Homo sapiens
tgttcattcaagctatttaa

SEQ ID NO: 899696 - DNA, 12 bp, Homo sapiens
tgttcattgtaa

SEQ ID NO: 899697 - DNA, 16 bp, Homo sapiens
tgttcattgtaatgtt

SEQ ID NO: 899698 - DNA, 19 bp, Homo sapiens
tgttcattgtaatgttact

SEQ ID NO: 899699 - DNA, 11 bp, Homo sapiens
tgttcatttag

SEQ ID NO: 899700 - DNA, 19 bp, Homo sapiens
tgttcatttagataatttg

SEQ ID NO: 899701 - DNA, 13 bp, Homo sapiens
tgttcatttcatt

SEQ ID NO: 899702 - DNA, 22 bp, Homo sapiens
tgttcatttggtgttcctggaa

SEQ ID NO: 899703 - DNA, 18 bp, Homo sapiens
tgttcattttattttcat

SEQ ID NO: 899704 - DNA, 18 bp, Homo sapiens
tgttcattttgagctgaa

SEQ ID NO: 899705 - DNA, 10 bp, Homo sapiens
tgttccaaat

SEQ ID NO: 899706 - DNA, 17 bp, Homo sapiens
tgttccaaatgaatgtt

SEQ ID NO: 899707 - DNA, 18 bp, Homo sapiens
tgttccaaattcagtttc

SEQ ID NO: 899708 - DNA, 19 bp, Homo sapiens
tgttccaaattcagtttca

SEQ ID NO: 899709 - DNA, 15 bp, Homo sapiens
tgttccaagacattg

SEQ ID NO: 899710 - DNA, 20 bp, Homo sapiens
tgttccaagacattgtcaat

SEQ ID NO: 899711 - DNA, 16 bp, Homo sapiens
gtttaatattccaata

SEQ ID NO: 899712 - DNA, 15 bp, Homo sapiens
gtttaatatttaaac

SEQ ID NO: 899713 - DNA, 19 bp, Homo sapiens
gtttaatgttcattttctc

SEQ ID NO: 899714 - DNA, 13 bp, Homo sapiens
gtttaatgttttg

SEQ ID NO: 899715 - DNA, 15 bp, Homo sapiens
gtttaattctgtctt

SEQ ID NO: 899716 - DNA, 19 bp, Homo sapiens
gtttacaagcccccccttc

SEQ ID NO: 899717 - DNA, 18 bp, Homo sapiens
gtttacaagtgtatatca

SEQ ID NO: 899718 - DNA, 19 bp, Homo sapiens
gtttacaagtgtatatcag

SEQ ID NO: 899719 - DNA, 18 bp, Homo sapiens
gtttacaatgatgccgaa

SEQ ID NO: 899720 - DNA, 18 bp, Homo sapiens
gtttacaatttacaaagt

SEQ ID NO: 899721 - DNA, 13 bp, Homo sapiens
gtttacagaaaaa

SEQ ID NO: 899722 - DNA, 14 bp, Homo sapiens
gtttacaggccctg

SEQ ID NO: 899723 - DNA, 17 bp, Homo sapiens
gtttacaggtttgaatt

SEQ ID NO: 899724 - DNA, 17 bp, Homo sapiens
gtttacagtgaagaaag

SEQ ID NO: 899725 - DNA, 17 bp, Homo sapiens
gtttacagtttgtgttt

SEQ ID NO: 899726 - DNA, 20 bp, Homo sapiens
gtttacagtttgtgttttaa

SEQ ID NO: 899727 - DNA, 13 bp, Homo sapiens
gtttacatgcaga

SEQ ID NO: 899728 - DNA, 11 bp, Homo sapiens
gtttacatgta

SEQ ID NO: 899729 - DNA, 20 bp, Homo sapiens
gtttacattgtcctgtagct

SEQ ID NO: 899730 - DNA, 21 bp, Homo sapiens
gtttacatttgatgcatgtct

SEQ ID NO: 899731 - DNA, 15 bp, Homo sapiens
gtttaccagttgcct

SEQ ID NO: 899732 - DNA, 17 bp, Homo sapiens
gtttaccatttgtaata

SEQ ID NO: 899733 - DNA, 18 bp, Homo sapiens
gtttaccatttgtaataa

SEQ ID NO: 899734 - DNA, 21 bp, Homo sapiens
gtttaccatttgtaataaagt

SEQ ID NO: 899735 - DNA, 22 bp, Homo sapiens
gtttacctcatccatgcacttt

SEQ ID NO: 899736 - DNA, 21 bp, Homo sapiens
gtttacctggcttatttaata

SEQ ID NO: 899737 - DNA, 15 bp, Homo sapiens
gtttacctggggatc

SEQ ID NO: 899738 - DNA, 21 bp, Homo sapiens
gtttactatgtgccagttcct

SEQ ID NO: 899739 - DNA, 23 bp, Homo sapiens
gtttactatgtgccagttcctgt

SEQ ID NO: 899740 - DNA, 20 bp, Homo sapiens
gtttactcccttctgtagtt

SEQ ID NO: 899741 - DNA, 14 bp, Homo sapiens
gtttactgaaattt

SEQ ID NO: 899742 - DNA, 11 bp, Homo sapiens
gtttacttgtc

SEQ ID NO: 899743 - DNA, 18 bp, Homo sapiens
gtttactttttggctgga

SEQ ID NO: 899744 - DNA, 19 bp, Homo sapiens
gtttactttttggctggag

SEQ ID NO: 899745 - DNA, 15 bp, Homo sapiens
gtttagataatacac

SEQ ID NO: 899746 - DNA, 23 bp, Homo sapiens
gtttagcagcagcctttaatgca

SEQ ID NO: 899747 - DNA, 15 bp, Homo sapiens
gtttagcagtggctg

SEQ ID NO: 899748 - DNA, 23 bp, Homo sapiens
gtttagcttcctccagaggaggg

SEQ ID NO: 899749 - DNA, 23 bp, Homo sapiens
gtttaggcctcatttctttgtct

SEQ ID NO: 899750 - DNA, 23 bp, Homo sapiens
gtttaggctatttgtaaatctgc

SEQ ID NO: 899751 - DNA, 18 bp, Homo sapiens
gtttaggctggtggccca

SEQ ID NO: 899752 - DNA, 15 bp, Homo sapiens
gtttagttctgttga

SEQ ID NO: 899753 - DNA, 20 bp, Homo sapiens
gtttagtttctagaggcctc

SEQ ID NO: 899754 - DNA, 19 bp, Homo sapiens
gtttagttttacattttaa

SEQ ID NO: 899755 - DNA, 13 bp, Homo sapiens
gtttataaactga

SEQ ID NO: 899756 - DNA, 12 bp, Homo sapiens
gtttataaagca

SEQ ID NO: 899757 - DNA, 15 bp, Homo sapiens
gtttataataaaaat

SEQ ID NO: 899758 - DNA, 16 bp, Homo sapiens
gtttataatctgaaga

SEQ ID NO: 899759 - DNA, 18 bp, Homo sapiens
gtttatacacaactttgc

SEQ ID NO: 899760 - DNA, 19 bp, Homo sapiens
gtttatacactgtgtaaat

SEQ ID NO: 899761 - DNA, 21 bp, Homo sapiens
gtttatacagaactcacagta

SEQ ID NO: 899762 - DNA, 19 bp, Homo sapiens
gtttatacgtggaaacaca

SEQ ID NO: 899763 - DNA, 21 bp, Homo sapiens
gtttatagagggccaagactt

SEQ ID NO: 899764 - DNA, 17 bp, Homo sapiens
gtttatatattgaaagt

SEQ ID NO: 899765 - DNA, 21 bp, Homo sapiens
gtttatatattgaaagttgct

SEQ ID NO: 899766 - DNA, 23 bp, Homo sapiens
gtttatatattgaaagttgcttt

SEQ ID NO: 899767 - DNA, 15 bp, Homo sapiens
gtttatcagatacat

SEQ ID NO: 899768 - DNA, 15 bp, Homo sapiens
gtttatcattcaagt

SEQ ID NO: 899769 - DNA, 17 bp, Homo sapiens
gtttatcattcaagtgt

SEQ ID NO: 899770 - DNA, 21 bp, Homo sapiens
gtttatcctcttggtgtctgg

SEQ ID NO: 899771 - DNA, 23 bp, Homo sapiens
gtttatcctgacatattcaagtg

SEQ ID NO: 899772 - DNA, 21 bp, Homo sapiens
gtttatgaattataaatgtgt

SEQ ID NO: 899773 - DNA, 16 bp, Homo sapiens
gtttatgagaaactgg

SEQ ID NO: 899774 - DNA, 15 bp, Homo sapiens
gtttatgatatttct

SEQ ID NO: 899775 - DNA, 13 bp, Homo sapiens
gtttatggcctca

SEQ ID NO: 899776 - DNA, 15 bp, Homo sapiens
gtttatggcctcagc

SEQ ID NO: 899777 - DNA, 18 bp, Homo sapiens
gtttatgtgttatgaaca

SEQ ID NO: 899778 - DNA, 13 bp, Homo sapiens
gtttattaacaaa

SEQ ID NO: 899779 - DNA, 19 bp, Homo sapiens
gtttattacaatgtatctt

SEQ ID NO: 899780 - DNA, 14 bp, Homo sapiens
gtttattacaattt

SEQ ID NO: 899781 - DNA, 21 bp, Homo sapiens
gtttattacttccatgaattt

SEQ ID NO: 899782 - DNA, 18 bp, Homo sapiens
gtttattcccaagtatgc

SEQ ID NO: 899783 - DNA, 19 bp, Homo sapiens
gtttattccttctgtagtg

SEQ ID NO: 899784 - DNA, 13 bp, Homo sapiens
gtttattctgtgg

SEQ ID NO: 899785 - DNA, 14 bp, Homo sapiens
tctctagtgctgtg

SEQ ID NO: 899786 - DNA, 16 bp, Homo sapiens
tctctagtgctgtgaa

SEQ ID NO: 899787 - DNA, 18 bp, Homo sapiens
tctctagtttgattaaat

SEQ ID NO: 899788 - DNA, 18 bp, Homo sapiens
tctctatcctctcttcct

SEQ ID NO: 899789 - DNA, 20 bp, Homo sapiens
tctctatgcaaaatgtctgt

SEQ ID NO: 899790 - DNA, 12 bp, Homo sapiens
tctctatgtact

SEQ ID NO: 899791 - DNA, 14 bp, Homo sapiens
tctctattagctgg

SEQ ID NO: 899792 - DNA, 15 bp, Homo sapiens
tctctattagctggg

SEQ ID NO: 899793 - DNA, 18 bp, Homo sapiens
tctctattctctgcaatt

SEQ ID NO: 899794 - DNA, 15 bp, Homo sapiens
tctctatttaatatt

SEQ ID NO: 899795 - DNA, 18 bp, Homo sapiens
tctctatttgaattattt

SEQ ID NO: 899796 - DNA, 13 bp, Homo sapiens
tctctcaagtgat

SEQ ID NO: 899797 - DNA, 13 bp, Homo sapiens
tctctcactgcat

SEQ ID NO: 899798 - DNA, 22 bp, Homo sapiens
tctctcactgtgttactgcttt

SEQ ID NO: 899799 - DNA, 14 bp, Homo sapiens
tctctcaggagcac

SEQ ID NO: 899800 - DNA, 18 bp, Homo sapiens
tctctcaggagcacaggc

SEQ ID NO: 899801 - DNA, 18 bp, Homo sapiens
tctctcatcttgttcttc

SEQ ID NO: 899802 - DNA, 16 bp, Homo sapiens
tctctcatgagaagcc

SEQ ID NO: 899803 - DNA, 19 bp, Homo sapiens
tctctcatgagaagccaag

SEQ ID NO: 899804 - DNA, 18 bp, Homo sapiens
tctctccacagtgttgtg

SEQ ID NO: 899805 - DNA, 22 bp, Homo sapiens
tctctccagaaacagctgcttc

SEQ ID NO: 899806 - DNA, 13 bp, Homo sapiens
tctctccagatgt

SEQ ID NO: 899807 - DNA, 11 bp, Homo sapiens
tctctccagga

SEQ ID NO: 899808 - DNA, 18 bp, Homo sapiens
agccgggcccctgggctt

SEQ ID NO: 899809 - DNA, 22 bp, Homo sapiens
agccgggcgtggtggcaggcac

SEQ ID NO: 899810 - DNA, 13 bp, Homo sapiens
agccggggcctta

SEQ ID NO: 899811 - DNA, 23 bp, Homo sapiens
agccgggggaggggccctcaggc

SEQ ID NO: 899812 - DNA, 22 bp, Homo sapiens
agccggtgcctggcgcccctgc

SEQ ID NO: 899813 - DNA, 16 bp, Homo sapiens
agccggtgtccctgga

SEQ ID NO: 899814 - DNA, 15 bp, Homo sapiens
agccgtattttacat

SEQ ID NO: 899815 - DNA, 14 bp, Homo sapiens
agccgtccatggca

SEQ ID NO: 899816 - DNA, 16 bp, Homo sapiens
agccgtccatggcacc

SEQ ID NO: 899817 - DNA, 17 bp, Homo sapiens
agccgtccatggcacca

SEQ ID NO: 899818 - DNA, 19 bp, Homo sapiens
agccgtccatggcaccagc

SEQ ID NO: 899819 - DNA, 23 bp, Homo sapiens
agccgtcctggcgcctggcagtc

SEQ ID NO: 899820 - DNA, 23 bp, Homo sapiens
agccgtctgactccagagtctga

SEQ ID NO: 899821 - DNA, 24 bp, Homo sapiens
agccgtctgactccagagtctgag

SEQ ID NO: 899822 - DNA, 17 bp, Homo sapiens
agccgtgccttcagctc

SEQ ID NO: 899823 - DNA, 15 bp, Homo sapiens
agccgttgaatctgg

SEQ ID NO: 899824 - DNA, 19 bp, Homo sapiens
agccgttgaatctgggagg

SEQ ID NO: 899825 - DNA, 20 bp, Homo sapiens
agccgttgaatctgggaggg

SEQ ID NO: 899826 - DNA, 21 bp, Homo sapiens
agcctaaaacgaatggtcttt

SEQ ID NO: 899827 - DNA, 13 bp, Homo sapiens
agcctaaaattac

SEQ ID NO: 899828 - DNA, 17 bp, Homo sapiens
agcctaaagggcagggc

SEQ ID NO: 899829 - DNA, 22 bp, Homo sapiens
agcctaaagggcagggcccacg

SEQ ID NO: 899830 - DNA, 18 bp, Homo sapiens
agcctaaggctcctgttt

SEQ ID NO: 899831 - DNA, 15 bp, Homo sapiens
agcctaatacaacat

SEQ ID NO: 899832 - DNA, 15 bp, Homo sapiens
agcctaatccctggg

SEQ ID NO: 899833 - DNA, 19 bp, Homo sapiens
agcctaatgagagtgcact

SEQ ID NO: 899834 - DNA, 18 bp, Homo sapiens
agcctacagaagggcagt

SEQ ID NO: 899835 - DNA, 20 bp, Homo sapiens
agcctacccgactctattta

SEQ ID NO: 899836 - DNA, 22 bp, Homo sapiens
agcctacccttcctgcatttct

SEQ ID NO: 899837 - DNA, 16 bp, Homo sapiens
agcctaccgtatttca

SEQ ID NO: 899838 - DNA, 20 bp, Homo sapiens
agcctaccgtatttcagcca

SEQ ID NO: 899839 - DNA, 19 bp, Homo sapiens
agcctaccttcaccaccta

SEQ ID NO: 899840 - DNA, 23 bp, Homo sapiens
agcctactgtactatttaaaatg

SEQ ID NO: 899841 - DNA, 18 bp, Homo sapiens
agcctagaacatccctgg

SEQ ID NO: 899842 - DNA, 15 bp, Homo sapiens
cagctctctgccctg

SEQ ID NO: 899843 - DNA, 13 bp, Homo sapiens
cagctctctgctg

SEQ ID NO: 899844 - DNA, 16 bp, Homo sapiens
cagctctctgctgggt

SEQ ID NO: 899845 - DNA, 14 bp, Homo sapiens
cagctctgacattc

SEQ ID NO: 899846 - DNA, 19 bp, Homo sapiens
cagctctgagatcctggag

SEQ ID NO: 899847 - DNA, 19 bp, Homo sapiens
cagctctgccgtctctgga

SEQ ID NO: 899848 - DNA, 22 bp, Homo sapiens
cagctctgccgtctctggagcg

SEQ ID NO: 899849 - DNA, 18 bp, Homo sapiens
cagctctgctatgagtgt

SEQ ID NO: 899850 - DNA, 18 bp, Homo sapiens
cagctctggaggggaggg

SEQ ID NO: 899851 - DNA, 14 bp, Homo sapiens
cagctctggcttcc

SEQ ID NO: 899852 - DNA, 22 bp, Homo sapiens
cagctctgggccattctccaca

SEQ ID NO: 899853 - DNA, 23 bp, Homo sapiens
cagctctgggccattctccacag

SEQ ID NO: 899854 - DNA, 14 bp, Homo sapiens
cagctctgggcctc

SEQ ID NO: 899855 - DNA, 15 bp, Homo sapiens
cagctctgggcctct

SEQ ID NO: 899856 - DNA, 17 bp, Homo sapiens
cagctctgggcctcttt

SEQ ID NO: 899857 - DNA, 18 bp, Homo sapiens
cagctctgggcctctttt

SEQ ID NO: 899858 - DNA, 20 bp, Homo sapiens
cagctctggtccaggccctg

SEQ ID NO: 899859 - DNA, 14 bp, Homo sapiens
cagctctgtggcct

SEQ ID NO: 899860 - DNA, 24 bp, Homo sapiens
cagctctgtggcctgtgtccagca

SEQ ID NO: 899861 - DNA, 13 bp, Homo sapiens
cagctcttccagg

SEQ ID NO: 899862 - DNA, 18 bp, Homo sapiens
cagctcttctccccaggt

SEQ ID NO: 899863 - DNA, 15 bp, Homo sapiens
cagctcttgcccttc

SEQ ID NO: 899864 - DNA, 23 bp, Homo sapiens
cagctcttgcccttccctgtccc

SEQ ID NO: 899865 - DNA, 19 bp, Homo sapiens
cagctcttgctctcttgtg

SEQ ID NO: 899866 - DNA, 17 bp, Homo sapiens
cagctcttggctccact

SEQ ID NO: 899867 - DNA, 16 bp, Homo sapiens
cagctctttccaaatt

SEQ ID NO: 899868 - DNA, 18 bp, Homo sapiens
cagctctttccaaattaa

SEQ ID NO: 899869 - DNA, 19 bp, Homo sapiens
cagctctttccaaattaaa

SEQ ID NO: 899870 - DNA, 17 bp, Homo sapiens
cagctgaaagaggagga

SEQ ID NO: 899871 - DNA, 21 bp, Homo sapiens
cagctgaagaaaaaatcagaa

SEQ ID NO: 899872 - DNA, 17 bp, Homo sapiens
cagctgaatgcctcctg

SEQ ID NO: 899873 - DNA, 16 bp, Homo sapiens
cagctgaattatctat

SEQ ID NO: 899874 - DNA, 14 bp, Homo sapiens
cagctgaccgggct

SEQ ID NO: 899875 - DNA, 19 bp, Homo sapiens
cagctgactccagtataat

SEQ ID NO: 899876 - DNA, 20 bp, Homo sapiens
cagctgactgtggccccctc

SEQ ID NO: 899877 - DNA, 20 bp, Homo sapiens
cagctgactgttggctctct

SEQ ID NO: 899878 - DNA, 23 bp, Homo sapiens
cagctgacttggttctgaagcca

SEQ ID NO: 899879 - DNA, 21 bp, Homo sapiens
cagctgagagacttttaatca

SEQ ID NO: 899880 - DNA, 15 bp, Homo sapiens
cagctgagagccctg

SEQ ID NO: 899881 - DNA, 20 bp, Homo sapiens
cagctgagagccctgctgtg

SEQ ID NO: 899882 - DNA, 21 bp, Homo sapiens
cagctgagagccctgctgtgg

SEQ ID NO: 899883 - DNA, 19 bp, Homo sapiens
cagctgaggacacacccca

SEQ ID NO: 899884 - DNA, 20 bp, Homo sapiens
cagctgaggacacaccccac

SEQ ID NO: 899885 - DNA, 22 bp, Homo sapiens
cagctgaggacacaccccacac

SEQ ID NO: 899886 - DNA, 12 bp, Homo sapiens
cagctgaggctg

SEQ ID NO: 899887 - DNA, 19 bp, Homo sapiens
cagctgagggtgagtgggt

SEQ ID NO: 899888 - DNA, 19 bp, Homo sapiens
cagctgaggtctcttgagg

SEQ ID NO: 899889 - DNA, 14 bp, Homo sapiens
cagctgagttatga

SEQ ID NO: 899890 - DNA, 16 bp, Homo sapiens
cagctgatacttcatt

SEQ ID NO: 899891 - DNA, 21 bp, Homo sapiens
cagctgatattatggcaagtg

SEQ ID NO: 899892 - DNA, 14 bp, Homo sapiens
cagctgatgagtta

SEQ ID NO: 899893 - DNA, 20 bp, Homo sapiens
cagctgatgagttacagcct

SEQ ID NO: 899894 - DNA, 12 bp, Homo sapiens
cagctgatttta

SEQ ID NO: 899895 - DNA, 22 bp, Homo sapiens
cagctgcaaggtactctggtga

SEQ ID NO: 899896 - DNA, 14 bp, Homo sapiens
cagctgcaccagag

SEQ ID NO: 899897 - DNA, 16 bp, Homo sapiens
cagctgcaccagcagg

SEQ ID NO: 899898 - DNA, 18 bp, Homo sapiens
cagctgcacctgccagcc

SEQ ID NO: 899899 - DNA, 21 bp, Homo sapiens
cagctgcacctgccagcctgg

SEQ ID NO: 899900 - DNA, 20 bp, Homo sapiens
cagctgcagaccatgccaga

SEQ ID NO: 899901 - DNA, 17 bp, Homo sapiens
cagctgcagctgatcca

SEQ ID NO: 899902 - DNA, 13 bp, Homo sapiens
cagctgcagctgg

SEQ ID NO: 899903 - DNA, 14 bp, Homo sapiens
cagctgcagctggg

SEQ ID NO: 899904 - DNA, 17 bp, Homo sapiens
cagctgcagctgggccc

SEQ ID NO: 899905 - DNA, 23 bp, Homo sapiens
cagctgcagctgggccccatgct

SEQ ID NO: 899906 - DNA, 13 bp, Homo sapiens
cagctgcagggca

SEQ ID NO: 899907 - DNA, 14 bp, Homo sapiens
cagctgcagggcac

SEQ ID NO: 899908 - DNA, 23 bp, Homo sapiens
cagctgcagggcacggggacctg

SEQ ID NO: 899909 - DNA, 16 bp, Homo sapiens
cagctgcattccgcag

SEQ ID NO: 899910 - DNA, 13 bp, Homo sapiens
cagctgccaagca

SEQ ID NO: 899911 - DNA, 22 bp, Homo sapiens
cagctgccaagcactcgagacc

SEQ ID NO: 899912 - DNA, 15 bp, Homo sapiens
cagctgccagagaag

SEQ ID NO: 899913 - DNA, 16 bp, Homo sapiens
cagctgccagagaagc

SEQ ID NO: 899914 - DNA, 15 bp, Homo sapiens
cagctgccaggcggc

SEQ ID NO: 899915 - DNA, 16 bp, Homo sapiens
cagctgccaggcggcc

SEQ ID NO: 899916 - DNA, 21 bp, Homo sapiens
cagctgccaggcggccctggg

SEQ ID NO: 899917 - DNA, 15 bp, Homo sapiens
cagctgccccagcca

SEQ ID NO: 899918 - DNA, 19 bp, Homo sapiens
cagctgccccggcccctcc

SEQ ID NO: 899919 - DNA, 22 bp, Homo sapiens
cagctgccccggcccctccccc

SEQ ID NO: 899920 - DNA, 12 bp, Homo sapiens
cagctgcccctc

SEQ ID NO: 899921 - DNA, 18 bp, Homo sapiens
cagctgccctatgggcct

SEQ ID NO: 899922 - DNA, 16 bp, Homo sapiens
cagctgccctgctgcc

SEQ ID NO: 899923 - DNA, 22 bp, Homo sapiens
cagctgccctgctgccacagca

SEQ ID NO: 899924 - DNA, 22 bp, Homo sapiens
cagctgccgggcctgatttggt

SEQ ID NO: 899925 - DNA, 14 bp, Homo sapiens
cagctgcctctgct

SEQ ID NO: 899926 - DNA, 15 bp, Homo sapiens
cagctgcctctgctc

SEQ ID NO: 899927 - DNA, 16 bp, Homo sapiens
cagctgcctctgctcc

SEQ ID NO: 899928 - DNA, 20 bp, Homo sapiens
cagctgcctctgctccctct

SEQ ID NO: 899929 - DNA, 15 bp, Homo sapiens
agcctccccttcttc

SEQ ID NO: 899930 - DNA, 16 bp, Homo sapiens
agcctccccttcttcc

SEQ ID NO: 899931 - DNA, 18 bp, Homo sapiens
agcctccccttcttcccg

SEQ ID NO: 899932 - DNA, 21 bp, Homo sapiens
agcctcccgagtagctgggat

SEQ ID NO: 899933 - DNA, 14 bp, Homo sapiens
agcctccctcagcc

SEQ ID NO: 899934 - DNA, 16 bp, Homo sapiens
agcctccctcagcccc

SEQ ID NO: 899935 - DNA, 22 bp, Homo sapiens
agcctccctcagcccccaggat

SEQ ID NO: 899936 - DNA, 21 bp, Homo sapiens
agcctccctctgacctgcagg

SEQ ID NO: 899937 - DNA, 17 bp, Homo sapiens
agcctccctgaagacca

SEQ ID NO: 899938 - DNA, 15 bp, Homo sapiens
agcctccctgagcct

SEQ ID NO: 899939 - DNA, 11 bp, Homo sapiens
agcctccctgc

SEQ ID NO: 899940 - DNA, 12 bp, Homo sapiens
agcctccctgca

SEQ ID NO: 899941 - DNA, 15 bp, Homo sapiens
agcctccctgcacgg

SEQ ID NO: 899942 - DNA, 17 bp, Homo sapiens
agcctccctgtctccag

SEQ ID NO: 899943 - DNA, 19 bp, Homo sapiens
agcctccctgtctccagct

SEQ ID NO: 899944 - DNA, 14 bp, Homo sapiens
agcctccgagaggg

SEQ ID NO: 899945 - DNA, 15 bp, Homo sapiens
agcctccggaagctg

SEQ ID NO: 899946 - DNA, 22 bp, Homo sapiens
agcctccgtcatccatgccctc

SEQ ID NO: 899947 - DNA, 18 bp, Homo sapiens
agcctccgtggaacattc

SEQ ID NO: 899948 - DNA, 18 bp, Homo sapiens
agcctccgtttatgggcc

SEQ ID NO: 899949 - DNA, 21 bp, Homo sapiens
agcctccgtttatgggccttg

SEQ ID NO: 899950 - DNA, 22 bp, Homo sapiens
agcctccgtttatgggccttgc

SEQ ID NO: 899951 - DNA, 23 bp, Homo sapiens
agcctccgtttatgggccttgct

SEQ ID NO: 899952 - DNA, 20 bp, Homo sapiens
agcctcctcatcccgtgttc

SEQ ID NO: 899953 - DNA, 13 bp, Homo sapiens
agcctcctctgga

SEQ ID NO: 899954 - DNA, 19 bp, Homo sapiens
agcctcctctggacggcag

SEQ ID NO: 899955 - DNA, 23 bp, Homo sapiens
agcctcctgaagttgctgctgtg

SEQ ID NO: 899956 - DNA, 11 bp, Homo sapiens
agcctcctgag

SEQ ID NO: 899957 - DNA, 18 bp, Homo sapiens
agcctcctgagcctgtgg

SEQ ID NO: 899958 - DNA, 11 bp, Homo sapiens
agcctcctggg

SEQ ID NO: 899959 - DNA, 18 bp, Homo sapiens
agcctcctgtacctcagt

SEQ ID NO: 899960 - DNA, 21 bp, Homo sapiens
agcctcctgtgcctggcccca

SEQ ID NO: 899961 - DNA, 10 bp, Homo sapiens
agcctccttg

SEQ ID NO: 899962 - DNA, 12 bp, Homo sapiens
agcctccttgct

SEQ ID NO: 899963 - DNA, 21 bp, Homo sapiens
agcctcgacacccccccaacc

SEQ ID NO: 899964 - DNA, 17 bp, Homo sapiens
agcctcgcacaggccct

SEQ ID NO: 899965 - DNA, 16 bp, Homo sapiens
agcctcggcctaggtc

SEQ ID NO: 899966 - DNA, 21 bp, Homo sapiens
agcctcgtggagctcgcccct

SEQ ID NO: 899967 - DNA, 22 bp, Homo sapiens
agcctcgtggagctcgcccctc

SEQ ID NO: 899968 - DNA, 16 bp, Homo sapiens
aatccaaaagacaaaa

SEQ ID NO: 899969 - DNA, 22 bp, Homo sapiens
aatccaaaagacaaaaatcaaa

SEQ ID NO: 899970 - DNA, 13 bp, Homo sapiens
aatccaaaatgaa

SEQ ID NO: 899971 - DNA, 18 bp, Homo sapiens
aatccaaccattttcatt

SEQ ID NO: 899972 - DNA, 23 bp, Homo sapiens
aatccaagcgaggtcaacagaga

SEQ ID NO: 899973 - DNA, 17 bp, Homo sapiens
aatccaagctccctgcc

SEQ ID NO: 899974 - DNA, 20 bp, Homo sapiens
aatccaagctccctgcccca

SEQ ID NO: 899975 - DNA, 19 bp, Homo sapiens
aatccaatactgcccaagg

SEQ ID NO: 899976 - DNA, 15 bp, Homo sapiens
aatccaatattgtaa

SEQ ID NO: 899977 - DNA, 19 bp, Homo sapiens
atataagcataaaagatca

SEQ ID NO: 899978 - DNA, 18 bp, Homo sapiens
atataagtgtacatatgt

SEQ ID NO: 899979 - DNA, 21 bp, Homo sapiens
atataataaatgtacattaat

SEQ ID NO: 899980 - DNA, 20 bp, Homo sapiens
atataataactttattgcat

SEQ ID NO: 899981 - DNA, 17 bp, Homo sapiens
atataatatatttgtgt

SEQ ID NO: 899982 - DNA, 17 bp, Homo sapiens
atataatatctaaagtt

SEQ ID NO: 899983 - DNA, 20 bp, Homo sapiens
atataatatctaaagttata

SEQ ID NO: 899984 - DNA, 20 bp, Homo sapiens
atataatattcagccagctt

SEQ ID NO: 899985 - DNA, 23 bp, Homo sapiens
atataatcatgctcatgtatatt

SEQ ID NO: 899986 - DNA, 23 bp, Homo sapiens
atataatcttggcttcttaaaaa

SEQ ID NO: 899987 - DNA, 11 bp, Homo sapiens
atataatgaac

SEQ ID NO: 899988 - DNA, 14 bp, Homo sapiens
atataatgaacacg

SEQ ID NO: 899989 - DNA, 22 bp, Homo sapiens
atataatgctttgcagtatctg

SEQ ID NO: 899990 - DNA, 19 bp, Homo sapiens
atataatggtgatgtcata

SEQ ID NO: 899991 - DNA, 16 bp, Homo sapiens
atataatgtgtgcttt

SEQ ID NO: 899992 - DNA, 14 bp, Homo sapiens
atataattctggag

SEQ ID NO: 899993 - DNA, 12 bp, Homo sapiens
atataattctgt

SEQ ID NO: 899994 - DNA, 17 bp, Homo sapiens
atataattctgtaaatg

SEQ ID NO: 899995 - DNA, 19 bp, Homo sapiens
atataatttgagtgtatat

SEQ ID NO: 899996 - DNA, 15 bp, Homo sapiens
atatacaaaacttta

SEQ ID NO: 899997 - DNA, 18 bp, Homo sapiens
atatacaataacataatt

SEQ ID NO: 899998 - DNA, 19 bp, Homo sapiens
atatacacaggatcctatt

SEQ ID NO: 899999 - DNA, 13 bp, Homo sapiens
atatacacataca

SEQ ID NO: 900000 - DNA, 23 bp, Homo sapiens
atatacagtaactttatgtgtaa

SEQ ID NO: 900001 - DNA, 15 bp, Homo sapiens
atatacatacttaca

SEQ ID NO: 900002 - DNA, 14 bp, Homo sapiens
atatacatatatat

SEQ ID NO: 900003 - DNA, 22 bp, Homo sapiens
atatacatatgagaatatacct

SEQ ID NO: 900004 - DNA, 18 bp, Homo sapiens
atatacattcaaacttaa

SEQ ID NO: 900005 - DNA, 18 bp, Homo sapiens
atatacattctttatctt

SEQ ID NO: 900006 - DNA, 16 bp, Homo sapiens
atatacattgcttaga

SEQ ID NO: 900007 - DNA, 13 bp, Homo sapiens
atatacattgtgt

SEQ ID NO: 900008 - DNA, 15 bp, Homo sapiens
atatacattgtgtga

SEQ ID NO: 900009 - DNA, 17 bp, Homo sapiens
atatacattttctaaat

SEQ ID NO: 900010 - DNA, 12 bp, Homo sapiens
atatacattttt

SEQ ID NO: 900011 - DNA, 16 bp, Homo sapiens
atataccccaaattgt

SEQ ID NO: 900012 - DNA, 17 bp, Homo sapiens
atataccccaaattgtg

SEQ ID NO: 900013 - DNA, 18 bp, Homo sapiens
atatacctggcttttact

SEQ ID NO: 900014 - DNA, 14 bp, Homo sapiens
atatacctggttta

SEQ ID NO: 900015 - DNA, 14 bp, Homo sapiens
atataccttattta

SEQ ID NO: 900016 - DNA, 16 bp, Homo sapiens
atataccttatttatt

SEQ ID NO: 900017 - DNA, 22 bp, Homo sapiens
atatactataattgtaaatatt

SEQ ID NO: 900018 - DNA, 13 bp, Homo sapiens
atatactgcagct

SEQ ID NO: 900019 - DNA, 15 bp, Homo sapiens
atatactgcagcttt

SEQ ID NO: 900020 - DNA, 22 bp, Homo sapiens
atatactgggttcttgttttat

SEQ ID NO: 900021 - DNA, 15 bp, Homo sapiens
atatacttaagaata

SEQ ID NO: 900022 - DNA, 19 bp, Homo sapiens
atatacttaagaatacaca

SEQ ID NO: 900023 - DNA, 12 bp, Homo sapiens
atatagaaaaca

SEQ ID NO: 900024 - DNA, 13 bp, Homo sapiens
atatagaaaacaa

SEQ ID NO: 900025 - DNA, 19 bp, Homo sapiens
atatagaaaacaaaggagc

SEQ ID NO: 900026 - DNA, 18 bp, Homo sapiens
atatagacattctcacat

SEQ ID NO: 900027 - DNA, 21 bp, Homo sapiens
atatagagacaggacagaatg

SEQ ID NO: 900028 - DNA, 14 bp, Homo sapiens
atatagagatgttt

SEQ ID NO: 900029 - DNA, 15 bp, Homo sapiens
atatagagatgtttt

SEQ ID NO: 900030 - DNA, 17 bp, Homo sapiens
atatagagattgtacat

SEQ ID NO: 900031 - DNA, 23 bp, Homo sapiens
atatagctaggtgacatatacat

SEQ ID NO: 900032 - DNA, 17 bp, Homo sapiens
atatagctgatcagttt

SEQ ID NO: 900033 - DNA, 17 bp, Homo sapiens
atatagctgtacaaata

SEQ ID NO: 900034 - DNA, 19 bp, Homo sapiens
atatagctgtacaaatata

SEQ ID NO: 900035 - DNA, 16 bp, Homo sapiens
atataggaacttaaat

SEQ ID NO: 900036 - DNA, 19 bp, Homo sapiens
atataggatagacactgga

SEQ ID NO: 900037 - DNA, 21 bp, Homo sapiens
atataggatagacactggaca

SEQ ID NO: 900038 - DNA, 19 bp, Homo sapiens
atatagggtgtggctccta

SEQ ID NO: 900039 - DNA, 15 bp, Homo sapiens
atatagggttttttt

SEQ ID NO: 900040 - DNA, 21 bp, Homo sapiens
atataggtctcttctcccaga

SEQ ID NO: 900041 - DNA, 22 bp, Homo sapiens
atataggtctcttctcccagaa

SEQ ID NO: 900042 - DNA, 19 bp, Homo sapiens
atataggtttctattcttg

SEQ ID NO: 900043 - DNA, 13 bp, Homo sapiens
atatagtatattt

SEQ ID NO: 900044 - DNA, 21 bp, Homo sapiens
atatagtatatttatactcta

SEQ ID NO: 900045 - DNA, 15 bp, Homo sapiens
atatagtccagacac

SEQ ID NO: 900046 - DNA, 16 bp, Homo sapiens
atatagtccagacact

SEQ ID NO: 900047 - DNA, 14 bp, Homo sapiens
atatagtctacagt

SEQ ID NO: 900048 - DNA, 21 bp, Homo sapiens
atatagtggatgatatacaca

SEQ ID NO: 900049 - DNA, 17 bp, Homo sapiens
atatagtgggtacatca

SEQ ID NO: 900050 - DNA, 22 bp, Homo sapiens
atatagtgggtacatcaagtcc

SEQ ID NO: 900051 - DNA, 22 bp, Homo sapiens
atatagttagctaataaaaagc

SEQ ID NO: 900052 - DNA, 12 bp, Homo sapiens
atatagttcctt

SEQ ID NO: 900053 - DNA, 19 bp, Homo sapiens
atatagttccttgccttaa

SEQ ID NO: 900054 - DNA, 13 bp, Homo sapiens
atatagttctgtg

SEQ ID NO: 900055 - DNA, 20 bp, Homo sapiens
atatagttctgtgtagagaa

SEQ ID NO: 900056 - DNA, 23 bp, Homo sapiens
atatagttctgtgtagagaatgt

SEQ ID NO: 900057 - DNA, 13 bp, Homo sapiens
atatagttttact

SEQ ID NO: 900058 - DNA, 16 bp, Homo sapiens
atatagttttactttt

SEQ ID NO: 900059 - DNA, 18 bp, Homo sapiens
atatagttttacttttaa

SEQ ID NO: 900060 - DNA, 13 bp, Homo sapiens
atatataaaataa

SEQ ID NO: 900061 - DNA, 18 bp, Homo sapiens
atatataaaataaatata

SEQ ID NO: 900062 - DNA, 19 bp, Homo sapiens
atatataaacaataaaaac

SEQ ID NO: 900063 - DNA, 14 bp, Homo sapiens
atatataaatatat

SEQ ID NO: 900064 - DNA, 21 bp, Homo sapiens
atatataagtttacaccttta

SEQ ID NO: 900065 - DNA, 15 bp, Homo sapiens
atatataatatgtat

SEQ ID NO: 900066 - DNA, 16 bp, Homo sapiens
atatataatttcctca

SEQ ID NO: 900067 - DNA, 14 bp, Homo sapiens
atatatacacatac

SEQ ID NO: 900068 - DNA, 16 bp, Homo sapiens
atatatacacatacat

SEQ ID NO: 900069 - DNA, 23 bp, Homo sapiens
atatatacacatacatacacata

SEQ ID NO: 900070 - DNA, 18 bp, Homo sapiens
atatatacagtaacttta

SEQ ID NO: 900071 - DNA, 13 bp, Homo sapiens
atatatagaatct

SEQ ID NO: 900072 - DNA, 23 bp, Homo sapiens
atatatagctacattcacacact

SEQ ID NO: 900073 - DNA, 20 bp, Homo sapiens
atatataggctattttctaa

SEQ ID NO: 900074 - DNA, 17 bp, Homo sapiens
atatatagtccagacac

SEQ ID NO: 900075 - DNA, 14 bp, Homo sapiens
atatatataaacct

SEQ ID NO: 900076 - DNA, 15 bp, Homo sapiens
atatatataaatata

SEQ ID NO: 900077 - DNA, 14 bp, Homo sapiens
atatatatacacat

SEQ ID NO: 900078 - DNA, 16 bp, Homo sapiens
atatatatacacatac

SEQ ID NO: 900079 - DNA, 10 bp, Homo sapiens
atatatatat

SEQ ID NO: 900080 - DNA, 13 bp, Homo sapiens
atatatatataaa

SEQ ID NO: 900081 - DNA, 15 bp, Homo sapiens
atatatatatacaca

SEQ ID NO: 900082 - DNA, 13 bp, Homo sapiens
atatatatatata

SEQ ID NO: 900083 - DNA, 14 bp, Homo sapiens
atatatatatatat

SEQ ID NO: 900084 - DNA, 16 bp, Homo sapiens
atatatatatatataa

SEQ ID NO: 900085 - DNA, 14 bp, Homo sapiens
atatatatatatgt

SEQ ID NO: 900086 - DNA, 14 bp, Homo sapiens
atatatatatattt

SEQ ID NO: 900087 - DNA, 13 bp, Homo sapiens
atatatatatgta

SEQ ID NO: 900088 - DNA, 13 bp, Homo sapiens
atatatatattta

SEQ ID NO: 900089 - DNA, 14 bp, Homo sapiens
atatatatctgata

SEQ ID NO: 900090 - DNA, 15 bp, Homo sapiens
atatatatgaataaa

SEQ ID NO: 900091 - DNA, 20 bp, Homo sapiens
atatatatgtacagttatct

SEQ ID NO: 900092 - DNA, 20 bp, Homo sapiens
atatatatgtgtgtgtatgt

SEQ ID NO: 900093 - DNA, 14 bp, Homo sapiens
atatatattgtaaa

SEQ ID NO: 900094 - DNA, 11 bp, Homo sapiens
atatatattta

SEQ ID NO: 900095 - DNA, 16 bp, Homo sapiens
atatatatttgtaaca

SEQ ID NO: 900096 - DNA, 20 bp, Homo sapiens
atatatatttgtaacattgt

SEQ ID NO: 900097 - DNA, 23 bp, Homo sapiens
atatatattttttgcttttgtat

SEQ ID NO: 900098 - DNA, 17 bp, Homo sapiens
atatatcaagaagtctt

SEQ ID NO: 900099 - DNA, 15 bp, Homo sapiens
atatatctatctatt

SEQ ID NO: 900100 - DNA, 18 bp, Homo sapiens
atatatctatctatttga

SEQ ID NO: 900101 - DNA, 19 bp, Homo sapiens
atatatctatctatttgag

SEQ ID NO: 900102 - DNA, 19 bp, Homo sapiens
atatatcttataaagtgga

SEQ ID NO: 900103 - DNA, 17 bp, Homo sapiens
aatccaatattgtaatc

SEQ ID NO: 900104 - DNA, 19 bp, Homo sapiens
aatccacaatgagatgcat

SEQ ID NO: 900105 - DNA, 12 bp, Homo sapiens
aatccacccatc

SEQ ID NO: 900106 - DNA, 12 bp, Homo sapiens
aatccaccccca

SEQ ID NO: 900107 - DNA, 13 bp, Homo sapiens
aatccacctgcct

SEQ ID NO: 900108 - DNA, 19 bp, Homo sapiens
aatccacctgcctcggcct

SEQ ID NO: 900109 - DNA, 13 bp, Homo sapiens
aatccagaggaac

SEQ ID NO: 900110 - DNA, 19 bp, Homo sapiens
aatccagaggaacaagcat

SEQ ID NO: 900111 - DNA, 13 bp, Homo sapiens
aatccagctccct

SEQ ID NO: 900112 - DNA, 18 bp, Homo sapiens
aatccagctccctagact

SEQ ID NO: 900113 - DNA, 24 bp, Homo sapiens
aatccagtattatattatcatatc

SEQ ID NO: 900114 - DNA, 21 bp, Homo sapiens
aatccagtattgctgatttta

SEQ ID NO: 900115 - DNA, 14 bp, Homo sapiens
aatccataaatgtg

SEQ ID NO: 900116 - DNA, 14 bp, Homo sapiens
aatccatgcttcac

SEQ ID NO: 900117 - DNA, 15 bp, Homo sapiens
aatccatgcttgggt

SEQ ID NO: 900118 - DNA, 19 bp, Homo sapiens
aatccatgtgaccattctg

SEQ ID NO: 900119 - DNA, 21 bp, Homo sapiens
aatccatgtgattaatgtttt

SEQ ID NO: 900120 - DNA, 18 bp, Homo sapiens
aatccattatcctttatt

SEQ ID NO: 900121 - DNA, 19 bp, Homo sapiens
aatccattgaactggaaga

SEQ ID NO: 900122 - DNA, 17 bp, Homo sapiens
aatccattgtttaaaga

SEQ ID NO: 900123 - DNA, 19 bp, Homo sapiens
aatccattgtttaaagatg

SEQ ID NO: 900124 - DNA, 22 bp, Homo sapiens
aatccattttaggtgataaaat

SEQ ID NO: 900125 - DNA, 22 bp, Homo sapiens
aatcccaatctttctatataaa

SEQ ID NO: 900126 - DNA, 15 bp, Homo sapiens
aatcccaatgtttga

SEQ ID NO: 900127 - DNA, 14 bp, Homo sapiens
aatcccactgtatg

SEQ ID NO: 900128 - DNA, 15 bp, Homo sapiens
aatcccagcactttg

SEQ ID NO: 900129 - DNA, 21 bp, Homo sapiens
aatcccagggaaggacttgga

SEQ ID NO: 900130 - DNA, 15 bp, Homo sapiens
aatcccatttcttga

SEQ ID NO: 900131 - DNA, 18 bp, Homo sapiens
aatccccaacatgcactg

SEQ ID NO: 900132 - DNA, 16 bp, Homo sapiens
aatccccatcattact

SEQ ID NO: 900133 - DNA, 22 bp, Homo sapiens
aatccccatcattactggtaaa

SEQ ID NO: 900134 - DNA, 16 bp, Homo sapiens
aatccccccttcagaa

SEQ ID NO: 900135 - DNA, 20 bp, Homo sapiens
aatccccgacccccctaccc

SEQ ID NO: 900136 - DNA, 22 bp, Homo sapiens
aatccccgacccccctacccca

SEQ ID NO: 900137 - DNA, 14 bp, Homo sapiens
aatcccctcattca

SEQ ID NO: 900138 - DNA, 10 bp, Homo sapiens
aatccctctc

SEQ ID NO: 900139 - DNA, 16 bp, Homo sapiens
aatccctctccactct

SEQ ID NO: 900140 - DNA, 23 bp, Homo sapiens
aatccctctccactcttctctcc

SEQ ID NO: 900141 - DNA, 14 bp, Homo sapiens
aatccctgccactg

SEQ ID NO: 900142 - DNA, 21 bp, Homo sapiens
aatccctgccactgggctctg

SEQ ID NO: 900143 - DNA, 23 bp, Homo sapiens
aatccctgccactgggctctgga

SEQ ID NO: 900144 - DNA, 14 bp, Homo sapiens
aatccctgttcatt

SEQ ID NO: 900145 - DNA, 17 bp, Homo sapiens
aatccctgttcattgta

SEQ ID NO: 900146 - DNA, 17 bp, Homo sapiens
aatccctgtttaatatt

SEQ ID NO: 900147 - DNA, 13 bp, Homo sapiens
aatcccttaaaat

SEQ ID NO: 900148 - DNA, 18 bp, Homo sapiens
aatcccttaacagttgta

SEQ ID NO: 900149 - DNA, 22 bp, Homo sapiens
aatcccttaacagttgtattta

SEQ ID NO: 900150 - DNA, 21 bp, Homo sapiens
aatcccttaatatcctaaaca

SEQ ID NO: 900151 - DNA, 13 bp, Homo sapiens
aatccgacttgaa

SEQ ID NO: 900152 - DNA, 20 bp, Homo sapiens
aatccgctctcttcctgccc

SEQ ID NO: 900153 - DNA, 23 bp, Homo sapiens
aatccgctctcttcctgcccctc

SEQ ID NO: 900154 - DNA, 15 bp, Homo sapiens
aatcctaaaagaagc

SEQ ID NO: 900155 - DNA, 14 bp, Homo sapiens
aatcctaagacaca

SEQ ID NO: 900156 - DNA, 17 bp, Homo sapiens
aatcctacctcaaaatt

SEQ ID NO: 900157 - DNA, 19 bp, Homo sapiens
aatcctagacttgaaagtt

SEQ ID NO: 900158 - DNA, 20 bp, Homo sapiens
aatcctagacttgaaagttt

SEQ ID NO: 900159 - DNA, 14 bp, Homo sapiens
aatcctatatctgt

SEQ ID NO: 900160 - DNA, 22 bp, Homo sapiens
aatcctatctggggagctcctg

SEQ ID NO: 900161 - DNA, 15 bp, Homo sapiens
aatcctattactctt

SEQ ID NO: 900162 - DNA, 21 bp, Homo sapiens
aatcctcagagagttgtctgt

SEQ ID NO: 900163 - DNA, 21 bp, Homo sapiens
aatcctcagccgagaaattgg

SEQ ID NO: 900164 - DNA, 9 bp, Homo sapiens
aatcctcct

SEQ ID NO: 900165 - DNA, 19 bp, Homo sapiens
aatcctcctacctcagcct

SEQ ID NO: 900166 - DNA, 15 bp, Homo sapiens
aatcctctcctttct

SEQ ID NO: 900167 - DNA, 11 bp, Homo sapiens
aatcctctggc

SEQ ID NO: 900168 - DNA, 14 bp, Homo sapiens
aatcctcttcctct

SEQ ID NO: 900169 - DNA, 15 bp, Homo sapiens
aatcctcttcctctg

SEQ ID NO: 900170 - DNA, 18 bp, Homo sapiens
aatcctcttcctctgagg

SEQ ID NO: 900171 - DNA, 18 bp, Homo sapiens
aatcctgaataaaccagt

SEQ ID NO: 900172 - DNA, 14 bp, Homo sapiens
aatcctgcaatgaa

SEQ ID NO: 900173 - DNA, 17 bp, Homo sapiens
aatcctgcaatgaaagg

SEQ ID NO: 900174 - DNA, 14 bp, Homo sapiens
aatcctgcctctcc

SEQ ID NO: 900175 - DNA, 14 bp, Homo sapiens
aatcctggaagaca

SEQ ID NO: 900176 - DNA, 23 bp, Homo sapiens
aatcctggaagacaacccaggca

SEQ ID NO: 900177 - DNA, 17 bp, Homo sapiens
aatcctggaaggacaca

SEQ ID NO: 900178 - DNA, 12 bp, Homo sapiens
aatcctggcagc

SEQ ID NO: 900179 - DNA, 16 bp, Homo sapiens
aatcctggcagcccag

SEQ ID NO: 900180 - DNA, 18 bp, Homo sapiens
aatcctggtaattaaaag

SEQ ID NO: 900181 - DNA, 12 bp, Homo sapiens
aatcctgtcttt

SEQ ID NO: 900182 - DNA, 14 bp, Homo sapiens
aatcctgtttataa

SEQ ID NO: 900183 - DNA, 16 bp, Homo sapiens
aatccttccctgctct

SEQ ID NO: 900184 - DNA, 18 bp, Homo sapiens
aatccttcgtcctaacat

SEQ ID NO: 900185 - DNA, 20 bp, Homo sapiens
aatccttctagtttcccaca

SEQ ID NO: 900186 - DNA, 19 bp, Homo sapiens
aatccttctattctagcct

SEQ ID NO: 900187 - DNA, 17 bp, Homo sapiens
aatccttgataatatat

SEQ ID NO: 900188 - DNA, 22 bp, Homo sapiens
aatccttggctgaattaaaatg

SEQ ID NO: 900189 - DNA, 23 bp, Homo sapiens
aatccttggctgaattaaaatgg

SEQ ID NO: 900190 - DNA, 20 bp, Homo sapiens
aatccttgtgacttacaatt

SEQ ID NO: 900191 - DNA, 21 bp, Homo sapiens
aatcctttctgccccccaggg

SEQ ID NO: 900192 - DNA, 22 bp, Homo sapiens
aatcctttgttttctgactaat

SEQ ID NO: 900193 - DNA, 19 bp, Homo sapiens
aatcgagagtgtgctctcc

SEQ ID NO: 900194 - DNA, 17 bp, Homo sapiens
aatcgaggaaccagagc

SEQ ID NO: 900195 - DNA, 20 bp, Homo sapiens
aatcgatgggggatgcttca

SEQ ID NO: 900196 - DNA, 21 bp, Homo sapiens
aatcgatgggggatgcttcat

SEQ ID NO: 900197 - DNA, 14 bp, Homo sapiens
aatcgattggcttt

SEQ ID NO: 900198 - DNA, 15 bp, Homo sapiens
aatcgatttcctccc

SEQ ID NO: 900199 - DNA, 14 bp, Homo sapiens
aatcgccccagact

SEQ ID NO: 900200 - DNA, 17 bp, Homo sapiens
aatcgcttgaacctggg

SEQ ID NO: 900201 - DNA, 22 bp, Homo sapiens
aatcggatctggggctctggga

SEQ ID NO: 900202 - DNA, 22 bp, Homo sapiens
aatcggcccacagctcccaccc

SEQ ID NO: 900203 - DNA, 21 bp, Homo sapiens
aatcggctacccctcgactca

SEQ ID NO: 900204 - DNA, 22 bp, Homo sapiens
aatcgggctaaggtccctgggg

SEQ ID NO: 900205 - DNA, 23 bp, Homo sapiens
aatcgtggcacgtattgctgtgt

SEQ ID NO: 900206 - DNA, 22 bp, Homo sapiens
aatcgtgtgccatggatctgat

SEQ ID NO: 900207 - DNA, 15 bp, Homo sapiens
aatcgtttctcagaa

SEQ ID NO: 900208 - DNA, 23 bp, Homo sapiens
aatctaaaacaaaatctgaactc

SEQ ID NO: 900209 - DNA, 14 bp, Homo sapiens
aatctaaaatgatt

SEQ ID NO: 900210 - DNA, 19 bp, Homo sapiens
aatctaaatctatttatta

SEQ ID NO: 900211 - DNA, 19 bp, Homo sapiens
aatctaagctgtttgccaa

SEQ ID NO: 900212 - DNA, 17 bp, Homo sapiens
atatcctctccccctcc

SEQ ID NO: 900213 - DNA, 15 bp, Homo sapiens
atatcctgagccatc

SEQ ID NO: 900214 - DNA, 12 bp, Homo sapiens
atatcctgcctc

SEQ ID NO: 900215 - DNA, 14 bp, Homo sapiens
atatcctgtaacta

SEQ ID NO: 900216 - DNA, 20 bp, Homo sapiens
atatcctgtgactgtctcac

SEQ ID NO: 900217 - DNA, 22 bp, Homo sapiens
atatcggggggtggaccacgcc

SEQ ID NO: 900218 - DNA, 22 bp, Homo sapiens
atatctaaagctttggacaagt

SEQ ID NO: 900219 - DNA, 20 bp, Homo sapiens
atatctaaagttatatttca

SEQ ID NO: 900220 - DNA, 19 bp, Homo sapiens
atatctaatatatatgaat

SEQ ID NO: 900221 - DNA, 20 bp, Homo sapiens
atatctaattattttgcagt

SEQ ID NO: 900222 - DNA, 17 bp, Homo sapiens
atatctacacatacaga

SEQ ID NO: 900223 - DNA, 23 bp, Homo sapiens
atatctacacatacagaaagaag

SEQ ID NO: 900224 - DNA, 14 bp, Homo sapiens
atatctattatgta

SEQ ID NO: 900225 - DNA, 17 bp, Homo sapiens
atatctcaatctgcagc

SEQ ID NO: 900226 - DNA, 22 bp, Homo sapiens
atatctccatggccctgtccca

SEQ ID NO: 900227 - DNA, 23 bp, Homo sapiens
atatctcctgaaaaggtttatga

SEQ ID NO: 900228 - DNA, 12 bp, Homo sapiens
atatctctgccg

SEQ ID NO: 900229 - DNA, 21 bp, Homo sapiens
aatctagaagatgtgtaaaca

SEQ ID NO: 900230 - DNA, 22 bp, Homo sapiens
aatctagaagatgtgtaaacag

SEQ ID NO: 900231 - DNA, 14 bp, Homo sapiens
aatctagaggaaaa

SEQ ID NO: 900232 - DNA, 19 bp, Homo sapiens
aatctagaggaaaagaaag

SEQ ID NO: 900233 - DNA, 20 bp, Homo sapiens
aatctagtgggttgaccttt

SEQ ID NO: 900234 - DNA, 23 bp, Homo sapiens
aatctagttttttttgtaaactg

SEQ ID NO: 900235 - DNA, 20 bp, Homo sapiens
aatctatagttcactgacac

SEQ ID NO: 900236 - DNA, 18 bp, Homo sapiens
aatctatatttgtcttcc

SEQ ID NO: 900237 - DNA, 23 bp, Homo sapiens
aatctatcactaaaaatttttac

SEQ ID NO: 900238 - DNA, 18 bp, Homo sapiens
aatctatgccaaagatca

SEQ ID NO: 900239 - DNA, 22 bp, Homo sapiens
aatctatggcttatttctatga

SEQ ID NO: 900240 - DNA, 21 bp, Homo sapiens
aatctatggtcgggagacagc

SEQ ID NO: 900241 - DNA, 19 bp, Homo sapiens
aatctatgtcgtgttttca

SEQ ID NO: 900242 - DNA, 15 bp, Homo sapiens
aatctatgtgtttct

SEQ ID NO: 900243 - DNA, 19 bp, Homo sapiens
aatctatgtgtttctgtaa

SEQ ID NO: 900244 - DNA, 14 bp, Homo sapiens
aatctattagattt

SEQ ID NO: 900245 - DNA, 19 bp, Homo sapiens
aatctattcagacaagcaa

SEQ ID NO: 900246 - DNA, 11 bp, Homo sapiens
aatctatttaa

SEQ ID NO: 900247 - DNA, 18 bp, Homo sapiens
aatctatttattaatatt

SEQ ID NO: 900248 - DNA, 12 bp, Homo sapiens
aatctatttcta

SEQ ID NO: 900249 - DNA, 13 bp, Homo sapiens
aatctcaaaatta

SEQ ID NO: 900250 - DNA, 14 bp, Homo sapiens
aatctcaaaattag

SEQ ID NO: 900251 - DNA, 15 bp, Homo sapiens
aatctcaaaggagaa

SEQ ID NO: 900252 - DNA, 16 bp, Homo sapiens
aatctcaaaggagaaa

SEQ ID NO: 900253 - DNA, 20 bp, Homo sapiens
aatctcaaaggagaaaaaaa

SEQ ID NO: 900254 - DNA, 15 bp, Homo sapiens
aatctcaaataacta

SEQ ID NO: 900255 - DNA, 15 bp, Homo sapiens
aatctcaaatttcta

SEQ ID NO: 900256 - DNA, 17 bp, Homo sapiens
aatctcaaatttctaaa

SEQ ID NO: 900257 - DNA, 18 bp, Homo sapiens
aatctcaaatttctaaat

SEQ ID NO: 900258 - DNA, 13 bp, Homo sapiens
aatctcagcaaag

SEQ ID NO: 900259 - DNA, 22 bp, Homo sapiens
aatctcagcaatgattactctt

SEQ ID NO: 900260 - DNA, 14 bp, Homo sapiens
aatctcagtgcttt

SEQ ID NO: 900261 - DNA, 20 bp, Homo sapiens
aatctcagttgtttgcttct

SEQ ID NO: 900262 - DNA, 21 bp, Homo sapiens
aatctcagttgtttgcttctt

SEQ ID NO: 900263 - DNA, 23 bp, Homo sapiens
aatctcataggttgccaataata

SEQ ID NO: 900264 - DNA, 13 bp, Homo sapiens
aatctcatccccc

SEQ ID NO: 900265 - DNA, 14 bp, Homo sapiens
aatctcatcccccc

SEQ ID NO: 900266 - DNA, 15 bp, Homo sapiens
aatctcatcccccca

SEQ ID NO: 900267 - DNA, 18 bp, Homo sapiens
aatctcatgattccatgc

SEQ ID NO: 900268 - DNA, 13 bp, Homo sapiens
aatctccaaaata

SEQ ID NO: 900269 - DNA, 16 bp, Homo sapiens
aatctcccagcccacc

SEQ ID NO: 900270 - DNA, 17 bp, Homo sapiens
aatctcccgctgctgct

SEQ ID NO: 900271 - DNA, 19 bp, Homo sapiens
aatctcccgctgctgctgc

SEQ ID NO: 900272 - DNA, 19 bp, Homo sapiens
aatctctcatattcgctag

SEQ ID NO: 900273 - DNA, 22 bp, Homo sapiens
aatctctcatattcgctagtgt

SEQ ID NO: 900274 - DNA, 16 bp, Homo sapiens
aatctctctgcagctg

SEQ ID NO: 900275 - DNA, 18 bp, Homo sapiens
aatctctctgcagctgcc

SEQ ID NO: 900276 - DNA, 19 bp, Homo sapiens
aatctcttcactaccctga

SEQ ID NO: 900277 - DNA, 19 bp, Homo sapiens
aatctcttcatgcttgaca

SEQ ID NO: 900278 - DNA, 19 bp, Homo sapiens
aatctcttcttatacagat

SEQ ID NO: 900279 - DNA, 17 bp, Homo sapiens
aatctcttgattataaa

SEQ ID NO: 900280 - DNA, 22 bp, Homo sapiens
aatctgaactctcaaaagtcta

SEQ ID NO: 900281 - DNA, 23 bp, Homo sapiens
aatctgaagatatatttcacttt

SEQ ID NO: 900282 - DNA, 17 bp, Homo sapiens
aatctgaggcctcctct

SEQ ID NO: 900283 - DNA, 19 bp, Homo sapiens
aatctgagggaaatgtttt

SEQ ID NO: 900284 - DNA, 20 bp, Homo sapiens
aatctgagggaaatgttttg

SEQ ID NO: 900285 - DNA, 21 bp, Homo sapiens
aatctgagggaaatgttttgt

SEQ ID NO: 900286 - DNA, 16 bp, Homo sapiens
aatctgatggccttaa

SEQ ID NO: 900287 - DNA, 20 bp, Homo sapiens
aatctgatggccttaatttc

SEQ ID NO: 900288 - DNA, 15 bp, Homo sapiens
aatctgattagaagt

SEQ ID NO: 900289 - DNA, 15 bp, Homo sapiens
aatctgatttaatgt

SEQ ID NO: 900290 - DNA, 19 bp, Homo sapiens
aatctgatttaatgttttc

SEQ ID NO: 900291 - DNA, 12 bp, Homo sapiens
aatctgcagcca

SEQ ID NO: 900292 - DNA, 11 bp, Homo sapiens
aatctgcaggg

SEQ ID NO: 900293 - DNA, 18 bp, Homo sapiens
aatctgcagggagcaact

SEQ ID NO: 900294 - DNA, 18 bp, Homo sapiens
aatctgcattttaacaag

SEQ ID NO: 900295 - DNA, 11 bp, Homo sapiens
aatctgctgtt

SEQ ID NO: 900296 - DNA, 16 bp, Homo sapiens
aatctggaaatctgtt

SEQ ID NO: 900297 - DNA, 15 bp, Homo sapiens
aatctggaagaaaaa

SEQ ID NO: 900298 - DNA, 22 bp, Homo sapiens
aatctggaccccatctgtgaat

SEQ ID NO: 900299 - DNA, 15 bp, Homo sapiens
aatctggactcctct

SEQ ID NO: 900300 - DNA, 17 bp, Homo sapiens
aatctggactcctctgt

SEQ ID NO: 900301 - DNA, 11 bp, Homo sapiens
aatctggatta

SEQ ID NO: 900302 - DNA, 21 bp, Homo sapiens
aatctggcattctacacctgg

SEQ ID NO: 900303 - DNA, 15 bp, Homo sapiens
aatctgggactttca

SEQ ID NO: 900304 - DNA, 16 bp, Homo sapiens
aatctgggagggaagt

SEQ ID NO: 900305 - DNA, 18 bp, Homo sapiens
aatctggggaagaggttt

SEQ ID NO: 900306 - DNA, 14 bp, Homo sapiens
aatctgggggtgag

SEQ ID NO: 900307 - DNA, 11 bp, Homo sapiens
aatctgtaaac

SEQ ID NO: 900308 - DNA, 13 bp, Homo sapiens
aatctgtacaatg

SEQ ID NO: 900309 - DNA, 20 bp, Homo sapiens
aatctgtataatactttgta

SEQ ID NO: 900310 - DNA, 14 bp, Homo sapiens
aatctgtcaaaaca

SEQ ID NO: 900311 - DNA, 20 bp, Homo sapiens
aatctgtcaaaacactgtgg

SEQ ID NO: 900312 - DNA, 16 bp, Homo sapiens
aatctgtgaattaaaa

SEQ ID NO: 900313 - DNA, 12 bp, Homo sapiens
aatctgtgcctg

SEQ ID NO: 900314 - DNA, 16 bp, Homo sapiens
aatctgtgctctttca

SEQ ID NO: 900315 - DNA, 13 bp, Homo sapiens
aatctgtgtacaa

SEQ ID NO: 900316 - DNA, 17 bp, Homo sapiens
aatctgtgtacaaagaa

SEQ ID NO: 900317 - DNA, 18 bp, Homo sapiens
aatctgtgtacaaagaaa

SEQ ID NO: 900318 - DNA, 18 bp, Homo sapiens
aatctgtgtgcatatttg

SEQ ID NO: 900319 - DNA, 19 bp, Homo sapiens
aatctgtgtgcatatttgt

SEQ ID NO: 900320 - DNA, 16 bp, Homo sapiens
aatctgtgtgtatatt

SEQ ID NO: 900321 - DNA, 23 bp, Homo sapiens
aatctgttatgtactagtgttct

SEQ ID NO: 900322 - DNA, 14 bp, Homo sapiens
aatctgtttctctg

SEQ ID NO: 900323 - DNA, 15 bp, Homo sapiens
aatctgtttctctgc

SEQ ID NO: 900324 - DNA, 20 bp, Homo sapiens
aatctgtttctctgctgtca

SEQ ID NO: 900325 - DNA, 18 bp, Homo sapiens
aatctgtttgtgcaaaca

SEQ ID NO: 900326 - DNA, 21 bp, Homo sapiens
aatctgttttataccttgctt

SEQ ID NO: 900327 - DNA, 22 bp, Homo sapiens
aatctgttttgtatatgatcta

SEQ ID NO: 900328 - DNA, 19 bp, Homo sapiens
aatctgtttttacgtatgt

SEQ ID NO: 900329 - DNA, 15 bp, Homo sapiens
aatcttaaaagtgta

SEQ ID NO: 900330 - DNA, 19 bp, Homo sapiens
aatcttaaacaatgtataa

SEQ ID NO: 900331 - DNA, 14 bp, Homo sapiens
aatcttaacatcat

SEQ ID NO: 900332 - DNA, 23 bp, Homo sapiens
aatcttaagtaccaatgggaagc

SEQ ID NO: 900333 - DNA, 16 bp, Homo sapiens
aatcttaccagatgct

SEQ ID NO: 900334 - DNA, 21 bp, Homo sapiens
atatgggaacaaattagagga

SEQ ID NO: 900335 - DNA, 20 bp, Homo sapiens
atatgggggcctggattcat

SEQ ID NO: 900336 - DNA, 17 bp, Homo sapiens
atatggggggccaacac

SEQ ID NO: 900337 - DNA, 18 bp, Homo sapiens
atatggtcttgagccagt

SEQ ID NO: 900338 - DNA, 14 bp, Homo sapiens
atatggttctccaa

SEQ ID NO: 900339 - DNA, 17 bp, Homo sapiens
atatggttctccaagaa

SEQ ID NO: 900340 - DNA, 20 bp, Homo sapiens
atatggttggagagccctgg

SEQ ID NO: 900341 - DNA, 15 bp, Homo sapiens
atatggtttggtttt

SEQ ID NO: 900342 - DNA, 14 bp, Homo sapiens
atatgtaaaacatt

SEQ ID NO: 900343 - DNA, 15 bp, Homo sapiens
atatgtaaaacattt

SEQ ID NO: 900344 - DNA, 22 bp, Homo sapiens
atatgtaaatggtatgtcattc

SEQ ID NO: 900345 - DNA, 14 bp, Homo sapiens
atatgtaagggaaa

SEQ ID NO: 900346 - DNA, 14 bp, Homo sapiens
atatgtaagtactt

SEQ ID NO: 900347 - DNA, 18 bp, Homo sapiens
atatgtaatataaattta

SEQ ID NO: 900348 - DNA, 15 bp, Homo sapiens
atatgtacagctctc

SEQ ID NO: 900349 - DNA, 14 bp, Homo sapiens
atatgtacagttat

SEQ ID NO: 900350 - DNA, 16 bp, Homo sapiens
atatgtacagtttatt

SEQ ID NO: 900351 - DNA, 14 bp, Homo sapiens
atatgtaccatgta

SEQ ID NO: 900352 - DNA, 19 bp, Homo sapiens
atatgtacttgtcaaagaa

SEQ ID NO: 900353 - DNA, 16 bp, Homo sapiens
atatgtagaaggcaca

SEQ ID NO: 900354 - DNA, 16 bp, Homo sapiens
atatgtagatgtatgc

SEQ ID NO: 900355 - DNA, 18 bp, Homo sapiens
atatgtagatgtatgcac

SEQ ID NO: 900356 - DNA, 15 bp, Homo sapiens
atatgtagtatctat

SEQ ID NO: 900357 - DNA, 16 bp, Homo sapiens
aaacaataattttaac

SEQ ID NO: 900358 - DNA, 15 bp, Homo sapiens
aaacaatatctgcag

SEQ ID NO: 900359 - DNA, 22 bp, Homo sapiens
aaacaatcccaatctttctata

SEQ ID NO: 900360 - DNA, 13 bp, Homo sapiens
aaacaatcttatt

SEQ ID NO: 900361 - DNA, 22 bp, Homo sapiens
aaacaatgtataaagattgtac

SEQ ID NO: 900362 - DNA, 16 bp, Homo sapiens
aaacaatgttgtccaa

SEQ ID NO: 900363 - DNA, 23 bp, Homo sapiens
aaacaatgtttgggggaaaaaaa

SEQ ID NO: 900364 - DNA, 17 bp, Homo sapiens
aaacaattcaagctgag

SEQ ID NO: 900365 - DNA, 20 bp, Homo sapiens
aaacaattcaagctgagaaa

SEQ ID NO: 900366 - DNA, 13 bp, Homo sapiens
aaacaattcagtg

SEQ ID NO: 900367 - DNA, 16 bp, Homo sapiens
aaacaattcagtggtc

SEQ ID NO: 900368 - DNA, 23 bp, Homo sapiens
aaacaattcccttctttttcatc

SEQ ID NO: 900369 - DNA, 17 bp, Homo sapiens
aaacaatttattttatt

SEQ ID NO: 900370 - DNA, 14 bp, Homo sapiens
aaacacaaaacaac

SEQ ID NO: 900371 - DNA, 23 bp, Homo sapiens
aaacacaccaggctgtgggcctc

SEQ ID NO: 900372 - DNA, 19 bp, Homo sapiens
aaacacagtcaaaataatt

SEQ ID NO: 900373 - DNA, 13 bp, Homo sapiens
aaacacagttaca

SEQ ID NO: 900374 - DNA, 17 bp, Homo sapiens
aaacacatacaaaagaa

SEQ ID NO: 900375 - DNA, 18 bp, Homo sapiens
aaacacatagattcacct

SEQ ID NO: 900376 - DNA, 18 bp, Homo sapiens
aaacacatctagtagttg

SEQ ID NO: 900377 - DNA, 14 bp, Homo sapiens
aaacacatgccagt

SEQ ID NO: 900378 - DNA, 19 bp, Homo sapiens
aaacaccaacatgttggga

SEQ ID NO: 900379 - DNA, 15 bp, Homo sapiens
aaacaccattataaa

SEQ ID NO: 900380 - DNA, 12 bp, Homo sapiens
aaacaccattca

SEQ ID NO: 900381 - DNA, 13 bp, Homo sapiens
aaacacctcccca

SEQ ID NO: 900382 - DNA, 17 bp, Homo sapiens
aaacacctccccagccc

SEQ ID NO: 900383 - DNA, 13 bp, Homo sapiens
aaacacgaaactt

SEQ ID NO: 900384 - DNA, 14 bp, Homo sapiens
aaacacgaaacttg

SEQ ID NO: 900385 - DNA, 15 bp, Homo sapiens
aaacacgaaacttgt

SEQ ID NO: 900386 - DNA, 17 bp, Homo sapiens
aaacacgaaacttgtta

SEQ ID NO: 900387 - DNA, 22 bp, Homo sapiens
aaacacgccttgttcctgctct

SEQ ID NO: 900388 - DNA, 20 bp, Homo sapiens
aaacactccacagtgtttat

SEQ ID NO: 900389 - DNA, 11 bp, Homo sapiens
aaacactggac

SEQ ID NO: 900390 - DNA, 18 bp, Homo sapiens
aaacactggacctggggg

SEQ ID NO: 900391 - DNA, 15 bp, Homo sapiens
aaacactgtaatctt

SEQ ID NO: 900392 - DNA, 13 bp, Homo sapiens
aaacactgtgcac

SEQ ID NO: 900393 - DNA, 17 bp, Homo sapiens
aaacacttccagtctgg

SEQ ID NO: 900394 - DNA, 19 bp, Homo sapiens
aaacacttggcatacaaaa

SEQ ID NO: 900395 - DNA, 14 bp, Homo sapiens
aaacactttctctt

SEQ ID NO: 900396 - DNA, 11 bp, Homo sapiens
aaacagaaata

SEQ ID NO: 900397 - DNA, 15 bp, Homo sapiens
aaacagaactccctt

SEQ ID NO: 900398 - DNA, 14 bp, Homo sapiens
aaacagaactcgat

SEQ ID NO: 900399 - DNA, 21 bp, Homo sapiens
aaacagaataaaagttcctct

SEQ ID NO: 900400 - DNA, 14 bp, Homo sapiens
aaacagacaatatg

SEQ ID NO: 900401 - DNA, 20 bp, Homo sapiens
aaacagactcgattcatatt

SEQ ID NO: 900402 - DNA, 16 bp, Homo sapiens
aaacagagacaggccc

SEQ ID NO: 900403 - DNA, 22 bp, Homo sapiens
aaacagagacaggcccaagaga

SEQ ID NO: 900404 - DNA, 22 bp, Homo sapiens
aaacagagtccaatttaaggaa

SEQ ID NO: 900405 - DNA, 15 bp, Homo sapiens
aaacagagtggcctc

SEQ ID NO: 900406 - DNA, 18 bp, Homo sapiens
aaacagagtggcctccct

SEQ ID NO: 900407 - DNA, 18 bp, Homo sapiens
aaacagatgaccataatt

SEQ ID NO: 900408 - DNA, 19 bp, Homo sapiens
aaacagatgataaatattt

SEQ ID NO: 900409 - DNA, 20 bp, Homo sapiens
aaacagatgataaatattta

SEQ ID NO: 900410 - DNA, 21 bp, Homo sapiens
aaacagatgtattatgctgtt

SEQ ID NO: 900411 - DNA, 22 bp, Homo sapiens
aaacagattcaggccagcccag

SEQ ID NO: 900412 - DNA, 19 bp, Homo sapiens
aaacagattctgattccct

SEQ ID NO: 900413 - DNA, 17 bp, Homo sapiens
aaacagatttggaaaga

SEQ ID NO: 900414 - DNA, 14 bp, Homo sapiens
aaacagatttttac

SEQ ID NO: 900415 - DNA, 15 bp, Homo sapiens
aaacagcagtttgtg

SEQ ID NO: 900416 - DNA, 21 bp, Homo sapiens
aaacagcagtttgtgatatag

SEQ ID NO: 900417 - DNA, 15 bp, Homo sapiens
aaacagcatgaataa

SEQ ID NO: 900418 - DNA, 18 bp, Homo sapiens
aaacagcattgctttctg

SEQ ID NO: 900419 - DNA, 21 bp, Homo sapiens
aaacagcattgctttctgaaa

SEQ ID NO: 900420 - DNA, 19 bp, Homo sapiens
aaacagccccagtcttcct

SEQ ID NO: 900421 - DNA, 20 bp, Homo sapiens
aaacagccccagtcttcctt

SEQ ID NO: 900422 - DNA, 22 bp, Homo sapiens
aaacagccgtcagccaaatgta

SEQ ID NO: 900423 - DNA, 14 bp, Homo sapiens
aaacagctattata

SEQ ID NO: 900424 - DNA, 20 bp, Homo sapiens
aaacagcttcatgcctttgt

SEQ ID NO: 900425 - DNA, 17 bp, Homo sapiens
aaacatggttacaatca

SEQ ID NO: 900426 - DNA, 20 bp, Homo sapiens
aaacatgtcacaatacagta

SEQ ID NO: 900427 - DNA, 17 bp, Homo sapiens
aaacatgttagaagcaa

SEQ ID NO: 900428 - DNA, 21 bp, Homo sapiens
aaacatgtttaaatagcctaa

SEQ ID NO: 900429 - DNA, 12 bp, Homo sapiens
aaacattaaaca

SEQ ID NO: 900430 - DNA, 21 bp, Homo sapiens
aaacattaaacactgtaatct

SEQ ID NO: 900431 - DNA, 14 bp, Homo sapiens
aaacattaagaaaa

SEQ ID NO: 900432 - DNA, 16 bp, Homo sapiens
aaacattaagtaaatg

SEQ ID NO: 900433 - DNA, 20 bp, Homo sapiens
aaacattaatagcagccttt

SEQ ID NO: 900434 - DNA, 21 bp, Homo sapiens
aaacattaatagcagcctttc

SEQ ID NO: 900435 - DNA, 16 bp, Homo sapiens
aaacattaattttgtg

SEQ ID NO: 900436 - DNA, 18 bp, Homo sapiens
aaacattatatgtataca

SEQ ID NO: 900437 - DNA, 17 bp, Homo sapiens
aaacattcctccagcct

SEQ ID NO: 900438 - DNA, 19 bp, Homo sapiens
aaacattctatctactgat

SEQ ID NO: 900439 - DNA, 23 bp, Homo sapiens
aaacattctgatttggaaaaaga

SEQ ID NO: 900440 - DNA, 17 bp, Homo sapiens
aaacattgcctttgaat

SEQ ID NO: 900441 - DNA, 12 bp, Homo sapiens
aaacattgctgc

SEQ ID NO: 900442 - DNA, 14 bp, Homo sapiens
aaacatttaacata

SEQ ID NO: 900443 - DNA, 13 bp, Homo sapiens
aaacatttacaat

SEQ ID NO: 900444 - DNA, 18 bp, Homo sapiens
aaacatttacaataaata

SEQ ID NO: 900445 - DNA, 19 bp, Homo sapiens
aaacatttacaataaatat

SEQ ID NO: 900446 - DNA, 23 bp, Homo sapiens
aaacatttacaataaatattctg

SEQ ID NO: 900447 - DNA, 12 bp, Homo sapiens
aaacatttattt

SEQ ID NO: 900448 - DNA, 17 bp, Homo sapiens
aaacatttattttgaca

SEQ ID NO: 900449 - DNA, 14 bp, Homo sapiens
aaacatttcataat

SEQ ID NO: 900450 - DNA, 16 bp, Homo sapiens
aaacatttcataattt

SEQ ID NO: 900451 - DNA, 18 bp, Homo sapiens
aaacatttcataatttgt

SEQ ID NO: 900452 - DNA, 22 bp, Homo sapiens
aaacatttcataatttgtttcc

SEQ ID NO: 900453 - DNA, 14 bp, Homo sapiens
aaacatttgctgaa

SEQ ID NO: 900454 - DNA, 17 bp, Homo sapiens
aaacattttatactgta

SEQ ID NO: 900455 - DNA, 19 bp, Homo sapiens
aaacattttatactgtaca

SEQ ID NO: 900456 - DNA, 23 bp, Homo sapiens
aaacattttatcattaaaaatta

SEQ ID NO: 900457 - DNA, 14 bp, Homo sapiens
aaacattttatttt

SEQ ID NO: 900458 - DNA, 16 bp, Homo sapiens
aaacattttctttctt

SEQ ID NO: 900459 - DNA, 15 bp, Homo sapiens
aaacattttgaagtg

SEQ ID NO: 900460 - DNA, 19 bp, Homo sapiens
aaacattttgtcatataag

SEQ ID NO: 900461 - DNA, 21 bp, Homo sapiens
aaacattttgtggtcattaag

SEQ ID NO: 900462 - DNA, 20 bp, Homo sapiens
aaacattttttaaggaggga

SEQ ID NO: 900463 - DNA, 21 bp, Homo sapiens
aaaccaaaaaaaaaaaaaatc

SEQ ID NO: 900464 - DNA, 16 bp, Homo sapiens
aaaccaaacccagcca

SEQ ID NO: 900465 - DNA, 17 bp, Homo sapiens
aaaccaaagagggcttc

SEQ ID NO: 900466 - DNA, 19 bp, Homo sapiens
aaaccaaagagggcttcct

SEQ ID NO: 900467 - DNA, 18 bp, Homo sapiens
aaaccaaagctgcctgtg

SEQ ID NO: 900468 - DNA, 11 bp, Homo sapiens
aaaccaaagtc

SEQ ID NO: 900469 - DNA, 16 bp, Homo sapiens
aaaccaaagtctgccg

SEQ ID NO: 900470 - DNA, 21 bp, Homo sapiens
aaaccaagaaggagacctttt

SEQ ID NO: 900471 - DNA, 16 bp, Homo sapiens
aaaccaagcatcaggg

SEQ ID NO: 900472 - DNA, 16 bp, Homo sapiens
aaaccaagccgtggct

SEQ ID NO: 900473 - DNA, 14 bp, Homo sapiens
aaaccaagccttgg

SEQ ID NO: 900474 - DNA, 23 bp, Homo sapiens
aaaccaagtcaagtgaaaaagga

SEQ ID NO: 900475 - DNA, 13 bp, Homo sapiens
aaaccaatttctt

SEQ ID NO: 900476 - DNA, 18 bp, Homo sapiens
aaaccaatttcttccttc

SEQ ID NO: 900477 - DNA, 21 bp, Homo sapiens
aaaccacaaggctgttgcatg

SEQ ID NO: 900478 - DNA, 16 bp, Homo sapiens
aaaccacacttcttga

SEQ ID NO: 900479 - DNA, 13 bp, Homo sapiens
aaaccacagcagg

SEQ ID NO: 900480 - DNA, 16 bp, Homo sapiens
aaaccacagccctgtc

SEQ ID NO: 900481 - DNA, 20 bp, Homo sapiens
aaaccacagctgggcagggt

SEQ ID NO: 900482 - DNA, 20 bp, Homo sapiens
aaaccacataatttttgtac

SEQ ID NO: 900483 - DNA, 16 bp, Homo sapiens
aaaccaccctctgggg

SEQ ID NO: 900484 - DNA, 13 bp, Homo sapiens
ccgcaccagctgc

SEQ ID NO: 900485 - DNA, 16 bp, Homo sapiens
ccgcaccagctgctct

SEQ ID NO: 900486 - DNA, 18 bp, Homo sapiens
ccgcaccagctgctctgc

SEQ ID NO: 900487 - DNA, 19 bp, Homo sapiens
ccgcaccagctgctctgcc

SEQ ID NO: 900488 - DNA, 17 bp, Homo sapiens
ccgcaccccagagtgtg

SEQ ID NO: 900489 - DNA, 15 bp, Homo sapiens
ccgcaccccatccca

SEQ ID NO: 900490 - DNA, 15 bp, Homo sapiens
ccgcacccccaccct

SEQ ID NO: 900491 - DNA, 13 bp, Homo sapiens
ccgcaccccccaa

SEQ ID NO: 900492 - DNA, 19 bp, Homo sapiens
ccgcacccccgccaggcgc

SEQ ID NO: 900493 - DNA, 13 bp, Homo sapiens
ccgcaccctgcac

SEQ ID NO: 900494 - DNA, 23 bp, Homo sapiens
ccgcaccctgcacctgctgcgtc

SEQ ID NO: 900495 - DNA, 22 bp, Homo sapiens
ccgcacctgtcggtggctgcct

SEQ ID NO: 900496 - DNA, 16 bp, Homo sapiens
ccgcaccttcctcctc

SEQ ID NO: 900497 - DNA, 20 bp, Homo sapiens
ccgcacgggctgtctgggtg

SEQ ID NO: 900498 - DNA, 14 bp, Homo sapiens
ccgcactaggggat

SEQ ID NO: 900499 - DNA, 14 bp, Homo sapiens
ccgcactctgcccc

SEQ ID NO: 900500 - DNA, 13 bp, Homo sapiens
ccgcagaagcagc

SEQ ID NO: 900501 - DNA, 14 bp, Homo sapiens
ccgcagaagcagcc

SEQ ID NO: 900502 - DNA, 17 bp, Homo sapiens
ccgcagaagcagcccct

SEQ ID NO: 900503 - DNA, 12 bp, Homo sapiens
ccgcagactgct

SEQ ID NO: 900504 - DNA, 14 bp, Homo sapiens
ccgcagactgcttg

SEQ ID NO: 900505 - DNA, 19 bp, Homo sapiens
ccgcagactgcttggccag

SEQ ID NO: 900506 - DNA, 21 bp, Homo sapiens
ccgcagactgcttggccagat

SEQ ID NO: 900507 - DNA, 15 bp, Homo sapiens
ccgcagagcccacgc

SEQ ID NO: 900508 - DNA, 14 bp, Homo sapiens
ccgcagcagctccc

SEQ ID NO: 900509 - DNA, 22 bp, Homo sapiens
ccgcagccagccggtgcctggc

SEQ ID NO: 900510 - DNA, 13 bp, Homo sapiens
ccgcagccccttt

SEQ ID NO: 900511 - DNA, 14 bp, Homo sapiens
ccgcagcctccctc

SEQ ID NO: 900512 - DNA, 18 bp, Homo sapiens
ccgcaggaactgggctgg

SEQ ID NO: 900513 - DNA, 20 bp, Homo sapiens
ccgcaggaactgggctgggc

SEQ ID NO: 900514 - DNA, 14 bp, Homo sapiens
ccgcaggagggagg

SEQ ID NO: 900515 - DNA, 22 bp, Homo sapiens
ccgcaggcagactacacaggat

SEQ ID NO: 900516 - DNA, 14 bp, Homo sapiens
ccgcagggccatgc

SEQ ID NO: 900517 - DNA, 21 bp, Homo sapiens
ccgcaggggtttgggtggggg

SEQ ID NO: 900518 - DNA, 20 bp, Homo sapiens
ccgcaggtgggtgctgccct

SEQ ID NO: 900519 - DNA, 21 bp, Homo sapiens
ccgcaggtgggtgctgccctg

SEQ ID NO: 900520 - DNA, 22 bp, Homo sapiens
ccgcaggtgggtgctgccctgt

SEQ ID NO: 900521 - DNA, 16 bp, Homo sapiens
ccgcagtccccagccc

SEQ ID NO: 900522 - DNA, 17 bp, Homo sapiens
ccgcagtccccagccct

SEQ ID NO: 900523 - DNA, 15 bp, Homo sapiens
ccgcataggcccagc

SEQ ID NO: 900524 - DNA, 22 bp, Homo sapiens
ccgcataggcccagccagggtg

SEQ ID NO: 900525 - DNA, 18 bp, Homo sapiens
ccgcatatgcatgccagg

SEQ ID NO: 900526 - DNA, 19 bp, Homo sapiens
ccgcatatgcatgccaggc

SEQ ID NO: 900527 - DNA, 23 bp, Homo sapiens
ccgcatatgcatgccaggctggg

SEQ ID NO: 900528 - DNA, 12 bp, Homo sapiens
ccgcatcttctc

SEQ ID NO: 900529 - DNA, 19 bp, Homo sapiens
ccgcatcttctccatctgg

SEQ ID NO: 900530 - DNA, 20 bp, Homo sapiens
ccgcatcttctccatctggc

SEQ ID NO: 900531 - DNA, 14 bp, Homo sapiens
ccgcatgtgtgcct

SEQ ID NO: 900532 - DNA, 20 bp, Homo sapiens
ccgcattcagtgcacctgcc

SEQ ID NO: 900533 - DNA, 15 bp, Homo sapiens
ccgcattccctgagt

SEQ ID NO: 900534 - DNA, 19 bp, Homo sapiens
ccgcattggaagagcccgc

SEQ ID NO: 900535 - DNA, 17 bp, Homo sapiens
ccgccaaggctggggga

SEQ ID NO: 900536 - DNA, 22 bp, Homo sapiens
ccgccacatggtgtggccatca

SEQ ID NO: 900537 - DNA, 17 bp, Homo sapiens
ccgccacccccatcttc

SEQ ID NO: 900538 - DNA, 14 bp, Homo sapiens
ccgccacctcaggg

SEQ ID NO: 900539 - DNA, 20 bp, Homo sapiens
ccgccactaggtgtccccaa

SEQ ID NO: 900540 - DNA, 21 bp, Homo sapiens
ccgccactcccgggccaagac

SEQ ID NO: 900541 - DNA, 19 bp, Homo sapiens
ccgccagaccccgtggctc

SEQ ID NO: 900542 - DNA, 19 bp, Homo sapiens
ccgccagccccgctcccac

SEQ ID NO: 900543 - DNA, 14 bp, Homo sapiens
ccgccagcctcagt

SEQ ID NO: 900544 - DNA, 15 bp, Homo sapiens
ccgccagcctcctct

SEQ ID NO: 900545 - DNA, 18 bp, Homo sapiens
ccgccagcctcctctgga

SEQ ID NO: 900546 - DNA, 12 bp, Homo sapiens
ccgccagcgtgt

SEQ ID NO: 900547 - DNA, 16 bp, Homo sapiens
ccgccagcgtgtggag

SEQ ID NO: 900548 - DNA, 17 bp, Homo sapiens
ccgccagcgtgtggagc

SEQ ID NO: 900549 - DNA, 22 bp, Homo sapiens
ccgccagcgtgtggagcagagc

SEQ ID NO: 900550 - DNA, 18 bp, Homo sapiens
ccgccaggcgcatgtctg

SEQ ID NO: 900551 - DNA, 23 bp, Homo sapiens
ccgccaggcgcatgtctgcacct

SEQ ID NO: 900552 - DNA, 13 bp, Homo sapiens
ccgccagggctgg

SEQ ID NO: 900553 - DNA, 16 bp, Homo sapiens
ccgccagggctgggga

SEQ ID NO: 900554 - DNA, 19 bp, Homo sapiens
ccgccatacattaaggagc

SEQ ID NO: 900555 - DNA, 15 bp, Homo sapiens
ccgccatagccccag

SEQ ID NO: 900556 - DNA, 21 bp, Homo sapiens
ccgccatccagggtctggcag

SEQ ID NO: 900557 - DNA, 14 bp, Homo sapiens
ccgccatctgcgca

SEQ ID NO: 900558 - DNA, 20 bp, Homo sapiens
ccgccatggggtcggctcct

SEQ ID NO: 900559 - DNA, 21 bp, Homo sapiens
ccgccatggggtcggctcctg

SEQ ID NO: 900560 - DNA, 17 bp, Homo sapiens
ccgccatggtgtcccgg

SEQ ID NO: 900561 - DNA, 14 bp, Homo sapiens
ccgccattgccacc

SEQ ID NO: 900562 - DNA, 15 bp, Homo sapiens
ccgccattgccacca

SEQ ID NO: 900563 - DNA, 13 bp, Homo sapiens
ccgcccaccccca

SEQ ID NO: 900564 - DNA, 20 bp, Homo sapiens
ccgcccacctcgctcccctc

SEQ ID NO: 900565 - DNA, 19 bp, Homo sapiens
ccgcccacgccggcctctg

SEQ ID NO: 900566 - DNA, 16 bp, Homo sapiens
ccgcccactgtcctgg

SEQ ID NO: 900567 - DNA, 19 bp, Homo sapiens
ccgcccactgtcctgggcg

SEQ ID NO: 900568 - DNA, 22 bp, Homo sapiens
ccgcccagctgcacctgccagc

SEQ ID NO: 900569 - DNA, 13 bp, Homo sapiens
ccgccccacctcc

SEQ ID NO: 900570 - DNA, 12 bp, Homo sapiens
ccgccccagagt

SEQ ID NO: 900571 - DNA, 13 bp, Homo sapiens
ccgcccccaccgg

SEQ ID NO: 900572 - DNA, 17 bp, Homo sapiens
ccgcccccaccgggctg

SEQ ID NO: 900573 - DNA, 13 bp, Homo sapiens
ccgcccccagcct

SEQ ID NO: 900574 - DNA, 19 bp, Homo sapiens
ccgcccccagtccccaccc

SEQ ID NO: 900575 - DNA, 17 bp, Homo sapiens
cagcccagcagtgtgga

SEQ ID NO: 900576 - DNA, 23 bp, Homo sapiens
cagcccagcagtgtggagaccct

SEQ ID NO: 900577 - DNA, 13 bp, Homo sapiens
cagcccagccagg

SEQ ID NO: 900578 - DNA, 14 bp, Homo sapiens
cagcccagccaggc

SEQ ID NO: 900579 - DNA, 23 bp, Homo sapiens
cagcccagccccgccccgttgtg

SEQ ID NO: 900580 - DNA, 13 bp, Homo sapiens
cagcccagcctgc

SEQ ID NO: 900581 - DNA, 14 bp, Homo sapiens
cagcccagcctgcc

SEQ ID NO: 900582 - DNA, 20 bp, Homo sapiens
cagcccagcctgccccctat

SEQ ID NO: 900583 - DNA, 23 bp, Homo sapiens
cagcccagcttggccctttcctt

SEQ ID NO: 900584 - DNA, 20 bp, Homo sapiens
cagcccaggatactggcaca

SEQ ID NO: 900585 - DNA, 22 bp, Homo sapiens
cagcccaggatactggcacaga

SEQ ID NO: 900586 - DNA, 19 bp, Homo sapiens
cagcccaggcatctccttg

SEQ ID NO: 900587 - DNA, 23 bp, Homo sapiens
cagcccaggccggggtggagcat

SEQ ID NO: 900588 - DNA, 12 bp, Homo sapiens
cagcccagggcc

SEQ ID NO: 900589 - DNA, 15 bp, Homo sapiens
cagcccagggcctgc

SEQ ID NO: 900590 - DNA, 16 bp, Homo sapiens
cagcccagggcctgca

SEQ ID NO: 900591 - DNA, 17 bp, Homo sapiens
cagcccagggttccccc

SEQ ID NO: 900592 - DNA, 21 bp, Homo sapiens
cagcccatccattaggccagc

SEQ ID NO: 900593 - DNA, 15 bp, Homo sapiens
cagcccatggccccc

SEQ ID NO: 900594 - DNA, 20 bp, Homo sapiens
cagcccatggcccccaataa

SEQ ID NO: 900595 - DNA, 21 bp, Homo sapiens
cagcccatggcccccaataaa

SEQ ID NO: 900596 - DNA, 23 bp, Homo sapiens
cagcccatggcccccaataaagg

SEQ ID NO: 900597 - DNA, 22 bp, Homo sapiens
cagcccattctctctcctgtcc

SEQ ID NO: 900598 - DNA, 14 bp, Homo sapiens
cagcccattgctgc

SEQ ID NO: 900599 - DNA, 15 bp, Homo sapiens
cagcccattgctgcc

SEQ ID NO: 900600 - DNA, 16 bp, Homo sapiens
cagcccattgctgcca

SEQ ID NO: 900601 - DNA, 22 bp, Homo sapiens
cagcccattggccgagctcctg

SEQ ID NO: 900602 - DNA, 23 bp, Homo sapiens
cagcccattggccgagctcctgg

SEQ ID NO: 900603 - DNA, 21 bp, Homo sapiens
cagccccaagcttctgagtct

SEQ ID NO: 900604 - DNA, 15 bp, Homo sapiens
cagccccacagtccc

SEQ ID NO: 900605 - DNA, 21 bp, Homo sapiens
cagccccacagtcccattcct

SEQ ID NO: 900606 - DNA, 13 bp, Homo sapiens
cagccccacccag

SEQ ID NO: 900607 - DNA, 21 bp, Homo sapiens
cagccccacccccagccaggc

SEQ ID NO: 900608 - DNA, 23 bp, Homo sapiens
cagccccacccccagccaggcta

SEQ ID NO: 900609 - DNA, 12 bp, Homo sapiens
cagccccactgc

SEQ ID NO: 900610 - DNA, 13 bp, Homo sapiens
cagccccactgcc

SEQ ID NO: 900611 - DNA, 14 bp, Homo sapiens
cagccccactgcca

SEQ ID NO: 900612 - DNA, 13 bp, Homo sapiens
cagccccacttct

SEQ ID NO: 900613 - DNA, 17 bp, Homo sapiens
cagccccagtcttcctt

SEQ ID NO: 900614 - DNA, 22 bp, Homo sapiens
cagccccatcgccccaactcca

SEQ ID NO: 900615 - DNA, 17 bp, Homo sapiens
cagcccccaccagggga

SEQ ID NO: 900616 - DNA, 13 bp, Homo sapiens
cagcccccactcc

SEQ ID NO: 900617 - DNA, 12 bp, Homo sapiens
cagcccccagcc

SEQ ID NO: 900618 - DNA, 16 bp, Homo sapiens
cagcccccagggcccc

SEQ ID NO: 900619 - DNA, 12 bp, Homo sapiens
cagcccccccac

SEQ ID NO: 900620 - DNA, 14 bp, Homo sapiens
cagcccccccaccc

SEQ ID NO: 900621 - DNA, 16 bp, Homo sapiens
cagcccccccacccac

SEQ ID NO: 900622 - DNA, 17 bp, Homo sapiens
cagcccccccacccacc

SEQ ID NO: 900623 - DNA, 20 bp, Homo sapiens
cagcccccccacccaccccc

SEQ ID NO: 900624 - DNA, 15 bp, Homo sapiens
cagcccccccctcaa

SEQ ID NO: 900625 - DNA, 19 bp, Homo sapiens
cagcccccccctcaagggg

SEQ ID NO: 900626 - DNA, 15 bp, Homo sapiens
cagcccccgccccag

SEQ ID NO: 900627 - DNA, 22 bp, Homo sapiens
cagcccccgcgccctccctccg

SEQ ID NO: 900628 - DNA, 17 bp, Homo sapiens
cagcccccgggacaccg

SEQ ID NO: 900629 - DNA, 11 bp, Homo sapiens
cagccccctcc

SEQ ID NO: 900630 - DNA, 15 bp, Homo sapiens
cagccccctccacac

SEQ ID NO: 900631 - DNA, 16 bp, Homo sapiens
cagccccctccacacc

SEQ ID NO: 900632 - DNA, 19 bp, Homo sapiens
cagcccccttgccctccgc

SEQ ID NO: 900633 - DNA, 20 bp, Homo sapiens
cagcccccttgccctccgcc

SEQ ID NO: 900634 - DNA, 15 bp, Homo sapiens
cagccccgactccag

SEQ ID NO: 900635 - DNA, 17 bp, Homo sapiens
cagccccgactccagcc

SEQ ID NO: 900636 - DNA, 20 bp, Homo sapiens
cagccccgactccagccagc

SEQ ID NO: 900637 - DNA, 17 bp, Homo sapiens
cagccccgacttcctga

SEQ ID NO: 900638 - DNA, 21 bp, Homo sapiens
cagccccgcgaccatgtggcc

SEQ ID NO: 900639 - DNA, 15 bp, Homo sapiens
cagccccgctcccag

SEQ ID NO: 900640 - DNA, 18 bp, Homo sapiens
cagccccgttttggggac

SEQ ID NO: 900641 - DNA, 15 bp, Homo sapiens
cagcccctaagcccc

SEQ ID NO: 900642 - DNA, 13 bp, Homo sapiens
cagcccctacccc

SEQ ID NO: 900643 - DNA, 18 bp, Homo sapiens
cagcccctacccctgccc

SEQ ID NO: 900644 - DNA, 15 bp, Homo sapiens
acctatctcgtggga

SEQ ID NO: 900645 - DNA, 14 bp, Homo sapiens
acctatgaagcaat

SEQ ID NO: 900646 - DNA, 15 bp, Homo sapiens
acctatgactttttt

SEQ ID NO: 900647 - DNA, 21 bp, Homo sapiens
acctatgagatggccatgctc

SEQ ID NO: 900648 - DNA, 15 bp, Homo sapiens
acctatgcagggagg

SEQ ID NO: 900649 - DNA, 12 bp, Homo sapiens
acctatgcctgt

SEQ ID NO: 900650 - DNA, 22 bp, Homo sapiens
acctatgcctgtggtgaagtgt

SEQ ID NO: 900651 - DNA, 18 bp, Homo sapiens
acctatggaagtggttct

SEQ ID NO: 900652 - DNA, 23 bp, Homo sapiens
acctatggaagtggttctatgtc

SEQ ID NO: 900653 - DNA, 22 bp, Homo sapiens
acctatggtataatggttgact

SEQ ID NO: 900654 - DNA, 12 bp, Homo sapiens
acctatgtactt

SEQ ID NO: 900655 - DNA, 22 bp, Homo sapiens
acctatgtcctaaggacacact

SEQ ID NO: 900656 - DNA, 23 bp, Homo sapiens
acctatgttattttgtgtacaag

SEQ ID NO: 900657 - DNA, 12 bp, Homo sapiens
acctattaggtg

SEQ ID NO: 900658 - DNA, 16 bp, Homo sapiens
acctattcaccctcca

SEQ ID NO: 900659 - DNA, 16 bp, Homo sapiens
acctatttccagaaat

SEQ ID NO: 900660 - DNA, 17 bp, Homo sapiens
acctatttccagaaata

SEQ ID NO: 900661 - DNA, 12 bp, Homo sapiens
acctatttccat

SEQ ID NO: 900662 - DNA, 17 bp, Homo sapiens
acctatttctgatgatg

SEQ ID NO: 900663 - DNA, 18 bp, Homo sapiens
acctatttctgatgatgt

SEQ ID NO: 900664 - DNA, 14 bp, Homo sapiens
acctatttgacata

SEQ ID NO: 900665 - DNA, 18 bp, Homo sapiens
acctattttcatttgtac

SEQ ID NO: 900666 - DNA, 15 bp, Homo sapiens
acctcaaagggcagt

SEQ ID NO: 900667 - DNA, 20 bp, Homo sapiens
acctcaaagggcagttttga

SEQ ID NO: 900668 - DNA, 21 bp, Homo sapiens
acctcaaagggcagttttgag

SEQ ID NO: 900669 - DNA, 16 bp, Homo sapiens
acctcaaccaatgcca

SEQ ID NO: 900670 - DNA, 21 bp, Homo sapiens
acctcaaccatcctggctgcg

SEQ ID NO: 900671 - DNA, 15 bp, Homo sapiens
acctcaacccagagg

SEQ ID NO: 900672 - DNA, 19 bp, Homo sapiens
acctcaacccccatttcta

SEQ ID NO: 900673 - DNA, 17 bp, Homo sapiens
acctcaactaaccctta

SEQ ID NO: 900674 - DNA, 22 bp, Homo sapiens
acctcaactaacccttaaaaat

SEQ ID NO: 900675 - DNA, 16 bp, Homo sapiens
acctcaactgcctact

SEQ ID NO: 900676 - DNA, 22 bp, Homo sapiens
acctcaactgcctactccaaaa

SEQ ID NO: 900677 - DNA, 14 bp, Homo sapiens
acctcaagaccccc

SEQ ID NO: 900678 - DNA, 13 bp, Homo sapiens
acctcaagccatc

SEQ ID NO: 900679 - DNA, 15 bp, Homo sapiens
acctcaagggggact

SEQ ID NO: 900680 - DNA, 15 bp, Homo sapiens
acctcaatgccctgc

SEQ ID NO: 900681 - DNA, 17 bp, Homo sapiens
acctcaatggaggtttg

SEQ ID NO: 900682 - DNA, 20 bp, Homo sapiens
acctcaatttttgtttttga

SEQ ID NO: 900683 - DNA, 23 bp, Homo sapiens
acctcacaaccgtacagtttctg

SEQ ID NO: 900684 - DNA, 16 bp, Homo sapiens
acctcacacacggctg

SEQ ID NO: 900685 - DNA, 14 bp, Homo sapiens
acctcaccaaacta

SEQ ID NO: 900686 - DNA, 19 bp, Homo sapiens
acctcaccattgtgaagca

SEQ ID NO: 900687 - DNA, 18 bp, Homo sapiens
acctcacccttgcaccgt

SEQ ID NO: 900688 - DNA, 14 bp, Homo sapiens
acctcactcctgtt

SEQ ID NO: 900689 - DNA, 22 bp, Homo sapiens
acctcactgagaggcctggagc

SEQ ID NO: 900690 - DNA, 21 bp, Homo sapiens
acctcactgggcctttccaga

SEQ ID NO: 900691 - DNA, 14 bp, Homo sapiens
acctcactgtcagg

SEQ ID NO: 900692 - DNA, 23 bp, Homo sapiens
acctcagaaagtcaccaggactt

SEQ ID NO: 900693 - DNA, 14 bp, Homo sapiens
acctcagccatgag

SEQ ID NO: 900694 - DNA, 14 bp, Homo sapiens
acctcagcctggag

SEQ ID NO: 900695 - DNA, 20 bp, Homo sapiens
acctcagcctggagaggcct

SEQ ID NO: 900696 - DNA, 12 bp, Homo sapiens
acctcagcctgt

SEQ ID NO: 900697 - DNA, 14 bp, Homo sapiens
acctcagccttgga

SEQ ID NO: 900698 - DNA, 15 bp, Homo sapiens
acctcagctctggga

SEQ ID NO: 900699 - DNA, 16 bp, Homo sapiens
acctcagctgcacatt

SEQ ID NO: 900700 - DNA, 19 bp, Homo sapiens
acctcagctgcacattcct

SEQ ID NO: 900701 - DNA, 20 bp, Homo sapiens
acctcagctgcacattcctg

SEQ ID NO: 900702 - DNA, 22 bp, Homo sapiens
acctcagctgcacattcctggc

SEQ ID NO: 900703 - DNA, 15 bp, Homo sapiens
acctcaggagggcag

SEQ ID NO: 900704 - DNA, 19 bp, Homo sapiens
acctcaggcttccttggca

SEQ ID NO: 900705 - DNA, 17 bp, Homo sapiens
agcatcctgagccccgc

SEQ ID NO: 900706 - DNA, 23 bp, Homo sapiens
agcatcctgagccccgccctctt

SEQ ID NO: 900707 - DNA, 19 bp, Homo sapiens
agcatccttttctgcagag

SEQ ID NO: 900708 - DNA, 19 bp, Homo sapiens
agcatcgggagcacccaga

SEQ ID NO: 900709 - DNA, 21 bp, Homo sapiens
agcatcgggagcacccagagc

SEQ ID NO: 900710 - DNA, 22 bp, Homo sapiens
agcatcgtgacccttcagggcc

SEQ ID NO: 900711 - DNA, 15 bp, Homo sapiens
agcatctacttcagg

SEQ ID NO: 900712 - DNA, 20 bp, Homo sapiens
agcatctcagcctaccatga

SEQ ID NO: 900713 - DNA, 22 bp, Homo sapiens
agcatctcttcttccctgtcag

SEQ ID NO: 900714 - DNA, 14 bp, Homo sapiens
agcatctgcaacaa

SEQ ID NO: 900715 - DNA, 20 bp, Homo sapiens
agcatctggctgtctagaat

SEQ ID NO: 900716 - DNA, 23 bp, Homo sapiens
agcatctggctgtctagaatgtg

SEQ ID NO: 900717 - DNA, 12 bp, Homo sapiens
agcatcttctgg

SEQ ID NO: 900718 - DNA, 15 bp, Homo sapiens
agcatcttctggagt

SEQ ID NO: 900719 - DNA, 18 bp, Homo sapiens
agcatcttgccagcctca

SEQ ID NO: 900720 - DNA, 13 bp, Homo sapiens
agcatgaaaaagc

SEQ ID NO: 900721 - DNA, 15 bp, Homo sapiens
agcatgaataaaaca

SEQ ID NO: 900722 - DNA, 20 bp, Homo sapiens
agcatgaataaaacactcat

SEQ ID NO: 900723 - DNA, 13 bp, Homo sapiens
agcatgacaaaaa

SEQ ID NO: 900724 - DNA, 16 bp, Homo sapiens
agcatgacaaaaataa

SEQ ID NO: 900725 - DNA, 15 bp, Homo sapiens
agcatgacaactttt

SEQ ID NO: 900726 - DNA, 21 bp, Homo sapiens
agcatgacaacttttaaagaa

SEQ ID NO: 900727 - DNA, 22 bp, Homo sapiens
agcatgacaagccccaggcagg

SEQ ID NO: 900728 - DNA, 20 bp, Homo sapiens
agcatgacagcctgcagcag

SEQ ID NO: 900729 - DNA, 20 bp, Homo sapiens
agcatgagttatctgatttt

SEQ ID NO: 900730 - DNA, 20 bp, Homo sapiens
agcatgatcttgttactgtg

SEQ ID NO: 900731 - DNA, 19 bp, Homo sapiens
agcatgattttaagaggct

SEQ ID NO: 900732 - DNA, 12 bp, Homo sapiens
agcatgcaagct

SEQ ID NO: 900733 - DNA, 17 bp, Homo sapiens
agcatgcacagctgctt

SEQ ID NO: 900734 - DNA, 16 bp, Homo sapiens
agcatgcccagattcc

SEQ ID NO: 900735 - DNA, 20 bp, Homo sapiens
agcatgcccagattcccaga

SEQ ID NO: 900736 - DNA, 18 bp, Homo sapiens
agcatgcggagccagcag

SEQ ID NO: 900737 - DNA, 20 bp, Homo sapiens
agcatgcggagccagcaggc

SEQ ID NO: 900738 - DNA, 19 bp, Homo sapiens
agcatgcttcctttctctc

SEQ ID NO: 900739 - DNA, 20 bp, Homo sapiens
agcatgcttcctttctctcc

SEQ ID NO: 900740 - DNA, 15 bp, Homo sapiens
agcatgcttgggctg

SEQ ID NO: 900741 - DNA, 16 bp, Homo sapiens
agcatgcttgggctga

SEQ ID NO: 900742 - DNA, 20 bp, Homo sapiens
agcatgcttgggctgaccca

SEQ ID NO: 900743 - DNA, 14 bp, Homo sapiens
agcatgctttgctg

SEQ ID NO: 900744 - DNA, 16 bp, Homo sapiens
agcatgctttgctgct

SEQ ID NO: 900745 - DNA, 18 bp, Homo sapiens
agcatgctttgctgctat

SEQ ID NO: 900746 - DNA, 16 bp, Homo sapiens
agcatggactctgggt

SEQ ID NO: 900747 - DNA, 20 bp, Homo sapiens
agcatggcatagccccggcc

SEQ ID NO: 900748 - DNA, 17 bp, Homo sapiens
agcatggctattttata

SEQ ID NO: 900749 - DNA, 22 bp, Homo sapiens
agcatggctgtctgcacagagg

SEQ ID NO: 900750 - DNA, 14 bp, Homo sapiens
agcatgggcctggc

SEQ ID NO: 900751 - DNA, 19 bp, Homo sapiens
agcatgggcctggccacct

SEQ ID NO: 900752 - DNA, 15 bp, Homo sapiens
agcatggggcccctg

SEQ ID NO: 900753 - DNA, 13 bp, Homo sapiens
agcatggggtcag

SEQ ID NO: 900754 - DNA, 19 bp, Homo sapiens
agcatgggtccaagagaca

SEQ ID NO: 900755 - DNA, 16 bp, Homo sapiens
agcatggtccctgcct

SEQ ID NO: 900756 - DNA, 13 bp, Homo sapiens
agcatgtaatggt

SEQ ID NO: 900757 - DNA, 21 bp, Homo sapiens
agcatgtaatgttaatgttat

SEQ ID NO: 900758 - DNA, 20 bp, Homo sapiens
agcatgtacggattttcagt

SEQ ID NO: 900759 - DNA, 21 bp, Homo sapiens
agcatgtacggattttcagtt

SEQ ID NO: 900760 - DNA, 15 bp, Homo sapiens
agcatgtatgtctgc

SEQ ID NO: 900761 - DNA, 20 bp, Homo sapiens
agcatgtatttttgtcaatt

SEQ ID NO: 900762 - DNA, 15 bp, Homo sapiens
agcatgtctctctgc

SEQ ID NO: 900763 - DNA, 17 bp, Homo sapiens
agcatgtctctctgcca

SEQ ID NO: 900764 - DNA, 15 bp, Homo sapiens
agcatgtctctgctt

SEQ ID NO: 900765 - DNA, 16 bp, Homo sapiens
agcatgtctctgcttc

SEQ ID NO: 900766 - DNA, 20 bp, Homo sapiens
agcatgtctctgcttccatg

SEQ ID NO: 900767 - DNA, 23 bp, Homo sapiens
agcatgtctctgcttccatggct

SEQ ID NO: 900768 - DNA, 19 bp, Homo sapiens
agcatgtgtatttccagtg

SEQ ID NO: 900769 - DNA, 14 bp, Homo sapiens
agcatgtttcatgt

SEQ ID NO: 900770 - DNA, 17 bp, Homo sapiens
agcatgtttcatgtttt

SEQ ID NO: 900771 - DNA, 18 bp, Homo sapiens
agcatgtttcatgttttg

SEQ ID NO: 900772 - DNA, 14 bp, Homo sapiens
agcattaactaatc

SEQ ID NO: 900773 - DNA, 18 bp, Homo sapiens
agcattaacttctctgga

SEQ ID NO: 900774 - DNA, 13 bp, Homo sapiens
agcattacattat

SEQ ID NO: 900775 - DNA, 21 bp, Homo sapiens
agcattacattattaaacgat

SEQ ID NO: 900776 - DNA, 19 bp, Homo sapiens
agcattactctttttcaat

SEQ ID NO: 900777 - DNA, 14 bp, Homo sapiens
agcattaggctttt

SEQ ID NO: 900778 - DNA, 21 bp, Homo sapiens
agcattaggcttttaagaaac

SEQ ID NO: 900779 - DNA, 16 bp, Homo sapiens
agcattatgcaattag

SEQ ID NO: 900780 - DNA, 17 bp, Homo sapiens
agcattcagaagaaaaa

SEQ ID NO: 900781 - DNA, 19 bp, Homo sapiens
agcattcagaagaaaaaga

SEQ ID NO: 900782 - DNA, 16 bp, Homo sapiens
agcattcagagagcag

SEQ ID NO: 900783 - DNA, 17 bp, Homo sapiens
agcattcagagagcagc

SEQ ID NO: 900784 - DNA, 20 bp, Homo sapiens
agcattcaggcagcactgac

SEQ ID NO: 900785 - DNA, 13 bp, Homo sapiens
agcattccagctc

SEQ ID NO: 900786 - DNA, 17 bp, Homo sapiens
agcattccagctctgcc

SEQ ID NO: 900787 - DNA, 18 bp, Homo sapiens
agcattccagctctgccc

SEQ ID NO: 900788 - DNA, 15 bp, Homo sapiens
agcattccagtaact

SEQ ID NO: 900789 - DNA, 17 bp, Homo sapiens
agcattccagtaacttt

SEQ ID NO: 900790 - DNA, 14 bp, Homo sapiens
agcattcccaccaa

SEQ ID NO: 900791 - DNA, 18 bp, Homo sapiens
agcattctcactcctacc

SEQ ID NO: 900792 - DNA, 22 bp, Homo sapiens
agcattctcactcctacctggt

SEQ ID NO: 900793 - DNA, 17 bp, Homo sapiens
agcattctgagctgggc

SEQ ID NO: 900794 - DNA, 18 bp, Homo sapiens
agcattctggaggggaga

SEQ ID NO: 900795 - DNA, 16 bp, Homo sapiens
agcattcttgtcacaa

SEQ ID NO: 900796 - DNA, 15 bp, Homo sapiens
agcattctttaacag

SEQ ID NO: 900797 - DNA, 19 bp, Homo sapiens
agcattctttggagttaaa

SEQ ID NO: 900798 - DNA, 22 bp, Homo sapiens
agcattctttggagttaaaatg

SEQ ID NO: 900799 - DNA, 22 bp, Homo sapiens
agcattgaacatttcttatgat

SEQ ID NO: 900800 - DNA, 13 bp, Homo sapiens
agcattgaagaga

SEQ ID NO: 900801 - DNA, 15 bp, Homo sapiens
agcattgaatggcta

SEQ ID NO: 900802 - DNA, 16 bp, Homo sapiens
agcattgataatcttc

SEQ ID NO: 900803 - DNA, 20 bp, Homo sapiens
agcattgataatcttcaggt

SEQ ID NO: 900804 - DNA, 14 bp, Homo sapiens
agcattgctggttc

SEQ ID NO: 900805 - DNA, 15 bp, Homo sapiens
agcattgctggttct

SEQ ID NO: 900806 - DNA, 11 bp, Homo sapiens
agcattgcttt

SEQ ID NO: 900807 - DNA, 13 bp, Homo sapiens
agcattgctttct

SEQ ID NO: 900808 - DNA, 14 bp, Homo sapiens
agcattgtaaaata

SEQ ID NO: 900809 - DNA, 13 bp, Homo sapiens
agcattgtctctc

SEQ ID NO: 900810 - DNA, 16 bp, Homo sapiens
agcattgtctttgctg

SEQ ID NO: 900811 - DNA, 18 bp, Homo sapiens
agcattgtctttgctgta

SEQ ID NO: 900812 - DNA, 15 bp, Homo sapiens
agcattgttccacac

SEQ ID NO: 900813 - DNA, 23 bp, Homo sapiens
agcattgtttgcttattgttcca

SEQ ID NO: 900814 - DNA, 22 bp, Homo sapiens
agcatttaacccccctgtacac

SEQ ID NO: 900815 - DNA, 20 bp, Homo sapiens
agcatttaatggcagctagt

SEQ ID NO: 900816 - DNA, 17 bp, Homo sapiens
agcatttagcacaattt

SEQ ID NO: 900817 - DNA, 18 bp, Homo sapiens
agcatttagcacaatttg

SEQ ID NO: 900818 - DNA, 18 bp, Homo sapiens
agcatttagtcttgccag

SEQ ID NO: 900819 - DNA, 13 bp, Homo sapiens
agcatttatttct

SEQ ID NO: 900820 - DNA, 18 bp, Homo sapiens
agcatttcaaagccctgc

SEQ ID NO: 900821 - DNA, 19 bp, Homo sapiens
agcatttcaaagccctgcc

SEQ ID NO: 900822 - DNA, 20 bp, Homo sapiens
agcatttcaaagccctgcct

SEQ ID NO: 900823 - DNA, 14 bp, Homo sapiens
agcatttcatgaaa

SEQ ID NO: 900824 - DNA, 14 bp, Homo sapiens
agcatttccaacac

SEQ ID NO: 900825 - DNA, 17 bp, Homo sapiens
agcatttccaacaccac

SEQ ID NO: 900826 - DNA, 18 bp, Homo sapiens
agcatttccaacaccaca

SEQ ID NO: 900827 - DNA, 19 bp, Homo sapiens
agccaccccgggctctctg

SEQ ID NO: 900828 - DNA, 14 bp, Homo sapiens
agccacccctgcca

SEQ ID NO: 900829 - DNA, 16 bp, Homo sapiens
agccacccctgccact

SEQ ID NO: 900830 - DNA, 14 bp, Homo sapiens
agccaccgctgcca

SEQ ID NO: 900831 - DNA, 15 bp, Homo sapiens
agccaccgtgcctgg

SEQ ID NO: 900832 - DNA, 17 bp, Homo sapiens
agccaccgtgcctggcc

SEQ ID NO: 900833 - DNA, 19 bp, Homo sapiens
agccaccgtgcctggccag

SEQ ID NO: 900834 - DNA, 21 bp, Homo sapiens
agccaccgtgcctggccagat

SEQ ID NO: 900835 - DNA, 14 bp, Homo sapiens
agccacctccgcca

SEQ ID NO: 900836 - DNA, 18 bp, Homo sapiens
agccacctccgccagacc

SEQ ID NO: 900837 - DNA, 14 bp, Homo sapiens
agccacctgcaaga

SEQ ID NO: 900838 - DNA, 19 bp, Homo sapiens
agccacctgcaagatggac

SEQ ID NO: 900839 - DNA, 17 bp, Homo sapiens
agccacctgggaacaca

SEQ ID NO: 900840 - DNA, 18 bp, Homo sapiens
agccacctgggaacacag

SEQ ID NO: 900841 - DNA, 15 bp, Homo sapiens
agccaccttgttaca

SEQ ID NO: 900842 - DNA, 15 bp, Homo sapiens
agccacgattggaga

SEQ ID NO: 900843 - DNA, 22 bp, Homo sapiens
agccacgcctatgccctgccct

SEQ ID NO: 900844 - DNA, 14 bp, Homo sapiens
agccacgctgtcct

SEQ ID NO: 900845 - DNA, 18 bp, Homo sapiens
agccacgctgtcctctcg

SEQ ID NO: 900846 - DNA, 19 bp, Homo sapiens
agccacggagggaggcacc

SEQ ID NO: 900847 - DNA, 17 bp, Homo sapiens
agccacgttccttactg

SEQ ID NO: 900848 - DNA, 21 bp, Homo sapiens
agccacgttccttactgcaga

SEQ ID NO: 900849 - DNA, 23 bp, Homo sapiens
agccacgttccttactgcagaat

SEQ ID NO: 900850 - DNA, 19 bp, Homo sapiens
agccactaaccttgcctgg

SEQ ID NO: 900851 - DNA, 20 bp, Homo sapiens
agccactaaccttgcctggt

SEQ ID NO: 900852 - DNA, 22 bp, Homo sapiens
agccactcaggaggctgaggca

SEQ ID NO: 900853 - DNA, 15 bp, Homo sapiens
agccactccaagccc

SEQ ID NO: 900854 - DNA, 18 bp, Homo sapiens
agccactccaagccccct

SEQ ID NO: 900855 - DNA, 21 bp, Homo sapiens
agccactccaagccccctggc

SEQ ID NO: 900856 - DNA, 22 bp, Homo sapiens
agccactccaagccccctggca

SEQ ID NO: 900857 - DNA, 23 bp, Homo sapiens
agccactccaagccccctggcag

SEQ ID NO: 900858 - DNA, 12 bp, Homo sapiens
agccactccagg

SEQ ID NO: 900859 - DNA, 17 bp, Homo sapiens
agccactccctcccaga

SEQ ID NO: 900860 - DNA, 14 bp, Homo sapiens
agccactcctctga

SEQ ID NO: 900861 - DNA, 19 bp, Homo sapiens
agccactcctgtcccgcct

SEQ ID NO: 900862 - DNA, 21 bp, Homo sapiens
agccactccttccttcaggac

SEQ ID NO: 900863 - DNA, 13 bp, Homo sapiens
agccactgaagct

SEQ ID NO: 900864 - DNA, 14 bp, Homo sapiens
agccactgggcccc

SEQ ID NO: 900865 - DNA, 15 bp, Homo sapiens
agccactgggcccct

SEQ ID NO: 900866 - DNA, 20 bp, Homo sapiens
agccactgggcccctgtccc

SEQ ID NO: 900867 - DNA, 15 bp, Homo sapiens
agccacttctcccca

SEQ ID NO: 900868 - DNA, 13 bp, Homo sapiens
agccagaaagggt

SEQ ID NO: 900869 - DNA, 17 bp, Homo sapiens
agccagaaatgggcagt

SEQ ID NO: 900870 - DNA, 20 bp, Homo sapiens
agccagaaatgggcagttct

SEQ ID NO: 900871 - DNA, 16 bp, Homo sapiens
agccagacactctgct

SEQ ID NO: 900872 - DNA, 19 bp, Homo sapiens
agccagacctagcaggctg

SEQ ID NO: 900873 - DNA, 14 bp, Homo sapiens
agccagactctggt

SEQ ID NO: 900874 - DNA, 15 bp, Homo sapiens
agccagagagacaga

SEQ ID NO: 900875 - DNA, 13 bp, Homo sapiens
agccagagcccca

SEQ ID NO: 900876 - DNA, 20 bp, Homo sapiens
agccagagccccaagcagga

SEQ ID NO: 900877 - DNA, 15 bp, Homo sapiens
agccagagcctgggg

SEQ ID NO: 900878 - DNA, 13 bp, Homo sapiens
agccagagctggg

SEQ ID NO: 900879 - DNA, 16 bp, Homo sapiens
agccagagctgtgcct

SEQ ID NO: 900880 - DNA, 17 bp, Homo sapiens
agccagaggagggcaga

SEQ ID NO: 900881 - DNA, 19 bp, Homo sapiens
agccagagggtgggagcct

SEQ ID NO: 900882 - DNA, 22 bp, Homo sapiens
agccagagggtgggagcctaag

SEQ ID NO: 900883 - DNA, 18 bp, Homo sapiens
agccagatttgtcttttt

SEQ ID NO: 900884 - DNA, 23 bp, Homo sapiens
agccagattttttaaaatttata

SEQ ID NO: 900885 - DNA, 20 bp, Homo sapiens
agccagcacttgtccagctg

SEQ ID NO: 900886 - DNA, 21 bp, Homo sapiens
agccagcacttgtccagctga

SEQ ID NO: 900887 - DNA, 18 bp, Homo sapiens
agccagcagcagcccaag

SEQ ID NO: 900888 - DNA, 20 bp, Homo sapiens
agccagcagccagctctcag

SEQ ID NO: 900889 - DNA, 16 bp, Homo sapiens
agccagcagctgaagt

SEQ ID NO: 900890 - DNA, 19 bp, Homo sapiens
agccagcattcagcacaca

SEQ ID NO: 900891 - DNA, 24 bp, Homo sapiens
agccagccaagctttaaattatgt

SEQ ID NO: 900892 - DNA, 14 bp, Homo sapiens
agccagccacccct

SEQ ID NO: 900893 - DNA, 19 bp, Homo sapiens
agccagcccaaaccttggg

SEQ ID NO: 900894 - DNA, 17 bp, Homo sapiens
agccagcccagcccagc

SEQ ID NO: 900895 - DNA, 18 bp, Homo sapiens
agccagcccagcccagct

SEQ ID NO: 900896 - DNA, 23 bp, Homo sapiens
agccagcccatggcccccaataa

SEQ ID NO: 900897 - DNA, 17 bp, Homo sapiens
agccagccccctccagc

SEQ ID NO: 900898 - DNA, 20 bp, Homo sapiens
agccagccccctccagctca

SEQ ID NO: 900899 - DNA, 20 bp, Homo sapiens
agccagccctccctgtcctc

SEQ ID NO: 900900 - DNA, 18 bp, Homo sapiens
agccagccctggcccacc

SEQ ID NO: 900901 - DNA, 19 bp, Homo sapiens
agccagcccttccctggcc

SEQ ID NO: 900902 - DNA, 15 bp, Homo sapiens
agccagccgccctgg

SEQ ID NO: 900903 - DNA, 16 bp, Homo sapiens
agccagccgccctggg

SEQ ID NO: 900904 - DNA, 21 bp, Homo sapiens
agccagccgccctgggctgtc

SEQ ID NO: 900905 - DNA, 22 bp, Homo sapiens
agccagccgccctgggctgtct

SEQ ID NO: 900906 - DNA, 18 bp, Homo sapiens
agccagccggtgcctggc

SEQ ID NO: 900907 - DNA, 16 bp, Homo sapiens
agccagcctcagaagg

SEQ ID NO: 900908 - DNA, 18 bp, Homo sapiens
agccagcctgaccttcct

SEQ ID NO: 900909 - DNA, 12 bp, Homo sapiens
agccagcctggc

SEQ ID NO: 900910 - DNA, 13 bp, Homo sapiens
agccagcctggga

SEQ ID NO: 900911 - DNA, 16 bp, Homo sapiens
agccagcctgggactc

SEQ ID NO: 900912 - DNA, 20 bp, Homo sapiens
agccagcctgggactcccag

SEQ ID NO: 900913 - DNA, 15 bp, Homo sapiens
agccagccttcccca

SEQ ID NO: 900914 - DNA, 19 bp, Homo sapiens
agccagcgcctccctccac

SEQ ID NO: 900915 - DNA, 21 bp, Homo sapiens
agccagcgcctccctccaccc

SEQ ID NO: 900916 - DNA, 22 bp, Homo sapiens
agccagcgcctccctccacccc

SEQ ID NO: 900917 - DNA, 18 bp, Homo sapiens
agccagcgtcctcctctg

SEQ ID NO: 900918 - DNA, 21 bp, Homo sapiens
agccagctcacagtgctgtgt

SEQ ID NO: 900919 - DNA, 15 bp, Homo sapiens
agccagctccctcta

SEQ ID NO: 900920 - DNA, 17 bp, Homo sapiens
agccagctccctctatt

SEQ ID NO: 900921 - DNA, 19 bp, Homo sapiens
agccagctccctctattta

SEQ ID NO: 900922 - DNA, 22 bp, Homo sapiens
agccagctccctctatttatgt

SEQ ID NO: 900923 - DNA, 13 bp, Homo sapiens
agccagctctcag

SEQ ID NO: 900924 - DNA, 16 bp, Homo sapiens
agccagctctgcatta

SEQ ID NO: 900925 - DNA, 17 bp, Homo sapiens
agccagctgcagggcac

SEQ ID NO: 900926 - DNA, 20 bp, Homo sapiens
agccagctgccgaccagagc

SEQ ID NO: 900927 - DNA, 22 bp, Homo sapiens
agccaggacccgcctgctccca

SEQ ID NO: 900928 - DNA, 15 bp, Homo sapiens
agccaggagaagctc

SEQ ID NO: 900929 - DNA, 13 bp, Homo sapiens
agccaggagcaaa

SEQ ID NO: 900930 - DNA, 23 bp, Homo sapiens
agccaggagcaaatgtttctgca

SEQ ID NO: 900931 - DNA, 12 bp, Homo sapiens
agccaggagcag

SEQ ID NO: 900932 - DNA, 13 bp, Homo sapiens
agccaggagcaga

SEQ ID NO: 900933 - DNA, 16 bp, Homo sapiens
agccaggaggcctgct

SEQ ID NO: 900934 - DNA, 19 bp, Homo sapiens
agccaggatgcccagatga

SEQ ID NO: 900935 - DNA, 18 bp, Homo sapiens
agccaggccaacagcacc

SEQ ID NO: 900936 - DNA, 10 bp, Homo sapiens
agccaggccc

SEQ ID NO: 900937 - DNA, 11 bp, Homo sapiens
agccaggccca

SEQ ID NO: 900938 - DNA, 17 bp, Homo sapiens
agccaggcccaggccag

SEQ ID NO: 900939 - DNA, 20 bp, Homo sapiens
agccaggcccaggccagccc

SEQ ID NO: 900940 - DNA, 12 bp, Homo sapiens
agccaggcctgg

SEQ ID NO: 900941 - DNA, 15 bp, Homo sapiens
agccaggcgggctca

SEQ ID NO: 900942 - DNA, 18 bp, Homo sapiens
agccaggcgggctcaagg

SEQ ID NO: 900943 - DNA, 21 bp, Homo sapiens
agccaggctatggttgccacc

SEQ ID NO: 900944 - DNA, 20 bp, Homo sapiens
agccaggctctccgggcctt

SEQ ID NO: 900945 - DNA, 22 bp, Homo sapiens
agccaggctgggccgcaagggc

SEQ ID NO: 900946 - DNA, 18 bp, Homo sapiens
agccaggcttggatggaa

SEQ ID NO: 900947 - DNA, 17 bp, Homo sapiens
agccagggcagaggaat

SEQ ID NO: 900948 - DNA, 12 bp, Homo sapiens
agccagggccag

SEQ ID NO: 900949 - DNA, 22 bp, Homo sapiens
agcccccaccttgatcccaatc

SEQ ID NO: 900950 - DNA, 19 bp, Homo sapiens
agcccccagatagagctgg

SEQ ID NO: 900951 - DNA, 17 bp, Homo sapiens
agcccccagccctggga

SEQ ID NO: 900952 - DNA, 12 bp, Homo sapiens
agcccccagcct

SEQ ID NO: 900953 - DNA, 18 bp, Homo sapiens
agcccccagccttgtttc

SEQ ID NO: 900954 - DNA, 13 bp, Homo sapiens
agcccccaggatc

SEQ ID NO: 900955 - DNA, 11 bp, Homo sapiens
agcccccaggc

SEQ ID NO: 900956 - DNA, 17 bp, Homo sapiens
agcccccaggctgctgg

SEQ ID NO: 900957 - DNA, 20 bp, Homo sapiens
agcccccccaacactgtgcc

SEQ ID NO: 900958 - DNA, 13 bp, Homo sapiens
agcccccccaccc

SEQ ID NO: 900959 - DNA, 21 bp, Homo sapiens
agcccccccacccacccccag

SEQ ID NO: 900960 - DNA, 22 bp, Homo sapiens
agccccccccttgaatctgcag

SEQ ID NO: 900961 - DNA, 13 bp, Homo sapiens
agcccccccttcc

SEQ ID NO: 900962 - DNA, 14 bp, Homo sapiens
agcccccctttggc

SEQ ID NO: 900963 - DNA, 23 bp, Homo sapiens
agcccccgccccgccccacattc

SEQ ID NO: 900964 - DNA, 20 bp, Homo sapiens
agcccccgggccgctggctg

SEQ ID NO: 900965 - DNA, 17 bp, Homo sapiens
agccccctccacaccag

SEQ ID NO: 900966 - DNA, 16 bp, Homo sapiens
agccccctccagctca

SEQ ID NO: 900967 - DNA, 14 bp, Homo sapiens
agccccctcttcct

SEQ ID NO: 900968 - DNA, 15 bp, Homo sapiens
agccccctcttcctc

SEQ ID NO: 900969 - DNA, 16 bp, Homo sapiens
agccccctcttcctcc

SEQ ID NO: 900970 - DNA, 19 bp, Homo sapiens
agccccctggatgtcccct

SEQ ID NO: 900971 - DNA, 14 bp, Homo sapiens
agccccctggcagc

SEQ ID NO: 900972 - DNA, 15 bp, Homo sapiens
agccccctggcagct

SEQ ID NO: 900973 - DNA, 19 bp, Homo sapiens
agccccctggcagctgccc

SEQ ID NO: 900974 - DNA, 16 bp, Homo sapiens
agcccccttctccatg

SEQ ID NO: 900975 - DNA, 14 bp, Homo sapiens
agccccgactccag

SEQ ID NO: 900976 - DNA, 20 bp, Homo sapiens
agccccgactccagccagcg

SEQ ID NO: 900977 - DNA, 21 bp, Homo sapiens
agccccgactccagccagcgc

SEQ ID NO: 900978 - DNA, 15 bp, Homo sapiens
agccccgacttcctg

SEQ ID NO: 900979 - DNA, 19 bp, Homo sapiens
agccccgccccagccctca

SEQ ID NO: 900980 - DNA, 15 bp, Homo sapiens
agccccgccctcttc

SEQ ID NO: 900981 - DNA, 19 bp, Homo sapiens
agccccgccctcttcctga

SEQ ID NO: 900982 - DNA, 20 bp, Homo sapiens
agccccgcctgtcacaataa

SEQ ID NO: 900983 - DNA, 15 bp, Homo sapiens
agccccgcgcctcct

SEQ ID NO: 900984 - DNA, 18 bp, Homo sapiens
agccccgcgcctccttcc

SEQ ID NO: 900985 - DNA, 15 bp, Homo sapiens
agccccggcaagcca

SEQ ID NO: 900986 - DNA, 22 bp, Homo sapiens
agccccggcaagccacaggaag

SEQ ID NO: 900987 - DNA, 16 bp, Homo sapiens
agccccgttttgggga

SEQ ID NO: 900988 - DNA, 12 bp, Homo sapiens
agcccctacccc

SEQ ID NO: 900989 - DNA, 17 bp, Homo sapiens
agcccctaccccacacc

SEQ ID NO: 900990 - DNA, 21 bp, Homo sapiens
agcccctaccccacaccaggc

SEQ ID NO: 900991 - DNA, 14 bp, Homo sapiens
agcccctacccctg

SEQ ID NO: 900992 - DNA, 16 bp, Homo sapiens
agcccctacccctgcc

SEQ ID NO: 900993 - DNA, 17 bp, Homo sapiens
agcccctacccctgccc

SEQ ID NO: 900994 - DNA, 19 bp, Homo sapiens
agcccctacccctgccctg

SEQ ID NO: 900995 - DNA, 20 bp, Homo sapiens
agcccctacccctgccctgc

SEQ ID NO: 900996 - DNA, 17 bp, Homo sapiens
agcccctactgctgtga

SEQ ID NO: 900997 - DNA, 18 bp, Homo sapiens
agcccctagaaacccaag

SEQ ID NO: 900998 - DNA, 18 bp, Homo sapiens
agcccctatagcactgag

SEQ ID NO: 900999 - DNA, 16 bp, Homo sapiens
agcccctcagcccttg

SEQ ID NO: 901000 - DNA, 21 bp, Homo sapiens
agcccctcagcccttgccccc

SEQ ID NO: 901001 - DNA, 13 bp, Homo sapiens
agcccctcccacc

SEQ ID NO: 901002 - DNA, 17 bp, Homo sapiens
agcccctcccaccacag

SEQ ID NO: 901003 - DNA, 23 bp, Homo sapiens
agcccctcccaccacagcaggtg

SEQ ID NO: 901004 - DNA, 12 bp, Homo sapiens
agcccctcccca

SEQ ID NO: 901005 - DNA, 14 bp, Homo sapiens
agcccctccccagc

SEQ ID NO: 901006 - DNA, 20 bp, Homo sapiens
agcccctcctccagcccctg

SEQ ID NO: 901007 - DNA, 21 bp, Homo sapiens
agcccctcctccagcccctgt

SEQ ID NO: 901008 - DNA, 14 bp, Homo sapiens
agcccctcctcccc

SEQ ID NO: 901009 - DNA, 14 bp, Homo sapiens
agcccctcctctgc

SEQ ID NO: 901010 - DNA, 15 bp, Homo sapiens
agcccctcctctgcc

SEQ ID NO: 901011 - DNA, 19 bp, Homo sapiens
agcccctcctctgccacct

SEQ ID NO: 901012 - DNA, 14 bp, Homo sapiens
agcccctcggctct

SEQ ID NO: 901013 - DNA, 15 bp, Homo sapiens
agcccctctcccctc

SEQ ID NO: 901014 - DNA, 16 bp, Homo sapiens
agcccctctcccctct

SEQ ID NO: 901015 - DNA, 23 bp, Homo sapiens
agcccctctcccctctctgctcc

SEQ ID NO: 901016 - DNA, 12 bp, Homo sapiens
agcccctctctc

SEQ ID NO: 901017 - DNA, 13 bp, Homo sapiens
agcccctctggat

SEQ ID NO: 901018 - DNA, 20 bp, Homo sapiens
agcccctctggattcccttt

SEQ ID NO: 901019 - DNA, 21 bp, Homo sapiens
agcccctctggattccctttt

SEQ ID NO: 901020 - DNA, 16 bp, Homo sapiens
agcccctctggtcgct

SEQ ID NO: 901021 - DNA, 17 bp, Homo sapiens
agcccctcttccccaat

SEQ ID NO: 901022 - DNA, 17 bp, Homo sapiens
agcccctcttcccttcc

SEQ ID NO: 901023 - DNA, 18 bp, Homo sapiens
agcccctcttcccttcct

SEQ ID NO: 901024 - DNA, 22 bp, Homo sapiens
agcccctcttcccttcctccat

SEQ ID NO: 901025 - DNA, 18 bp, Homo sapiens
agcccctcttggagaagt

SEQ ID NO: 901026 - DNA, 16 bp, Homo sapiens
agcccctgaaagccat

SEQ ID NO: 901027 - DNA, 11 bp, Homo sapiens
agcccctgagt

SEQ ID NO: 901028 - DNA, 19 bp, Homo sapiens
agcccctgagtccgcctgc

SEQ ID NO: 901029 - DNA, 20 bp, Homo sapiens
agcccctgatctctgacctc

SEQ ID NO: 901030 - DNA, 22 bp, Homo sapiens
agcccctgatctctgacctctg

SEQ ID NO: 901031 - DNA, 12 bp, Homo sapiens
agcccctgcccc

SEQ ID NO: 901032 - DNA, 19 bp, Homo sapiens
agcccctgccctggggaga

SEQ ID NO: 901033 - DNA, 22 bp, Homo sapiens
agcccctgccctggggagaaag

SEQ ID NO: 901034 - DNA, 15 bp, Homo sapiens
agcccctggacccct

SEQ ID NO: 901035 - DNA, 21 bp, Homo sapiens
agcccctggacccctggggtg

SEQ ID NO: 901036 - DNA, 12 bp, Homo sapiens
agcccctgggaa

SEQ ID NO: 901037 - DNA, 19 bp, Homo sapiens
agcccctgggaacaggccc

SEQ ID NO: 901038 - DNA, 21 bp, Homo sapiens
agcccctgggaacaggcccca

SEQ ID NO: 901039 - DNA, 16 bp, Homo sapiens
agcccctggggcccag

SEQ ID NO: 901040 - DNA, 22 bp, Homo sapiens
agcccctggggtggccaccagt

SEQ ID NO: 901041 - DNA, 12 bp, Homo sapiens
agcccctgggtg

SEQ ID NO: 901042 - DNA, 17 bp, Homo sapiens
agcccctggtcttctct

SEQ ID NO: 901043 - DNA, 20 bp, Homo sapiens
agcccctgtctagagaggga

SEQ ID NO: 901044 - DNA, 16 bp, Homo sapiens
agcccctgtgaccctc

SEQ ID NO: 901045 - DNA, 14 bp, Homo sapiens
agccccttctccca

SEQ ID NO: 901046 - DNA, 22 bp, Homo sapiens
agccccttctgctcagctctgg

SEQ ID NO: 901047 - DNA, 17 bp, Homo sapiens
agccccttgagaaacct

SEQ ID NO: 901048 - DNA, 23 bp, Homo sapiens
agccccttgctctcccctgccct

SEQ ID NO: 901049 - DNA, 21 bp, Homo sapiens
agcccctttgcctctgtcctc

SEQ ID NO: 901050 - DNA, 20 bp, Homo sapiens
agccccttttctctgctctt

SEQ ID NO: 901051 - DNA, 22 bp, Homo sapiens
agcccctttttcatatgttgct

SEQ ID NO: 901052 - DNA, 15 bp, Homo sapiens
agcccgacagtgcca

SEQ ID NO: 901053 - DNA, 21 bp, Homo sapiens
agcccgacagtgccatcccca

SEQ ID NO: 901054 - DNA, 15 bp, Homo sapiens
agcccgcacccccac

SEQ ID NO: 901055 - DNA, 21 bp, Homo sapiens
agcccgcacccccaccctttg

SEQ ID NO: 901056 - DNA, 19 bp, Homo sapiens
agcccgccaaggtagccat

SEQ ID NO: 901057 - DNA, 19 bp, Homo sapiens
agcccgccgtctgcagggg

SEQ ID NO: 901058 - DNA, 15 bp, Homo sapiens
agcccgcggggacat

SEQ ID NO: 901059 - DNA, 20 bp, Homo sapiens
agcccgcggggacattggga

SEQ ID NO: 901060 - DNA, 23 bp, Homo sapiens
agcccgctaggctcgccttccct

SEQ ID NO: 901061 - DNA, 16 bp, Homo sapiens
agcccgctctctggct

SEQ ID NO: 901062 - DNA, 21 bp, Homo sapiens
agcccgcttcaagctctctgt

SEQ ID NO: 901063 - DNA, 16 bp, Homo sapiens
agcccggccccacctc

SEQ ID NO: 901064 - DNA, 21 bp, Homo sapiens
agcccggccccacctccctgc

SEQ ID NO: 901065 - DNA, 16 bp, Homo sapiens
agcccggcgcccctgc

SEQ ID NO: 901066 - DNA, 18 bp, Homo sapiens
agcccggcgcccctgcca

SEQ ID NO: 901067 - DNA, 22 bp, Homo sapiens
agcccggcgcccctgccacctc

SEQ ID NO: 901068 - DNA, 15 bp, Homo sapiens
agcccggctgctgct

SEQ ID NO: 901069 - DNA, 14 bp, Homo sapiens
agcccgggagccta

SEQ ID NO: 901070 - DNA, 15 bp, Homo sapiens
agcccgggagcctag

SEQ ID NO: 901071 - DNA, 19 bp, Homo sapiens
ccatcactggtccaggtct

SEQ ID NO: 901072 - DNA, 17 bp, Homo sapiens
ccatcacttctccccgc

SEQ ID NO: 901073 - DNA, 18 bp, Homo sapiens
ccatcagaacctgagcta

SEQ ID NO: 901074 - DNA, 13 bp, Homo sapiens
ccatcagatattt

SEQ ID NO: 901075 - DNA, 13 bp, Homo sapiens
ccatcagcccctg

SEQ ID NO: 901076 - DNA, 14 bp, Homo sapiens
ccatcagcccctgg

SEQ ID NO: 901077 - DNA, 16 bp, Homo sapiens
ccatcagcccctggga

SEQ ID NO: 901078 - DNA, 22 bp, Homo sapiens
ccatcagcgggtctcctcccag

SEQ ID NO: 901079 - DNA, 13 bp, Homo sapiens
ccatcagctccca

SEQ ID NO: 901080 - DNA, 14 bp, Homo sapiens
ccatcagctcccaa

SEQ ID NO: 901081 - DNA, 12 bp, Homo sapiens
ccatcaggcagt

SEQ ID NO: 901082 - DNA, 12 bp, Homo sapiens
ccatcagggccc

SEQ ID NO: 901083 - DNA, 24 bp, Homo sapiens
ccatcagggtgggccactctcccc

SEQ ID NO: 901084 - DNA, 17 bp, Homo sapiens
ccatcaggttccatccc

SEQ ID NO: 901085 - DNA, 16 bp, Homo sapiens
ccatcagttcccccag

SEQ ID NO: 901086 - DNA, 18 bp, Homo sapiens
ccatcatatgcctgaccc

SEQ ID NO: 901087 - DNA, 18 bp, Homo sapiens
ccatcatcactgtaaaga

SEQ ID NO: 901088 - DNA, 16 bp, Homo sapiens
ccatcatcccagctgc

SEQ ID NO: 901089 - DNA, 13 bp, Homo sapiens
ccatcatgccttg

SEQ ID NO: 901090 - DNA, 15 bp, Homo sapiens
ccatcatgccttgat

SEQ ID NO: 901091 - DNA, 23 bp, Homo sapiens
ccatcatgcggtgggtgctgcca

SEQ ID NO: 901092 - DNA, 13 bp, Homo sapiens
ccatcatgtctgt

SEQ ID NO: 901093 - DNA, 15 bp, Homo sapiens
ccatccaaggccagg

SEQ ID NO: 901094 - DNA, 17 bp, Homo sapiens
ccatccacatgggagcc

SEQ ID NO: 901095 - DNA, 17 bp, Homo sapiens
ccatccacctttcccaa

SEQ ID NO: 901096 - DNA, 22 bp, Homo sapiens
ccatccagaggaataaaaaggt

SEQ ID NO: 901097 - DNA, 17 bp, Homo sapiens
ccatccagccacggagg

SEQ ID NO: 901098 - DNA, 23 bp, Homo sapiens
ccatccagccacggagggaggca

SEQ ID NO: 901099 - DNA, 14 bp, Homo sapiens
ccatccagccagac

SEQ ID NO: 901100 - DNA, 12 bp, Homo sapiens
ccatccaggcag

SEQ ID NO: 901101 - DNA, 13 bp, Homo sapiens
ccatccaggcagt

SEQ ID NO: 901102 - DNA, 16 bp, Homo sapiens
ccatccagggtctggc

SEQ ID NO: 901103 - DNA, 19 bp, Homo sapiens
ccatccagggtctggcaga

SEQ ID NO: 901104 - DNA, 20 bp, Homo sapiens
ccatccagggtctggcagag

SEQ ID NO: 901105 - DNA, 23 bp, Homo sapiens
ccatccagggtctggcagagcct

SEQ ID NO: 901106 - DNA, 15 bp, Homo sapiens
ccatccatccctaga

SEQ ID NO: 901107 - DNA, 14 bp, Homo sapiens
ccatccatctccag

SEQ ID NO: 901108 - DNA, 14 bp, Homo sapiens
ccatcccacaccct

SEQ ID NO: 901109 - DNA, 17 bp, Homo sapiens
ccatcccactgctcccc

SEQ ID NO: 901110 - DNA, 17 bp, Homo sapiens
ccatcccagggtcccac

SEQ ID NO: 901111 - DNA, 19 bp, Homo sapiens
ccatcccatgaacacactg

SEQ ID NO: 901112 - DNA, 22 bp, Homo sapiens
ccatcccattttcatcctgagc

SEQ ID NO: 901113 - DNA, 14 bp, Homo sapiens
ccatccccaccact

SEQ ID NO: 901114 - DNA, 13 bp, Homo sapiens
ccatccccaccag

SEQ ID NO: 901115 - DNA, 16 bp, Homo sapiens
ccatccccaccagctc

SEQ ID NO: 901116 - DNA, 15 bp, Homo sapiens
ccatccccagctggt

SEQ ID NO: 901117 - DNA, 12 bp, Homo sapiens
ccatccccaggt

SEQ ID NO: 901118 - DNA, 14 bp, Homo sapiens
ccatccccatcggc

SEQ ID NO: 901119 - DNA, 18 bp, Homo sapiens
ccatccccatcggccctg

SEQ ID NO: 901120 - DNA, 20 bp, Homo sapiens
ccatccccctctcacgccac

SEQ ID NO: 901121 - DNA, 15 bp, Homo sapiens
ccatccccctgccct

SEQ ID NO: 901122 - DNA, 14 bp, Homo sapiens
ccatcccccttctt

SEQ ID NO: 901123 - DNA, 14 bp, Homo sapiens
ccatccccgcagtg

SEQ ID NO: 901124 - DNA, 17 bp, Homo sapiens
ccatccccgcagtgtgc

SEQ ID NO: 901125 - DNA, 17 bp, Homo sapiens
ccatcccctatggacca

SEQ ID NO: 901126 - DNA, 12 bp, Homo sapiens
ccatcccctcaa

SEQ ID NO: 901127 - DNA, 21 bp, Homo sapiens
ccatcccctcaacaccctgct

SEQ ID NO: 901128 - DNA, 15 bp, Homo sapiens
ccatcccctccctgc

SEQ ID NO: 901129 - DNA, 17 bp, Homo sapiens
ccatcccctccctgcct

SEQ ID NO: 901130 - DNA, 21 bp, Homo sapiens
ccatcccctccctgcctgctc

SEQ ID NO: 901131 - DNA, 18 bp, Homo sapiens
ccatcccctcctagcaca

SEQ ID NO: 901132 - DNA, 13 bp, Homo sapiens
ccatcccctggac

SEQ ID NO: 901133 - DNA, 22 bp, Homo sapiens
ccatccccttcccccatcccta

SEQ ID NO: 901134 - DNA, 20 bp, Homo sapiens
ccatcccctttcctccccac

SEQ ID NO: 901135 - DNA, 20 bp, Homo sapiens
ccatcccgaagccatcactt

SEQ ID NO: 901136 - DNA, 16 bp, Homo sapiens
ccatcccgcttagcct

SEQ ID NO: 901137 - DNA, 18 bp, Homo sapiens
ccatcccgcttagcctgc

SEQ ID NO: 901138 - DNA, 21 bp, Homo sapiens
ccatcccgcttagcctgcctc

SEQ ID NO: 901139 - DNA, 21 bp, Homo sapiens
ccatccctagaagagcacaga

SEQ ID NO: 901140 - DNA, 22 bp, Homo sapiens
ccatccctagaagagcacagag

SEQ ID NO: 901141 - DNA, 15 bp, Homo sapiens
ccatccctgctctgg

SEQ ID NO: 901142 - DNA, 14 bp, Homo sapiens
ccatccctgggccc

SEQ ID NO: 901143 - DNA, 20 bp, Homo sapiens
ccatccctgggcccctccac

SEQ ID NO: 901144 - DNA, 13 bp, Homo sapiens
ccatccctgtcat

SEQ ID NO: 901145 - DNA, 13 bp, Homo sapiens
ccatcccttcctg

SEQ ID NO: 901146 - DNA, 16 bp, Homo sapiens
ccatcccttcggagcc

SEQ ID NO: 901147 - DNA, 20 bp, Homo sapiens
ccatcccttcggagccaaca

SEQ ID NO: 901148 - DNA, 12 bp, Homo sapiens
ccatcccttggg

SEQ ID NO: 901149 - DNA, 19 bp, Homo sapiens
ccatcccttttcctttctg

SEQ ID NO: 901150 - DNA, 20 bp, Homo sapiens
ccatcccttttcctttctgg

SEQ ID NO: 901151 - DNA, 23 bp, Homo sapiens
ccatcccttttcctttctggccc

SEQ ID NO: 901152 - DNA, 16 bp, Homo sapiens
ccatccgactgcccct

SEQ ID NO: 901153 - DNA, 21 bp, Homo sapiens
ccatccgactgcccctgctgt

SEQ ID NO: 901154 - DNA, 23 bp, Homo sapiens
ccatccgactgcccctgctgtgc

SEQ ID NO: 901155 - DNA, 22 bp, Homo sapiens
ccatccgcagactgcttggcca

SEQ ID NO: 901156 - DNA, 15 bp, Homo sapiens
ccatcctaaaagcca

SEQ ID NO: 901157 - DNA, 12 bp, Homo sapiens
ccatcctaccct

SEQ ID NO: 901158 - DNA, 16 bp, Homo sapiens
ccatcctaccctcggg

SEQ ID NO: 901159 - DNA, 22 bp, Homo sapiens
ccatcctaccctcgggcccacc

SEQ ID NO: 901160 - DNA, 12 bp, Homo sapiens
ccatcctcagag

SEQ ID NO: 901161 - DNA, 16 bp, Homo sapiens
ccatcctcagaggctg

SEQ ID NO: 901162 - DNA, 13 bp, Homo sapiens
ccatcctccagcc

SEQ ID NO: 901163 - DNA, 14 bp, Homo sapiens
ccatcctccagctt

SEQ ID NO: 901164 - DNA, 15 bp, Homo sapiens
ccatcctccagcttc

SEQ ID NO: 901165 - DNA, 17 bp, Homo sapiens
ccatcctccagcttctg

SEQ ID NO: 901166 - DNA, 21 bp, Homo sapiens
ccatcctccccttccctgcaa

SEQ ID NO: 901167 - DNA, 12 bp, Homo sapiens
ccatcctgacca

SEQ ID NO: 901168 - DNA, 12 bp, Homo sapiens
ccatcctgactg

SEQ ID NO: 901169 - DNA, 13 bp, Homo sapiens
ccatcctgatccc

SEQ ID NO: 901170 - DNA, 17 bp, Homo sapiens
ccatcctgatcccagac

SEQ ID NO: 901171 - DNA, 21 bp, Homo sapiens
ccatcctgatggacctgcccc

SEQ ID NO: 901172 - DNA, 11 bp, Homo sapiens
ccatcctgcaa

SEQ ID NO: 901173 - DNA, 16 bp, Homo sapiens
ccatcctgcaaaggcc

SEQ ID NO: 901174 - DNA, 16 bp, Homo sapiens
ccatcctgcagcctcc

SEQ ID NO: 901175 - DNA, 16 bp, Homo sapiens
ccatcctggcccctcc

SEQ ID NO: 901176 - DNA, 13 bp, Homo sapiens
ccatcctggctgc

SEQ ID NO: 901177 - DNA, 15 bp, Homo sapiens
ccatcctggggcagc

SEQ ID NO: 901178 - DNA, 16 bp, Homo sapiens
ccatcctggggcagca

SEQ ID NO: 901179 - DNA, 21 bp, Homo sapiens
ccatcctggggcagcactccc

SEQ ID NO: 901180 - DNA, 17 bp, Homo sapiens
ccatcgccatcttcttc

SEQ ID NO: 901181 - DNA, 19 bp, Homo sapiens
ccatcgccccaccgcagct

SEQ ID NO: 901182 - DNA, 16 bp, Homo sapiens
ccatcgctgtgtgtta

SEQ ID NO: 901183 - DNA, 20 bp, Homo sapiens
ccatcgctgtgtgttagttc

SEQ ID NO: 901184 - DNA, 20 bp, Homo sapiens
ccatcggccctgtcccctgg

SEQ ID NO: 901185 - DNA, 22 bp, Homo sapiens
ccatcggtgtccatttatagaa

SEQ ID NO: 901186 - DNA, 15 bp, Homo sapiens
ccatcgtccagccct

SEQ ID NO: 901187 - DNA, 14 bp, Homo sapiens
ccatcgtcctggga

SEQ ID NO: 901188 - DNA, 22 bp, Homo sapiens
ccatcgtctcatcctcctttca

SEQ ID NO: 901189 - DNA, 23 bp, Homo sapiens
ccatcgtgtgtgccttgggtctc

SEQ ID NO: 901190 - DNA, 19 bp, Homo sapiens
ccatctaatgcttgtttat

SEQ ID NO: 901191 - DNA, 17 bp, Homo sapiens
ccatctagtacttgaaa

SEQ ID NO: 901192 - DNA, 12 bp, Homo sapiens
ccatctcagcct

SEQ ID NO: 901193 - DNA, 15 bp, Homo sapiens
ccatctcagcctcct

SEQ ID NO: 901194 - DNA, 21 bp, Homo sapiens
ccattcttcagtgtctctgtt

SEQ ID NO: 901195 - DNA, 12 bp, Homo sapiens
ccattcttcccg

SEQ ID NO: 901196 - DNA, 14 bp, Homo sapiens
ccattcttcttgct

SEQ ID NO: 901197 - DNA, 21 bp, Homo sapiens
ccattctttataatcctctgt

SEQ ID NO: 901198 - DNA, 16 bp, Homo sapiens
ccattgaacagctgtg

SEQ ID NO: 901199 - DNA, 19 bp, Homo sapiens
ccattgaacagctgtgagc

SEQ ID NO: 901200 - DNA, 22 bp, Homo sapiens
ccattgaattcttggttgagga

SEQ ID NO: 901201 - DNA, 16 bp, Homo sapiens
ccattgacctcagctg

SEQ ID NO: 901202 - DNA, 14 bp, Homo sapiens
ccattgagtccctg

SEQ ID NO: 901203 - DNA, 17 bp, Homo sapiens
ccattgccaccaggaga

SEQ ID NO: 901204 - DNA, 13 bp, Homo sapiens
ccattgccaggag

SEQ ID NO: 901205 - DNA, 14 bp, Homo sapiens
ccattgccaggaga

SEQ ID NO: 901206 - DNA, 16 bp, Homo sapiens
ccattgccccagacct

SEQ ID NO: 901207 - DNA, 17 bp, Homo sapiens
ccattgcctagctcttt

SEQ ID NO: 901208 - DNA, 22 bp, Homo sapiens
ccattgctcttagtcccaagct

SEQ ID NO: 901209 - DNA, 21 bp, Homo sapiens
ccattggacagatttcagtaa

SEQ ID NO: 901210 - DNA, 19 bp, Homo sapiens
ccattggagcacctgggcc

SEQ ID NO: 901211 - DNA, 16 bp, Homo sapiens
ccattggatctgcaag

SEQ ID NO: 901212 - DNA, 18 bp, Homo sapiens
ccattggccgagctcctg

SEQ ID NO: 901213 - DNA, 13 bp, Homo sapiens
ccattggcctctt

SEQ ID NO: 901214 - DNA, 16 bp, Homo sapiens
ccattggtccaccctt

SEQ ID NO: 901215 - DNA, 16 bp, Homo sapiens
ccattggttggaagct

SEQ ID NO: 901216 - DNA, 19 bp, Homo sapiens
ccattgtaaatctgaagaa

SEQ ID NO: 901217 - DNA, 21 bp, Homo sapiens
ccattgtaactattaaccttt

SEQ ID NO: 901218 - DNA, 20 bp, Homo sapiens
ccattgtactccagcctggg

SEQ ID NO: 901219 - DNA, 15 bp, Homo sapiens
ccattgtccctctgc

SEQ ID NO: 901220 - DNA, 17 bp, Homo sapiens
ccattgtccctctgccc

SEQ ID NO: 901221 - DNA, 19 bp, Homo sapiens
ccattgtccctctgcccca

SEQ ID NO: 901222 - DNA, 12 bp, Homo sapiens
ccattgtcctcc

SEQ ID NO: 901223 - DNA, 15 bp, Homo sapiens
ccattgtcctccttt

SEQ ID NO: 901224 - DNA, 17 bp, Homo sapiens
ccattgtcctccttttc

SEQ ID NO: 901225 - DNA, 20 bp, Homo sapiens
ccattgtgtgatccagccct

SEQ ID NO: 901226 - DNA, 16 bp, Homo sapiens
ccattgtgtggcctgg

SEQ ID NO: 901227 - DNA, 24 bp, Homo sapiens
ccattgttcccttcctcttcctgc

SEQ ID NO: 901228 - DNA, 17 bp, Homo sapiens
ccattgttgtcaaatgc

SEQ ID NO: 901229 - DNA, 18 bp, Homo sapiens
ccattgttgtcaaggaag

SEQ ID NO: 901230 - DNA, 22 bp, Homo sapiens
ccattgtttgaaacaaagaagg

SEQ ID NO: 901231 - DNA, 20 bp, Homo sapiens
ccatttaagtatcttgtgct

SEQ ID NO: 901232 - DNA, 22 bp, Homo sapiens
ccatttagcactatttaaaata

SEQ ID NO: 901233 - DNA, 19 bp, Homo sapiens
ccatttagttctttgttat

SEQ ID NO: 901234 - DNA, 20 bp, Homo sapiens
ccatttataaccccagcctg

SEQ ID NO: 901235 - DNA, 20 bp, Homo sapiens
ccatttattgtttgaaatgt

SEQ ID NO: 901236 - DNA, 13 bp, Homo sapiens
ccatttcagagag

SEQ ID NO: 901237 - DNA, 19 bp, Homo sapiens
ccatttcaggaatttaaaa

SEQ ID NO: 901238 - DNA, 20 bp, Homo sapiens
ccatttcaggaatttaaaat

SEQ ID NO: 901239 - DNA, 17 bp, Homo sapiens
ccatttcagtggcttcc

SEQ ID NO: 901240 - DNA, 17 bp, Homo sapiens
ccatttcatctatttct

SEQ ID NO: 901241 - DNA, 15 bp, Homo sapiens
ccatttcatgtccat

SEQ ID NO: 901242 - DNA, 15 bp, Homo sapiens
ccatttcccacatct

SEQ ID NO: 901243 - DNA, 18 bp, Homo sapiens
ccatttcccacatctttc

SEQ ID NO: 901244 - DNA, 14 bp, Homo sapiens
ccatttcccatctg

SEQ ID NO: 901245 - DNA, 16 bp, Homo sapiens
ccatttccccctcctc

SEQ ID NO: 901246 - DNA, 22 bp, Homo sapiens
ccatttcccttctggacactga

SEQ ID NO: 901247 - DNA, 12 bp, Homo sapiens
ccatttcctgta

SEQ ID NO: 901248 - DNA, 13 bp, Homo sapiens
ccatttcctgtac

SEQ ID NO: 901249 - DNA, 12 bp, Homo sapiens
ccatttctattt

SEQ ID NO: 901250 - DNA, 19 bp, Homo sapiens
ccatttctcaatcagtgca

SEQ ID NO: 901251 - DNA, 17 bp, Homo sapiens
ccatttctctacactaa

SEQ ID NO: 901252 - DNA, 13 bp, Homo sapiens
ccatttctgcctc

SEQ ID NO: 901253 - DNA, 15 bp, Homo sapiens
ccatttctgtggagg

SEQ ID NO: 901254 - DNA, 14 bp, Homo sapiens
ccatttctgttgct

SEQ ID NO: 901255 - DNA, 16 bp, Homo sapiens
ccatttctgttgctgg

SEQ ID NO: 901256 - DNA, 16 bp, Homo sapiens
ccatttcttgctagct

SEQ ID NO: 901257 - DNA, 22 bp, Homo sapiens
ccatttcttggcattggaattc

SEQ ID NO: 901258 - DNA, 16 bp, Homo sapiens
ccatttctttcttcca

SEQ ID NO: 901259 - DNA, 12 bp, Homo sapiens
ccatttctttta

SEQ ID NO: 901260 - DNA, 19 bp, Homo sapiens
ccatttgcaataacagctg

SEQ ID NO: 901261 - DNA, 22 bp, Homo sapiens
ccatttgcaataacagctgcaa

SEQ ID NO: 901262 - DNA, 12 bp, Homo sapiens
ccatttgcattt

SEQ ID NO: 901263 - DNA, 15 bp, Homo sapiens
ccatttgcatttgtt

SEQ ID NO: 901264 - DNA, 22 bp, Homo sapiens
ccatttgcatttgtttatgtaa

SEQ ID NO: 901265 - DNA, 20 bp, Homo sapiens
ccatttgctagttctgctgc

SEQ ID NO: 901266 - DNA, 21 bp, Homo sapiens
ccatttggtgtggattttcta

SEQ ID NO: 901267 - DNA, 12 bp, Homo sapiens
ccatttgtaata

SEQ ID NO: 901268 - DNA, 16 bp, Homo sapiens
ccatttgtattaccat

SEQ ID NO: 901269 - DNA, 14 bp, Homo sapiens
ccatttgtcccaga

SEQ ID NO: 901270 - DNA, 14 bp, Homo sapiens
ccatttgtgtgtgt

SEQ ID NO: 901271 - DNA, 15 bp, Homo sapiens
ccatttgttaatatc

SEQ ID NO: 901272 - DNA, 14 bp, Homo sapiens
ccatttgttcctgc

SEQ ID NO: 901273 - DNA, 20 bp, Homo sapiens
ccatttgttcctgcttccga

SEQ ID NO: 901274 - DNA, 22 bp, Homo sapiens
ccattttaaagttagtatcttt

SEQ ID NO: 901275 - DNA, 14 bp, Homo sapiens
ccattttacacagc

SEQ ID NO: 901276 - DNA, 19 bp, Homo sapiens
ccattttattttatatgat

SEQ ID NO: 901277 - DNA, 21 bp, Homo sapiens
ccattttattttttgggccat

SEQ ID NO: 901278 - DNA, 21 bp, Homo sapiens
ccattttcccatcatcctttg

SEQ ID NO: 901279 - DNA, 10 bp, Homo sapiens
ccattttcta

SEQ ID NO: 901280 - DNA, 20 bp, Homo sapiens
ccattttcttctctgtgaag

SEQ ID NO: 901281 - DNA, 19 bp, Homo sapiens
ccattttgcccttccatag

SEQ ID NO: 901282 - DNA, 18 bp, Homo sapiens
ccattttgttattgacta

SEQ ID NO: 901283 - DNA, 14 bp, Homo sapiens
ccatttttaatgat

SEQ ID NO: 901284 - DNA, 14 bp, Homo sapiens
ccatttttacaagt

SEQ ID NO: 901285 - DNA, 16 bp, Homo sapiens
ccatttttcaaagcaa

SEQ ID NO: 901286 - DNA, 14 bp, Homo sapiens
ccatttttctgggg

SEQ ID NO: 901287 - DNA, 23 bp, Homo sapiens
ccattttttcttcccttttccct

SEQ ID NO: 901288 - DNA, 17 bp, Homo sapiens
cccaaaacccagggcaa

SEQ ID NO: 901289 - DNA, 14 bp, Homo sapiens
cccaaaagattgct

SEQ ID NO: 901290 - DNA, 23 bp, Homo sapiens
cccaaaagtcaaaaggtgcctgt

SEQ ID NO: 901291 - DNA, 14 bp, Homo sapiens
cccaaacacaaaac

SEQ ID NO: 901292 - DNA, 21 bp, Homo sapiens
cccaaacaccagtcacctcgt

SEQ ID NO: 901293 - DNA, 16 bp, Homo sapiens
cccaaacaccttccag

SEQ ID NO: 901294 - DNA, 22 bp, Homo sapiens
cccaaacacttctgctttcact

SEQ ID NO: 901295 - DNA, 16 bp, Homo sapiens
cccaaacaggacagca

SEQ ID NO: 901296 - DNA, 14 bp, Homo sapiens
cccaaacatagccc

SEQ ID NO: 901297 - DNA, 14 bp, Homo sapiens
cccaaacatctggc

SEQ ID NO: 901298 - DNA, 23 bp, Homo sapiens
cccaaacattaatcaccaaagta

SEQ ID NO: 901299 - DNA, 20 bp, Homo sapiens
cccaaacccttaactgacat

SEQ ID NO: 901300 - DNA, 23 bp, Homo sapiens
cccaaacgccctttcctcctcag

SEQ ID NO: 901301 - DNA, 13 bp, Homo sapiens
cccaaactcccct

SEQ ID NO: 901302 - DNA, 17 bp, Homo sapiens
cccaaactccccttccc

SEQ ID NO: 901303 - DNA, 20 bp, Homo sapiens
cccaaactccccttccctgg

SEQ ID NO: 901304 - DNA, 17 bp, Homo sapiens
cccaaacttatggacac

SEQ ID NO: 901305 - DNA, 23 bp, Homo sapiens
cccaaacttatggacactgcctt

SEQ ID NO: 901306 - DNA, 17 bp, Homo sapiens
cccaaactttaaaatgc

SEQ ID NO: 901307 - DNA, 23 bp, Homo sapiens
cccaaagaattcctgaagccaga

SEQ ID NO: 901308 - DNA, 18 bp, Homo sapiens
cccaaagagcctggagaa

SEQ ID NO: 901309 - DNA, 19 bp, Homo sapiens
cccaaagagcctggagaag

SEQ ID NO: 901310 - DNA, 15 bp, Homo sapiens
cccaaagctcagact

SEQ ID NO: 901311 - DNA, 16 bp, Homo sapiens
cccaaagctttcctgc

SEQ ID NO: 901312 - DNA, 20 bp, Homo sapiens
cccaaaggatgagaatgtga

SEQ ID NO: 901313 - DNA, 14 bp, Homo sapiens
cccaaaggcccagg

SEQ ID NO: 901314 - DNA, 18 bp, Homo sapiens
cccaaaggcccagggagg

SEQ ID NO: 901315 - DNA, 22 bp, Homo sapiens
cccaaaggcccagggaggcagc

SEQ ID NO: 901316 - DNA, 16 bp, Homo sapiens
gattcacctcttcctc

SEQ ID NO: 901317 - DNA, 18 bp, Homo sapiens
gattcacctcttcctctg

SEQ ID NO: 901318 - DNA, 13 bp, Homo sapiens
gattcacctgtaa

SEQ ID NO: 901319 - DNA, 18 bp, Homo sapiens
gattcactgccttcctct

SEQ ID NO: 901320 - DNA, 17 bp, Homo sapiens
gattcactgtcttttga

SEQ ID NO: 901321 - DNA, 21 bp, Homo sapiens
gattcagaaaatgttctgttt

SEQ ID NO: 901322 - DNA, 21 bp, Homo sapiens
gattcagccttctttttctgg

SEQ ID NO: 901323 - DNA, 23 bp, Homo sapiens
gattcagctcattatgaaaaaca

SEQ ID NO: 901324 - DNA, 17 bp, Homo sapiens
gattcaggccagcccag

SEQ ID NO: 901325 - DNA, 21 bp, Homo sapiens
gattcaggccagcccagccag

SEQ ID NO: 901326 - DNA, 12 bp, Homo sapiens
gattcaggctgc

SEQ ID NO: 901327 - DNA, 18 bp, Homo sapiens
gattcaggggaagggcag

SEQ ID NO: 901328 - DNA, 20 bp, Homo sapiens
gattcaggggaagggcaggc

SEQ ID NO: 901329 - DNA, 20 bp, Homo sapiens
gattcaggggctttgggccc

SEQ ID NO: 901330 - DNA, 21 bp, Homo sapiens
gattcaggggctttgggccca

SEQ ID NO: 901331 - DNA, 15 bp, Homo sapiens
gattcagttttcatt

SEQ ID NO: 901332 - DNA, 17 bp, Homo sapiens
gattcataaagtaatga

SEQ ID NO: 901333 - DNA, 20 bp, Homo sapiens
gattcataaagtaatgatga

SEQ ID NO: 901334 - DNA, 19 bp, Homo sapiens
gattcataagacacttaga

SEQ ID NO: 901335 - DNA, 19 bp, Homo sapiens
gattcatatttacttctta

SEQ ID NO: 901336 - DNA, 13 bp, Homo sapiens
gattcatctctgg

SEQ ID NO: 901337 - DNA, 18 bp, Homo sapiens
gattcatgttatatttaa

SEQ ID NO: 901338 - DNA, 14 bp, Homo sapiens
gattcattttcctg

SEQ ID NO: 901339 - DNA, 15 bp, Homo sapiens
gattcattttcctgt

SEQ ID NO: 901340 - DNA, 14 bp, Homo sapiens
gattccaaaaacat

SEQ ID NO: 901341 - DNA, 23 bp, Homo sapiens
gattccaaagagtagaattgcat

SEQ ID NO: 901342 - DNA, 12 bp, Homo sapiens
gattccaaataa

SEQ ID NO: 901343 - DNA, 19 bp, Homo sapiens
gattccagagagtggctcc

SEQ ID NO: 901344 - DNA, 22 bp, Homo sapiens
gattcccaccaaggtcttcagc

SEQ ID NO: 901345 - DNA, 21 bp, Homo sapiens
gattcccccccctttcctaaa

SEQ ID NO: 901346 - DNA, 16 bp, Homo sapiens
gattccccctgccctg

SEQ ID NO: 901347 - DNA, 21 bp, Homo sapiens
gattccccctgccctgtgccg

SEQ ID NO: 901348 - DNA, 18 bp, Homo sapiens
gattcccttctgggcttc

SEQ ID NO: 901349 - DNA, 22 bp, Homo sapiens
gattcctacccctcttccagct

SEQ ID NO: 901350 - DNA, 16 bp, Homo sapiens
gattcctattactgca

SEQ ID NO: 901351 - DNA, 13 bp, Homo sapiens
gattcctgaccca

SEQ ID NO: 901352 - DNA, 15 bp, Homo sapiens
gattcctgacccagg

SEQ ID NO: 901353 - DNA, 17 bp, Homo sapiens
gattcctgagctggcct

SEQ ID NO: 901354 - DNA, 19 bp, Homo sapiens
gattcctgagctggcctgt

SEQ ID NO: 901355 - DNA, 18 bp, Homo sapiens
gattccttagactctttt

SEQ ID NO: 901356 - DNA, 13 bp, Homo sapiens
gattcctttaaaa

SEQ ID NO: 901357 - DNA, 17 bp, Homo sapiens
gattcctttaaaatata

SEQ ID NO: 901358 - DNA, 20 bp, Homo sapiens
gattccttttgatggggaga

SEQ ID NO: 901359 - DNA, 22 bp, Homo sapiens
gattccttttgatggggagaaa

SEQ ID NO: 901360 - DNA, 16 bp, Homo sapiens
gattcggtatcccccc

SEQ ID NO: 901361 - DNA, 14 bp, Homo sapiens
gattctactttaag

SEQ ID NO: 901362 - DNA, 23 bp, Homo sapiens
gattctactttaagcactacata

SEQ ID NO: 901363 - DNA, 21 bp, Homo sapiens
gattctagtacataattgatt

SEQ ID NO: 901364 - DNA, 22 bp, Homo sapiens
gattctatattattatatatat

SEQ ID NO: 901365 - DNA, 21 bp, Homo sapiens
gattctatttaattgaaactc

SEQ ID NO: 901366 - DNA, 20 bp, Homo sapiens
gattctatttcccctcttct

SEQ ID NO: 901367 - DNA, 16 bp, Homo sapiens
gattctcccaaagtac

SEQ ID NO: 901368 - DNA, 15 bp, Homo sapiens
gattctcctgcctca

SEQ ID NO: 901369 - DNA, 16 bp, Homo sapiens
gattctcctgcctcag

SEQ ID NO: 901370 - DNA, 16 bp, Homo sapiens
gattctcctgtgctag

SEQ ID NO: 901371 - DNA, 18 bp, Homo sapiens
gattctctacatgctctt

SEQ ID NO: 901372 - DNA, 12 bp, Homo sapiens
gattctctgccc

SEQ ID NO: 901373 - DNA, 12 bp, Homo sapiens
gattctgaatct

SEQ ID NO: 901374 - DNA, 15 bp, Homo sapiens
gattctgacatttat

SEQ ID NO: 901375 - DNA, 20 bp, Homo sapiens
gattctgaccttaaatgcaa

SEQ ID NO: 901376 - DNA, 23 bp, Homo sapiens
gattctgatttcagtttttcatt

SEQ ID NO: 901377 - DNA, 16 bp, Homo sapiens
gattctgcagtaaatc

SEQ ID NO: 901378 - DNA, 21 bp, Homo sapiens
gattctgcagtaaatctttta

SEQ ID NO: 901379 - DNA, 13 bp, Homo sapiens
gattctgcctctc

SEQ ID NO: 901380 - DNA, 13 bp, Homo sapiens
gattctgctttta

SEQ ID NO: 901381 - DNA, 17 bp, Homo sapiens
gattctggatctcctgc

SEQ ID NO: 901382 - DNA, 12 bp, Homo sapiens
gattctgggttt

SEQ ID NO: 901383 - DNA, 19 bp, Homo sapiens
gattctgtgtgttttcata

SEQ ID NO: 901384 - DNA, 22 bp, Homo sapiens
gattctgtttattcttccagaa

SEQ ID NO: 901385 - DNA, 21 bp, Homo sapiens
gattcttaacacagccttcct

SEQ ID NO: 901386 - DNA, 22 bp, Homo sapiens
gattcttaacacagccttcctt

SEQ ID NO: 901387 - DNA, 16 bp, Homo sapiens
gattcttcaaaagcat

SEQ ID NO: 901388 - DNA, 17 bp, Homo sapiens
gattcttgattcctggc

SEQ ID NO: 901389 - DNA, 17 bp, Homo sapiens
gattcttgtaaatcttt

SEQ ID NO: 901390 - DNA, 18 bp, Homo sapiens
gattcttgtaaatctttt

SEQ ID NO: 901391 - DNA, 19 bp, Homo sapiens
gattctttaatagaagttt

SEQ ID NO: 901392 - DNA, 18 bp, Homo sapiens
gattctttccatttgcat

SEQ ID NO: 901393 - DNA, 13 bp, Homo sapiens
gattctttcccca

SEQ ID NO: 901394 - DNA, 15 bp, Homo sapiens
gattctttccccaga

SEQ ID NO: 901395 - DNA, 23 bp, Homo sapiens
gattcttttgtatgtaacaattg

SEQ ID NO: 901396 - DNA, 15 bp, Homo sapiens
gattcttttttcagt

SEQ ID NO: 901397 - DNA, 20 bp, Homo sapiens
gattgaaaatgtccaggaaa

SEQ ID NO: 901398 - DNA, 18 bp, Homo sapiens
gattgaagaatctgcccc

SEQ ID NO: 901399 - DNA, 16 bp, Homo sapiens
gattgaagggtcctgc

SEQ ID NO: 901400 - DNA, 21 bp, Homo sapiens
gattgaagtattttgctggaa

SEQ ID NO: 901401 - DNA, 23 bp, Homo sapiens
gattgaagtattttgctggaata

SEQ ID NO: 901402 - DNA, 17 bp, Homo sapiens
gattgacagctttgctg

SEQ ID NO: 901403 - DNA, 20 bp, Homo sapiens
gattgacctgaggagacatc

SEQ ID NO: 901404 - DNA, 12 bp, Homo sapiens
gattgacctgct

SEQ ID NO: 901405 - DNA, 14 bp, Homo sapiens
gattgacctgctcc

SEQ ID NO: 901406 - DNA, 14 bp, Homo sapiens
gattgactaaataa

SEQ ID NO: 901407 - DNA, 18 bp, Homo sapiens
gattgagaactgacaaag

SEQ ID NO: 901408 - DNA, 22 bp, Homo sapiens
gattgaggcctgccctcaggga

SEQ ID NO: 901409 - DNA, 19 bp, Homo sapiens
gattgatagagtgttatca

SEQ ID NO: 901410 - DNA, 22 bp, Homo sapiens
gattgatcggagcctcctctct

SEQ ID NO: 901411 - DNA, 14 bp, Homo sapiens
gattgatgtacaga

SEQ ID NO: 901412 - DNA, 14 bp, Homo sapiens
gattgcacagaatt

SEQ ID NO: 901413 - DNA, 14 bp, Homo sapiens
gattgcacattgtt

SEQ ID NO: 901414 - DNA, 16 bp, Homo sapiens
gattgcaccactgcac

SEQ ID NO: 901415 - DNA, 15 bp, Homo sapiens
gattgcacgtggcct

SEQ ID NO: 901416 - DNA, 17 bp, Homo sapiens
gattgcacgtggcctct

SEQ ID NO: 901417 - DNA, 23 bp, Homo sapiens
gattgcacgtggcctcttgagca

SEQ ID NO: 901418 - DNA, 12 bp, Homo sapiens
gattgcactgct

SEQ ID NO: 901419 - DNA, 19 bp, Homo sapiens
gattgcagaaaattctgtg

SEQ ID NO: 901420 - DNA, 23 bp, Homo sapiens
gattgccccagagccccactccc

SEQ ID NO: 901421 - DNA, 19 bp, Homo sapiens
gattgcgcctttgtattat

SEQ ID NO: 901422 - DNA, 19 bp, Homo sapiens
gattgcggtttacagctat

SEQ ID NO: 901423 - DNA, 16 bp, Homo sapiens
gattgctctggagcag

SEQ ID NO: 901424 - DNA, 17 bp, Homo sapiens
gattgctctggagcagc

SEQ ID NO: 901425 - DNA, 20 bp, Homo sapiens
gattgctctggagcagccaa

SEQ ID NO: 901426 - DNA, 11 bp, Homo sapiens
gattgctgcca

SEQ ID NO: 901427 - DNA, 21 bp, Homo sapiens
gattgctgccccatcagtgct

SEQ ID NO: 901428 - DNA, 19 bp, Homo sapiens
gattgctggaaaccaagtc

SEQ ID NO: 901429 - DNA, 16 bp, Homo sapiens
gattgcttctgtagta

SEQ ID NO: 901430 - DNA, 19 bp, Homo sapiens
gattgcttgagcccaggag

SEQ ID NO: 901431 - DNA, 11 bp, Homo sapiens
gattgctttgc

SEQ ID NO: 901432 - DNA, 21 bp, Homo sapiens
gattgctttgcattactgtcc

SEQ ID NO: 901433 - DNA, 16 bp, Homo sapiens
gattggaaagacagga

SEQ ID NO: 901434 - DNA, 20 bp, Homo sapiens
gattggaaagacaggaagac

SEQ ID NO: 901435 - DNA, 22 bp, Homo sapiens
gattggaatttctggcctccta

SEQ ID NO: 901436 - DNA, 23 bp, Homo sapiens
gattggacggcctgatgctccct

SEQ ID NO: 901437 - DNA, 22 bp, Homo sapiens
gcaaaggagacaaagcaggagt

SEQ ID NO: 901438 - DNA, 22 bp, Homo sapiens
gcaaaggaggggaaacaatgaa

SEQ ID NO: 901439 - DNA, 12 bp, Homo sapiens
gcaaaggcagtc

SEQ ID NO: 901440 - DNA, 20 bp, Homo sapiens
gcaaaggcccatgccccctt

SEQ ID NO: 901441 - DNA, 13 bp, Homo sapiens
gcaaaggcccttg

SEQ ID NO: 901442 - DNA, 22 bp, Homo sapiens
gcaaaggcccttgtcattgcct

SEQ ID NO: 901443 - DNA, 11 bp, Homo sapiens
gcaaaggcctg

SEQ ID NO: 901444 - DNA, 22 bp, Homo sapiens
gcaaagggcctgcccagacaag

SEQ ID NO: 901445 - DNA, 19 bp, Homo sapiens
gcaaagggctgaaagccat

SEQ ID NO: 901446 - DNA, 22 bp, Homo sapiens
gcaaagggctgaaagccatttg

SEQ ID NO: 901447 - DNA, 17 bp, Homo sapiens
gcaaaggggggaggtca

SEQ ID NO: 901448 - DNA, 21 bp, Homo sapiens
gcaaaggttccaactgtatat

SEQ ID NO: 901449 - DNA, 22 bp, Homo sapiens
gcaaagtatcaaagaaaaacaa

SEQ ID NO: 901450 - DNA, 15 bp, Homo sapiens
gcaaagtattgtaaa

SEQ ID NO: 901451 - DNA, 18 bp, Homo sapiens
gcaaagtattgtaaatta

SEQ ID NO: 901452 - DNA, 22 bp, Homo sapiens
gcaaagtcgccagtcactgctg

SEQ ID NO: 901453 - DNA, 23 bp, Homo sapiens
gcaaagtcgccagtcactgctgc

SEQ ID NO: 901454 - DNA, 23 bp, Homo sapiens
gcaaagtgctgtacccttccacc

SEQ ID NO: 901455 - DNA, 17 bp, Homo sapiens
gcaaagtttacagatgt

SEQ ID NO: 901456 - DNA, 15 bp, Homo sapiens
gcaaagttttacaga

SEQ ID NO: 901457 - DNA, 12 bp, Homo sapiens
gcaaataaaagt

SEQ ID NO: 901458 - DNA, 15 bp, Homo sapiens
gcaaataaagccttt

SEQ ID NO: 901459 - DNA, 20 bp, Homo sapiens
gcaaataaatacgtgtcaaa

SEQ ID NO: 901460 - DNA, 17 bp, Homo sapiens
gcaaataagtgtatttt

SEQ ID NO: 901461 - DNA, 17 bp, Homo sapiens
gcaaatagaaaacagga

SEQ ID NO: 901462 - DNA, 17 bp, Homo sapiens
gcaaatattagcaaaga

SEQ ID NO: 901463 - DNA, 18 bp, Homo sapiens
gcaaatattagcaaagaa

SEQ ID NO: 901464 - DNA, 22 bp, Homo sapiens
gcaaatcagaaacttgtgaagt

SEQ ID NO: 901465 - DNA, 17 bp, Homo sapiens
gcaaatcaggcttttgt

SEQ ID NO: 901466 - DNA, 16 bp, Homo sapiens
gcaaatcaggggccag

SEQ ID NO: 901467 - DNA, 14 bp, Homo sapiens
gcaaatcatttgtt

SEQ ID NO: 901468 - DNA, 15 bp, Homo sapiens
gcaaatcccatttct

SEQ ID NO: 901469 - DNA, 19 bp, Homo sapiens
gcaaatctttctgtaaaca

SEQ ID NO: 901470 - DNA, 22 bp, Homo sapiens
gcaaatctttctgtaaacagaa

SEQ ID NO: 901471 - DNA, 17 bp, Homo sapiens
gcaaatgaatcattgtt

SEQ ID NO: 901472 - DNA, 18 bp, Homo sapiens
gcaaatgccagggcccgc

SEQ ID NO: 901473 - DNA, 14 bp, Homo sapiens
gcaaatggagataa

SEQ ID NO: 901474 - DNA, 23 bp, Homo sapiens
gcaaatggagataaaagcaattc

SEQ ID NO: 901475 - DNA, 18 bp, Homo sapiens
gcaaatggaggcttttca

SEQ ID NO: 901476 - DNA, 20 bp, Homo sapiens
gcaaatggaggcttttcact

SEQ ID NO: 901477 - DNA, 19 bp, Homo sapiens
gcaaatggctgagatggag

SEQ ID NO: 901478 - DNA, 20 bp, Homo sapiens
gcaaatgggagctgagcagc

SEQ ID NO: 901479 - DNA, 15 bp, Homo sapiens
gcaaatgggcagctc

SEQ ID NO: 901480 - DNA, 16 bp, Homo sapiens
gcaaatgtcacagtaa

SEQ ID NO: 901481 - DNA, 22 bp, Homo sapiens
gcaaatgtcacagtaatgcaag

SEQ ID NO: 901482 - DNA, 20 bp, Homo sapiens
gcaaattcttttgaattgtt

SEQ ID NO: 901483 - DNA, 16 bp, Homo sapiens
gcaaattgctagtcag

SEQ ID NO: 901484 - DNA, 14 bp, Homo sapiens
gcaaattgtatctt

SEQ ID NO: 901485 - DNA, 18 bp, Homo sapiens
gcaaattgtttcagtttt

SEQ ID NO: 901486 - DNA, 14 bp, Homo sapiens
gcaaatttaagaga

SEQ ID NO: 901487 - DNA, 12 bp, Homo sapiens
gcaaattttaaa

SEQ ID NO: 901488 - DNA, 21 bp, Homo sapiens
gcaacaacaattggtaaaact

SEQ ID NO: 901489 - DNA, 20 bp, Homo sapiens
gcaacaagactgccaggtgg

SEQ ID NO: 901490 - DNA, 21 bp, Homo sapiens
gcaacaagcccgttagcccca

SEQ ID NO: 901491 - DNA, 13 bp, Homo sapiens
gcaacaataaata

SEQ ID NO: 901492 - DNA, 16 bp, Homo sapiens
gcaacacaagctggaa

SEQ ID NO: 901493 - DNA, 19 bp, Homo sapiens
gcaacacaagctggaagca

SEQ ID NO: 901494 - DNA, 13 bp, Homo sapiens
gcaacactccggt

SEQ ID NO: 901495 - DNA, 17 bp, Homo sapiens
gcaacactccggtcagc

SEQ ID NO: 901496 - DNA, 17 bp, Homo sapiens
gcaacactctatattta

SEQ ID NO: 901497 - DNA, 22 bp, Homo sapiens
gcaacactggaacatggctagc

SEQ ID NO: 901498 - DNA, 19 bp, Homo sapiens
gcaacagacaagtgactgt

SEQ ID NO: 901499 - DNA, 13 bp, Homo sapiens
gcaacagagcact

SEQ ID NO: 901500 - DNA, 18 bp, Homo sapiens
gcaacagattgaaaagac

SEQ ID NO: 901501 - DNA, 15 bp, Homo sapiens
gcaacagcaagaaat

SEQ ID NO: 901502 - DNA, 18 bp, Homo sapiens
gcaacagcactggctctc

SEQ ID NO: 901503 - DNA, 20 bp, Homo sapiens
gcaacagcactggctctctc

SEQ ID NO: 901504 - DNA, 18 bp, Homo sapiens
gcaacaggggaggaaaaa

SEQ ID NO: 901505 - DNA, 21 bp, Homo sapiens
gcaacatagtgagattctgtt

SEQ ID NO: 901506 - DNA, 18 bp, Homo sapiens
gcaacatctagcaaatgt

SEQ ID NO: 901507 - DNA, 19 bp, Homo sapiens
gcaacatctcgagccccct

SEQ ID NO: 901508 - DNA, 13 bp, Homo sapiens
gcaacatcttttt

SEQ ID NO: 901509 - DNA, 23 bp, Homo sapiens
gcaacattcctttcttgtgccct

SEQ ID NO: 901510 - DNA, 20 bp, Homo sapiens
gcaacatttctgtatactgt

SEQ ID NO: 901511 - DNA, 22 bp, Homo sapiens
gcaacatttgtatggatttaag

SEQ ID NO: 901512 - DNA, 12 bp, Homo sapiens
gcaaccacatgt

SEQ ID NO: 901513 - DNA, 11 bp, Homo sapiens
gcaaccaggaa

SEQ ID NO: 901514 - DNA, 17 bp, Homo sapiens
gcaaccaggaacagcaa

SEQ ID NO: 901515 - DNA, 14 bp, Homo sapiens
gcaaccatttgaaa

SEQ ID NO: 901516 - DNA, 14 bp, Homo sapiens
gcaacccacgtgta

SEQ ID NO: 901517 - DNA, 19 bp, Homo sapiens
gcaaccccagttctgctcc

SEQ ID NO: 901518 - DNA, 19 bp, Homo sapiens
gcaacccctgtacccagct

SEQ ID NO: 901519 - DNA, 20 bp, Homo sapiens
gcaacccgctggagcccaca

SEQ ID NO: 901520 - DNA, 23 bp, Homo sapiens
gcaaccctcctatcacctcccct

SEQ ID NO: 901521 - DNA, 21 bp, Homo sapiens
gcaacccttaccccttagcct

SEQ ID NO: 901522 - DNA, 22 bp, Homo sapiens
gcaacccttagagattgcccca

SEQ ID NO: 901523 - DNA, 17 bp, Homo sapiens
gcaacctcaccttcctg

SEQ ID NO: 901524 - DNA, 13 bp, Homo sapiens
gcaacctctgcct

SEQ ID NO: 901525 - DNA, 17 bp, Homo sapiens
gcaacctgtggctcagg

SEQ ID NO: 901526 - DNA, 19 bp, Homo sapiens
gcaacgcccctccaaacct

SEQ ID NO: 901527 - DNA, 14 bp, Homo sapiens
gcaacgtagcctgg

SEQ ID NO: 901528 - DNA, 15 bp, Homo sapiens
gcaactaaggacaaa

SEQ ID NO: 901529 - DNA, 19 bp, Homo sapiens
gcaactaatgtttgaacaa

SEQ ID NO: 901530 - DNA, 15 bp, Homo sapiens
gcaactacaacttct

SEQ ID NO: 901531 - DNA, 16 bp, Homo sapiens
gcaactacaacttctc

SEQ ID NO: 901532 - DNA, 18 bp, Homo sapiens
gcaactacaacttctcct

SEQ ID NO: 901533 - DNA, 18 bp, Homo sapiens
gcaactacagaagtggaa

SEQ ID NO: 901534 - DNA, 14 bp, Homo sapiens
gcaactcatcttag

SEQ ID NO: 901535 - DNA, 15 bp, Homo sapiens
gcaactcttgattat

SEQ ID NO: 901536 - DNA, 14 bp, Homo sapiens
gcaactcttggaag

SEQ ID NO: 901537 - DNA, 17 bp, Homo sapiens
gcaactcttttaagtgc

SEQ ID NO: 901538 - DNA, 23 bp, Homo sapiens
gcaactgacttcatttgtgccac

SEQ ID NO: 901539 - DNA, 14 bp, Homo sapiens
gcaactgaggcaga

SEQ ID NO: 901540 - DNA, 15 bp, Homo sapiens
gcaactgaggcagac

SEQ ID NO: 901541 - DNA, 22 bp, Homo sapiens
gcaactgaggcagacagcagct

SEQ ID NO: 901542 - DNA, 12 bp, Homo sapiens
gcaactgttatg

SEQ ID NO: 901543 - DNA, 18 bp, Homo sapiens
gcaactgttatgaaataa

SEQ ID NO: 901544 - DNA, 19 bp, Homo sapiens
gcaacttgtctttttctgg

SEQ ID NO: 901545 - DNA, 23 bp, Homo sapiens
gcaacttgtctttttctggactg

SEQ ID NO: 901546 - DNA, 12 bp, Homo sapiens
gcaacttgtgaa

SEQ ID NO: 901547 - DNA, 14 bp, Homo sapiens
gcaacttgtgaact

SEQ ID NO: 901548 - DNA, 13 bp, Homo sapiens
gcaacttttaaag

SEQ ID NO: 901549 - DNA, 15 bp, Homo sapiens
gcaactttttaaagt

SEQ ID NO: 901550 - DNA, 11 bp, Homo sapiens
gcaagaaaagg

SEQ ID NO: 901551 - DNA, 20 bp, Homo sapiens
gcaagaaagcttgagtctca

SEQ ID NO: 901552 - DNA, 23 bp, Homo sapiens
gcaagaaatggcgtctgctctgg

SEQ ID NO: 901553 - DNA, 18 bp, Homo sapiens
gcaagaacccaagtgcct

SEQ ID NO: 901554 - DNA, 18 bp, Homo sapiens
gcaagaagaaaatgtggc

SEQ ID NO: 901555 - DNA, 14 bp, Homo sapiens
gcaagaaggaattg

SEQ ID NO: 901556 - DNA, 16 bp, Homo sapiens
gcaagaaggcaaaaat

SEQ ID NO: 901557 - DNA, 21 bp, Homo sapiens
gcaagaaggcaaaaatagttt

SEQ ID NO: 901558 - DNA, 13 bp, Homo sapiens
gcaagaagtagca

SEQ ID NO: 901559 - DNA, 18 bp, Homo sapiens
gcacattgcccatggctg

SEQ ID NO: 901560 - DNA, 16 bp, Homo sapiens
gcacatttatatatat

SEQ ID NO: 901561 - DNA, 20 bp, Homo sapiens
gcacatttatatatatatgt

SEQ ID NO: 901562 - DNA, 13 bp, Homo sapiens
gcacatttcagaa

SEQ ID NO: 901563 - DNA, 22 bp, Homo sapiens
gcacattttccacggaaacaga

SEQ ID NO: 901564 - DNA, 16 bp, Homo sapiens
gcaccaaaagaagtaa

SEQ ID NO: 901565 - DNA, 18 bp, Homo sapiens
gcaccaaaagaagtaaaa

SEQ ID NO: 901566 - DNA, 11 bp, Homo sapiens
gcaccaagcag

SEQ ID NO: 901567 - DNA, 15 bp, Homo sapiens
gcaccacaaaatata

SEQ ID NO: 901568 - DNA, 13 bp, Homo sapiens
gcaccacactggg

SEQ ID NO: 901569 - DNA, 23 bp, Homo sapiens
gcaccacactgggtgcgtctcca

SEQ ID NO: 901570 - DNA, 21 bp, Homo sapiens
gcaccacagccggtcagagga

SEQ ID NO: 901571 - DNA, 16 bp, Homo sapiens
gcaccacattgcctca

SEQ ID NO: 901572 - DNA, 13 bp, Homo sapiens
gcaccaccaagcc

SEQ ID NO: 901573 - DNA, 14 bp, Homo sapiens
gcaccaccaagcca

SEQ ID NO: 901574 - DNA, 14 bp, Homo sapiens
gcaccaccacacag

SEQ ID NO: 901575 - DNA, 16 bp, Homo sapiens
gcaccaccacacagtc

SEQ ID NO: 901576 - DNA, 17 bp, Homo sapiens
gcaccaccacacagtca

SEQ ID NO: 901577 - DNA, 14 bp, Homo sapiens
gcaccaccagggtg

SEQ ID NO: 901578 - DNA, 19 bp, Homo sapiens
gcaccaccagggtggacca

SEQ ID NO: 901579 - DNA, 14 bp, Homo sapiens
gcaccaccatgccc

SEQ ID NO: 901580 - DNA, 17 bp, Homo sapiens
gcaccacctacacagga

SEQ ID NO: 901581 - DNA, 21 bp, Homo sapiens
gcaccacggcgtttttttaca

SEQ ID NO: 901582 - DNA, 21 bp, Homo sapiens
gcaccactgcactccagcctg

SEQ ID NO: 901583 - DNA, 23 bp, Homo sapiens
gcaccactgcactccagcctggg

SEQ ID NO: 901584 - DNA, 12 bp, Homo sapiens
gcaccactgcca

SEQ ID NO: 901585 - DNA, 17 bp, Homo sapiens
gcaccactgctgaggag

SEQ ID NO: 901586 - DNA, 15 bp, Homo sapiens
gcaccagaggctgca

SEQ ID NO: 901587 - DNA, 21 bp, Homo sapiens
gcaccagcaggtgccatcacg

SEQ ID NO: 901588 - DNA, 12 bp, Homo sapiens
gcaccagccagc

SEQ ID NO: 901589 - DNA, 16 bp, Homo sapiens
gcaccagccccctgga

SEQ ID NO: 901590 - DNA, 17 bp, Homo sapiens
gcaccagcgcccccaga

SEQ ID NO: 901591 - DNA, 18 bp, Homo sapiens
gcaccagctctgtggcct

SEQ ID NO: 901592 - DNA, 22 bp, Homo sapiens
gcaccagctctgtggcctgtgt

SEQ ID NO: 901593 - DNA, 23 bp, Homo sapiens
gcaccagctctgtggcctgtgtc

SEQ ID NO: 901594 - DNA, 13 bp, Homo sapiens
gcaccagctgctc

SEQ ID NO: 901595 - DNA, 20 bp, Homo sapiens
gcaccagctgctctgcccct

SEQ ID NO: 901596 - DNA, 16 bp, Homo sapiens
gcaccagcttctccag

SEQ ID NO: 901597 - DNA, 19 bp, Homo sapiens
gcaccagcttctccaggct

SEQ ID NO: 901598 - DNA, 20 bp, Homo sapiens
gcaccagcttctccaggctc

SEQ ID NO: 901599 - DNA, 14 bp, Homo sapiens
gcaccaggaagccg

SEQ ID NO: 901600 - DNA, 18 bp, Homo sapiens
gcaccaggaagccgtcct

SEQ ID NO: 901601 - DNA, 21 bp, Homo sapiens
gcaccaggcacgaacccacct

SEQ ID NO: 901602 - DNA, 16 bp, Homo sapiens
gcaccaggggtttctc

SEQ ID NO: 901603 - DNA, 14 bp, Homo sapiens
gcaccatccctttt

SEQ ID NO: 901604 - DNA, 19 bp, Homo sapiens
gcaccatgcaaatgtcttc

SEQ ID NO: 901605 - DNA, 16 bp, Homo sapiens
gcaccatggacatgtg

SEQ ID NO: 901606 - DNA, 19 bp, Homo sapiens
gcaccatgtgggcacggag

SEQ ID NO: 901607 - DNA, 15 bp, Homo sapiens
gcaccattctcctgc

SEQ ID NO: 901608 - DNA, 15 bp, Homo sapiens
gcaccattctgactc

SEQ ID NO: 901609 - DNA, 17 bp, Homo sapiens
gcacccaaaactcaagc

SEQ ID NO: 901610 - DNA, 15 bp, Homo sapiens
gcacccacaagcccg

SEQ ID NO: 901611 - DNA, 22 bp, Homo sapiens
gcacccacaagcccgtgacaga

SEQ ID NO: 901612 - DNA, 17 bp, Homo sapiens
gcacccaccaccacgcc

SEQ ID NO: 901613 - DNA, 21 bp, Homo sapiens
gcacccaccgtctcggccctg

SEQ ID NO: 901614 - DNA, 18 bp, Homo sapiens
gcacccacctccaccccc

SEQ ID NO: 901615 - DNA, 13 bp, Homo sapiens
gcacccacctgtt

SEQ ID NO: 901616 - DNA, 18 bp, Homo sapiens
gcacccacctgttttctg

SEQ ID NO: 901617 - DNA, 21 bp, Homo sapiens
gcacccacctgttttctgaaa

SEQ ID NO: 901618 - DNA, 22 bp, Homo sapiens
gcacccacctgttttctgaaac

SEQ ID NO: 901619 - DNA, 14 bp, Homo sapiens
gcacccactcacca

SEQ ID NO: 901620 - DNA, 19 bp, Homo sapiens
gcacccagagaaaattaat

SEQ ID NO: 901621 - DNA, 20 bp, Homo sapiens
gcaccccaaagctttcctgc

SEQ ID NO: 901622 - DNA, 15 bp, Homo sapiens
gcaccccactgggag

SEQ ID NO: 901623 - DNA, 22 bp, Homo sapiens
gcaccccagcattccagctctg

SEQ ID NO: 901624 - DNA, 16 bp, Homo sapiens
gcaccccagcgtcagg

SEQ ID NO: 901625 - DNA, 19 bp, Homo sapiens
gcaccccagctaccccttc

SEQ ID NO: 901626 - DNA, 19 bp, Homo sapiens
gcaccccatcccaccagcc

SEQ ID NO: 901627 - DNA, 16 bp, Homo sapiens
gcacccccacccacct

SEQ ID NO: 901628 - DNA, 18 bp, Homo sapiens
gcacccccacccacctcc

SEQ ID NO: 901629 - DNA, 21 bp, Homo sapiens
gcacccccacccacctccacc

SEQ ID NO: 901630 - DNA, 13 bp, Homo sapiens
gcacccccaccct

SEQ ID NO: 901631 - DNA, 18 bp, Homo sapiens
gcacccccaccctttggg

SEQ ID NO: 901632 - DNA, 12 bp, Homo sapiens
gcacccccgcca

SEQ ID NO: 901633 - DNA, 22 bp, Homo sapiens
gcaccccgcttttgcagcagag

SEQ ID NO: 901634 - DNA, 23 bp, Homo sapiens
gcaccccgcttttgcagcagagg

SEQ ID NO: 901635 - DNA, 13 bp, Homo sapiens
gcacccctcccag

SEQ ID NO: 901636 - DNA, 13 bp, Homo sapiens
gcacccctccctg

SEQ ID NO: 901637 - DNA, 17 bp, Homo sapiens
gcacccctccctgcttg

SEQ ID NO: 901638 - DNA, 20 bp, Homo sapiens
gcacccctccgtgtggagca

SEQ ID NO: 901639 - DNA, 12 bp, Homo sapiens
gcacccctggaa

SEQ ID NO: 901640 - DNA, 18 bp, Homo sapiens
gcacccctgggccagcgg

SEQ ID NO: 901641 - DNA, 12 bp, Homo sapiens
gcaccccttctc

SEQ ID NO: 901642 - DNA, 20 bp, Homo sapiens
gcaccccttctctcctcccc

SEQ ID NO: 901643 - DNA, 19 bp, Homo sapiens
gcacccctttcctccccat

SEQ ID NO: 901644 - DNA, 21 bp, Homo sapiens
gcaccctagttctacctcagg

SEQ ID NO: 901645 - DNA, 13 bp, Homo sapiens
gcaccctataaat

SEQ ID NO: 901646 - DNA, 15 bp, Homo sapiens
gcaccctcaggcagg

SEQ ID NO: 901647 - DNA, 19 bp, Homo sapiens
gcaccctcaggcaggtggg

SEQ ID NO: 901648 - DNA, 17 bp, Homo sapiens
gcaccctcatacacaga

SEQ ID NO: 901649 - DNA, 20 bp, Homo sapiens
gcaccctcatacacagaaac

SEQ ID NO: 901650 - DNA, 14 bp, Homo sapiens
gcaccctccaccct

SEQ ID NO: 901651 - DNA, 15 bp, Homo sapiens
gcaccctccaccctg

SEQ ID NO: 901652 - DNA, 15 bp, Homo sapiens
gcaccctctcctggg

SEQ ID NO: 901653 - DNA, 16 bp, Homo sapiens
gcaccctgcacctgct

SEQ ID NO: 901654 - DNA, 18 bp, Homo sapiens
gcaccctgccctcatggg

SEQ ID NO: 901655 - DNA, 22 bp, Homo sapiens
gcaccctggaaaggggagttga

SEQ ID NO: 901656 - DNA, 14 bp, Homo sapiens
gcaccctggggcct

SEQ ID NO: 901657 - DNA, 17 bp, Homo sapiens
gcaccctggggcctgga

SEQ ID NO: 901658 - DNA, 13 bp, Homo sapiens
gcaccctgggtgc

SEQ ID NO: 901659 - DNA, 15 bp, Homo sapiens
gcaccctgggtgcca

SEQ ID NO: 901660 - DNA, 22 bp, Homo sapiens
gcaccctgggtgccattcccag

SEQ ID NO: 901661 - DNA, 19 bp, Homo sapiens
gcacccttctcggagaccc

SEQ ID NO: 901662 - DNA, 18 bp, Homo sapiens
gcacccttctttcctctt

SEQ ID NO: 901663 - DNA, 21 bp, Homo sapiens
gcacccttctttcctcttccc

SEQ ID NO: 901664 - DNA, 16 bp, Homo sapiens
gcaccgacccgaggcc

SEQ ID NO: 901665 - DNA, 18 bp, Homo sapiens
gcaccgacccgaggccca

SEQ ID NO: 901666 - DNA, 13 bp, Homo sapiens
gcaccgccgcaga

SEQ ID NO: 901667 - DNA, 15 bp, Homo sapiens
gcaccgccgccaccc

SEQ ID NO: 901668 - DNA, 14 bp, Homo sapiens
gcaccgcctgccct

SEQ ID NO: 901669 - DNA, 15 bp, Homo sapiens
gcaccgcctgccctc

SEQ ID NO: 901670 - DNA, 21 bp, Homo sapiens
gcaccgcctgccctcccgcac

SEQ ID NO: 901671 - DNA, 12 bp, Homo sapiens
gcaccggcgctg

SEQ ID NO: 901672 - DNA, 17 bp, Homo sapiens
gcaccggcgctgcaggt

SEQ ID NO: 901673 - DNA, 16 bp, Homo sapiens
gcaccgggctccatgc

SEQ ID NO: 901674 - DNA, 22 bp, Homo sapiens
gcaccgggctccatgcctctgg

SEQ ID NO: 901675 - DNA, 13 bp, Homo sapiens
gcaccgggctggc

SEQ ID NO: 901676 - DNA, 24 bp, Homo sapiens
gcaccgtgatggagaggacagagc

SEQ ID NO: 901677 - DNA, 20 bp, Homo sapiens
gcaccgtgtcaagctgctct

SEQ ID NO: 901678 - DNA, 17 bp, Homo sapiens
gcaccgtgtcctcctct

SEQ ID NO: 901679 - DNA, 14 bp, Homo sapiens
gcaccgttctgtgc

SEQ ID NO: 901680 - DNA, 19 bp, Homo sapiens
gcacctaaaccaccagtgc

SEQ ID NO: 901681 - DNA, 13 bp, Homo sapiens
tccagctaattca

SEQ ID NO: 901682 - DNA, 19 bp, Homo sapiens
tccagctcagaacccaggg

SEQ ID NO: 901683 - DNA, 14 bp, Homo sapiens
tccagctcctctag

SEQ ID NO: 901684 - DNA, 17 bp, Homo sapiens
tccagctctgacatccc

SEQ ID NO: 901685 - DNA, 15 bp, Homo sapiens
tccagctctggaggg

SEQ ID NO: 901686 - DNA, 14 bp, Homo sapiens
tccagctgactaaa

SEQ ID NO: 901687 - DNA, 17 bp, Homo sapiens
tccagctgcaccagagc

SEQ ID NO: 901688 - DNA, 16 bp, Homo sapiens
tccagctgcccctccc

SEQ ID NO: 901689 - DNA, 18 bp, Homo sapiens
tccagctgcccctccctc

SEQ ID NO: 901690 - DNA, 21 bp, Homo sapiens
tccagctgcccttccgcagtg

SEQ ID NO: 901691 - DNA, 12 bp, Homo sapiens
tccagctgcctg

SEQ ID NO: 901692 - DNA, 13 bp, Homo sapiens
tccagctgcctgg

SEQ ID NO: 901693 - DNA, 14 bp, Homo sapiens
tccagctgcctggg

SEQ ID NO: 901694 - DNA, 15 bp, Homo sapiens
tccagctgcctgggc

SEQ ID NO: 901695 - DNA, 17 bp, Homo sapiens
tccagctgcctgggccc

SEQ ID NO: 901696 - DNA, 14 bp, Homo sapiens
tccagctgctgtct

SEQ ID NO: 901697 - DNA, 15 bp, Homo sapiens
tccagctgctgtctt

SEQ ID NO: 901698 - DNA, 12 bp, Homo sapiens
tccagctggcct

SEQ ID NO: 901699 - DNA, 12 bp, Homo sapiens
tccagctgggac

SEQ ID NO: 901700 - DNA, 18 bp, Homo sapiens
tccagctggggccagagg

SEQ ID NO: 901701 - DNA, 14 bp, Homo sapiens
tccagctgtcgtct

SEQ ID NO: 901702 - DNA, 15 bp, Homo sapiens
tccagctgttcttag

SEQ ID NO: 901703 - DNA, 17 bp, Homo sapiens
tccagcttcagctcaac

SEQ ID NO: 901704 - DNA, 16 bp, Homo sapiens
tccagcttcggagggc

SEQ ID NO: 901705 - DNA, 23 bp, Homo sapiens
tccagcttcggagggcccctgcg

SEQ ID NO: 901706 - DNA, 23 bp, Homo sapiens
tccagcttctggtactctcctag

SEQ ID NO: 901707 - DNA, 17 bp, Homo sapiens
tccagcttgctcttcag

SEQ ID NO: 901708 - DNA, 19 bp, Homo sapiens
tccagcttgctcttcagtg

SEQ ID NO: 901709 - DNA, 14 bp, Homo sapiens
tccagctttaaggg

SEQ ID NO: 901710 - DNA, 16 bp, Homo sapiens
tccagctttctgccat

SEQ ID NO: 901711 - DNA, 14 bp, Homo sapiens
tccagctttgggga

SEQ ID NO: 901712 - DNA, 17 bp, Homo sapiens
tccagcttttcctcagg

SEQ ID NO: 901713 - DNA, 19 bp, Homo sapiens
tccagcttttcctcagggt

SEQ ID NO: 901714 - DNA, 13 bp, Homo sapiens
tccaggaaaaaat

SEQ ID NO: 901715 - DNA, 19 bp, Homo sapiens
tccaggaaaaaataaaaag

SEQ ID NO: 901716 - DNA, 19 bp, Homo sapiens
tccaggaaaactgggacat

SEQ ID NO: 901717 - DNA, 11 bp, Homo sapiens
tccaggaaaga

SEQ ID NO: 901718 - DNA, 15 bp, Homo sapiens
tccaggaaagagcag

SEQ ID NO: 901719 - DNA, 14 bp, Homo sapiens
tccaggaaccaaaa

SEQ ID NO: 901720 - DNA, 16 bp, Homo sapiens
tccaggaactgcctgg

SEQ ID NO: 901721 - DNA, 21 bp, Homo sapiens
tccaggaagaaagaatgttac

SEQ ID NO: 901722 - DNA, 12 bp, Homo sapiens
tccaggaaggca

SEQ ID NO: 901723 - DNA, 14 bp, Homo sapiens
tccaggaaggcagc

SEQ ID NO: 901724 - DNA, 15 bp, Homo sapiens
tccaggaaggcagct

SEQ ID NO: 901725 - DNA, 16 bp, Homo sapiens
tccaggaaggcagctg

SEQ ID NO: 901726 - DNA, 18 bp, Homo sapiens
tccaggaaggcagctgct

SEQ ID NO: 901727 - DNA, 19 bp, Homo sapiens
tccaggaaggcagctgctc

SEQ ID NO: 901728 - DNA, 16 bp, Homo sapiens
tccaggaataggcatt

SEQ ID NO: 901729 - DNA, 22 bp, Homo sapiens
tccaggaatgctgggcccccag

SEQ ID NO: 901730 - DNA, 18 bp, Homo sapiens
tccaggacatgatactga

SEQ ID NO: 901731 - DNA, 20 bp, Homo sapiens
tccaggagaaggccaattcc

SEQ ID NO: 901732 - DNA, 17 bp, Homo sapiens
tccaggagacatatata

SEQ ID NO: 901733 - DNA, 17 bp, Homo sapiens
tccaggagagagccagg

SEQ ID NO: 901734 - DNA, 16 bp, Homo sapiens
tccaggagagcctggg

SEQ ID NO: 901735 - DNA, 18 bp, Homo sapiens
tccaggagagcctggggg

SEQ ID NO: 901736 - DNA, 18 bp, Homo sapiens
tccaggagcctgtgcctc

SEQ ID NO: 901737 - DNA, 16 bp, Homo sapiens
tccaggagcttcttgt

SEQ ID NO: 901738 - DNA, 23 bp, Homo sapiens
tccaggagcttcttgtttccttg

SEQ ID NO: 901739 - DNA, 17 bp, Homo sapiens
tccaggatcctgcagga

SEQ ID NO: 901740 - DNA, 20 bp, Homo sapiens
tccaggatctccactgataa

SEQ ID NO: 901741 - DNA, 21 bp, Homo sapiens
tccaggatggatgcatcacac

SEQ ID NO: 901742 - DNA, 16 bp, Homo sapiens
tccaggattttaattt

SEQ ID NO: 901743 - DNA, 23 bp, Homo sapiens
tccaggattttaatttcaggaaa

SEQ ID NO: 901744 - DNA, 12 bp, Homo sapiens
tccaggcacagg

SEQ ID NO: 901745 - DNA, 13 bp, Homo sapiens
tccaggcacagga

SEQ ID NO: 901746 - DNA, 18 bp, Homo sapiens
tccaggcacaggatgctg

SEQ ID NO: 901747 - DNA, 21 bp, Homo sapiens
tccaggcaccaggactagggc

SEQ ID NO: 901748 - DNA, 18 bp, Homo sapiens
tccaggcaccctcaggga

SEQ ID NO: 901749 - DNA, 15 bp, Homo sapiens
tccaggcacccttct

SEQ ID NO: 901750 - DNA, 20 bp, Homo sapiens
tccaggcacccttctttcct

SEQ ID NO: 901751 - DNA, 16 bp, Homo sapiens
tccaggcactgagata

SEQ ID NO: 901752 - DNA, 17 bp, Homo sapiens
tccaggcagcagacaca

SEQ ID NO: 901753 - DNA, 15 bp, Homo sapiens
tccaggcaggccagg

SEQ ID NO: 901754 - DNA, 23 bp, Homo sapiens
tccaggcaggccaggctgcctcg

SEQ ID NO: 901755 - DNA, 17 bp, Homo sapiens
tccaggccactgtggcc

SEQ ID NO: 901756 - DNA, 15 bp, Homo sapiens
tccaggccaggtggg

SEQ ID NO: 901757 - DNA, 21 bp, Homo sapiens
tccaggccagtgggcctggta

SEQ ID NO: 901758 - DNA, 11 bp, Homo sapiens
tccaggcccaa

SEQ ID NO: 901759 - DNA, 17 bp, Homo sapiens
tccaggcccaaggctcc

SEQ ID NO: 901760 - DNA, 19 bp, Homo sapiens
tccaggcccaaggctcccg

SEQ ID NO: 901761 - DNA, 16 bp, Homo sapiens
tccaggcccctgagga

SEQ ID NO: 901762 - DNA, 17 bp, Homo sapiens
tccaggcccctgaggac

SEQ ID NO: 901763 - DNA, 22 bp, Homo sapiens
tccaggcccctgaggactggag

SEQ ID NO: 901764 - DNA, 17 bp, Homo sapiens
tccaggcctctctctgc

SEQ ID NO: 901765 - DNA, 20 bp, Homo sapiens
tccaggcctctctctgctcc

SEQ ID NO: 901766 - DNA, 21 bp, Homo sapiens
tccaggcctctctctgctcca

SEQ ID NO: 901767 - DNA, 14 bp, Homo sapiens
tccaggcctgcagc

SEQ ID NO: 901768 - DNA, 14 bp, Homo sapiens
tccaggcctgcctc

SEQ ID NO: 901769 - DNA, 15 bp, Homo sapiens
tccaggcctgcctcc

SEQ ID NO: 901770 - DNA, 16 bp, Homo sapiens
tccaggcctgcctccc

SEQ ID NO: 901771 - DNA, 21 bp, Homo sapiens
tccaggctacaatcttcattt

SEQ ID NO: 901772 - DNA, 22 bp, Homo sapiens
tccaggctctgggcacagtgct

SEQ ID NO: 901773 - DNA, 15 bp, Homo sapiens
tccaggctcttcctg

SEQ ID NO: 901774 - DNA, 20 bp, Homo sapiens
tccaggctcttcctggacct

SEQ ID NO: 901775 - DNA, 22 bp, Homo sapiens
tccaggctggtcttgaattcct

SEQ ID NO: 901776 - DNA, 15 bp, Homo sapiens
tccaggcttgcctca

SEQ ID NO: 901777 - DNA, 21 bp, Homo sapiens
tccagggaaggtggccacagc

SEQ ID NO: 901778 - DNA, 14 bp, Homo sapiens
tccagggaatccaa

SEQ ID NO: 901779 - DNA, 20 bp, Homo sapiens
tccagggaatccaagcctcc

SEQ ID NO: 901780 - DNA, 15 bp, Homo sapiens
tccagggacccttgc

SEQ ID NO: 901781 - DNA, 17 bp, Homo sapiens
tccagggacccttgcct

SEQ ID NO: 901782 - DNA, 21 bp, Homo sapiens
tccagggacccttgcctgcct

SEQ ID NO: 901783 - DNA, 14 bp, Homo sapiens
tccagggcagcagc

SEQ ID NO: 901784 - DNA, 16 bp, Homo sapiens
tccagggcagcagccg

SEQ ID NO: 901785 - DNA, 13 bp, Homo sapiens
tccagggcagcct

SEQ ID NO: 901786 - DNA, 23 bp, Homo sapiens
tccagggccacgtgccaggcccg

SEQ ID NO: 901787 - DNA, 14 bp, Homo sapiens
tccagggcccaggt

SEQ ID NO: 901788 - DNA, 21 bp, Homo sapiens
tccagggccccaggcccgcgg

SEQ ID NO: 901789 - DNA, 13 bp, Homo sapiens
tccagggccctga

SEQ ID NO: 901790 - DNA, 20 bp, Homo sapiens
tccagggcgccagggtgctg

SEQ ID NO: 901791 - DNA, 14 bp, Homo sapiens
tccagggctagtga

SEQ ID NO: 901792 - DNA, 21 bp, Homo sapiens
tccagggctccaaatctgcct

SEQ ID NO: 901793 - DNA, 11 bp, Homo sapiens
tccagggctgg

SEQ ID NO: 901794 - DNA, 15 bp, Homo sapiens
tccagggctggggtg

SEQ ID NO: 901795 - DNA, 14 bp, Homo sapiens
tccaggggaacctg

SEQ ID NO: 901796 - DNA, 12 bp, Homo sapiens
tccaggggcacc

SEQ ID NO: 901797 - DNA, 21 bp, Homo sapiens
tccaggggcccttgggacagc

SEQ ID NO: 901798 - DNA, 23 bp, Homo sapiens
tccaggggcccttgggacagcca

SEQ ID NO: 901799 - DNA, 13 bp, Homo sapiens
tccaggggctcct

SEQ ID NO: 901800 - DNA, 16 bp, Homo sapiens
tccaggggctcctggg

SEQ ID NO: 901801 - DNA, 22 bp, Homo sapiens
tccaggggctgcttcctcctgg

SEQ ID NO: 901802 - DNA, 19 bp, Homo sapiens
tccagggggaaggccaagg

SEQ ID NO: 901803 - DNA, 18 bp, Homo sapiens
tccagggtccctctgtgt

SEQ ID NO: 901804 - DNA, 14 bp, Homo sapiens
tttccttatttgct

SEQ ID NO: 901805 - DNA, 14 bp, Homo sapiens
tttccttcaggttt

SEQ ID NO: 901806 - DNA, 12 bp, Homo sapiens
tttccttccact

SEQ ID NO: 901807 - DNA, 19 bp, Homo sapiens
tttccttccatccctaccc

SEQ ID NO: 901808 - DNA, 21 bp, Homo sapiens
tgaacacacacgccagctcct

SEQ ID NO: 901809 - DNA, 17 bp, Homo sapiens
tgaacacagtgtctgtt

SEQ ID NO: 901810 - DNA, 15 bp, Homo sapiens
tgaacacagtttagt

SEQ ID NO: 901811 - DNA, 22 bp, Homo sapiens
tgaacacgaaagaaatgtacct

SEQ ID NO: 901812 - DNA, 19 bp, Homo sapiens
tgaacactagtctgtgtaa

SEQ ID NO: 901813 - DNA, 18 bp, Homo sapiens
tgaacactggcaacaaca

SEQ ID NO: 901814 - DNA, 17 bp, Homo sapiens
tgaacactgggggaggg

SEQ ID NO: 901815 - DNA, 22 bp, Homo sapiens
tgaacactgggggaggggacat

SEQ ID NO: 901816 - DNA, 13 bp, Homo sapiens
tgaacactgtcat

SEQ ID NO: 901817 - DNA, 12 bp, Homo sapiens
tgaacactgtga

SEQ ID NO: 901818 - DNA, 16 bp, Homo sapiens
tgaacagaagctctta

SEQ ID NO: 901819 - DNA, 21 bp, Homo sapiens
tgaacagaagctcttactctt

SEQ ID NO: 901820 - DNA, 20 bp, Homo sapiens
tgaacagagggagagactaa

SEQ ID NO: 901821 - DNA, 21 bp, Homo sapiens
tgaacagagggagagactaac

SEQ ID NO: 901822 - DNA, 19 bp, Homo sapiens
tgaacagcagtaatcctgg

SEQ ID NO: 901823 - DNA, 20 bp, Homo sapiens
tgaacagcagtaatcctggg

SEQ ID NO: 901824 - DNA, 13 bp, Homo sapiens
tgaacagctgtga

SEQ ID NO: 901825 - DNA, 17 bp, Homo sapiens
tgaacagctgtgtctgc

SEQ ID NO: 901826 - DNA, 13 bp, Homo sapiens
tgaacaggctggg

SEQ ID NO: 901827 - DNA, 15 bp, Homo sapiens
tgaacaggctggggc

SEQ ID NO: 901828 - DNA, 18 bp, Homo sapiens
tgaacagttgctgttctt

SEQ ID NO: 901829 - DNA, 19 bp, Homo sapiens
tgaacagttgctgttctta

SEQ ID NO: 901830 - DNA, 19 bp, Homo sapiens
tgaacatacttcaaaaata

SEQ ID NO: 901831 - DNA, 22 bp, Homo sapiens
tgaacatcagggtgtggcattt

SEQ ID NO: 901832 - DNA, 18 bp, Homo sapiens
tgaacatccttccttccc

SEQ ID NO: 901833 - DNA, 20 bp, Homo sapiens
tgaacatccttccttcccac

SEQ ID NO: 901834 - DNA, 17 bp, Homo sapiens
tgaacatctgagtcctg

SEQ ID NO: 901835 - DNA, 22 bp, Homo sapiens
tgaacatgcagttcattatttt

SEQ ID NO: 901836 - DNA, 22 bp, Homo sapiens
tgaacatgcctgccaaagacgt

SEQ ID NO: 901837 - DNA, 20 bp, Homo sapiens
tgaacatgtgccttttctga

SEQ ID NO: 901838 - DNA, 12 bp, Homo sapiens
tgaacatgttta

SEQ ID NO: 901839 - DNA, 15 bp, Homo sapiens
tgaacatgtttacag

SEQ ID NO: 901840 - DNA, 16 bp, Homo sapiens
tgaacattaaaatata

SEQ ID NO: 901841 - DNA, 12 bp, Homo sapiens
tgaacattgcat

SEQ ID NO: 901842 - DNA, 22 bp, Homo sapiens
tgaacattgcatataacttata

SEQ ID NO: 901843 - DNA, 23 bp, Homo sapiens
tgaacattggggattgaaaatca

SEQ ID NO: 901844 - DNA, 20 bp, Homo sapiens
tgaacattggttctttcatt

SEQ ID NO: 901845 - DNA, 15 bp, Homo sapiens
tgaacatttcaaatt

SEQ ID NO: 901846 - DNA, 21 bp, Homo sapiens
tgaacatttcaaattgaattt

SEQ ID NO: 901847 - DNA, 22 bp, Homo sapiens
tgaacatttgggttactatttc

SEQ ID NO: 901848 - DNA, 22 bp, Homo sapiens
tgaacattttgtggagtttgta

SEQ ID NO: 901849 - DNA, 15 bp, Homo sapiens
tgaaccaaagcctct

SEQ ID NO: 901850 - DNA, 15 bp, Homo sapiens
tgaaccaacatcttt

SEQ ID NO: 901851 - DNA, 14 bp, Homo sapiens
tgaaccaagggatc

SEQ ID NO: 901852 - DNA, 19 bp, Homo sapiens
tgaaccacaagtgaatctt

SEQ ID NO: 901853 - DNA, 14 bp, Homo sapiens
ggccagaggctggg

SEQ ID NO: 901854 - DNA, 15 bp, Homo sapiens
ggccagaggctggga

SEQ ID NO: 901855 - DNA, 15 bp, Homo sapiens
ggccagagggcagtg

SEQ ID NO: 901856 - DNA, 15 bp, Homo sapiens
ggccagagtggcctg

SEQ ID NO: 901857 - DNA, 20 bp, Homo sapiens
ggccagagtggcctggccag

SEQ ID NO: 901858 - DNA, 20 bp, Homo sapiens
ggccagatgcacatccctgg

SEQ ID NO: 901859 - DNA, 21 bp, Homo sapiens
ggccagatgcacatccctgga

SEQ ID NO: 901860 - DNA, 19 bp, Homo sapiens
ggccagcaaaaactgtggg

SEQ ID NO: 901861 - DNA, 14 bp, Homo sapiens
ggccagcaaggcag

SEQ ID NO: 901862 - DNA, 16 bp, Homo sapiens
ggccagcaaggcaggt

SEQ ID NO: 901863 - DNA, 17 bp, Homo sapiens
ggccagcaccctctcct

SEQ ID NO: 901864 - DNA, 14 bp, Homo sapiens
ggccagcagagggc

SEQ ID NO: 901865 - DNA, 20 bp, Homo sapiens
ggccagcataggggggaggg

SEQ ID NO: 901866 - DNA, 14 bp, Homo sapiens
ggccagccaggcgg

SEQ ID NO: 901867 - DNA, 16 bp, Homo sapiens
ggccagccaggcgggc

SEQ ID NO: 901868 - DNA, 15 bp, Homo sapiens
ggccagccatgtctg

SEQ ID NO: 901869 - DNA, 11 bp, Homo sapiens
ggccagcccag

SEQ ID NO: 901870 - DNA, 20 bp, Homo sapiens
ggccagccccacccaggagg

SEQ ID NO: 901871 - DNA, 21 bp, Homo sapiens
ggccagccccacccaggaggg

SEQ ID NO: 901872 - DNA, 23 bp, Homo sapiens
ggccagccccacccccagccagg

SEQ ID NO: 901873 - DNA, 18 bp, Homo sapiens
ggccagcccccccaccca

SEQ ID NO: 901874 - DNA, 16 bp, Homo sapiens
ggccagcccctggggc

SEQ ID NO: 901875 - DNA, 22 bp, Homo sapiens
ggccagcccctggggcccagcc

SEQ ID NO: 901876 - DNA, 15 bp, Homo sapiens
ggccagcccggctgg

SEQ ID NO: 901877 - DNA, 18 bp, Homo sapiens
ggccagcccggctggttt

SEQ ID NO: 901878 - DNA, 22 bp, Homo sapiens
ggccagcctccgagagggagag

SEQ ID NO: 901879 - DNA, 13 bp, Homo sapiens
ggccagcctggat

SEQ ID NO: 901880 - DNA, 16 bp, Homo sapiens
ggccagcgccagggcc

SEQ ID NO: 901881 - DNA, 18 bp, Homo sapiens
ggccagcgccagggccca

SEQ ID NO: 901882 - DNA, 22 bp, Homo sapiens
ggccagcgccagggcccaggcc

SEQ ID NO: 901883 - DNA, 14 bp, Homo sapiens
ggccagcggggctg

SEQ ID NO: 901884 - DNA, 19 bp, Homo sapiens
ggccagcggggctgctcac

SEQ ID NO: 901885 - DNA, 21 bp, Homo sapiens
ggccagctaatttttgtatgt

SEQ ID NO: 901886 - DNA, 20 bp, Homo sapiens
ggccagctgccccagccaga

SEQ ID NO: 901887 - DNA, 13 bp, Homo sapiens
ggccagctgggga

SEQ ID NO: 901888 - DNA, 14 bp, Homo sapiens
ggccagctggggag

SEQ ID NO: 901889 - DNA, 18 bp, Homo sapiens
ggccagctggggagatgg

SEQ ID NO: 901890 - DNA, 22 bp, Homo sapiens
ggccagctggggagatgggggc

SEQ ID NO: 901891 - DNA, 16 bp, Homo sapiens
ggccaggacaggcccg

SEQ ID NO: 901892 - DNA, 15 bp, Homo sapiens
ggccaggagctcttc

SEQ ID NO: 901893 - DNA, 19 bp, Homo sapiens
ggccaggagtttgagacca

SEQ ID NO: 901894 - DNA, 20 bp, Homo sapiens
ggccaggagtttgagaccag

SEQ ID NO: 901895 - DNA, 22 bp, Homo sapiens
ggccaggatccccctctttgca

SEQ ID NO: 901896 - DNA, 11 bp, Homo sapiens
ggccaggcaga

SEQ ID NO: 901897 - DNA, 12 bp, Homo sapiens
ggccaggcagaa

SEQ ID NO: 901898 - DNA, 20 bp, Homo sapiens
ggccaggcagaatggctgca

SEQ ID NO: 901899 - DNA, 15 bp, Homo sapiens
ggccaggcagatctg

SEQ ID NO: 901900 - DNA, 16 bp, Homo sapiens
ggccaggccaccagga

SEQ ID NO: 901901 - DNA, 22 bp, Homo sapiens
ggccaggcctcgcacttgcaga

SEQ ID NO: 901902 - DNA, 15 bp, Homo sapiens
ggccaggcctgcaga

SEQ ID NO: 901903 - DNA, 11 bp, Homo sapiens
ggccaggcctt

SEQ ID NO: 901904 - DNA, 23 bp, Homo sapiens
ggccaggccttacatctggctgg

SEQ ID NO: 901905 - DNA, 14 bp, Homo sapiens
ggccaggcgagcct

SEQ ID NO: 901906 - DNA, 21 bp, Homo sapiens
ggccaggctgatgggacagaa

SEQ ID NO: 901907 - DNA, 14 bp, Homo sapiens
ggccaggctgcctc

SEQ ID NO: 901908 - DNA, 19 bp, Homo sapiens
ggccagggacccaaagcag

SEQ ID NO: 901909 - DNA, 12 bp, Homo sapiens
ggccagggaggc

SEQ ID NO: 901910 - DNA, 14 bp, Homo sapiens
ggccagggaggcgc

SEQ ID NO: 901911 - DNA, 18 bp, Homo sapiens
ggccagggaggcgcaggg

SEQ ID NO: 901912 - DNA, 20 bp, Homo sapiens
ggccagggaggcgcagggac

SEQ ID NO: 901913 - DNA, 20 bp, Homo sapiens
ggccagggccacgctccagc

SEQ ID NO: 901914 - DNA, 16 bp, Homo sapiens
ggccagggccctgcag

SEQ ID NO: 901915 - DNA, 17 bp, Homo sapiens
ggccagggccctgcaga

SEQ ID NO: 901916 - DNA, 17 bp, Homo sapiens
ggccagggcctctccaa

SEQ ID NO: 901917 - DNA, 16 bp, Homo sapiens
ggccagggcggccagg

SEQ ID NO: 901918 - DNA, 19 bp, Homo sapiens
ggccagggctatagctcag

SEQ ID NO: 901919 - DNA, 20 bp, Homo sapiens
ggccagggctatagctcagg

SEQ ID NO: 901920 - DNA, 21 bp, Homo sapiens
ggccagggctcaccagctggg

SEQ ID NO: 901921 - DNA, 18 bp, Homo sapiens
ggccagggctgccctgag

SEQ ID NO: 901922 - DNA, 20 bp, Homo sapiens
ggccagggctgccctgagaa

SEQ ID NO: 901923 - DNA, 24 bp, Homo sapiens
ggccagggcttccccatcagctcc

SEQ ID NO: 901924 - DNA, 23 bp, Homo sapiens
ggccagggtctgtgtgaatgtgg

SEQ ID NO: 901925 - DNA, 16 bp, Homo sapiens
ggccagggtgagagct

SEQ ID NO: 901926 - DNA, 11 bp, Homo sapiens
ggccagggtgg

SEQ ID NO: 901927 - DNA, 16 bp, Homo sapiens
ggccagggtgggaaga

SEQ ID NO: 901928 - DNA, 13 bp, Homo sapiens
ggccactgaccca

SEQ ID NO: 901929 - DNA, 14 bp, Homo sapiens
ggccactgacccac

SEQ ID NO: 901930 - DNA, 16 bp, Homo sapiens
ggccactgacccacct

SEQ ID NO: 901931 - DNA, 13 bp, Homo sapiens
ggccactgcgcca

SEQ ID NO: 901932 - DNA, 21 bp, Homo sapiens
ggccactgcgccactgccatc

SEQ ID NO: 901933 - DNA, 18 bp, Homo sapiens
ggccactgtcaaggcagg

SEQ ID NO: 901934 - DNA, 15 bp, Homo sapiens
ggccactgtccctgt

SEQ ID NO: 901935 - DNA, 19 bp, Homo sapiens
ggccactgtccctgtcctt

SEQ ID NO: 901936 - DNA, 15 bp, Homo sapiens
ggccactgtggccag

SEQ ID NO: 901937 - DNA, 17 bp, Homo sapiens
ggccactgtggccagag

SEQ ID NO: 901938 - DNA, 20 bp, Homo sapiens
ggccactgtggccagagctg

SEQ ID NO: 901939 - DNA, 13 bp, Homo sapiens
ggccactgtgggt

SEQ ID NO: 901940 - DNA, 15 bp, Homo sapiens
ggccactgtgggtga

SEQ ID NO: 901941 - DNA, 21 bp, Homo sapiens
ggccactgtgggtgaagcgcc

SEQ ID NO: 901942 - DNA, 18 bp, Homo sapiens
ggccactgtgtctctgtt

SEQ ID NO: 901943 - DNA, 22 bp, Homo sapiens
ggccactttcagagcccccagc

SEQ ID NO: 901944 - DNA, 15 bp, Homo sapiens
ggccacttttgacta

SEQ ID NO: 901945 - DNA, 13 bp, Homo sapiens
ggccagaaggagg

SEQ ID NO: 901946 - DNA, 14 bp, Homo sapiens
ggccagaaggaggg

SEQ ID NO: 901947 - DNA, 15 bp, Homo sapiens
ggccagaaggagggc

SEQ ID NO: 901948 - DNA, 16 bp, Homo sapiens
ggccagaaggagggca

SEQ ID NO: 901949 - DNA, 20 bp, Homo sapiens
ggccagaaggagggcagagc

SEQ ID NO: 901950 - DNA, 23 bp, Homo sapiens
ggccagaaggagggcagagccat

SEQ ID NO: 901951 - DNA, 24 bp, Homo sapiens
ggccagaaggagggcagagccatg

SEQ ID NO: 901952 - DNA, 16 bp, Homo sapiens
ggccagaagtaccaga

SEQ ID NO: 901953 - DNA, 17 bp, Homo sapiens
ggccagactggaagaca

SEQ ID NO: 901954 - DNA, 22 bp, Homo sapiens
ggccagactggaagacacttca

SEQ ID NO: 901955 - DNA, 23 bp, Homo sapiens
ggccagagaagataatgttcttt

SEQ ID NO: 901956 - DNA, 13 bp, Homo sapiens
ggccagagagcag

SEQ ID NO: 901957 - DNA, 14 bp, Homo sapiens
ggccagagagcagg

SEQ ID NO: 901958 - DNA, 15 bp, Homo sapiens
ggccagagagcaggg

SEQ ID NO: 901959 - DNA, 16 bp, Homo sapiens
ggccagagagcagggg

SEQ ID NO: 901960 - DNA, 17 bp, Homo sapiens
ggccagagagcagggga

SEQ ID NO: 901961 - DNA, 18 bp, Homo sapiens
ggccagagagcctggtgc

SEQ ID NO: 901962 - DNA, 23 bp, Homo sapiens
ggccagagagcctggtgctgctg

SEQ ID NO: 901963 - DNA, 12 bp, Homo sapiens
ggccagagaggg

SEQ ID NO: 901964 - DNA, 13 bp, Homo sapiens
ggccagagagggc

SEQ ID NO: 901965 - DNA, 20 bp, Homo sapiens
ggccagagagggcccagctg

SEQ ID NO: 901966 - DNA, 23 bp, Homo sapiens
ggccagagagggcccagctgtag

SEQ ID NO: 901967 - DNA, 14 bp, Homo sapiens
ggccagagcctctg

SEQ ID NO: 901968 - DNA, 14 bp, Homo sapiens
ggccagagctaggg

SEQ ID NO: 901969 - DNA, 16 bp, Homo sapiens
ggccagagctggaagg

SEQ ID NO: 901970 - DNA, 17 bp, Homo sapiens
ggccagagctggaaggc

SEQ ID NO: 901971 - DNA, 19 bp, Homo sapiens
ggccagagctggaaggcag

SEQ ID NO: 901972 - DNA, 22 bp, Homo sapiens
ggccagagctggaaggcagggc

SEQ ID NO: 901973 - DNA, 17 bp, Homo sapiens
ggccagagctgggaggc

SEQ ID NO: 901974 - DNA, 21 bp, Homo sapiens
ggccagagctgggaggcatgg

SEQ ID NO: 901975 - DNA, 21 bp, Homo sapiens
ggccagaggcccccagcccag

SEQ ID NO: 901976 - DNA, 11 bp, Homo sapiens
ggccagaggct

SEQ ID NO: 901977 - DNA, 18 bp, Homo sapiens
gagcataggaggggtctg

SEQ ID NO: 901978 - DNA, 13 bp, Homo sapiens
gagcatcaatctt

SEQ ID NO: 901979 - DNA, 22 bp, Homo sapiens
gagcatcagccagtgaatctgt

SEQ ID NO: 901980 - DNA, 19 bp, Homo sapiens
gagcatcccccaaagttca

SEQ ID NO: 901981 - DNA, 23 bp, Homo sapiens
gagcatccccctcctctccctgt

SEQ ID NO: 901982 - DNA, 13 bp, Homo sapiens
gagcatcccggag

SEQ ID NO: 901983 - DNA, 19 bp, Homo sapiens
gagcatccggccaaatgca

SEQ ID NO: 901984 - DNA, 15 bp, Homo sapiens
gagcatcctgagccc

SEQ ID NO: 901985 - DNA, 16 bp, Homo sapiens
gagcatcctgagcccc

SEQ ID NO: 901986 - DNA, 18 bp, Homo sapiens
gagcatcctgagccccgc

SEQ ID NO: 901987 - DNA, 19 bp, Homo sapiens
gagcatcggagggagtccc

SEQ ID NO: 901988 - DNA, 19 bp, Homo sapiens
gagcatcgtgacccttcag

SEQ ID NO: 901989 - DNA, 20 bp, Homo sapiens
gagcatctcttgaggccagg

SEQ ID NO: 901990 - DNA, 17 bp, Homo sapiens
gagcatgacagcctgca

SEQ ID NO: 901991 - DNA, 13 bp, Homo sapiens
gagcatgatttga

SEQ ID NO: 901992 - DNA, 18 bp, Homo sapiens
gagcatgcggagccagca

SEQ ID NO: 901993 - DNA, 21 bp, Homo sapiens
gagcatgcggagccagcaggc

SEQ ID NO: 901994 - DNA, 18 bp, Homo sapiens
gagcatggaacacttcga

SEQ ID NO: 901995 - DNA, 17 bp, Homo sapiens
gagcatgggcctggcca

SEQ ID NO: 901996 - DNA, 13 bp, Homo sapiens
gagcatgggtgtg

SEQ ID NO: 901997 - DNA, 15 bp, Homo sapiens
gagcatgtcgtggac

SEQ ID NO: 901998 - DNA, 20 bp, Homo sapiens
gagcattaactaaatgctca

SEQ ID NO: 901999 - DNA, 17 bp, Homo sapiens
gagcattacgtgagcca

SEQ ID NO: 902000 - DNA, 14 bp, Homo sapiens
gagcattagctggc

SEQ ID NO: 902001 - DNA, 20 bp, Homo sapiens
gagcattcaggcagcactga

SEQ ID NO: 902002 - DNA, 23 bp, Homo sapiens
gagcatttccaacaccacagaca

SEQ ID NO: 902003 - DNA, 14 bp, Homo sapiens
gagccaaattttat

SEQ ID NO: 902004 - DNA, 21 bp, Homo sapiens
gagccaacaagaccgccccag

SEQ ID NO: 902005 - DNA, 19 bp, Homo sapiens
gagccaacctcggcttgtg

SEQ ID NO: 902006 - DNA, 22 bp, Homo sapiens
gagccaacctcggcttgtgggc

SEQ ID NO: 902007 - DNA, 21 bp, Homo sapiens
gagccaactgattttgtatgt

SEQ ID NO: 902008 - DNA, 15 bp, Homo sapiens
gagccaagaaacact

SEQ ID NO: 902009 - DNA, 14 bp, Homo sapiens
gagccaagctgcac

SEQ ID NO: 902010 - DNA, 12 bp, Homo sapiens
gagccaaggagg

SEQ ID NO: 902011 - DNA, 20 bp, Homo sapiens
gagccaaggaggcctgggga

SEQ ID NO: 902012 - DNA, 12 bp, Homo sapiens
gagccaaggcca

SEQ ID NO: 902013 - DNA, 13 bp, Homo sapiens
gagccaaggccac

SEQ ID NO: 902014 - DNA, 14 bp, Homo sapiens
gagccaagggaggg

SEQ ID NO: 902015 - DNA, 19 bp, Homo sapiens
gagccaagggagggaaggg

SEQ ID NO: 902016 - DNA, 19 bp, Homo sapiens
gagccaagggttcagagac

SEQ ID NO: 902017 - DNA, 15 bp, Homo sapiens
gagccacaagctgca

SEQ ID NO: 902018 - DNA, 17 bp, Homo sapiens
gagccacaagctgcact

SEQ ID NO: 902019 - DNA, 21 bp, Homo sapiens
gagccacaagctgcactgtga

SEQ ID NO: 902020 - DNA, 21 bp, Homo sapiens
gagccacaggaacggccctgc

SEQ ID NO: 902021 - DNA, 22 bp, Homo sapiens
gagccacaggcaggggtgagag

SEQ ID NO: 902022 - DNA, 19 bp, Homo sapiens
gagccacagtgcctggccc

SEQ ID NO: 902023 - DNA, 14 bp, Homo sapiens
gagccacagtggga

SEQ ID NO: 902024 - DNA, 14 bp, Homo sapiens
gagccaccagttct

SEQ ID NO: 902025 - DNA, 18 bp, Homo sapiens
gagccaccgcgcccagcc

SEQ ID NO: 902026 - DNA, 14 bp, Homo sapiens
gagccaccgctgcc

SEQ ID NO: 902027 - DNA, 14 bp, Homo sapiens
gagccaccgtgcct

SEQ ID NO: 902028 - DNA, 12 bp, Homo sapiens
gagccacctcac

SEQ ID NO: 902029 - DNA, 11 bp, Homo sapiens
gagccacctgc

SEQ ID NO: 902030 - DNA, 18 bp, Homo sapiens
gagccacctgcaagatgg

SEQ ID NO: 902031 - DNA, 19 bp, Homo sapiens
gagccacctgcaagatgga

SEQ ID NO: 902032 - DNA, 13 bp, Homo sapiens
gagccacctggca

SEQ ID NO: 902033 - DNA, 20 bp, Homo sapiens
gagccacctggcagggctca

SEQ ID NO: 902034 - DNA, 18 bp, Homo sapiens
gagccacgcctatgccct

SEQ ID NO: 902035 - DNA, 13 bp, Homo sapiens
gagccactccttc

SEQ ID NO: 902036 - DNA, 21 bp, Homo sapiens
gagccactcgcagtcgcagga

SEQ ID NO: 902037 - DNA, 21 bp, Homo sapiens
gagccactgcacctgcccagc

SEQ ID NO: 902038 - DNA, 20 bp, Homo sapiens
gagccactgcgcccagcctg

SEQ ID NO: 902039 - DNA, 17 bp, Homo sapiens
gagccactgggcccctg

SEQ ID NO: 902040 - DNA, 21 bp, Homo sapiens
gagccactgggcccctgtccc

SEQ ID NO: 902041 - DNA, 16 bp, Homo sapiens
gagccacttctcccca

SEQ ID NO: 902042 - DNA, 23 bp, Homo sapiens
gagccagaaatgggcagttctcc

SEQ ID NO: 902043 - DNA, 23 bp, Homo sapiens
gagccagactctggtcttctttg

SEQ ID NO: 902044 - DNA, 23 bp, Homo sapiens
gagccagagagaacaacaggcag

SEQ ID NO: 902045 - DNA, 19 bp, Homo sapiens
gagccagcagctgaagtct

SEQ ID NO: 902046 - DNA, 21 bp, Homo sapiens
gagccagcagctgaagtctct

SEQ ID NO: 902047 - DNA, 13 bp, Homo sapiens
gagccagcctggc

SEQ ID NO: 902048 - DNA, 14 bp, Homo sapiens
gagccagcctggct

SEQ ID NO: 902049 - DNA, 15 bp, Homo sapiens
gagccagcctgggac

SEQ ID NO: 902050 - DNA, 13 bp, Homo sapiens
gagccagctgctt

SEQ ID NO: 902051 - DNA, 23 bp, Homo sapiens
gagccagctgcttgacctagctc

SEQ ID NO: 902052 - DNA, 20 bp, Homo sapiens
gagccaggaagatcccccag

SEQ ID NO: 902053 - DNA, 21 bp, Homo sapiens
gagccaggaagatcccccaga

SEQ ID NO: 902054 - DNA, 13 bp, Homo sapiens
gagccaggagaag

SEQ ID NO: 902055 - DNA, 14 bp, Homo sapiens
gagccaggagaagc

SEQ ID NO: 902056 - DNA, 21 bp, Homo sapiens
gagccaggagaagctcagctg

SEQ ID NO: 902057 - DNA, 12 bp, Homo sapiens
gagccaggcctg

SEQ ID NO: 902058 - DNA, 14 bp, Homo sapiens
gagccaggcttgga

SEQ ID NO: 902059 - DNA, 18 bp, Homo sapiens
gagccaggcttggatgga

SEQ ID NO: 902060 - DNA, 17 bp, Homo sapiens
gagccagggcagaggaa

SEQ ID NO: 902061 - DNA, 13 bp, Homo sapiens
gagccagggcctc

SEQ ID NO: 902062 - DNA, 15 bp, Homo sapiens
gagccagggtagagc

SEQ ID NO: 902063 - DNA, 17 bp, Homo sapiens
gagccagggtagagcaa

SEQ ID NO: 902064 - DNA, 23 bp, Homo sapiens
gagccagggtagagcaaaggaga

SEQ ID NO: 902065 - DNA, 23 bp, Homo sapiens
gagccagtgagggcagtcctgca

SEQ ID NO: 902066 - DNA, 23 bp, Homo sapiens
gagccagtggaacagcgggagac

SEQ ID NO: 902067 - DNA, 23 bp, Homo sapiens
gagccatataagtttgaaggaaa

SEQ ID NO: 902068 - DNA, 19 bp, Homo sapiens
gagccatattaattgcctg

SEQ ID NO: 902069 - DNA, 22 bp, Homo sapiens
gagccatcactagaagaaaagc

SEQ ID NO: 902070 - DNA, 20 bp, Homo sapiens
gagccatcccttcggagcca

SEQ ID NO: 902071 - DNA, 22 bp, Homo sapiens
gagccatcccttcggagccaac

SEQ ID NO: 902072 - DNA, 14 bp, Homo sapiens
gagccatgcctccc

SEQ ID NO: 902073 - DNA, 16 bp, Homo sapiens
gagccatgcctccctg

SEQ ID NO: 902074 - DNA, 22 bp, Homo sapiens
gagccattagagcacagcttct

SEQ ID NO: 902075 - DNA, 21 bp, Homo sapiens
gagccattgagtgctggggga

SEQ ID NO: 902076 - DNA, 15 bp, Homo sapiens
gagccattgtccctc

SEQ ID NO: 902077 - DNA, 13 bp, Homo sapiens
gagccatttgaga

SEQ ID NO: 902078 - DNA, 14 bp, Homo sapiens
gagcccaagggaat

SEQ ID NO: 902079 - DNA, 15 bp, Homo sapiens
gagcccacagcgagc

SEQ ID NO: 902080 - DNA, 16 bp, Homo sapiens
gagcccacagcgagcc

SEQ ID NO: 902081 - DNA, 17 bp, Homo sapiens
gagcccacagcgagcct

SEQ ID NO: 902082 - DNA, 18 bp, Homo sapiens
gagcccacagcgagcctg

SEQ ID NO: 902083 - DNA, 21 bp, Homo sapiens
gagcccacagcgagcctgtgc

SEQ ID NO: 902084 - DNA, 13 bp, Homo sapiens
gagcccaccagcc

SEQ ID NO: 902085 - DNA, 20 bp, Homo sapiens
gagcccaccagccagccctg

SEQ ID NO: 902086 - DNA, 21 bp, Homo sapiens
gagcccactgcccaccccctc

SEQ ID NO: 902087 - DNA, 16 bp, Homo sapiens
gagcccagagaacagc

SEQ ID NO: 902088 - DNA, 20 bp, Homo sapiens
gagcccagccagaaagcact

SEQ ID NO: 902089 - DNA, 15 bp, Homo sapiens
gagcccagccctccc

SEQ ID NO: 902090 - DNA, 23 bp, Homo sapiens
gagcccagcctgggagcccagag

SEQ ID NO: 902091 - DNA, 21 bp, Homo sapiens
gagcccagctacattcctcag

SEQ ID NO: 902092 - DNA, 16 bp, Homo sapiens
gagcctgcatcttctt

SEQ ID NO: 902093 - DNA, 19 bp, Homo sapiens
gagcctgcatcttcttgca

SEQ ID NO: 902094 - DNA, 23 bp, Homo sapiens
gagcctgcatttcctcgcagcct

SEQ ID NO: 902095 - DNA, 12 bp, Homo sapiens
gagcctgctgga

SEQ ID NO: 902096 - DNA, 15 bp, Homo sapiens
gagcctgctggcacc

SEQ ID NO: 902097 - DNA, 10 bp, Homo sapiens
gagcctggca

SEQ ID NO: 902098 - DNA, 23 bp, Homo sapiens
gagcctggcaaggcattcctcat

SEQ ID NO: 902099 - DNA, 15 bp, Homo sapiens
gagcctggccccagg

SEQ ID NO: 902100 - DNA, 23 bp, Homo sapiens
gagcctggctccgtccaggagcc

SEQ ID NO: 902101 - DNA, 16 bp, Homo sapiens
gagcctggctgcccat

SEQ ID NO: 902102 - DNA, 13 bp, Homo sapiens
taaagtgcagtca

SEQ ID NO: 902103 - DNA, 22 bp, Homo sapiens
taaagtgccagtattttaaaat

SEQ ID NO: 902104 - DNA, 15 bp, Homo sapiens
taaagtgccttctgg

SEQ ID NO: 902105 - DNA, 16 bp, Homo sapiens
taaagtgccttctggg

SEQ ID NO: 902106 - DNA, 15 bp, Homo sapiens
taaagtgcttgcttt

SEQ ID NO: 902107 - DNA, 19 bp, Homo sapiens
taaagtgcttgctttttgc

SEQ ID NO: 902108 - DNA, 16 bp, Homo sapiens
taaagtgtaaatcctt

SEQ ID NO: 902109 - DNA, 19 bp, Homo sapiens
taaagtgtaacaattgtgt

SEQ ID NO: 902110 - DNA, 15 bp, Homo sapiens
taaagtgtatttttt

SEQ ID NO: 902111 - DNA, 21 bp, Homo sapiens
taaagtgtatttttttactaa

SEQ ID NO: 902112 - DNA, 23 bp, Homo sapiens
taaagtgtatttttttactaata

SEQ ID NO: 902113 - DNA, 13 bp, Homo sapiens
taaagtgtgtgat

SEQ ID NO: 902114 - DNA, 17 bp, Homo sapiens
taaagtgtgttgttgct

SEQ ID NO: 902115 - DNA, 20 bp, Homo sapiens
taaagtgttctgccagatct

SEQ ID NO: 902116 - DNA, 18 bp, Homo sapiens
taaagttaaacattttta

SEQ ID NO: 902117 - DNA, 15 bp, Homo sapiens
taaagttactactga

SEQ ID NO: 902118 - DNA, 23 bp, Homo sapiens
taaagttactactgattttaaaa

SEQ ID NO: 902119 - DNA, 20 bp, Homo sapiens
taaagttagtatcttttgat

SEQ ID NO: 902120 - DNA, 19 bp, Homo sapiens
taaagttctgcaaaataca

SEQ ID NO: 902121 - DNA, 20 bp, Homo sapiens
taaagttcttattttagtat

SEQ ID NO: 902122 - DNA, 18 bp, Homo sapiens
taaagttgaagcatttgt

SEQ ID NO: 902123 - DNA, 13 bp, Homo sapiens
ggggaacggatgc

SEQ ID NO: 902124 - DNA, 17 bp, Homo sapiens
ggggaagaagcagagag

SEQ ID NO: 902125 - DNA, 18 bp, Homo sapiens
ggggaagaagcagagaga

SEQ ID NO: 902126 - DNA, 13 bp, Homo sapiens
ggggaagccctgg

SEQ ID NO: 902127 - DNA, 14 bp, Homo sapiens
ggggaagctggctt

SEQ ID NO: 902128 - DNA, 14 bp, Homo sapiens
ggggaagctgggcc

SEQ ID NO: 902129 - DNA, 16 bp, Homo sapiens
ggggaaggcagaggct

SEQ ID NO: 902130 - DNA, 18 bp, Homo sapiens
ggggaaggcagaggctgg

SEQ ID NO: 902131 - DNA, 20 bp, Homo sapiens
ggggaaggcagaggctggca

SEQ ID NO: 902132 - DNA, 15 bp, Homo sapiens
ggggaaggccctgag

SEQ ID NO: 902133 - DNA, 18 bp, Homo sapiens
ggggaaggcgctgggtgc

SEQ ID NO: 902134 - DNA, 14 bp, Homo sapiens
ggggaagggcaggc

SEQ ID NO: 902135 - DNA, 22 bp, Homo sapiens
ggggaagggccagtctgggctg

SEQ ID NO: 902136 - DNA, 12 bp, Homo sapiens
ggggaaggggcc

SEQ ID NO: 902137 - DNA, 21 bp, Homo sapiens
ggggaatgagcccagagaaca

SEQ ID NO: 902138 - DNA, 18 bp, Homo sapiens
ggggaatgctcccagctg

SEQ ID NO: 902139 - DNA, 10 bp, Homo sapiens
ggtgggtcca

SEQ ID NO: 902140 - DNA, 20 bp, Homo sapiens
ggtgggtccatgggcagagc

SEQ ID NO: 902141 - DNA, 23 bp, Homo sapiens
ggtgggtctacctcatctctgaa

SEQ ID NO: 902142 - DNA, 22 bp, Homo sapiens
ggtgggtctatgttccccagga

SEQ ID NO: 902143 - DNA, 14 bp, Homo sapiens
ggtgggtgctcaga

SEQ ID NO: 902144 - DNA, 15 bp, Homo sapiens
ggtgggtgggcctga

SEQ ID NO: 902145 - DNA, 12 bp, Homo sapiens
ggtggtaaagaa

SEQ ID NO: 902146 - DNA, 22 bp, Homo sapiens
ggtggtaaatattttcaaagag

SEQ ID NO: 902147 - DNA, 14 bp, Homo sapiens
ggtggtaaccctgg

SEQ ID NO: 902148 - DNA, 23 bp, Homo sapiens
ggtggtactttattcttgctggg

SEQ ID NO: 902149 - DNA, 17 bp, Homo sapiens
ggtggtcctgagacctg

SEQ ID NO: 902150 - DNA, 20 bp, Homo sapiens
ggtggtctcttcctgtctgg

SEQ ID NO: 902151 - DNA, 19 bp, Homo sapiens
ggtggtctgaatgttctga

SEQ ID NO: 902152 - DNA, 16 bp, Homo sapiens
ggtggtctgttggcag

SEQ ID NO: 902153 - DNA, 16 bp, Homo sapiens
ggtggtgtcgggccct

SEQ ID NO: 902154 - DNA, 19 bp, Homo sapiens
ggtggtgtcgggcccttct

SEQ ID NO: 902155 - DNA, 22 bp, Homo sapiens
ggtggttttcagagcaggaggc

SEQ ID NO: 902156 - DNA, 23 bp, Homo sapiens
ggtggttttcagagcaggaggcc

SEQ ID NO: 902157 - DNA, 18 bp, Homo sapiens
ggtggttttctgttcttt

SEQ ID NO: 902158 - DNA, 18 bp, Homo sapiens
ggtgtaatcattttaaat

SEQ ID NO: 902159 - DNA, 14 bp, Homo sapiens
ggtgtaatggagca

SEQ ID NO: 902160 - DNA, 17 bp, Homo sapiens
ggtgtagccctcccact

SEQ ID NO: 902161 - DNA, 13 bp, Homo sapiens
ggtgtaggctggg

SEQ ID NO: 902162 - DNA, 12 bp, Homo sapiens
ggtgtaggggcc

SEQ ID NO: 902163 - DNA, 17 bp, Homo sapiens
ggtgtaggggccacctc

SEQ ID NO: 902164 - DNA, 21 bp, Homo sapiens
ggtgtaggggccacctcctcc

SEQ ID NO: 902165 - DNA, 22 bp, Homo sapiens
ggtgtaggggccacctcctccc

SEQ ID NO: 902166 - DNA, 13 bp, Homo sapiens
ggtgtatagtgtt

SEQ ID NO: 902167 - DNA, 15 bp, Homo sapiens
ggtgtatataatttt

SEQ ID NO: 902168 - DNA, 16 bp, Homo sapiens
ggtgtatttaaactat

SEQ ID NO: 902169 - DNA, 23 bp, Homo sapiens
ggtgtatttattttcctccccag

SEQ ID NO: 902170 - DNA, 19 bp, Homo sapiens
ggtgtcacatggtgcccct

SEQ ID NO: 902171 - DNA, 19 bp, Homo sapiens
ggtgtcaccctgcagagct

SEQ ID NO: 902172 - DNA, 21 bp, Homo sapiens
ggtgtcagcccctcttccctt

SEQ ID NO: 902173 - DNA, 13 bp, Homo sapiens
ggtgtcatgcttt

SEQ ID NO: 902174 - DNA, 18 bp, Homo sapiens
ggtgtcatttcattccat

SEQ ID NO: 902175 - DNA, 15 bp, Homo sapiens
ggtgtccccaacgtc

SEQ ID NO: 902176 - DNA, 19 bp, Homo sapiens
ggtgtccccttcccctgct

SEQ ID NO: 902177 - DNA, 20 bp, Homo sapiens
ggtgtccccttcccctgctg

SEQ ID NO: 902178 - DNA, 23 bp, Homo sapiens
ggtgtccccttcccctgctgacc

SEQ ID NO: 902179 - DNA, 20 bp, Homo sapiens
ggtgtcctgaccaccctccc

SEQ ID NO: 902180 - DNA, 20 bp, Homo sapiens
ggtgtcctgcctgtctgccc

SEQ ID NO: 902181 - DNA, 12 bp, Homo sapiens
ggtgtctccctc

SEQ ID NO: 902182 - DNA, 17 bp, Homo sapiens
ggtgtctctgggcctgt

SEQ ID NO: 902183 - DNA, 14 bp, Homo sapiens
ggtgtctctggtct

SEQ ID NO: 902184 - DNA, 22 bp, Homo sapiens
ggtgtcttttccactcctatgg

SEQ ID NO: 902185 - DNA, 20 bp, Homo sapiens
ggtgtgaactcaccctggga

SEQ ID NO: 902186 - DNA, 11 bp, Homo sapiens
ggtgtgaccat

SEQ ID NO: 902187 - DNA, 21 bp, Homo sapiens
ggtgtgactcgggagctgcac

SEQ ID NO: 902188 - DNA, 23 bp, Homo sapiens
ggtgtgagatcctctttactctg

SEQ ID NO: 902189 - DNA, 20 bp, Homo sapiens
ggtgtgcaatgtctgagtga

SEQ ID NO: 902190 - DNA, 17 bp, Homo sapiens
ggtgtgcaccagggttg

SEQ ID NO: 902191 - DNA, 16 bp, Homo sapiens
ggtgtgcctgccctgg

SEQ ID NO: 902192 - DNA, 19 bp, Homo sapiens
ggtgtgcctgccctggagg

SEQ ID NO: 902193 - DNA, 21 bp, Homo sapiens
ggtgtgcggaggcaggagcat

SEQ ID NO: 902194 - DNA, 19 bp, Homo sapiens
ggtgtgctagaacaaggtc

SEQ ID NO: 902195 - DNA, 11 bp, Homo sapiens
ggtgtggaagg

SEQ ID NO: 902196 - DNA, 18 bp, Homo sapiens
ggtgtggaagggaccaag

SEQ ID NO: 902197 - DNA, 12 bp, Homo sapiens
ggtgtggagaag

SEQ ID NO: 902198 - DNA, 23 bp, Homo sapiens
ggtgtggagaagcggctggcagc

SEQ ID NO: 902199 - DNA, 17 bp, Homo sapiens
ggtgtggataaggctta

SEQ ID NO: 902200 - DNA, 15 bp, Homo sapiens
ggtgtggccctgcca

SEQ ID NO: 902201 - DNA, 19 bp, Homo sapiens
ggtgtggctttccaggcac

SEQ ID NO: 902202 - DNA, 22 bp, Homo sapiens
ggtgtggggacacagcagtgag

SEQ ID NO: 902203 - DNA, 15 bp, Homo sapiens
ggtgtggtggctcat

SEQ ID NO: 902204 - DNA, 18 bp, Homo sapiens
ggtgtgtccttgaactga

SEQ ID NO: 902205 - DNA, 19 bp, Homo sapiens
ggtgtgtccttgaactgag

SEQ ID NO: 902206 - DNA, 23 bp, Homo sapiens
ggtgtgtccttgaactgaggccc

SEQ ID NO: 902207 - DNA, 15 bp, Homo sapiens
ggtgtgtgcgcctga

SEQ ID NO: 902208 - DNA, 18 bp, Homo sapiens
ggtgtgtggcctccctgg

SEQ ID NO: 902209 - DNA, 22 bp, Homo sapiens
ggtgtgtggcctccctggctcc

SEQ ID NO: 902210 - DNA, 18 bp, Homo sapiens
ggtgttaaagctgtacac

SEQ ID NO: 902211 - DNA, 20 bp, Homo sapiens
ggtgttacacagcccaagag

SEQ ID NO: 902212 - DNA, 12 bp, Homo sapiens
ggtgttatttgg

SEQ ID NO: 902213 - DNA, 19 bp, Homo sapiens
ggtgttcaccaaaaccaaa

SEQ ID NO: 902214 - DNA, 23 bp, Homo sapiens
ggtgttccgaaaccaaagaagaa

SEQ ID NO: 902215 - DNA, 18 bp, Homo sapiens
ggtgttcctaccaggact

SEQ ID NO: 902216 - DNA, 13 bp, Homo sapiens
ggtgttcctggaa

SEQ ID NO: 902217 - DNA, 16 bp, Homo sapiens
ggtgttcctggaagca

SEQ ID NO: 902218 - DNA, 17 bp, Homo sapiens
ggtgttcgtttccatca

SEQ ID NO: 902219 - DNA, 21 bp, Homo sapiens
ggtgttgccaaatatgtcctg

SEQ ID NO: 902220 - DNA, 22 bp, Homo sapiens
ggtgttgccatttctctgctta

SEQ ID NO: 902221 - DNA, 12 bp, Homo sapiens
ggtgttgctgtt

SEQ ID NO: 902222 - DNA, 21 bp, Homo sapiens
ggtgtttattacaagtggctc

SEQ ID NO: 902223 - DNA, 16 bp, Homo sapiens
ggtgtttcccttcctc

SEQ ID NO: 902224 - DNA, 23 bp, Homo sapiens
ggtgtttcttgtgtttgagaacc

SEQ ID NO: 902225 - DNA, 14 bp, Homo sapiens
ggtgttttcatgta

SEQ ID NO: 902226 - DNA, 15 bp, Homo sapiens
ggtgtttttaataaa

SEQ ID NO: 902227 - DNA, 16 bp, Homo sapiens
ggttaaaaaaaaaagt

SEQ ID NO: 902228 - DNA, 17 bp, Homo sapiens
ggttaaaaaacaaatgt

SEQ ID NO: 902229 - DNA, 23 bp, Homo sapiens
ggttaaacaaaatgaaaatatct

SEQ ID NO: 902230 - DNA, 20 bp, Homo sapiens
ggttaaatagtatgggaaaa

SEQ ID NO: 902231 - DNA, 16 bp, Homo sapiens
ggttaaggccagggcc

SEQ ID NO: 902232 - DNA, 19 bp, Homo sapiens
ggttaaggtgggtccagga

SEQ ID NO: 902233 - DNA, 17 bp, Homo sapiens
ggttaatctttcctgat

SEQ ID NO: 902234 - DNA, 15 bp, Homo sapiens
ggttaatttttcctg

SEQ ID NO: 902235 - DNA, 15 bp, Homo sapiens
ggttacaaactgcaa

SEQ ID NO: 902236 - DNA, 16 bp, Homo sapiens
ggttaccaagaagcct

SEQ ID NO: 902237 - DNA, 13 bp, Homo sapiens
ggttacctccctc

SEQ ID NO: 902238 - DNA, 23 bp, Homo sapiens
ggttacctgttccattgttgtca

SEQ ID NO: 902239 - DNA, 17 bp, Homo sapiens
ggttacttcttctctta

SEQ ID NO: 902240 - DNA, 19 bp, Homo sapiens
ggttagagccaagctgcac

SEQ ID NO: 902241 - DNA, 19 bp, Homo sapiens
ggttagctaaaccaagaag

SEQ ID NO: 902242 - DNA, 17 bp, Homo sapiens
ggttaggaatctcttca

SEQ ID NO: 902243 - DNA, 13 bp, Homo sapiens
ggttagggagggg

SEQ ID NO: 902244 - DNA, 17 bp, Homo sapiens
ggttagtcattgataga

SEQ ID NO: 902245 - DNA, 14 bp, Homo sapiens
ggttagtcgggtgc

SEQ ID NO: 902246 - DNA, 19 bp, Homo sapiens
ggttataacagcaaatgaa

SEQ ID NO: 902247 - DNA, 23 bp, Homo sapiens
ggttataacttaatgaaaacaat

SEQ ID NO: 902248 - DNA, 12 bp, Homo sapiens
ggttataatttt

SEQ ID NO: 902249 - DNA, 14 bp, Homo sapiens
ggttatctctgtgt

SEQ ID NO: 902250 - DNA, 16 bp, Homo sapiens
ggttatctgcctggcc

SEQ ID NO: 902251 - DNA, 21 bp, Homo sapiens
ggttatctgcctggcctggct

SEQ ID NO: 902252 - DNA, 23 bp, Homo sapiens
ggttatctgcctggcctggctcc

SEQ ID NO: 902253 - DNA, 18 bp, Homo sapiens
ggttatctttttaaaaac

SEQ ID NO: 902254 - DNA, 13 bp, Homo sapiens
ggttatgaaacat

SEQ ID NO: 902255 - DNA, 17 bp, Homo sapiens
ggttatgtatcagaaga

SEQ ID NO: 902256 - DNA, 11 bp, Homo sapiens
ggttatgtttt

SEQ ID NO: 902257 - DNA, 23 bp, Homo sapiens
ggttattcacaacctcaccaaac

SEQ ID NO: 902258 - DNA, 20 bp, Homo sapiens
ggttatttagggaactgctt

SEQ ID NO: 902259 - DNA, 19 bp, Homo sapiens
ggttattttaaatataaat

SEQ ID NO: 902260 - DNA, 18 bp, Homo sapiens
agccctactccctgcaga

SEQ ID NO: 902261 - DNA, 20 bp, Homo sapiens
agccctactccctgcagatg

SEQ ID NO: 902262 - DNA, 21 bp, Homo sapiens
agccctagctgtcccatgggg

SEQ ID NO: 902263 - DNA, 16 bp, Homo sapiens
agccctatggatgtgg

SEQ ID NO: 902264 - DNA, 11 bp, Homo sapiens
agccctcacct

SEQ ID NO: 902265 - DNA, 10 bp, Homo sapiens
agccctcaga

SEQ ID NO: 902266 - DNA, 13 bp, Homo sapiens
agccctcagaaca

SEQ ID NO: 902267 - DNA, 14 bp, Homo sapiens
agccctcaggctcc

SEQ ID NO: 902268 - DNA, 19 bp, Homo sapiens
agccctcaggctccccaga

SEQ ID NO: 902269 - DNA, 12 bp, Homo sapiens
agccctcatccc

SEQ ID NO: 902270 - DNA, 21 bp, Homo sapiens
agccctcatcccacttccttt

SEQ ID NO: 902271 - DNA, 16 bp, Homo sapiens
agccctcatcccgagc

SEQ ID NO: 902272 - DNA, 12 bp, Homo sapiens
agccctcccact

SEQ ID NO: 902273 - DNA, 13 bp, Homo sapiens
agccctcccactt

SEQ ID NO: 902274 - DNA, 19 bp, Homo sapiens
agccctccccccagctccc

SEQ ID NO: 902275 - DNA, 23 bp, Homo sapiens
agccctccccctcaacctcacca

SEQ ID NO: 902276 - DNA, 21 bp, Homo sapiens
agccctcccccttccccttct

SEQ ID NO: 902277 - DNA, 15 bp, Homo sapiens
agccctccctgcccc

SEQ ID NO: 902278 - DNA, 14 bp, Homo sapiens
agccctccctgtcc

SEQ ID NO: 902279 - DNA, 13 bp, Homo sapiens
agccctcctcacc

SEQ ID NO: 902280 - DNA, 18 bp, Homo sapiens
agccctcgaaccaaggca

SEQ ID NO: 902281 - DNA, 23 bp, Homo sapiens
agccctcgaaccaaggcagcctc

SEQ ID NO: 902282 - DNA, 17 bp, Homo sapiens
agccctcggcctccgag

SEQ ID NO: 902283 - DNA, 20 bp, Homo sapiens
agccctcggcctccgaggct

SEQ ID NO: 902284 - DNA, 14 bp, Homo sapiens
agccctctagggca

SEQ ID NO: 902285 - DNA, 14 bp, Homo sapiens
agccctctcactcc

SEQ ID NO: 902286 - DNA, 18 bp, Homo sapiens
agccctctcactccagcc

SEQ ID NO: 902287 - DNA, 20 bp, Homo sapiens
agccctctcactccagccaa

SEQ ID NO: 902288 - DNA, 12 bp, Homo sapiens
agccctctgcct

SEQ ID NO: 902289 - DNA, 22 bp, Homo sapiens
agccctctgcctcctccccagg

SEQ ID NO: 902290 - DNA, 21 bp, Homo sapiens
agccctctttaatgctgtctt

SEQ ID NO: 902291 - DNA, 18 bp, Homo sapiens
agccctgaacatttcatg

SEQ ID NO: 902292 - DNA, 15 bp, Homo sapiens
agccctgaccctgtg

SEQ ID NO: 902293 - DNA, 12 bp, Homo sapiens
agccctgacctt

SEQ ID NO: 902294 - DNA, 18 bp, Homo sapiens
agccctgactcctggact

SEQ ID NO: 902295 - DNA, 19 bp, Homo sapiens
agccctgactcctggactc

SEQ ID NO: 902296 - DNA, 18 bp, Homo sapiens
agccctgaggacctctca

SEQ ID NO: 902297 - DNA, 19 bp, Homo sapiens
agccctgaggacctctcag

SEQ ID NO: 902298 - DNA, 16 bp, Homo sapiens
agccctgaggggctgg

SEQ ID NO: 902299 - DNA, 19 bp, Homo sapiens
agccctgaggggctgggct

SEQ ID NO: 902300 - DNA, 16 bp, Homo sapiens
agccgggaccctcagg

SEQ ID NO: 902301 - DNA, 14 bp, Homo sapiens
agccgggcccctgg

SEQ ID NO: 902302 - DNA, 17 bp, Homo sapiens
agccgggcccctgggct

SEQ ID NO: 902303 - DNA, 19 bp, Homo sapiens
agccgggcctggggctcct

SEQ ID NO: 902304 - DNA, 14 bp, Homo sapiens
agccgggggagggg

SEQ ID NO: 902305 - DNA, 21 bp, Homo sapiens
agccgggggaggggccctcag

SEQ ID NO: 902306 - DNA, 22 bp, Homo sapiens
agccggggtgtaacttcctgct

SEQ ID NO: 902307 - DNA, 21 bp, Homo sapiens
agccgggtctgcctcttctgg

SEQ ID NO: 902308 - DNA, 12 bp, Homo sapiens
agccggtgcctg

SEQ ID NO: 902309 - DNA, 13 bp, Homo sapiens
agccggtgtccct

SEQ ID NO: 902310 - DNA, 21 bp, Homo sapiens
agccgtccatggcaccagccc

SEQ ID NO: 902311 - DNA, 13 bp, Homo sapiens
agccgtcccaggc

SEQ ID NO: 902312 - DNA, 22 bp, Homo sapiens
agccgtcccgcgttcaagactt

SEQ ID NO: 902313 - DNA, 18 bp, Homo sapiens
agccgtctgactccagag

SEQ ID NO: 902314 - DNA, 19 bp, Homo sapiens
agccgtctgactccagagt

SEQ ID NO: 902315 - DNA, 21 bp, Homo sapiens
agccgtctgactccagagtct

SEQ ID NO: 902316 - DNA, 17 bp, Homo sapiens
agccgtgatgctcaggc

SEQ ID NO: 902317 - DNA, 19 bp, Homo sapiens
agccgtgatgctcaggctt

SEQ ID NO: 902318 - DNA, 16 bp, Homo sapiens
agccgtgccttcagct

SEQ ID NO: 902319 - DNA, 18 bp, Homo sapiens
agccgtgctcgccccagc

SEQ ID NO: 902320 - DNA, 18 bp, Homo sapiens
agccgtgctcttttaaaa

SEQ ID NO: 902321 - DNA, 23 bp, Homo sapiens
agccgtggcttcccgctcagccc

SEQ ID NO: 902322 - DNA, 15 bp, Homo sapiens
agccgtggtccctga

SEQ ID NO: 902323 - DNA, 16 bp, Homo sapiens
agccgtggtcctttgg

SEQ ID NO: 902324 - DNA, 19 bp, Homo sapiens
agccgtgtgggtggcgggt

SEQ ID NO: 902325 - DNA, 21 bp, Homo sapiens
agccgttgaatctgggaggga

SEQ ID NO: 902326 - DNA, 13 bp, Homo sapiens
agccgttttcctc

SEQ ID NO: 902327 - DNA, 23 bp, Homo sapiens
agcctaaagggcagggcccacgt

SEQ ID NO: 902328 - DNA, 18 bp, Homo sapiens
agcctaagatgaagagga

SEQ ID NO: 902329 - DNA, 19 bp, Homo sapiens
agcctaagcggctgtttac

SEQ ID NO: 902330 - DNA, 19 bp, Homo sapiens
agcctaaggctcctgtttt

SEQ ID NO: 902331 - DNA, 16 bp, Homo sapiens
agcctaagggatcctg

SEQ ID NO: 902332 - DNA, 23 bp, Homo sapiens
agcctaatccctgggcattgctt

SEQ ID NO: 902333 - DNA, 23 bp, Homo sapiens
agcctacattctccagttgatta

SEQ ID NO: 902334 - DNA, 19 bp, Homo sapiens
agcctacattttagtttct

SEQ ID NO: 902335 - DNA, 17 bp, Homo sapiens
agcctaccgtatttcag

SEQ ID NO: 902336 - DNA, 16 bp, Homo sapiens
agcctacgctgaagat

SEQ ID NO: 902337 - DNA, 17 bp, Homo sapiens
agcctagaacatccctg

SEQ ID NO: 902338 - DNA, 21 bp, Homo sapiens
agcctagaacatccctgggca

SEQ ID NO: 902339 - DNA, 22 bp, Homo sapiens
agcctagaacatccctgggcaa

SEQ ID NO: 902340 - DNA, 15 bp, Homo sapiens
agcctagaccctcct

SEQ ID NO: 902341 - DNA, 18 bp, Homo sapiens
agcctagcggagcccagc

SEQ ID NO: 902342 - DNA, 22 bp, Homo sapiens
agcctaggaccactcagcccct

SEQ ID NO: 902343 - DNA, 18 bp, Homo sapiens
agcctaggacgccaactt

SEQ ID NO: 902344 - DNA, 16 bp, Homo sapiens
agcctaggtggaggca

SEQ ID NO: 902345 - DNA, 19 bp, Homo sapiens
agcctaggtggaggcaagt

SEQ ID NO: 902346 - DNA, 21 bp, Homo sapiens
agcctagttatcaaggggatg

SEQ ID NO: 902347 - DNA, 15 bp, Homo sapiens
agcctagttcatcca

SEQ ID NO: 902348 - DNA, 17 bp, Homo sapiens
agcctatacgtttctgt

SEQ ID NO: 902349 - DNA, 17 bp, Homo sapiens
agcctatagtaaatgtg

SEQ ID NO: 902350 - DNA, 17 bp, Homo sapiens
agcctatgagcatcctg

SEQ ID NO: 902351 - DNA, 19 bp, Homo sapiens
agcctatgagcatcctgag

SEQ ID NO: 902352 - DNA, 20 bp, Homo sapiens
agcctatgggggctctcgga

SEQ ID NO: 902353 - DNA, 17 bp, Homo sapiens
agcctatttttttagat

SEQ ID NO: 902354 - DNA, 22 bp, Homo sapiens
agcctcaaaacgggtcagtatt

SEQ ID NO: 902355 - DNA, 19 bp, Homo sapiens
agcctcaacctcctgggtt

SEQ ID NO: 902356 - DNA, 17 bp, Homo sapiens
agcctcaaggccctcgg

SEQ ID NO: 902357 - DNA, 15 bp, Homo sapiens
agcctcaatttctga

SEQ ID NO: 902358 - DNA, 22 bp, Homo sapiens
agcctcacttgaatgtgtcact

SEQ ID NO: 902359 - DNA, 18 bp, Homo sapiens
agcctcagaaagggattg

SEQ ID NO: 902360 - DNA, 15 bp, Homo sapiens
agcctcagaaggccc

SEQ ID NO: 902361 - DNA, 14 bp, Homo sapiens
agcctcagactgga

SEQ ID NO: 902362 - DNA, 21 bp, Homo sapiens
agcctcagcccaacttcttac

SEQ ID NO: 902363 - DNA, 15 bp, Homo sapiens
agcctcagcctactc

SEQ ID NO: 902364 - DNA, 16 bp, Homo sapiens
agcctcagctgtacga

SEQ ID NO: 902365 - DNA, 22 bp, Homo sapiens
agcctcaggcttgagggagggc

SEQ ID NO: 902366 - DNA, 19 bp, Homo sapiens
agcctcagtctccctccct

SEQ ID NO: 902367 - DNA, 18 bp, Homo sapiens
agcctcagtgccacttga

SEQ ID NO: 902368 - DNA, 22 bp, Homo sapiens
agcctcatacctacatcagaca

SEQ ID NO: 902369 - DNA, 14 bp, Homo sapiens
agcctcatatttaa

SEQ ID NO: 902370 - DNA, 14 bp, Homo sapiens
agcctcatccgagg

SEQ ID NO: 902371 - DNA, 17 bp, Homo sapiens
agcctcatccgaggcag

SEQ ID NO: 902372 - DNA, 18 bp, Homo sapiens
agcctcatccgaggcagg

SEQ ID NO: 902373 - DNA, 21 bp, Homo sapiens
agcctcatcctccccaggacc

SEQ ID NO: 902374 - DNA, 14 bp, Homo sapiens
agcctcatgttctc

SEQ ID NO: 902375 - DNA, 15 bp, Homo sapiens
agcctcatgttctct

SEQ ID NO: 902376 - DNA, 20 bp, Homo sapiens
agcctcatgttctcttccca

SEQ ID NO: 902377 - DNA, 21 bp, Homo sapiens
agcctcatgttctcttcccag

SEQ ID NO: 902378 - DNA, 16 bp, Homo sapiens
agcctcatgttctgtg

SEQ ID NO: 902379 - DNA, 18 bp, Homo sapiens
agcctcattgtgccaagc

SEQ ID NO: 902380 - DNA, 20 bp, Homo sapiens
agcctcattgtgccaagcct

SEQ ID NO: 902381 - DNA, 20 bp, Homo sapiens
agcctccaaagtggagctgg

SEQ ID NO: 902382 - DNA, 22 bp, Homo sapiens
agcctccaaagtggagctggga

SEQ ID NO: 902383 - DNA, 21 bp, Homo sapiens
agcctccacagcgagggcagc

SEQ ID NO: 902384 - DNA, 22 bp, Homo sapiens
agcctccacagcgagggcagct

SEQ ID NO: 902385 - DNA, 22 bp, Homo sapiens
agcctccaccccacaacccaaa

SEQ ID NO: 902386 - DNA, 15 bp, Homo sapiens
agcctccagagaagc

SEQ ID NO: 902387 - DNA, 17 bp, Homo sapiens
agcctccagagaagccc

SEQ ID NO: 902388 - DNA, 21 bp, Homo sapiens
agcctccagagaagccccgca

SEQ ID NO: 902389 - DNA, 23 bp, Homo sapiens
agccagtaaatgggggtgcattt

SEQ ID NO: 902390 - DNA, 15 bp, Homo sapiens
agccagtaatcttta

SEQ ID NO: 902391 - DNA, 21 bp, Homo sapiens
agccagtcatggaatcttgct

SEQ ID NO: 902392 - DNA, 12 bp, Homo sapiens
agccagtctcag

SEQ ID NO: 902393 - DNA, 19 bp, Homo sapiens
agccagtctcagagaccag

SEQ ID NO: 902394 - DNA, 20 bp, Homo sapiens
agccagtctcagagaccagc

SEQ ID NO: 902395 - DNA, 22 bp, Homo sapiens
agccagtctcagagaccagcac

SEQ ID NO: 902396 - DNA, 23 bp, Homo sapiens
agccagtctcagagaccagcact

SEQ ID NO: 902397 - DNA, 13 bp, Homo sapiens
agccagtgaagga

SEQ ID NO: 902398 - DNA, 18 bp, Homo sapiens
agccagtgaaggagccac

SEQ ID NO: 902399 - DNA, 13 bp, Homo sapiens
agccagtgacttt

SEQ ID NO: 902400 - DNA, 14 bp, Homo sapiens
agccagtgactttt

SEQ ID NO: 902401 - DNA, 16 bp, Homo sapiens
agccagtgagggcagt

SEQ ID NO: 902402 - DNA, 19 bp, Homo sapiens
agccagtggagctggtctg

SEQ ID NO: 902403 - DNA, 16 bp, Homo sapiens
agccagtggcacagga

SEQ ID NO: 902404 - DNA, 16 bp, Homo sapiens
agccagttaaggaaag

SEQ ID NO: 902405 - DNA, 17 bp, Homo sapiens
agccagttaaggaaaga

SEQ ID NO: 902406 - DNA, 18 bp, Homo sapiens
agccagttaaggaaagaa

SEQ ID NO: 902407 - DNA, 20 bp, Homo sapiens
agccagttctccttccctgc

SEQ ID NO: 902408 - DNA, 18 bp, Homo sapiens
agccagttggatctctgg

SEQ ID NO: 902409 - DNA, 14 bp, Homo sapiens
agccagttgtccta

SEQ ID NO: 902410 - DNA, 20 bp, Homo sapiens
agccagttgtcctatggaca

SEQ ID NO: 902411 - DNA, 21 bp, Homo sapiens
agccagtttgccggatacaaa

SEQ ID NO: 902412 - DNA, 16 bp, Homo sapiens
agccataaaagcattg

SEQ ID NO: 902413 - DNA, 17 bp, Homo sapiens
agccataaaagcattgt

SEQ ID NO: 902414 - DNA, 20 bp, Homo sapiens
agccataacgtgcccccaga

SEQ ID NO: 902415 - DNA, 13 bp, Homo sapiens
agccataataaaa

SEQ ID NO: 902416 - DNA, 12 bp, Homo sapiens
agccataatttt

SEQ ID NO: 902417 - DNA, 16 bp, Homo sapiens
agccataattttgcat

SEQ ID NO: 902418 - DNA, 16 bp, Homo sapiens
agccatacataaaaga

SEQ ID NO: 902419 - DNA, 22 bp, Homo sapiens
agccataccgaccatcgtccag

SEQ ID NO: 902420 - DNA, 17 bp, Homo sapiens
agccataggcccaggat

SEQ ID NO: 902421 - DNA, 21 bp, Homo sapiens
agccatagggggctgcacggg

SEQ ID NO: 902422 - DNA, 22 bp, Homo sapiens
agccatagggggctgcacggga

SEQ ID NO: 902423 - DNA, 16 bp, Homo sapiens
agccatattaattgcc

SEQ ID NO: 902424 - DNA, 18 bp, Homo sapiens
agccatattaattgcctg

SEQ ID NO: 902425 - DNA, 20 bp, Homo sapiens
agccatattaattgcctgtt

SEQ ID NO: 902426 - DNA, 18 bp, Homo sapiens
agccatattcacacctca

SEQ ID NO: 902427 - DNA, 19 bp, Homo sapiens
agccatattccagcagtga

SEQ ID NO: 902428 - DNA, 16 bp, Homo sapiens
agccatcaaaatgctt

SEQ ID NO: 902429 - DNA, 18 bp, Homo sapiens
agccatcaacaagagttg

SEQ ID NO: 902430 - DNA, 15 bp, Homo sapiens
agccatcaccctcac

SEQ ID NO: 902431 - DNA, 18 bp, Homo sapiens
agccatcactagaagaaa

SEQ ID NO: 902432 - DNA, 20 bp, Homo sapiens
agccatcactagaagaaaag

SEQ ID NO: 902433 - DNA, 17 bp, Homo sapiens
agccatcacttctcccc

SEQ ID NO: 902434 - DNA, 19 bp, Homo sapiens
agccatcacttctccccgc

SEQ ID NO: 902435 - DNA, 17 bp, Homo sapiens
agccatcccgcttagcc

SEQ ID NO: 902436 - DNA, 20 bp, Homo sapiens
agccatcccgcttagcctgc

SEQ ID NO: 902437 - DNA, 21 bp, Homo sapiens
agccatcccgcttagcctgcc

SEQ ID NO: 902438 - DNA, 22 bp, Homo sapiens
agccatcccgcttagcctgcct

SEQ ID NO: 902439 - DNA, 23 bp, Homo sapiens
agccatcccgcttagcctgcctc

SEQ ID NO: 902440 - DNA, 15 bp, Homo sapiens
agccatcccttgggg

SEQ ID NO: 902441 - DNA, 19 bp, Homo sapiens
agccatcccttggggaagg

SEQ ID NO: 902442 - DNA, 15 bp, Homo sapiens
agccatcctccctcc

SEQ ID NO: 902443 - DNA, 16 bp, Homo sapiens
agccatcctccctcca

SEQ ID NO: 902444 - DNA, 22 bp, Homo sapiens
agccatcggtgaaactaacaga

SEQ ID NO: 902445 - DNA, 18 bp, Homo sapiens
agccatcgtcctgggact

SEQ ID NO: 902446 - DNA, 22 bp, Homo sapiens
agccatcgtcctgggactcgga

SEQ ID NO: 902447 - DNA, 23 bp, Homo sapiens
agccatctaatgcttgtttatga

SEQ ID NO: 902448 - DNA, 23 bp, Homo sapiens
agccatctcatgaggggagagga

SEQ ID NO: 902449 - DNA, 16 bp, Homo sapiens
agccatctgacagcag

SEQ ID NO: 902450 - DNA, 15 bp, Homo sapiens
agccatctgcccagg

SEQ ID NO: 902451 - DNA, 19 bp, Homo sapiens
agccatgaggagttgctgt

SEQ ID NO: 902452 - DNA, 20 bp, Homo sapiens
agccatgaggagttgctgtt

SEQ ID NO: 902453 - DNA, 19 bp, Homo sapiens
agccatgatttgtcccagc

SEQ ID NO: 902454 - DNA, 21 bp, Homo sapiens
agccatgatttgtcccagcct

SEQ ID NO: 902455 - DNA, 15 bp, Homo sapiens
agccatgattttcta

SEQ ID NO: 902456 - DNA, 16 bp, Homo sapiens
agccatgattttctaa

SEQ ID NO: 902457 - DNA, 21 bp, Homo sapiens
agccatgccagctggcctttg

SEQ ID NO: 902458 - DNA, 16 bp, Homo sapiens
agccatgccaggctgc

SEQ ID NO: 902459 - DNA, 16 bp, Homo sapiens
agccatgcctccctgg

SEQ ID NO: 902460 - DNA, 16 bp, Homo sapiens
agccatgcgccccctc

SEQ ID NO: 902461 - DNA, 16 bp, Homo sapiens
agccatggaaggtgcc

SEQ ID NO: 902462 - DNA, 19 bp, Homo sapiens
agccatggaaggtgccaga

SEQ ID NO: 902463 - DNA, 20 bp, Homo sapiens
agccatggagattctcataa

SEQ ID NO: 902464 - DNA, 22 bp, Homo sapiens
agccatggagattctcataact

SEQ ID NO: 902465 - DNA, 15 bp, Homo sapiens
agccatggctcaggc

SEQ ID NO: 902466 - DNA, 21 bp, Homo sapiens
agccatggctcaggcaagccc

SEQ ID NO: 902467 - DNA, 14 bp, Homo sapiens
agccatgggcctgg

SEQ ID NO: 902468 - DNA, 15 bp, Homo sapiens
agccatgggcctggg

SEQ ID NO: 902469 - DNA, 20 bp, Homo sapiens
agccatgggcctgggcctgc

SEQ ID NO: 902470 - DNA, 21 bp, Homo sapiens
agccatgggcctgggcctgct

SEQ ID NO: 902471 - DNA, 17 bp, Homo sapiens
agccatgtagccaccca

SEQ ID NO: 902472 - DNA, 20 bp, Homo sapiens
agccatgtatttcagggacc

SEQ ID NO: 902473 - DNA, 21 bp, Homo sapiens
agccatgtatttcagggacct

SEQ ID NO: 902474 - DNA, 22 bp, Homo sapiens
agccatgtatttcagggacctc

SEQ ID NO: 902475 - DNA, 23 bp, Homo sapiens
agccatgtccaagttcttcacct

SEQ ID NO: 902476 - DNA, 14 bp, Homo sapiens
agccattaaaataa

SEQ ID NO: 902477 - DNA, 22 bp, Homo sapiens
agccattaaaataaaacaagcc

SEQ ID NO: 902478 - DNA, 14 bp, Homo sapiens
agccattcactgcc

SEQ ID NO: 902479 - DNA, 13 bp, Homo sapiens
agccattcttcag

SEQ ID NO: 902480 - DNA, 12 bp, Homo sapiens
agccattctttt

SEQ ID NO: 902481 - DNA, 14 bp, Homo sapiens
agccattgaacagc

SEQ ID NO: 902482 - DNA, 20 bp, Homo sapiens
agccattgaacagctgtgag

SEQ ID NO: 902483 - DNA, 22 bp, Homo sapiens
agccattggctatttaaaactt

SEQ ID NO: 902484 - DNA, 18 bp, Homo sapiens
agccattgttggctttcc

SEQ ID NO: 902485 - DNA, 21 bp, Homo sapiens
agccatttatacctttgaaat

SEQ ID NO: 902486 - DNA, 22 bp, Homo sapiens
agccatttatacctttgaaata

SEQ ID NO: 902487 - DNA, 16 bp, Homo sapiens
agccatttccccctcc

SEQ ID NO: 902488 - DNA, 18 bp, Homo sapiens
agccatttctccatgggc

SEQ ID NO: 902489 - DNA, 17 bp, Homo sapiens
agccatttgttggggca

SEQ ID NO: 902490 - DNA, 12 bp, Homo sapiens
agccatttttag

SEQ ID NO: 902491 - DNA, 13 bp, Homo sapiens
agccatttttaga

SEQ ID NO: 902492 - DNA, 19 bp, Homo sapiens
agccatttttcaaagcaat

SEQ ID NO: 902493 - DNA, 16 bp, Homo sapiens
agcccaaaccttgggc

SEQ ID NO: 902494 - DNA, 20 bp, Homo sapiens
agcccaaagtggtatagaaa

SEQ ID NO: 902495 - DNA, 20 bp, Homo sapiens
agcccaaattcatataaaag

SEQ ID NO: 902496 - DNA, 23 bp, Homo sapiens
agcccaacagacaccatcttttg

SEQ ID NO: 902497 - DNA, 19 bp, Homo sapiens
agcccaacttccagaggac

SEQ ID NO: 902498 - DNA, 18 bp, Homo sapiens
agcccaagcatcactgcc

SEQ ID NO: 902499 - DNA, 15 bp, Homo sapiens
agcccaagcttccct

SEQ ID NO: 902500 - DNA, 16 bp, Homo sapiens
agcccaaggtcaggga

SEQ ID NO: 902501 - DNA, 23 bp, Homo sapiens
agcccaagttcatgcagctgtgg

SEQ ID NO: 902502 - DNA, 22 bp, Homo sapiens
agcccacaaccttcggctccgg

SEQ ID NO: 902503 - DNA, 17 bp, Homo sapiens
agcccacacttgagagg

SEQ ID NO: 902504 - DNA, 12 bp, Homo sapiens
agcccacagagc

SEQ ID NO: 902505 - DNA, 14 bp, Homo sapiens
agcccacagagcct

SEQ ID NO: 902506 - DNA, 14 bp, Homo sapiens
agcccacagcgagc

SEQ ID NO: 902507 - DNA, 20 bp, Homo sapiens
agcccacagtatattttatt

SEQ ID NO: 902508 - DNA, 18 bp, Homo sapiens
agcccaccaatctgccct

SEQ ID NO: 902509 - DNA, 19 bp, Homo sapiens
agcccaccaatctgccctt

SEQ ID NO: 902510 - DNA, 23 bp, Homo sapiens
agcccaccagacgtcaggccctg

SEQ ID NO: 902511 - DNA, 17 bp, Homo sapiens
agcccaccagccagccc

SEQ ID NO: 902512 - DNA, 17 bp, Homo sapiens
agcattgctttctgaaa

SEQ ID NO: 902513 - DNA, 17 bp, Homo sapiens
agcattggcccctgagc

SEQ ID NO: 902514 - DNA, 17 bp, Homo sapiens
agcattgtaaaagcatt

SEQ ID NO: 902515 - DNA, 20 bp, Homo sapiens
agcattgtaaaataattctg

SEQ ID NO: 902516 - DNA, 21 bp, Homo sapiens
agcattgtctcgtgtacagct

SEQ ID NO: 902517 - DNA, 17 bp, Homo sapiens
agcattgtctttgctgt

SEQ ID NO: 902518 - DNA, 17 bp, Homo sapiens
agcattgtgaactgaca

SEQ ID NO: 902519 - DNA, 12 bp, Homo sapiens
agcattgttcca

SEQ ID NO: 902520 - DNA, 23 bp, Homo sapiens
agcattgttccacacatttaaaa

SEQ ID NO: 902521 - DNA, 16 bp, Homo sapiens
agcattgtttcaaaat

SEQ ID NO: 902522 - DNA, 21 bp, Homo sapiens
agcattgtttgcttattgttc

SEQ ID NO: 902523 - DNA, 13 bp, Homo sapiens
agcatttaaaatg

SEQ ID NO: 902524 - DNA, 21 bp, Homo sapiens
agcatttaacccccctgtaca

SEQ ID NO: 902525 - DNA, 23 bp, Homo sapiens
agcatttaacccccctgtacaca

SEQ ID NO: 902526 - DNA, 15 bp, Homo sapiens
agcatttagaaaact

SEQ ID NO: 902527 - DNA, 21 bp, Homo sapiens
agcatttagcacaatttgaga

SEQ ID NO: 902528 - DNA, 22 bp, Homo sapiens
agcatttagttacaacctgaag

SEQ ID NO: 902529 - DNA, 13 bp, Homo sapiens
agcatttatgttt

SEQ ID NO: 902530 - DNA, 22 bp, Homo sapiens
agcatttcaaagccctgcctct

SEQ ID NO: 902531 - DNA, 23 bp, Homo sapiens
agcatttcaaagccctgcctctg

SEQ ID NO: 902532 - DNA, 20 bp, Homo sapiens
agcatttcttttctggccaa

SEQ ID NO: 902533 - DNA, 13 bp, Homo sapiens
agcatttgccact

SEQ ID NO: 902534 - DNA, 14 bp, Homo sapiens
agcatttgtatatt

SEQ ID NO: 902535 - DNA, 15 bp, Homo sapiens
agcatttgtattatt

SEQ ID NO: 902536 - DNA, 14 bp, Homo sapiens
agcatttgtccttt

SEQ ID NO: 902537 - DNA, 19 bp, Homo sapiens
agcattttaaacaaaatag

SEQ ID NO: 902538 - DNA, 17 bp, Homo sapiens
agcattttaattctctc

SEQ ID NO: 902539 - DNA, 18 bp, Homo sapiens
agcattttagaaactaca

SEQ ID NO: 902540 - DNA, 20 bp, Homo sapiens
agcattttagaaactacaaa

SEQ ID NO: 902541 - DNA, 14 bp, Homo sapiens
agcattttcctgtt

SEQ ID NO: 902542 - DNA, 14 bp, Homo sapiens
agcattttgaaaca

SEQ ID NO: 902543 - DNA, 18 bp, Homo sapiens
agcattttgaaacaaagt

SEQ ID NO: 902544 - DNA, 20 bp, Homo sapiens
agcattttgggatccttcag

SEQ ID NO: 902545 - DNA, 17 bp, Homo sapiens
agcattttgtaagttga

SEQ ID NO: 902546 - DNA, 15 bp, Homo sapiens
agcattttgtatttg

SEQ ID NO: 902547 - DNA, 16 bp, Homo sapiens
agcatttttatgcaga

SEQ ID NO: 902548 - DNA, 17 bp, Homo sapiens
agcatttttatgcagac

SEQ ID NO: 902549 - DNA, 16 bp, Homo sapiens
agcatttttcaatata

SEQ ID NO: 902550 - DNA, 13 bp, Homo sapiens
agcatttttccat

SEQ ID NO: 902551 - DNA, 23 bp, Homo sapiens
agccaaaaaggcaaataatggaa

SEQ ID NO: 902552 - DNA, 19 bp, Homo sapiens
agccaaacccatgaggcaa

SEQ ID NO: 902553 - DNA, 20 bp, Homo sapiens
agccaaagaaatgggcctgc

SEQ ID NO: 902554 - DNA, 13 bp, Homo sapiens
agccaaagccagg

SEQ ID NO: 902555 - DNA, 15 bp, Homo sapiens
agccaaaggggagcc

SEQ ID NO: 902556 - DNA, 16 bp, Homo sapiens
agccaaaggggagcca

SEQ ID NO: 902557 - DNA, 17 bp, Homo sapiens
agccaaaggggagccag

SEQ ID NO: 902558 - DNA, 15 bp, Homo sapiens
agccaaagtttctgt

SEQ ID NO: 902559 - DNA, 17 bp, Homo sapiens
agccaaagtttctgttg

SEQ ID NO: 902560 - DNA, 19 bp, Homo sapiens
agccaaagtttctgttgaa

SEQ ID NO: 902561 - DNA, 17 bp, Homo sapiens
agccaaagttttcaaac

SEQ ID NO: 902562 - DNA, 22 bp, Homo sapiens
agccaaatgcagggaggggagg

SEQ ID NO: 902563 - DNA, 23 bp, Homo sapiens
agccaaatgcagggaggggaggc

SEQ ID NO: 902564 - DNA, 12 bp, Homo sapiens
agccaaatttaa

SEQ ID NO: 902565 - DNA, 13 bp, Homo sapiens
agccaaatttaaa

SEQ ID NO: 902566 - DNA, 13 bp, Homo sapiens
agccaaatttcct

SEQ ID NO: 902567 - DNA, 20 bp, Homo sapiens
agcactttaaccctctcttc

SEQ ID NO: 902568 - DNA, 19 bp, Homo sapiens
agcactttgaaaatatttc

SEQ ID NO: 902569 - DNA, 20 bp, Homo sapiens
agcactttgaaaatatttct

SEQ ID NO: 902570 - DNA, 23 bp, Homo sapiens
agcactttgaaaatatttctatg

SEQ ID NO: 902571 - DNA, 11 bp, Homo sapiens
agcactttgat

SEQ ID NO: 902572 - DNA, 21 bp, Homo sapiens
agcactttgattgaagtattc

SEQ ID NO: 902573 - DNA, 16 bp, Homo sapiens
agcactttgcacttaa

SEQ ID NO: 902574 - DNA, 21 bp, Homo sapiens
agcactttgggaggccaaggt

SEQ ID NO: 902575 - DNA, 22 bp, Homo sapiens
agcactttgggaggccaaggtg

SEQ ID NO: 902576 - DNA, 22 bp, Homo sapiens
agcagaaaacccttgggccaga

SEQ ID NO: 902577 - DNA, 18 bp, Homo sapiens
agcagaaaggcacgtcca

SEQ ID NO: 902578 - DNA, 22 bp, Homo sapiens
agcagaaagtgcctttatctca

SEQ ID NO: 902579 - DNA, 11 bp, Homo sapiens
agcagaaatgc

SEQ ID NO: 902580 - DNA, 20 bp, Homo sapiens
agcagaaatgcccccattct

SEQ ID NO: 902581 - DNA, 13 bp, Homo sapiens
agcagaaatgcct

SEQ ID NO: 902582 - DNA, 14 bp, Homo sapiens
agcagaacaaatgt

SEQ ID NO: 902583 - DNA, 15 bp, Homo sapiens
agcagaacaaatgtg

SEQ ID NO: 902584 - DNA, 16 bp, Homo sapiens
agcagaacaaatgtgt

SEQ ID NO: 902585 - DNA, 21 bp, Homo sapiens
agcagaacaaatgtgtttttc

SEQ ID NO: 902586 - DNA, 14 bp, Homo sapiens
agcagaacaggtag

SEQ ID NO: 902587 - DNA, 16 bp, Homo sapiens
agcagaacctgcacac

SEQ ID NO: 902588 - DNA, 23 bp, Homo sapiens
agcagaacctgcacacaggacag

SEQ ID NO: 902589 - DNA, 18 bp, Homo sapiens
agcagaagcagggtaccc

SEQ ID NO: 902590 - DNA, 16 bp, Homo sapiens
agcagaagtggagctg

SEQ ID NO: 902591 - DNA, 18 bp, Homo sapiens
agcagaatactggtctca

SEQ ID NO: 902592 - DNA, 18 bp, Homo sapiens
agcagaatggagaaagta

SEQ ID NO: 902593 - DNA, 19 bp, Homo sapiens
agcagaatgttgtacttga

SEQ ID NO: 902594 - DNA, 21 bp, Homo sapiens
agcagaatgttgtacttgaaa

SEQ ID NO: 902595 - DNA, 16 bp, Homo sapiens
agcagaattcattcat

SEQ ID NO: 902596 - DNA, 13 bp, Homo sapiens
agcagaattttaa

SEQ ID NO: 902597 - DNA, 14 bp, Homo sapiens
agcagaattttaat

SEQ ID NO: 902598 - DNA, 18 bp, Homo sapiens
agcagaattttaatgtga

SEQ ID NO: 902599 - DNA, 13 bp, Homo sapiens
agcagacagaaac

SEQ ID NO: 902600 - DNA, 15 bp, Homo sapiens
agcagacagaaactg

SEQ ID NO: 902601 - DNA, 16 bp, Homo sapiens
agcagacagaaactgg

SEQ ID NO: 902602 - DNA, 14 bp, Homo sapiens
agcagacagagcca

SEQ ID NO: 902603 - DNA, 20 bp, Homo sapiens
agcagacaggcctggccctg

SEQ ID NO: 902604 - DNA, 11 bp, Homo sapiens
agcagacattt

SEQ ID NO: 902605 - DNA, 22 bp, Homo sapiens
agcagacccatacctttccagg

SEQ ID NO: 902606 - DNA, 14 bp, Homo sapiens
agcagactccagcc

SEQ ID NO: 902607 - DNA, 17 bp, Homo sapiens
agcagactccagcccct

SEQ ID NO: 902608 - DNA, 19 bp, Homo sapiens
agcagactccagcccctgg

SEQ ID NO: 902609 - DNA, 20 bp, Homo sapiens
agcagactccagcccctgga

SEQ ID NO: 902610 - DNA, 19 bp, Homo sapiens
agcagagagagaggacaga

SEQ ID NO: 902611 - DNA, 19 bp, Homo sapiens
agcagagagagccagacag

SEQ ID NO: 902612 - DNA, 14 bp, Homo sapiens
agcagagagccctg

SEQ ID NO: 902613 - DNA, 15 bp, Homo sapiens
agcagagatgtactg

SEQ ID NO: 902614 - DNA, 18 bp, Homo sapiens
agcagagcaaatgaggga

SEQ ID NO: 902615 - DNA, 15 bp, Homo sapiens
agcagagcaggggca

SEQ ID NO: 902616 - DNA, 14 bp, Homo sapiens
agcagagccaaggc

SEQ ID NO: 902617 - DNA, 18 bp, Homo sapiens
agcagagcccaccagcca

SEQ ID NO: 902618 - DNA, 11 bp, Homo sapiens
agcagagccta

SEQ ID NO: 902619 - DNA, 13 bp, Homo sapiens
agcagaggagctg

SEQ ID NO: 902620 - DNA, 16 bp, Homo sapiens
agcagaggcaggctgg

SEQ ID NO: 902621 - DNA, 14 bp, Homo sapiens
agcagaggcagtgg

SEQ ID NO: 902622 - DNA, 18 bp, Homo sapiens
agcagagggactttgtat

SEQ ID NO: 902623 - DNA, 17 bp, Homo sapiens
agcagagggaggaagat

SEQ ID NO: 902624 - DNA, 14 bp, Homo sapiens
agcagaggggctga

SEQ ID NO: 902625 - DNA, 18 bp, Homo sapiens
agcagagggggagtagcc

SEQ ID NO: 902626 - DNA, 14 bp, Homo sapiens
agcagagtctgggc

SEQ ID NO: 902627 - DNA, 19 bp, Homo sapiens
agcagagtctgggcctctg

SEQ ID NO: 902628 - DNA, 21 bp, Homo sapiens
agcagagtctgggcctctgac

SEQ ID NO: 902629 - DNA, 16 bp, Homo sapiens
agcagagtctgtctct

SEQ ID NO: 902630 - DNA, 20 bp, Homo sapiens
agcagagtgggacttggaga

SEQ ID NO: 902631 - DNA, 18 bp, Homo sapiens
agcagagttaaatctcaa

SEQ ID NO: 902632 - DNA, 12 bp, Homo sapiens
agcagagtttac

SEQ ID NO: 902633 - DNA, 22 bp, Homo sapiens
agcagatgctgttgtgaagcta

SEQ ID NO: 902634 - DNA, 14 bp, Homo sapiens
agcagatggacagc

SEQ ID NO: 902635 - DNA, 19 bp, Homo sapiens
agcagatggtttccacatt

SEQ ID NO: 902636 - DNA, 22 bp, Homo sapiens
agcagattttaattttgaataa

SEQ ID NO: 902637 - DNA, 20 bp, Homo sapiens
agcagcaaatgaaagaaccg

SEQ ID NO: 902638 - DNA, 14 bp, Homo sapiens
agcagcaagaagca

SEQ ID NO: 902639 - DNA, 19 bp, Homo sapiens
agcagcaagaagcagcctg

SEQ ID NO: 902640 - DNA, 13 bp, Homo sapiens
agcagcaagtgtg

SEQ ID NO: 902641 - DNA, 14 bp, Homo sapiens
agcagcacaaggaa

SEQ ID NO: 902642 - DNA, 14 bp, Homo sapiens
agcagcacaattct

SEQ ID NO: 902643 - DNA, 15 bp, Homo sapiens
agcagcacaattctg

SEQ ID NO: 902644 - DNA, 13 bp, Homo sapiens
agcagcacctcct

SEQ ID NO: 902645 - DNA, 16 bp, Homo sapiens
agcagcacctttctct

SEQ ID NO: 902646 - DNA, 22 bp, Homo sapiens
agcagcactcaaacctggagct

SEQ ID NO: 902647 - DNA, 15 bp, Homo sapiens
agcagcagagagccc

SEQ ID NO: 902648 - DNA, 15 bp, Homo sapiens
agcagcagaggtgag

SEQ ID NO: 902649 - DNA, 14 bp, Homo sapiens
agcagcagccagca

SEQ ID NO: 902650 - DNA, 17 bp, Homo sapiens
agcagcagccagcacca

SEQ ID NO: 902651 - DNA, 19 bp, Homo sapiens
agcagcagcctttaatgca

SEQ ID NO: 902652 - DNA, 22 bp, Homo sapiens
agcagcagctaggactgaggag

SEQ ID NO: 902653 - DNA, 18 bp, Homo sapiens
agcagcaggatgggctga

SEQ ID NO: 902654 - DNA, 15 bp, Homo sapiens
agcagcaggctcagg

SEQ ID NO: 902655 - DNA, 21 bp, Homo sapiens
agcagcaggtgctgtgcgcct

SEQ ID NO: 902656 - DNA, 16 bp, Homo sapiens
agcagcatcccagcct

SEQ ID NO: 902657 - DNA, 17 bp, Homo sapiens
agcagcatggaaaaatg

SEQ ID NO: 902658 - DNA, 20 bp, Homo sapiens
agcagcatggaaaaatggtt

SEQ ID NO: 902659 - DNA, 18 bp, Homo sapiens
agcagcattctggagggg

SEQ ID NO: 902660 - DNA, 19 bp, Homo sapiens
agcagccacacttccttta

SEQ ID NO: 902661 - DNA, 13 bp, Homo sapiens
agcagccacgagg

SEQ ID NO: 902662 - DNA, 13 bp, Homo sapiens
agcagccagagct

SEQ ID NO: 902663 - DNA, 14 bp, Homo sapiens
agcagccagagctg

SEQ ID NO: 902664 - DNA, 12 bp, Homo sapiens
agcagccagcac

SEQ ID NO: 902665 - DNA, 13 bp, Homo sapiens
agcagccagcacc

SEQ ID NO: 902666 - DNA, 15 bp, Homo sapiens
agcagccagccagtc

SEQ ID NO: 902667 - DNA, 16 bp, Homo sapiens
agcagccagccagtct

SEQ ID NO: 902668 - DNA, 17 bp, Homo sapiens
agcagccagctctcagc

SEQ ID NO: 902669 - DNA, 23 bp, Homo sapiens
agcagccagctctcagccaacga

SEQ ID NO: 902670 - DNA, 15 bp, Homo sapiens
agcagccaggacccg

SEQ ID NO: 902671 - DNA, 15 bp, Homo sapiens
agcagccaggaggga

SEQ ID NO: 902672 - DNA, 16 bp, Homo sapiens
agcagccaggagggac

SEQ ID NO: 902673 - DNA, 15 bp, Homo sapiens
agcagccagtctcag

SEQ ID NO: 902674 - DNA, 18 bp, Homo sapiens
agcagccagtctcagaga

SEQ ID NO: 902675 - DNA, 19 bp, Homo sapiens
agcagccagtctcagagac

SEQ ID NO: 902676 - DNA, 19 bp, Homo sapiens
agcagccatcataggaagg

SEQ ID NO: 902677 - DNA, 12 bp, Homo sapiens
agcagcccagct

SEQ ID NO: 902678 - DNA, 13 bp, Homo sapiens
agcagccccccag

SEQ ID NO: 902679 - DNA, 22 bp, Homo sapiens
agcagcccccgggccgctggct

SEQ ID NO: 902680 - DNA, 18 bp, Homo sapiens
agcagcccctcgaggcct

SEQ ID NO: 902681 - DNA, 17 bp, Homo sapiens
agcagccctcctcaccc

SEQ ID NO: 902682 - DNA, 17 bp, Homo sapiens
agcagccctctgcctcc

SEQ ID NO: 902683 - DNA, 12 bp, Homo sapiens
agcagcccttgt

SEQ ID NO: 902684 - DNA, 14 bp, Homo sapiens
agcagcccttgtgt

SEQ ID NO: 902685 - DNA, 19 bp, Homo sapiens
agcagcccttgtgtgtgcc

SEQ ID NO: 902686 - DNA, 22 bp, Homo sapiens
agcagcccttgtgtgtgccctg

SEQ ID NO: 902687 - DNA, 22 bp, Homo sapiens
agcagcctcaaaacgggtcagt

SEQ ID NO: 902688 - DNA, 20 bp, Homo sapiens
agcagcctcagagtggtcga

SEQ ID NO: 902689 - DNA, 12 bp, Homo sapiens
agcagcctcgag

SEQ ID NO: 902690 - DNA, 16 bp, Homo sapiens
agcagcctcgaggctg

SEQ ID NO: 902691 - DNA, 17 bp, Homo sapiens
agcagcctcgaggctgg

SEQ ID NO: 902692 - DNA, 18 bp, Homo sapiens
agcagcctcgaggctggt

SEQ ID NO: 902693 - DNA, 21 bp, Homo sapiens
agcacatgtctgtcctcagag

SEQ ID NO: 902694 - DNA, 19 bp, Homo sapiens
agcaccaaaataagaaaag

SEQ ID NO: 902695 - DNA, 13 bp, Homo sapiens
agcaccacactgg

SEQ ID NO: 902696 - DNA, 15 bp, Homo sapiens
agcaccactgctgag

SEQ ID NO: 902697 - DNA, 16 bp, Homo sapiens
agcaccactgctgagg

SEQ ID NO: 902698 - DNA, 17 bp, Homo sapiens
agcaccagcttctccag

SEQ ID NO: 902699 - DNA, 18 bp, Homo sapiens
agcaccagcttctccagg

SEQ ID NO: 902700 - DNA, 14 bp, Homo sapiens
agcacccagagcac

SEQ ID NO: 902701 - DNA, 14 bp, Homo sapiens
agcacccatttcaa

SEQ ID NO: 902702 - DNA, 21 bp, Homo sapiens
agcacccatttcaatgtgtat

SEQ ID NO: 902703 - DNA, 15 bp, Homo sapiens
agcacccccaagcct

SEQ ID NO: 902704 - DNA, 17 bp, Homo sapiens
agcacccccaagcctgg

SEQ ID NO: 902705 - DNA, 14 bp, Homo sapiens
agcacccccaccca

SEQ ID NO: 902706 - DNA, 17 bp, Homo sapiens
agcacccccacccacct

SEQ ID NO: 902707 - DNA, 20 bp, Homo sapiens
agcacccccacccacctcca

SEQ ID NO: 902708 - DNA, 21 bp, Homo sapiens
agcaccccctcattcccctcg

SEQ ID NO: 902709 - DNA, 22 bp, Homo sapiens
agcaccccgaagggagcatctg

SEQ ID NO: 902710 - DNA, 23 bp, Homo sapiens
agcaccccgaagggagcatctgt

SEQ ID NO: 902711 - DNA, 23 bp, Homo sapiens
agcaccccgcttttgcagcagag

SEQ ID NO: 902712 - DNA, 16 bp, Homo sapiens
agcacccctctctgca

SEQ ID NO: 902713 - DNA, 13 bp, Homo sapiens
agcaccctccccc

SEQ ID NO: 902714 - DNA, 18 bp, Homo sapiens
agcaccctcccccgcagc

SEQ ID NO: 902715 - DNA, 12 bp, Homo sapiens
agcaccctctcc

SEQ ID NO: 902716 - DNA, 13 bp, Homo sapiens
agcaccctctcct

SEQ ID NO: 902717 - DNA, 15 bp, Homo sapiens
agcaccctctcctgg

SEQ ID NO: 902718 - DNA, 16 bp, Homo sapiens
agcaccctctcctggg

SEQ ID NO: 902719 - DNA, 12 bp, Homo sapiens
agcaccctgggt

SEQ ID NO: 902720 - DNA, 14 bp, Homo sapiens
agcaccctgggtgc

SEQ ID NO: 902721 - DNA, 17 bp, Homo sapiens
agcaccctgggtgccat

SEQ ID NO: 902722 - DNA, 22 bp, Homo sapiens
agcacccttctcggagacccat

SEQ ID NO: 902723 - DNA, 21 bp, Homo sapiens
agcaccgataataggtagcct

SEQ ID NO: 902724 - DNA, 21 bp, Homo sapiens
agcaccgcttttgttctcgca

SEQ ID NO: 902725 - DNA, 16 bp, Homo sapiens
agcaccgtgccaaccc

SEQ ID NO: 902726 - DNA, 17 bp, Homo sapiens
agcaccgttctgtgcac

SEQ ID NO: 902727 - DNA, 23 bp, Homo sapiens
agcacctactatgtgctgggtgc

SEQ ID NO: 902728 - DNA, 16 bp, Homo sapiens
agcacctccaaccaaa

SEQ ID NO: 902729 - DNA, 22 bp, Homo sapiens
agcacctccaaccaaataagac

SEQ ID NO: 902730 - DNA, 16 bp, Homo sapiens
agcacctccagcctga

SEQ ID NO: 902731 - DNA, 20 bp, Homo sapiens
agcacctccagcctgaacag

SEQ ID NO: 902732 - DNA, 15 bp, Homo sapiens
agcacctgaacccca

SEQ ID NO: 902733 - DNA, 21 bp, Homo sapiens
agcacctgaaccccatgggct

SEQ ID NO: 902734 - DNA, 15 bp, Homo sapiens
agcacctgccgacct

SEQ ID NO: 902735 - DNA, 16 bp, Homo sapiens
agcacctgccgacctc

SEQ ID NO: 902736 - DNA, 18 bp, Homo sapiens
agcacctgcctcctcgtt

SEQ ID NO: 902737 - DNA, 18 bp, Homo sapiens
agcacctggaccccctgc

SEQ ID NO: 902738 - DNA, 20 bp, Homo sapiens
agcacctggaccccctgccc

SEQ ID NO: 902739 - DNA, 19 bp, Homo sapiens
agcacctgggccccactgg

SEQ ID NO: 902740 - DNA, 14 bp, Homo sapiens
agcaccttcagggc

SEQ ID NO: 902741 - DNA, 16 bp, Homo sapiens
agcaccttcagggctg

SEQ ID NO: 902742 - DNA, 22 bp, Homo sapiens
agcaccttcagggctgagttct

SEQ ID NO: 902743 - DNA, 20 bp, Homo sapiens
agcaccttcctcacttccat

SEQ ID NO: 902744 - DNA, 20 bp, Homo sapiens
agcaccttctttctggactg

SEQ ID NO: 902745 - DNA, 22 bp, Homo sapiens
agcaccttctttctggactggc

SEQ ID NO: 902746 - DNA, 17 bp, Homo sapiens
agcacctttctctgaga

SEQ ID NO: 902747 - DNA, 17 bp, Homo sapiens
agcacgaaatgttattt

SEQ ID NO: 902748 - DNA, 17 bp, Homo sapiens
agcacgatttctgttta

SEQ ID NO: 902749 - DNA, 13 bp, Homo sapiens
agcacgcctgcca

SEQ ID NO: 902750 - DNA, 18 bp, Homo sapiens
agcacgctgcctgccaaa

SEQ ID NO: 902751 - DNA, 15 bp, Homo sapiens
agcacggcccggccc

SEQ ID NO: 902752 - DNA, 18 bp, Homo sapiens
agcacggcccggcccctc

SEQ ID NO: 902753 - DNA, 19 bp, Homo sapiens
agcacggcccggcccctca

SEQ ID NO: 902754 - DNA, 13 bp, Homo sapiens
agcacgtggagat

SEQ ID NO: 902755 - DNA, 14 bp, Homo sapiens
agcacgtggagata

SEQ ID NO: 902756 - DNA, 16 bp, Homo sapiens
agcactaaagcagtgg

SEQ ID NO: 902757 - DNA, 19 bp, Homo sapiens
agcactaaccaatgccttt

SEQ ID NO: 902758 - DNA, 16 bp, Homo sapiens
agcactaacgtaaata

SEQ ID NO: 902759 - DNA, 20 bp, Homo sapiens
agcactactgggtgtcattt

SEQ ID NO: 902760 - DNA, 22 bp, Homo sapiens
agcactactgggtgtcatttca

SEQ ID NO: 902761 - DNA, 15 bp, Homo sapiens
agcactagtttgatt

SEQ ID NO: 902762 - DNA, 22 bp, Homo sapiens
agcactagtttgattattatgt

SEQ ID NO: 902763 - DNA, 23 bp, Homo sapiens
agcactagtttgattattatgtt

SEQ ID NO: 902764 - DNA, 20 bp, Homo sapiens
agcactattttatatttaaa

SEQ ID NO: 902765 - DNA, 16 bp, Homo sapiens
agcactcacacaggac

SEQ ID NO: 902766 - DNA, 18 bp, Homo sapiens
agcactcacgccctaagc

SEQ ID NO: 902767 - DNA, 14 bp, Homo sapiens
agcactcagcctca

SEQ ID NO: 902768 - DNA, 18 bp, Homo sapiens
agcactccccagagctgt

SEQ ID NO: 902769 - DNA, 22 bp, Homo sapiens
agcactccccagagctgtgcca

SEQ ID NO: 902770 - DNA, 23 bp, Homo sapiens
agcactcccgctgcacacagacg

SEQ ID NO: 902771 - DNA, 22 bp, Homo sapiens
agcactcccttaggcattattt

SEQ ID NO: 902772 - DNA, 20 bp, Homo sapiens
agcactccgcatcacctcac

SEQ ID NO: 902773 - DNA, 22 bp, Homo sapiens
agcactccgcatcacctcacca

SEQ ID NO: 902774 - DNA, 17 bp, Homo sapiens
agcactcctcaagactt

SEQ ID NO: 902775 - DNA, 19 bp, Homo sapiens
agcactcctcaagactttg

SEQ ID NO: 902776 - DNA, 20 bp, Homo sapiens
agcactcctcaagactttga

SEQ ID NO: 902777 - DNA, 18 bp, Homo sapiens
agcactcgagaccatcct

SEQ ID NO: 902778 - DNA, 20 bp, Homo sapiens
agcactcgagaccatcctgg

SEQ ID NO: 902779 - DNA, 21 bp, Homo sapiens
agcactcgagaccatcctggc

SEQ ID NO: 902780 - DNA, 15 bp, Homo sapiens
agcactctcacccca

SEQ ID NO: 902781 - DNA, 13 bp, Homo sapiens
agcactgacctgt

SEQ ID NO: 902782 - DNA, 11 bp, Homo sapiens
agcactgagca

SEQ ID NO: 902783 - DNA, 22 bp, Homo sapiens
agcactgatagtcctttttcca

SEQ ID NO: 902784 - DNA, 14 bp, Homo sapiens
agcactgcctcctg

SEQ ID NO: 902785 - DNA, 15 bp, Homo sapiens
agcactgcctcctgt

SEQ ID NO: 902786 - DNA, 21 bp, Homo sapiens
agcactgcctcctgttttctc

SEQ ID NO: 902787 - DNA, 23 bp, Homo sapiens
agcactgcctctatgccctgcag

SEQ ID NO: 902788 - DNA, 21 bp, Homo sapiens
agcactgctaggcgagtgcca

SEQ ID NO: 902789 - DNA, 17 bp, Homo sapiens
agcactggagtgcaggg

SEQ ID NO: 902790 - DNA, 22 bp, Homo sapiens
agcactggagtgcagggaggag

SEQ ID NO: 902791 - DNA, 23 bp, Homo sapiens
agcactggagtgcagggaggaga

SEQ ID NO: 902792 - DNA, 16 bp, Homo sapiens
agcactggccagagag

SEQ ID NO: 902793 - DNA, 16 bp, Homo sapiens
agcactgtcccttgcc

SEQ ID NO: 902794 - DNA, 15 bp, Homo sapiens
agcactgttcacatc

SEQ ID NO: 902795 - DNA, 15 bp, Homo sapiens
agcactgttgatgta

SEQ ID NO: 902796 - DNA, 17 bp, Homo sapiens
agcactgttgatgtatc

SEQ ID NO: 902797 - DNA, 18 bp, Homo sapiens
agcactgttgatgtatct

SEQ ID NO: 902798 - DNA, 13 bp, Homo sapiens
agcacttaagaga

SEQ ID NO: 902799 - DNA, 17 bp, Homo sapiens
agcacttaagagaatat

SEQ ID NO: 902800 - DNA, 15 bp, Homo sapiens
agcacttatttaatg

SEQ ID NO: 902801 - DNA, 14 bp, Homo sapiens
agcacttctagaat

SEQ ID NO: 902802 - DNA, 23 bp, Homo sapiens
agcacttgaccttttcgacgctt

SEQ ID NO: 902803 - DNA, 22 bp, Homo sapiens
agcacttgagaaccagtctcct

SEQ ID NO: 902804 - DNA, 13 bp, Homo sapiens
agcacttgcctgg

SEQ ID NO: 902805 - DNA, 21 bp, Homo sapiens
agcacttgcctggaataaaat

SEQ ID NO: 902806 - DNA, 14 bp, Homo sapiens
agcacttgcgtcct

SEQ ID NO: 902807 - DNA, 17 bp, Homo sapiens
agcacttgcgtcctgca

SEQ ID NO: 902808 - DNA, 14 bp, Homo sapiens
agcacttggagcca

SEQ ID NO: 902809 - DNA, 17 bp, Homo sapiens
agcacttggagccaagg

SEQ ID NO: 902810 - DNA, 22 bp, Homo sapiens
agcacttgggggttcaggcccg

SEQ ID NO: 902811 - DNA, 12 bp, Homo sapiens
agcacttgtata

SEQ ID NO: 902812 - DNA, 15 bp, Homo sapiens
agcacttgttttaaa

SEQ ID NO: 902813 - DNA, 17 bp, Homo sapiens
agcacttgttttaaaat

SEQ ID NO: 902814 - DNA, 21 bp, Homo sapiens
agcacttgttttaaaatgcag

SEQ ID NO: 902815 - DNA, 18 bp, Homo sapiens
agcactttaaagaggctg

SEQ ID NO: 902816 - DNA, 19 bp, Homo sapiens
agcactttaaccctctctt

SEQ ID NO: 902817 - DNA, 14 bp, Homo sapiens
agcaagccagacct

SEQ ID NO: 902818 - DNA, 14 bp, Homo sapiens
agcaagccatcatc

SEQ ID NO: 902819 - DNA, 20 bp, Homo sapiens
agcaagccctacagagctgt

SEQ ID NO: 902820 - DNA, 15 bp, Homo sapiens
agcaagcgggagccc

SEQ ID NO: 902821 - DNA, 19 bp, Homo sapiens
agcaaggaaatgtcctgca

SEQ ID NO: 902822 - DNA, 21 bp, Homo sapiens
agcaaggaaatgtcctgcatg

SEQ ID NO: 902823 - DNA, 14 bp, Homo sapiens
agcaaggagattta

SEQ ID NO: 902824 - DNA, 17 bp, Homo sapiens
agcaaggagatttacaa

SEQ ID NO: 902825 - DNA, 20 bp, Homo sapiens
agcaaggcgcctgccttggg

SEQ ID NO: 902826 - DNA, 21 bp, Homo sapiens
agcaaggcgcctgccttggga

SEQ ID NO: 902827 - DNA, 14 bp, Homo sapiens
agcaaggctgctgc

SEQ ID NO: 902828 - DNA, 13 bp, Homo sapiens
agcaagggacctg

SEQ ID NO: 902829 - DNA, 12 bp, Homo sapiens
agcaagggagaa

SEQ ID NO: 902830 - DNA, 16 bp, Homo sapiens
agcaagggagaaaaga

SEQ ID NO: 902831 - DNA, 14 bp, Homo sapiens
agcaagggctccag

SEQ ID NO: 902832 - DNA, 17 bp, Homo sapiens
agcaaggggaccttggc

SEQ ID NO: 902833 - DNA, 20 bp, Homo sapiens
agcaagggttccctcaagag

SEQ ID NO: 902834 - DNA, 21 bp, Homo sapiens
agcaagggttggaggcaatgt

SEQ ID NO: 902835 - DNA, 20 bp, Homo sapiens
agcaagtagataaatatttg

SEQ ID NO: 902836 - DNA, 13 bp, Homo sapiens
agcaagtcccaga

SEQ ID NO: 902837 - DNA, 16 bp, Homo sapiens
agcaagtcttaacaaa

SEQ ID NO: 902838 - DNA, 12 bp, Homo sapiens
agcaagtgagca

SEQ ID NO: 902839 - DNA, 15 bp, Homo sapiens
agcaagtgagcagag

SEQ ID NO: 902840 - DNA, 16 bp, Homo sapiens
agcaagtgagcagaga

SEQ ID NO: 902841 - DNA, 23 bp, Homo sapiens
agcaagtgagtctggtggaggag

SEQ ID NO: 902842 - DNA, 20 bp, Homo sapiens
agcaagttcctgagtgcgtg

SEQ ID NO: 902843 - DNA, 21 bp, Homo sapiens
agcaagttctagagaagaggc

SEQ ID NO: 902844 - DNA, 23 bp, Homo sapiens
agcaagttctagagaagaggctg

SEQ ID NO: 902845 - DNA, 14 bp, Homo sapiens
agcaataaagctct

SEQ ID NO: 902846 - DNA, 13 bp, Homo sapiens
agcaataaatgaa

SEQ ID NO: 902847 - DNA, 17 bp, Homo sapiens
agcaataacactatatt

SEQ ID NO: 902848 - DNA, 19 bp, Homo sapiens
agcaataacattcccactg

SEQ ID NO: 902849 - DNA, 17 bp, Homo sapiens
agcaataactccaagca

SEQ ID NO: 902850 - DNA, 19 bp, Homo sapiens
agcaataactccaagcaga

SEQ ID NO: 902851 - DNA, 13 bp, Homo sapiens
agcaataattgtt

SEQ ID NO: 902852 - DNA, 16 bp, Homo sapiens
agcaatacaactttac

SEQ ID NO: 902853 - DNA, 20 bp, Homo sapiens
agcaatacaactttaccata

SEQ ID NO: 902854 - DNA, 16 bp, Homo sapiens
agcaatactcatcaga

SEQ ID NO: 902855 - DNA, 18 bp, Homo sapiens
agcaatactgtttccatt

SEQ ID NO: 902856 - DNA, 24 bp, Homo sapiens
agcaatatattaccagcaagaata

SEQ ID NO: 902857 - DNA, 15 bp, Homo sapiens
agcaatattgcctgt

SEQ ID NO: 902858 - DNA, 21 bp, Homo sapiens
agcaatattgcctgtgcttct

SEQ ID NO: 902859 - DNA, 22 bp, Homo sapiens
agcaatcaaggttataattttt

SEQ ID NO: 902860 - DNA, 15 bp, Homo sapiens
agcaatcattttatg

SEQ ID NO: 902861 - DNA, 23 bp, Homo sapiens
agcaatccatgatctatacacat

SEQ ID NO: 902862 - DNA, 23 bp, Homo sapiens
agcaatccatgttagtttttact

SEQ ID NO: 902863 - DNA, 17 bp, Homo sapiens
agcaatcctcctgcctc

SEQ ID NO: 902864 - DNA, 15 bp, Homo sapiens
agcaatctcttcatt

SEQ ID NO: 902865 - DNA, 18 bp, Homo sapiens
agcaatctcttcattatt

SEQ ID NO: 902866 - DNA, 16 bp, Homo sapiens
agcaatctttgaaata

SEQ ID NO: 902867 - DNA, 21 bp, Homo sapiens
agcaatgacatctcaggggcc

SEQ ID NO: 902868 - DNA, 19 bp, Homo sapiens
agcaatgatgtccagaaga

SEQ ID NO: 902869 - DNA, 21 bp, Homo sapiens
agcaatgcccgtaatgcttag

SEQ ID NO: 902870 - DNA, 22 bp, Homo sapiens
agcaatgcttttaatgaattta

SEQ ID NO: 902871 - DNA, 18 bp, Homo sapiens
agcaatggccagagcctc

SEQ ID NO: 902872 - DNA, 20 bp, Homo sapiens
agcaatggccagagcctctg

SEQ ID NO: 902873 - DNA, 18 bp, Homo sapiens
agcaatggggaatacaag

SEQ ID NO: 902874 - DNA, 18 bp, Homo sapiens
agcaatgggtcttagctc

SEQ ID NO: 902875 - DNA, 15 bp, Homo sapiens
agcaattagtgatat

SEQ ID NO: 902876 - DNA, 17 bp, Homo sapiens
agcaattatgaaaataa

SEQ ID NO: 902877 - DNA, 16 bp, Homo sapiens
agcaattctcctgcct

SEQ ID NO: 902878 - DNA, 16 bp, Homo sapiens
agcaattctctttctt

SEQ ID NO: 902879 - DNA, 15 bp, Homo sapiens
agcaattctgactgt

SEQ ID NO: 902880 - DNA, 15 bp, Homo sapiens
agcaattgccctgta

SEQ ID NO: 902881 - DNA, 18 bp, Homo sapiens
agcaattggttgtttaac

SEQ ID NO: 902882 - DNA, 16 bp, Homo sapiens
agcaatttaaatgtta

SEQ ID NO: 902883 - DNA, 19 bp, Homo sapiens
agcaatttaaatgttatga

SEQ ID NO: 902884 - DNA, 15 bp, Homo sapiens
agcaatttagacaaa

SEQ ID NO: 902885 - DNA, 20 bp, Homo sapiens
agcaatttatacaatatcat

SEQ ID NO: 902886 - DNA, 16 bp, Homo sapiens
agcaatttcccccctc

SEQ ID NO: 902887 - DNA, 22 bp, Homo sapiens
agcaatttcgccgttgaagagg

SEQ ID NO: 902888 - DNA, 20 bp, Homo sapiens
agcaattttctttgtttctt

SEQ ID NO: 902889 - DNA, 15 bp, Homo sapiens
agcacaaaattcaaa

SEQ ID NO: 902890 - DNA, 22 bp, Homo sapiens
agcacaaaattcaaagcatgga

SEQ ID NO: 902891 - DNA, 21 bp, Homo sapiens
agcacaaagttctcagagctc

SEQ ID NO: 902892 - DNA, 22 bp, Homo sapiens
agcacaaagttctcagagctct

SEQ ID NO: 902893 - DNA, 16 bp, Homo sapiens
agcacaaccggtccct

SEQ ID NO: 902894 - DNA, 19 bp, Homo sapiens
agcacaactttaagaggac

SEQ ID NO: 902895 - DNA, 17 bp, Homo sapiens
agcacaaggagtgcccg

SEQ ID NO: 902896 - DNA, 15 bp, Homo sapiens
agcacaagggcacat

SEQ ID NO: 902897 - DNA, 17 bp, Homo sapiens
agcacaagttatttaaa

SEQ ID NO: 902898 - DNA, 22 bp, Homo sapiens
agcacaatggtcttacattgga

SEQ ID NO: 902899 - DNA, 19 bp, Homo sapiens
agcacaattctgtccctgt

SEQ ID NO: 902900 - DNA, 19 bp, Homo sapiens
agcacacacaaacctactg

SEQ ID NO: 902901 - DNA, 17 bp, Homo sapiens
agcacaccaagttatat

SEQ ID NO: 902902 - DNA, 16 bp, Homo sapiens
agcacaccagccgctg

SEQ ID NO: 902903 - DNA, 17 bp, Homo sapiens
agcacaccagccgctgc

SEQ ID NO: 902904 - DNA, 20 bp, Homo sapiens
agcacaccagccgctgcagg

SEQ ID NO: 902905 - DNA, 14 bp, Homo sapiens
agcacacctctggg

SEQ ID NO: 902906 - DNA, 20 bp, Homo sapiens
agcacactcatcccctcact

SEQ ID NO: 902907 - DNA, 14 bp, Homo sapiens
agcacactgtagca

SEQ ID NO: 902908 - DNA, 16 bp, Homo sapiens
agcacacttatttatg

SEQ ID NO: 902909 - DNA, 17 bp, Homo sapiens
agcacacttatttatga

SEQ ID NO: 902910 - DNA, 14 bp, Homo sapiens
agcacagagaggga

SEQ ID NO: 902911 - DNA, 16 bp, Homo sapiens
agcacagagagggaca

SEQ ID NO: 902912 - DNA, 20 bp, Homo sapiens
agagtgggggagagcaggct

SEQ ID NO: 902913 - DNA, 18 bp, Homo sapiens
agagtggtatttgcagac

SEQ ID NO: 902914 - DNA, 18 bp, Homo sapiens
agagtggtctttctggag

SEQ ID NO: 902915 - DNA, 17 bp, Homo sapiens
agagctactcagaaatg

SEQ ID NO: 902916 - DNA, 19 bp, Homo sapiens
agagctactcagaaatgga

SEQ ID NO: 902917 - DNA, 17 bp, Homo sapiens
agagctagaaaaataaa

SEQ ID NO: 902918 - DNA, 13 bp, Homo sapiens
agagctagcgctg

SEQ ID NO: 902919 - DNA, 14 bp, Homo sapiens
agagctagcgctgc

SEQ ID NO: 902920 - DNA, 23 bp, Homo sapiens
agagctagctgccactttcacgt

SEQ ID NO: 902921 - DNA, 17 bp, Homo sapiens
agagctagggctgctgc

SEQ ID NO: 902922 - DNA, 20 bp, Homo sapiens
agagctcatcccccctgctg

SEQ ID NO: 902923 - DNA, 15 bp, Homo sapiens
agagctcccctccac

SEQ ID NO: 902924 - DNA, 18 bp, Homo sapiens
agagctcccctccacagc

SEQ ID NO: 902925 - DNA, 20 bp, Homo sapiens
agagctcccctccacagctg

SEQ ID NO: 902926 - DNA, 22 bp, Homo sapiens
agagctcccctccacagctgca

SEQ ID NO: 902927 - DNA, 20 bp, Homo sapiens
agagctcccgaggaagcaca

SEQ ID NO: 902928 - DNA, 22 bp, Homo sapiens
agagctcccgaggaagcacagc

SEQ ID NO: 902929 - DNA, 23 bp, Homo sapiens
agagctctcccctcctgctgggc

SEQ ID NO: 902930 - DNA, 15 bp, Homo sapiens
agagctcttaatgtt

SEQ ID NO: 902931 - DNA, 22 bp, Homo sapiens
agagctcttcaagctgtcccct

SEQ ID NO: 902932 - DNA, 14 bp, Homo sapiens
agagctgagccagt

SEQ ID NO: 902933 - DNA, 18 bp, Homo sapiens
agagctgagccagttgtc

SEQ ID NO: 902934 - DNA, 20 bp, Homo sapiens
agaggcccaggcaccaccag

SEQ ID NO: 902935 - DNA, 21 bp, Homo sapiens
agaggcccaggcaccaccagg

SEQ ID NO: 902936 - DNA, 14 bp, Homo sapiens
agaggcccccagcc

SEQ ID NO: 902937 - DNA, 21 bp, Homo sapiens
agaggcccccagcccagggct

SEQ ID NO: 902938 - DNA, 16 bp, Homo sapiens
agaggcccccagtggg

SEQ ID NO: 902939 - DNA, 20 bp, Homo sapiens
agaggcccccagtggggaca

SEQ ID NO: 902940 - DNA, 17 bp, Homo sapiens
agaggcccgcccgccca

SEQ ID NO: 902941 - DNA, 12 bp, Homo sapiens
agaggcctcagt

SEQ ID NO: 902942 - DNA, 16 bp, Homo sapiens
agaggcctgctgccag

SEQ ID NO: 902943 - DNA, 14 bp, Homo sapiens
agaggcctgggctg

SEQ ID NO: 902944 - DNA, 19 bp, Homo sapiens
agaggcctgggctgggaaa

SEQ ID NO: 902945 - DNA, 21 bp, Homo sapiens
agaggcctgggggacccctgg

SEQ ID NO: 902946 - DNA, 22 bp, Homo sapiens
agaggcctgggggacccctggc

SEQ ID NO: 902947 - DNA, 21 bp, Homo sapiens
agaggcctggggtgggacagg

SEQ ID NO: 902948 - DNA, 21 bp, Homo sapiens
agaggccttgtcatcctccct

SEQ ID NO: 902949 - DNA, 17 bp, Homo sapiens
agaggcgcgtctgcccc

SEQ ID NO: 902950 - DNA, 18 bp, Homo sapiens
agaggcgcgtctgcccca

SEQ ID NO: 902951 - DNA, 15 bp, Homo sapiens
agaggcgggccagcc

SEQ ID NO: 902952 - DNA, 16 bp, Homo sapiens
agaggcgggccagcca

SEQ ID NO: 902953 - DNA, 17 bp, Homo sapiens
agaggcgggccagccag

SEQ ID NO: 902954 - DNA, 20 bp, Homo sapiens
agaggcgggccagccaggcg

SEQ ID NO: 902955 - DNA, 19 bp, Homo sapiens
agaggcgtgtgcaggccga

SEQ ID NO: 902956 - DNA, 22 bp, Homo sapiens
agaggcgtgtgcaggccgacag

SEQ ID NO: 902957 - DNA, 16 bp, Homo sapiens
agaggctaagatgaga

SEQ ID NO: 902958 - DNA, 15 bp, Homo sapiens
agaggctactcttga

SEQ ID NO: 902959 - DNA, 18 bp, Homo sapiens
agaggctcagattgtaat

SEQ ID NO: 902960 - DNA, 19 bp, Homo sapiens
agaggctctggacagcaga

SEQ ID NO: 902961 - DNA, 22 bp, Homo sapiens
agaggctctggacagcagaagc

SEQ ID NO: 902962 - DNA, 23 bp, Homo sapiens
agaggctctggacagcagaagcc

SEQ ID NO: 902963 - DNA, 16 bp, Homo sapiens
agaggctcttgatggt

SEQ ID NO: 902964 - DNA, 13 bp, Homo sapiens
agaggctgaaaga

SEQ ID NO: 902965 - DNA, 16 bp, Homo sapiens
agaggctgagccctgt

SEQ ID NO: 902966 - DNA, 12 bp, Homo sapiens
agaggctgcccc

SEQ ID NO: 902967 - DNA, 13 bp, Homo sapiens
agaggctgcctca

SEQ ID NO: 902968 - DNA, 17 bp, Homo sapiens
agaggctgcctcagcca

SEQ ID NO: 902969 - DNA, 17 bp, Homo sapiens
agaggctggaggcaggg

SEQ ID NO: 902970 - DNA, 13 bp, Homo sapiens
agaggctgggagg

SEQ ID NO: 902971 - DNA, 23 bp, Homo sapiens
agaggctgggaggttgggaggct

SEQ ID NO: 902972 - DNA, 16 bp, Homo sapiens
agaggctgtggctggt

SEQ ID NO: 902973 - DNA, 16 bp, Homo sapiens
agaggctgtgtggcca

SEQ ID NO: 902974 - DNA, 14 bp, Homo sapiens
agagggaaaaagag

SEQ ID NO: 902975 - DNA, 21 bp, Homo sapiens
agagggaaaatgtgaaatctc

SEQ ID NO: 902976 - DNA, 19 bp, Homo sapiens
agagggaatgttccctgca

SEQ ID NO: 902977 - DNA, 16 bp, Homo sapiens
agagggacacatgccc

SEQ ID NO: 902978 - DNA, 17 bp, Homo sapiens
agagggacacatgcccc

SEQ ID NO: 902979 - DNA, 18 bp, Homo sapiens
agagggacacatgcccct

SEQ ID NO: 902980 - DNA, 20 bp, Homo sapiens
agagggacacatgcccctcc

SEQ ID NO: 902981 - DNA, 13 bp, Homo sapiens
agagggacagggt

SEQ ID NO: 902982 - DNA, 17 bp, Homo sapiens
agagggaccatgtgtca

SEQ ID NO: 902983 - DNA, 15 bp, Homo sapiens
agagggacctctccc

SEQ ID NO: 902984 - DNA, 16 bp, Homo sapiens
agagggacctctccca

SEQ ID NO: 902985 - DNA, 13 bp, Homo sapiens
agagggagaagaa

SEQ ID NO: 902986 - DNA, 19 bp, Homo sapiens
agagggagaagcatgaaaa

SEQ ID NO: 902987 - DNA, 14 bp, Homo sapiens
agagggagaatcca

SEQ ID NO: 902988 - DNA, 12 bp, Homo sapiens
agagggagagag

SEQ ID NO: 902989 - DNA, 10 bp, Homo sapiens
agagggagca

SEQ ID NO: 902990 - DNA, 24 bp, Homo sapiens
agagggaggagaatgagcctcggc

SEQ ID NO: 902991 - DNA, 17 bp, Homo sapiens
agagggaggcaagccct

SEQ ID NO: 902992 - DNA, 14 bp, Homo sapiens
agagggaggggcct

SEQ ID NO: 902993 - DNA, 22 bp, Homo sapiens
agagggaggtcactggaaaggg

SEQ ID NO: 902994 - DNA, 14 bp, Homo sapiens
agagggaggtgttt

SEQ ID NO: 902995 - DNA, 23 bp, Homo sapiens
agagggagtttaatacaggaaat

SEQ ID NO: 902996 - DNA, 17 bp, Homo sapiens
agagggatacaagagag

SEQ ID NO: 902997 - DNA, 18 bp, Homo sapiens
agagggatgggttcctgc

SEQ ID NO: 902998 - DNA, 15 bp, Homo sapiens
agagggatttccctg

SEQ ID NO: 902999 - DNA, 18 bp, Homo sapiens
agagggatttccctgcag

SEQ ID NO: 903000 - DNA, 23 bp, Homo sapiens
agagggcatgcgcacaaggctga

SEQ ID NO: 903001 - DNA, 24 bp, Homo sapiens
agagggccagagctagggctgctg

SEQ ID NO: 903002 - DNA, 15 bp, Homo sapiens
agagggccagcaggc

SEQ ID NO: 903003 - DNA, 21 bp, Homo sapiens
agagggccagcaggctcctgg

SEQ ID NO: 903004 - DNA, 13 bp, Homo sapiens
agagggcccagcc

SEQ ID NO: 903005 - DNA, 14 bp, Homo sapiens
agagggcccagccc

SEQ ID NO: 903006 - DNA, 16 bp, Homo sapiens
agagggcccagctgta

SEQ ID NO: 903007 - DNA, 23 bp, Homo sapiens
agagggcccagctgtagccatgg

SEQ ID NO: 903008 - DNA, 19 bp, Homo sapiens
agagggcctgtgggagcct

SEQ ID NO: 903009 - DNA, 12 bp, Homo sapiens
agagggccttgc

SEQ ID NO: 903010 - DNA, 14 bp, Homo sapiens
agagggctagggag

SEQ ID NO: 903011 - DNA, 19 bp, Homo sapiens
agagggctggaggcccagg

SEQ ID NO: 903012 - DNA, 12 bp, Homo sapiens
agagggcttcct

SEQ ID NO: 903013 - DNA, 15 bp, Homo sapiens
agagggctttttaaa

SEQ ID NO: 903014 - DNA, 12 bp, Homo sapiens
agaggggaagaa

SEQ ID NO: 903015 - DNA, 20 bp, Homo sapiens
agaggggaataatagaagaa

SEQ ID NO: 903016 - DNA, 20 bp, Homo sapiens
agaggggacaaaacccacct

SEQ ID NO: 903017 - DNA, 18 bp, Homo sapiens
agaggggactctgggcta

SEQ ID NO: 903018 - DNA, 14 bp, Homo sapiens
agaggggactgggg

SEQ ID NO: 903019 - DNA, 20 bp, Homo sapiens
agaggggagggctcctgggg

SEQ ID NO: 903020 - DNA, 18 bp, Homo sapiens
agaggggaggggcctagg

SEQ ID NO: 903021 - DNA, 14 bp, Homo sapiens
agaggggcagccgc

SEQ ID NO: 903022 - DNA, 21 bp, Homo sapiens
agaggggcctgatgagactcc

SEQ ID NO: 903023 - DNA, 23 bp, Homo sapiens
agaggggcgccttttcagccctt

SEQ ID NO: 903024 - DNA, 15 bp, Homo sapiens
agaggggcgggctca

SEQ ID NO: 903025 - DNA, 17 bp, Homo sapiens
agaggggcgggctcaga

SEQ ID NO: 903026 - DNA, 21 bp, Homo sapiens
agaggggctgaatagcagaag

SEQ ID NO: 903027 - DNA, 22 bp, Homo sapiens
agagggggactgctgctgcctg

SEQ ID NO: 903028 - DNA, 16 bp, Homo sapiens
agagggggagtagcca

SEQ ID NO: 903029 - DNA, 12 bp, Homo sapiens
agagggggcctg

SEQ ID NO: 903030 - DNA, 19 bp, Homo sapiens
agagggggcctgggacttc

SEQ ID NO: 903031 - DNA, 22 bp, Homo sapiens
agagggggcctgggacttccat

SEQ ID NO: 903032 - DNA, 16 bp, Homo sapiens
agaggggtgcacccac

SEQ ID NO: 903033 - DNA, 23 bp, Homo sapiens
agaggggtgcacccactcaccag

SEQ ID NO: 903034 - DNA, 18 bp, Homo sapiens
agaggggtgcagaggctg

SEQ ID NO: 903035 - DNA, 19 bp, Homo sapiens
agaggggtgcagaggctgt

SEQ ID NO: 903036 - DNA, 19 bp, Homo sapiens
agaggggtggagactgctt

SEQ ID NO: 903037 - DNA, 16 bp, Homo sapiens
agagggtcccattgtg

SEQ ID NO: 903038 - DNA, 18 bp, Homo sapiens
agagggtctggagaagca

SEQ ID NO: 903039 - DNA, 22 bp, Homo sapiens
agagggtgtggctttccaggca

SEQ ID NO: 903040 - DNA, 22 bp, Homo sapiens
agaggtaaaagtgtgagcagtg

SEQ ID NO: 903041 - DNA, 17 bp, Homo sapiens
agaggtagcgagctgct

SEQ ID NO: 903042 - DNA, 17 bp, Homo sapiens
agaggtatttatcttta

SEQ ID NO: 903043 - DNA, 16 bp, Homo sapiens
agaggtcaccagctgc

SEQ ID NO: 903044 - DNA, 14 bp, Homo sapiens
agaggtcagactaa

SEQ ID NO: 903045 - DNA, 18 bp, Homo sapiens
agagcagctggctctcca

SEQ ID NO: 903046 - DNA, 21 bp, Homo sapiens
agagcagctttaaactcaggg

SEQ ID NO: 903047 - DNA, 20 bp, Homo sapiens
agagcaggaagcattcagag

SEQ ID NO: 903048 - DNA, 21 bp, Homo sapiens
agagcaggactccaggcccaa

SEQ ID NO: 903049 - DNA, 22 bp, Homo sapiens
agagcaggagcccctggggctg

SEQ ID NO: 903050 - DNA, 11 bp, Homo sapiens
agagcaggagg

SEQ ID NO: 903051 - DNA, 12 bp, Homo sapiens
agagcaggaggc

SEQ ID NO: 903052 - DNA, 13 bp, Homo sapiens
agagcaggaggcc

SEQ ID NO: 903053 - DNA, 20 bp, Homo sapiens
agagcaggaggcccctggcc

SEQ ID NO: 903054 - DNA, 19 bp, Homo sapiens
agagcaggcacatggagga

SEQ ID NO: 903055 - DNA, 21 bp, Homo sapiens
agagcaggcaggggcatctgt

SEQ ID NO: 903056 - DNA, 15 bp, Homo sapiens
agagcaggccaggcg

SEQ ID NO: 903057 - DNA, 13 bp, Homo sapiens
agagcaggctcag

SEQ ID NO: 903058 - DNA, 19 bp, Homo sapiens
agagcaggggagcttggga

SEQ ID NO: 903059 - DNA, 17 bp, Homo sapiens
agagcaggggctccagc

SEQ ID NO: 903060 - DNA, 22 bp, Homo sapiens
agagcaggtgactgtgctgtgc

SEQ ID NO: 903061 - DNA, 14 bp, Homo sapiens
agagcagtgggcag

SEQ ID NO: 903062 - DNA, 21 bp, Homo sapiens
agagcagttggccaagcagaa

SEQ ID NO: 903063 - DNA, 18 bp, Homo sapiens
agagcatacaacagaggg

SEQ ID NO: 903064 - DNA, 19 bp, Homo sapiens
agagcatgatttgaaaaaa

SEQ ID NO: 903065 - DNA, 16 bp, Homo sapiens
agagcattagctggcg

SEQ ID NO: 903066 - DNA, 19 bp, Homo sapiens
agagcattgaattggagag

SEQ ID NO: 903067 - DNA, 15 bp, Homo sapiens
agagccaacctcggc

SEQ ID NO: 903068 - DNA, 21 bp, Homo sapiens
agagccaacctcggcttgtgg

SEQ ID NO: 903069 - DNA, 22 bp, Homo sapiens
agacttggacatctctctggct

SEQ ID NO: 903070 - DNA, 23 bp, Homo sapiens
agacttggacatctctctggctt

SEQ ID NO: 903071 - DNA, 17 bp, Homo sapiens
agacttggcaacagaag

SEQ ID NO: 903072 - DNA, 14 bp, Homo sapiens
agacttggggccag

SEQ ID NO: 903073 - DNA, 18 bp, Homo sapiens
agacttgggttgatctct

SEQ ID NO: 903074 - DNA, 21 bp, Homo sapiens
agacttggttggtagggtggg

SEQ ID NO: 903075 - DNA, 22 bp, Homo sapiens
agacttggttggtagggtggga

SEQ ID NO: 903076 - DNA, 15 bp, Homo sapiens
agacttgttcttggt

SEQ ID NO: 903077 - DNA, 22 bp, Homo sapiens
agactttaatcactgctgaaga

SEQ ID NO: 903078 - DNA, 18 bp, Homo sapiens
agactttagcttttcctt

SEQ ID NO: 903079 - DNA, 19 bp, Homo sapiens
agactttccattaaatcaa

SEQ ID NO: 903080 - DNA, 14 bp, Homo sapiens
agactttctcagtg

SEQ ID NO: 903081 - DNA, 17 bp, Homo sapiens
agactttctgaaaacac

SEQ ID NO: 903082 - DNA, 12 bp, Homo sapiens
agactttcttct

SEQ ID NO: 903083 - DNA, 17 bp, Homo sapiens
agactttgatccttgga

SEQ ID NO: 903084 - DNA, 18 bp, Homo sapiens
agactttgatccttggaa

SEQ ID NO: 903085 - DNA, 17 bp, Homo sapiens
agactttgctgcatttt

SEQ ID NO: 903086 - DNA, 18 bp, Homo sapiens
agactttgtttttaaaat

SEQ ID NO: 903087 - DNA, 21 bp, Homo sapiens
agacttttatgtgagatttcc

SEQ ID NO: 903088 - DNA, 23 bp, Homo sapiens
agacttttatgtgagatttcctt

SEQ ID NO: 903089 - DNA, 16 bp, Homo sapiens
agacttttcagaagat

SEQ ID NO: 903090 - DNA, 23 bp, Homo sapiens
agacttttgcttaccttttccta

SEQ ID NO: 903091 - DNA, 16 bp, Homo sapiens
agagaaaaaaaaaata

SEQ ID NO: 903092 - DNA, 13 bp, Homo sapiens
agagaaaaaagaa

SEQ ID NO: 903093 - DNA, 14 bp, Homo sapiens
agagaaaaaagcca

SEQ ID NO: 903094 - DNA, 20 bp, Homo sapiens
agagaaaaagcagaggccaa

SEQ ID NO: 903095 - DNA, 13 bp, Homo sapiens
agagaaaagaaaa

SEQ ID NO: 903096 - DNA, 15 bp, Homo sapiens
agagaaaagaaaaaa

SEQ ID NO: 903097 - DNA, 12 bp, Homo sapiens
agagaaaataaa

SEQ ID NO: 903098 - DNA, 15 bp, Homo sapiens
agagaaaatatatgt

SEQ ID NO: 903099 - DNA, 16 bp, Homo sapiens
agagaaaatatatgta

SEQ ID NO: 903100 - DNA, 14 bp, Homo sapiens
agagaaaatgaatt

SEQ ID NO: 903101 - DNA, 16 bp, Homo sapiens
agagaaaatgaatttg

SEQ ID NO: 903102 - DNA, 22 bp, Homo sapiens
agagaaacactgaaaagaagga

SEQ ID NO: 903103 - DNA, 22 bp, Homo sapiens
agagaggcagaagaaccctggc

SEQ ID NO: 903104 - DNA, 15 bp, Homo sapiens
agagaggcagcaagt

SEQ ID NO: 903105 - DNA, 13 bp, Homo sapiens
agagaggcctgct

SEQ ID NO: 903106 - DNA, 20 bp, Homo sapiens
agagaggcgcgtctgcccca

SEQ ID NO: 903107 - DNA, 16 bp, Homo sapiens
agagaggcgggcccca

SEQ ID NO: 903108 - DNA, 19 bp, Homo sapiens
agagaggctcaacaaggaa

SEQ ID NO: 903109 - DNA, 18 bp, Homo sapiens
agagagggacacatgccc

SEQ ID NO: 903110 - DNA, 19 bp, Homo sapiens
agagagggacacatgcccc

SEQ ID NO: 903111 - DNA, 23 bp, Homo sapiens
agagagggacacatgcccctccc

SEQ ID NO: 903112 - DNA, 22 bp, Homo sapiens
agagagggagaaacaagtggac

SEQ ID NO: 903113 - DNA, 16 bp, Homo sapiens
agagagggagaagaag

SEQ ID NO: 903114 - DNA, 19 bp, Homo sapiens
agagagggagaagaagtca

SEQ ID NO: 903115 - DNA, 12 bp, Homo sapiens
agagagggccca

SEQ ID NO: 903116 - DNA, 13 bp, Homo sapiens
agagagggcccag

SEQ ID NO: 903117 - DNA, 15 bp, Homo sapiens
agagagggctttaat

SEQ ID NO: 903118 - DNA, 16 bp, Homo sapiens
agagaggggaagaatt

SEQ ID NO: 903119 - DNA, 14 bp, Homo sapiens
agagaggggaagag

SEQ ID NO: 903120 - DNA, 22 bp, Homo sapiens
agagaggggaataatagaagaa

SEQ ID NO: 903121 - DNA, 15 bp, Homo sapiens
agagagggggctctc

SEQ ID NO: 903122 - DNA, 22 bp, Homo sapiens
agagaggtttttcttgggaaag

SEQ ID NO: 903123 - DNA, 14 bp, Homo sapiens
agagagtataaata

SEQ ID NO: 903124 - DNA, 14 bp, Homo sapiens
agagagtggctcct

SEQ ID NO: 903125 - DNA, 15 bp, Homo sapiens
agagagttagcatgt

SEQ ID NO: 903126 - DNA, 13 bp, Homo sapiens
agagagtttcaaa

SEQ ID NO: 903127 - DNA, 13 bp, Homo sapiens
agagagtttgtaa

SEQ ID NO: 903128 - DNA, 15 bp, Homo sapiens
agagatagcttctct

SEQ ID NO: 903129 - DNA, 16 bp, Homo sapiens
agagatagcttctctt

SEQ ID NO: 903130 - DNA, 15 bp, Homo sapiens
agagatagttctaaa

SEQ ID NO: 903131 - DNA, 20 bp, Homo sapiens
agagatatgtagaaggcaca

SEQ ID NO: 903132 - DNA, 16 bp, Homo sapiens
agagatattgatattg

SEQ ID NO: 903133 - DNA, 18 bp, Homo sapiens
agagatattttaaaatga

SEQ ID NO: 903134 - DNA, 13 bp, Homo sapiens
agagatattttgt

SEQ ID NO: 903135 - DNA, 14 bp, Homo sapiens
agagatattttgta

SEQ ID NO: 903136 - DNA, 16 bp, Homo sapiens
agagatattttgtaaa

SEQ ID NO: 903137 - DNA, 20 bp, Homo sapiens
agagatcacccactcctatg

SEQ ID NO: 903138 - DNA, 23 bp, Homo sapiens
agagatcgagaccatcctggcca

SEQ ID NO: 903139 - DNA, 15 bp, Homo sapiens
agagatctgggcatt

SEQ ID NO: 903140 - DNA, 15 bp, Homo sapiens
agagatgaaataatt

SEQ ID NO: 903141 - DNA, 16 bp, Homo sapiens
agagatgcatgcgcag

SEQ ID NO: 903142 - DNA, 16 bp, Homo sapiens
agagatgcctccaccg

SEQ ID NO: 903143 - DNA, 21 bp, Homo sapiens
agagatgctgtaacttaaaat

SEQ ID NO: 903144 - DNA, 15 bp, Homo sapiens
agagatgtactgcaa

SEQ ID NO: 903145 - DNA, 23 bp, Homo sapiens
agagatgtccatttttacaagtt

SEQ ID NO: 903146 - DNA, 19 bp, Homo sapiens
agagatgtggcaaagtgct

SEQ ID NO: 903147 - DNA, 16 bp, Homo sapiens
agagatgtttacagta

SEQ ID NO: 903148 - DNA, 23 bp, Homo sapiens
agagatgtttacagtatgatgaa

SEQ ID NO: 903149 - DNA, 12 bp, Homo sapiens
agagatgttttt

SEQ ID NO: 903150 - DNA, 20 bp, Homo sapiens
agagatgtttttaaaagttt

SEQ ID NO: 903151 - DNA, 19 bp, Homo sapiens
agagattacctcctgagaa

SEQ ID NO: 903152 - DNA, 13 bp, Homo sapiens
agagattcttcta

SEQ ID NO: 903153 - DNA, 19 bp, Homo sapiens
agagattgccccagagccc

SEQ ID NO: 903154 - DNA, 14 bp, Homo sapiens
agagattgggagaa

SEQ ID NO: 903155 - DNA, 13 bp, Homo sapiens
agagatttatctt

SEQ ID NO: 903156 - DNA, 16 bp, Homo sapiens
agagcaaaagggagga

SEQ ID NO: 903157 - DNA, 15 bp, Homo sapiens
agagcaaagcgccca

SEQ ID NO: 903158 - DNA, 14 bp, Homo sapiens
agagcaaaggagac

SEQ ID NO: 903159 - DNA, 22 bp, Homo sapiens
agagcaaaggagacaaagcagg

SEQ ID NO: 903160 - DNA, 15 bp, Homo sapiens
agagcaaaggcccat

SEQ ID NO: 903161 - DNA, 16 bp, Homo sapiens
agagcaaaggcccatg

SEQ ID NO: 903162 - DNA, 16 bp, Homo sapiens
agagcaaatgagggag

SEQ ID NO: 903163 - DNA, 17 bp, Homo sapiens
agagcaacctctcactc

SEQ ID NO: 903164 - DNA, 18 bp, Homo sapiens
agagcaacctctgtatta

SEQ ID NO: 903165 - DNA, 14 bp, Homo sapiens
agagcaagactctg

SEQ ID NO: 903166 - DNA, 17 bp, Homo sapiens
agagcaataacactata

SEQ ID NO: 903167 - DNA, 19 bp, Homo sapiens
agagcaataacactatatt

SEQ ID NO: 903168 - DNA, 21 bp, Homo sapiens
agagcaatgcccgtaatgctt

SEQ ID NO: 903169 - DNA, 18 bp, Homo sapiens
agagcacaaacttcagaa

SEQ ID NO: 903170 - DNA, 23 bp, Homo sapiens
agagcacacttatttatgaattg

SEQ ID NO: 903171 - DNA, 14 bp, Homo sapiens
agagcacagagccc

SEQ ID NO: 903172 - DNA, 13 bp, Homo sapiens
agagcacagccca

SEQ ID NO: 903173 - DNA, 17 bp, Homo sapiens
agagcacagcccacggg

SEQ ID NO: 903174 - DNA, 14 bp, Homo sapiens
agagcacagcttct

SEQ ID NO: 903175 - DNA, 18 bp, Homo sapiens
agagcacagcttcttctg

SEQ ID NO: 903176 - DNA, 23 bp, Homo sapiens
agagcacccccaagcctgggctt

SEQ ID NO: 903177 - DNA, 18 bp, Homo sapiens
agagcacctagtccagtg

SEQ ID NO: 903178 - DNA, 16 bp, Homo sapiens
agagcaccttgcagtt

SEQ ID NO: 903179 - DNA, 20 bp, Homo sapiens
agagcacctttgcacaggat

SEQ ID NO: 903180 - DNA, 15 bp, Homo sapiens
agagcactagaagtg

SEQ ID NO: 903181 - DNA, 18 bp, Homo sapiens
agagcactgcctctatgc

SEQ ID NO: 903182 - DNA, 20 bp, Homo sapiens
agagcactgcctctatgccc

SEQ ID NO: 903183 - DNA, 20 bp, Homo sapiens
agagcactgggttgcagggg

SEQ ID NO: 903184 - DNA, 20 bp, Homo sapiens
agagcagaacggagccccag

SEQ ID NO: 903185 - DNA, 16 bp, Homo sapiens
agagcagagcctacag

SEQ ID NO: 903186 - DNA, 15 bp, Homo sapiens
agagcagcagcacca

SEQ ID NO: 903187 - DNA, 16 bp, Homo sapiens
agagcagcagcaccaa

SEQ ID NO: 903188 - DNA, 15 bp, Homo sapiens
agagcagcagcacct

SEQ ID NO: 903189 - DNA, 16 bp, Homo sapiens
agagcagcaggtgctg

SEQ ID NO: 903190 - DNA, 14 bp, Homo sapiens
agagcagcctcgtg

SEQ ID NO: 903191 - DNA, 11 bp, Homo sapiens
agagcagcctg

SEQ ID NO: 903192 - DNA, 18 bp, Homo sapiens
agagcagcctgatggcca

SEQ ID NO: 903193 - DNA, 19 bp, Homo sapiens
agagcagcctgatggccaa

SEQ ID NO: 903194 - DNA, 21 bp, Homo sapiens
agagcagcgcccaggcctgct

SEQ ID NO: 903195 - DNA, 18 bp, Homo sapiens
agagcagctaactccgag

SEQ ID NO: 903196 - DNA, 19 bp, Homo sapiens
agagcagctccctttctca

SEQ ID NO: 903197 - DNA, 21 bp, Homo sapiens
agagcagctccctttctcagg

SEQ ID NO: 903198 - DNA, 12 bp, Homo sapiens
agagcagctggc

SEQ ID NO: 903199 - DNA, 21 bp, Homo sapiens
agaccgcttcacccctgcact

SEQ ID NO: 903200 - DNA, 16 bp, Homo sapiens
agaccgggcccccctg

SEQ ID NO: 903201 - DNA, 17 bp, Homo sapiens
agaccgggccctgggtt

SEQ ID NO: 903202 - DNA, 15 bp, Homo sapiens
agaccgtacaaactc

SEQ ID NO: 903203 - DNA, 15 bp, Homo sapiens
agacctacattccct

SEQ ID NO: 903204 - DNA, 23 bp, Homo sapiens
agacctacattccctctcctgcc

SEQ ID NO: 903205 - DNA, 18 bp, Homo sapiens
agacctagcaggctgttc

SEQ ID NO: 903206 - DNA, 20 bp, Homo sapiens
agacctagcaggctgttcca

SEQ ID NO: 903207 - DNA, 18 bp, Homo sapiens
agacctagctatgttggc

SEQ ID NO: 903208 - DNA, 14 bp, Homo sapiens
agacctagggagga

SEQ ID NO: 903209 - DNA, 19 bp, Homo sapiens
agacctagggaggacctta

SEQ ID NO: 903210 - DNA, 17 bp, Homo sapiens
agacctcactgtcaggg

SEQ ID NO: 903211 - DNA, 11 bp, Homo sapiens
agacctcagcc

SEQ ID NO: 903212 - DNA, 14 bp, Homo sapiens
agacctcagccatg

SEQ ID NO: 903213 - DNA, 12 bp, Homo sapiens
agacctcagcct

SEQ ID NO: 903214 - DNA, 16 bp, Homo sapiens
agacctcagcctgtgc

SEQ ID NO: 903215 - DNA, 15 bp, Homo sapiens
agacctcatcaggat

SEQ ID NO: 903216 - DNA, 17 bp, Homo sapiens
agacctcatcaggatga

SEQ ID NO: 903217 - DNA, 13 bp, Homo sapiens
agacctcatcctg

SEQ ID NO: 903218 - DNA, 13 bp, Homo sapiens
agacctcatgccc

SEQ ID NO: 903219 - DNA, 15 bp, Homo sapiens
agacctcatgcccag

SEQ ID NO: 903220 - DNA, 22 bp, Homo sapiens
agacctcatgcccagctctctg

SEQ ID NO: 903221 - DNA, 23 bp, Homo sapiens
agacctcatgcccagctctctga

SEQ ID NO: 903222 - DNA, 16 bp, Homo sapiens
agacctccccctcact

SEQ ID NO: 903223 - DNA, 13 bp, Homo sapiens
agacctctgccta

SEQ ID NO: 903224 - DNA, 20 bp, Homo sapiens
agacctctggttaatttata

SEQ ID NO: 903225 - DNA, 19 bp, Homo sapiens
agacctcttctaagaggat

SEQ ID NO: 903226 - DNA, 15 bp, Homo sapiens
agacctgaattcttt

SEQ ID NO: 903227 - DNA, 19 bp, Homo sapiens
agacctgacaagcactgct

SEQ ID NO: 903228 - DNA, 23 bp, Homo sapiens
agacctgacaccgtccctcagtg

SEQ ID NO: 903229 - DNA, 22 bp, Homo sapiens
agacctgcagtgaggggccctc

SEQ ID NO: 903230 - DNA, 13 bp, Homo sapiens
agacctgcatttg

SEQ ID NO: 903231 - DNA, 14 bp, Homo sapiens
agacctggaaccag

SEQ ID NO: 903232 - DNA, 16 bp, Homo sapiens
agacctggagcccctg

SEQ ID NO: 903233 - DNA, 22 bp, Homo sapiens
agacctggagcccctgggtggg

SEQ ID NO: 903234 - DNA, 12 bp, Homo sapiens
agacctggcctt

SEQ ID NO: 903235 - DNA, 17 bp, Homo sapiens
agacctggtgtgcggag

SEQ ID NO: 903236 - DNA, 14 bp, Homo sapiens
agacctgtcttcca

SEQ ID NO: 903237 - DNA, 15 bp, Homo sapiens
agacctgtcttccaa

SEQ ID NO: 903238 - DNA, 23 bp, Homo sapiens
agacctgtcttccaaggagacca

SEQ ID NO: 903239 - DNA, 17 bp, Homo sapiens
agacctgttggcctgtg

SEQ ID NO: 903240 - DNA, 21 bp, Homo sapiens
agacctgttggcctgtgggcc

SEQ ID NO: 903241 - DNA, 23 bp, Homo sapiens
agacctgttggtataggaatgta

SEQ ID NO: 903242 - DNA, 18 bp, Homo sapiens
agaccttaagacactgtg

SEQ ID NO: 903243 - DNA, 17 bp, Homo sapiens
agaccttactcagggga

SEQ ID NO: 903244 - DNA, 23 bp, Homo sapiens
agaccttccataatgctactgtc

SEQ ID NO: 903245 - DNA, 18 bp, Homo sapiens
agaccttctccaaatgag

SEQ ID NO: 903246 - DNA, 19 bp, Homo sapiens
agaccttctccaaatgaga

SEQ ID NO: 903247 - DNA, 17 bp, Homo sapiens
agaccttgagggtgggc

SEQ ID NO: 903248 - DNA, 19 bp, Homo sapiens
agaccttgagggtgggcca

SEQ ID NO: 903249 - DNA, 21 bp, Homo sapiens
agaccttgttacttctgaggt

SEQ ID NO: 903250 - DNA, 12 bp, Homo sapiens
agacctttactg

SEQ ID NO: 903251 - DNA, 18 bp, Homo sapiens
agacctttatttttctat

SEQ ID NO: 903252 - DNA, 22 bp, Homo sapiens
agacctttgatgaattcttcct

SEQ ID NO: 903253 - DNA, 12 bp, Homo sapiens
agaccttttcaa

SEQ ID NO: 903254 - DNA, 16 bp, Homo sapiens
agaccttttttaggaa

SEQ ID NO: 903255 - DNA, 20 bp, Homo sapiens
agaccttttttttttttcca

SEQ ID NO: 903256 - DNA, 18 bp, Homo sapiens
agacgagatcctgtttca

SEQ ID NO: 903257 - DNA, 13 bp, Homo sapiens
agacgatatactc

SEQ ID NO: 903258 - DNA, 17 bp, Homo sapiens
agacgatttgtcagtta

SEQ ID NO: 903259 - DNA, 22 bp, Homo sapiens
agacgcatagactgaggtataa

SEQ ID NO: 903260 - DNA, 18 bp, Homo sapiens
agacgccactccctggga

SEQ ID NO: 903261 - DNA, 15 bp, Homo sapiens
agacgcctgagctca

SEQ ID NO: 903262 - DNA, 13 bp, Homo sapiens
agacgcctgagga

SEQ ID NO: 903263 - DNA, 16 bp, Homo sapiens
agacgctgccgctgcc

SEQ ID NO: 903264 - DNA, 13 bp, Homo sapiens
agacggatggcag

SEQ ID NO: 903265 - DNA, 14 bp, Homo sapiens
agacggatggcagg

SEQ ID NO: 903266 - DNA, 13 bp, Homo sapiens
agacggccctgct

SEQ ID NO: 903267 - DNA, 23 bp, Homo sapiens
agacggccggccggacctctgag

SEQ ID NO: 903268 - DNA, 19 bp, Homo sapiens
agacggcctaggggtggcg

SEQ ID NO: 903269 - DNA, 23 bp, Homo sapiens
agacggcctaggggtggcgctca

SEQ ID NO: 903270 - DNA, 22 bp, Homo sapiens
agacgggaatgcctaggtccct

SEQ ID NO: 903271 - DNA, 19 bp, Homo sapiens
agacggggtttcaccatgt

SEQ ID NO: 903272 - DNA, 13 bp, Homo sapiens
agacggtctgtgt

SEQ ID NO: 903273 - DNA, 16 bp, Homo sapiens
agacgtaaagaatttt

SEQ ID NO: 903274 - DNA, 17 bp, Homo sapiens
agacgtcaggccctgac

SEQ ID NO: 903275 - DNA, 18 bp, Homo sapiens
agacgtggaacctctgtc

SEQ ID NO: 903276 - DNA, 20 bp, Homo sapiens
agacgtggaacctctgtctc

SEQ ID NO: 903277 - DNA, 14 bp, Homo sapiens
agacgtggactcct

SEQ ID NO: 903278 - DNA, 14 bp, Homo sapiens
agacgtgtttgtgt

SEQ ID NO: 903279 - DNA, 16 bp, Homo sapiens
agacgttttctttatc

SEQ ID NO: 903280 - DNA, 21 bp, Homo sapiens
agacgtttttgtgctgtgggc

SEQ ID NO: 903281 - DNA, 19 bp, Homo sapiens
agactaaaggatccagaga

SEQ ID NO: 903282 - DNA, 17 bp, Homo sapiens
agactaagaaatattcc

SEQ ID NO: 903283 - DNA, 19 bp, Homo sapiens
agactaagaaatattccaa

SEQ ID NO: 903284 - DNA, 23 bp, Homo sapiens
agactaagccctgtcgagacact

SEQ ID NO: 903285 - DNA, 14 bp, Homo sapiens
agactaatttaaaa

SEQ ID NO: 903286 - DNA, 15 bp, Homo sapiens
agactaatttaaaaa

SEQ ID NO: 903287 - DNA, 14 bp, Homo sapiens
agactagaattcta

SEQ ID NO: 903288 - DNA, 17 bp, Homo sapiens
agactagaattctagtg

SEQ ID NO: 903289 - DNA, 23 bp, Homo sapiens
agactagaattctagtgctgctg

SEQ ID NO: 903290 - DNA, 21 bp, Homo sapiens
agactagagtctgagatgccc

SEQ ID NO: 903291 - DNA, 13 bp, Homo sapiens
agactagatgtag

SEQ ID NO: 903292 - DNA, 14 bp, Homo sapiens
agactagatgtagt

SEQ ID NO: 903293 - DNA, 23 bp, Homo sapiens
agactagatgtagtattttttgt

SEQ ID NO: 903294 - DNA, 17 bp, Homo sapiens
agactagcaatctcttc

SEQ ID NO: 903295 - DNA, 17 bp, Homo sapiens
agactagggctgcaagt

SEQ ID NO: 903296 - DNA, 21 bp, Homo sapiens
agactagtgccgtagggagta

SEQ ID NO: 903297 - DNA, 21 bp, Homo sapiens
agactagttctcttgtcctgt

SEQ ID NO: 903298 - DNA, 24 bp, Homo sapiens
agactagttctcttgtcctgtgat

SEQ ID NO: 903299 - DNA, 13 bp, Homo sapiens
agactataaataa

SEQ ID NO: 903300 - DNA, 19 bp, Homo sapiens
agactatctaaatgttgaa

SEQ ID NO: 903301 - DNA, 17 bp, Homo sapiens
agactatttcaaaatgt

SEQ ID NO: 903302 - DNA, 20 bp, Homo sapiens
agactattttctattttccc

SEQ ID NO: 903303 - DNA, 18 bp, Homo sapiens
agactcaaaacctggaga
